United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 4

SEQ ID NO: 115360 - RNA, 22 nt, Human
aaauauagugacacuuauaguc

SEQ ID NO: 115361 - RNA, 22 nt, Human
aaaucuuccugaaauuuguuca

SEQ ID NO: 115362 - RNA, 22 nt, Human
aaaucugaauuaaaaucugguu

SEQ ID NO: 115363 - RNA, 22 nt, Human
aaauauugaauuugaggaugua

SEQ ID NO: 115364 - RNA, 22 nt, Human
aaauauuagacauaccuggaga

SEQ ID NO: 115365 - RNA, 22 nt, Human
aaauauuaaugaugaagguagu

SEQ ID NO: 115366 - RNA, 22 nt, Human
aaaucauguuaaagagggaguu

SEQ ID NO: 115367 - RNA, 22 nt, Human
aaaucaaaagugguuauuuuau

SEQ ID NO: 115368 - RNA, 22 nt, Human
aaaugcuuuaauugaguucaug

SEQ ID NO: 115369 - RNA, 22 nt, Human
aaauuagucacaccagugucuu

SEQ ID NO: 115370 - RNA, 20 nt, Human
aaauccuugggaguggugca

SEQ ID NO: 115371 - RNA, 22 nt, Human
aaauccaucaaaucuucuagaa

SEQ ID NO: 115372 - RNA, 22 nt, Human
aaaucuuucacauauuuuuuau

SEQ ID NO: 115373 - RNA, 22 nt, Human
aaauuaacuaucacuuuuguga

SEQ ID NO: 115374 - RNA, 22 nt, Human
aaauuaaaguuuuauuuagagc

SEQ ID NO: 115375 - RNA, 22 nt, Human
aaauuaggcccugauuuuaugu

SEQ ID NO: 115376 - RNA, 22 nt, Human
aaauguauuagccuaugugaga

SEQ ID NO: 115377 - RNA, 22 nt, Human
aaaugucugagacuucugaacu

SEQ ID NO: 115378 - RNA, 22 nt, Human
aaauugcauuuuaaagguagau

SEQ ID NO: 115379 - RNA, 20 nt, Human
aacagcucucgacuuaucuu

SEQ ID NO: 115380 - RNA, 22 nt, Human
aacaaagaacuuucuuccuuug

SEQ ID NO: 115381 - RNA, 22 nt, Human
aacagaauaucaaaagauuaug

SEQ ID NO: 115382 - RNA, 22 nt, Human
aacaaagaaaagcuugagguuu

SEQ ID NO: 115383 - RNA, 22 nt, Human
aacaaaacauuuuacgaauaua

SEQ ID NO: 115384 - RNA, 22 nt, Human
aacauuuauguuuugaccaagu

SEQ ID NO: 115385 - RNA, 22 nt, Human
aacauuguuuaaguuaaauugu

SEQ ID NO: 115386 - RNA, 22 nt, Human
aacaaccuaguaguaucuuuca

SEQ ID NO: 115387 - RNA, 22 nt, Human
aacacguuuauccuaagaacuc

SEQ ID NO: 115388 - RNA, 19 nt, Human
aacaaaauaguucuaguua

SEQ ID NO: 115389 - RNA, 22 nt, Human
aacaggaagaauccagauggug

SEQ ID NO: 115390 - RNA, 22 nt, Human
aaauauuugaaugguguaagau

SEQ ID NO: 115391 - RNA, 22 nt, Human
aaagucugaaaaaguuuguggg

SEQ ID NO: 115392 - RNA, 22 nt, Human
aaaguagaugagaauuuuguug

SEQ ID NO: 115393 - RNA, 21 nt, Human
aaagugguaaggauuauuuug

SEQ ID NO: 115394 - RNA, 22 nt, Human
aaaguguaagucccugguuguc

SEQ ID NO: 115395 - RNA, 22 nt, Human
aaauauauauaauauauauauu

SEQ ID NO: 115396 - RNA, 22 nt, Human
aaaguuacacgacuauuuaugu

SEQ ID NO: 115397 - RNA, 22 nt, Human
aaaguguuuaacaaauugcuuu

SEQ ID NO: 115398 - RNA, 22 nt, Human
aaaucccacucacgaguuuugc

SEQ ID NO: 115399 - RNA, 22 nt, Human
aaaucugaaggaaacagcuuca

SEQ ID NO: 115400 - RNA, 22 nt, Human
aaaucauagccaugaacauuug

SEQ ID NO: 115401 - RNA, 21 nt, Human
aaauccagugaucuccucuaa

SEQ ID NO: 115402 - RNA, 23 nt, Human
aaauaauaauuucucuguuggga

SEQ ID NO: 115403 - RNA, 22 nt, Human
aaaucaagucagcugaauucca

SEQ ID NO: 115404 - RNA, 22 nt, Human
aaauagauuugacuacuuggug

SEQ ID NO: 115405 - RNA, 22 nt, Human
aaauaggaguagugauguauua

SEQ ID NO: 115406 - RNA, 22 nt, Human
aaaguagaauaauaaacccuug

SEQ ID NO: 115407 - RNA, 22 nt, Human
aaaguuacccaaucucuaugaa

SEQ ID NO: 115408 - RNA, 23 nt, Human
aaaguacuuaaucugcaaaccac

SEQ ID NO: 115409 - RNA, 22 nt, Human
aaaguuaauucuuguuuuuuau

SEQ ID NO: 115410 - RNA, 22 nt, Human
aaagcaaauaguugcuuaauau

SEQ ID NO: 115411 - RNA, 22 nt, Human
aaagcagguugcaauuacagug

SEQ ID NO: 115412 - RNA, 22 nt, Human
aaagccaagucugauuuuguug

SEQ ID NO: 115413 - RNA, 22 nt, Human
aaagccauaucuauucuauucu

SEQ ID NO: 115414 - RNA, 20 nt, Human
aaagauacuuuuuguaaugg

SEQ ID NO: 115415 - RNA, 22 nt, Human
aaagaugucauacacauuaaga

SEQ ID NO: 115416 - RNA, 22 nt, Human
aaaguaaagccuauuuaauaau

SEQ ID NO: 115417 - RNA, 22 nt, Human
aaaggcaugugcaacuacaaau

SEQ ID NO: 115418 - RNA, 22 nt, Human
aaagccagggacagugugcaug

SEQ ID NO: 115419 - RNA, 22 nt, Human
aaagccaagguccauguacuuu

SEQ ID NO: 115420 - RNA, 22 nt, Human
aaaggaaacuaugaaucucugg

SEQ ID NO: 115421 - RNA, 22 nt, Human
aaagaagugucuuacucccucu

SEQ ID NO: 115422 - RNA, 21 nt, Human
aaagaagagcucagagguaga

SEQ ID NO: 115423 - RNA, 22 nt, Human
aaagaguuaagagucuuaagcu

SEQ ID NO: 115424 - RNA, 22 nt, Human
aaagacaauaauucucucuagc

SEQ ID NO: 115425 - RNA, 22 nt, Human
aaacgcaauuucuugcauguca

SEQ ID NO: 115426 - RNA, 22 nt, Human
aaacuuuugaaggaggaaaaag

SEQ ID NO: 115427 - RNA, 22 nt, Human
aaagaguuguauucuuuuugag

SEQ ID NO: 115428 - RNA, 22 nt, Human
aaagaggacgugcuauuuuuua

SEQ ID NO: 115429 - RNA, 22 nt, Human
aaagcagucuguuuuaaccuga

SEQ ID NO: 115430 - RNA, 22 nt, Human
aaagcauucuaaccgaucgacg

SEQ ID NO: 115431 - RNA, 22 nt, Human
aaagagugugcauguaccugug

SEQ ID NO: 115432 - RNA, 23 nt, Human
aaagaggugaauccaggacaagc

SEQ ID NO: 115433 - RNA, 22 nt, Human
aaagaugaaguucagcgaagaa

SEQ ID NO: 115434 - RNA, 22 nt, Human
aaagaauuucaagauucccaca

SEQ ID NO: 115435 - RNA, 22 nt, Human
aaagcaaagaucuguagcccaa

SEQ ID NO: 115436 - RNA, 17 nt, Human
aaaaucaaaggaggugc

SEQ ID NO: 115437 - RNA, 22 nt, Human
aaaauauuuaucuagcucuuaa

SEQ ID NO: 115438 - RNA, 22 nt, Human
aaaagguauuuagcgauugcau

SEQ ID NO: 115439 - RNA, 22 nt, Human
aaaagguuauagcuuugccuug

SEQ ID NO: 115440 - RNA, 22 nt, Human
aaaaguauaagugucuccugau

SEQ ID NO: 115441 - RNA, 22 nt, Human
aaaauauucuauaucaaagaua

SEQ ID NO: 115442 - RNA, 22 nt, Human
aaaaugggaaaauuuuagauua

SEQ ID NO: 115443 - RNA, 22 nt, Human
aaacuagaacagagagagaagc

SEQ ID NO: 115444 - RNA, 23 nt, Human
aaacuacauuuauaguuuuucuc

SEQ ID NO: 115445 - RNA, 22 nt, Human
aaacagguuugaacuucuuaac

SEQ ID NO: 115446 - RNA, 22 nt, Human
aaaaucucagaaaaguuuaggu

SEQ ID NO: 115447 - RNA, 18 nt, Human
aaacccacguauucaggc

SEQ ID NO: 115448 - RNA, 22 nt, Human
aaaauuuccuuggaccauuuuu

SEQ ID NO: 115449 - RNA, 22 nt, Human
aaacaaauccaauaauaaaauu

SEQ ID NO: 115450 - RNA, 22 nt, Human
aaacaagagcuuacauggcugc

SEQ ID NO: 115451 - RNA, 22 nt, Human
aaacaauaauaauuaggaagga

SEQ ID NO: 115452 - RNA, 22 nt, Human
aaaaggacaguagccuugaggu

SEQ ID NO: 115453 - RNA, 22 nt, Human
aaaaggauauuuggugcaaagc

SEQ ID NO: 115454 - RNA, 22 nt, Human
aaaaggucacuguaaaaugacg

SEQ ID NO: 115455 - RNA, 22 nt, Human
aaaauaaccuucauuugcauug

SEQ ID NO: 115456 - RNA, 22 nt, Human
aaaaguuguaauauuuccuuua

SEQ ID NO: 115457 - RNA, 22 nt, Human
aaaaccugcaagaugaaaucag

SEQ ID NO: 115458 - RNA, 22 nt, Human
aaaagaaugaugggagcugggu

SEQ ID NO: 115459 - RNA, 22 nt, Human
auuuuuuuuccugucucuuuca

SEQ ID NO: 115460 - RNA, 22 nt, Human
auacauauaugcacauuaauau

SEQ ID NO: 115461 - RNA, 22 nt, Human
auauucaaugaggucauauaag

SEQ ID NO: 115462 - RNA, 22 nt, Human
uggaaaauuuagaaagauuuau

SEQ ID NO: 115463 - RNA, 22 nt, Human
aggcaguguguagcuggaagag

SEQ ID NO: 115464 - RNA, 22 nt, Human
uuuucaauuuucauuugcaaga

SEQ ID NO: 115465 - RNA, 22 nt, Human
ugugugcuaguuuugucaguau

SEQ ID NO: 115466 - RNA, 17 nt, Human
ucuuuuacuuucucucc

SEQ ID NO: 115467 - RNA, 17 nt, Human
ccacuagauagguugug

SEQ ID NO: 115468 - RNA, 22 nt, Human
uuuuucuccucucucuuucauu

SEQ ID NO: 115469 - RNA, 22 nt, Human
aaaauauucuauaucaaagaua

SEQ ID NO: 115470 - RNA, 22 nt, Human
aagugugugugcgcaugugcau

SEQ ID NO: 115471 - RNA, 22 nt, Human
uguuuucuuuccccuucuuuuc

SEQ ID NO: 115472 - RNA, 22 nt, Human
uguacauacauagauauacaca

SEQ ID NO: 115473 - RNA, 22 nt, Human
aaugcuuuuugcgaaaugugca

SEQ ID NO: 115474 - RNA, 22 nt, Human
aacugcauaagcuucgggaccu

SEQ ID NO: 115475 - RNA, 22 nt, Human
uugaaaauuaauagguguacaa

SEQ ID NO: 115476 - RNA, 22 nt, Human
auguuccaugacuaugcaugaa

SEQ ID NO: 115477 - RNA, 22 nt, Human
aggcauauaguguuuaaaaaaa

SEQ ID NO: 115478 - RNA, 22 nt, Human
aagaggcuacagcccugugucu

SEQ ID NO: 115479 - RNA, 22 nt, Human
uuuuauuuguauguugaaugua

SEQ ID NO: 115480 - RNA, 22 nt, Human
ucgagcucagcagggaggugcg

SEQ ID NO: 115481 - RNA, 19 nt, Human
augaaauagcauuuucuga

SEQ ID NO: 115482 - RNA, 22 nt, Human
auuucacucuuaauugcuuccu

SEQ ID NO: 115483 - RNA, 22 nt, Human
gcuucuguuaggauguggcuua

SEQ ID NO: 115484 - RNA, 22 nt, Human
uuuugcuucuaguauauuuuuu

SEQ ID NO: 115485 - RNA, 22 nt, Human
agcaaaauuccaaaaugcuaau

SEQ ID NO: 115486 - RNA, 22 nt, Human
aguuauuuuucacuauuaggcu

SEQ ID NO: 115487 - RNA, 22 nt, Human
uauauaauacacaaauauguac

SEQ ID NO: 115488 - RNA, 22 nt, Human
aaauucuuccaggaggaaauac

SEQ ID NO: 115489 - RNA, 22 nt, Human
uguccuuuauauguuuuuuagu

SEQ ID NO: 115490 - RNA, 23 nt, Human
cagagaaaauagaauaugcugug

SEQ ID NO: 115491 - RNA, 19 nt, Human
agugaacuccauaucaggu

SEQ ID NO: 115492 - RNA, 22 nt, Human
auuuucuugucucuguuguagg

SEQ ID NO: 115493 - RNA, 22 nt, Human
agagauacugcaggccauaaau

SEQ ID NO: 115494 - RNA, 22 nt, Human
uuucuggacuaaagggagagau

SEQ ID NO: 115495 - RNA, 22 nt, Human
uccaugaguuuuuuaguuucac

SEQ ID NO: 115496 - RNA, 22 nt, Human
uuauuuuuguuuguuaagccua

SEQ ID NO: 115497 - RNA, 22 nt, Human
auacaucuuaacgcgcucuugg

SEQ ID NO: 115498 - RNA, 22 nt, Human
uuuuuaaaagaugauuuaauga

SEQ ID NO: 115499 - RNA, 22 nt, Human
uucaaaaugcagaauaguuugg

SEQ ID NO: 115500 - RNA, 22 nt, Human
aaauauagugacacuuauaguc

SEQ ID NO: 115501 - RNA, 22 nt, Human
ucacucuuuaucuuuuaugucu

SEQ ID NO: 115502 - RNA, 22 nt, Human
uucauaugaauuggguuuuuuu

SEQ ID NO: 115503 - RNA, 22 nt, Human
uuuccuaggaaaugauugaagu

SEQ ID NO: 115504 - RNA, 22 nt, Human
aagugaggagaccucuucuuca

SEQ ID NO: 115505 - RNA, 22 nt, Human
cuaaauucuauauccuugcuuc

SEQ ID NO: 115506 - RNA, 22 nt, Human
uauaaagaccuuauccuucaua

SEQ ID NO: 115507 - RNA, 22 nt, Human
uagcacauaguaggcacaggcu

SEQ ID NO: 115508 - RNA, 22 nt, Human
uacuuuaauugcaaaaauaaau

SEQ ID NO: 115509 - RNA, 22 nt, Human
uuaaaagaauccuguuauccuc

SEQ ID NO: 115510 - RNA, 22 nt, Human
uuguuauuauuauuuucguucu

SEQ ID NO: 115511 - RNA, 22 nt, Human
aggcaguggagcuggaauaggc

SEQ ID NO: 115512 - RNA, 22 nt, Human
ccagucuuggugucuguagcac

SEQ ID NO: 115513 - RNA, 22 nt, Human
cagcuccaucuugcuuauacca

SEQ ID NO: 115514 - RNA, 22 nt, Human
aucguuaugauagagaaagaga

SEQ ID NO: 115515 - RNA, 22 nt, Human
ccccauggaaaacccaccuagg

SEQ ID NO: 115516 - RNA, 22 nt, Human
guuuuaucuauguaauuauaaa

SEQ ID NO: 115517 - RNA, 22 nt, Human
caaauguuugguggcauuuugu

SEQ ID NO: 115518 - RNA, 22 nt, Human
ucuuuuucccugguuccuuuuu

SEQ ID NO: 115519 - RNA, 22 nt, Human
guucuucagauuccauuucagu

SEQ ID NO: 115520 - RNA, 22 nt, Human
cagaccuggaaaacaggcuugc

SEQ ID NO: 115521 - RNA, 22 nt, Human
uaaaugauaguauugaagguag

SEQ ID NO: 115522 - RNA, 22 nt, Human
ucauuguuuacugucuuuuuuc

SEQ ID NO: 115523 - RNA, 22 nt, Human
uguuuuuuagagugauacuuuu

SEQ ID NO: 115524 - RNA, 22 nt, Human
gauuuuaaaagauguauaaggu

SEQ ID NO: 115525 - RNA, 23 nt, Human
uuuuccaaaucgacucucuaguu

SEQ ID NO: 115526 - RNA, 22 nt, Human
uuaucuuuuaaaaacacuugug

SEQ ID NO: 115527 - RNA, 22 nt, Human
ugaaauuuuuuggagauaauuu

SEQ ID NO: 115528 - RNA, 22 nt, Human
aauuauguugaaauaugagaac

SEQ ID NO: 115529 - RNA, 22 nt, Human
uaauauaacugccaguuaaggu

SEQ ID NO: 115530 - RNA, 22 nt, Human
auauuuuacagcucucguugaa

SEQ ID NO: 115531 - RNA, 22 nt, Human
uugugugugcccaccuguggcc

SEQ ID NO: 115532 - RNA, 22 nt, Human
ccuaggcuggcugucuucaggu

SEQ ID NO: 115533 - RNA, 22 nt, Human
uucacuuuuucucugcuugaga

SEQ ID NO: 115534 - RNA, 22 nt, Human
uucauagaagggaguuuuuccu

SEQ ID NO: 115535 - RNA, 22 nt, Human
acugucuuguuguaugugagcu

SEQ ID NO: 115536 - RNA, 22 nt, Human
uacaaaugaucaucucuuugaa

SEQ ID NO: 115537 - RNA, 22 nt, Human
guuuccaggcuuugguaugguu

SEQ ID NO: 115538 - RNA, 22 nt, Human
cuucuuuucuacuggccuagaa

SEQ ID NO: 115539 - RNA, 22 nt, Human
cagcuuguucugaccugugauu

SEQ ID NO: 115540 - RNA, 22 nt, Human
aaaucauagccaugaacauuug

SEQ ID NO: 115541 - RNA, 22 nt, Human
uauuuguauugucuuaucacuu

SEQ ID NO: 115542 - RNA, 22 nt, Human
uuauuguuuggguauaauuuga

SEQ ID NO: 115543 - RNA, 22 nt, Human
aaaauaauauuauaccacugcu

SEQ ID NO: 115544 - RNA, 20 nt, Human
uuuuuuaaauagagcuguug

SEQ ID NO: 115545 - RNA, 22 nt, Human
ugagauguaauguaguacuuug

SEQ ID NO: 115546 - RNA, 17 nt, Human
ugucuuuuuccuccucc

SEQ ID NO: 115547 - RNA, 22 nt, Human
aauucuguugguuagaguugga

SEQ ID NO: 115548 - RNA, 22 nt, Human
ccuuuuaucgcgaagaacucca

SEQ ID NO: 115549 - RNA, 23 nt, Human
uuucugaguuuuuuaaaagucca

SEQ ID NO: 115550 - RNA, 22 nt, Human
uuuacuguuuacagcuaaugca

SEQ ID NO: 115551 - RNA, 22 nt, Human
aguuuccacuggagacacugug

SEQ ID NO: 115552 - RNA, 22 nt, Human
guccuguguaaguacuugcuca

SEQ ID NO: 115553 - RNA, 18 nt, Human
auucauuugcguuuggcu

SEQ ID NO: 115554 - RNA, 22 nt, Human
cuccaugagccaggagggcuac

SEQ ID NO: 115555 - RNA, 22 nt, Human
auaaaaauguuuuuguguggua

SEQ ID NO: 115556 - RNA, 22 nt, Human
uauuucaugagugaauaucuag

SEQ ID NO: 115557 - RNA, 22 nt, Human
gcuuucacugcaauagaugaau

SEQ ID NO: 115558 - RNA, 22 nt, Human
uucuaauauuaugauuucuaag

SEQ ID NO: 115559 - RNA, 22 nt, Human
auuuuugguuucaccugcacgc

SEQ ID NO: 115560 - RNA, 22 nt, Human
uauuuaaagucagcaacuuuuc

SEQ ID NO: 115561 - RNA, 22 nt, Human
auuaauaucaauauauuauaug

SEQ ID NO: 115562 - RNA, 22 nt, Human
uuauuucauguaaaauuuaugu

SEQ ID NO: 115563 - RNA, 22 nt, Human
ugcuuggagaaucagucccagc

SEQ ID NO: 115564 - RNA, 22 nt, Human
uggucuuuccuucauuguccag

SEQ ID NO: 115565 - RNA, 22 nt, Human
uuauuuaaguauuuauugaagu

SEQ ID NO: 115566 - RNA, 22 nt, Human
guucuucagcccucagguccua

SEQ ID NO: 115567 - RNA, 22 nt, Human
guccccugcguguucauccugg

SEQ ID NO: 115568 - RNA, 22 nt, Human
ugagguauuuggauuuauauuu

SEQ ID NO: 115569 - RNA, 20 nt, Human
cauuccaugcaucuuggucc

SEQ ID NO: 115570 - RNA, 22 nt, Human
uuuuaaaguaauugaagcuugu

SEQ ID NO: 115571 - RNA, 22 nt, Human
ugcuuucaaaacucagaggaau

SEQ ID NO: 115572 - RNA, 22 nt, Human
uuauaucagaaggugagauuga

SEQ ID NO: 115573 - RNA, 21 nt, Human
uuucauuaguacaucaauuug

SEQ ID NO: 115574 - RNA, 22 nt, Human
gugucccaaagauuagaaauca

SEQ ID NO: 115575 - RNA, 22 nt, Human
uuauauuuuauuuaauuaaaua

SEQ ID NO: 115576 - RNA, 22 nt, Human
aauauuuugggacugaggaauu

SEQ ID NO: 115577 - RNA, 22 nt, Human
agucugugguccucuguaucuc

SEQ ID NO: 115578 - RNA, 22 nt, Human
uuauuuuuguaacacuguauag

SEQ ID NO: 115579 - RNA, 22 nt, Human
uuucauguuggauacuguuuca

SEQ ID NO: 115580 - RNA, 22 nt, Human
aucuaaaacuacgaauacuacc

SEQ ID NO: 115581 - RNA, 22 nt, Human
uccauguauugcuaacaaauag

SEQ ID NO: 115582 - RNA, 22 nt, Human
cuuucuuucaaguucugcuuua

SEQ ID NO: 115583 - RNA, 23 nt, Human
cuuauauaaucauuagaaaccau

SEQ ID NO: 115584 - RNA, 21 nt, Human
uccccugugccuggcauacag

SEQ ID NO: 115585 - RNA, 22 nt, Human
uuauuugcccauguuuagcaga

SEQ ID NO: 115586 - RNA, 20 nt, Human
ucucuuuuucuucuuuucuc

SEQ ID NO: 115587 - RNA, 22 nt, Human
uuuuaaauggcuuuuacuuuuc

SEQ ID NO: 115588 - RNA, 22 nt, Human
uuucuaaaaccagaguuuauaa

SEQ ID NO: 115589 - RNA, 22 nt, Human
auuuuauuuugggaucuuuuua

SEQ ID NO: 115590 - RNA, 22 nt, Human
ucuucacagaugcauauacuuc

SEQ ID NO: 115591 - RNA, 22 nt, Human
uuuauuuuccaugucucuaggu

SEQ ID NO: 115592 - RNA, 22 nt, Human
gcugucccccaaagaugcuccu

SEQ ID NO: 115593 - RNA, 22 nt, Human
cuauguuucagauauauauaua

SEQ ID NO: 115594 - RNA, 22 nt, Human
uuacuuuuuucccccuuagaug

SEQ ID NO: 115595 - RNA, 22 nt, Human
uaguuucuucaacugucccagc

SEQ ID NO: 115596 - RNA, 22 nt, Human
uuguuuuaguagaaguuacaug

SEQ ID NO: 115597 - RNA, 22 nt, Human
uucacugugauugggguggauu

SEQ ID NO: 115598 - RNA, 22 nt, Human
augaagguggacagauuuuuuu

SEQ ID NO: 115599 - RNA, 22 nt, Human
uacuauuuugacaugaaauuga

SEQ ID NO: 115600 - RNA, 22 nt, Human
uuagaaauguccuacuaauaug

SEQ ID NO: 115601 - RNA, 22 nt, Human
uuuucucuuugcuucucuaaaa

SEQ ID NO: 115602 - RNA, 23 nt, Human
uucuuuccuuaucccauuuacuu

SEQ ID NO: 115603 - RNA, 20 nt, Human
ugauuauuccaacaagaaug

SEQ ID NO: 115604 - RNA, 22 nt, Human
ucuucaugaaauugauugcuua

SEQ ID NO: 115605 - RNA, 22 nt, Human
auucuucauguugaagcuguca

SEQ ID NO: 115606 - RNA, 22 nt, Human
cauaggcucuucagagaacuga

SEQ ID NO: 115607 - RNA, 22 nt, Human
aaaauacuaggaaaauaaauca

SEQ ID NO: 115608 - RNA, 22 nt, Human
uucacugugauguuuaagagaa

SEQ ID NO: 115609 - RNA, 22 nt, Human
uuaucaaaaaauaguacuuuga

SEQ ID NO: 115610 - RNA, 22 nt, Human
uuuaaaauguuuuauuuauuua

SEQ ID NO: 115611 - RNA, 20 nt, Human
uugauucacaaaaagcuuag

SEQ ID NO: 115612 - RNA, 16 nt, Human
gaauuccauugcucug

SEQ ID NO: 115613 - RNA, 22 nt, Human
aggcaguguggagggcuguugc

SEQ ID NO: 115614 - RNA, 22 nt, Human
aggaaauaggaccagacaaagc

SEQ ID NO: 115615 - RNA, 22 nt, Human
uuauuuaaaauguagguuggga

SEQ ID NO: 115616 - RNA, 22 nt, Human
aaauuaaaguuuuauuuagagc

SEQ ID NO: 115617 - RNA, 22 nt, Human
ugaaaaauauuuuuagaaauaa

SEQ ID NO: 115618 - RNA, 22 nt, Human
uucuucuucuuccucauccuca

SEQ ID NO: 115619 - RNA, 22 nt, Human
uauuuuagccaacagaaugaug

SEQ ID NO: 115620 - RNA, 20 nt, Human
aauaaauauaacccauaauu

SEQ ID NO: 115621 - RNA, 22 nt, Human
auuuuucuuucacauuuucuua

SEQ ID NO: 115622 - RNA, 20 nt, Human
acuagaaagucacugggggg

SEQ ID NO: 115623 - RNA, 22 nt, Human
auuuucauauggguuauuugua

SEQ ID NO: 115624 - RNA, 22 nt, Human
ucauuguuucugcuuuucauga

SEQ ID NO: 115625 - RNA, 22 nt, Human
accuccauggcccacaucuagu

SEQ ID NO: 115626 - RNA, 22 nt, Human
aaauguaaacuguauuuauaaa

SEQ ID NO: 115627 - RNA, 22 nt, Human
uuuuguuuacauuaaauuuuga

SEQ ID NO: 115628 - RNA, 22 nt, Human
acuuuuccuggguagcuccugg

SEQ ID NO: 115629 - RNA, 22 nt, Human
gcauaauauugagaaauuauua

SEQ ID NO: 115630 - RNA, 22 nt, Human
guuguuuuuguuaaaacaguga

SEQ ID NO: 115631 - RNA, 22 nt, Human
ggcagagguagcuggaaccagg

SEQ ID NO: 115632 - RNA, 22 nt, Human
aauguugaaccuuuuuggccug

SEQ ID NO: 115633 - RNA, 22 nt, Human
ccauuucacaucccugacaugu

SEQ ID NO: 115634 - RNA, 22 nt, Human
uuuaacauaugaaagaauauuu

SEQ ID NO: 115635 - RNA, 22 nt, Human
uuauuuuuaggaauguagaggu

SEQ ID NO: 115636 - RNA, 22 nt, Human
guuuauuucuuaucaucacuau

SEQ ID NO: 115637 - RNA, 22 nt, Human
cuccccuuauuccucaacauga

SEQ ID NO: 115638 - RNA, 20 nt, Human
cuuauuuuggagaacuuuuc

SEQ ID NO: 115639 - RNA, 22 nt, Human
uauauacacgcacauauacaua

SEQ ID NO: 115640 - RNA, 22 nt, Human
augaaaacggaccagagcuauu

SEQ ID NO: 115641 - RNA, 22 nt, Human
uuuuuaaaauuaggacggcacg

SEQ ID NO: 115642 - RNA, 22 nt, Human
acauauaugugcauacaacuau

SEQ ID NO: 115643 - RNA, 22 nt, Human
ugcuuucagauaucuguuucaa

SEQ ID NO: 115644 - RNA, 22 nt, Human
uguuggaaucuucuagucuucc

SEQ ID NO: 115645 - RNA, 22 nt, Human
uuauuucaggcauuuguaaaug

SEQ ID NO: 115646 - RNA, 22 nt, Human
aaauguuucauucuauuuuuag

SEQ ID NO: 115647 - RNA, 22 nt, Human
uuauuuuauaaagagaagacuu

SEQ ID NO: 115648 - RNA, 22 nt, Human
uaauaaaaauuuaauucacauu

SEQ ID NO: 115649 - RNA, 22 nt, Human
aaauuuuguugaaaaauauuuu

SEQ ID NO: 115650 - RNA, 22 nt, Human
uuuucauagccagaaacugaaa

SEQ ID NO: 115651 - RNA, 22 nt, Human
auagaaauagacaaugcaaaga

SEQ ID NO: 115652 - RNA, 22 nt, Human
gcuucucacccuuacuaucucu

SEQ ID NO: 115653 - RNA, 22 nt, Human
uuucacugaguaggagagcacu

SEQ ID NO: 115654 - RNA, 22 nt, Human
gugugucucaguugcuccgaag

SEQ ID NO: 115655 - RNA, 22 nt, Human
gaauauuuaucucagcugcaga

SEQ ID NO: 115656 - RNA, 22 nt, Human
aacgagcugggggggccggggg

SEQ ID NO: 115657 - RNA, 22 nt, Human
uuuuaaaacaugucaaaaugug

SEQ ID NO: 115658 - RNA, 22 nt, Human
gcacaaaagguacuucauguag

SEQ ID NO: 115659 - RNA, 22 nt, Human
acauuuuaaaaacaguaccugg

SEQ ID NO: 115660 - RNA, 22 nt, Human
ugcuuggauuuccaaaugguuu

SEQ ID NO: 115661 - RNA, 22 nt, Human
ucucucucucuuccagcauguu

SEQ ID NO: 115662 - RNA, 22 nt, Human
aaauauuugaaugguguaagau

SEQ ID NO: 115663 - RNA, 22 nt, Human
auuuccagcagcauauuugucu

SEQ ID NO: 115664 - RNA, 22 nt, Human
uuuuaaaagguugcuguuauaa

SEQ ID NO: 115665 - RNA, 22 nt, Human
caaaaaauccauagaaagaggu

SEQ ID NO: 115666 - RNA, 22 nt, Human
cugcaucacagcaggaggcaca

SEQ ID NO: 115667 - RNA, 19 nt, Human
caggucuucuuggaggacu

SEQ ID NO: 115668 - RNA, 22 nt, Human
guuuucuccugcuauacagugc

SEQ ID NO: 115669 - RNA, 22 nt, Human
ucauuauuuugauguauuuccu

SEQ ID NO: 115670 - RNA, 22 nt, Human
uuuuaaauaaacuacacugauu

SEQ ID NO: 115671 - RNA, 22 nt, Human
uucacccuucucuggcuuucag

SEQ ID NO: 115672 - RNA, 22 nt, Human
ucauacuuuuuugacccuugug

SEQ ID NO: 115673 - RNA, 22 nt, Human
auauauguauauaugugugugu

SEQ ID NO: 115674 - RNA, 22 nt, Human
uucaaacaguguagaauauaug

SEQ ID NO: 115675 - RNA, 22 nt, Human
uagcugucauuggaucagaagg

SEQ ID NO: 115676 - RNA, 22 nt, Human
gaauuccaggugagagaaggua

SEQ ID NO: 115677 - RNA, 22 nt, Human
uaccuggauaaauguacaaccg

SEQ ID NO: 115678 - RNA, 22 nt, Human
aaucauaacaaaagcaauuaua

SEQ ID NO: 115679 - RNA, 22 nt, Human
guuauuuugucuuguucaugaa

SEQ ID NO: 115680 - RNA, 22 nt, Human
auuuucuucauuuugauuguau

SEQ ID NO: 115681 - RNA, 22 nt, Human
uacuuacacugaagcaaagaua

SEQ ID NO: 115682 - RNA, 22 nt, Human
cuggagaacucugugcuucacu

SEQ ID NO: 115683 - RNA, 22 nt, Human
guaaauaucucacgaaugauuc

SEQ ID NO: 115684 - RNA, 22 nt, Human
uucauuagcacauuuccuuggu

SEQ ID NO: 115685 - RNA, 22 nt, Human
aauguaaauaauuguaaaauuu

SEQ ID NO: 115686 - RNA, 22 nt, Human
gguagacugagcuccuugagga

SEQ ID NO: 115687 - RNA, 22 nt, Human
uauuuuaaaagcauuaauucuu

SEQ ID NO: 115688 - RNA, 20 nt, Human
gaacauaaauaacucuuuac

SEQ ID NO: 115689 - RNA, 21 nt, Human
uuccuggaggcagaaacguga

SEQ ID NO: 115690 - RNA, 22 nt, Human
uuguuauaggaucagugucacu

SEQ ID NO: 115691 - RNA, 22 nt, Human
uggaguuuuaaucuguacagaa

SEQ ID NO: 115692 - RNA, 22 nt, Human
auuuuguugaaacccuuguugu

SEQ ID NO: 115693 - RNA, 22 nt, Human
uuuguuuccagccuuuugucuu

SEQ ID NO: 115694 - RNA, 22 nt, Human
ugucuuuuaaaaauguguaaaa

SEQ ID NO: 115695 - RNA, 21 nt, Human
cuauaaaaaugguucuuugcg

SEQ ID NO: 115696 - RNA, 22 nt, Human
acucauuuggauuuuggaguuu

SEQ ID NO: 115697 - RNA, 22 nt, Human
uuuuucuuugcuuuccacuggc

SEQ ID NO: 115698 - RNA, 22 nt, Human
uucuuuuaauagagauccugug

SEQ ID NO: 115699 - RNA, 22 nt, Human
uggagucuugcuuugggagugc

SEQ ID NO: 115700 - RNA, 19 nt, Human
uagaggagaauggcaaaga

SEQ ID NO: 115701 - RNA, 22 nt, Human
uauuuuuuuaacauuuauugua

SEQ ID NO: 115702 - RNA, 22 nt, Human
cuucuucaucuuuuggaggaac

SEQ ID NO: 115703 - RNA, 22 nt, Human
uuuucucaguuuuuuucaaaag

SEQ ID NO: 115704 - RNA, 22 nt, Human
auauuuuugcagaauuuuucgu

SEQ ID NO: 115705 - RNA, 22 nt, Human
agagcuccaggguuuuguagug

SEQ ID NO: 115706 - RNA, 22 nt, Human
ugcuuucaaugaauuguauacu

SEQ ID NO: 115707 - RNA, 22 nt, Human
uauuaaaagagaaaaagccacc

SEQ ID NO: 115708 - RNA, 22 nt, Human
uguauuuuuucccugaaauaaa

SEQ ID NO: 115709 - RNA, 22 nt, Human
uuguuuucuaguguuuugaaua

SEQ ID NO: 115710 - RNA, 22 nt, Human
ucuucaaauacagucauauuga

SEQ ID NO: 115711 - RNA, 22 nt, Human
aacacuaaaggucaguuagaag

SEQ ID NO: 115712 - RNA, 22 nt, Human
auuuuagagaaacaaacguagg

SEQ ID NO: 115713 - RNA, 22 nt, Human
gaagaaggaagaucaugcuuga

SEQ ID NO: 115714 - RNA, 22 nt, Human
auuuuacuaugauaguugagaa

SEQ ID NO: 115715 - RNA, 22 nt, Human
uuuuccuuccugucucuuuauu

SEQ ID NO: 115716 - RNA, 22 nt, Human
uauuucuagggcaugaaaauaa

SEQ ID NO: 115717 - RNA, 22 nt, Human
uucuuuuaauuucugucugcag

SEQ ID NO: 115718 - RNA, 22 nt, Human
auauaguacauguauauauaua

SEQ ID NO: 115719 - RNA, 22 nt, Human
uauuguuuuaagguguauuaau

SEQ ID NO: 115720 - RNA, 22 nt, Human
uauuuuuacuguuugaugauuc

SEQ ID NO: 115721 - RNA, 22 nt, Human
aucacuagaguuacauugccag

SEQ ID NO: 115722 - RNA, 22 nt, Human
uucacuguucuuagagaagacc

SEQ ID NO: 115723 - RNA, 22 nt, Human
uauuuucucugccacacuucca

SEQ ID NO: 115724 - RNA, 22 nt, Human
aaauguuugguggauaaaagga

SEQ ID NO: 115725 - RNA, 22 nt, Human
uuuuauaauacccuugacuaau

SEQ ID NO: 115726 - RNA, 22 nt, Human
ggagaggaaguuuaaagaauug

SEQ ID NO: 115727 - RNA, 23 nt, Human
uugcuuuugccccaaaagaguua

SEQ ID NO: 115728 - RNA, 22 nt, Human
uuauuuucgugugugugugugu

SEQ ID NO: 115729 - RNA, 22 nt, Human
ugcagcuuuugguuucuagaug

SEQ ID NO: 115730 - RNA, 22 nt, Human
uuuauaauuacguaaaauauuu

SEQ ID NO: 115731 - RNA, 22 nt, Human
augcaaaaucuuauuuuuucua

SEQ ID NO: 115732 - RNA, 22 nt, Human
uuuuagaagcauuuaugagauu

SEQ ID NO: 115733 - RNA, 22 nt, Human
uaaaacuaugcaaccuacuacc

SEQ ID NO: 115734 - RNA, 22 nt, Human
guuuaaaagcaaccaacaggcu

SEQ ID NO: 115735 - RNA, 22 nt, Human
cuucuuaaaguugucacagcug

SEQ ID NO: 115736 - RNA, 22 nt, Human
auucuuuucucuaaaugaugaa

SEQ ID NO: 115737 - RNA, 22 nt, Human
aucuucuuucaucagccccuca

SEQ ID NO: 115738 - RNA, 22 nt, Human
guuaaaaugauuugugauuuau

SEQ ID NO: 115739 - RNA, 22 nt, Human
auuuuuauuugccuaugauaua

SEQ ID NO: 115740 - RNA, 22 nt, Human
ggcagaggagcuggaaacaugg

SEQ ID NO: 115741 - RNA, 22 nt, Human
uaguauuuguaauuaucaaagc

SEQ ID NO: 115742 - RNA, 22 nt, Human
uuauuuaagaucuuaauauaua

SEQ ID NO: 115743 - RNA, 22 nt, Human
acuuuauacuagugauaguuug

SEQ ID NO: 115744 - RNA, 17 nt, Human
auuguuuuuaauuugca

SEQ ID NO: 115745 - RNA, 22 nt, Human
cuucuuuuggggaugaaaaugg

SEQ ID NO: 115746 - RNA, 22 nt, Human
uuuuccuucuuccugccuugcc

SEQ ID NO: 115747 - RNA, 22 nt, Human
guuguuuucagcccagcauuag

SEQ ID NO: 115748 - RNA, 22 nt, Human
uuuauguuuguuuuugaaauaa

SEQ ID NO: 115749 - RNA, 22 nt, Human
aaggcuguuugagcacuggagc

SEQ ID NO: 115750 - RNA, 22 nt, Human
aguaaaugaaagcaauuuuaga

SEQ ID NO: 115751 - RNA, 22 nt, Human
auagagcuggggaagaagcugg

SEQ ID NO: 115752 - RNA, 22 nt, Human
uugccaggagacaucuggagcc

SEQ ID NO: 115753 - RNA, 22 nt, Human
uucucuugccuucucuuuuauc

SEQ ID NO: 115754 - RNA, 17 nt, Human
auucaugaacauguccu

SEQ ID NO: 115755 - RNA, 22 nt, Human
aacccugaacuuaguucuagga

SEQ ID NO: 115756 - RNA, 20 nt, Human
agugauuuguuaguacauug

SEQ ID NO: 115757 - RNA, 22 nt, Human
uccauuuacuauucucauaucg

SEQ ID NO: 115758 - RNA, 22 nt, Human
uauauuaaagugcuuugcagug

SEQ ID NO: 115759 - RNA, 22 nt, Human
aaaugcuuuaauugaguucaug

SEQ ID NO: 115760 - RNA, 22 nt, Human
cuuuaaaaauguauuuuugugg

SEQ ID NO: 115761 - RNA, 22 nt, Human
gcuguggagaagcugccuaugg

SEQ ID NO: 115762 - RNA, 22 nt, Human
auaaaucaagggcaguauuucc

SEQ ID NO: 115763 - RNA, 22 nt, Human
uuuuacaaugcaaauucuugcu

SEQ ID NO: 115764 - RNA, 22 nt, Human
aaugaauaaauuuuaaagacag

SEQ ID NO: 115765 - RNA, 22 nt, Human
uguuuuuauucuuaauguuuca

SEQ ID NO: 115766 - RNA, 22 nt, Human
uuaacauuguccuuagcagauu

SEQ ID NO: 115767 - RNA, 22 nt, Human
cauuucaaacaguuacagcugc

SEQ ID NO: 115768 - RNA, 22 nt, Human
aaugauuuucugcaaacaguga

SEQ ID NO: 115769 - RNA, 22 nt, Human
agcacagugccugacauauaug

SEQ ID NO: 115770 - RNA, 22 nt, Human
uuuaaauuucugaaucuugagg

SEQ ID NO: 115771 - RNA, 22 nt, Human
uuaaacauuuccacuugccagu

SEQ ID NO: 115772 - RNA, 22 nt, Human
gucuuuguaguuuuaauuugag

SEQ ID NO: 115773 - RNA, 22 nt, Human
uaaaaucaugacagauugacau

SEQ ID NO: 115774 - RNA, 22 nt, Human
uauuuuuaccuaauuuaugaga

SEQ ID NO: 115775 - RNA, 22 nt, Human
aaaacauuuaggguuuuuuuua

SEQ ID NO: 115776 - RNA, 22 nt, Human
cuuuuuuucuccauauuucugg

SEQ ID NO: 115777 - RNA, 22 nt, Human
uuuucauuguuaguuucuccuu

SEQ ID NO: 115778 - RNA, 22 nt, Human
uuucagaaauggcacugaaauc

SEQ ID NO: 115779 - RNA, 22 nt, Human
guugagaaucucuagcuuagga

SEQ ID NO: 115780 - RNA, 22 nt, Human
gcuuauuagguuauuucaagga

SEQ ID NO: 115781 - RNA, 22 nt, Human
ugcauucugaacguaaauguga

SEQ ID NO: 115782 - RNA, 22 nt, Human
auucuuuauuuucuguacuugc

SEQ ID NO: 115783 - RNA, 22 nt, Human
ucuuuuaucuguuguguaacaa

SEQ ID NO: 115784 - RNA, 22 nt, Human
ggcuguggcagcuggaaguggu

SEQ ID NO: 115785 - RNA, 22 nt, Human
uauaagaaaagucauuaucaaa

SEQ ID NO: 115786 - RNA, 22 nt, Human
aaugaaaaucugucaguucaag

SEQ ID NO: 115787 - RNA, 22 nt, Human
uaauuccacacucccgcaagcg

SEQ ID NO: 115788 - RNA, 22 nt, Human
uuuuuuccuguuugucuuuggg

SEQ ID NO: 115789 - RNA, 22 nt, Human
aaucacuucuuugucuucuuca

SEQ ID NO: 115790 - RNA, 22 nt, Human
uuuguuugcugagugaauucaa

SEQ ID NO: 115791 - RNA, 22 nt, Human
auguaugagagauucuuuuauu

SEQ ID NO: 115792 - RNA, 22 nt, Human
ucaaauaugggccagaggaaau

SEQ ID NO: 115793 - RNA, 22 nt, Human
gugugugucuacuuucaucucu

SEQ ID NO: 115794 - RNA, 22 nt, Human
gagaaaaauuucuuugcugcac

SEQ ID NO: 115795 - RNA, 22 nt, Human
uuuucacugacuuggucuggaa

SEQ ID NO: 115796 - RNA, 21 nt, Human
auauuguugggguuuucuuuu

SEQ ID NO: 115797 - RNA, 22 nt, Human
uugccaggggacaucuggagcc

SEQ ID NO: 115798 - RNA, 22 nt, Human
aauaucuugaguuauaaauuca

SEQ ID NO: 115799 - RNA, 22 nt, Human
ggcagucuuucccuugagcucu

SEQ ID NO: 115800 - RNA, 22 nt, Human
auuuaaaaacugguacaacagg

SEQ ID NO: 115801 - RNA, 22 nt, Human
uauuuuauuuagguuuaguugu

SEQ ID NO: 115802 - RNA, 22 nt, Human
augaaaacgugugugugugugu

SEQ ID NO: 115803 - RNA, 22 nt, Human
uggggagacauggaguaaaaga

SEQ ID NO: 115804 - RNA, 22 nt, Human
guuuucuuguuaauuuugaacg

SEQ ID NO: 115805 - RNA, 22 nt, Human
guuauuguuauugcguugucga

SEQ ID NO: 115806 - RNA, 22 nt, Human
uuuacaaggcaguuauuuuccu

SEQ ID NO: 115807 - RNA, 22 nt, Human
uccuuucaaauuuauuugacau

SEQ ID NO: 115808 - RNA, 22 nt, Human
ucugaggacagugcugugccug

SEQ ID NO: 115809 - RNA, 22 nt, Human
auuguuuugugaaacauaguga

SEQ ID NO: 115810 - RNA, 22 nt, Human
auauguuaugccauuuucaagg

SEQ ID NO: 115811 - RNA, 23 nt, Human
uggaaguugagagucugcuuugu

SEQ ID NO: 115812 - RNA, 22 nt, Human
uuuaaucaguugguaauauuga

SEQ ID NO: 115813 - RNA, 22 nt, Human
uucuuuucuucccuguuuauua

SEQ ID NO: 115814 - RNA, 22 nt, Human
cuagcacagugcuuggcacaca

SEQ ID NO: 115815 - RNA, 22 nt, Human
aaauguauuagccuaugugaga

SEQ ID NO: 115816 - RNA, 22 nt, Human
uugucuuucguauggaacacua

SEQ ID NO: 115817 - RNA, 18 nt, Human
acaaaaauagugcuuugg

SEQ ID NO: 115818 - RNA, 22 nt, Human
uagacugugagcuccuugaggg

SEQ ID NO: 115819 - RNA, 22 nt, Human
cagcuccagcccaggcagcucc

SEQ ID NO: 115820 - RNA, 22 nt, Human
uucuucuuuccuauaauuaauu

SEQ ID NO: 115821 - RNA, 22 nt, Human
ucuucaucucuaaaaugggaac

SEQ ID NO: 115822 - RNA, 22 nt, Human
uuuaaaacagcauuuaaaaggu

SEQ ID NO: 115823 - RNA, 22 nt, Human
auuaaaaaaagauaaugaguua

SEQ ID NO: 115824 - RNA, 22 nt, Human
gaaacauuuguugaguacuugc

SEQ ID NO: 115825 - RNA, 19 nt, Human
ccaguuuuuuaauauucaa

SEQ ID NO: 115826 - RNA, 22 nt, Human
gcuggaaauaacuuguguagaa

SEQ ID NO: 115827 - RNA, 22 nt, Leptospira interrogans serovar lai str. 56601
cuuaccgucauauucucaauuu

SEQ ID NO: 115828 - RNA, 22 nt, Leptospira interrogans serovar lai str. 56601
acauaucuugcaaaaggagauu

SEQ ID NO: 115829 - RNA, 22 nt, Leptospira interrogans serovar lai str. 56601
aguucaaggaacucuuuaucgc

SEQ ID NO: 115830 - RNA, 22 nt, Leptospira interrogans serovar lai str. 56601
uaacguuucguuugauuggaga

SEQ ID NO: 115831 - RNA, 16 nt, Leptospira interrogans serovar lai str. 56601
guuugacuagcauuga

SEQ ID NO: 115832 - RNA, 22 nt, Leptospira interrogans serovar lai str. 56601
ucuguuaaacuuuugugaagau

SEQ ID NO: 115833 - RNA, 22 nt, Leptospira interrogans serovar lai str. 56601
ucuguuuauucuuaaguccuaa

SEQ ID NO: 115834 - RNA, 22 nt, Leptospira interrogans serovar lai str. 56601
guuuccauuugcaacguugauu

SEQ ID NO: 115835 - RNA, 22 nt, Leptospira interrogans serovar lai str. 56601
uaugauccgucucuccgaucaa

SEQ ID NO: 115836 - RNA, 22 nt, Leptospira interrogans serovar lai str. 56601
aacggauugaauuucuuaauuu

SEQ ID NO: 115837 - RNA, 22 nt, Leptospira interrogans serovar lai str. 56601
cugaacagaagugauugauccu

SEQ ID NO: 115838 - RNA, 22 nt, Leptospira interrogans serovar lai str. 56601
gaucaauuugaauccgauuguu

SEQ ID NO: 115839 - RNA, 22 nt, Leptospira interrogans serovar lai str. 56601
ggucauaucaaaguauuuggag

SEQ ID NO: 115840 - RNA, 22 nt, Leptospira interrogans serovar lai str. 56601
gaaccguuucuuguagacauga

SEQ ID NO: 115841 - RNA, 22 nt, Leptospira interrogans serovar lai str. 56601
uuaaucugugggaacuaccaca

SEQ ID NO: 115842 - RNA, 22 nt, Leptospira interrogans serovar lai str. 56601
aaaucguuuaucuauguccguc

SEQ ID NO: 115843 - RNA, 22 nt, Leptospira interrogans serovar lai str. 56601
augcguagccugcuauuuuugg

SEQ ID NO: 115844 - RNA, 22 nt, Leptospira interrogans serovar lai str. 56601
ucuccggaauucaaaaaacggu

SEQ ID NO: 115845 - RNA, 22 nt, Leptospira interrogans serovar lai str. 56601
cucaugauucugaaaaaaguug

SEQ ID NO: 115846 - RNA, 22 nt, Leptospira interrogans serovar lai str. 56601
gagugcaaaauacugaauaucu

SEQ ID NO: 115847 - RNA, 22 nt, Leptospira interrogans serovar lai str. 56601
ucgaaucggcggaccuucguag

SEQ ID NO: 115848 - RNA, 17 nt, Leptospira interrogans serovar lai str. 56601
uacaauccguuucucau

SEQ ID NO: 115849 - RNA, 22 nt, Leptospira interrogans serovar lai str. 56601
auuugcaaauauuugucacggu

SEQ ID NO: 115850 - RNA, 22 nt, Leptospira interrogans serovar lai str. 56601
auagaagcguucagauuuuuuc

SEQ ID NO: 115851 - RNA, 20 nt, Leptospira interrogans serovar lai str. 56601
aguaguuguaacagauguag

SEQ ID NO: 115852 - RNA, 22 nt, Leptospira interrogans serovar lai str. 56601
uucaggauucuaucaauuucua

SEQ ID NO: 115853 - RNA, 22 nt, Leptospira interrogans serovar lai str. 56601
gucgucucaaaaauauuguagg

SEQ ID NO: 115854 - RNA, 22 nt, Leptospira interrogans serovar lai str. 56601
ugaaaucguugucuuuuuugua

SEQ ID NO: 115855 - RNA, 22 nt, Leptospira interrogans serovar lai str. 56601
uucagaagaauguguagugggc

SEQ ID NO: 115856 - RNA, 22 nt, Leptospira interrogans serovar lai str. 56601
aguucauaaaagaguucccgca

SEQ ID NO: 115857 - RNA, 20 nt, Leptospira interrogans serovar lai str. 56601
cgguaaagguuauguugucc

SEQ ID NO: 115858 - RNA, 22 nt, Leptospira interrogans serovar lai str. 56601
gaguuggaaagacgaaaucgga

SEQ ID NO: 115859 - RNA, 22 nt, Leptospira interrogans serovar lai str. 56601
ucuuauagaaguauuaggagaa

SEQ ID NO: 115860 - RNA, 22 nt, Leptospira interrogans serovar lai str. 56601
gaguuuccaccgaaccgugaga

SEQ ID NO: 115861 - RNA, 22 nt, Leptospira interrogans serovar lai str. 56601
acuuguucacguuaaauacauu

SEQ ID NO: 115862 - RNA, 22 nt, Leptospira interrogans serovar lai str. 56601
gaaauacuuucgaucgaaaauu

SEQ ID NO: 115863 - RNA, 22 nt, Leptospira interrogans serovar lai str. 56601
uagagguagaaggaggauuuuu

SEQ ID NO: 115864 - RNA, 22 nt, Leptospira interrogans serovar lai str. 56601
uucuucggugcacgaucacggu

SEQ ID NO: 115865 - RNA, 22 nt, Leptospira interrogans serovar lai str. 56601
ucaaacucauagucuuuuucgu

SEQ ID NO: 115866 - RNA, 22 nt, Leptospira interrogans serovar lai str. 56601
gagcagcgcugauauuuuccuc

SEQ ID NO: 115867 - RNA, 22 nt, Leptospira interrogans serovar lai str. 56601
uguuugaaugugagauauuggg

SEQ ID NO: 115868 - RNA, 22 nt, Leptospira interrogans serovar lai str. 56601
guucgggauuauauuuuucuaa

SEQ ID NO: 115869 - RNA, 22 nt, Leptospira interrogans serovar lai str. 56601
uugaauuccccuaggaaagaau

SEQ ID NO: 115870 - RNA, 22 nt, Leptospira interrogans serovar lai str. 56601
cuuauugaucuuagaagaaaga

SEQ ID NO: 115871 - RNA, 22 nt, Leptospira interrogans serovar lai str. 56601
aacgaauaccauuauuucuagc

SEQ ID NO: 115872 - RNA, 22 nt, Leptospira interrogans serovar lai str. 56601
augcaguaugggaaagaauugc

SEQ ID NO: 115873 - RNA, 22 nt, Leptospira interrogans serovar lai str. 56601
gucucagauggacuuuguacuu

SEQ ID NO: 115874 - RNA, 22 nt, Leptospira interrogans serovar lai str. 56601
ugaguucuauaaggauuccaga

SEQ ID NO: 115875 - RNA, 22 nt, Leptospira interrogans serovar lai str. 56601
ucacggaauuuuauuuuaugga

SEQ ID NO: 115876 - RNA, 22 nt, Leptospira interrogans serovar lai str. 56601
ugaauggauugaaaugggcuga

SEQ ID NO: 115877 - RNA, 22 nt, Leptospira interrogans serovar lai str. 56601
uguucaaucggauugacuaaau

SEQ ID NO: 115878 - RNA, 22 nt, Leptospira interrogans serovar lai str. 56601
uauaguuccuguuucguccgua

SEQ ID NO: 115879 - RNA, 22 nt, Leptospira interrogans serovar lai str. 56601
gaaauccuuuuaccucuugcua

SEQ ID NO: 115880 - RNA, 22 nt, Leptospira interrogans serovar lai str. 56601
aguuccuacaauuuuagaauuu

SEQ ID NO: 115881 - RNA, 22 nt, Leptospira interrogans serovar lai str. 56601
ucuaagcuauuuuugagaugau

SEQ ID NO: 115882 - RNA, 22 nt, Leptospira interrogans serovar lai str. 56601
aagucuaaaucguugucuucua

SEQ ID NO: 115883 - RNA, 23 nt, Leptospira interrogans serovar lai str. 56601
ucgacuuauacuccuaucgauuc

SEQ ID NO: 115884 - RNA, 22 nt, Leptospira interrogans serovar lai str. 56601
gaauuacguuugcaagugaaac

SEQ ID NO: 115885 - RNA, 22 nt, Leptospira interrogans serovar lai str. 56601
acuaagagaauucagccaaagg

SEQ ID NO: 115886 - RNA, 22 nt, Leptospira interrogans serovar lai str. 56601
ccuaucaguuuauauuuugaau

SEQ ID NO: 115887 - RNA, 22 nt, Leptospira interrogans serovar lai str. 56601
uugccggaaguuuuauuuacga

SEQ ID NO: 115888 - RNA, 22 nt, Leptospira interrogans serovar lai str. 56601
uggauauuuuagaaucucuucc

SEQ ID NO: 115889 - RNA, 22 nt, Leptospira interrogans serovar lai str. 56601
aacgucuaguauaaaagcgauu

SEQ ID NO: 115890 - RNA, 22 nt, Leptospira interrogans serovar lai str. 56601
uucuaucaguguuuugccuuua

SEQ ID NO: 115891 - RNA, 22 nt, Leptospira interrogans serovar lai str. 56601
uuuauccgagaaaucaaucaua

SEQ ID NO: 115892 - RNA, 22 nt, Leptospira interrogans serovar lai str. 56601
aaagaguugcguccagauaaga

SEQ ID NO: 115893 - RNA, 22 nt, Leptospira interrogans serovar lai str. 56601
ugauccguaaaaaaccugugga

SEQ ID NO: 115894 - RNA, 20 nt, Leptospira interrogans serovar lai str. 56601
aaucagcuuggaaauauuuc

SEQ ID NO: 115895 - RNA, 22 nt, Leptospira interrogans serovar lai str. 56601
ucguagcgacguuguauuuugu

SEQ ID NO: 115896 - RNA, 21 nt, Leptospira interrogans serovar lai str. 56601
gcgaauuucggaacggaccga

SEQ ID NO: 115897 - RNA, 22 nt, Leptospira interrogans serovar lai str. 56601
gaaguuuacuccggauuuuagg

SEQ ID NO: 115898 - RNA, 22 nt, Leptospira interrogans serovar lai str. 56601
cuauaugagcagguuccauaaa

SEQ ID NO: 115899 - RNA, 22 nt, Leptospira interrogans serovar lai str. 56601
ucuuagauaaacaaauuguaag

SEQ ID NO: 115900 - RNA, 22 nt, Leptospira interrogans serovar lai str. 56601
ucuaauuccuccauucaggaag

SEQ ID NO: 115901 - RNA, 22 nt, Leptospira interrogans serovar lai str. 56601
agcagauuuauugguugcuuug

SEQ ID NO: 115902 - RNA, 22 nt, Leptospira interrogans serovar lai str. 56601
agguuccuauguauuuucuuuc

SEQ ID NO: 115903 - RNA, 22 nt, Leptospira interrogans serovar lai str. 56601
aaaucaguuuggaaaucgcuuc

SEQ ID NO: 115904 - RNA, 22 nt, Leptospira interrogans serovar lai str. 56601
gaaaucaggagaauauguuaua

SEQ ID NO: 115905 - RNA, 22 nt, Leptospira interrogans serovar lai str. 56601
auugucgaaaauugaauaucuu

SEQ ID NO: 115906 - RNA, 22 nt, Leptospira interrogans serovar lai str. 56601
uggaauuucacaauaacuugac

SEQ ID NO: 115907 - RNA, 22 nt, Leptospira interrogans serovar lai str. 56601
ucuuuguagaucauucugcauu

SEQ ID NO: 115908 - RNA, 22 nt, Leptospira interrogans serovar lai str. 56601
auucuugcaaugauuucucgua

SEQ ID NO: 115909 - RNA, 22 nt, Leptospira interrogans serovar lai str. 56601
acaacguugugcuugaauacaa

SEQ ID NO: 115910 - RNA, 22 nt, Leptospira interrogans serovar lai str. 56601
cggaaauuaugaaagagaucau

SEQ ID NO: 115911 - RNA, 22 nt, Leptospira interrogans serovar lai str. 56601
gaagauauucgaguggauuauu

SEQ ID NO: 115912 - RNA, 20 nt, Leptospira interrogans serovar lai str. 56601
caauacuugccuugaugcgu

SEQ ID NO: 115913 - RNA, 22 nt, Leptospira interrogans serovar lai str. 56601
ccuuuagaugguuuggguuuau

SEQ ID NO: 115914 - RNA, 22 nt, Leptospira interrogans serovar lai str. 56601
uuccaagugguuuuacaaguac

SEQ ID NO: 115915 - RNA, 22 nt, Leptospira interrogans serovar lai str. 56601
ucuaaaggucugcauucaggaa

SEQ ID NO: 115916 - RNA, 22 nt, Leptospira interrogans serovar lai str. 56601
aaacgcgauuuuaaaaggagga

SEQ ID NO: 115917 - RNA, 22 nt, Leptospira interrogans serovar lai str. 56601
acuuggaaguuaggaaaagacc

SEQ ID NO: 115918 - RNA, 22 nt, Leptospira interrogans serovar lai str. 56601
guuuaagucuucuuugucgauu

SEQ ID NO: 115919 - RNA, 23 nt, Leptospira interrogans serovar lai str. 56601
ggaacuugauaaccacaauucac

SEQ ID NO: 115920 - RNA, 22 nt, Leptospira interrogans serovar lai str. 56601
gaaucuugagagaaauuuuacu

SEQ ID NO: 115921 - RNA, 22 nt, Leptospira interrogans serovar lai str. 56601
gucgauugaaguaguuuuguua

SEQ ID NO: 115922 - RNA, 22 nt, Leptospira interrogans serovar lai str. 56601
gaauacaaggaaaauucuuugg

SEQ ID NO: 115923 - RNA, 22 nt, Leptospira interrogans serovar lai str. 56601
uggaauacguuagacgcucaau

SEQ ID NO: 115924 - RNA, 22 nt, Leptospira interrogans serovar lai str. 56601
ucggagaaauuccagagcucaa

SEQ ID NO: 115925 - RNA, 22 nt, Leptospira interrogans serovar lai str. 56601
cguauagauugaucgguaaaaa

SEQ ID NO: 115926 - RNA, 22 nt, Leptospira interrogans serovar lai str. 56601
uuucuacggagucggccuuuga

SEQ ID NO: 115927 - RNA, 22 nt, Leptospira interrogans serovar lai str. 56601
ugggaauucuuuuaggauauaa

SEQ ID NO: 115928 - RNA, 22 nt, Leptospira interrogans serovar lai str. 56601
gggacucugaaauaaauuucua

SEQ ID NO: 115929 - RNA, 22 nt, Leptospira interrogans serovar lai str. 56601
ucuuggaaauuuuuaucauagc

SEQ ID NO: 115930 - RNA, 22 nt, Leptospira interrogans serovar lai str. 56601
uauucuguagugaucggagguu

SEQ ID NO: 115931 - RNA, 22 nt, Leptospira interrogans serovar lai str. 56601
aucgugaauugguuauccugca

SEQ ID NO: 115932 - RNA, 22 nt, Leptospira interrogans serovar lai str. 56601
uguagaucgauucuuaaaaugu

SEQ ID NO: 115933 - RNA, 22 nt, Leptospira interrogans serovar lai str. 56601
cuucugaauuuuuagcaacuuc

SEQ ID NO: 115934 - RNA, 22 nt, Leptospira interrogans serovar lai str. 56601
cgguucaauagguuuucgugau

SEQ ID NO: 115935 - RNA, 22 nt, Leptospira interrogans serovar lai str. 56601
uaguuucuacaagcucgagcuu

SEQ ID NO: 115936 - RNA, 22 nt, Leptospira interrogans serovar lai str. 56601
gaugacuuuugaaaccgaaggu

SEQ ID NO: 115937 - RNA, 22 nt, Leptospira interrogans serovar lai str. 56601
aaacgcagacaguucucucaga

SEQ ID NO: 115938 - RNA, 22 nt, Leptospira interrogans serovar lai str. 56601
guucaggauuauauuuuucuaa

SEQ ID NO: 115939 - RNA, 22 nt, Leptospira interrogans serovar lai str. 56601
auuggauacuggaaacgaauau

SEQ ID NO: 115940 - RNA, 22 nt, Leptospira interrogans serovar lai str. 56601
aacgcucuuuaugaaucgcguu

SEQ ID NO: 115941 - RNA, 19 nt, Leptospira interrogans serovar lai str. 56601
ucugagcaagauuuugaug

SEQ ID NO: 115942 - RNA, 22 nt, Leptospira interrogans serovar lai str. 56601
uuggaauaaggaucguauguua

SEQ ID NO: 115943 - RNA, 22 nt, Leptospira interrogans serovar lai str. 56601
ccgaaaguagaaaguauauuuu

SEQ ID NO: 115944 - RNA, 18 nt, Leptospira interrogans serovar lai str. 56601
ggaguucccacauuucaa

SEQ ID NO: 115945 - RNA, 18 nt, Leptospira interrogans serovar lai str. 56601
aagugaacuuacugaguu

SEQ ID NO: 115946 - RNA, 22 nt, Leptospira interrogans serovar lai str. 56601
caucugaauauaaaagaauucu

SEQ ID NO: 115947 - RNA, 22 nt, Leptospira interrogans serovar lai str. 56601
cuucguauucuuuugagaauuu

SEQ ID NO: 115948 - RNA, 20 nt, Leptospira interrogans serovar lai str. 56601
augugaacgauuuaaauuuu

SEQ ID NO: 115949 - RNA, 22 nt, Leptospira interrogans serovar lai str. 56601
aucaagccagauuuucuucgga

SEQ ID NO: 115950 - RNA, 23 nt, Leptospira interrogans serovar lai str. 56601
agguucaaaaagaguacuauuau

SEQ ID NO: 115951 - RNA, 22 nt, Leptospira interrogans serovar lai str. 56601
aguuugaacuuucucgugcuuc

SEQ ID NO: 115952 - RNA, 22 nt, Leptospira interrogans serovar lai str. 56601
acgcucuuuaugaaucgcguug

SEQ ID NO: 115953 - RNA, 22 nt, Leptospira interrogans serovar lai str. 56601
uaaagguuugagcaauucuugg

SEQ ID NO: 115954 - RNA, 22 nt, Leptospira interrogans serovar lai str. 56601
ugcagcucagguauuagauuua

SEQ ID NO: 115955 - RNA, 22 nt, Leptospira interrogans serovar lai str. 56601
cuugaauuggagcgggaaaaaa

SEQ ID NO: 115956 - RNA, 22 nt, Leptospira interrogans serovar lai str. 56601
aucuuguuguucuaucuugauc

SEQ ID NO: 115957 - RNA, 22 nt, Leptospira interrogans serovar lai str. 56601
uuccagaagugaucgauccgau

SEQ ID NO: 115958 - RNA, 18 nt, Leptospira interrogans serovar lai str. 56601
auuuaggaagaauuuuag

SEQ ID NO: 115959 - RNA, 22 nt, Leptospira interrogans serovar lai str. 56601
aaguucaggauuauauuuuucu

SEQ ID NO: 115960 - RNA, 22 nt, Leptospira interrogans serovar lai str. 56601
uacaaagaaagaaauucuaccc

SEQ ID NO: 115961 - RNA, 22 nt, Leptospira interrogans serovar lai str. 56601
aaccugugcgagaauuaccuaa

SEQ ID NO: 115962 - RNA, 22 nt, Leptospira interrogans serovar lai str. 56601
uuuguagcccauucuuuuagau

SEQ ID NO: 115963 - RNA, 23 nt, Leptospira interrogans serovar lai str. 56601
acgaauaucguccuaccgguauc

SEQ ID NO: 115964 - RNA, 22 nt, Leptospira interrogans serovar lai str. 56601
gauucggaagguauuucacuuu

SEQ ID NO: 115965 - RNA, 22 nt, Leptospira interrogans serovar lai str. 56601
caaguuauuggaaauuauaaaa

SEQ ID NO: 115966 - RNA, 22 nt, Leptospira interrogans serovar lai str. 56601
aaguguuuuaucuucugaggaa

SEQ ID NO: 115967 - RNA, 22 nt, Leptospira interrogans serovar lai str. 56601
gaugcagauucauauuuaaccu

SEQ ID NO: 115968 - RNA, 22 nt, Leptospira interrogans serovar lai str. 56601
agucuuacguaacaugggauau

SEQ ID NO: 115969 - RNA, 22 nt, Leptospira interrogans serovar lai str. 56601
agaacgaucggauccaaauugu

SEQ ID NO: 115970 - RNA, 22 nt, Leptospira interrogans serovar lai str. 56601
uucaagaaaugagacgcuuuaa

SEQ ID NO: 115971 - RNA, 21 nt, Leptospira interrogans serovar lai str. 56601
agaguucauaucuucggaggu

SEQ ID NO: 115972 - RNA, 22 nt, Leptospira interrogans serovar lai str. 56601
ucacgaauuucuugaaauuggu

SEQ ID NO: 115973 - RNA, 22 nt, Leptospira interrogans serovar lai str. 56601
uuccagaagguuauuucugcga

SEQ ID NO: 115974 - RNA, 22 nt, Leptospira interrogans serovar lai str. 56601
aaguucuucagagguuuucccu

SEQ ID NO: 115975 - RNA, 22 nt, Leptospira interrogans serovar lai str. 56601
aaggaucagaaacuauaguuug

SEQ ID NO: 115976 - RNA, 23 nt, Leptospira interrogans serovar lai str. 56601
acgaacucaauucuaccauugga

SEQ ID NO: 115977 - RNA, 22 nt, Leptospira interrogans serovar lai str. 56601
aaauucucuuucgguagaagug

SEQ ID NO: 115978 - RNA, 22 nt, Leptospira interrogans serovar lai str. 56601
uggaaguaggucuagguuauau

SEQ ID NO: 115979 - RNA, 22 nt, Leptospira interrogans serovar lai str. 56601
aaacucagggcuucuuuguuuc

SEQ ID NO: 115980 - RNA, 22 nt, Leptospira interrogans serovar lai str. 56601
cucgaagaagaggguucaauug

SEQ ID NO: 115981 - RNA, 22 nt, Leptospira interrogans serovar lai str. 56601
agaucgaauggaauuuuauauu

SEQ ID NO: 115982 - RNA, 22 nt, Leptospira interrogans serovar lai str. 56601
acauugacaaaguuuuucaaag

SEQ ID NO: 115983 - RNA, 23 nt, Leptospira interrogans serovar lai str. 56601
gaugcaauuuauauagaagcagc

SEQ ID NO: 115984 - RNA, 22 nt, Leptospira interrogans serovar lai str. 56601
gucguugaaaaauuccauaguu

SEQ ID NO: 115985 - RNA, 22 nt, Leptospira interrogans serovar lai str. 56601
augaacuuuugggaaauuuguu

SEQ ID NO: 115986 - RNA, 22 nt, Leptospira interrogans serovar lai str. 56601
aagcauuuccugcacuuuuaga

SEQ ID NO: 115987 - RNA, 22 nt, Leptospira interrogans serovar lai str. 56601
uaucaaaguaagaaauuucuuc

SEQ ID NO: 115988 - RNA, 22 nt, Leptospira interrogans serovar lai str. 56601
agagcgaucaaucugccaccgg

SEQ ID NO: 115989 - RNA, 22 nt, Leptospira interrogans serovar lai str. 56601
aacgucgacuuguuuucaaaau

SEQ ID NO: 115990 - RNA, 22 nt, Leptospira interrogans serovar lai str. 56601
cuggaauugaaagugauuugaa

SEQ ID NO: 115991 - RNA, 22 nt, Leptospira interrogans serovar lai str. 56601
auuucgucaaagacgaauucua

SEQ ID NO: 115992 - RNA, 22 nt, Leptospira interrogans serovar lai str. 56601
agaaauugauagaauccugaac

SEQ ID NO: 115993 - RNA, 22 nt, Leptospira interrogans serovar lai str. 56601
gaccauggauucuacgaucgga

SEQ ID NO: 115994 - RNA, 22 nt, Leptospira interrogans serovar lai str. 56601
uuaggacgauucaagauuggaa

SEQ ID NO: 115995 - RNA, 22 nt, Leptospira interrogans serovar lai str. 56601
ucaaguuauuguguuuuguagg

SEQ ID NO: 115996 - RNA, 19 nt, Leptospira interrogans serovar lai str. 56601
cggauugagucuuuguauu

SEQ ID NO: 115997 - RNA, 22 nt, Leptospira interrogans serovar lai str. 56601
aaagacuuaacccuucggaaga

SEQ ID NO: 115998 - RNA, 22 nt, Leptospira interrogans serovar lai str. 56601
aaauucagucugagcuuaacuu

SEQ ID NO: 115999 - RNA, 22 nt, Leptospira interrogans serovar lai str. 56601
uagauggaacuuuuaaucauga

SEQ ID NO: 116000 - RNA, 22 nt, Leptospira interrogans serovar lai str. 56601
uuuccgaagaagagaacuuuag

SEQ ID NO: 116001 - RNA, 22 nt, Leptospira interrogans serovar lai str. 56601
ugucuuuaguuacaauuuagaa

SEQ ID NO: 116002 - RNA, 22 nt, Leptospira interrogans serovar lai str. 56601
acucagcgaacgucucuaugga

SEQ ID NO: 116003 - RNA, 22 nt, Leptospira interrogans serovar lai str. 56601
uugauucggaucuugaaaaaaa

SEQ ID NO: 116004 - RNA, 22 nt, Leptospira interrogans serovar lai str. 56601
cagcaguaagaaaaauuuugga

SEQ ID NO: 116005 - RNA, 22 nt, Leptospira interrogans serovar lai str. 56601
cuucgggaagagucaguucuuu

SEQ ID NO: 116006 - RNA, 22 nt, Leptospira interrogans serovar lai str. 56601
aauugcaaaaccucaaaaggua

SEQ ID NO: 116007 - RNA, 22 nt, Leptospira interrogans serovar lai str. 56601
uuugaaucguauuuacuggauc

SEQ ID NO: 116008 - RNA, 22 nt, Leptospira interrogans serovar lai str. 56601
uucaaucugaaguggagcguua

SEQ ID NO: 116009 - RNA, 18 nt, Leptospira interrogans serovar lai str. 56601
ugaguucgacguaaggaa

SEQ ID NO: 116010 - RNA, 20 nt, Leptospira interrogans serovar lai str. 56601
ugcaaauucaaaaggucgca

SEQ ID NO: 116011 - RNA, 22 nt, Leptospira interrogans serovar lai str. 56601
gacaaguuagaucgaauucgaa

SEQ ID NO: 116012 - RNA, 22 nt, Leptospira interrogans serovar lai str. 56601
aaggaauccgaaauaucgauuu

SEQ ID NO: 116013 - RNA, 22 nt, Leptospira interrogans serovar lai str. 56601
uuuacguucucuaacucuuuca

SEQ ID NO: 116014 - RNA, 22 nt, Leptospira interrogans serovar lai str. 56601
aaaguaacugguuuaccuucug

SEQ ID NO: 116015 - RNA, 22 nt, Leptospira interrogans serovar lai str. 56601
gauccgaauuuggauacguuuc

SEQ ID NO: 116016 - RNA, 22 nt, Leptospira interrogans serovar lai str. 56601
agguuuaauacguuuucuuugc

SEQ ID NO: 116017 - RNA, 22 nt, Leptospira interrogans serovar lai str. 56601
uggaacuuuccgauagacgucu

SEQ ID NO: 116018 - RNA, 22 nt, Leptospira interrogans serovar lai str. 56601
ucuucaauuuuugcuuuaggga

SEQ ID NO: 116019 - RNA, 22 nt, Leptospira interrogans serovar lai str. 56601
uucagagagccaagugcgaaga

SEQ ID NO: 116020 - RNA, 22 nt, Leptospira interrogans serovar lai str. 56601
ucuccggagaucaaaguauuuu

SEQ ID NO: 116021 - RNA, 22 nt, Leptospira interrogans serovar lai str. 56601
aucgauauuccuuuccggcuuc

SEQ ID NO: 116022 - RNA, 22 nt, Leptospira interrogans serovar lai str. 56601
gaauagauucaaucgaaaguuc

SEQ ID NO: 116023 - RNA, 22 nt, Leptospira interrogans serovar lai str. 56601
gaaccagauacggcuuuuaguu

SEQ ID NO: 116024 - RNA, 22 nt, Leptospira interrogans serovar lai str. 56601
aagauguagagcguuuuuccag

SEQ ID NO: 116025 - RNA, 22 nt, Leptospira interrogans serovar lai str. 56601
auuuggaucggcuugcacuuag

SEQ ID NO: 116026 - RNA, 22 nt, Leptospira interrogans serovar lai str. 56601
uucgucuagcuuucucucaguu

SEQ ID NO: 116027 - RNA, 22 nt, Leptospira interrogans serovar lai str. 56601
uuggaaguagaacucuucaacc

SEQ ID NO: 116028 - RNA, 22 nt, Leptospira interrogans serovar lai str. 56601
uaggaauucuuagcaaaccguu

SEQ ID NO: 116029 - RNA, 22 nt, Leptospira interrogans serovar lai str. 56601
aauucgacccguaaaaauacgu

SEQ ID NO: 116030 - RNA, 22 nt, Leptospira interrogans serovar lai str. 56601
ggaucaguauugauucucaaga

SEQ ID NO: 116031 - RNA, 22 nt, Leptospira interrogans serovar lai str. 56601
ugcggaaguuucugaaauuucu

SEQ ID NO: 116032 - RNA, 22 nt, Leptospira interrogans serovar lai str. 56601
uuugaagugguucuugaaaagu

SEQ ID NO: 116033 - RNA, 21 nt, Leptospira interrogans serovar lai str. 56601
uuguagcuaacuugaaaguag

SEQ ID NO: 116034 - RNA, 22 nt, Leptospira interrogans serovar lai str. 56601
agaauaugagauccuuuuaaaa

SEQ ID NO: 116035 - RNA, 20 nt, Leptospira interrogans serovar lai str. 56601
accuuucaaaucgaagagcc

SEQ ID NO: 116036 - RNA, 22 nt, Leptospira interrogans serovar lai str. 56601
cuaugaaaaggacgaauggaua

SEQ ID NO: 116037 - RNA, 22 nt, Leptospira interrogans serovar lai str. 56601
ugacaaagaugucagcaaacaa

SEQ ID NO: 116038 - RNA, 22 nt, Leptospira interrogans serovar lai str. 56601
cuaaaguuuuuugccaauucau

SEQ ID NO: 116039 - RNA, 22 nt, Leptospira interrogans serovar lai str. 56601
uacucagcaaucgcuagagguu

SEQ ID NO: 116040 - RNA, 22 nt, Leptospira interrogans serovar lai str. 56601
uucuuugagguuuugggcaagc

SEQ ID NO: 116041 - RNA, 22 nt, Leptospira interrogans serovar lai str. 56601
aacgaugggaggaaacauaucc

SEQ ID NO: 116042 - RNA, 22 nt, Leptospira interrogans serovar lai str. 56601
caggaucuucguaaggaacuug

SEQ ID NO: 116043 - RNA, 22 nt, Leptospira interrogans serovar lai str. 56601
cucauacaaaaacuacaauguu

SEQ ID NO: 116044 - RNA, 22 nt, Leptospira interrogans serovar lai str. 56601
ugcucuaaaauucuucuagaau

SEQ ID NO: 116045 - RNA, 22 nt, Leptospira interrogans serovar lai str. 56601
agaaugcugucugcuugcucuc

SEQ ID NO: 116046 - RNA, 22 nt, Leptospira interrogans serovar lai str. 56601
aaucggaagcggaggaaucgua

SEQ ID NO: 116047 - RNA, 22 nt, Leptospira interrogans serovar lai str. 56601
cuugaguucucgaacggaaaau

SEQ ID NO: 116048 - RNA, 22 nt, Leptospira interrogans serovar lai str. 56601
gucaaguuauuggcaaccuagg

SEQ ID NO: 116049 - RNA, 22 nt, Leptospira interrogans serovar lai str. 56601
gaaccagugacugacuuagauu

SEQ ID NO: 116050 - RNA, 22 nt, Leptospira interrogans serovar lai str. 56601
uuacaguugucgcagacuguuu

SEQ ID NO: 116051 - RNA, 22 nt, Leptospira interrogans serovar lai str. 56601
aauuacacaagagauuuugauu

SEQ ID NO: 116052 - RNA, 22 nt, Leptospira interrogans serovar lai str. 56601
uuuggcaaagguuaggaacuuc

SEQ ID NO: 116053 - RNA, 20 nt, Leptospira interrogans serovar lai str. 56601
ccaacauugcaggaauauug

SEQ ID NO: 116054 - RNA, 22 nt, Leptospira interrogans serovar lai str. 56601
ucugaaagacgucuaacgucuu

SEQ ID NO: 116055 - RNA, 22 nt, Leptospira interrogans serovar lai str. 56601
cagaauuuuugcgcauaaauuu

SEQ ID NO: 116056 - RNA, 22 nt, Leptospira interrogans serovar lai str. 56601
gauuucuauggaucacguuuua

SEQ ID NO: 116057 - RNA, 22 nt, Leptospira interrogans serovar lai str. 56601
ucgcgaucgauuacgagaggau

SEQ ID NO: 116058 - RNA, 22 nt, Leptospira interrogans serovar lai str. 56601
gucuaaaugcgaaguaugcgga

SEQ ID NO: 116059 - RNA, 22 nt, Leptospira interrogans serovar lai str. 56601
auuucaacacggagaguuugau

SEQ ID NO: 116060 - RNA, 21 nt, Leptospira interrogans serovar lai str. 56601
uagaucaauaggaaagaauuu

SEQ ID NO: 116061 - RNA, 22 nt, Leptospira interrogans serovar lai str. 56601
ggaacuguauaugaaaucgguu

SEQ ID NO: 116062 - RNA, 22 nt, Leptospira interrogans serovar lai str. 56601
uaaagaacauauuagagcggau

SEQ ID NO: 116063 - RNA, 22 nt, Leptospira interrogans serovar lai str. 56601
gaugaacaaauugaauuuagga

SEQ ID NO: 116064 - RNA, 22 nt, Leptospira interrogans serovar lai str. 56601
gauggauuuagagcgcucuuac

SEQ ID NO: 116065 - RNA, 22 nt, Leptospira interrogans serovar lai str. 56601
auucccauaaauacaacguuag

SEQ ID NO: 116066 - RNA, 22 nt, Leptospira interrogans serovar lai str. 56601
aucauagaauagggaauuggac

SEQ ID NO: 116067 - RNA, 22 nt, Leptospira interrogans serovar lai str. 56601
aaauuccagauucuucugcaua

SEQ ID NO: 116068 - RNA, 22 nt, Leptospira interrogans serovar lai str. 56601
agauuagacaacauaagaauuu

SEQ ID NO: 116069 - RNA, 22 nt, Leptospira interrogans serovar lai str. 56601
cugcgucuauugcagaaugaga

SEQ ID NO: 116070 - RNA, 20 nt, Leptospira interrogans serovar lai str. 56601
auccgaguuagauucaaaac

SEQ ID NO: 116071 - RNA, 22 nt, Leptospira interrogans serovar lai str. 56601
cuggcaauuagucuugaaaauu

SEQ ID NO: 116072 - RNA, 22 nt, Leptospira interrogans serovar lai str. 56601
aguauagauucacauucaaagc

SEQ ID NO: 116073 - RNA, 20 nt, Leptospira interrogans serovar lai str. 56601
ucugauucugguuuuagagc

SEQ ID NO: 116074 - RNA, 22 nt, Leptospira interrogans serovar lai str. 56601
ucugucggaauuacgacaaagc

SEQ ID NO: 116075 - RNA, 22 nt, Leptospira interrogans serovar lai str. 56601
aagaaaucugaauuugauuugg

SEQ ID NO: 116076 - RNA, 22 nt, Leptospira interrogans serovar lai str. 56601
uaucuagauauuugcaaacuuu

SEQ ID NO: 116077 - RNA, 22 nt, Leptospira interrogans serovar lai str. 56601
uuuggaauuucacaauaacuug

SEQ ID NO: 116078 - RNA, 22 nt, Leptospira interrogans serovar lai str. 56601
aaguuagaauaugacgguaaga

SEQ ID NO: 116079 - RNA, 22 nt, Leptospira interrogans serovar lai str. 56601
uugcgauuguacgagagaauaa

SEQ ID NO: 116080 - RNA, 22 nt, Leptospira interrogans serovar lai str. 56601
ugaauacaauuuuuugaccaga

SEQ ID NO: 116081 - RNA, 22 nt, Leptospira interrogans serovar lai str. 56601
ugcagagcaaccauccauagaa

SEQ ID NO: 116082 - RNA, 22 nt, Leptospira interrogans serovar lai str. 56601
ugaagucuaagauacguaugau

SEQ ID NO: 116083 - RNA, 22 nt, Leptospira interrogans serovar lai str. 56601
agaugcaaguucuuuaaauucu

SEQ ID NO: 116084 - RNA, 22 nt, Leptospira interrogans serovar lai str. 56601
auccgguuugacguuucauagc

SEQ ID NO: 116085 - RNA, 22 nt, Leptospira interrogans serovar lai str. 56601
agugaucgaucaauuuguugau

SEQ ID NO: 116086 - RNA, 22 nt, Leptospira interrogans serovar lai str. 56601
uuucacaaaaugugggaacuac

SEQ ID NO: 116087 - RNA, 22 nt, Leptospira interrogans serovar lai str. 56601
aaaugguagaucgacuuagauc

SEQ ID NO: 116088 - RNA, 21 nt, Leptospira interrogans serovar lai str. 56601
aucaggaaaugcaaaaggauc

SEQ ID NO: 116089 - RNA, 17 nt, Leptospira interrogans serovar lai str. 56601
gacuuuaauagguugag

SEQ ID NO: 116090 - RNA, 21 nt, Leptospira interrogans serovar lai str. 56601
uuccggguugauuucuauaag

SEQ ID NO: 116091 - RNA, 22 nt, Leptospira interrogans serovar lai str. 56601
ccacaagguucuacuuccaauc

SEQ ID NO: 116092 - RNA, 22 nt, Leptospira interrogans serovar lai str. 56601
uacucucaauagaccucuacaa

SEQ ID NO: 116093 - RNA, 22 nt, Leptospira interrogans serovar lai str. 56601
ucucauugcacucaguuuguug

SEQ ID NO: 116094 - RNA, 22 nt, Leptospira interrogans serovar lai str. 56601
gaggaguuaaucauauaacuuu

SEQ ID NO: 116095 - RNA, 22 nt, Leptospira interrogans serovar lai str. 56601
aaggcgauucuuuccgauuggg

SEQ ID NO: 116096 - RNA, 22 nt, Leptospira interrogans serovar lai str. 56601
aucuucauuagagauauacgag

SEQ ID NO: 116097 - RNA, 22 nt, Leptospira interrogans serovar lai str. 56601
ggauuguaucaaguaagacuaa

SEQ ID NO: 116098 - RNA, 23 nt, Leptospira interrogans serovar lai str. 56601
uccguagaaaaaguuucaaguga

SEQ ID NO: 116099 - RNA, 22 nt, Leptospira interrogans serovar lai str. 56601
uaaaccgaagugaauuagaaug

SEQ ID NO: 116100 - RNA, 21 nt, Leptospira interrogans serovar lai str. 56601
uggaaacuacggaaugugugg

SEQ ID NO: 116101 - RNA, 22 nt, Leptospira interrogans serovar lai str. 56601
auggauucguauuuuucuagga

SEQ ID NO: 116102 - RNA, 22 nt, Leptospira interrogans serovar lai str. 56601
auaacucuuggaaaacgaucaa

SEQ ID NO: 116103 - RNA, 22 nt, Leptospira interrogans serovar lai str. 56601
uggaauuuuacaauaacuugac

SEQ ID NO: 116104 - RNA, 22 nt, Leptospira interrogans serovar lai str. 56601
aaagcucaaauuagauuguaaa

SEQ ID NO: 116105 - RNA, 22 nt, Leptospira interrogans serovar lai str. 56601
agaguugagaucaaaaaacuuc

SEQ ID NO: 116106 - RNA, 22 nt, Leptospira interrogans serovar lai str. 56601
auuccuaagaugaaauuggacg

SEQ ID NO: 116107 - RNA, 22 nt, Leptospira interrogans serovar lai str. 56601
gaggaguuucguugcaaagaua

SEQ ID NO: 116108 - RNA, 22 nt, Leptospira interrogans serovar lai str. 56601
aaucuucuaaaaggaggaaucu

SEQ ID NO: 116109 - RNA, 22 nt, Leptospira interrogans serovar lai str. 56601
aacauucuauccaauacgcaaa

SEQ ID NO: 116110 - RNA, 22 nt, Leptospira interrogans serovar lai str. 56601
uccuuuaaaauuaaccacucga

SEQ ID NO: 116111 - RNA, 22 nt, Leptospira interrogans serovar lai str. 56601
uuccggaugcgguauuuauaga

SEQ ID NO: 116112 - RNA, 22 nt, Leptospira interrogans serovar lai str. 56601
uuuaagagauuuaaacguaggu

SEQ ID NO: 116113 - RNA, 22 nt, Leptospira interrogans serovar lai str. 56601
agcauucaccgcugaguuuucc

SEQ ID NO: 116114 - RNA, 22 nt, Leptospira interrogans serovar lai str. 56601
uauacaguaacccuucaaguaa

SEQ ID NO: 116115 - RNA, 22 nt, Leptospira interrogans serovar lai str. 56601
uagagauuaugucuauuuuagg

SEQ ID NO: 116116 - RNA, 22 nt, Leptospira interrogans serovar lai str. 56601
agaauccuacacuaaaauuauu

SEQ ID NO: 116117 - RNA, 22 nt, Leptospira interrogans serovar lai str. 56601
uuccgaaacgguuuacgcuaac

SEQ ID NO: 116118 - RNA, 22 nt, Leptospira interrogans serovar lai str. 56601
aacccuuuuaccuucaauuugg

SEQ ID NO: 116119 - RNA, 21 nt, Leptospira interrogans serovar lai str. 56601
uuuaugacagguucuuacuuu

SEQ ID NO: 116120 - RNA, 22 nt, Leptospira interrogans serovar lai str. 56601
aaguuuggaauugugggaacuc

SEQ ID NO: 116121 - RNA, 22 nt, Leptospira interrogans serovar lai str. 56601
ugcuuugauauccaacauagga

SEQ ID NO: 116122 - RNA, 22 nt, Leptospira interrogans serovar lai str. 56601
ucaaguucaaguacuuucugca

SEQ ID NO: 116123 - RNA, 22 nt, Leptospira interrogans serovar lai str. 56601
aauugcaagauugguuaguucu

SEQ ID NO: 116124 - RNA, 22 nt, Leptospira interrogans serovar lai str. 56601
uucaagcucuaguagaaaaaau

SEQ ID NO: 116125 - RNA, 22 nt, Leptospira interrogans serovar lai str. 56601
augcaguuccacguuuugauuu

SEQ ID NO: 116126 - RNA, 22 nt, Leptospira interrogans serovar lai str. 56601
aacgcuuuccuaugggucgcgu

SEQ ID NO: 116127 - RNA, 22 nt, Leptospira interrogans serovar lai str. 56601
auggaauuacgaaaucguuuuu

SEQ ID NO: 116128 - RNA, 22 nt, Leptospira interrogans serovar lai str. 56601
aaaguuucucccggagguguuc

SEQ ID NO: 116129 - RNA, 22 nt, Leptospira interrogans serovar lai str. 56601
ucguaagauugugcgagaugau

SEQ ID NO: 116130 - RNA, 22 nt, Leptospira interrogans serovar lai str. 56601
ucuaguuuggauuuauuucaga

SEQ ID NO: 116131 - RNA, 20 nt, Leptospira interrogans serovar lai str. 56601
uuugaagaauaggagcgauu

SEQ ID NO: 116132 - RNA, 22 nt, Leptospira interrogans serovar lai str. 56601
caucauggucguugccggugga

SEQ ID NO: 116133 - RNA, 22 nt, Leptospira interrogans serovar lai str. 56601
uugucaagucgucuguaaguuu

SEQ ID NO: 116134 - RNA, 22 nt, Leptospira interrogans serovar lai str. 56601
uagcuguugaucgauuccuuuu

SEQ ID NO: 116135 - RNA, 22 nt, Leptospira interrogans serovar lai str. 56601
uaccgaagauaauccuuuagga

SEQ ID NO: 116136 - RNA, 22 nt, Leptospira interrogans serovar lai str. 56601
cgaaucaaauguucuacuucag

SEQ ID NO: 116137 - RNA, 22 nt, Leptospira interrogans serovar lai str. 56601
ugcauuuguggacauuagaaga

SEQ ID NO: 116138 - RNA, 22 nt, Leptospira interrogans serovar lai str. 56601
caaaggauacgcgcucaucuua

SEQ ID NO: 116139 - RNA, 22 nt, Leptospira interrogans serovar lai str. 56601
auucuaguuuucaauaacuuga

SEQ ID NO: 116140 - RNA, 22 nt, Leptospira interrogans serovar lai str. 56601
aaguaugagaacuuuugaaaua

SEQ ID NO: 116141 - RNA, 22 nt, Leptospira interrogans serovar lai str. 56601
cuuuggaucuaaaucggaagca

SEQ ID NO: 116142 - RNA, 22 nt, Leptospira interrogans serovar lai str. 56601
uucaggaaaaauguuugcuggu

SEQ ID NO: 116143 - RNA, 22 nt, Leptospira interrogans serovar lai str. 56601
cucaagaacaaucuuuucuuaa

SEQ ID NO: 116144 - RNA, 22 nt, Leptospira interrogans serovar lai str. 56601
ugcaaacucuaguauucuauuu

SEQ ID NO: 116145 - RNA, 22 nt, Leptospira interrogans serovar lai str. 56601
uugggcaguaguaaaauugaua

SEQ ID NO: 116146 - RNA, 22 nt, Leptospira interrogans serovar lai str. 56601
guuuggaaacucgccuuggccc

SEQ ID NO: 116147 - RNA, 22 nt, Leptospira interrogans serovar lai str. 56601
agacauucagagcguggaauau

SEQ ID NO: 116148 - RNA, 22 nt, Leptospira interrogans serovar lai str. 56601
gcgguuccuauguuaguuagaa

SEQ ID NO: 116149 - RNA, 22 nt, Leptospira interrogans serovar lai str. 56601
uugaaguuccacgaguuguuuu

SEQ ID NO: 116150 - RNA, 20 nt, Leptospira interrogans serovar lai str. 56601
ggaguuccaacuuauuuagu

SEQ ID NO: 116151 - RNA, 22 nt, Leptospira interrogans serovar lai str. 56601
cauuucguagagauuaucuaca

SEQ ID NO: 116152 - RNA, 20 nt, Leptospira interrogans serovar lai str. 56601
uugcaguuuuugaaccuucu

SEQ ID NO: 116153 - RNA, 22 nt, Leptospira interrogans serovar lai str. 56601
ucuguuauauuucaaguguggg

SEQ ID NO: 116154 - RNA, 22 nt, Leptospira interrogans serovar lai str. 56601
aggucaaguuauugguauuuua

SEQ ID NO: 116155 - RNA, 22 nt, Leptospira interrogans serovar lai str. 56601
aacgaucucuuaaaacuucuua

SEQ ID NO: 116156 - RNA, 22 nt, Leptospira interrogans serovar lai str. 56601
uggagaaugaaaucaagaauuu

SEQ ID NO: 116157 - RNA, 22 nt, Leptospira interrogans serovar lai str. 56601
aauguugacgguuuuuguagga

SEQ ID NO: 116158 - RNA, 22 nt, Leptospira interrogans serovar lai str. 56601
gucggaacaauugauuucguuu

SEQ ID NO: 116159 - RNA, 22 nt, Leptospira interrogans serovar lai str. 56601
gagcuacucuggauuauuauua

SEQ ID NO: 116160 - RNA, 22 nt, Leptospira interrogans serovar lai str. 56601
aaacuugcagaauuuacggcua

SEQ ID NO: 116161 - RNA, 22 nt, Leptospira interrogans serovar lai str. 56601
acugaaaucaaaagagaaccua

SEQ ID NO: 116162 - RNA, 21 nt, Leptospira interrogans serovar lai str. 56601
caaucgaaauucuuuuugaga

SEQ ID NO: 116163 - RNA, 22 nt, Leptospira interrogans serovar lai str. 56601
aaccugcauuuuuaauuuggua

SEQ ID NO: 116164 - RNA, 22 nt, Leptospira interrogans serovar lai str. 56601
ucgaaauaucuggaugcgauuu

SEQ ID NO: 116165 - RNA, 22 nt, Leptospira interrogans serovar lai str. 56601
aaugaucauccgacuugcaaaa

SEQ ID NO: 116166 - RNA, 22 nt, Leptospira interrogans serovar lai str. 56601
ucucauaccguuuaucuugcaa

SEQ ID NO: 116167 - RNA, 22 nt, Leptospira interrogans serovar lai str. 56601
uugaaagauucuugggcaagag

SEQ ID NO: 116168 - RNA, 22 nt, Leptospira interrogans serovar lai str. 56601
acguuuccggaagaauaaucua

SEQ ID NO: 116169 - RNA, 22 nt, Leptospira interrogans serovar lai str. 56601
guuccuauuucuguuggcucuu

SEQ ID NO: 116170 - RNA, 22 nt, Leptospira interrogans serovar lai str. 56601
acgcgugauaaguagacauauu

SEQ ID NO: 116171 - RNA, 22 nt, Leptospira interrogans serovar lai str. 56601
ugucuuagaauuuaugauacuu

SEQ ID NO: 116172 - RNA, 22 nt, Leptospira interrogans serovar lai str. 56601
uaaacguaaguguauccgguag

SEQ ID NO: 116173 - RNA, 22 nt, Leptospira interrogans serovar lai str. 56601
aucuggacuuuacagaucgauu

SEQ ID NO: 116174 - RNA, 22 nt, Leptospira interrogans serovar lai str. 56601
auguuccaucuuuaaauuagga

SEQ ID NO: 116175 - RNA, 22 nt, Leptospira interrogans serovar lai str. 56601
gacgauuuuaaaucccucauua

SEQ ID NO: 116176 - RNA, 22 nt, Leptospira interrogans serovar lai str. 56601
cuggaauuccuuugguguagac

SEQ ID NO: 116177 - RNA, 21 nt, Leptospira interrogans serovar lai str. 56601
cguauucucuuagaagaauuu

SEQ ID NO: 116178 - RNA, 22 nt, Leptospira interrogans serovar lai str. 56601
aaucgggauuuuacauauggua

SEQ ID NO: 116179 - RNA, 22 nt, Leptospira interrogans serovar lai str. 56601
acucaaugcugcuucucuacag

SEQ ID NO: 116180 - RNA, 22 nt, Leptospira interrogans serovar lai str. 56601
auccuuuaaaaauggcauucca

SEQ ID NO: 116181 - RNA, 22 nt, Leptospira interrogans serovar lai str. 56601
guaaucaaaucguuuugaacug

SEQ ID NO: 116182 - RNA, 18 nt, Leptospira interrogans serovar lai str. 56601
ccagaguucuaauugcug

SEQ ID NO: 116183 - RNA, 22 nt, Leptospira interrogans serovar lai str. 56601
ggacucgaugcaauuuuaaaga

SEQ ID NO: 116184 - RNA, 22 nt, Leptospira interrogans serovar lai str. 56601
ucgauuguuaagcgaagaggaa

SEQ ID NO: 116185 - RNA, 19 nt, Leptospira interrogans serovar lai str. 56601
cgacuguuuauaauacucu

SEQ ID NO: 116186 - RNA, 22 nt, Leptospira interrogans serovar lai str. 56601
uucgaauugaacuaugaagguu

SEQ ID NO: 116187 - RNA, 22 nt, Leptospira interrogans serovar lai str. 56601
uuuacuuggagcuucuuuggaa

SEQ ID NO: 116188 - RNA, 22 nt, Leptospira interrogans serovar lai str. 56601
ucggaagagauuuuaauucuuu

SEQ ID NO: 116189 - RNA, 22 nt, Leptospira interrogans serovar lai str. 56601
ggacguuuggauguuuccaucg

SEQ ID NO: 116190 - RNA, 22 nt, Leptospira interrogans serovar lai str. 56601
cacguuaugcucccuuuuagac

SEQ ID NO: 116191 - RNA, 22 nt, Leptospira interrogans serovar lai str. 56601
ugggaacuagagucuugguuuc

SEQ ID NO: 116192 - RNA, 22 nt, Leptospira interrogans serovar lai str. 56601
gacuuagaaugaacuauuuaaa

SEQ ID NO: 116193 - RNA, 22 nt, Leptospira interrogans serovar lai str. 56601
uaagacgagaacuuggauuuuu

SEQ ID NO: 116194 - RNA, 23 nt, Leptospira interrogans serovar lai str. 56601
uaccggaaaauguuggugauucc

SEQ ID NO: 116195 - RNA, 22 nt, Leptospira interrogans serovar lai str. 56601
aaaugcagccguagaauaaggu

SEQ ID NO: 116196 - RNA, 22 nt, Leptospira interrogans serovar lai str. 56601
augauucuuguuuugggaacca

SEQ ID NO: 116197 - RNA, 22 nt, Leptospira interrogans serovar lai str. 56601
uuucuaacuuuacucaaucaag

SEQ ID NO: 116198 - RNA, 22 nt, Leptospira interrogans serovar lai str. 56601
uucuuacaaaacuuuguauuga

SEQ ID NO: 116199 - RNA, 22 nt, Leptospira interrogans serovar lai str. 56601
ggaauaucgggauguuuggauc

SEQ ID NO: 116200 - RNA, 22 nt, Leptospira interrogans serovar lai str. 56601
gagaauccaagaaucgguuuau

SEQ ID NO: 116201 - RNA, 22 nt, Leptospira interrogans serovar lai str. 56601
agauucuuauguuguuugauaa

SEQ ID NO: 116202 - RNA, 22 nt, Leptospira interrogans serovar lai str. 56601
gauucugacucuuuuucuggau

SEQ ID NO: 116203 - RNA, 22 nt, Leptospira interrogans serovar lai str. 56601
uacaaguucuggaggacuugcu

SEQ ID NO: 116204 - RNA, 22 nt, Leptospira interrogans serovar lai str. 56601
uuagauggaaagauucuuuguu

SEQ ID NO: 116205 - RNA, 22 nt, Leptospira interrogans serovar lai str. 56601
aauaguacaucagaagaacguc

SEQ ID NO: 116206 - RNA, 22 nt, Leptospira interrogans serovar lai str. 56601
cacguugaaauaauuaugaagu

SEQ ID NO: 116207 - RNA, 22 nt, Leptospira interrogans serovar lai str. 56601
ccgauaugauaagaaaauuuua

SEQ ID NO: 116208 - RNA, 22 nt, Leptospira interrogans serovar lai str. 56601
uuagaguuguuccagaauccca

SEQ ID NO: 116209 - RNA, 22 nt, Leptospira interrogans serovar lai str. 56601
aaguccuaauuuuugaauugau

SEQ ID NO: 116210 - RNA, 22 nt, Leptospira interrogans serovar lai str. 56601
auuggaaauuaggauugacagg

SEQ ID NO: 116211 - RNA, 22 nt, Leptospira interrogans serovar lai str. 56601
uuccgaguacgauauccugagu

SEQ ID NO: 116212 - RNA, 22 nt, Leptospira interrogans serovar lai str. 56601
uuacagaaaaaucagauuuuac

SEQ ID NO: 116213 - RNA, 22 nt, Leptospira interrogans serovar lai str. 56601
aaucugcuuuuuggaagacuca

SEQ ID NO: 116214 - RNA, 22 nt, Leptospira interrogans serovar lai str. 56601
ucgaauuagaaggguacuuucu

SEQ ID NO: 116215 - RNA, 22 nt, Leptospira interrogans serovar lai str. 56601
uuacagaagaagauucuucuac

SEQ ID NO: 116216 - RNA, 22 nt, Leptospira interrogans serovar lai str. 56601
ucaaagcggaaugugaagcgga

SEQ ID NO: 116217 - RNA, 22 nt, Leptospira interrogans serovar lai str. 56601
ucuucagaaugauuauuugcuu

SEQ ID NO: 116218 - RNA, 22 nt, Leptospira interrogans serovar lai str. 56601
aucgauuuaucugggguuuugu

SEQ ID NO: 116219 - RNA, 17 nt, Leptospira interrogans serovar lai str. 56601
ugggaacaaugcaaucc

SEQ ID NO: 116220 - RNA, 22 nt, Leptospira interrogans serovar lai str. 56601
uucagcuuauaaaagucguucg

SEQ ID NO: 116221 - RNA, 22 nt, Leptospira interrogans serovar lai str. 56601
ccuguaaauucggcguuucaau

SEQ ID NO: 116222 - RNA, 21 nt, Leptospira interrogans serovar lai str. 56601
auggaaguauuuaaacgauuu

SEQ ID NO: 116223 - RNA, 23 nt, Leptospira interrogans serovar lai str. 56601
uuagacgacuuggucgaucuucc

SEQ ID NO: 116224 - RNA, 22 nt, Leptospira interrogans serovar lai str. 56601
uagguucucuuuugauuucagu

SEQ ID NO: 116225 - RNA, 22 nt, Leptospira interrogans serovar lai str. 56601
ucagauuucucaaaacaagaaa

SEQ ID NO: 116226 - RNA, 22 nt, Leptospira interrogans serovar lai str. 56601
ucaaacggcgguucuugcuucu

SEQ ID NO: 116227 - RNA, 22 nt, Leptospira interrogans serovar lai str. 56601
guaggauuuuacgagcuucuug

SEQ ID NO: 116228 - RNA, 22 nt, Leptospira interrogans serovar lai str. 56601
aacucaguaucucuuuucuaug

SEQ ID NO: 116229 - RNA, 22 nt, Leptospira interrogans serovar lai str. 56601
aguugguaggagauuauucuga

SEQ ID NO: 116230 - RNA, 22 nt, Leptospira interrogans serovar lai str. 56601
gauacaaagauuacaauuucgu

SEQ ID NO: 116231 - RNA, 22 nt, Leptospira interrogans serovar lai str. 56601
uuugacagccagaaugauaaau

SEQ ID NO: 116232 - RNA, 22 nt, Leptospira interrogans serovar lai str. 56601
gaaauacaauuuaccccugcua

SEQ ID NO: 116233 - RNA, 22 nt, Leptospira interrogans serovar lai str. 56601
uagcuuucuggaacgaaugaaa

SEQ ID NO: 116234 - RNA, 21 nt, Leptospira interrogans serovar lai str. 56601
gcugaguuuugugggucgcuc

SEQ ID NO: 116235 - RNA, 22 nt, Leptospira interrogans serovar lai str. 56601
cgauuggaaaguuaaucgcuuc

SEQ ID NO: 116236 - RNA, 22 nt, Leptospira interrogans serovar lai str. 56601
cuuucgguuggccuuguagucu

SEQ ID NO: 116237 - RNA, 22 nt, Leptospira interrogans serovar lai str. 56601
uaugagaaaaaugaaucgaucg

SEQ ID NO: 116238 - RNA, 22 nt, Leptospira interrogans serovar lai str. 56601
cuguagaugcuuguuuauuuuc

SEQ ID NO: 116239 - RNA, 22 nt, Leptospira interrogans serovar lai str. 56601
agguuuacgaacuuauuucugg

SEQ ID NO: 116240 - RNA, 22 nt, Leptospira interrogans serovar lai str. 56601
auucuucaaucgucucccgggc

SEQ ID NO: 116241 - RNA, 22 nt, Leptospira interrogans serovar lai str. 56601
ucguauuuuuuaaaguagaucg

SEQ ID NO: 116242 - RNA, 22 nt, Leptospira interrogans serovar lai str. 56601
guuccggacucugccaacauag

SEQ ID NO: 116243 - RNA, 22 nt, Leptospira interrogans serovar lai str. 56601
guggauucggaaucaggggauc

SEQ ID NO: 116244 - RNA, 22 nt, Leptospira interrogans serovar lai str. 56601
guaugaguuccuacaauuuuag

SEQ ID NO: 116245 - RNA, 23 nt, Leptospira interrogans serovar lai str. 56601
aauuucggacgcaaaaugaaucg

SEQ ID NO: 116246 - RNA, 22 nt, Leptospira interrogans serovar lai str. 56601
uccggaacuacgauuucuucug

SEQ ID NO: 116247 - RNA, 22 nt, Leptospira interrogans serovar lai str. 56601
auugaagaagaauuucuuuuag

SEQ ID NO: 116248 - RNA, 22 nt, Leptospira interrogans serovar lai str. 56601
auuccguucaugggagaaauuu

SEQ ID NO: 116249 - RNA, 22 nt, Leptospira interrogans serovar lai str. 56601
uggauaaagcuucugaaauaga

SEQ ID NO: 116250 - RNA, 22 nt, Leptospira interrogans serovar lai str. 56601
aagucuuuauaaaauaguauuu

SEQ ID NO: 116251 - RNA, 16 nt, Leptospira interrogans serovar lai str. 56601
gagauucuagaucuua

SEQ ID NO: 116252 - RNA, 22 nt, Leptospira interrogans serovar lai str. 56601
aucaaacucuccguguugaaau

SEQ ID NO: 116253 - RNA, 22 nt, Leptospira interrogans serovar lai str. 56601
aauugguuuuucucuaugcccu

SEQ ID NO: 116254 - RNA, 23 nt, Leptospira interrogans serovar lai str. 56601
uggaauuucacaauaacuugacc

SEQ ID NO: 116255 - RNA, 22 nt, Leptospira interrogans serovar lai str. 56601
aaacuugaaguguaguaguucc

SEQ ID NO: 116256 - RNA, 22 nt, Leptospira interrogans serovar lai str. 56601
auuguaggaacucccaugaaca

SEQ ID NO: 116257 - RNA, 22 nt, Leptospira interrogans serovar lai str. 56601
uuagaacuuauuuuuccgggac

SEQ ID NO: 116258 - RNA, 22 nt, Leptospira interrogans serovar lai str. 56601
aacauucuuuaauuguucugca

SEQ ID NO: 116259 - RNA, 22 nt, Leptospira interrogans serovar lai str. 56601
aagaaacuuacucaagaucgga

SEQ ID NO: 116260 - RNA, 22 nt, Leptospira interrogans serovar lai str. 56601
uaaucgaucgucuuguaucugg

SEQ ID NO: 116261 - RNA, 22 nt, Leptospira interrogans serovar lai str. 56601
aagcgauuacagauucucugau

SEQ ID NO: 116262 - RNA, 22 nt, Leptospira interrogans serovar lai str. 56601
aaucgaauacucaaaucgauga

SEQ ID NO: 116263 - RNA, 22 nt, Leptospira interrogans serovar lai str. 56601
guaguucccacauuuuagaguu

SEQ ID NO: 116264 - RNA, 22 nt, Leptospira interrogans serovar lai str. 56601
ucuaaagucaaagguaucgaau

SEQ ID NO: 116265 - RNA, 22 nt, Leptospira interrogans serovar lai str. 56601
uccggaaacgggagaaagaacg

SEQ ID NO: 116266 - RNA, 21 nt, Leptospira interrogans serovar lai str. 56601
uacuuuaccagaugaauuuca

SEQ ID NO: 116267 - RNA, 22 nt, Leptospira interrogans serovar lai str. 56601
uuugagaagucuucuaauuuaa

SEQ ID NO: 116268 - RNA, 23 nt, Leptospira interrogans serovar lai str. 56601
uugcacauugaaaguacucacuu

SEQ ID NO: 116269 - RNA, 22 nt, Leptospira interrogans serovar lai str. 56601
aacuggaacguuuuacugguaa

SEQ ID NO: 116270 - RNA, 22 nt, Leptospira interrogans serovar lai str. 56601
uaaaugugggaacucccacaau

SEQ ID NO: 116271 - RNA, 22 nt, Leptospira interrogans serovar lai str. 56601
caucaauuaugucaaaucucug

SEQ ID NO: 116272 - RNA, 22 nt, Leptospira interrogans serovar lai str. 56601
ucggauucuucuaaaagucgua

SEQ ID NO: 116273 - RNA, 22 nt, Leptospira interrogans serovar lai str. 56601
gaucgauuacaauuuggaaaua

SEQ ID NO: 116274 - RNA, 22 nt, Leptospira interrogans serovar lai str. 56601
guugggaauuuuacuucuucau

SEQ ID NO: 116275 - RNA, 22 nt, Leptospira interrogans serovar lai str. 56601
uggaagauuacaaacacuucgg

SEQ ID NO: 116276 - RNA, 22 nt, Leptospira interrogans serovar lai str. 56601
guggauaaauuuguuuggaauu

SEQ ID NO: 116277 - RNA, 22 nt, Leptospira interrogans serovar lai str. 56601
acaaucucaauccgaaacaagg

SEQ ID NO: 116278 - RNA, 22 nt, Leptospira interrogans serovar lai str. 56601
uggaaauuagaagaugauucug

SEQ ID NO: 116279 - RNA, 22 nt, Leptospira interrogans serovar lai str. 56601
caucuucgucaggaaacuucug

SEQ ID NO: 116280 - RNA, 22 nt, Leptospira interrogans serovar lai str. 56601
uuacaccagugguacaaaucaa

SEQ ID NO: 116281 - RNA, 22 nt, Leptospira interrogans serovar lai str. 56601
gucuauaucaaguccggaauca

SEQ ID NO: 116282 - RNA, 22 nt, Leptospira interrogans serovar lai str. 56601
acucguuuuacuuccaauuuga

SEQ ID NO: 116283 - RNA, 22 nt, Leptospira interrogans serovar lai str. 56601
cugagaauuuuuucagaaguca

SEQ ID NO: 116284 - RNA, 22 nt, Leptospira interrogans serovar lai str. 56601
uuaguggaugguuacguauuua

SEQ ID NO: 116285 - RNA, 22 nt, Leptospira interrogans serovar lai str. 56601
uccuacgguccacgcuuuuuga

SEQ ID NO: 116286 - RNA, 22 nt, Leptospira interrogans serovar lai str. 56601
cuuccauaggauuucuggaucg

SEQ ID NO: 116287 - RNA, 22 nt, Leptospira interrogans serovar lai str. 56601
ugagauuagauuuucgaaucga

SEQ ID NO: 116288 - RNA, 22 nt, Leptospira interrogans serovar lai str. 56601
agaucuguuuaucugugauucc

SEQ ID NO: 116289 - RNA, 22 nt, Leptospira interrogans serovar lai str. 56601
acauagaauuuccgaacgaucu

SEQ ID NO: 116290 - RNA, 22 nt, Leptospira interrogans serovar lai str. 56601
agaaaucuuagguucaauuaau

SEQ ID NO: 116291 - RNA, 22 nt, Leptospira interrogans serovar lai str. 56601
ggaauugaaaagaucaccuucu

SEQ ID NO: 116292 - RNA, 22 nt, Leptospira interrogans serovar lai str. 56601
uucugguauaggaacuucuuuu

SEQ ID NO: 116293 - RNA, 22 nt, Leptospira interrogans serovar lai str. 56601
guugaaguuuuagaucuucguu

SEQ ID NO: 116294 - RNA, 22 nt, Leptospira interrogans serovar lai str. 56601
agaguucuuaccgaauugauuu

SEQ ID NO: 116295 - RNA, 22 nt, Leptospira interrogans serovar lai str. 56601
uuugaacaaaucgguucuucua

SEQ ID NO: 116296 - RNA, 22 nt, Leptospira interrogans serovar lai str. 56601
caagcuuugauauauauucuaa

SEQ ID NO: 116297 - RNA, 18 nt, Leptospira interrogans serovar lai str. 56601
aguuuggaucucugcuuc

SEQ ID NO: 116298 - RNA, 22 nt, Leptospira interrogans serovar lai str. 56601
uacgaaugucuuuuuguaugau

SEQ ID NO: 116299 - RNA, 22 nt, Leptospira interrogans serovar lai str. 56601
aucuaaaggagaucuugcguuu

SEQ ID NO: 116300 - RNA, 22 nt, Leptospira interrogans serovar lai str. 56601
aucuguuucuugauccaauagc

SEQ ID NO: 116301 - RNA, 22 nt, Leptospira interrogans serovar lai str. 56601
agaaguucccgaaguacugguu

SEQ ID NO: 116302 - RNA, 22 nt, Leptospira interrogans serovar lai str. 56601
acucaguucguugggagugauu

SEQ ID NO: 116303 - RNA, 22 nt, Leptospira interrogans serovar lai str. 56601
uaugaagcaaaggauuuauaaa

SEQ ID NO: 116304 - RNA, 22 nt, Leptospira interrogans serovar lai str. 56601
aaagaacugaccccuggaacaa

SEQ ID NO: 116305 - RNA, 22 nt, Leptospira interrogans serovar lai str. 56601
uugaagcguaugggaacuuagc

SEQ ID NO: 116306 - RNA, 22 nt, Leptospira interrogans serovar lai str. 56601
aguuuaaggaagcguuuugcug

SEQ ID NO: 116307 - RNA, 22 nt, Leptospira interrogans serovar lai str. 56601
aaacgaguuugaaaaggaucgc

SEQ ID NO: 116308 - RNA, 22 nt, Leptospira interrogans serovar lai str. 56601
uacaaagaggcagaaauuuuca

SEQ ID NO: 116309 - RNA, 22 nt, Leptospira interrogans serovar lai str. 56601
gcgggaacuaaguuuuacagaa

SEQ ID NO: 116310 - RNA, 22 nt, Leptospira interrogans serovar lai str. 56601
acuucgaaguuuuuaaaugaua

SEQ ID NO: 116311 - RNA, 22 nt, Leptospira interrogans serovar lai str. 56601
gaagccaaugcaguccacgguu

SEQ ID NO: 116312 - RNA, 22 nt, Leptospira interrogans serovar lai str. 56601
auucguuuuuaaaauucggaga

SEQ ID NO: 116313 - RNA, 22 nt, Leptospira interrogans serovar lai str. 56601
uacuucuaaacuugcagacuug

SEQ ID NO: 116314 - RNA, 22 nt, Leptospira interrogans serovar lai str. 56601
acguuauaaauuuuggaauugu

SEQ ID NO: 116315 - RNA, 22 nt, Leptospira interrogans serovar lai str. 56601
gaauucuuccuugggaaaugua

SEQ ID NO: 116316 - RNA, 22 nt, Leptospira interrogans serovar lai str. 56601
gcguauuauuguuucgguuucu

SEQ ID NO: 116317 - RNA, 22 nt, Leptospira interrogans serovar lai str. 56601
uaugggauucuggaacaacucu

SEQ ID NO: 116318 - RNA, 22 nt, Leptospira interrogans serovar lai str. 56601
augauuccaugagaaagaucuu

SEQ ID NO: 116319 - RNA, 22 nt, Leptospira interrogans serovar lai str. 56601
uugaaucucuuucgaacucgcg

SEQ ID NO: 116320 - RNA, 22 nt, Leptospira interrogans serovar lai str. 56601
uuagaugaguugaccgaacucg

SEQ ID NO: 116321 - RNA, 22 nt, Leptospira interrogans serovar lai str. 56601
ugggaaugaucuuauggguagg

SEQ ID NO: 116322 - RNA, 22 nt, Leptospira interrogans serovar lai str. 56601
uuccggaauaucuuucaaaugc

SEQ ID NO: 116323 - RNA, 22 nt, Leptospira interrogans serovar lai str. 56601
cucuagagcagccaaucucguu

SEQ ID NO: 116324 - RNA, 22 nt, Leptospira interrogans serovar lai str. 56601
acuguaauugauauaguagugu

SEQ ID NO: 116325 - RNA, 22 nt, Leptospira interrogans serovar lai str. 56601
ucgaaaggauauucuuuuuccg

SEQ ID NO: 116326 - RNA, 22 nt, Leptospira interrogans serovar lai str. 56601
acuuguuucaaguagacgaacu

SEQ ID NO: 116327 - RNA, 22 nt, Leptospira interrogans serovar lai str. 56601
uugccgaacuuucugcaagcca

SEQ ID NO: 116328 - RNA, 22 nt, Leptospira interrogans serovar lai str. 56601
ugcaauuggagcaguaggaguu

SEQ ID NO: 116329 - RNA, 23 nt, Leptospira interrogans serovar lai str. 56601
uuucaagaggacuucuauauuuu

SEQ ID NO: 116330 - RNA, 22 nt, Leptospira interrogans serovar lai str. 56601
gacaaucauaccuacguagucg

SEQ ID NO: 116331 - RNA, 22 nt, Leptospira interrogans serovar lai str. 56601
uaacaugaguuugguguaagag

SEQ ID NO: 116332 - RNA, 22 nt, Leptospira interrogans serovar lai str. 56601
acauucuuuaaaaguauaugau

SEQ ID NO: 116333 - RNA, 22 nt, Leptospira interrogans serovar lai str. 56601
uuucaugagaauggcuugaagu

SEQ ID NO: 116334 - RNA, 21 nt, Leptospira interrogans serovar lai str. 56601
agagcgaucaaucugccaccg

SEQ ID NO: 116335 - RNA, 22 nt, Leptospira interrogans serovar lai str. 56601
augagauuguuguuaguaggga

SEQ ID NO: 116336 - RNA, 22 nt, Leptospira interrogans serovar lai str. 56601
uggaauucaaaugggaggagga

SEQ ID NO: 116337 - RNA, 22 nt, Leptospira interrogans serovar lai str. 56601
uuugcggaaaaucuucgauaga

SEQ ID NO: 116338 - RNA, 22 nt, Leptospira interrogans serovar lai str. 56601
uuggaaaggaacacaaauggcu

SEQ ID NO: 116339 - RNA, 22 nt, Leptospira interrogans serovar lai str. 56601
aucgaaagggcucgacgucaau

SEQ ID NO: 116340 - RNA, 19 nt, Leptospira interrogans serovar lai str. 56601
aguuucuccccuuugacgg

SEQ ID NO: 116341 - RNA, 22 nt, Leptospira interrogans serovar lai str. 56601
uagaguuguucguaaaaucgug

SEQ ID NO: 116342 - RNA, 22 nt, Leptospira interrogans serovar lai str. 56601
aucgcauugauacgauucccuu

SEQ ID NO: 116343 - RNA, 22 nt, Leptospira interrogans serovar lai str. 56601
cagaaauaaaaucaacuuaucu

SEQ ID NO: 116344 - RNA, 22 nt, Leptospira interrogans serovar lai str. 56601
auuugcgagugaaaagcuaaau

SEQ ID NO: 116345 - RNA, 22 nt, Leptospira interrogans serovar lai str. 56601
caauuugagauuuuacaguaaa

SEQ ID NO: 116346 - RNA, 22 nt, Leptospira interrogans serovar lai str. 56601
caaguuauugguauuuuauaaa

SEQ ID NO: 116347 - RNA, 22 nt, Leptospira interrogans serovar lai str. 56601
uauuuccgaagaaagauuuaaa

SEQ ID NO: 116348 - RNA, 22 nt, Leptospira interrogans serovar lai str. 56601
aggauucgauucuuugauccac

SEQ ID NO: 116349 - RNA, 22 nt, Leptospira interrogans serovar lai str. 56601
uagaucuuuaucaaacacauug

SEQ ID NO: 116350 - RNA, 22 nt, Leptospira interrogans serovar lai str. 56601
ugugagaguucccacagauuaa

SEQ ID NO: 116351 - RNA, 22 nt, Leptospira interrogans serovar lai str. 56601
uucgauuguagaaguuuagggu

SEQ ID NO: 116352 - RNA, 22 nt, Leptospira interrogans serovar lai str. 56601
auucccgagaucaauuuuagaa

SEQ ID NO: 116353 - RNA, 22 nt, Leptospira interrogans serovar lai str. 56601
gucaaguuauugguauuuuaua

SEQ ID NO: 116354 - RNA, 20 nt, Leptospira interrogans serovar lai str. 56601
ucauuucauucgcuucucca

SEQ ID NO: 116355 - RNA, 23 nt, Leptospira interrogans serovar lai str. 56601
uccaauucuaucauauuccuccg

SEQ ID NO: 116356 - RNA, 22 nt, Leptospira interrogans serovar lai str. 56601
ucuaauuccuccauucaggaag

SEQ ID NO: 116357 - RNA, 22 nt, Leptospira interrogans serovar lai str. 56601
uaaaugugggaacucccacaau

SEQ ID NO: 116358 - RNA, 22 nt, Leptospira interrogans serovar lai str. 56601
uauucuguagugaucggagguu

SEQ ID NO: 116359 - RNA, 22 nt, Leptospira interrogans serovar lai str. 56601
cguagcucucguauucucuuuu

SEQ ID NO: 116360 - RNA, 22 nt, Leptospira interrogans serovar lai str. 56601
acuuggaaguuaggaaaagacc

SEQ ID NO: 116361 - RNA, 22 nt, Leptospira interrogans serovar lai str. 56601
aguggacacguugcaauuaccg

SEQ ID NO: 116362 - RNA, 22 nt, Leptospira interrogans serovar lai str. 56601
auuccaguuccaggagcgacua

SEQ ID NO: 116363 - RNA, 22 nt, Leptospira interrogans serovar lai str. 56601
auucuucaaucgucucccgggc

SEQ ID NO: 116364 - RNA, 22 nt, Leptospira interrogans serovar lai str. 56601
caaucagguucgucauuuuacg

SEQ ID NO: 116365 - RNA, 22 nt, Leptospira interrogans serovar lai str. 56601
caaguuauuggaaauuauaaaa

SEQ ID NO: 116366 - RNA, 22 nt, Leptospira interrogans serovar lai str. 56601
caagcuuugauauauauucuaa

SEQ ID NO: 116367 - RNA, 22 nt, Leptospira interrogans serovar lai str. 56601
cagaauuuuugcgcauaaauuu

SEQ ID NO: 116368 - RNA, 22 nt, Leptospira interrogans serovar lai str. 56601
aauguugacgguuuuuguagga

SEQ ID NO: 116369 - RNA, 18 nt, Leptospira interrogans serovar lai str. 56601
aagugaacuuacugaguu

SEQ ID NO: 116370 - RNA, 22 nt, Leptospira interrogans serovar lai str. 56601
aaauuccagauucuucugcaua

SEQ ID NO: 116371 - RNA, 22 nt, Leptospira interrogans serovar lai str. 56601
aaccucuagcgauugcugagua

SEQ ID NO: 116372 - RNA, 23 nt, Leptospira interrogans serovar lai str. 56601
agcuacaaagauaguuccauuga

SEQ ID NO: 116373 - RNA, 22 nt, Leptospira interrogans serovar lai str. 56601
aaucuucuaaaaggaggaaucu

SEQ ID NO: 116374 - RNA, 23 nt, Leptospira interrogans serovar lai str. 56601
acgaacucaauucuaccauugga

SEQ ID NO: 116375 - RNA, 22 nt, Leptospira interrogans serovar lai str. 56601
uuucuaacuuuacucaaucaag

SEQ ID NO: 116376 - RNA, 22 nt, Leptospira interrogans serovar lai str. 56601
uucuuacaaaacuuuguauuga

SEQ ID NO: 116377 - RNA, 22 nt, Leptospira interrogans serovar lai str. 56601
uucaagaaaugagacgcuuuaa

SEQ ID NO: 116378 - RNA, 23 nt, Leptospira interrogans serovar lai str. 56601
uggaauuucacaauaacuugacc

SEQ ID NO: 116379 - RNA, 22 nt, Leptospira interrogans serovar lai str. 56601
gcuuggaggaaggcagguugga

SEQ ID NO: 116380 - RNA, 19 nt, Leptospira interrogans serovar lai str. 56601
gccucuacuucuucugugg

SEQ ID NO: 116381 - RNA, 22 nt, Leptospira interrogans serovar lai str. 56601
gagcauccauguuuccaacuga

SEQ ID NO: 116382 - RNA, 22 nt, Leptospira interrogans serovar lai str. 56601
gagcucgacuaaaaucauccau

SEQ ID NO: 116383 - RNA, 22 nt, Leptospira interrogans serovar lai str. 56601
gaugaacaaauugaauuuagga

SEQ ID NO: 116384 - RNA, 22 nt, Leptospira interrogans serovar lai str. 56601
ccugaaguuuacaaacaucuag

SEQ ID NO: 116385 - RNA, 22 nt, Human
aaaaaauugcuggcagagcugu

SEQ ID NO: 116386 - RNA, 22 nt, Human
aaaaauuucuggugaaaugccu

SEQ ID NO: 116387 - RNA, 22 nt, Human
aaaaaguaccacuuggacacuu

SEQ ID NO: 116388 - RNA, 20 nt, Human
aaaaacaguaaugcugaaga

SEQ ID NO: 116389 - RNA, 22 nt, Human
aaaaaaacuaauuuuaaaugug

SEQ ID NO: 116390 - RNA, 22 nt, Human
aaaaacuuaccccagggcaagg

SEQ ID NO: 116391 - RNA, 22 nt, Human
aaaaaggagaaagagagggaga

SEQ ID NO: 116392 - RNA, 22 nt, Human
aaaacuuucagggauacagaaa

SEQ ID NO: 116393 - RNA, 22 nt, Human
aaaagacaaggaucuggaguga

SEQ ID NO: 116394 - RNA, 20 nt, Human
aaaaauguguuuauggagau

SEQ ID NO: 116395 - RNA, 22 nt, Human
aaacauguagugcaugaggauc

SEQ ID NO: 116396 - RNA, 22 nt, Human
aaaauauguugagauacugaaa

SEQ ID NO: 116397 - RNA, 22 nt, Human
aaacauaugccuucuuuuguaa

SEQ ID NO: 116398 - RNA, 21 nt, Human
aaacaugcagccugccaauuc

SEQ ID NO: 116399 - RNA, 22 nt, Human
aaaauacuaggaaaauaaauca

SEQ ID NO: 116400 - RNA, 22 nt, Human
aaaauauaaaggauguggguuu

SEQ ID NO: 116401 - RNA, 22 nt, Human
aaaauaauauuauaccacugcu

SEQ ID NO: 116402 - RNA, 22 nt, Human
aaacaagagcuuacauggcugc

SEQ ID NO: 116403 - RNA, 22 nt, Human
aaacaauaauaauuaggaagga

SEQ ID NO: 116404 - RNA, 22 nt, Human
aaacucaucaguuuagaaaccu

SEQ ID NO: 116405 - RNA, 21 nt, Human
aaagaagagcucagagguaga

SEQ ID NO: 116406 - RNA, 22 nt, Human
aaagagcugccaagguuacagu

SEQ ID NO: 116407 - RNA, 22 nt, Human
aaagacaauaauucucucuagc

SEQ ID NO: 116408 - RNA, 22 nt, Human
aagcauaucaaguuuuaugugc

SEQ ID NO: 116409 - RNA, 22 nt, Human
aaggaguggugaagucagaugu

SEQ ID NO: 116410 - RNA, 22 nt, Human
aagcccuuugaaaauguguguc

SEQ ID NO: 116411 - RNA, 22 nt, Human
aagggaaaagcugaaugagaug

SEQ ID NO: 116412 - RNA, 22 nt, Human
aagggaaacagccaggcccugu

SEQ ID NO: 116413 - RNA, 22 nt, Human
aaguaauuugugaaggcauguu

SEQ ID NO: 116414 - RNA, 21 nt, Human
aaguaaauuuuuacuuaggcc

SEQ ID NO: 116415 - RNA, 22 nt, Human
aagugguuuauuguaugguuuu

SEQ ID NO: 116416 - RNA, 22 nt, Human
aaguuaaaaaagcuggguaaaa

SEQ ID NO: 116417 - RNA, 22 nt, Human
aagugugugugcgcaugugcau

SEQ ID NO: 116418 - RNA, 22 nt, Human
aaguugacuguuuuacuuaugu

SEQ ID NO: 116419 - RNA, 22 nt, Human
aaguugaaugucuugcugaaug

SEQ ID NO: 116420 - RNA, 22 nt, Human
aaguuaauugcuucuaguuaau

SEQ ID NO: 116421 - RNA, 20 nt, Human
aaguugaaguuacuucaugg

SEQ ID NO: 116422 - RNA, 22 nt, Human
aaguagccuguuauguaguuca

SEQ ID NO: 116423 - RNA, 22 nt, Human
aaguauuccccaaguauucugg

SEQ ID NO: 116424 - RNA, 22 nt, Human
aagucauuaucucuucuaaucu

SEQ ID NO: 116425 - RNA, 22 nt, Human
aaguccaaaacauuucucugcu

SEQ ID NO: 116426 - RNA, 22 nt, Human
aauauagagcagaucuggcucu

SEQ ID NO: 116427 - RNA, 22 nt, Human
aauagguaaaugaguaagaaau

SEQ ID NO: 116428 - RNA, 22 nt, Human
aaguuuaagguagugaugauga

SEQ ID NO: 116429 - RNA, 21 nt, Human
aaguuucucccuaauuguugc

SEQ ID NO: 116430 - RNA, 22 nt, Human
aauguaguuuacugugagugca

SEQ ID NO: 116431 - RNA, 22 nt, Human
aaugguuacuacccugggucuu

SEQ ID NO: 116432 - RNA, 22 nt, Human
aauguaaauaauuguaaaauuu

SEQ ID NO: 116433 - RNA, 22 nt, Human
aauguacucgaaugauguuaag

SEQ ID NO: 116434 - RNA, 22 nt, Human
aauguacucuguguuucucaug

SEQ ID NO: 116435 - RNA, 22 nt, Human
aaugguaauauuucauaguugu

SEQ ID NO: 116436 - RNA, 22 nt, Human
aaugguggaugucuguucugac

SEQ ID NO: 116437 - RNA, 22 nt, Human
aauggaccuuaaauugcuucag

SEQ ID NO: 116438 - RNA, 22 nt, Human
aaugcauaaugguuugugacaa

SEQ ID NO: 116439 - RNA, 21 nt, Human
aauuauuugcauuuuucuugu

SEQ ID NO: 116440 - RNA, 22 nt, Human
aauuagaagcuguuagcaaaau

SEQ ID NO: 116441 - RNA, 22 nt, Human
aauuacuuuaggaaaacuccuc

SEQ ID NO: 116442 - RNA, 22 nt, Human
aauuauuaagcuuucuccagug

SEQ ID NO: 116443 - RNA, 22 nt, Human
aauuauguugaaauaugagaac

SEQ ID NO: 116444 - RNA, 23 nt, Human
aauguugaggguggguuuuuaac

SEQ ID NO: 116445 - RNA, 22 nt, Human
aauguuuaacuguggucagcag

SEQ ID NO: 116446 - RNA, 22 nt, Human
aauguuguaaauauucuuugag

SEQ ID NO: 116447 - RNA, 22 nt, Human
aauguuuaagcuuuuauuuaca

SEQ ID NO: 116448 - RNA, 22 nt, Human
aaucaaauuucuugugguuguu

SEQ ID NO: 116449 - RNA, 22 nt, Human
aauauuuaccuaccugucaucu

SEQ ID NO: 116450 - RNA, 22 nt, Human
aauauuuugggacugaggaauu

SEQ ID NO: 116451 - RNA, 22 nt, Human
aaugaaaaucugucaguucaag

SEQ ID NO: 116452 - RNA, 22 nt, Human
aaucuguugucaggaauccaca

SEQ ID NO: 116453 - RNA, 22 nt, Human
aaugaaacuaguagaaucuuug

SEQ ID NO: 116454 - RNA, 22 nt, Human
aaugagauggaggacucuuaau

SEQ ID NO: 116455 - RNA, 22 nt, Human
aaugaaugaaugaaugauuaug

SEQ ID NO: 116456 - RNA, 22 nt, Human
aaugaauaaauuuuaaagacag

SEQ ID NO: 116457 - RNA, 22 nt, Human
aaugcagaugugucuuuaauuu

SEQ ID NO: 116458 - RNA, 22 nt, Human
aaugauuuucugcaaacaguga

SEQ ID NO: 116459 - RNA, 22 nt, Human
aaugcauacguguuuguggcaa

SEQ ID NO: 116460 - RNA, 22 nt, Human
aaugaguucaucugaauucugg

SEQ ID NO: 116461 - RNA, 23 nt, Human
aaugaguugggcagcauacaggc

SEQ ID NO: 116462 - RNA, 22 nt, Human
aaugaguuuguucuauuauuug

SEQ ID NO: 116463 - RNA, 22 nt, Human
aacucugacgcugucaaauaca

SEQ ID NO: 116464 - RNA, 22 nt, Human
aacgggcacuuuauuuaaaaaa

SEQ ID NO: 116465 - RNA, 21 nt, Human
aacuauuaauaccauuagcaa

SEQ ID NO: 116466 - RNA, 22 nt, Human
aacuuaacucugcaauccagcu

SEQ ID NO: 116467 - RNA, 22 nt, Human
aagaaaagaaacauggguaugc

SEQ ID NO: 116468 - RNA, 22 nt, Human
aagaaaagguaaccgcuuaucu

SEQ ID NO: 116469 - RNA, 22 nt, Human
aacuuaaacaagcucccaaguu

SEQ ID NO: 116470 - RNA, 22 nt, Human
aacuguugucacgaauguggcu

SEQ ID NO: 116471 - RNA, 22 nt, Human
aacugggugauucaggcuguuu

SEQ ID NO: 116472 - RNA, 22 nt, Human
aacuuucagaauccuaugcauu

SEQ ID NO: 116473 - RNA, 22 nt, Human
aacuuucuuugcaucuaaguuu

SEQ ID NO: 116474 - RNA, 22 nt, Human
aacuuucugaaaagcuugauca

SEQ ID NO: 116475 - RNA, 22 nt, Human
aacuuuuaugaaggaaaucaua

SEQ ID NO: 116476 - RNA, 22 nt, Human
aagaaggaaggcaagagauggg

SEQ ID NO: 116477 - RNA, 22 nt, Human
aacuuuuucuuaggggaaagca

SEQ ID NO: 116478 - RNA, 22 nt, Human
aagagaggcccaaguggcuggc

SEQ ID NO: 116479 - RNA, 22 nt, Human
aagagugugagguugugcuuuu

SEQ ID NO: 116480 - RNA, 22 nt, Human
aagaccacaggaaucaaacagg

SEQ ID NO: 116481 - RNA, 22 nt, Human
aagaggauuuuaguuugccaga

SEQ ID NO: 116482 - RNA, 22 nt, Human
aagagaaaugcuuuaacuuuau

SEQ ID NO: 116483 - RNA, 22 nt, Human
aagauguuguagauuagugaga

SEQ ID NO: 116484 - RNA, 22 nt, Human
aagaugcuucaugagaguuggg

SEQ ID NO: 116485 - RNA, 22 nt, Human
aagcaaguucuaaaguaauucu

SEQ ID NO: 116486 - RNA, 22 nt, Human
aagcaauucacaguucacuuaa

SEQ ID NO: 116487 - RNA, 21 nt, Human
aagcagcugcagaauuucagu

SEQ ID NO: 116488 - RNA, 22 nt, Human
aagcauuuuagauaaagcauca

SEQ ID NO: 116489 - RNA, 22 nt, Human
aagcaguuuagucaucgggauu

SEQ ID NO: 116490 - RNA, 22 nt, Human
aagauuuaccacuuuauucaag

SEQ ID NO: 116491 - RNA, 22 nt, Human
aagauuugaaaguggugcauuu

SEQ ID NO: 116492 - RNA, 22 nt, Human
aagcaaaagguuacacuucugg

SEQ ID NO: 116493 - RNA, 22 nt, Human
aacauuuauguuuugaccaagu

SEQ ID NO: 116494 - RNA, 22 nt, Human
aaccaaaguugguauuuaauaa

SEQ ID NO: 116495 - RNA, 22 nt, Human
aacaguuaagaggaggcagaga

SEQ ID NO: 116496 - RNA, 22 nt, Human
aacaguaugugagauuuacaca

SEQ ID NO: 116497 - RNA, 22 nt, Human
aaccagaagucaucagagcuga

SEQ ID NO: 116498 - RNA, 21 nt, Human
aacagguuuccuaccacuugc

SEQ ID NO: 116499 - RNA, 22 nt, Human
aaccuaagaacagcaggcuccu

SEQ ID NO: 116500 - RNA, 22 nt, Human
aacuagugucuguaugauaagg

SEQ ID NO: 116501 - RNA, 22 nt, Human
aacgaugauaaauuguucucug

SEQ ID NO: 116502 - RNA, 22 nt, Human
aaccuuauuguguaucaccaua

SEQ ID NO: 116503 - RNA, 22 nt, Human
aaauuuuguugaaaaauauuuu

SEQ ID NO: 116504 - RNA, 22 nt, Human
aaauuuauaacuuaaagugaau

SEQ ID NO: 116505 - RNA, 20 nt, Human
aaauugaacaagccaggcug

SEQ ID NO: 116506 - RNA, 22 nt, Human
aacaucaaaggaagaaugauau

SEQ ID NO: 116507 - RNA, 22 nt, Human
aacacuaaaggucaguuagaag

SEQ ID NO: 116508 - RNA, 22 nt, Human
aaauucuuccaggaggaaauac

SEQ ID NO: 116509 - RNA, 22 nt, Human
aaauucagauggcuuucuuuuc

SEQ ID NO: 116510 - RNA, 22 nt, Human
aaauguuugguggauaaaagga

SEQ ID NO: 116511 - RNA, 20 nt, Human
aaauucgacuaaaaccagaa

SEQ ID NO: 116512 - RNA, 22 nt, Human
aaauucagcagguuucaaaagc

SEQ ID NO: 116513 - RNA, 22 nt, Human
aaauggauaaucaagauaauca

SEQ ID NO: 116514 - RNA, 22 nt, Human
aaauguuucauucuauuuuuag

SEQ ID NO: 116515 - RNA, 22 nt, Human
aaagaucaguuaacgccaucaa

SEQ ID NO: 116516 - RNA, 22 nt, Human
aaaugguguucuuuagaugaaa

SEQ ID NO: 116517 - RNA, 22 nt, Human
aaagaguuguauucuuuuugag

SEQ ID NO: 116518 - RNA, 22 nt, Human
aguaucuuccucaugaacacgu

SEQ ID NO: 116519 - RNA, 22 nt, Human
aguauucaguuagugagcuaag

SEQ ID NO: 116520 - RNA, 19 nt, Human
aguauauaucuuuaccuca

SEQ ID NO: 116521 - RNA, 22 nt, Human
aguaacuuaagcaauuguguau

SEQ ID NO: 116522 - RNA, 22 nt, Human
aguaauaaacaacucauuuugg

SEQ ID NO: 116523 - RNA, 22 nt, Human
aguaauuucuuacggagaccuu

SEQ ID NO: 116524 - RNA, 22 nt, Human
aggucuugguaggccagagucu

SEQ ID NO: 116525 - RNA, 22 nt, Human
aguaaaugaaagcaauuuuaga

SEQ ID NO: 116526 - RNA, 18 nt, Human
aguaaauguuaaauauug

SEQ ID NO: 116527 - RNA, 22 nt, Human
agguuuuacuuuuuuuggaggu

SEQ ID NO: 116528 - RNA, 22 nt, Human
aguauuuuaaaauacauuaucc

SEQ ID NO: 116529 - RNA, 22 nt, Human
aguauuuucuuuaguuuguuag

SEQ ID NO: 116530 - RNA, 22 nt, Human
agucaaaaaaccuagaaacacc

SEQ ID NO: 116531 - RNA, 22 nt, Human
aguauuuaguauucuauauuag

SEQ ID NO: 116532 - RNA, 22 nt, Human
agucagaaggugucagaucuug

SEQ ID NO: 116533 - RNA, 22 nt, Human
agucauuugucauuuuuuugag

SEQ ID NO: 116534 - RNA, 18 nt, Human
agucauguuuuagucacu

SEQ ID NO: 116535 - RNA, 22 nt, Human
agucauuugaggcaugauuaug

SEQ ID NO: 116536 - RNA, 22 nt, Human
agucggauuucccagguuauug

SEQ ID NO: 116537 - RNA, 20 nt, Human
agucuucaggugugaggauu

SEQ ID NO: 116538 - RNA, 19 nt, Human
aggucuaaucauaagacaa

SEQ ID NO: 116539 - RNA, 22 nt, Human
agguagcuggugcugggcuccu

SEQ ID NO: 116540 - RNA, 22 nt, Human
agggcuugggggccuugaaggc

SEQ ID NO: 116541 - RNA, 22 nt, Human
agggaagagaaacaaagauuca

SEQ ID NO: 116542 - RNA, 22 nt, Human
agggaguuccgaucugugcacc

SEQ ID NO: 116543 - RNA, 22 nt, Human
agggaaauaggagaagaaagga

SEQ ID NO: 116544 - RNA, 22 nt, Human
aggcgguuggcuuugucugggu

SEQ ID NO: 116545 - RNA, 22 nt, Human
aggcuaagugauuagugacaua

SEQ ID NO: 116546 - RNA, 16 nt, Human
aggauauauucucuuc

SEQ ID NO: 116547 - RNA, 22 nt, Human
aggccauuucacagguuuugga

SEQ ID NO: 116548 - RNA, 22 nt, Human
agcaggaaggcuagaagcagga

SEQ ID NO: 116549 - RNA, 22 nt, Human
agcacggugguuaagagagugg

SEQ ID NO: 116550 - RNA, 22 nt, Human
agauaagaacauuaguaagccg

SEQ ID NO: 116551 - RNA, 22 nt, Human
agauacaaaagauaagauuuag

SEQ ID NO: 116552 - RNA, 22 nt, Human
agcauuugcuguucuagaaagu

SEQ ID NO: 116553 - RNA, 22 nt, Human
agcaguucucugucuagcuaga

SEQ ID NO: 116554 - RNA, 22 nt, Human
agcaugaauugccauuuauuaa

SEQ ID NO: 116555 - RNA, 22 nt, Human
agcauuuuaaaacuaguuacca

SEQ ID NO: 116556 - RNA, 22 nt, Human
agcccuuucuuguuuaacugca

SEQ ID NO: 116557 - RNA, 22 nt, Human
agcgacuugacagacauguccu

SEQ ID NO: 116558 - RNA, 22 nt, Human
agcuaaaaugagguuuuuggau

SEQ ID NO: 116559 - RNA, 22 nt, Human
agcuaaauauuuuuccugacac

SEQ ID NO: 116560 - RNA, 22 nt, Human
agcguucuguuccaugcuaaca

SEQ ID NO: 116561 - RNA, 22 nt, Human
agcucuucugacucuaggcuca

SEQ ID NO: 116562 - RNA, 22 nt, Human
agcucuuccuccauucuggcca

SEQ ID NO: 116563 - RNA, 20 nt, Human
agcugaauaguuuugugaaa

SEQ ID NO: 116564 - RNA, 22 nt, Human
agcugaugucucaccuguuaga

SEQ ID NO: 116565 - RNA, 22 nt, Human
aggaaaauggaccagaguuguu

SEQ ID NO: 116566 - RNA, 20 nt, Human
agcuuucaccaguacuucca

SEQ ID NO: 116567 - RNA, 22 nt, Human
agcuuggcaagcacuguuugag

SEQ ID NO: 116568 - RNA, 22 nt, Human
aggauaaaugggucauuaggca

SEQ ID NO: 116569 - RNA, 22 nt, Human
aggaaagacgcauuucuguagg

SEQ ID NO: 116570 - RNA, 22 nt, Human
aggaaauaggaccagacaaagc

SEQ ID NO: 116571 - RNA, 22 nt, Human
agcuggaaucucggcaaagcgu

SEQ ID NO: 116572 - RNA, 22 nt, Human
agcugugaccaguuacgaaauu

SEQ ID NO: 116573 - RNA, 22 nt, Human
agcuugaaccuaaaacaauaau

SEQ ID NO: 116574 - RNA, 20 nt, Human
aggaagauccuuucuuuuaa

SEQ ID NO: 116575 - RNA, 22 nt, Human
aggaaaaagaagaaaagaauca

SEQ ID NO: 116576 - RNA, 22 nt, Human
acuaauuuacagaaauuucuua

SEQ ID NO: 116577 - RNA, 22 nt, Human
acugauuuuauauauuaccccg

SEQ ID NO: 116578 - RNA, 22 nt, Human
acugagaacuuggggacagagg

SEQ ID NO: 116579 - RNA, 22 nt, Human
acugcuguugugauggguauuu

SEQ ID NO: 116580 - RNA, 22 nt, Human
acuggauucucuuacacagaug

SEQ ID NO: 116581 - RNA, 22 nt, Human
acugggcaaggauaugaugggu

SEQ ID NO: 116582 - RNA, 22 nt, Human
acuggcaugauagaccauaaca

SEQ ID NO: 116583 - RNA, 22 nt, Human
acuggcuuggaaauggguauuu

SEQ ID NO: 116584 - RNA, 21 nt, Human
acugggcuagccugacuucug

SEQ ID NO: 116585 - RNA, 22 nt, Human
acuucucuuuucauuaauuuug

SEQ ID NO: 116586 - RNA, 22 nt, Human
acugucuuguuguaugugagcu

SEQ ID NO: 116587 - RNA, 22 nt, Human
acuugaagcaugaaaauaagcc

SEQ ID NO: 116588 - RNA, 20 nt, Human
acuuucacaugaacauuuaa

SEQ ID NO: 116589 - RNA, 22 nt, Human
acuugcaucuuagagacucacc

SEQ ID NO: 116590 - RNA, 22 nt, Human
acuuuuuugccaucccuccagc

SEQ ID NO: 116591 - RNA, 22 nt, Human
acuuuuaauaguagauuuuuaa

SEQ ID NO: 116592 - RNA, 22 nt, Human
agaacaagaaacccgaaaagug

SEQ ID NO: 116593 - RNA, 22 nt, Human
acuuuggugcgaagucacuuua

SEQ ID NO: 116594 - RNA, 22 nt, Human
acuuuuaaggggccuugauuua

SEQ ID NO: 116595 - RNA, 22 nt, Human
acuuugugaauagaacuggaug

SEQ ID NO: 116596 - RNA, 22 nt, Human
agaaauggggugaagcaaaugg

SEQ ID NO: 116597 - RNA, 22 nt, Human
agaaacacaaguaaagcuccca

SEQ ID NO: 116598 - RNA, 22 nt, Human
agaagcaaagcaaacacauucu

SEQ ID NO: 116599 - RNA, 19 nt, Human
agaaacaacauucuggaga

SEQ ID NO: 116600 - RNA, 22 nt, Human
agaaagcacccugcacuuucug

SEQ ID NO: 116601 - RNA, 19 nt, Human
agaaauagccuuccuuguc

SEQ ID NO: 116602 - RNA, 22 nt, Human
agacagaacauaauuaguacug

SEQ ID NO: 116603 - RNA, 21 nt, Human
agaaugaagaagaggucuuug

SEQ ID NO: 116604 - RNA, 22 nt, Human
agacuugguaacuagugaagaa

SEQ ID NO: 116605 - RNA, 22 nt, Human
agagaaauguacuagucuaacu

SEQ ID NO: 116606 - RNA, 22 nt, Human
agacuuugaaugaugacagcgu

SEQ ID NO: 116607 - RNA, 22 nt, Human
agagaagaauccccugguggag

SEQ ID NO: 116608 - RNA, 22 nt, Human
agagaaccauggcauccaggua

SEQ ID NO: 116609 - RNA, 22 nt, Human
agagcacaggguuuugugccgg

SEQ ID NO: 116610 - RNA, 19 nt, Human
agagauuuucuguuuuagu

SEQ ID NO: 116611 - RNA, 22 nt, Human
agagaaacauuaauugaugagg

SEQ ID NO: 116612 - RNA, 22 nt, Human
agagauuagagaagaugauaaa

SEQ ID NO: 116613 - RNA, 22 nt, Human
agaggaauuauugaguuagauu

SEQ ID NO: 116614 - RNA, 22 nt, Human
accucuuucuauggauuuuuug

SEQ ID NO: 116615 - RNA, 22 nt, Human
accugcagguguuuccacacuu

SEQ ID NO: 116616 - RNA, 22 nt, Human
accuccauggcccacaucuagu

SEQ ID NO: 116617 - RNA, 22 nt, Human
accuauuuauacaacugcacca

SEQ ID NO: 116618 - RNA, 22 nt, Human
acgaaugacaugugauuugaaa

SEQ ID NO: 116619 - RNA, 22 nt, Human
accuuaagugauuaugacauau

SEQ ID NO: 116620 - RNA, 22 nt, Human
acuaaagcagcucagacgagaa

SEQ ID NO: 116621 - RNA, 22 nt, Human
acgguuuugugagguaguacuu

SEQ ID NO: 116622 - RNA, 22 nt, Human
acaguuagguccuaaaauucug

SEQ ID NO: 116623 - RNA, 22 nt, Human
aauucugaggccauuuauuucc

SEQ ID NO: 116624 - RNA, 22 nt, Human
aauucuaaugaguucuuaucua

SEQ ID NO: 116625 - RNA, 22 nt, Human
aauucagguuauauuugcaacu

SEQ ID NO: 116626 - RNA, 22 nt, Human
acauuugauauggaguugugua

SEQ ID NO: 116627 - RNA, 22 nt, Human
acauggaauuucagaagagcau

SEQ ID NO: 116628 - RNA, 22 nt, Human
accauuauagaggacauuaugu

SEQ ID NO: 116629 - RNA, 22 nt, Human
accaauaaaagcaauucacagu

SEQ ID NO: 116630 - RNA, 22 nt, Human
acauuuuuggguugaugucuga

SEQ ID NO: 116631 - RNA, 22 nt, Human
acauuuuguuuauggaaaagau

SEQ ID NO: 116632 - RNA, 22 nt, Human
acauuucuccuacuuguuauuu

SEQ ID NO: 116633 - RNA, 22 nt, Human
acauuuugggagaaaguuguua

SEQ ID NO: 116634 - RNA, 23 nt, Human
cauauucagaaacaccuaguggu

SEQ ID NO: 116635 - RNA, 22 nt, Human
cauuacaagaaauagcauaaug

SEQ ID NO: 116636 - RNA, 22 nt, Human
ccagcuuuucagaaucugccug

SEQ ID NO: 116637 - RNA, 22 nt, Human
cccuuuuuuauggaguuggcca

SEQ ID NO: 116638 - RNA, 22 nt, Human
ccaguuguggagaauuguuuga

SEQ ID NO: 116639 - RNA, 22 nt, Human
cccagcgccugcccuccgccgc

SEQ ID NO: 116640 - RNA, 22 nt, Human
ccucuuugcccucuuuccuucc

SEQ ID NO: 116641 - RNA, 22 nt, Human
ccucuuuugaaccaguucuuca

SEQ ID NO: 116642 - RNA, 22 nt, Human
cccuuuuuugccauuccuuccu

SEQ ID NO: 116643 - RNA, 22 nt, Human
ccgaaaaacagaaucuuggaac

SEQ ID NO: 116644 - RNA, 22 nt, Human
cgacagauuauuuugugacugc

SEQ ID NO: 116645 - RNA, 22 nt, Human
ccugcugcugaugcuguuucac

SEQ ID NO: 116646 - RNA, 22 nt, Human
ccugaauuuaucugaauggugg

SEQ ID NO: 116647 - RNA, 22 nt, Human
ccugcuggagucuaguuggucu

SEQ ID NO: 116648 - RNA, 22 nt, Human
ccuuuuaucgcgaagaacucca

SEQ ID NO: 116649 - RNA, 22 nt, Human
cguuugagggaguuggaacugc

SEQ ID NO: 116650 - RNA, 22 nt, Human
cuauuaauggccaggagucaug

SEQ ID NO: 116651 - RNA, 22 nt, Human
cuaugaaucaauuucugcaguu

SEQ ID NO: 116652 - RNA, 22 nt, Human
cuauaauuguacuuguuuuuua

SEQ ID NO: 116653 - RNA, 22 nt, Human
cuauugguaucacacugauuuc

SEQ ID NO: 116654 - RNA, 22 nt, Human
cuauuauuauugucguuuuaca

SEQ ID NO: 116655 - RNA, 22 nt, Human
cucaauuuuuauugcuuuuuug

SEQ ID NO: 116656 - RNA, 22 nt, Human
cucagaagaacaaaggcucuac

SEQ ID NO: 116657 - RNA, 22 nt, Human
cggagagacaagucugcuuugg

SEQ ID NO: 116658 - RNA, 22 nt, Human
cuccuugagaaugaacaaagga

SEQ ID NO: 116659 - RNA, 22 nt, Human
cuccuuuuccuacucauacuau

SEQ ID NO: 116660 - RNA, 22 nt, Human
cucuuauaaagaugucucuguu

SEQ ID NO: 116661 - RNA, 22 nt, Human
cugaaagacagccaggcaaagc

SEQ ID NO: 116662 - RNA, 22 nt, Human
cucuuuuuuugucuuaagaacc

SEQ ID NO: 116663 - RNA, 22 nt, Human
cucuuuuuccuaugaaaucuau

SEQ ID NO: 116664 - RNA, 22 nt, Human
cugaacuaagcccaaagacacu

SEQ ID NO: 116665 - RNA, 22 nt, Human
cugaaggacacgugaggagcca

SEQ ID NO: 116666 - RNA, 22 nt, Human
cugaagcugggcacuuccuuuu

SEQ ID NO: 116667 - RNA, 22 nt, Human
gaaagcauucuggaggggcaga

SEQ ID NO: 116668 - RNA, 22 nt, Human
cuggaugucugggaggcuuccc

SEQ ID NO: 116669 - RNA, 21 nt, Human
cuuuggcaagggagaagucac

SEQ ID NO: 116670 - RNA, 22 nt, Human
gaaagcuuggaaacgacuuuau

SEQ ID NO: 116671 - RNA, 22 nt, Human
cugugcuugcugugcuggggcc

SEQ ID NO: 116672 - RNA, 22 nt, Human
gaacaaaagauagcccaaacau

SEQ ID NO: 116673 - RNA, 22 nt, Human
gaaauuucuuuguuaucuuggu

SEQ ID NO: 116674 - RNA, 22 nt, Human
gaagcagguucuucaggaugaa

SEQ ID NO: 116675 - RNA, 20 nt, Human
cuuauuuuggagaacuuuuc

SEQ ID NO: 116676 - RNA, 22 nt, Human
cuucucuuugacaguugggugu

SEQ ID NO: 116677 - RNA, 22 nt, Human
gaaggagaggauugugaggcug

SEQ ID NO: 116678 - RNA, 22 nt, Human
gaaggaaaagacgugcuaagua

SEQ ID NO: 116679 - RNA, 22 nt, Human
gaagcgucaugaaagaaaggcu

SEQ ID NO: 116680 - RNA, 22 nt, Human
cuucuuucuuuucuucuucucu

SEQ ID NO: 116681 - RNA, 22 nt, Human
gaaguaaugugauugcucaggg

SEQ ID NO: 116682 - RNA, 22 nt, Human
gaaugcacacgugugugcaugc

SEQ ID NO: 116683 - RNA, 22 nt, Human
cuuggugagcuccuggcgcagc

SEQ ID NO: 116684 - RNA, 22 nt, Human
gaaugcauuuuuuaaaagcaua

SEQ ID NO: 116685 - RNA, 19 nt, Human
cuuuuagagggagaggacu

SEQ ID NO: 116686 - RNA, 22 nt, Human
cuuuucaaacaggacagguccu

SEQ ID NO: 116687 - RNA, 19 nt, Human
cuuugugguuuucagaacu

SEQ ID NO: 116688 - RNA, 22 nt, Human
cuuuuaaucuaauuuuuauauu

SEQ ID NO: 116689 - RNA, 22 nt, Human
cuuuucauuucauggaauacaa

SEQ ID NO: 116690 - RNA, 22 nt, Human
cuuuuucuuaucuuuuucuaug

SEQ ID NO: 116691 - RNA, 22 nt, Human
gacucuucucucccaaaugccc

SEQ ID NO: 116692 - RNA, 22 nt, Human
cuuguuuuaaacuguuguggcu

SEQ ID NO: 116693 - RNA, 22 nt, Human
gaccagaacuucuagucuaagu

SEQ ID NO: 116694 - RNA, 22 nt, Human
gaaaaagucuuaaaguaaggca

SEQ ID NO: 116695 - RNA, 22 nt, Human
gaaaagaaggcaggagcccaag

SEQ ID NO: 116696 - RNA, 22 nt, Human
gaaaaggaggggaggcagaugg

SEQ ID NO: 116697 - RNA, 22 nt, Human
gagaaguaggaauaucaggagu

SEQ ID NO: 116698 - RNA, 22 nt, Human
gaaaaguauuaugugaggguuc

SEQ ID NO: 116699 - RNA, 22 nt, Human
gagaagugaauaacgaagcagg

SEQ ID NO: 116700 - RNA, 22 nt, Human
gaaaugaaacacacaugcagcu

SEQ ID NO: 116701 - RNA, 22 nt, Human
gaaaugggggcaugcguuacau

SEQ ID NO: 116702 - RNA, 22 nt, Human
gagauuuccauauuuuguaaca

SEQ ID NO: 116703 - RNA, 22 nt, Human
gaacaguuucccuguagaaaau

SEQ ID NO: 116704 - RNA, 22 nt, Human
gagauuugaguuccuacugagu

SEQ ID NO: 116705 - RNA, 22 nt, Human
gaacaugaguuuuaugguauuu

SEQ ID NO: 116706 - RNA, 22 nt, Human
gaagaugacaucggaucugucu

SEQ ID NO: 116707 - RNA, 22 nt, Human
gaacuugagugugcuauuucuu

SEQ ID NO: 116708 - RNA, 22 nt, Human
cuucauuucaggcugaagaaua

SEQ ID NO: 116709 - RNA, 22 nt, Human
cugauguuuaucucaagaguuc

SEQ ID NO: 116710 - RNA, 22 nt, Human
cuucucugcugccugccucuuu

SEQ ID NO: 116711 - RNA, 22 nt, Human
cuucuaauucuuauguaagcuu

SEQ ID NO: 116712 - RNA, 22 nt, Human
cuuccugcaacaccuguguugc

SEQ ID NO: 116713 - RNA, 22 nt, Human
cuucuuuuggggaugaaaaugg

SEQ ID NO: 116714 - RNA, 22 nt, Human
cuucuuugacucacugguacgc

SEQ ID NO: 116715 - RNA, 22 nt, Human
cuucuucuagaagauggggaag

SEQ ID NO: 116716 - RNA, 22 nt, Human
cugccgaugcgcaguggcgccu

SEQ ID NO: 116717 - RNA, 23 nt, Human
cuugugacagcaauuauagcaag

SEQ ID NO: 116718 - RNA, 22 nt, Human
cuuguuaacaauugguaucuuu

SEQ ID NO: 116719 - RNA, 20 nt, Human
cuuguuaaauaugcagguag

SEQ ID NO: 116720 - RNA, 22 nt, Human
cuuuauguuggggugucuuagu

SEQ ID NO: 116721 - RNA, 22 nt, Human
cuuuaaaaauguauuuuugugg

SEQ ID NO: 116722 - RNA, 22 nt, Human
cuuugauuucucugguccaauc

SEQ ID NO: 116723 - RNA, 22 nt, Human
cuugcuuuaucugguuucucau

SEQ ID NO: 116724 - RNA, 22 nt, Human
cuugcuguccgaugggucugua

SEQ ID NO: 116725 - RNA, 22 nt, Human
cugcgcgagcacugccggcggg

SEQ ID NO: 116726 - RNA, 22 nt, Human
cucuuuguauucuagaagcucu

SEQ ID NO: 116727 - RNA, 19 nt, Human
cucuucauuggaggguuga

SEQ ID NO: 116728 - RNA, 22 nt, Human
cucuucauguuggugcagaagc

SEQ ID NO: 116729 - RNA, 22 nt, Human
cugagcuauauauuaugcauag

SEQ ID NO: 116730 - RNA, 22 nt, Human
cuucacuaccuacacugccgcu

SEQ ID NO: 116731 - RNA, 22 nt, Human
cugagcuuuucucugcuucuua

SEQ ID NO: 116732 - RNA, 19 nt, Human
cugggacaaugaaagcauc

SEQ ID NO: 116733 - RNA, 22 nt, Human
cuccuauugaucaguacuauuu

SEQ ID NO: 116734 - RNA, 22 nt, Human
cuggcuuucauggcgcaguuga

SEQ ID NO: 116735 - RNA, 22 nt, Human
cuccuuuuuuuaaagauggauu

SEQ ID NO: 116736 - RNA, 22 nt, Human
cucuauuuuuucaucuuucagg

SEQ ID NO: 116737 - RNA, 22 nt, Human
cuggauuaaacaguuugauacu

SEQ ID NO: 116738 - RNA, 22 nt, Human
cuggaaaaauggauccugucuu

SEQ ID NO: 116739 - RNA, 23 nt, Human
cuggacauucgcaaaguucaucu

SEQ ID NO: 116740 - RNA, 22 nt, Human
cacucaaacugaaauccuuuuu

SEQ ID NO: 116741 - RNA, 22 nt, Human
caaugaaaauuuaaguugcagc

SEQ ID NO: 116742 - RNA, 22 nt, Human
cacaacaaaaaauaaguaugag

SEQ ID NO: 116743 - RNA, 22 nt, Human
cacaaggagaaauagauauuga

SEQ ID NO: 116744 - RNA, 22 nt, Human
cagaaaaaaaugcagacuagca

SEQ ID NO: 116745 - RNA, 22 nt, Human
cacuuuuucccccuggugucau

SEQ ID NO: 116746 - RNA, 22 nt, Human
cagauguuugaaugcuuaccac

SEQ ID NO: 116747 - RNA, 22 nt, Human
cacuugauugucagaaaaaugg

SEQ ID NO: 116748 - RNA, 22 nt, Human
cacuuguuaaaugccaauggca

SEQ ID NO: 116749 - RNA, 22 nt, Human
cagauaagcuauaaguaguacc

SEQ ID NO: 116750 - RNA, 22 nt, Human
cagaaaacauuguguguauaag

SEQ ID NO: 116751 - RNA, 22 nt, Human
cagauggaguuaguuucuaaca

SEQ ID NO: 116752 - RNA, 22 nt, Human
cagauggagaaagagugaaugg

SEQ ID NO: 116753 - RNA, 22 nt, Human
cagccuuuucuuaaaaugcaag

SEQ ID NO: 116754 - RNA, 22 nt, Human
cagcccuugcgacacccuggcu

SEQ ID NO: 116755 - RNA, 22 nt, Human
cagcuuuugcagacuucuugcc

SEQ ID NO: 116756 - RNA, 22 nt, Human
cagcuccagcccaggcagcucc

SEQ ID NO: 116757 - RNA, 22 nt, Human
caugaauaauucuuuuucuugg

SEQ ID NO: 116758 - RNA, 22 nt, Human
caguucacggcugguaugaauu

SEQ ID NO: 116759 - RNA, 22 nt, Human
caguuuuauacacugcagcucc

SEQ ID NO: 116760 - RNA, 22 nt, Human
caguuuuggaagaaacaaggaa

SEQ ID NO: 116761 - RNA, 22 nt, Human
caguugcuauugagagaacaca

SEQ ID NO: 116762 - RNA, 22 nt, Human
cauaaauuuuaccuuguaagug

SEQ ID NO: 116763 - RNA, 22 nt, Human
cauaguuuguucuuuuuuauug

SEQ ID NO: 116764 - RNA, 22 nt, Human
cauccagagcugccugaccccg

SEQ ID NO: 116765 - RNA, 22 nt, Human
cagguauaugugugucuaauac

SEQ ID NO: 116766 - RNA, 22 nt, Human
caguauguuuauuagaacugca

SEQ ID NO: 116767 - RNA, 22 nt, Human
auuuccugugaacuuuucugau

SEQ ID NO: 116768 - RNA, 22 nt, Human
auuuauuugaagagccauugca

SEQ ID NO: 116769 - RNA, 22 nt, Human
auuuaaaggaagugggugauaa

SEQ ID NO: 116770 - RNA, 22 nt, Human
auuuaaagaguaauacaaucca

SEQ ID NO: 116771 - RNA, 19 nt, Human
auuuccuggcauauaucac

SEQ ID NO: 116772 - RNA, 22 nt, Human
auuguuuugugaaacauaguga

SEQ ID NO: 116773 - RNA, 22 nt, Human
auuucauaaaaacuuuaccuga

SEQ ID NO: 116774 - RNA, 22 nt, Human
auuucauuuuagaaauaagugu

SEQ ID NO: 116775 - RNA, 22 nt, Human
auuuauuuucccucaaguaccu

SEQ ID NO: 116776 - RNA, 22 nt, Human
auuucacucuuaauugcuuccu

SEQ ID NO: 116777 - RNA, 22 nt, Human
auuucagaaugaaaggaaaaau

SEQ ID NO: 116778 - RNA, 22 nt, Human
auuucagaguagaucguuauuu

SEQ ID NO: 116779 - RNA, 22 nt, Human
auugaaauuugcuuccucacug

SEQ ID NO: 116780 - RNA, 17 nt, Human
auuguuuuuaauuugca

SEQ ID NO: 116781 - RNA, 22 nt, Human
auugaaauuaauuucugcuuuc

SEQ ID NO: 116782 - RNA, 22 nt, Human
auuuaaaaacugguacaacagg

SEQ ID NO: 116783 - RNA, 22 nt, Human
auuuauauauuuuguucuggua

SEQ ID NO: 116784 - RNA, 22 nt, Human
auuuaaguuacuucucuuuccu

SEQ ID NO: 116785 - RNA, 22 nt, Human
auugacuuucccuucuccucau

SEQ ID NO: 116786 - RNA, 22 nt, Human
auuuagacaacaagccuucucc

SEQ ID NO: 116787 - RNA, 22 nt, Human
auuaauguguaugauauaaauu

SEQ ID NO: 116788 - RNA, 22 nt, Human
auuaauaucaauauauuauaug

SEQ ID NO: 116789 - RNA, 22 nt, Human
auuagaaaugacaugugggaau

SEQ ID NO: 116790 - RNA, 22 nt, Human
auuacugaggcaaaguaguuuu

SEQ ID NO: 116791 - RNA, 22 nt, Human
auugugaaugccugucagucuu

SEQ ID NO: 116792 - RNA, 22 nt, Human
auuguauugcguuugcgaaugu

SEQ ID NO: 116793 - RNA, 22 nt, Human
auuuccacaaauuaagauugca

SEQ ID NO: 116794 - RNA, 22 nt, Human
auuugaaaaucuaugaugugca

SEQ ID NO: 116795 - RNA, 22 nt, Human
auuuuacuaugauaguugagaa

SEQ ID NO: 116796 - RNA, 22 nt, Human
auuugacuugguaagacuuaag

SEQ ID NO: 116797 - RNA, 22 nt, Human
auuuucuucauuuugauuguau

SEQ ID NO: 116798 - RNA, 18 nt, Human
auuuguggggguuauaga

SEQ ID NO: 116799 - RNA, 21 nt, Human
auuuggucaaugucugcguga

SEQ ID NO: 116800 - RNA, 22 nt, Human
auuuggucuacauuuuccaaau

SEQ ID NO: 116801 - RNA, 22 nt, Human
caaagaagagauuuacagagcu

SEQ ID NO: 116802 - RNA, 19 nt, Human
auuuugguucuuuccauuc

SEQ ID NO: 116803 - RNA, 22 nt, Human
auuuuuuuuccugucucuuuca

SEQ ID NO: 116804 - RNA, 22 nt, Human
caaaacauucagagagcucacu

SEQ ID NO: 116805 - RNA, 22 nt, Human
caacaagcgcucagagcaaagc

SEQ ID NO: 116806 - RNA, 22 nt, Human
auuuuucuuucacauuuucuua

SEQ ID NO: 116807 - RNA, 22 nt, Human
auuuuucucucaugugcaacua

SEQ ID NO: 116808 - RNA, 21 nt, Human
auuuuucagaaggaugugaua

SEQ ID NO: 116809 - RNA, 22 nt, Human
caacauuucaaggucuuuagga

SEQ ID NO: 116810 - RNA, 22 nt, Human
cacacguuucuacugcugccaa

SEQ ID NO: 116811 - RNA, 22 nt, Human
caaggaaaacagaugaucaaca

SEQ ID NO: 116812 - RNA, 22 nt, Human
caaggaaaugucagaaaggcaa

SEQ ID NO: 116813 - RNA, 22 nt, Human
caaggaguuuggggaccaagga

SEQ ID NO: 116814 - RNA, 22 nt, Human
caccaaaauaucccuuuguaca

SEQ ID NO: 116815 - RNA, 22 nt, Human
caauaccucuuggugauugggc

SEQ ID NO: 116816 - RNA, 22 nt, Human
caauguuuuuccuuccuuaaua

SEQ ID NO: 116817 - RNA, 22 nt, Human
caaaugaugcauggcuagugag

SEQ ID NO: 116818 - RNA, 22 nt, Human
caaaugcaguggucgugcugga

SEQ ID NO: 116819 - RNA, 22 nt, Human
caauaguaaucaaugcaguuag

SEQ ID NO: 116820 - RNA, 22 nt, Human
caaaguauuuagcugacucgcu

SEQ ID NO: 116821 - RNA, 22 nt, Human
caauagcuauguaaccugaaga

SEQ ID NO: 116822 - RNA, 22 nt, Human
cacaauuuccauugagcagcag

SEQ ID NO: 116823 - RNA, 22 nt, Human
caacaaguugauuucacgcugc

SEQ ID NO: 116824 - RNA, 22 nt, Human
caaagaugccaaaaggaagaca

SEQ ID NO: 116825 - RNA, 22 nt, Human
caagaaaaaacaugaugagugu

SEQ ID NO: 116826 - RNA, 22 nt, Human
caaagcuucaucuguuguuuug

SEQ ID NO: 116827 - RNA, 22 nt, Human
caaguauuuauugaggcccugu

SEQ ID NO: 116828 - RNA, 22 nt, Human
caaggaagguugguugaaggua

SEQ ID NO: 116829 - RNA, 22 nt, Human
augugaaagagguguucagugg

SEQ ID NO: 116830 - RNA, 22 nt, Human
auguauauauacauguauugua

SEQ ID NO: 116831 - RNA, 22 nt, Human
augguuuugugaaaaugcuuug

SEQ ID NO: 116832 - RNA, 22 nt, Human
auggcuucugucuuggaaauuu

SEQ ID NO: 116833 - RNA, 22 nt, Human
augcuuucucuucuauuucuca

SEQ ID NO: 116834 - RNA, 22 nt, Human
auggcaucuucgguuggacugc

SEQ ID NO: 116835 - RNA, 22 nt, Human
auguuagcaucuggcacuaugg

SEQ ID NO: 116836 - RNA, 22 nt, Human
auguguuuccaacagagaggga

SEQ ID NO: 116837 - RNA, 22 nt, Human
augugaaauuugggcucuggga

SEQ ID NO: 116838 - RNA, 22 nt, Human
augguuuuguccucuuugguuc

SEQ ID NO: 116839 - RNA, 22 nt, Human
augugauacuccuucuagugga

SEQ ID NO: 116840 - RNA, 22 nt, Human
auguaaauauuuauauaugcau

SEQ ID NO: 116841 - RNA, 22 nt, Human
auguauuuauguauguguuaua

SEQ ID NO: 116842 - RNA, 22 nt, Human
auuaagucugacuggauuguau

SEQ ID NO: 116843 - RNA, 22 nt, Human
auucauauagcgcuuacagccu

SEQ ID NO: 116844 - RNA, 21 nt, Human
auucaaagaagaggaaggccc

SEQ ID NO: 116845 - RNA, 22 nt, Human
auuaaagcuaguugagauuuaa

SEQ ID NO: 116846 - RNA, 22 nt, Human
auuaaauagcagaagaaagaug

SEQ ID NO: 116847 - RNA, 22 nt, Human
auuauucaaggugaggguaaaa

SEQ ID NO: 116848 - RNA, 22 nt, Human
auuauucuuugggaaaguugaa

SEQ ID NO: 116849 - RNA, 22 nt, Human
auuaugugagggacuuaaucau

SEQ ID NO: 116850 - RNA, 22 nt, Human
auuaugcagcugccuccaaggu

SEQ ID NO: 116851 - RNA, 22 nt, Human
auuagaagagcuuuuuacucuu

SEQ ID NO: 116852 - RNA, 20 nt, Human
auuaauuuuuagggcucacc

SEQ ID NO: 116853 - RNA, 22 nt, Human
auguuuaauuugaaauuuuauu

SEQ ID NO: 116854 - RNA, 22 nt, Human
auuauaauucauuaggcuuagu

SEQ ID NO: 116855 - RNA, 22 nt, Human
auuauacauuaggagauugauu

SEQ ID NO: 116856 - RNA, 22 nt, Human
auguuuucauuuagaagcuaau

SEQ ID NO: 116857 - RNA, 22 nt, Human
auguuuuauacacauguaucac

SEQ ID NO: 116858 - RNA, 21 nt, Human
auuauagugacuaaauugaua

SEQ ID NO: 116859 - RNA, 22 nt, Human
auuaucugacugaguagucugu

SEQ ID NO: 116860 - RNA, 22 nt, Human
augaugaugguuuaacuucagg

SEQ ID NO: 116861 - RNA, 22 nt, Human
augaucaagaauuuuguauucc

SEQ ID NO: 116862 - RNA, 22 nt, Human
augcagauguagauucugaaau

SEQ ID NO: 116863 - RNA, 22 nt, Human
augcugcuuguccauuuauuug

SEQ ID NO: 116864 - RNA, 22 nt, Human
augcuugaaaguuauuucauuu

SEQ ID NO: 116865 - RNA, 22 nt, Human
augcuuuauuggagacagucau

SEQ ID NO: 116866 - RNA, 22 nt, Human
augcuacuugugaaaacccagg

SEQ ID NO: 116867 - RNA, 22 nt, Human
augcuagaaaauuucauauuau

SEQ ID NO: 116868 - RNA, 22 nt, Human
aucugcuguaguuggugccagu

SEQ ID NO: 116869 - RNA, 22 nt, Human
aucugcugcuccuucuucuugc

SEQ ID NO: 116870 - RNA, 19 nt, Human
augaaauagcauuuucuga

SEQ ID NO: 116871 - RNA, 22 nt, Human
augaaacucuagcuuucagcac

SEQ ID NO: 116872 - RNA, 22 nt, Human
aucuauguaucucagaagcuag

SEQ ID NO: 116873 - RNA, 22 nt, Human
aucugggaaggggaaaaugcug

SEQ ID NO: 116874 - RNA, 22 nt, Human
augagaguuagccugcauaguu

SEQ ID NO: 116875 - RNA, 22 nt, Human
aucuucuauguguaggcauuuu

SEQ ID NO: 116876 - RNA, 22 nt, Human
aucuucuuucaucagccccuca

SEQ ID NO: 116877 - RNA, 22 nt, Human
augauuauuugaaugaagagga

SEQ ID NO: 116878 - RNA, 22 nt, Human
augauuuguuaacagacuuaau

SEQ ID NO: 116879 - RNA, 19 nt, Human
augagccccaguucguucc

SEQ ID NO: 116880 - RNA, 22 nt, Human
augcacuugacucuauuccaca

SEQ ID NO: 116881 - RNA, 22 nt, Human
augauggagaacaaagaaaauc

SEQ ID NO: 116882 - RNA, 22 nt, Human
augauuaagguacgucauuucu

SEQ ID NO: 116883 - RNA, 22 nt, Human
augauguuggaauuuuaacuua

SEQ ID NO: 116884 - RNA, 22 nt, Human
augaauuaucugguguuggaaa

SEQ ID NO: 116885 - RNA, 22 nt, Human
auauguuaugccauuuucaagg

SEQ ID NO: 116886 - RNA, 22 nt, Human
auauuuuugcagaauuuuucgu

SEQ ID NO: 116887 - RNA, 22 nt, Human
aucaaaauguguagucuugauc

SEQ ID NO: 116888 - RNA, 22 nt, Human
aucagaagaaauggaugugacu

SEQ ID NO: 116889 - RNA, 22 nt, Human
auauuuuacagcucucguugaa

SEQ ID NO: 116890 - RNA, 22 nt, Human
auauuugucuguuuuaguggca

SEQ ID NO: 116891 - RNA, 22 nt, Human
aucaaguuauuaaguagcuuuc

SEQ ID NO: 116892 - RNA, 22 nt, Human
aucaaaauuuucagauacuaca

SEQ ID NO: 116893 - RNA, 22 nt, Human
aucauguauauuuuugcuauua

SEQ ID NO: 116894 - RNA, 22 nt, Human
auccuucaaaaggaauagcagg

SEQ ID NO: 116895 - RNA, 22 nt, Human
auccuugacuguagugauauua

SEQ ID NO: 116896 - RNA, 22 nt, Human
auccagaaguauuuuggguacu

SEQ ID NO: 116897 - RNA, 22 nt, Human
aucuaauguggcaaguugcuga

SEQ ID NO: 116898 - RNA, 22 nt, Human
auccugauggaaacugguauga

SEQ ID NO: 116899 - RNA, 22 nt, Human
aucauugaaaauuuaugcauuu

SEQ ID NO: 116900 - RNA, 22 nt, Human
aucccacaccccuacaacauau

SEQ ID NO: 116901 - RNA, 22 nt, Human
aucaugcugacacaguuuaucu

SEQ ID NO: 116902 - RNA, 22 nt, Human
auagaagugaaaagggaugacu

SEQ ID NO: 116903 - RNA, 22 nt, Human
auagaaauagacaaugcaaaga

SEQ ID NO: 116904 - RNA, 22 nt, Human
auacaucuuaacgcgcucuugg

SEQ ID NO: 116905 - RNA, 22 nt, Human
auaguaaauguuaacagcaaca

SEQ ID NO: 116906 - RNA, 22 nt, Human
auauaagauaauaacuuuuuua

SEQ ID NO: 116907 - RNA, 22 nt, Human
auaguuaucuguggauaagguu

SEQ ID NO: 116908 - RNA, 22 nt, Human
auauaguacauguauauauaua

SEQ ID NO: 116909 - RNA, 22 nt, Human
auagauuuuaucagauuuuauc

SEQ ID NO: 116910 - RNA, 19 nt, Human
auagcagaagucauuuuca

SEQ ID NO: 116911 - RNA, 22 nt, Human
auaugagaggaggagcaucagu

SEQ ID NO: 116912 - RNA, 22 nt, Human
auauaagucacauuaaggaggu

SEQ ID NO: 116913 - RNA, 22 nt, Human
auaggagcaagauuauagcagg

SEQ ID NO: 116914 - RNA, 21 nt, Human
auauuguugggguuuucuuuu

SEQ ID NO: 116915 - RNA, 22 nt, Human
auauuguagcaucacugucuug

SEQ ID NO: 116916 - RNA, 22 nt, Human
auauggugauuuuaugcaggaa

SEQ ID NO: 116917 - RNA, 22 nt, Human
auaugaagaaugaucugaagua

SEQ ID NO: 116918 - RNA, 22 nt, Human
auauauacuuugacacauucug

SEQ ID NO: 116919 - RNA, 22 nt, Human
auauaaugcaguaggugauuaa

SEQ ID NO: 116920 - RNA, 22 nt, Human
auauuauuaaaauagauggaua

SEQ ID NO: 116921 - RNA, 22 nt, Human
uuuuuuuccaguuauucauuuu

SEQ ID NO: 116922 - RNA, 22 nt, Human
uuuuuugguuuggggauuauuu

SEQ ID NO: 116923 - RNA, 22 nt, Human
uuuuuuguuccuugguuuuugu

SEQ ID NO: 116924 - RNA, 22 nt, Human
uuuuuuguggcuggaagaaaaa

SEQ ID NO: 116925 - RNA, 22 nt, Human
uuuuuuuaaguuuugauuuuag

SEQ ID NO: 116926 - RNA, 22 nt, Human
uuuuuucuggaguuugggguuu

SEQ ID NO: 116927 - RNA, 22 nt, Human
uuuuuuccagcuucuagaggcc

SEQ ID NO: 116928 - RNA, 22 nt, Human
uuuuugggccaaauauauuuac

SEQ ID NO: 116929 - RNA, 20 nt, Human
uuuuuuaaauagagcuguug

SEQ ID NO: 116930 - RNA, 22 nt, Human
uuuuugcccuaaagaagucauu

SEQ ID NO: 116931 - RNA, 22 nt, Human
uuuuugcuuuuuugucaucuaa

SEQ ID NO: 116932 - RNA, 22 nt, Human
uuuuucuccucucucuuucauu

SEQ ID NO: 116933 - RNA, 22 nt, Human
uuuuucugacugcuaacaaaaa

SEQ ID NO: 116934 - RNA, 22 nt, Human
uuuuucugccucucucccacau

SEQ ID NO: 116935 - RNA, 22 nt, Human
uuuuugaauaagugcaucauca

SEQ ID NO: 116936 - RNA, 22 nt, Human
uuuuucuuugguaacucuuccu

SEQ ID NO: 116937 - RNA, 22 nt, Human
uuuuucacacuccuuuccaguu

SEQ ID NO: 116938 - RNA, 22 nt, Human
uuuuucagacuaauagggcaua

SEQ ID NO: 116939 - RNA, 22 nt, Human
uuuuuauguaaaauauuaaaag

SEQ ID NO: 116940 - RNA, 22 nt, Human
uuuuuauaagauuuaaaaugua

SEQ ID NO: 116941 - RNA, 22 nt, Human
uuuuuauaagagcagcagaguu

SEQ ID NO: 116942 - RNA, 22 nt, Human
uuuuuagcuguuauuguggaag

SEQ ID NO: 116943 - RNA, 22 nt, Human
uuuuguuuacauuaaauuuuga

SEQ ID NO: 116944 - RNA, 22 nt, Human
uuuuguuacugauuauuaaaau

SEQ ID NO: 116945 - RNA, 22 nt, Human
uuuuuaagguuuguuuauauau

SEQ ID NO: 116946 - RNA, 22 nt, Human
uuuuuaauuuuaagcuauuugu

SEQ ID NO: 116947 - RNA, 22 nt, Human
uuuugguauaauuuaaaauuaa

SEQ ID NO: 116948 - RNA, 22 nt, Human
uuuugguaguccagaguuuagu

SEQ ID NO: 116949 - RNA, 22 nt, Human
uuuugguauggcuugauagagu

SEQ ID NO: 116950 - RNA, 18 nt, Human
uuuuguguuuauucugca

SEQ ID NO: 116951 - RNA, 22 nt, Human
uuuuguggacugugagggugca

SEQ ID NO: 116952 - RNA, 22 nt, Human
uuuuguagauagggaaacagag

SEQ ID NO: 116953 - RNA, 20 nt, Human
uuuuguccaccugcaggaag

SEQ ID NO: 116954 - RNA, 22 nt, Human
uuuugauacaaguuguaaaaaa

SEQ ID NO: 116955 - RNA, 22 nt, Human
uuuugaauaauucagaaacagc

SEQ ID NO: 116956 - RNA, 22 nt, Human
uuuucuuggaguggcuguccuu

SEQ ID NO: 116957 - RNA, 22 nt, Human
uuuucuguuuaugaaauugugu

SEQ ID NO: 116958 - RNA, 22 nt, Human
uuuuccaaaaguggagaggaau

SEQ ID NO: 116959 - RNA, 22 nt, Human
uuuguuugcugagugaauucaa

SEQ ID NO: 116960 - RNA, 22 nt, Human
uuuguuuuggugucaugcguga

SEQ ID NO: 116961 - RNA, 22 nt, Human
uuuuaaaacaugucaaaaugug

SEQ ID NO: 116962 - RNA, 22 nt, Human
uuuguuuccagccuuuugucuu

SEQ ID NO: 116963 - RNA, 21 nt, Human
uuuguucaggggcaaaguuaa

SEQ ID NO: 116964 - RNA, 22 nt, Human
uuuguucuagauaacugguaau

SEQ ID NO: 116965 - RNA, 22 nt, Human
uuuaaugucuuggaaaaagacu

SEQ ID NO: 116966 - RNA, 22 nt, Human
uuuagaaugaaugcaagagaau

SEQ ID NO: 116967 - RNA, 22 nt, Human
uuuagagguacaguaggcauga

SEQ ID NO: 116968 - RNA, 22 nt, Human
uuuucaacuuuauuuuccccca

SEQ ID NO: 116969 - RNA, 22 nt, Human
uuuuauuuguauguugaaugua

SEQ ID NO: 116970 - RNA, 22 nt, Human
uuuucaaucaaguuuauuuaua

SEQ ID NO: 116971 - RNA, 22 nt, Human
uuuuagaagcauuuaugagauu

SEQ ID NO: 116972 - RNA, 22 nt, Human
uuuuaauccucuugguaucuua

SEQ ID NO: 116973 - RNA, 22 nt, Human
uuuuacaaugcaaauucuugcu

SEQ ID NO: 116974 - RNA, 22 nt, Human
uuuuaaaguaauugaagcuugu

SEQ ID NO: 116975 - RNA, 22 nt, Human
uuuuaaaagguugcuguuauaa

SEQ ID NO: 116976 - RNA, 22 nt, Human
uuuguugaauggcaggauuuua

SEQ ID NO: 116977 - RNA, 18 nt, Human
uucuaaauucuguuuuua

SEQ ID NO: 116978 - RNA, 22 nt, Human
uuuuaggauuugaguugcugga

SEQ ID NO: 116979 - RNA, 22 nt, Human
uuuuauaaaaccuguuugaccu

SEQ ID NO: 116980 - RNA, 22 nt, Human
uucuaauauuaugauuucuaag

SEQ ID NO: 116981 - RNA, 22 nt, Human
uuuuccuuaacagagggagaaa

SEQ ID NO: 116982 - RNA, 22 nt, Human
uucucuuguaaaauuccuuuuu

SEQ ID NO: 116983 - RNA, 22 nt, Human
uucucuugccuucucuuuuauc

SEQ ID NO: 116984 - RNA, 22 nt, Human
uuuucaauuuucauuugcaaga

SEQ ID NO: 116985 - RNA, 22 nt, Human
uuuuggaaaaaccaguauggaa

SEQ ID NO: 116986 - RNA, 22 nt, Human
uuuuggagaaaugggacuuaau

SEQ ID NO: 116987 - RNA, 23 nt, Human
uucugcuucccauagcacuuugu

SEQ ID NO: 116988 - RNA, 21 nt, Human
uucugcuguucaccaccaccc

SEQ ID NO: 116989 - RNA, 22 nt, Human
uuuugaugaccauucuucuuuu

SEQ ID NO: 116990 - RNA, 22 nt, Human
uuuuuuuguagguguaugaaaa

SEQ ID NO: 116991 - RNA, 22 nt, Human
uugacuauacucuggcggaaaa

SEQ ID NO: 116992 - RNA, 22 nt, Human
uugaggaagggaggcaaaacug

SEQ ID NO: 116993 - RNA, 18 nt, Human
uuuuuuguucuguuuugu

SEQ ID NO: 116994 - RNA, 22 nt, Human
uuuuuuuagaaagaucauaguu

SEQ ID NO: 116995 - RNA, 19 nt, Human
uugaauguuugauagucuc

SEQ ID NO: 116996 - RNA, 22 nt, Human
uugaagaagucaaaagcugcag

SEQ ID NO: 116997 - RNA, 22 nt, Human
uugaagccaccacuguaaguca

SEQ ID NO: 116998 - RNA, 22 nt, Human
uuuuuucuucucuaucuuaaua

SEQ ID NO: 116999 - RNA, 22 nt, Human
uuuuuguuauuuagguguagag

SEQ ID NO: 117000 - RNA, 21 nt, Human
uuuuucuccagaguuuccacu

SEQ ID NO: 117001 - RNA, 22 nt, Human
uucuucuuuccuauaauuaauu

SEQ ID NO: 117002 - RNA, 22 nt, Human
uucuuacuaaguagaguacuca

SEQ ID NO: 117003 - RNA, 22 nt, Human
uucuuauuuuucguaaauccug

SEQ ID NO: 117004 - RNA, 22 nt, Human
uuuuuaaaagaugauuuaauga

SEQ ID NO: 117005 - RNA, 22 nt, Human
uuguuuucuaguguuuugaaua

SEQ ID NO: 117006 - RNA, 22 nt, Human
uuguuuucuugaugaaauuauu

SEQ ID NO: 117007 - RNA, 22 nt, Human
uuguuuuucucuagggaaggcu

SEQ ID NO: 117008 - RNA, 22 nt, Human
uuuaaaacaguacguuuucuua

SEQ ID NO: 117009 - RNA, 22 nt, Human
uuuaaaauguuuuauuuauuua

SEQ ID NO: 117010 - RNA, 22 nt, Human
uuguuugcacuuuagagacugu

SEQ ID NO: 117011 - RNA, 22 nt, Human
uuuaaauuucugaaucuugagg

SEQ ID NO: 117012 - RNA, 22 nt, Human
uuuaagguacagcuagcagcau

SEQ ID NO: 117013 - RNA, 22 nt, Human
uuuaaauaguugguuuuuuugc

SEQ ID NO: 117014 - RNA, 22 nt, Human
uuuaaagucaggcuguaguggu

SEQ ID NO: 117015 - RNA, 18 nt, Human
uuuaauaagccuguuaug

SEQ ID NO: 117016 - RNA, 22 nt, Human
uuuaauauucucuuugaaggaa

SEQ ID NO: 117017 - RNA, 22 nt, Human
uuuaauauuacacuuaccuugu

SEQ ID NO: 117018 - RNA, 22 nt, Human
uuuaaugguuuauggucuaaga

SEQ ID NO: 117019 - RNA, 22 nt, Human
uuuaaucaauaaccuccugggu

SEQ ID NO: 117020 - RNA, 22 nt, Human
uuguagccaugucacaagcaca

SEQ ID NO: 117021 - RNA, 22 nt, Human
uuguacuuguucuguuuccuug

SEQ ID NO: 117022 - RNA, 22 nt, Human
uuguacaaauaggaaccucuga

SEQ ID NO: 117023 - RNA, 22 nt, Human
uuggugauguagcagcaauugu

SEQ ID NO: 117024 - RNA, 22 nt, Human
uuggugaugaaagugcugcgcu

SEQ ID NO: 117025 - RNA, 22 nt, Human
uuggucaagacugauaucaaga

SEQ ID NO: 117026 - RNA, 22 nt, Human
uuggguguugguuccugggagg

SEQ ID NO: 117027 - RNA, 22 nt, Human
uugcucuuaccauuauguguga

SEQ ID NO: 117028 - RNA, 22 nt, Human
uugcugcgcugaccuccaguga

SEQ ID NO: 117029 - RNA, 22 nt, Human
uugcuggaguagaaaacuuaac

SEQ ID NO: 117030 - RNA, 22 nt, Human
uugcugguggcucugauuucau

SEQ ID NO: 117031 - RNA, 22 nt, Human
uugcuuuuugggguuuacuggg

SEQ ID NO: 117032 - RNA, 22 nt, Human
uuggaaauguagaaaagcagau

SEQ ID NO: 117033 - RNA, 22 nt, Human
uuggaagacagccgucuuuauu

SEQ ID NO: 117034 - RNA, 22 nt, Human
uugcaagauaguguauuuuuca

SEQ ID NO: 117035 - RNA, 22 nt, Human
uugcaugugugaaaugcacaga

SEQ ID NO: 117036 - RNA, 22 nt, Human
uugcaugauuuaagaauaucug

SEQ ID NO: 117037 - RNA, 22 nt, Human
uucauugcuacuuaaaauacca

SEQ ID NO: 117038 - RNA, 22 nt, Human
uucauuuccauuuuauagauaa

SEQ ID NO: 117039 - RNA, 22 nt, Human
uucauugauuuccuuggaauaa

SEQ ID NO: 117040 - RNA, 22 nt, Human
uuuguacuuucuaauguauuua

SEQ ID NO: 117041 - RNA, 22 nt, Human
uucauuuuauauuagagcuguu

SEQ ID NO: 117042 - RNA, 22 nt, Human
uuugucauuuagcccauggugg

SEQ ID NO: 117043 - RNA, 22 nt, Human
uuugugguuuugagagaguugc

SEQ ID NO: 117044 - RNA, 22 nt, Human
uuuguuaugguuggaagcagga

SEQ ID NO: 117045 - RNA, 22 nt, Human
uuuguuaggguuucagcuagcc

SEQ ID NO: 117046 - RNA, 22 nt, Human
uuuguguuuugaggucuugcaa

SEQ ID NO: 117047 - RNA, 22 nt, Human
uucaguuugaauucuguagaac

SEQ ID NO: 117048 - RNA, 22 nt, Human
uucaguuuugcuuuuaaucaug

SEQ ID NO: 117049 - RNA, 22 nt, Human
uucauccucuuuaucuaccugu

SEQ ID NO: 117050 - RNA, 22 nt, Human
uuugggcuuuguuuuaagguau

SEQ ID NO: 117051 - RNA, 22 nt, Human
uuugauuuuguuuauagugccg

SEQ ID NO: 117052 - RNA, 22 nt, Human
uuugagaaugucaaucacaaga

SEQ ID NO: 117053 - RNA, 22 nt, Human
uuugaugauuuucuagagugua

SEQ ID NO: 117054 - RNA, 22 nt, Human
uuugagaagauaggggaauacu

SEQ ID NO: 117055 - RNA, 22 nt, Human
uuucuuuuucuacaccuuagcu

SEQ ID NO: 117056 - RNA, 22 nt, Human
uuauuuuuguaacacuguauag

SEQ ID NO: 117057 - RNA, 22 nt, Human
uucaaacacugugcaauugggu

SEQ ID NO: 117058 - RNA, 22 nt, Human
uuauuuuuguuuguuaagccua

SEQ ID NO: 117059 - RNA, 22 nt, Human
uuauuuaaguauuuauugaagu

SEQ ID NO: 117060 - RNA, 22 nt, Human
uuauuucaggcauuuguaaaug

SEQ ID NO: 117061 - RNA, 22 nt, Human
uuauuucuucucgaagcuuggg

SEQ ID NO: 117062 - RNA, 22 nt, Human
uuauuucauguaaaauuuaugu

SEQ ID NO: 117063 - RNA, 17 nt, Human
uuucugcaugauuggac

SEQ ID NO: 117064 - RNA, 22 nt, Human
uuucugcuuucuaguugguguu

SEQ ID NO: 117065 - RNA, 22 nt, Human
uuucugcauuuguauuggaaaa

SEQ ID NO: 117066 - RNA, 22 nt, Human
uuucuugggaaaugucagaagu

SEQ ID NO: 117067 - RNA, 22 nt, Human
uuucuugugauuuugaugaacu

SEQ ID NO: 117068 - RNA, 22 nt, Human
uuauuuuauaaagagaagacuu

SEQ ID NO: 117069 - RNA, 22 nt, Human
uuucuuugcugguuggcucucc

SEQ ID NO: 117070 - RNA, 22 nt, Human
uuucuguuuguaacuccagcaa

SEQ ID NO: 117071 - RNA, 22 nt, Human
uuucuguucuguuggauucuuu

SEQ ID NO: 117072 - RNA, 22 nt, Human
uuuaugauguagccuagagcug

SEQ ID NO: 117073 - RNA, 19 nt, Human
uuuauuugagacaugccuu

SEQ ID NO: 117074 - RNA, 22 nt, Human
uuuauuuuccaugucucuaggu

SEQ ID NO: 117075 - RNA, 22 nt, Human
uuuauuugugguaguguaaucu

SEQ ID NO: 117076 - RNA, 22 nt, Human
uuauaaaccgcuaacagcacuu

SEQ ID NO: 117077 - RNA, 22 nt, Human
uuuauauauauguaggagcaca

SEQ ID NO: 117078 - RNA, 22 nt, Human
uuuauaauuguuauguuaccca

SEQ ID NO: 117079 - RNA, 22 nt, Human
uuuauaauuacguaaaauauuu

SEQ ID NO: 117080 - RNA, 22 nt, Human
uuagcagacagauggagagaga

SEQ ID NO: 117081 - RNA, 22 nt, Human
uuagcacugucugguuaucuug

SEQ ID NO: 117082 - RNA, 22 nt, Human
uguuugaugugcacgugugugu

SEQ ID NO: 117083 - RNA, 22 nt, Human
uuacuggaauauaaagauaaga

SEQ ID NO: 117084 - RNA, 22 nt, Human
uuagaaauguccuacuaauaug

SEQ ID NO: 117085 - RNA, 22 nt, Human
uuuaggaagaucugaaggaaga

SEQ ID NO: 117086 - RNA, 20 nt, Human
uuuagcacauuguacaaaac

SEQ ID NO: 117087 - RNA, 22 nt, Human
uuuagcaaggagaaauaauccu

SEQ ID NO: 117088 - RNA, 22 nt, Human
uuaucuuuuaaaaacacuugug

SEQ ID NO: 117089 - RNA, 22 nt, Human
uuucacuucgaucagaguuuuu

SEQ ID NO: 117090 - RNA, 18 nt, Human
uuauacaauuuuuuuuca

SEQ ID NO: 117091 - RNA, 22 nt, Human
uuauaagugccucuuuauuuuc

SEQ ID NO: 117092 - RNA, 22 nt, Human
uuauaggugauuaauuuuaacc

SEQ ID NO: 117093 - RNA, 22 nt, Human
uuucagcaugacuguuaucuuu

SEQ ID NO: 117094 - RNA, 22 nt, Human
uuaugucauuugaauuaauuuu

SEQ ID NO: 117095 - RNA, 22 nt, Human
uuucuacauuuguaaccagauu

SEQ ID NO: 117096 - RNA, 22 nt, Human
uuuccuuuguuuugguauaugu

SEQ ID NO: 117097 - RNA, 22 nt, Human
uuauuguuuggguauaauuuga

SEQ ID NO: 117098 - RNA, 22 nt, Human
uuucuaaaaccagaguuuauaa

SEQ ID NO: 117099 - RNA, 22 nt, Human
uuucgcuuguucggagugcuuu

SEQ ID NO: 117100 - RNA, 22 nt, Human
uugcugugucauuuguuuaauc

SEQ ID NO: 117101 - RNA, 22 nt, Human
uguggcuuaggugagcauguga

SEQ ID NO: 117102 - RNA, 22 nt, Human
uugcugggauucauugaagggu

SEQ ID NO: 117103 - RNA, 22 nt, Human
ugugcuauuuuugcauaugugu

SEQ ID NO: 117104 - RNA, 22 nt, Human
ugugcuugucuguuuugauugu

SEQ ID NO: 117105 - RNA, 22 nt, Human
ugugcaguauugaaauauaugu

SEQ ID NO: 117106 - RNA, 22 nt, Human
ugugcgcgugugcuuugugugu

SEQ ID NO: 117107 - RNA, 22 nt, Human
uguguggaggugggugaugucu

SEQ ID NO: 117108 - RNA, 22 nt, Human
uguguggccuccauaggguacu

SEQ ID NO: 117109 - RNA, 22 nt, Human
uuggaggccacagucaucuuua

SEQ ID NO: 117110 - RNA, 22 nt, Human
uuggaaaagaaauacucauaua

SEQ ID NO: 117111 - RNA, 22 nt, Human
uugcuuuuuuggguuuacuggg

SEQ ID NO: 117112 - RNA, 22 nt, Human
uugcuugcggccuuugugccuu

SEQ ID NO: 117113 - RNA, 22 nt, Human
uugcuugaacccaggaagugga

SEQ ID NO: 117114 - RNA, 23 nt, Human
uugcuuuugccccaaaagaguua

SEQ ID NO: 117115 - RNA, 22 nt, Human
uugggaaauuugaaaauaaaag

SEQ ID NO: 117116 - RNA, 22 nt, Human
uguuaaaaagucccuguuuugu

SEQ ID NO: 117117 - RNA, 22 nt, Human
uguugaagcaccucugucuuuc

SEQ ID NO: 117118 - RNA, 22 nt, Human
uguugaaacagcuauugacuuu

SEQ ID NO: 117119 - RNA, 22 nt, Human
uguuggaauaagugcuugaagg

SEQ ID NO: 117120 - RNA, 22 nt, Human
uguugccaucuaaaauguuacu

SEQ ID NO: 117121 - RNA, 21 nt, Human
uguugcuugucugagacuaug

SEQ ID NO: 117122 - RNA, 22 nt, Human
uuggugaugcuaggaauguagu

SEQ ID NO: 117123 - RNA, 22 nt, Human
uuggugaugcccaccuuuucau

SEQ ID NO: 117124 - RNA, 22 nt, Human
uuggugauugggaauggauggg

SEQ ID NO: 117125 - RNA, 22 nt, Human
uguuggcagugcuacagucagu

SEQ ID NO: 117126 - RNA, 22 nt, Human
uugauuuggaauuuuuagagcu

SEQ ID NO: 117127 - RNA, 22 nt, Human
uugauuuccauuguccagcauu

SEQ ID NO: 117128 - RNA, 22 nt, Human
uugauuugcagaagguguagag

SEQ ID NO: 117129 - RNA, 22 nt, Human
uguauuugaagaaagagcuucu

SEQ ID NO: 117130 - RNA, 22 nt, Human
ugugaaugacuguguucuuugc

SEQ ID NO: 117131 - RNA, 22 nt, Human
ugugaagcgugugcaggggaca

SEQ ID NO: 117132 - RNA, 22 nt, Human
ugugacugaaaaugauugagug

SEQ ID NO: 117133 - RNA, 17 nt, Human
ugucuuuuuccuccucc

SEQ ID NO: 117134 - RNA, 22 nt, Human
ugucuuuagagugaacagaaga

SEQ ID NO: 117135 - RNA, 21 nt, Human
uucuuugaagacccauuugag

SEQ ID NO: 117136 - RNA, 22 nt, Human
ugguuuacucuguaaaccagga

SEQ ID NO: 117137 - RNA, 22 nt, Human
uugaaaacugucaccuuuauuc

SEQ ID NO: 117138 - RNA, 22 nt, Human
uugaaaauuaauagguguacaa

SEQ ID NO: 117139 - RNA, 22 nt, Human
uugaaagaacaauucugugaug

SEQ ID NO: 117140 - RNA, 22 nt, Human
uugaacguguaggaagcugguu

SEQ ID NO: 117141 - RNA, 22 nt, Human
uucuguuuaaccuggaaagugu

SEQ ID NO: 117142 - RNA, 22 nt, Human
uucugaguguugucaccaugug

SEQ ID NO: 117143 - RNA, 22 nt, Human
uucugaugccuggguugcuucu

SEQ ID NO: 117144 - RNA, 22 nt, Human
uucugaaacauugcuauuuucc

SEQ ID NO: 117145 - RNA, 22 nt, Human
uuauuaauacaugcaccugcau

SEQ ID NO: 117146 - RNA, 22 nt, Human
uuauucuuagccucgguauuuc

SEQ ID NO: 117147 - RNA, 22 nt, Human
uuauuguagcacuuuggcagug

SEQ ID NO: 117148 - RNA, 22 nt, Human
uuauuuaaaauguagguuggga

SEQ ID NO: 117149 - RNA, 22 nt, Human
uggaggaggaugcauuuguugu

SEQ ID NO: 117150 - RNA, 22 nt, Human
uuauuuaagaucuuaauauaua

SEQ ID NO: 117151 - RNA, 22 nt, Human
uuauuugcccauguuuagcaga

SEQ ID NO: 117152 - RNA, 22 nt, Human
uuauuuuguagcucugaucuuu

SEQ ID NO: 117153 - RNA, 22 nt, Human
uuauuugguuuuggcuuuagcu

SEQ ID NO: 117154 - RNA, 22 nt, Human
uggauauagcugaggugucuug

SEQ ID NO: 117155 - RNA, 22 nt, Human
uuauuuuuaggaauguagaggu

SEQ ID NO: 117156 - RNA, 22 nt, Human
uucaaaaugcagaauaguuugg

SEQ ID NO: 117157 - RNA, 22 nt, Human
uucaacaacuugguucaaaugg

SEQ ID NO: 117158 - RNA, 22 nt, Human
uggauuagugcugaaaugaugg

SEQ ID NO: 117159 - RNA, 22 nt, Human
uggaugcuccaaguagaccuua

SEQ ID NO: 117160 - RNA, 22 nt, Human
uucacccaaaucaagcuggccu

SEQ ID NO: 117161 - RNA, 22 nt, Human
uucacugacaguauugaggagg

SEQ ID NO: 117162 - RNA, 22 nt, Human
uucacugugauugggguggauu

SEQ ID NO: 117163 - RNA, 22 nt, Human
uggcaucacagacaaggcagca

SEQ ID NO: 117164 - RNA, 22 nt, Human
uggcaucucggugcugguucuu

SEQ ID NO: 117165 - RNA, 22 nt, Human
uucagcaagugucucuacuguc

SEQ ID NO: 117166 - RNA, 21 nt, Human
uucauucauggcauaauauag

SEQ ID NO: 117167 - RNA, 22 nt, Human
uggcuucugguuuauccuuaua

SEQ ID NO: 117168 - RNA, 22 nt, Human
uucauccucuaguacugaagug

SEQ ID NO: 117169 - RNA, 22 nt, Human
uggccauuuacucuguaagagu

SEQ ID NO: 117170 - RNA, 22 nt, Human
uucauagaagggaguuuuuccu

SEQ ID NO: 117171 - RNA, 22 nt, Human
uggcuugagcugggcccaccug

SEQ ID NO: 117172 - RNA, 22 nt, Human
ugggaugagcuauauagaaagu

SEQ ID NO: 117173 - RNA, 22 nt, Human
uucccauuccagcucgaucaau

SEQ ID NO: 117174 - RNA, 22 nt, Human
uuccccuucuaauacucaauuu

SEQ ID NO: 117175 - RNA, 23 nt, Human
ugggccucuccacccuuuucugu

SEQ ID NO: 117176 - RNA, 22 nt, Human
uggggaauguaauucuuuggcu

SEQ ID NO: 117177 - RNA, 22 nt, Human
uucuacauugugaaguucuuua

SEQ ID NO: 117178 - RNA, 20 nt, Human
uucguuucaguguuggauca

SEQ ID NO: 117179 - RNA, 22 nt, Human
uucuacuagugguugauggccu

SEQ ID NO: 117180 - RNA, 22 nt, Human
ugcaucauuaagguacaguugg

SEQ ID NO: 117181 - RNA, 22 nt, Human
ugucuucuuuucccuuagcccu

SEQ ID NO: 117182 - RNA, 22 nt, Human
uguguguaugagcauuuguaug

SEQ ID NO: 117183 - RNA, 22 nt, Human
ugcauuuugaaggaaaaaaaug

SEQ ID NO: 117184 - RNA, 22 nt, Human
ugcauuugcaauggguacacaa

SEQ ID NO: 117185 - RNA, 22 nt, Human
ugcauuuuuaauuuggaaaaaa

SEQ ID NO: 117186 - RNA, 22 nt, Human
uguuaguauuggcaaauuuguu

SEQ ID NO: 117187 - RNA, 22 nt, Human
uguguuuuucauuuuaaguccu

SEQ ID NO: 117188 - RNA, 21 nt, Human
uguguuuauauguguuuauau

SEQ ID NO: 117189 - RNA, 22 nt, Human
uguguuuaaacuauaugccugc

SEQ ID NO: 117190 - RNA, 22 nt, Human
uguucuuacuaaguaccugaaa

SEQ ID NO: 117191 - RNA, 22 nt, Human
uguucuuaacuuuuguguauau

SEQ ID NO: 117192 - RNA, 22 nt, Human
uguucggaaaagggcaagcuau

SEQ ID NO: 117193 - RNA, 22 nt, Human
ugcgcgcaccugcauauauaug

SEQ ID NO: 117194 - RNA, 22 nt, Human
uggggucuggcauaugguagau

SEQ ID NO: 117195 - RNA, 22 nt, Human
uggugacaucuaccuagguaaa

SEQ ID NO: 117196 - RNA, 22 nt, Human
ugagggaugccucuccuuccgg

SEQ ID NO: 117197 - RNA, 22 nt, Human
uggugcacgugggcagucggcc

SEQ ID NO: 117198 - RNA, 22 nt, Human
ugagcuuugguaccuucauuug

SEQ ID NO: 117199 - RNA, 22 nt, Human
ugaguguuguaaccauaugauu

SEQ ID NO: 117200 - RNA, 22 nt, Human
ugguugcaguggugcuuauaca

SEQ ID NO: 117201 - RNA, 22 nt, Human
ugaguuuaggccaggauauggu

SEQ ID NO: 117202 - RNA, 22 nt, Human
uguaaacuuuugcauacugcuu

SEQ ID NO: 117203 - RNA, 22 nt, Human
ugaucauugaacaucgaguuaa

SEQ ID NO: 117204 - RNA, 22 nt, Human
uguaauuugguuagauuucuuu

SEQ ID NO: 117205 - RNA, 22 nt, Human
ugaugaugaagaaauauuauca

SEQ ID NO: 117206 - RNA, 21 nt, Human
uguauacacacauuguaccaa

SEQ ID NO: 117207 - RNA, 22 nt, Human
uguauagcaggguucuuccucc

SEQ ID NO: 117208 - RNA, 22 nt, Human
uguagacaugcuuuucugauga

SEQ ID NO: 117209 - RNA, 22 nt, Human
uguauugaggauucauuuuugu

SEQ ID NO: 117210 - RNA, 22 nt, Human
uguauauuuucuguauaaaaua

SEQ ID NO: 117211 - RNA, 22 nt, Human
ugcaaaaagagcgaggagcccu

SEQ ID NO: 117212 - RNA, 22 nt, Human
ugauuuguuuaaauugcucguu

SEQ ID NO: 117213 - RNA, 22 nt, Human
uguauuuuuucccugaaauaaa

SEQ ID NO: 117214 - RNA, 19 nt, Human
uguauuuauauuucugugc

SEQ ID NO: 117215 - RNA, 22 nt, Human
ugauugcucgacacucugcuug

SEQ ID NO: 117216 - RNA, 22 nt, Human
ugauugcucagcuagccucuuu

SEQ ID NO: 117217 - RNA, 22 nt, Human
ugauugauaaugaagacaguca

SEQ ID NO: 117218 - RNA, 22 nt, Human
ugucugucugccauuuauucuc

SEQ ID NO: 117219 - RNA, 22 nt, Human
ugcaagagcccaaacuauauac

SEQ ID NO: 117220 - RNA, 22 nt, Human
ugcaagauccagucuugagaag

SEQ ID NO: 117221 - RNA, 23 nt, Human
ugcaaaauuugcagaguucgaug

SEQ ID NO: 117222 - RNA, 22 nt, Human
ugaaauuuuuuggagauaauuu

SEQ ID NO: 117223 - RNA, 22 nt, Human
uggcuugacaucaauacuuauu

SEQ ID NO: 117224 - RNA, 22 nt, Human
uggcugaugucuguucuguuau

SEQ ID NO: 117225 - RNA, 22 nt, Human
ucuuuucagccagcugguagga

SEQ ID NO: 117226 - RNA, 22 nt, Human
uggcuuuuuauuccuaugugau

SEQ ID NO: 117227 - RNA, 22 nt, Human
ugaagaauuccauggcuuccau

SEQ ID NO: 117228 - RNA, 22 nt, Human
ugaagacaguuuuacucaugag

SEQ ID NO: 117229 - RNA, 22 nt, Human
ugaagcuaguauuaacucagau

SEQ ID NO: 117230 - RNA, 22 nt, Human
ugggauucugaaaauggauuac

SEQ ID NO: 117231 - RNA, 22 nt, Human
ugggcaaaugcuuuuuagucaa

SEQ ID NO: 117232 - RNA, 22 nt, Human
ugaaggaggugaauccaugcau

SEQ ID NO: 117233 - RNA, 22 nt, Human
ugaauggugcccuagagggaug

SEQ ID NO: 117234 - RNA, 22 nt, Human
ugaauuuuggcaauuuucugug

SEQ ID NO: 117235 - RNA, 22 nt, Human
ugaauuauaugguauugaacau

SEQ ID NO: 117236 - RNA, 22 nt, Human
ugaauucaaacuuuuuaacaag

SEQ ID NO: 117237 - RNA, 22 nt, Human
ucuuaaauaugaaaaggauuau

SEQ ID NO: 117238 - RNA, 22 nt, Human
ucuuauugguaaugauggcauu

SEQ ID NO: 117239 - RNA, 21 nt, Human
ucuuauacagcaauagaucug

SEQ ID NO: 117240 - RNA, 22 nt, Human
ucuuauucuuuuaaacaacgca

SEQ ID NO: 117241 - RNA, 22 nt, Human
ucuuaaucauucuucacuuccu

SEQ ID NO: 117242 - RNA, 22 nt, Human
uggauuguuuacaucaugucug

SEQ ID NO: 117243 - RNA, 22 nt, Human
ucuucuuuccuuuugugcauuu

SEQ ID NO: 117244 - RNA, 22 nt, Human
ucuugcuguggcagaucuggag

SEQ ID NO: 117245 - RNA, 22 nt, Human
ucuugugagcugagauaaagcc

SEQ ID NO: 117246 - RNA, 19 nt, Human
ucuuucauuucuagcucug

SEQ ID NO: 117247 - RNA, 22 nt, Human
uggaagaaaugguugagccaug

SEQ ID NO: 117248 - RNA, 22 nt, Human
uggaaagcagcccugcucccca

SEQ ID NO: 117249 - RNA, 22 nt, Human
uggaaauaguugugagucaggc

SEQ ID NO: 117250 - RNA, 22 nt, Human
uggaaauagauguaggaaauug

SEQ ID NO: 117251 - RNA, 22 nt, Human
uggagaaauaacauuuggauuc

SEQ ID NO: 117252 - RNA, 21 nt, Human
uggaauuggaaaccauucuau

SEQ ID NO: 117253 - RNA, 22 nt, Human
uggaagaucugguguagcuccu

SEQ ID NO: 117254 - RNA, 22 nt, Human
uggagcuggcuuguggaaguug

SEQ ID NO: 117255 - RNA, 22 nt, Human
ucguccaauaaccugccagcgc

SEQ ID NO: 117256 - RNA, 22 nt, Human
ugcuauuuuguuuucaguccau

SEQ ID NO: 117257 - RNA, 22 nt, Human
ugcuauuaagagaaagugaaca

SEQ ID NO: 117258 - RNA, 22 nt, Human
ugcuauucuuggagcugaugga

SEQ ID NO: 117259 - RNA, 21 nt, Human
ugcguaugucuuguauuacuc

SEQ ID NO: 117260 - RNA, 22 nt, Human
ucccuuuuuaauugugucccug

SEQ ID NO: 117261 - RNA, 22 nt, Human
ucccuuuuagccccgcccuccu

SEQ ID NO: 117262 - RNA, 22 nt, Human
ugcauugccucuauucauuaua

SEQ ID NO: 117263 - RNA, 22 nt, Human
ugcauuaguaaagagaggaggg

SEQ ID NO: 117264 - RNA, 22 nt, Human
ugacuuauuaaaaguuuuuauu

SEQ ID NO: 117265 - RNA, 22 nt, Human
ugagguauuuggauuuauauuu

SEQ ID NO: 117266 - RNA, 22 nt, Human
ucauccugaagaaccugcuucc

SEQ ID NO: 117267 - RNA, 22 nt, Human
ugaguuuuggaagauguuacag

SEQ ID NO: 117268 - RNA, 22 nt, Human
ucauuguuuacugucuuuuuuc

SEQ ID NO: 117269 - RNA, 22 nt, Human
ucauugguugcauaauuugauc

SEQ ID NO: 117270 - RNA, 23 nt, Human
ucauugcucaagauaaugguuga

SEQ ID NO: 117271 - RNA, 22 nt, Human
uccaaauucccaugacagaagu

SEQ ID NO: 117272 - RNA, 22 nt, Human
uccaacuuaauugggaagauua

SEQ ID NO: 117273 - RNA, 22 nt, Human
uccaaauagcuggaugauggug

SEQ ID NO: 117274 - RNA, 22 nt, Human
ugaugcuagaacuuccaagaua

SEQ ID NO: 117275 - RNA, 22 nt, Human
ugaugaaguuggaaggaaaguu

SEQ ID NO: 117276 - RNA, 22 nt, Human
uccagugccagcuguuaaaguu

SEQ ID NO: 117277 - RNA, 22 nt, Human
uccaucauucagaaauuuuuga

SEQ ID NO: 117278 - RNA, 22 nt, Human
ugauuugauuuguuuaugccug

SEQ ID NO: 117279 - RNA, 22 nt, Human
uccacagugguggaauuguuca

SEQ ID NO: 117280 - RNA, 22 nt, Human
uccauugucaauaguauugauu

SEQ ID NO: 117281 - RNA, 22 nt, Human
ucccagcaggcaccgcuucugc

SEQ ID NO: 117282 - RNA, 22 nt, Human
ucuugauggugauguuguguca

SEQ ID NO: 117283 - RNA, 22 nt, Human
ucuucuuugugguugcccaagg

SEQ ID NO: 117284 - RNA, 22 nt, Human
ucuucuuacauuaaguugaaac

SEQ ID NO: 117285 - RNA, 22 nt, Human
uauugaucuuugaaaccuuggu

SEQ ID NO: 117286 - RNA, 22 nt, Human
uauugauuuuguugcuaccugg

SEQ ID NO: 117287 - RNA, 22 nt, Human
uauuggcucagucagaaguuuu

SEQ ID NO: 117288 - RNA, 22 nt, Human
ucuuuaaggggccuuuguguca

SEQ ID NO: 117289 - RNA, 22 nt, Human
ucuuuauuucccuaacuugcua

SEQ ID NO: 117290 - RNA, 22 nt, Human
ucuuguuaaagguuaaagguga

SEQ ID NO: 117291 - RNA, 22 nt, Human
ucuuggucccugagcucuuuca

SEQ ID NO: 117292 - RNA, 22 nt, Human
ucuuugcauggacauguguuuu

SEQ ID NO: 117293 - RNA, 22 nt, Human
ucuuuguuagucagaauugauc

SEQ ID NO: 117294 - RNA, 22 nt, Human
uauuuaggcagaaagugauauu

SEQ ID NO: 117295 - RNA, 22 nt, Human
uauuuaugcaucacuuuuuucc

SEQ ID NO: 117296 - RNA, 18 nt, Human
uauuuacuguguguuacc

SEQ ID NO: 117297 - RNA, 22 nt, Human
uauuuaaagucagcaacuuuuc

SEQ ID NO: 117298 - RNA, 22 nt, Human
uauuguuuuaagguguauuaau

SEQ ID NO: 117299 - RNA, 22 nt, Human
uauugugaaggccaugugcuaa

SEQ ID NO: 117300 - RNA, 22 nt, Human
uauuucaucugaacuucccaac

SEQ ID NO: 117301 - RNA, 22 nt, Human
uauuucaugagugaauaucuag

SEQ ID NO: 117302 - RNA, 22 nt, Human
uauuuccugcguuucugugagc

SEQ ID NO: 117303 - RNA, 22 nt, Human
uauuuguuucuaguggcagcaa

SEQ ID NO: 117304 - RNA, 22 nt, Human
uauuuguuuuuaaugcugggug

SEQ ID NO: 117305 - RNA, 22 nt, Human
uauuugauggaacucuugcuuu

SEQ ID NO: 117306 - RNA, 22 nt, Human
uauuuugaggugaaagaguuug

SEQ ID NO: 117307 - RNA, 22 nt, Human
uauuuucucugccacacuucca

SEQ ID NO: 117308 - RNA, 22 nt, Human
uauuuuggcuccugagcucuga

SEQ ID NO: 117309 - RNA, 22 nt, Human
uauuuuagccaacagaaugaug

SEQ ID NO: 117310 - RNA, 22 nt, Human
uauuuuagaagauuuggagaaa

SEQ ID NO: 117311 - RNA, 22 nt, Human
uauuuuauuuagguuuaguugu

SEQ ID NO: 117312 - RNA, 22 nt, Human
ugaaaaaugcuuuaaugcaugu

SEQ ID NO: 117313 - RNA, 22 nt, Human
ugaaagcuggcucugcagagug

SEQ ID NO: 117314 - RNA, 22 nt, Human
ugaaauugaguaccucuuuaua

SEQ ID NO: 117315 - RNA, 22 nt, Human
ugaaaugccucuuugguucuaa

SEQ ID NO: 117316 - RNA, 22 nt, Human
uauuuuuaccuaauuuaugaga

SEQ ID NO: 117317 - RNA, 22 nt, Human
ugaaccaugaauuacaggagca

SEQ ID NO: 117318 - RNA, 22 nt, Human
uauuuuuuuaacauuuauugua

SEQ ID NO: 117319 - RNA, 22 nt, Human
ugaagccaugcuaaauguuaca

SEQ ID NO: 117320 - RNA, 22 nt, Human
ugaauaaauaaacuuuuacuac

SEQ ID NO: 117321 - RNA, 23 nt, Human
ugaagugaaauuucacaagggac

SEQ ID NO: 117322 - RNA, 22 nt, Human
ucaaggaagggguaggaauaau

SEQ ID NO: 117323 - RNA, 21 nt, Human
ucaagcggcagagcaguuauu

SEQ ID NO: 117324 - RNA, 22 nt, Human
ugaagcuagguucaugaggucg

SEQ ID NO: 117325 - RNA, 22 nt, Human
ugaaucuuguuuacugauuccu

SEQ ID NO: 117326 - RNA, 22 nt, Human
ugaauaaucuuggguauuaaua

SEQ ID NO: 117327 - RNA, 22 nt, Human
ucaauuuauguggcuauucauu

SEQ ID NO: 117328 - RNA, 22 nt, Human
ugaauuacacugggaucagggc

SEQ ID NO: 117329 - RNA, 22 nt, Human
ugaaugaagcacuguaauucuc

SEQ ID NO: 117330 - RNA, 22 nt, Human
ucacuuuacaucuguaaaagga

SEQ ID NO: 117331 - RNA, 22 nt, Human
ucacuuccuugcagcuguagaa

SEQ ID NO: 117332 - RNA, 22 nt, Human
ucagaacuaacuuugcugaacc

SEQ ID NO: 117333 - RNA, 20 nt, Human
ucacuguaauugccuacauu

SEQ ID NO: 117334 - RNA, 22 nt, Human
ugaauuucuuuuuaaaauauua

SEQ ID NO: 117335 - RNA, 22 nt, Human
ucagagaaguaggcuaauggug

SEQ ID NO: 117336 - RNA, 22 nt, Human
ugacauuugagagagauauaca

SEQ ID NO: 117337 - RNA, 22 nt, Human
ucagauaauccaauagagagga

SEQ ID NO: 117338 - RNA, 22 nt, Human
ugacgggacacaggugccaaca

SEQ ID NO: 117339 - RNA, 22 nt, Human
ugacgcauggccagcucugucu

SEQ ID NO: 117340 - RNA, 22 nt, Human
uaguucugaauagcauugaaga

SEQ ID NO: 117341 - RNA, 22 nt, Human
uagcauuucacugaucuucacu

SEQ ID NO: 117342 - RNA, 22 nt, Human
uagcauuuagaacaccuugaga

SEQ ID NO: 117343 - RNA, 22 nt, Human
uauaaugucuuuguugaaaucu

SEQ ID NO: 117344 - RNA, 22 nt, Human
uauaaucuugcccauaguauuu

SEQ ID NO: 117345 - RNA, 22 nt, Human
uauacauauacaaaugcacaua

SEQ ID NO: 117346 - RNA, 22 nt, Human
uauacucaauaaauauuuggag

SEQ ID NO: 117347 - RNA, 18 nt, Human
uauaaacacacuuagguu

SEQ ID NO: 117348 - RNA, 22 nt, Human
uauaaagaccuuauccuucaua

SEQ ID NO: 117349 - RNA, 22 nt, Human
uauaagaaacaaggcaaauuuu

SEQ ID NO: 117350 - RNA, 22 nt, Human
uauagccuuacaagauauuaua

SEQ ID NO: 117351 - RNA, 22 nt, Human
uaugauuuucaugguagaguua

SEQ ID NO: 117352 - RNA, 22 nt, Human
guguggcgacucagagcugccu

SEQ ID NO: 117353 - RNA, 22 nt, Human
guguguauguagguauauaugu

SEQ ID NO: 117354 - RNA, 22 nt, Human
uauauuuguccuagcuccuagc

SEQ ID NO: 117355 - RNA, 22 nt, Human
uauuuuggaugcauugagaugc

SEQ ID NO: 117356 - RNA, 22 nt, Human
guugauuuaaccucaccuuuga

SEQ ID NO: 117357 - RNA, 22 nt, Human
uauuucuagggcaugaaaauaa

SEQ ID NO: 117358 - RNA, 22 nt, Human
uauuacugccacaucauuaggu

SEQ ID NO: 117359 - RNA, 22 nt, Human
uauuggguagguccuuuggagu

SEQ ID NO: 117360 - RNA, 22 nt, Human
uauggcuucucagucaugaaaa

SEQ ID NO: 117361 - RNA, 22 nt, Human
guguuaaucauuuuugauuuug

SEQ ID NO: 117362 - RNA, 22 nt, Human
guguuagagucuugugcucauu

SEQ ID NO: 117363 - RNA, 22 nt, Human
guuacuacccacccuucucccc

SEQ ID NO: 117364 - RNA, 22 nt, Human
uauguuaaauguuugauguuua

SEQ ID NO: 117365 - RNA, 22 nt, Human
uaugugugaguauauaugcaca

SEQ ID NO: 117366 - RNA, 22 nt, Human
uauuaaaagagaaaaagccacc

SEQ ID NO: 117367 - RNA, 22 nt, Human
uauucccacuccucagcaauuu

SEQ ID NO: 117368 - RNA, 21 nt, Human
uauucgcauuucugucuuuac

SEQ ID NO: 117369 - RNA, 22 nt, Human
ucaagguauuauuuuuguggug

SEQ ID NO: 117370 - RNA, 22 nt, Human
guugcaaaugggaagaugguua

SEQ ID NO: 117371 - RNA, 22 nt, Human
uauuuuuacuguuugaugauuc

SEQ ID NO: 117372 - RNA, 22 nt, Human
guuguuuucagcccagcauuag

SEQ ID NO: 117373 - RNA, 22 nt, Human
guuuaaguuaaaauuuaccugc

SEQ ID NO: 117374 - RNA, 22 nt, Human
guuuaagcagauugcuguggug

SEQ ID NO: 117375 - RNA, 22 nt, Human
guuguuuuuguuaaaacaguga

SEQ ID NO: 117376 - RNA, 22 nt, Human
guuugaacagaaggguugauca

SEQ ID NO: 117377 - RNA, 22 nt, Human
guuugagcaaucccucuauccc

SEQ ID NO: 117378 - RNA, 22 nt, Human
guuuccaagucucucaacaccc

SEQ ID NO: 117379 - RNA, 22 nt, Human
guuuauuucuuaucaucacuau

SEQ ID NO: 117380 - RNA, 22 nt, Human
guuuacaacaucuuguccuuca

SEQ ID NO: 117381 - RNA, 22 nt, Human
ucacuucuaugaucugucucuu

SEQ ID NO: 117382 - RNA, 23 nt, Human
ucacuucucuuacccucucucug

SEQ ID NO: 117383 - RNA, 22 nt, Human
guuuuucuagaaaucuccuccu

SEQ ID NO: 117384 - RNA, 22 nt, Human
guuuuuaguuuaaguuuuugca

SEQ ID NO: 117385 - RNA, 22 nt, Human
guuuucuuguuaauuuugaacg

SEQ ID NO: 117386 - RNA, 22 nt, Human
guuuugaugugauuucucaugu

SEQ ID NO: 117387 - RNA, 22 nt, Human
guuuugauggaguguguuaaau

SEQ ID NO: 117388 - RNA, 22 nt, Human
guuuuguucaugaacauugggu

SEQ ID NO: 117389 - RNA, 22 nt, Human
guuuuuacuuccaaugcuauga

SEQ ID NO: 117390 - RNA, 22 nt, Human
ucagaacucuagucucagccug

SEQ ID NO: 117391 - RNA, 22 nt, Human
guuuuauaacuauagugagaau

SEQ ID NO: 117392 - RNA, 22 nt, Human
ucagauagcaagggauaccugu

SEQ ID NO: 117393 - RNA, 22 nt, Human
uaaaaccauucauugaccuaug

SEQ ID NO: 117394 - RNA, 22 nt, Human
uaaaaauuagauauguauuuag

SEQ ID NO: 117395 - RNA, 22 nt, Human
guuuuucuuugauuuagaacca

SEQ ID NO: 117396 - RNA, 22 nt, Human
uaaaaucaugacagauugacau

SEQ ID NO: 117397 - RNA, 22 nt, Human
uaaaaugcucagauaaauauau

SEQ ID NO: 117398 - RNA, 22 nt, Human
uaaaaguuagcuaggacaaagu

SEQ ID NO: 117399 - RNA, 22 nt, Human
uaaagaagaaaaggcuucaggc

SEQ ID NO: 117400 - RNA, 22 nt, Human
uaauucuacagggaacucugga

SEQ ID NO: 117401 - RNA, 22 nt, Human
uacaaaugaucaucucuuugaa

SEQ ID NO: 117402 - RNA, 20 nt, Human
uacaaggauguucaucagag

SEQ ID NO: 117403 - RNA, 22 nt, Human
ucauugguugcguaauuugauu

SEQ ID NO: 117404 - RNA, 22 nt, Human
uaagugguagaaagagaaaggu

SEQ ID NO: 117405 - RNA, 22 nt, Human
uaacuuuuuauccuguuaaaug

SEQ ID NO: 117406 - RNA, 22 nt, Human
uaaagacaauuucgagcuguag

SEQ ID NO: 117407 - RNA, 22 nt, Human
uaagacuuuaccaggcucaaau

SEQ ID NO: 117408 - RNA, 22 nt, Human
uacauagaauauauaaaugucg

SEQ ID NO: 117409 - RNA, 22 nt, Human
uacauuguguuaaaacagaaga

SEQ ID NO: 117410 - RNA, 22 nt, Human
uccagaaaucucuguugauugu

SEQ ID NO: 117411 - RNA, 22 nt, Human
uccagaaagccguugacuuauu

SEQ ID NO: 117412 - RNA, 22 nt, Human
uacucgaaaucagagagaauaa

SEQ ID NO: 117413 - RNA, 22 nt, Human
ucccagaaccuuuuagcuucac

SEQ ID NO: 117414 - RNA, 22 nt, Human
uacuuaaaacacauuuagcauu

SEQ ID NO: 117415 - RNA, 22 nt, Human
uacucauuggagaauuacgagg

SEQ ID NO: 117416 - RNA, 22 nt, Human
uacuauuuugacaugaaauuga

SEQ ID NO: 117417 - RNA, 23 nt, Human
uaccauugauuuuaugguuuucu

SEQ ID NO: 117418 - RNA, 22 nt, Human
uccuuuuuagguuauuguacau

SEQ ID NO: 117419 - RNA, 19 nt, Human
ucggaaugugggaagcaug

SEQ ID NO: 117420 - RNA, 22 nt, Human
ucgcuguguccuuuucacuuau

SEQ ID NO: 117421 - RNA, 22 nt, Human
uagguaauacuuagaccugauu

SEQ ID NO: 117422 - RNA, 22 nt, Human
uaggucugaggcugcaucuugg

SEQ ID NO: 117423 - RNA, 22 nt, Human
ucguauucagugcaagucaacg

SEQ ID NO: 117424 - RNA, 22 nt, Human
uaguaauauuccuacauuaugu

SEQ ID NO: 117425 - RNA, 22 nt, Human
ucuaagcuugaucacuugcuuu

SEQ ID NO: 117426 - RNA, 22 nt, Human
ucuaaaaauuagaaauuagguc

SEQ ID NO: 117427 - RNA, 22 nt, Human
uagugauuuaagaaaggugacu

SEQ ID NO: 117428 - RNA, 22 nt, Human
uaguacuugauuuuaaauguua

SEQ ID NO: 117429 - RNA, 22 nt, Human
uaguagcuguuguuuuuuaaac

SEQ ID NO: 117430 - RNA, 22 nt, Human
uaguauuuguaauuaucaaagc

SEQ ID NO: 117431 - RNA, 22 nt, Human
uaguauuguguuguuugacagu

SEQ ID NO: 117432 - RNA, 18 nt, Human
uccuuucaccccuucucu

SEQ ID NO: 117433 - RNA, 22 nt, Human
uccuuguucugauuuuucuggg

SEQ ID NO: 117434 - RNA, 22 nt, Human
uagccguugggguaacuggaca

SEQ ID NO: 117435 - RNA, 22 nt, Human
uagauuguaagcuccuugaggg

SEQ ID NO: 117436 - RNA, 22 nt, Human
uagauuuaaaaagggugggaug

SEQ ID NO: 117437 - RNA, 22 nt, Human
uagcauuuauugggcuagcaaa

SEQ ID NO: 117438 - RNA, 22 nt, Human
uacuuagagucgggaugcacaa

SEQ ID NO: 117439 - RNA, 22 nt, Human
uagaaguuaaaggaauacagaa

SEQ ID NO: 117440 - RNA, 22 nt, Human
uagagaaauuacagcuuucuuu

SEQ ID NO: 117441 - RNA, 22 nt, Human
uagagaaauauuuguagugcug

SEQ ID NO: 117442 - RNA, 22 nt, Human
uacuuaucuuagggaugcuugc

SEQ ID NO: 117443 - RNA, 22 nt, Human
gugauauaacaauuuagggaau

SEQ ID NO: 117444 - RNA, 22 nt, Human
uagaaugggaggggaaucaucc

SEQ ID NO: 117445 - RNA, 19 nt, Human
uagacagauuuguguuacu

SEQ ID NO: 117446 - RNA, 22 nt, Human
uagauuccaaaauaguuugguu

SEQ ID NO: 117447 - RNA, 22 nt, Human
uagcagcacuauuuguuguagu

SEQ ID NO: 117448 - RNA, 22 nt, Human
gugcgaaagaagcgacuccagu

SEQ ID NO: 117449 - RNA, 22 nt, Human
uacuaaagaaugaguuaaguuu

SEQ ID NO: 117450 - RNA, 22 nt, Human
uacccauuuugguucuugaugc

SEQ ID NO: 117451 - RNA, 22 nt, Human
gucuccuucauuuacuguuucc

SEQ ID NO: 117452 - RNA, 22 nt, Human
uaauaaaaauuuaauucacauu

SEQ ID NO: 117453 - RNA, 22 nt, Human
uaauaacuacacucagaggacc

SEQ ID NO: 117454 - RNA, 22 nt, Human
gucuauuuauagacagauccua

SEQ ID NO: 117455 - RNA, 22 nt, Human
uaauaguugaaggucaucacua

SEQ ID NO: 117456 - RNA, 22 nt, Human
guuuuaaucuccuuauuccuaa

SEQ ID NO: 117457 - RNA, 22 nt, Human
guuuuaucuauguaauuauaaa

SEQ ID NO: 117458 - RNA, 22 nt, Human
ggucaaauaugaguaauuuccu

SEQ ID NO: 117459 - RNA, 22 nt, Human
guuuucuaaaacacauauaagu

SEQ ID NO: 117460 - RNA, 22 nt, Human
guuuuauguuuuauagacacaa

SEQ ID NO: 117461 - RNA, 22 nt, Human
gguggcauucaguaaguauaua

SEQ ID NO: 117462 - RNA, 22 nt, Human
gguggcauguaccucacagacu

SEQ ID NO: 117463 - RNA, 22 nt, Human
guuuugaagagaagcaagucug

SEQ ID NO: 117464 - RNA, 22 nt, Human
uaaagaggagaauuaagucagc

SEQ ID NO: 117465 - RNA, 23 nt, Human
uaaagauaguuuaaaggugaguu

SEQ ID NO: 117466 - RNA, 22 nt, Human
uaaagcacucaaaauuguagcu

SEQ ID NO: 117467 - RNA, 21 nt, Human
gguuucugcaaaccuuguaca

SEQ ID NO: 117468 - RNA, 22 nt, Human
gguuuauucccacaaaggaagu

SEQ ID NO: 117469 - RNA, 22 nt, Human
uaaaugauaguauugaagguag

SEQ ID NO: 117470 - RNA, 22 nt, Human
uaaaugagcaccucuaguuuug

SEQ ID NO: 117471 - RNA, 22 nt, Human
guaaauaucucacgaaugauuc

SEQ ID NO: 117472 - RNA, 22 nt, Human
guaaacugaauuggauacugug

SEQ ID NO: 117473 - RNA, 22 nt, Human
uaaauguacugaggcaacagga

SEQ ID NO: 117474 - RNA, 22 nt, Human
gguuauuucugauuauaugaua

SEQ ID NO: 117475 - RNA, 22 nt, Human
gguguuaaccagcuaaaguuug

SEQ ID NO: 117476 - RNA, 22 nt, Human
uaaggaaaugcaaauuuaagaa

SEQ ID NO: 117477 - RNA, 22 nt, Human
gucacuuuuaagggccuuuucu

SEQ ID NO: 117478 - RNA, 22 nt, Human
uaagauauugagugguaauuug

SEQ ID NO: 117479 - RNA, 22 nt, Human
guauuaugaaugccgaggcggc

SEQ ID NO: 117480 - RNA, 22 nt, Human
guaucuuuauuuuaauuaagau

SEQ ID NO: 117481 - RNA, 21 nt, Human
guaucuuucuuuuaaaauauc

SEQ ID NO: 117482 - RNA, 22 nt, Human
uaagaaacauuuuuaugacagu

SEQ ID NO: 117483 - RNA, 22 nt, Human
guauauuuaugagcauuagccu

SEQ ID NO: 117484 - RNA, 22 nt, Human
guauaaauaucuauauuguuac

SEQ ID NO: 117485 - RNA, 22 nt, Human
guaguuuuucuugcaagaguag

SEQ ID NO: 117486 - RNA, 22 nt, Human
guaggaaaugaauaagguaccu

SEQ ID NO: 117487 - RNA, 22 nt, Human
guuaaaaugauuugugauuuau

SEQ ID NO: 117488 - RNA, 23 nt, Human
guuaccgaccugauucggcagcc

SEQ ID NO: 117489 - RNA, 22 nt, Human
guuagaauggacaaagcugaaa

SEQ ID NO: 117490 - RNA, 22 nt, Human
guuauuuugucuuguucaugaa

SEQ ID NO: 117491 - RNA, 22 nt, Human
gggguugauaauuagagaaaug

SEQ ID NO: 117492 - RNA, 22 nt, Human
ggggcuuggguaagaaugcaaa

SEQ ID NO: 117493 - RNA, 22 nt, Human
ggguggaaugugagugugugug

SEQ ID NO: 117494 - RNA, 22 nt, Human
guucuacaugacacucaacauu

SEQ ID NO: 117495 - RNA, 22 nt, Human
guugauuuaggguuuugguuuu

SEQ ID NO: 117496 - RNA, 22 nt, Human
guucuucucuuguaauggaauc

SEQ ID NO: 117497 - RNA, 22 nt, Human
guucuuuacuucgcaucugcua

SEQ ID NO: 117498 - RNA, 22 nt, Human
guugagaagaccauuuuguuca

SEQ ID NO: 117499 - RNA, 22 nt, Human
ggguuuuaccagauguguggug

SEQ ID NO: 117500 - RNA, 22 nt, Human
ggguuggaggcauugaaacaga

SEQ ID NO: 117501 - RNA, 22 nt, Human
gggcuguuugcauauguuuaua

SEQ ID NO: 117502 - RNA, 22 nt, Human
ggggaagagagaagaaugaucu

SEQ ID NO: 117503 - RNA, 22 nt, Human
ggggaaauauuucugaccugug

SEQ ID NO: 117504 - RNA, 22 nt, Human
guggugaacauuugcaucugcu

SEQ ID NO: 117505 - RNA, 22 nt, Human
guggugauuugggucuagcuuu

SEQ ID NO: 117506 - RNA, 22 nt, Human
gugguaagugcuccuauuggcg

SEQ ID NO: 117507 - RNA, 22 nt, Human
guguauuucuagaagaaaugaa

SEQ ID NO: 117508 - RNA, 22 nt, Human
guguagauuuguucaccuauua

SEQ ID NO: 117509 - RNA, 22 nt, Human
guguauaguggugucgguagaa

SEQ ID NO: 117510 - RNA, 22 nt, Human
guggugguguuggugacaaguu

SEQ ID NO: 117511 - RNA, 22 nt, Human
gugggcuuuuuugaaaccugaa

SEQ ID NO: 117512 - RNA, 22 nt, Human
gugggauaaccugagauaacau

SEQ ID NO: 117513 - RNA, 18 nt, Human
guggccauugaccagcuu

SEQ ID NO: 117514 - RNA, 22 nt, Human
gugcuuugcuaggaccgauugu

SEQ ID NO: 117515 - RNA, 22 nt, Human
ggaagauagaaguucaaaaguu

SEQ ID NO: 117516 - RNA, 22 nt, Human
ggaagcucaauacuuuccucuu

SEQ ID NO: 117517 - RNA, 22 nt, Human
gcugggacacacagucuucuuu

SEQ ID NO: 117518 - RNA, 22 nt, Human
gcugggccucuuacuucuuacg

SEQ ID NO: 117519 - RNA, 22 nt, Human
ggaauaauauuacagauacagu

SEQ ID NO: 117520 - RNA, 22 nt, Human
ggaagugagcucauuacuuuag

SEQ ID NO: 117521 - RNA, 19 nt, Human
ggagcagauaaacauacuu

SEQ ID NO: 117522 - RNA, 22 nt, Human
ggagaugaaugugguaaaacug

SEQ ID NO: 117523 - RNA, 22 nt, Human
ggauggaugugaucugccuccu

SEQ ID NO: 117524 - RNA, 22 nt, Human
ggaucgauuccaaauguagauc

SEQ ID NO: 117525 - RNA, 22 nt, Human
ggauugaagggaaccucagaau

SEQ ID NO: 117526 - RNA, 22 nt, Human
ggcaagauccagcacaaacaca

SEQ ID NO: 117527 - RNA, 22 nt, Human
gcuggaagggccagcuuucagg

SEQ ID NO: 117528 - RNA, 21 nt, Human
ggcuguuaauagugauuagaa

SEQ ID NO: 117529 - RNA, 22 nt, Human
ggcuggagcaggcugcacagug

SEQ ID NO: 117530 - RNA, 20 nt, Human
ggauugaacuauuucucagc

SEQ ID NO: 117531 - RNA, 22 nt, Human
gguagauacaaaaagauugugg

SEQ ID NO: 117532 - RNA, 22 nt, Human
ggauaauguauuuuaaaauggg

SEQ ID NO: 117533 - RNA, 22 nt, Human
ggauuugaugagacuaucuacu

SEQ ID NO: 117534 - RNA, 22 nt, Human
ggugggccaaauuaaacauaua

SEQ ID NO: 117535 - RNA, 22 nt, Human
ggugggaauccaggccuucauc

SEQ ID NO: 117536 - RNA, 22 nt, Human
guaguggaauuuagaguauaau

SEQ ID NO: 117537 - RNA, 22 nt, Human
guacugggaauggagccugggc

SEQ ID NO: 117538 - RNA, 22 nt, Human
guaaccacuaugguuauugauu

SEQ ID NO: 117539 - RNA, 22 nt, Human
guaccuguacauaacuacauau

SEQ ID NO: 117540 - RNA, 22 nt, Human
gguuuuuggcucaauauuuugg

SEQ ID NO: 117541 - RNA, 22 nt, Human
guaaauacuaugagauaaugaa

SEQ ID NO: 117542 - RNA, 22 nt, Human
guaaauuaugucugggucaguu

SEQ ID NO: 117543 - RNA, 23 nt, Human
gcuuugaaaaugcuuucuuccag

SEQ ID NO: 117544 - RNA, 22 nt, Human
gcuuuucucccugcuuucuucc

SEQ ID NO: 117545 - RNA, 22 nt, Human
ggaaaaugcugaagcaucugaa

SEQ ID NO: 117546 - RNA, 22 nt, Human
gggcaagagaggaagagauggc

SEQ ID NO: 117547 - RNA, 22 nt, Human
gggcaagaagcuggaagcauuc

SEQ ID NO: 117548 - RNA, 22 nt, Human
ggaaaagaauuguuaguuagug

SEQ ID NO: 117549 - RNA, 19 nt, Human
gggauuccuggcuuuagaa

SEQ ID NO: 117550 - RNA, 22 nt, Human
ggaagcuguugugagugcagca

SEQ ID NO: 117551 - RNA, 23 nt, Human
ggaauuucagaugugaaauaaaa

SEQ ID NO: 117552 - RNA, 22 nt, Human
ggagaaacuaguuagauccaau

SEQ ID NO: 117553 - RNA, 22 nt, Human
ggggauuuuucuuacucuuagg

SEQ ID NO: 117554 - RNA, 22 nt, Human
gcggaucuccuugagugggcaa

SEQ ID NO: 117555 - RNA, 22 nt, Human
gcggcuggcuguccaaacuggg

SEQ ID NO: 117556 - RNA, 17 nt, Human
gcuaguuguuuccagua

SEQ ID NO: 117557 - RNA, 22 nt, Human
gcuauuuagaaaggcuuggaga

SEQ ID NO: 117558 - RNA, 22 nt, Human
gcucugaacugucaugaauugg

SEQ ID NO: 117559 - RNA, 22 nt, Human
gcugagcaaugcacugccgcau

SEQ ID NO: 117560 - RNA, 23 nt, Human
gcugagcaccagccauaucuuuu

SEQ ID NO: 117561 - RNA, 22 nt, Human
gcugcuggcggagcuggcgcug

SEQ ID NO: 117562 - RNA, 22 nt, Human
gcuggauuuaggguucccuccu

SEQ ID NO: 117563 - RNA, 22 nt, Human
gcccagaagguagcgaguaguc

SEQ ID NO: 117564 - RNA, 22 nt, Human
gauugauguaggugauaaaucu

SEQ ID NO: 117565 - RNA, 22 nt, Human
gaugguuuuacauuuuaauguu

SEQ ID NO: 117566 - RNA, 22 nt, Human
gcaaaaacaguguagucuucug

SEQ ID NO: 117567 - RNA, 22 nt, Human
gauuugucuauauucaaauaug

SEQ ID NO: 117568 - RNA, 22 nt, Human
gauauauuucaaauucuuuugc

SEQ ID NO: 117569 - RNA, 22 nt, Human
gauagaaagagaaucagaacuu

SEQ ID NO: 117570 - RNA, 22 nt, Human
gaugauuuuguaacuggggaca

SEQ ID NO: 117571 - RNA, 22 nt, Human
gaucauuuucauuaauguugca

SEQ ID NO: 117572 - RNA, 18 nt, Human
gaugaagaggaagaggag

SEQ ID NO: 117573 - RNA, 22 nt, Human
gauauuuugugaaaaaacaacu

SEQ ID NO: 117574 - RNA, 22 nt, Human
gcauuucuguuuuuuuaaauga

SEQ ID NO: 117575 - RNA, 22 nt, Human
gaggggaaggguguucaauggg

SEQ ID NO: 117576 - RNA, 22 nt, Human
gaggucaugcagcucugaguuc

SEQ ID NO: 117577 - RNA, 22 nt, Human
gcaggacugauggagcauaugu

SEQ ID NO: 117578 - RNA, 22 nt, Human
gcagcguguggcuaauggcucu

SEQ ID NO: 117579 - RNA, 22 nt, Human
gagggaaauauggguuugguua

SEQ ID NO: 117580 - RNA, 22 nt, Human
gcagaaguauuguacgguggga

SEQ ID NO: 117581 - RNA, 21 nt, Human
gcagaaagugauuugcuauuc

SEQ ID NO: 117582 - RNA, 22 nt, Human
gcacaaaagguacuucauguag

SEQ ID NO: 117583 - RNA, 22 nt, Human
gcaagagaagaaagaauaguuu

SEQ ID NO: 117584 - RNA, 22 nt, Human
gcaaggaggguaaccacauuuc

SEQ ID NO: 117585 - RNA, 20 nt, Human
gauuuaacgcugcgucuguc

SEQ ID NO: 117586 - RNA, 22 nt, Human
gauuguagacauauuagacugc

SEQ ID NO: 117587 - RNA, 22 nt, Human
gauugauuuaauaugagaggau

SEQ ID NO: 117588 - RNA, 21 nt, Human
gauuuuagggcagccaaacac

SEQ ID NO: 117589 - RNA, 22 nt, Human
gauuucuucauuuaaaaauauu

SEQ ID NO: 117590 - RNA, 22 nt, Human
gauuuuaaaagauguauaaggu

SEQ ID NO: 117591 - RNA, 22 nt, Human
gauuuucauuauagcuaguuuc

SEQ ID NO: 117592 - RNA, 22 nt, Human
gauuucauaaaacgagaaacuc

SEQ ID NO: 117593 - RNA, 22 nt, Human
gcaaagaauugauucauuuugc

SEQ ID NO: 117594 - RNA, 22 nt, Human
gauuuuuaaaaguaguuuugaa

SEQ ID NO: 117595 - RNA, 22 nt, Human
gagcuggagaaacacauaagaa

SEQ ID NO: 117596 - RNA, 22 nt, Human
gagcuggacauacaggaaacca

SEQ ID NO: 117597 - RNA, 22 nt, Human
gauggauuuuuuauuaaaucag

SEQ ID NO: 117598 - RNA, 22 nt, Human
gauggcaaugcuagaaauuuag

SEQ ID NO: 117599 - RNA, 22 nt, Human
gaugauugaauaaauaugguca

SEQ ID NO: 117600 - RNA, 22 nt, Human
aaaagaaugaugggagcugggu

SEQ ID NO: 117601 - RNA, 22 nt, Human
aaaacauuuuacugccaucuca

SEQ ID NO: 117602 - RNA, 22 nt, Human
aaaauaaccuucauuugcauug

SEQ ID NO: 117603 - RNA, 22 nt, Human
aaaagggucugacacugcuuga

SEQ ID NO: 117604 - RNA, 22 nt, Human
aaaagguuauagcuuugccuug

SEQ ID NO: 117605 - RNA, 22 nt, Human
aaaaggauauuuggugcaaagc

SEQ ID NO: 117606 - RNA, 22 nt, Human
aaaaggaagaguuuucagagac

SEQ ID NO: 117607 - RNA, 22 nt, Human
aaaaggaacaauaugguauuuu

SEQ ID NO: 117608 - RNA, 22 nt, Human
aaaagcgaagagaacugaaguu

SEQ ID NO: 117609 - RNA, 22 nt, Human
aaaagauguaaacauauauuaa

SEQ ID NO: 117610 - RNA, 22 nt, Human
aaacaaauccaauaauaaaauu

SEQ ID NO: 117611 - RNA, 22 nt, Human
aaacaccaagagcuagcuauua

SEQ ID NO: 117612 - RNA, 22 nt, Human
aaaauuuccuuggaccauuuuu

SEQ ID NO: 117613 - RNA, 22 nt, Human
aaacagcugcaguacacggccu

SEQ ID NO: 117614 - RNA, 22 nt, Human
aaaaguauaagugucuccugau

SEQ ID NO: 117615 - RNA, 22 nt, Human
aaaagguauuuagcgauugcau

SEQ ID NO: 117616 - RNA, 22 nt, Human
aaaauauuuaucuagcucuuaa

SEQ ID NO: 117617 - RNA, 17 nt, Human
aaaaucaaaggaggugc

SEQ ID NO: 117618 - RNA, 22 nt, Human
aaaauauucuauaucaaagaua

SEQ ID NO: 117619 - RNA, 22 nt, Human
aaagcaaagaucuguagcccaa

SEQ ID NO: 117620 - RNA, 22 nt, Human
aaagaauuucaagauucccaca

SEQ ID NO: 117621 - RNA, 23 nt, Human
aaagaggugaauccaggacaagc

SEQ ID NO: 117622 - RNA, 22 nt, Human
aaagcagguugcaauuacagug

SEQ ID NO: 117623 - RNA, 22 nt, Human
aaagcagucuguuuuaaccuga

SEQ ID NO: 117624 - RNA, 22 nt, Human
aaagaggacgugcuauuuuuua

SEQ ID NO: 117625 - RNA, 22 nt, Human
aaagaguuaagagucuuaagcu

SEQ ID NO: 117626 - RNA, 22 nt, Human
aaacuuuugaaggaggaaaaag

SEQ ID NO: 117627 - RNA, 22 nt, Human
aaagagugugcauguaccugug

SEQ ID NO: 117628 - RNA, 22 nt, Human
aaaggaaacuaugaaucucugg

SEQ ID NO: 117629 - RNA, 22 nt, Human
aaaggagugaaaugagaggaaa

SEQ ID NO: 117630 - RNA, 22 nt, Human
aaagcauucuaaccgaucgacg

SEQ ID NO: 117631 - RNA, 22 nt, Human
aaagccagggacagugugcaug

SEQ ID NO: 117632 - RNA, 22 nt, Human
aaagaugucauacacauuaaga

SEQ ID NO: 117633 - RNA, 22 nt, Human
aaagaugaaguucagcgaagaa

SEQ ID NO: 117634 - RNA, 20 nt, Human
aaagauacuuuuuguaaugg

SEQ ID NO: 117635 - RNA, 22 nt, Human
aaagccaagucugauuuuguug

SEQ ID NO: 117636 - RNA, 22 nt, Human
aaagcauuuguuucuccuggaa

SEQ ID NO: 117637 - RNA, 22 nt, Human
aaagcaaauaguugcuuaauau

SEQ ID NO: 117638 - RNA, 22 nt, Human
aaagcugaaacgaaaugacaac

SEQ ID NO: 117639 - RNA, 17 nt, Human
aaagccgaucagauguu

SEQ ID NO: 117640 - RNA, 22 nt, Human
aaaguuaauucuuguuuuuuau

SEQ ID NO: 117641 - RNA, 22 nt, Human
aaaguguuuaacaaauugcuuu

SEQ ID NO: 117642 - RNA, 23 nt, Human
aaaguacuuaaucugcaaaccac

SEQ ID NO: 117643 - RNA, 22 nt, Human
aaaguagaugagaauuuuguug

SEQ ID NO: 117644 - RNA, 22 nt, Human
aaagggagauaaaguaauuuua

SEQ ID NO: 117645 - RNA, 23 nt, Human
aaauaauaauuucucuguuggga

SEQ ID NO: 117646 - RNA, 22 nt, Human
aaauagucagaaaucaacgugc

SEQ ID NO: 117647 - RNA, 22 nt, Human
aaauagauuugacuacuuggug

SEQ ID NO: 117648 - RNA, 22 nt, Human
aaaguaaagccuauuuaauaau

SEQ ID NO: 117649 - RNA, 22 nt, Human
aaaucaagucagcugaauucca

SEQ ID NO: 117650 - RNA, 22 nt, Human
aaaucaaaagugguuauuuuau

SEQ ID NO: 117651 - RNA, 22 nt, Human
aaauaggucaaucagacuauga

SEQ ID NO: 117652 - RNA, 22 nt, Human
aaauaggaguagugauguauua

SEQ ID NO: 117653 - RNA, 21 nt, Human
aaauccagugaucuccucuaa

SEQ ID NO: 117654 - RNA, 22 nt, Human
aaauccaucaaaucuucuagaa

SEQ ID NO: 117655 - RNA, 22 nt, Human
aaaucauagccaugaacauuug

SEQ ID NO: 117656 - RNA, 22 nt, Human
aaaguuacacgacuauuuaugu

SEQ ID NO: 117657 - RNA, 22 nt, Human
aaauauauauaauauauauauu

SEQ ID NO: 117658 - RNA, 21 nt, Human
aaagugguaaggauuauuuug

SEQ ID NO: 117659 - RNA, 22 nt, Human
aaauauuugaaugguguaagau

SEQ ID NO: 117660 - RNA, 19 nt, Human
aacaaaauaguucuaguua

SEQ ID NO: 117661 - RNA, 22 nt, Human
aacacguuuauccuaagaacuc

SEQ ID NO: 117662 - RNA, 22 nt, Human
aacauuuccggccuuuuguucu

SEQ ID NO: 117663 - RNA, 22 nt, Human
aacaaaacauuuuacgaauaua

SEQ ID NO: 117664 - RNA, 21 nt, Human
aacaaaagggaagaacagcug

SEQ ID NO: 117665 - RNA, 22 nt, Human
aacaaagaaaagcuugagguuu

SEQ ID NO: 117666 - RNA, 22 nt, Human
aacagaauaucaaaagauuaug

SEQ ID NO: 117667 - RNA, 22 nt, Human
aaaugucugagacuucugaacu

SEQ ID NO: 117668 - RNA, 22 nt, Human
aaauuaaaguuuuauuuagagc

SEQ ID NO: 117669 - RNA, 22 nt, Human
aaauuaacuaucacuuuuguga

SEQ ID NO: 117670 - RNA, 22 nt, Human
aaaucuuucacauauuuuuuau

SEQ ID NO: 117671 - RNA, 22 nt, Human
aaaucugaauuaaaaucugguu

SEQ ID NO: 117672 - RNA, 22 nt, Human
aaaucgcuugaacccaggaagu

SEQ ID NO: 117673 - RNA, 22 nt, Human
aaauuagucacaccagugucuu

SEQ ID NO: 117674 - RNA, 22 nt, Human
aaauuaggcccugauuuuaugu

SEQ ID NO: 117675 - RNA, 22 nt, Human
aaaugggagucacacagguuua

SEQ ID NO: 117676 - RNA, 22 nt, Human
aaauguaaacuguauuuauaaa

SEQ ID NO: 117677 - RNA, 22 nt, Human
aaaugcuuuaauugaguucaug

SEQ ID NO: 117678 - RNA, 22 nt, Human
aaauguauuagccuaugugaga

SEQ ID NO: 117679 - RNA, 22 nt, Human
aaauggaaguuuguucucagcc

SEQ ID NO: 117680 - RNA, 22 nt, Human
aaaucauguuaaagagggaguu

SEQ ID NO: 117681 - RNA, 22 nt, Human
aaauauuaaugaugaagguagu

SEQ ID NO: 117682 - RNA, 22 nt, Human
aaaucuuccugaaauuuguuca

SEQ ID NO: 117683 - RNA, 22 nt, Human
aaaugcacaauaaaguaaaggc

SEQ ID NO: 117684 - RNA, 22 nt, Human
aaauauagugacacuuauaguc

SEQ ID NO: 117685 - RNA, 22 nt, Human
aaucuacaaugaaaaaauguuu

SEQ ID NO: 117686 - RNA, 22 nt, Human
aauccaaacaggauuaccuauc

SEQ ID NO: 117687 - RNA, 22 nt, Human
aauggaaaaagaacuguuuaaa

SEQ ID NO: 117688 - RNA, 22 nt, Human
aauggaaaggagccugacuaua

SEQ ID NO: 117689 - RNA, 22 nt, Human
aaugcuuuuugcgaaaugugca

SEQ ID NO: 117690 - RNA, 22 nt, Human
aauggagaaaagacaauguuga

SEQ ID NO: 117691 - RNA, 22 nt, Human
aauggaugauuaaauggaugaa

SEQ ID NO: 117692 - RNA, 22 nt, Human
aauggcaaaaguuucggaaauu

SEQ ID NO: 117693 - RNA, 22 nt, Human
aauguguauguguauauauaug

SEQ ID NO: 117694 - RNA, 22 nt, Human
aauguuaguauuuaagagcuug

SEQ ID NO: 117695 - RNA, 22 nt, Human
aauguuuuucaaguguggagca

SEQ ID NO: 117696 - RNA, 22 nt, Human
aauguuuaguuuuauuuuagua

SEQ ID NO: 117697 - RNA, 22 nt, Human
aauuaacuggguucucagaugc

SEQ ID NO: 117698 - RNA, 22 nt, Human
aauuaaauguuugguuugagcu

SEQ ID NO: 117699 - RNA, 22 nt, Human
aauuauuauguggaagacgacg

SEQ ID NO: 117700 - RNA, 22 nt, Human
aauuauuaucauuaucuuccug

SEQ ID NO: 117701 - RNA, 22 nt, Human
aauguggaguugguuuccuucc

SEQ ID NO: 117702 - RNA, 23 nt, Human
aaugugaaauugaguuuuuguua

SEQ ID NO: 117703 - RNA, 22 nt, Human
aauguauuuuuaggcagaauau

SEQ ID NO: 117704 - RNA, 22 nt, Human
aauggcuagcauguaaaauauc

SEQ ID NO: 117705 - RNA, 22 nt, Human
aauuuuauuagacaggcauaau

SEQ ID NO: 117706 - RNA, 22 nt, Human
aauuuuagcuaaagauccaugg

SEQ ID NO: 117707 - RNA, 22 nt, Human
acaaaaauauuguagaagugcu

SEQ ID NO: 117708 - RNA, 22 nt, Human
aauuucuuuagagguacugauc

SEQ ID NO: 117709 - RNA, 22 nt, Human
aauuucuuucagcugcuuuaag

SEQ ID NO: 117710 - RNA, 22 nt, Human
aauuugcuccaaugucaguucu

SEQ ID NO: 117711 - RNA, 22 nt, Human
aauuucuccuuuucaguuagau

SEQ ID NO: 117712 - RNA, 18 nt, Human
acaaaaauagugcuuugg

SEQ ID NO: 117713 - RNA, 22 nt, Human
acaaacugggauaggauccugu

SEQ ID NO: 117714 - RNA, 22 nt, Human
acaaauuuaaauguugucuguu

SEQ ID NO: 117715 - RNA, 22 nt, Human
acaaaucccuguaaacacagcu

SEQ ID NO: 117716 - RNA, 22 nt, Human
acaacagaacuccugggauuuu

SEQ ID NO: 117717 - RNA, 22 nt, Human
aauuauugucuuuuuuaaaagc

SEQ ID NO: 117718 - RNA, 22 nt, Human
aauuauucuugccuagguuuaa

SEQ ID NO: 117719 - RNA, 22 nt, Human
aauucuuuguuccucugccaag

SEQ ID NO: 117720 - RNA, 22 nt, Human
aauugauauuagauuugucuca

SEQ ID NO: 117721 - RNA, 22 nt, Human
aauugcuuucacaaguguuaua

SEQ ID NO: 117722 - RNA, 20 nt, Human
aauuuagaguuuuaccaagg

SEQ ID NO: 117723 - RNA, 22 nt, Human
aauuuaauugguuuuuacuugu

SEQ ID NO: 117724 - RNA, 22 nt, Human
aauuucagaccaacgagucagg

SEQ ID NO: 117725 - RNA, 22 nt, Human
aauuggagaguugugaaaggau

SEQ ID NO: 117726 - RNA, 22 nt, Human
aauuuaaguuauugcuaaugug

SEQ ID NO: 117727 - RNA, 22 nt, Human
aauugugagaguuagagagcau

SEQ ID NO: 117728 - RNA, 22 nt, Human
aauuguuagaaaugacuguuuu

SEQ ID NO: 117729 - RNA, 22 nt, Human
aauugguuugaauaaauaaaga

SEQ ID NO: 117730 - RNA, 22 nt, Human
acaagaaaggucugggaacaau

SEQ ID NO: 117731 - RNA, 22 nt, Human
acaacuuuaauggguuucagcu

SEQ ID NO: 117732 - RNA, 20 nt, Human
acaacuuaguugagagacua

SEQ ID NO: 117733 - RNA, 22 nt, Human
acaauaauguuuuuagguuauu

SEQ ID NO: 117734 - RNA, 21 nt, Human
acaaugaguuugaggcaucag

SEQ ID NO: 117735 - RNA, 22 nt, Human
acaaguuucauuguuuagaacc

SEQ ID NO: 117736 - RNA, 22 nt, Human
acacaacuuuauuaauuuauac

SEQ ID NO: 117737 - RNA, 22 nt, Human
acaaugugcuuaugaaggcagu

SEQ ID NO: 117738 - RNA, 22 nt, Human
acacuuacugcauuuuucuaua

SEQ ID NO: 117739 - RNA, 22 nt, Human
acagacuuaguauccugcugcu

SEQ ID NO: 117740 - RNA, 23 nt, Human
acagcaagaggaccagaugugag

SEQ ID NO: 117741 - RNA, 22 nt, Human
acagaucuauauuauauauaca

SEQ ID NO: 117742 - RNA, 22 nt, Human
acagccacccuggaacgguugu

SEQ ID NO: 117743 - RNA, 22 nt, Human
acaggaaaugaaaugguaucua

SEQ ID NO: 117744 - RNA, 22 nt, Human
acauaaauagcacugugaauuu

SEQ ID NO: 117745 - RNA, 22 nt, Human
acauauaugugcauacaacuau

SEQ ID NO: 117746 - RNA, 22 nt, Human
acaguuuuccuugguauagaac

SEQ ID NO: 117747 - RNA, 22 nt, Human
aaggaaaaaauggcuugugaua

SEQ ID NO: 117748 - RNA, 22 nt, Human
aagcuuugggcagaagaggauu

SEQ ID NO: 117749 - RNA, 22 nt, Human
aaggaaaaccugacugaagaac

SEQ ID NO: 117750 - RNA, 22 nt, Human
aaggggauuuaagguaagaaga

SEQ ID NO: 117751 - RNA, 22 nt, Human
aagguauaucuuuaaaagugaa

SEQ ID NO: 117752 - RNA, 18 nt, Human
aaguaguuugagauuguu

SEQ ID NO: 117753 - RNA, 20 nt, Human
aaguagguuucaguugcugu

SEQ ID NO: 117754 - RNA, 22 nt, Human
aaguacugauucuguuccucaa

SEQ ID NO: 117755 - RNA, 22 nt, Human
aaguagaaaaccgcacuggacu

SEQ ID NO: 117756 - RNA, 22 nt, Human
aagugauuuucccaccaucuac

SEQ ID NO: 117757 - RNA, 22 nt, Human
aagugaaaaaagucaguacuga

SEQ ID NO: 117758 - RNA, 22 nt, Human
aagugaagccaauuuuuuuagg

SEQ ID NO: 117759 - RNA, 20 nt, Human
aauaaauauaacccauaauu

SEQ ID NO: 117760 - RNA, 22 nt, Human
aauaaagcuugaaagcagggaa

SEQ ID NO: 117761 - RNA, 21 nt, Human
aaguuuuggcuguacaguugu

SEQ ID NO: 117762 - RNA, 22 nt, Human
aauaacuuaaugacuguguaca

SEQ ID NO: 117763 - RNA, 22 nt, Human
aauaacuuacucuaugcuuagu

SEQ ID NO: 117764 - RNA, 22 nt, Human
aauaauacaugugaugagaauu

SEQ ID NO: 117765 - RNA, 22 nt, Human
aauaagaguuaagaaguauauu

SEQ ID NO: 117766 - RNA, 22 nt, Human
aaguucaccugcauuuacuaaa

SEQ ID NO: 117767 - RNA, 22 nt, Human
aaguucuugguuaauuagggaa

SEQ ID NO: 117768 - RNA, 22 nt, Human
aaguucuuauguucugaugugc

SEQ ID NO: 117769 - RNA, 20 nt, Human
aagugcuguuagcugccuga

SEQ ID NO: 117770 - RNA, 22 nt, Human
aauaucuugaguuauaaauuca

SEQ ID NO: 117771 - RNA, 22 nt, Human
aauaugaugccaaauugcuaca

SEQ ID NO: 117772 - RNA, 22 nt, Human
aauaaugguuugauucucacau

SEQ ID NO: 117773 - RNA, 22 nt, Human
aauaauuuuuuugugauuaugu

SEQ ID NO: 117774 - RNA, 20 nt, Human
aauagcacagcucaaacauu

SEQ ID NO: 117775 - RNA, 22 nt, Human
aaucaaagccugcaaguugacu

SEQ ID NO: 117776 - RNA, 22 nt, Human
aaucaauuauccauuuguuagu

SEQ ID NO: 117777 - RNA, 22 nt, Human
aauauuuaaauagaauuacauc

SEQ ID NO: 117778 - RNA, 22 nt, Human
aagcaggaaaugaaaugcuugc

SEQ ID NO: 117779 - RNA, 22 nt, Human
aaggaaaguuaagguaaacucu

SEQ ID NO: 117780 - RNA, 22 nt, Human
aagcuuugaauauuagaccuug

SEQ ID NO: 117781 - RNA, 22 nt, Human
aagcucuuuccacuaaaccacu

SEQ ID NO: 117782 - RNA, 22 nt, Human
aagcugaguaggaaugguaggu

SEQ ID NO: 117783 - RNA, 22 nt, Human
aagcugcagacccccugucuca

SEQ ID NO: 117784 - RNA, 20 nt, Human
aagcuguguucaagauggga

SEQ ID NO: 117785 - RNA, 22 nt, Human
aaggccuaggaguugacauggg

SEQ ID NO: 117786 - RNA, 22 nt, Human
aagaaaagcaucuuuguaguag

SEQ ID NO: 117787 - RNA, 22 nt, Human
aagaaagaucugaaagaagcga

SEQ ID NO: 117788 - RNA, 22 nt, Human
aagaaaggcacaagaaagaaaa

SEQ ID NO: 117789 - RNA, 22 nt, Human
aagaaaggagauauucuuuuag

SEQ ID NO: 117790 - RNA, 22 nt, Human
aagaaauacagaaauggcagua

SEQ ID NO: 117791 - RNA, 22 nt, Human
aagaaauagauagaggaauacu

SEQ ID NO: 117792 - RNA, 22 nt, Human
aagaacaacugcuuuaaaagca

SEQ ID NO: 117793 - RNA, 22 nt, Human
aagaacaugggugugggcauuc

SEQ ID NO: 117794 - RNA, 19 nt, Human
aagaacaguucuaauuuca

SEQ ID NO: 117795 - RNA, 22 nt, Human
aagacagaaaagcagagagagg

SEQ ID NO: 117796 - RNA, 22 nt, Human
aagaagagaauauauuuacguc

SEQ ID NO: 117797 - RNA, 22 nt, Human
aagaagcuacugucacuaucag

SEQ ID NO: 117798 - RNA, 22 nt, Human
aagagaaagggaaaaugguaaa

SEQ ID NO: 117799 - RNA, 22 nt, Human
aagagaaaaaucuuaaucuagu

SEQ ID NO: 117800 - RNA, 22 nt, Human
aagaaugaaaugaaagaacuaa

SEQ ID NO: 117801 - RNA, 22 nt, Human
aagauauauaaggaaguucagu

SEQ ID NO: 117802 - RNA, 22 nt, Human
aagauauauaacccuuucacuu

SEQ ID NO: 117803 - RNA, 22 nt, Human
aagcaaaugguauugguauuau

SEQ ID NO: 117804 - RNA, 23 nt, Human
aagcaacagacuucaucagauau

SEQ ID NO: 117805 - RNA, 22 nt, Human
aagaugcaagcauuuugaacug

SEQ ID NO: 117806 - RNA, 22 nt, Human
aagcagaacuguuuuguuuucu

SEQ ID NO: 117807 - RNA, 22 nt, Human
aagaugaguuacaaaggaguaa

SEQ ID NO: 117808 - RNA, 22 nt, Human
aagaguggagcuggaaaguggg

SEQ ID NO: 117809 - RNA, 22 nt, Human
aagagugaguagcuugguuggu

SEQ ID NO: 117810 - RNA, 22 nt, Human
aagaggcuacagcccugugucu

SEQ ID NO: 117811 - RNA, 22 nt, Human
aagcaaaaucgcaucuggggcc

SEQ ID NO: 117812 - RNA, 22 nt, Human
aguucuuugcucccugcuuuuu

SEQ ID NO: 117813 - RNA, 22 nt, Human
aguugcuaauacaaaaaguccc

SEQ ID NO: 117814 - RNA, 22 nt, Human
aguucauucuagcugggagcag

SEQ ID NO: 117815 - RNA, 22 nt, Human
aguuccaaauuugcaagaaaau

SEQ ID NO: 117816 - RNA, 22 nt, Human
aguucggauuguaauagauaau

SEQ ID NO: 117817 - RNA, 22 nt, Human
aguuguucucagcagaagaacu

SEQ ID NO: 117818 - RNA, 22 nt, Human
aguugugagaaugaacacugaa

SEQ ID NO: 117819 - RNA, 22 nt, Human
aguuggaagacacccugaaauc

SEQ ID NO: 117820 - RNA, 22 nt, Human
aguugggaaaugcugcaguagu

SEQ ID NO: 117821 - RNA, 22 nt, Human
aguugguggaagcuaagcuucu

SEQ ID NO: 117822 - RNA, 22 nt, Human
aguuuggaggagaaagugcggg

SEQ ID NO: 117823 - RNA, 22 nt, Human
aguuugauuugucuaucuucau

SEQ ID NO: 117824 - RNA, 22 nt, Human
aguuuggauccugcuaaaccag

SEQ ID NO: 117825 - RNA, 22 nt, Human
aguuguuuuucuuagauuuuag

SEQ ID NO: 117826 - RNA, 22 nt, Human
aguuuaaauuguucuaucagaa

SEQ ID NO: 117827 - RNA, 22 nt, Human
auacaaaaaguggugaguguau

SEQ ID NO: 117828 - RNA, 22 nt, Human
auaacgaaagcaauuauuuuca

SEQ ID NO: 117829 - RNA, 22 nt, Human
auaauugaauaagagcugcagg

SEQ ID NO: 117830 - RNA, 19 nt, Human
auacacguguauacauaca

SEQ ID NO: 117831 - RNA, 22 nt, Human
auacaggcaguaagauucucag

SEQ ID NO: 117832 - RNA, 22 nt, Human
auaaaucaagggcaguauuucc

SEQ ID NO: 117833 - RNA, 22 nt, Human
auaaauucuaugauggauuggg

SEQ ID NO: 117834 - RNA, 22 nt, Human
auaaauuugccagcauauguuc

SEQ ID NO: 117835 - RNA, 22 nt, Human
auaaaaauguuuuuguguggua

SEQ ID NO: 117836 - RNA, 22 nt, Human
auaaaaaguggcugcuauugga

SEQ ID NO: 117837 - RNA, 22 nt, Human
auaaaaucugaagcaagaauaa

SEQ ID NO: 117838 - RNA, 18 nt, Human
aguuuuuuuggcaaaagg

SEQ ID NO: 117839 - RNA, 22 nt, Human
aguuuuguuuguuuguuuguua

SEQ ID NO: 117840 - RNA, 22 nt, Human
aguuuuuaacgccauguuugaa

SEQ ID NO: 117841 - RNA, 22 nt, Human
auaaaguaaugcauauaaugug

SEQ ID NO: 117842 - RNA, 22 nt, Human
auaaaagcacaauagaguuaug

SEQ ID NO: 117843 - RNA, 22 nt, Human
auaaaacagaucaggagaauga

SEQ ID NO: 117844 - RNA, 23 nt, Human
auaaugauaaugcuauuuuuugu

SEQ ID NO: 117845 - RNA, 22 nt, Human
aguguggcccaugaauuauugg

SEQ ID NO: 117846 - RNA, 22 nt, Human
aguggggaaauaucaauauuug

SEQ ID NO: 117847 - RNA, 22 nt, Human
aguguauuugccuauaaaaaug

SEQ ID NO: 117848 - RNA, 22 nt, Human
aguuaaagggggcuacagugug

SEQ ID NO: 117849 - RNA, 22 nt, Human
aguuaaucuuguauuaaugguu

SEQ ID NO: 117850 - RNA, 17 nt, Human
aguuacugcacuugcca

SEQ ID NO: 117851 - RNA, 22 nt, Human
aguuaguagacuuuuccauuua

SEQ ID NO: 117852 - RNA, 23 nt, Human
aguuaucuaaugaaguucuucca

SEQ ID NO: 117853 - RNA, 22 nt, Human
aguguuuuaagaaaguaauuuu

SEQ ID NO: 117854 - RNA, 22 nt, Human
aguucaauuguuuuguaaaagu

SEQ ID NO: 117855 - RNA, 22 nt, Human
aguucauaucuacuuuuccauc

SEQ ID NO: 117856 - RNA, 22 nt, Human
aguucauccucauuuacaagga

SEQ ID NO: 117857 - RNA, 22 nt, Human
aguuauuuuucacuauuaggcu

SEQ ID NO: 117858 - RNA, 22 nt, Human
aguuauggguauguauuauaau

SEQ ID NO: 117859 - RNA, 22 nt, Human
aguuauuaagaaaauuuugcca

SEQ ID NO: 117860 - RNA, 22 nt, Human
agugaugcuuuggagaagaucc

SEQ ID NO: 117861 - RNA, 22 nt, Human
aguaggaauucaaagagacaaa

SEQ ID NO: 117862 - RNA, 21 nt, Human
aguagucgauucaggagaagu

SEQ ID NO: 117863 - RNA, 22 nt, Human
agugaaaacugaaucaccuucc

SEQ ID NO: 117864 - RNA, 22 nt, Human
agugaaauaugcccauugcugu

SEQ ID NO: 117865 - RNA, 22 nt, Human
agugaaagaaaacuguuagaac

SEQ ID NO: 117866 - RNA, 22 nt, Human
agugacuguccuacuuuguaga

SEQ ID NO: 117867 - RNA, 22 nt, Human
agugagcauuagugcuuauauu

SEQ ID NO: 117868 - RNA, 23 nt, Human
agugaagcugguuagugaugacc

SEQ ID NO: 117869 - RNA, 22 nt, Human
agugaugauccaaaugaauuga

SEQ ID NO: 117870 - RNA, 22 nt, Human
agggaugcaguaaaaacuguag

SEQ ID NO: 117871 - RNA, 22 nt, Human
aggcuucaaggacagcagccac

SEQ ID NO: 117872 - RNA, 22 nt, Human
aggguaauaacaguauggugau

SEQ ID NO: 117873 - RNA, 22 nt, Human
aggugauaugggcuucucugag

SEQ ID NO: 117874 - RNA, 22 nt, Human
agguggcguauguguucguguu

SEQ ID NO: 117875 - RNA, 20 nt, Human
aguacugacaauauucugug

SEQ ID NO: 117876 - RNA, 22 nt, Human
aguaagaaagaaugauaggccu

SEQ ID NO: 117877 - RNA, 22 nt, Human
aguaaaggaaggaagggacagc

SEQ ID NO: 117878 - RNA, 22 nt, Human
agguuuuagagagccaggaugu

SEQ ID NO: 117879 - RNA, 22 nt, Human
agguuuuagaagcugaagccaa

SEQ ID NO: 117880 - RNA, 22 nt, Human
aggaauuugggguuacaugaug

SEQ ID NO: 117881 - RNA, 22 nt, Human
aggacaaaggaccagaucugga

SEQ ID NO: 117882 - RNA, 22 nt, Human
aggaaauaguuuagucccaaaa

SEQ ID NO: 117883 - RNA, 22 nt, Human
aggaacaacagccuuuauaucc

SEQ ID NO: 117884 - RNA, 22 nt, Human
aggaagaagggacagaauuuug

SEQ ID NO: 117885 - RNA, 22 nt, Human
aggaacaguuucaaagagugaa

SEQ ID NO: 117886 - RNA, 22 nt, Human
aggauuuaauugcauuuuucuc

SEQ ID NO: 117887 - RNA, 22 nt, Human
aggauugauggcauguuuacug

SEQ ID NO: 117888 - RNA, 22 nt, Human
aggauugaaaaaacacauauau

SEQ ID NO: 117889 - RNA, 22 nt, Human
aggauugucuccugugaugugc

SEQ ID NO: 117890 - RNA, 23 nt, Human
aggcagcaugcaacaggccauuu

SEQ ID NO: 117891 - RNA, 20 nt, Human
agcauucaacuuucuauguu

SEQ ID NO: 117892 - RNA, 22 nt, Human
agcacuuuagaauuuagaguug

SEQ ID NO: 117893 - RNA, 22 nt, Human
agcacuugggugauaguacuuu

SEQ ID NO: 117894 - RNA, 22 nt, Human
agcacagugccugacauauaug

SEQ ID NO: 117895 - RNA, 22 nt, Human
agcaaagccucuuugaaaaaaa

SEQ ID NO: 117896 - RNA, 22 nt, Human
agcaaaauuccaaaaugcuaau

SEQ ID NO: 117897 - RNA, 22 nt, Human
agauuuucuuuuccaucuuugu

SEQ ID NO: 117898 - RNA, 22 nt, Human
agcaauucugaaauuacuugac

SEQ ID NO: 117899 - RNA, 22 nt, Human
agcagagaacauucauucaugu

SEQ ID NO: 117900 - RNA, 22 nt, Human
agcaaauaauugucuuugaggg

SEQ ID NO: 117901 - RNA, 22 nt, Human
agcaaggagcugaaaccgggcu

SEQ ID NO: 117902 - RNA, 22 nt, Human
agcgaaaagaauggaguggagu

SEQ ID NO: 117903 - RNA, 18 nt, Human
agcccucuguuacuggaa

SEQ ID NO: 117904 - RNA, 22 nt, Human
agccccaauuacagcugugcug

SEQ ID NO: 117905 - RNA, 17 nt, Human
agaucugaaggagaaca

SEQ ID NO: 117906 - RNA, 22 nt, Human
agauguuaauaaccuuagggca

SEQ ID NO: 117907 - RNA, 22 nt, Human
agauuauuuaagacaggaacca

SEQ ID NO: 117908 - RNA, 22 nt, Human
agauugaacgagcuggcaugga

SEQ ID NO: 117909 - RNA, 22 nt, Human
agaugguucagaauuauaaaga

SEQ ID NO: 117910 - RNA, 22 nt, Human
agcaaaacuaaagacacagaca

SEQ ID NO: 117911 - RNA, 22 nt, Human
agacagaaaaguugucaaucau

SEQ ID NO: 117912 - RNA, 22 nt, Human
agagcuauuucuuaaaagcugu

SEQ ID NO: 117913 - RNA, 21 nt, Human
agaguugaaggcaguaaagag

SEQ ID NO: 117914 - RNA, 22 nt, Human
agauauguuaggcuuguucccu

SEQ ID NO: 117915 - RNA, 22 nt, Human
agauaaaucauuuauuaagcgg

SEQ ID NO: 117916 - RNA, 22 nt, Human
agaguaauguggaguuugugcu

SEQ ID NO: 117917 - RNA, 22 nt, Human
agauauuauuuucuauuuauca

SEQ ID NO: 117918 - RNA, 22 nt, Human
agauaaacaacucuuagcuguu

SEQ ID NO: 117919 - RNA, 22 nt, Human
acuauuguccgauuucuuuacu

SEQ ID NO: 117920 - RNA, 22 nt, Human
acucaaacuuuuuguggacauu

SEQ ID NO: 117921 - RNA, 22 nt, Human
acucacuguuuugaaauugaac

SEQ ID NO: 117922 - RNA, 22 nt, Human
acuaucuauugucuucuucaug

SEQ ID NO: 117923 - RNA, 22 nt, Human
acuacuguaauuuauuguuaca

SEQ ID NO: 117924 - RNA, 22 nt, Human
acuauauaaugcacacaguaua

SEQ ID NO: 117925 - RNA, 22 nt, Human
acucauuuggauuuuggaguuu

SEQ ID NO: 117926 - RNA, 22 nt, Human
acugaaauggggacaguccuua

SEQ ID NO: 117927 - RNA, 18 nt, Human
acucuuccuuauguucuu

SEQ ID NO: 117928 - RNA, 19 nt, Human
agaacccccuuccucugcu

SEQ ID NO: 117929 - RNA, 22 nt, Human
agaagaaugguuugaaagauuu

SEQ ID NO: 117930 - RNA, 22 nt, Human
agaagaagacccuaaggaaagg

SEQ ID NO: 117931 - RNA, 22 nt, Human
agaaaauagguaguagacgggc

SEQ ID NO: 117932 - RNA, 22 nt, Human
agaacauaucuguuuucuaacu

SEQ ID NO: 117933 - RNA, 22 nt, Human
agaaccaauacuacagcaagua

SEQ ID NO: 117934 - RNA, 22 nt, Human
agaauacaauuguucaguaaua

SEQ ID NO: 117935 - RNA, 22 nt, Human
agaaguagacaguuggauauaa

SEQ ID NO: 117936 - RNA, 22 nt, Human
agaagcaauuggaaaguacagg

SEQ ID NO: 117937 - RNA, 22 nt, Human
agaagcagaaggaagcagggcc

SEQ ID NO: 117938 - RNA, 22 nt, Human
agaauauaguaaauauuuucua

SEQ ID NO: 117939 - RNA, 22 nt, Human
agaauguaagaaugcaaagauu

SEQ ID NO: 117940 - RNA, 22 nt, Human
agacaaucaacuguugaugccu

SEQ ID NO: 117941 - RNA, 22 nt, Human
agaauuuguaucuacggugugc

SEQ ID NO: 117942 - RNA, 19 nt, Human
agaauuggaaccaugaacc

SEQ ID NO: 117943 - RNA, 22 nt, Human
agacaauuccauccuacguggg

SEQ ID NO: 117944 - RNA, 22 nt, Human
agacaaggggauuuuugauggu

SEQ ID NO: 117945 - RNA, 22 nt, Human
agaaacaagcccuagaaguccu

SEQ ID NO: 117946 - RNA, 20 nt, Human
agaaaggaguaaagaagaga

SEQ ID NO: 117947 - RNA, 22 nt, Human
agaaauuguaauaaaucugguc

SEQ ID NO: 117948 - RNA, 22 nt, Human
agaaaagaggcuuucuaagcau

SEQ ID NO: 117949 - RNA, 22 nt, Human
agaaaagagacaauguuuuugg

SEQ ID NO: 117950 - RNA, 22 nt, Human
agaaaaggaagcuuagacugua

SEQ ID NO: 117951 - RNA, 22 nt, Human
acuuggcuaggguuuuuaucuu

SEQ ID NO: 117952 - RNA, 22 nt, Human
acuuagaacagccuaugggaag

SEQ ID NO: 117953 - RNA, 22 nt, Human
acuuauaaauuuaguacacugu

SEQ ID NO: 117954 - RNA, 22 nt, Human
acuuaagcagaucuguggucca

SEQ ID NO: 117955 - RNA, 22 nt, Human
acuguugagggaagcagaugaa

SEQ ID NO: 117956 - RNA, 22 nt, Human
acuucuuuugcaugauucuuua

SEQ ID NO: 117957 - RNA, 21 nt, Human
gaaaaucuaaugugacaaugc

SEQ ID NO: 117958 - RNA, 22 nt, Human
gaaaaucaggauggaugugagg

SEQ ID NO: 117959 - RNA, 22 nt, Human
gagccucaggguuuuguugaca

SEQ ID NO: 117960 - RNA, 22 nt, Human
gaagcuucgaaagagugauuuc

SEQ ID NO: 117961 - RNA, 22 nt, Human
gaagcuucucaacugguggaau

SEQ ID NO: 117962 - RNA, 22 nt, Human
gaggaaaauggaguguaauuaa

SEQ ID NO: 117963 - RNA, 22 nt, Human
gaagguuuacugaagauuuaaa

SEQ ID NO: 117964 - RNA, 22 nt, Human
gaaggugcugaaacagaaauuu

SEQ ID NO: 117965 - RNA, 22 nt, Human
gaaguaaaacaguaacuuuguu

SEQ ID NO: 117966 - RNA, 22 nt, Human
gaggaggacauuggaaagaacu

SEQ ID NO: 117967 - RNA, 22 nt, Human
gaauggaugcuggucaguuugg

SEQ ID NO: 117968 - RNA, 22 nt, Human
gaauagauuagaaagaguaugu

SEQ ID NO: 117969 - RNA, 22 nt, Human
gaauacaaauaauaccaaggug

SEQ ID NO: 117970 - RNA, 22 nt, Human
gaaguucuuagucucauuugca

SEQ ID NO: 117971 - RNA, 22 nt, Human
gaauaagaauccacuucuggca

SEQ ID NO: 117972 - RNA, 21 nt, Human
gaaguagcucugagaaaagug

SEQ ID NO: 117973 - RNA, 22 nt, Human
gagggaaaggggccaugauugg

SEQ ID NO: 117974 - RNA, 22 nt, Human
gaaugggaauuauggugggacu

SEQ ID NO: 117975 - RNA, 22 nt, Human
gaauguuugagugccaugugac

SEQ ID NO: 117976 - RNA, 22 nt, Human
gaaugguuauaugauguuuaaa

SEQ ID NO: 117977 - RNA, 20 nt, Human
gaauucugaagauaauuugg

SEQ ID NO: 117978 - RNA, 18 nt, Human
gacaaaaguacagacaga

SEQ ID NO: 117979 - RNA, 19 nt, Human
gaauugcacgagcagaggc

SEQ ID NO: 117980 - RNA, 19 nt, Human
gaguaaaacuagagagaaa

SEQ ID NO: 117981 - RNA, 22 nt, Human
gacaauuucucaauauagaaac

SEQ ID NO: 117982 - RNA, 22 nt, Human
gaguaaaagaugaggcaguaga

SEQ ID NO: 117983 - RNA, 22 nt, Human
gacauugaauugaauccagauu

SEQ ID NO: 117984 - RNA, 22 nt, Human
gaguagaacagauagucaagaa

SEQ ID NO: 117985 - RNA, 22 nt, Human
gaguugauggccauugaguuga

SEQ ID NO: 117986 - RNA, 22 nt, Human
gacuaaauaaaagccaaacuuc

SEQ ID NO: 117987 - RNA, 22 nt, Human
gaguuauuuuuccuguuuuuua

SEQ ID NO: 117988 - RNA, 22 nt, Human
gaguuaaauagcuuaggauuca

SEQ ID NO: 117989 - RNA, 22 nt, Human
gauaaauaguguuuggggacau

SEQ ID NO: 117990 - RNA, 22 nt, Human
gacuugaagcucucugguuuug

SEQ ID NO: 117991 - RNA, 22 nt, Human
gagaaagggagaaaaagaucuu

SEQ ID NO: 117992 - RNA, 22 nt, Human
gauauuaguuuuggaaggaggg

SEQ ID NO: 117993 - RNA, 22 nt, Human
gagaaaaauuucuuugcugcac

SEQ ID NO: 117994 - RNA, 22 nt, Human
gauauucauaggcagguauuua

SEQ ID NO: 117995 - RNA, 22 nt, Human
gagaagugggggucugggauga

SEQ ID NO: 117996 - RNA, 22 nt, Human
cuuucuuuuugguuucccccca

SEQ ID NO: 117997 - RNA, 22 nt, Human
gacaggaauuaucuaaaguaga

SEQ ID NO: 117998 - RNA, 22 nt, Human
cuuuccaugucuucuuucucca

SEQ ID NO: 117999 - RNA, 22 nt, Human
cuuucuccagagugaagauccu

SEQ ID NO: 118000 - RNA, 22 nt, Human
cuuucuuucaaguucugcuuua

SEQ ID NO: 118001 - RNA, 22 nt, Human
cuuuguaaucaauaagucuuuu

SEQ ID NO: 118002 - RNA, 22 nt, Human
cuuuuugcccuugggcuuccug

SEQ ID NO: 118003 - RNA, 22 nt, Human
cuuuuuaaaguaaauggcuaga

SEQ ID NO: 118004 - RNA, 22 nt, Human
cuuuuucaugggugaugagugg

SEQ ID NO: 118005 - RNA, 22 nt, Human
gagaaaacauacuuaguguccu

SEQ ID NO: 118006 - RNA, 16 nt, Human
gacuuucuacgacucu

SEQ ID NO: 118007 - RNA, 22 nt, Human
gagaaauagauucaugguagau

SEQ ID NO: 118008 - RNA, 22 nt, Human
gagaacaaggaagagucggcag

SEQ ID NO: 118009 - RNA, 22 nt, Human
gaagcaagagggaucaggaucu

SEQ ID NO: 118010 - RNA, 22 nt, Human
cuuauuagaaagaaaagacaug

SEQ ID NO: 118011 - RNA, 22 nt, Human
gaauuacagaguuguuaaguca

SEQ ID NO: 118012 - RNA, 22 nt, Human
gaauuagguaauagaacuagua

SEQ ID NO: 118013 - RNA, 22 nt, Human
gaauguuaaugcacuucuagcu

SEQ ID NO: 118014 - RNA, 22 nt, Human
gaaugguuagugaacaaauuug

SEQ ID NO: 118015 - RNA, 22 nt, Human
cuugccaguguugcagaagcuc

SEQ ID NO: 118016 - RNA, 22 nt, Human
cuuucauuuuugggcaucugag

SEQ ID NO: 118017 - RNA, 22 nt, Human
cuuuaguaaaacguauuuagga

SEQ ID NO: 118018 - RNA, 22 nt, Human
cuugggguuugggggcuugacc

SEQ ID NO: 118019 - RNA, 22 nt, Human
cuugucuaguuccuggugaugu

SEQ ID NO: 118020 - RNA, 22 nt, Human
gacaacuucaguaaaguagauu

SEQ ID NO: 118021 - RNA, 22 nt, Human
gacaagaagaacggagguuuca

SEQ ID NO: 118022 - RNA, 22 nt, Human
cuuuugcaauagugacacugau

SEQ ID NO: 118023 - RNA, 22 nt, Human
cuuuucuuuucuucucuuccca

SEQ ID NO: 118024 - RNA, 22 nt, Human
cuuugcaaagagagaaaguggg

SEQ ID NO: 118025 - RNA, 22 nt, Human
cuggauagaccccuuauugcau

SEQ ID NO: 118026 - RNA, 22 nt, Human
cugggaaucuagagggcucauu

SEQ ID NO: 118027 - RNA, 22 nt, Human
cuuuuugccuugaagugaccuc

SEQ ID NO: 118028 - RNA, 22 nt, Human
cuuuuucuugugguuaauaucu

SEQ ID NO: 118029 - RNA, 22 nt, Human
gaaaaagagaaggaguucagua

SEQ ID NO: 118030 - RNA, 22 nt, Human
gaaaaacucagugggggucuuu

SEQ ID NO: 118031 - RNA, 22 nt, Human
gaaaaaccacaauugguauuuu

SEQ ID NO: 118032 - RNA, 22 nt, Human
gaaaaauggguuguuugaagau

SEQ ID NO: 118033 - RNA, 22 nt, Human
cugggcuuucaggcccuaaggc

SEQ ID NO: 118034 - RNA, 22 nt, Human
gaaacauuuguugaguacuugc

SEQ ID NO: 118035 - RNA, 22 nt, Human
gaaaaugcacacauacacaccc

SEQ ID NO: 118036 - RNA, 22 nt, Human
gaaagagaugucguuugucuuc

SEQ ID NO: 118037 - RNA, 22 nt, Human
gaacuuaauauacaaucaguuc

SEQ ID NO: 118038 - RNA, 22 nt, Human
gaacauuucugcagaugucuga

SEQ ID NO: 118039 - RNA, 22 nt, Human
gaaccauuuaauggagaugcuc

SEQ ID NO: 118040 - RNA, 22 nt, Human
gaaaagaaaggaugguaugugu

SEQ ID NO: 118041 - RNA, 22 nt, Human
gaaaagcucuuuagaagagguu

SEQ ID NO: 118042 - RNA, 22 nt, Human
gaaaaucaugaaaguguguugu

SEQ ID NO: 118043 - RNA, 22 nt, Human
gaaaaguuuaaccuuguacauu

SEQ ID NO: 118044 - RNA, 22 nt, Human
gaaaauaguucaucacaaugau

SEQ ID NO: 118045 - RNA, 22 nt, Human
cugguuuuccaauguuuugacu

SEQ ID NO: 118046 - RNA, 22 nt, Human
cuggucuugguauucgcagaag

SEQ ID NO: 118047 - RNA, 22 nt, Human
cuggucaauaaucauguaguac

SEQ ID NO: 118048 - RNA, 22 nt, Human
cuggcgauugcgagagucgccu

SEQ ID NO: 118049 - RNA, 22 nt, Human
cucauugacagagcagcucuac

SEQ ID NO: 118050 - RNA, 22 nt, Human
cugguuuauuucauaguuuguu

SEQ ID NO: 118051 - RNA, 22 nt, Human
cuggugcuguagccugauugag

SEQ ID NO: 118052 - RNA, 22 nt, Human
cucuuucauucuuagguugccg

SEQ ID NO: 118053 - RNA, 22 nt, Human
cuguuaauugugaauuuuacau

SEQ ID NO: 118054 - RNA, 22 nt, Human
cugaaagacgaggggaagucgg

SEQ ID NO: 118055 - RNA, 22 nt, Human
cugaagaaagaaaauggccauc

SEQ ID NO: 118056 - RNA, 22 nt, Human
cuguuuuugccugugacaaaaa

SEQ ID NO: 118057 - RNA, 22 nt, Human
cuaaauuuuuuagugaaauagg

SEQ ID NO: 118058 - RNA, 22 nt, Human
cuaauuguaagcuccuugaggg

SEQ ID NO: 118059 - RNA, 22 nt, Human
cuaggcuuucugugugacuaga

SEQ ID NO: 118060 - RNA, 22 nt, Human
cuaguauuaagugugaguaaaa

SEQ ID NO: 118061 - RNA, 22 nt, Human
cugcuauaacacuaacaucuaa

SEQ ID NO: 118062 - RNA, 22 nt, Human
cuaguuuuaagcuccuugaggu

SEQ ID NO: 118063 - RNA, 22 nt, Human
cuagguuuuuuccuuuccccac

SEQ ID NO: 118064 - RNA, 22 nt, Human
cugcugcuugauugcaggaagu

SEQ ID NO: 118065 - RNA, 21 nt, Human
cuauaaaaaugguucuuugcg

SEQ ID NO: 118066 - RNA, 22 nt, Human
cuauguuuugcuagugaugggu

SEQ ID NO: 118067 - RNA, 22 nt, Human
cguuauagagcacucgaacuuu

SEQ ID NO: 118068 - RNA, 22 nt, Human
cugauuucaaauggugcuagau

SEQ ID NO: 118069 - RNA, 22 nt, Human
cugauuguagccacugugauga

SEQ ID NO: 118070 - RNA, 20 nt, Human
cuaaaacaggugucuaguga

SEQ ID NO: 118071 - RNA, 22 nt, Human
cguuuugaguagauagccauau

SEQ ID NO: 118072 - RNA, 22 nt, Human
cugauccuauauugguaugagg

SEQ ID NO: 118073 - RNA, 22 nt, Human
cuaguagcccauuuuggauacc

SEQ ID NO: 118074 - RNA, 22 nt, Human
cuagcacagugcuuggcacaca

SEQ ID NO: 118075 - RNA, 22 nt, Human
cucaaauggguuuguagaauau

SEQ ID NO: 118076 - RNA, 22 nt, Human
cucaaaauccauaaaaucaggu

SEQ ID NO: 118077 - RNA, 22 nt, Human
cucucuuuuuuucccuuguuaa

SEQ ID NO: 118078 - RNA, 22 nt, Human
cucucuguuaugcuuucaugaa

SEQ ID NO: 118079 - RNA, 16 nt, Human
cuaaaaugucuacuug

SEQ ID NO: 118080 - RNA, 22 nt, Human
cuaaacacuauucuggaaauag

SEQ ID NO: 118081 - RNA, 22 nt, Human
cuaaaacuuuuccaaauuaugu

SEQ ID NO: 118082 - RNA, 22 nt, Human
cuacuuucuucuucagaauugu

SEQ ID NO: 118083 - RNA, 22 nt, Human
cuagaaguuuggguccauuaag

SEQ ID NO: 118084 - RNA, 22 nt, Human
cuagagaaaaagcuuagguacg

SEQ ID NO: 118085 - RNA, 22 nt, Human
ccuucuuaaacaucauuuuggc

SEQ ID NO: 118086 - RNA, 22 nt, Human
ccuggccacagggcucugcauu

SEQ ID NO: 118087 - RNA, 21 nt, Human
ccuuugaguguguuugaagua

SEQ ID NO: 118088 - RNA, 22 nt, Human
ccuuuuuagaugugcgaauguu

SEQ ID NO: 118089 - RNA, 22 nt, Human
cgaaaaagaagugcaccauguu

SEQ ID NO: 118090 - RNA, 22 nt, Human
ccuauuuucaaaauuguuuauc

SEQ ID NO: 118091 - RNA, 22 nt, Human
cgaguaauuggaaauuugcuau

SEQ ID NO: 118092 - RNA, 22 nt, Human
cgcuuugacuuuagaaggccaa

SEQ ID NO: 118093 - RNA, 22 nt, Human
ccugggcucgcgcacuucaccc

SEQ ID NO: 118094 - RNA, 20 nt, Human
ccugggcuccaggagccccg

SEQ ID NO: 118095 - RNA, 22 nt, Human
ccagaauuugaacccacaaaug

SEQ ID NO: 118096 - RNA, 22 nt, Human
ccuuuuaagggagacuagagau

SEQ ID NO: 118097 - RNA, 17 nt, Human
ccuuucugaucaucuga

SEQ ID NO: 118098 - RNA, 22 nt, Human
ccacuuucuaaauuggcgauuu

SEQ ID NO: 118099 - RNA, 22 nt, Human
cauuuagagaagauuacaagga

SEQ ID NO: 118100 - RNA, 22 nt, Human
cauuucuugugagccgcauccu

SEQ ID NO: 118101 - RNA, 22 nt, Human
cauuucaaacaguuacagcugc

SEQ ID NO: 118102 - RNA, 22 nt, Human
ccaaagaagcaaugagaauagu

SEQ ID NO: 118103 - RNA, 22 nt, Human
ccaaacauuucaaauuuagaga

SEQ ID NO: 118104 - RNA, 22 nt, Human
cauuuugguccucauguguagc

SEQ ID NO: 118105 - RNA, 22 nt, Human
cauuuuuccucaggcaauuuga

SEQ ID NO: 118106 - RNA, 22 nt, Human
cauuuugguaauguucguuugc

SEQ ID NO: 118107 - RNA, 22 nt, Human
ccaaaauauuagugcuuaagua

SEQ ID NO: 118108 - RNA, 22 nt, Human
ccaaauuguuguuguuguuguu

SEQ ID NO: 118109 - RNA, 19 nt, Human
ccaguuuuuuaauauucaa

SEQ ID NO: 118110 - RNA, 22 nt, Human
ccauaaaagagaaucuaaauga

SEQ ID NO: 118111 - RNA, 22 nt, Human
ccaaagaauuuggaaaaucuga

SEQ ID NO: 118112 - RNA, 19 nt, Human
ccaacaguacugaagcacu

SEQ ID NO: 118113 - RNA, 22 nt, Human
cauuuuuuuuccccuccuggua

SEQ ID NO: 118114 - RNA, 22 nt, Human
caugcagcagaauaaugacuau

SEQ ID NO: 118115 - RNA, 22 nt, Human
ccaaauuaccuucuuggauuca

SEQ ID NO: 118116 - RNA, 22 nt, Human
ccaauuuuggaauuauuaggca

SEQ ID NO: 118117 - RNA, 22 nt, Human
cauuccaagaaguaguucugca

SEQ ID NO: 118118 - RNA, 22 nt, Human
cagguuuuuauuacaacuuuga

SEQ ID NO: 118119 - RNA, 22 nt, Human
cauguggaaaugcaugcuuuuu

SEQ ID NO: 118120 - RNA, 22 nt, Human
cagguuuuccuuuuaaaaggaa

SEQ ID NO: 118121 - RNA, 22 nt, Human
cauuccaaguauauacaugaua

SEQ ID NO: 118122 - RNA, 22 nt, Human
cauugcaaccauuccaaauggc

SEQ ID NO: 118123 - RNA, 22 nt, Human
cauugcaaccccaaaaagaaca

SEQ ID NO: 118124 - RNA, 23 nt, Human
cauuugauccucacaauaaaugg

SEQ ID NO: 118125 - RNA, 22 nt, Human
cauugcaucuuuuauggguaag

SEQ ID NO: 118126 - RNA, 22 nt, Human
caucuuuguuuuggauauaauc

SEQ ID NO: 118127 - RNA, 22 nt, Human
cauuuaucacuugcuaaacaua

SEQ ID NO: 118128 - RNA, 22 nt, Human
caaagaaccuucgagacagggc

SEQ ID NO: 118129 - RNA, 22 nt, Human
caaaagcaaagaucuuugauug

SEQ ID NO: 118130 - RNA, 22 nt, Human
caagcagauauuuuagucaaga

SEQ ID NO: 118131 - RNA, 22 nt, Human
caaugggagaugcagaacagcu

SEQ ID NO: 118132 - RNA, 22 nt, Human
caauggagccaagaggaggaaa

SEQ ID NO: 118133 - RNA, 22 nt, Human
cacuuauuuuuccuuugugauu

SEQ ID NO: 118134 - RNA, 22 nt, Human
cagaaacacuguauuuagggaa

SEQ ID NO: 118135 - RNA, 22 nt, Human
cagaaagaaguggggauagagg

SEQ ID NO: 118136 - RNA, 22 nt, Human
cacauuuuccagaagaaucaga

SEQ ID NO: 118137 - RNA, 22 nt, Human
cacauuucagcacucagggcau

SEQ ID NO: 118138 - RNA, 22 nt, Human
cagacagaaggcuccuugaggu

SEQ ID NO: 118139 - RNA, 22 nt, Human
caggaggaggccgggaggaagc

SEQ ID NO: 118140 - RNA, 22 nt, Human
caguugcagagugauguguuug

SEQ ID NO: 118141 - RNA, 22 nt, Human
cauauuaugcauguuguucuuu

SEQ ID NO: 118142 - RNA, 22 nt, Human
cauaucuuaaacaucaucucug

SEQ ID NO: 118143 - RNA, 22 nt, Human
cauagcuagcaccuucuuuucu

SEQ ID NO: 118144 - RNA, 22 nt, Human
cagguggauggcgagcccugca

SEQ ID NO: 118145 - RNA, 22 nt, Human
caguuuuucaaaauuacaugau

SEQ ID NO: 118146 - RNA, 22 nt, Human
cagcuucaugacaaacaguuuu

SEQ ID NO: 118147 - RNA, 22 nt, Human
caggaguggugagguuagcaga

SEQ ID NO: 118148 - RNA, 22 nt, Human
cagcuguacgugaucuacaugg

SEQ ID NO: 118149 - RNA, 22 nt, Human
cagcuggaggagcagcuuccag

SEQ ID NO: 118150 - RNA, 22 nt, Human
cagcuucuccauucuucuggcu

SEQ ID NO: 118151 - RNA, 22 nt, Human
aucugugauuuuggcaagauuu

SEQ ID NO: 118152 - RNA, 22 nt, Human
aucugcugccuaggguuugucu

SEQ ID NO: 118153 - RNA, 22 nt, Human
auacacauguuauuguggaagc

SEQ ID NO: 118154 - RNA, 22 nt, Human
auacacuucauguuuucaucug

SEQ ID NO: 118155 - RNA, 22 nt, Human
aucguuaugauagagaaagaga

SEQ ID NO: 118156 - RNA, 22 nt, Human
aucuaaaacuacgaauacuacc

SEQ ID NO: 118157 - RNA, 22 nt, Human
aucuuuguaaguaaucaaagcu

SEQ ID NO: 118158 - RNA, 22 nt, Human
aucucaaagauaugcugguaaa

SEQ ID NO: 118159 - RNA, 22 nt, Human
aucuguucuucaaaauauuaca

SEQ ID NO: 118160 - RNA, 22 nt, Human
augaaaacggaccagagcuauu

SEQ ID NO: 118161 - RNA, 22 nt, Human
aucuuuuuucacaauuuauuuu

SEQ ID NO: 118162 - RNA, 22 nt, Human
augaacuaagagucauuagugu

SEQ ID NO: 118163 - RNA, 19 nt, Human
aucuuucagcagcuccccu

SEQ ID NO: 118164 - RNA, 22 nt, Human
augaaaacgugugugugugugu

SEQ ID NO: 118165 - RNA, 23 nt, Human
augaacgcacugagaucauaauu

SEQ ID NO: 118166 - RNA, 23 nt, Human
augaaaugauacuuuauucacug

SEQ ID NO: 118167 - RNA, 22 nt, Human
augaaggauagggcaaaauuuu

SEQ ID NO: 118168 - RNA, 22 nt, Human
augagugugugguucuaaauga

SEQ ID NO: 118169 - RNA, 22 nt, Human
augcauaucuccuaucuccuca

SEQ ID NO: 118170 - RNA, 19 nt, Human
augcacgugaaaugcauuu

SEQ ID NO: 118171 - RNA, 22 nt, Human
augcugcuccuuuucaggcauu

SEQ ID NO: 118172 - RNA, 22 nt, Human
augcauaugugugcaagugugu

SEQ ID NO: 118173 - RNA, 22 nt, Human
augcaaaaucuuauuuuuucua

SEQ ID NO: 118174 - RNA, 22 nt, Human
auggaacauuaaucuucaaaug

SEQ ID NO: 118175 - RNA, 22 nt, Human
auggaagagacaaugcuaucug

SEQ ID NO: 118176 - RNA, 19 nt, Human
augguauugcuggguuuuu

SEQ ID NO: 118177 - RNA, 22 nt, Human
augggcuuuacccucagagcuu

SEQ ID NO: 118178 - RNA, 22 nt, Human
auggugaugaugaugaugauaa

SEQ ID NO: 118179 - RNA, 22 nt, Human
auguuguugaacucuuugcaug

SEQ ID NO: 118180 - RNA, 19 nt, Human
auguuuccauuucuggaua

SEQ ID NO: 118181 - RNA, 22 nt, Human
auguuugugauugcugaaaaga

SEQ ID NO: 118182 - RNA, 22 nt, Human
auguuuaaguguuuugccccaa

SEQ ID NO: 118183 - RNA, 22 nt, Human
auuaaagcaugaauaauaugua

SEQ ID NO: 118184 - RNA, 22 nt, Human
auuaaacuaaauuaugaauugg

SEQ ID NO: 118185 - RNA, 22 nt, Human
auuaaaaaugagaguagggauu

SEQ ID NO: 118186 - RNA, 22 nt, Human
auguuuuuugaaaauguauuuu

SEQ ID NO: 118187 - RNA, 22 nt, Human
auuaaaaaaagauaaugaguua

SEQ ID NO: 118188 - RNA, 22 nt, Human
auguuuucuugucuggagaagu

SEQ ID NO: 118189 - RNA, 22 nt, Human
auugaauuagauguuguagucc

SEQ ID NO: 118190 - RNA, 22 nt, Human
auugaaguguacguuugaucua

SEQ ID NO: 118191 - RNA, 19 nt, Human
auugguuugcucgggaaug

SEQ ID NO: 118192 - RNA, 22 nt, Human
auuguuuccccggaauuauuca

SEQ ID NO: 118193 - RNA, 19 nt, Human
auucuucucuuccugcugu

SEQ ID NO: 118194 - RNA, 22 nt, Human
auucuuuagaguccuucaaaua

SEQ ID NO: 118195 - RNA, 22 nt, Human
auugagaaaauucgagcaaguu

SEQ ID NO: 118196 - RNA, 22 nt, Human
auugagaugcuuaaaucuucac

SEQ ID NO: 118197 - RNA, 22 nt, Human
auugauuuugugcuuuccuacg

SEQ ID NO: 118198 - RNA, 22 nt, Human
auugaugaaaauaguuauuuua

SEQ ID NO: 118199 - RNA, 22 nt, Human
auugaugccugaaaaauaugua

SEQ ID NO: 118200 - RNA, 22 nt, Human
auugcauucaugcuccccuuag

SEQ ID NO: 118201 - RNA, 23 nt, Human
auugccuguagaucuucacuuuc

SEQ ID NO: 118202 - RNA, 22 nt, Human
auuuaggacagugucugaauug

SEQ ID NO: 118203 - RNA, 22 nt, Human
auuugcuuguucaccaguacuu

SEQ ID NO: 118204 - RNA, 22 nt, Human
auuggaagacgcuggaggcacu

SEQ ID NO: 118205 - RNA, 22 nt, Human
auuugaaguauaaguaauugcu

SEQ ID NO: 118206 - RNA, 23 nt, Human
auuugcugaucguagaugacuag

SEQ ID NO: 118207 - RNA, 22 nt, Human
auuuuuagagugaaagaauuaa

SEQ ID NO: 118208 - RNA, 22 nt, Human
auuuuguugaaacccuuguugu

SEQ ID NO: 118209 - RNA, 22 nt, Human
auuuuggguguuaacaaugaaa

SEQ ID NO: 118210 - RNA, 22 nt, Human
auuuugcuuuucuaguggguuu

SEQ ID NO: 118211 - RNA, 22 nt, Human
auuuucuugucucuguuguagg

SEQ ID NO: 118212 - RNA, 23 nt, Human
auuuccuaaaagauaaucauuac

SEQ ID NO: 118213 - RNA, 22 nt, Human
auuucuguaauucugaggagug

SEQ ID NO: 118214 - RNA, 22 nt, Human
auuuucgcaccucgcgaguugc

SEQ ID NO: 118215 - RNA, 22 nt, Human
auuuuauuuugggaucuuuuua

SEQ ID NO: 118216 - RNA, 22 nt, Human
auuuuagagaaacaaacguagg

SEQ ID NO: 118217 - RNA, 22 nt, Human
auuuucauauggguuauuugua

SEQ ID NO: 118218 - RNA, 22 nt, Human
auuuuuucaugugugguugaga

SEQ ID NO: 118219 - RNA, 22 nt, Human
caaaaaauccauagaaagaggu

SEQ ID NO: 118220 - RNA, 22 nt, Human
caaaaauacuugccuguaucug

SEQ ID NO: 118221 - RNA, 22 nt, Human
auuuuuuuggucauaugagaua

SEQ ID NO: 118222 - RNA, 22 nt, Human
auuuuugugcuuuauuggggua

SEQ ID NO: 118223 - RNA, 22 nt, Human
auuuuugguuauaaaauaguuu

SEQ ID NO: 118224 - RNA, 22 nt, Human
caaaucuguuaauuucaaguug

SEQ ID NO: 118225 - RNA, 22 nt, Human
caaauguuugguggcauuuugu

SEQ ID NO: 118226 - RNA, 22 nt, Human
caaaauuguugaugcugcuuug

SEQ ID NO: 118227 - RNA, 22 nt, Human
auuuuuagucuugcugcaauca

SEQ ID NO: 118228 - RNA, 22 nt, Human
caaaggaaagagaaaaagucuu

SEQ ID NO: 118229 - RNA, 22 nt, Human
caaaggauguguagugcaacca

SEQ ID NO: 118230 - RNA, 22 nt, Human
auuuuuauuugccuaugauaua

SEQ ID NO: 118231 - RNA, 22 nt, Human
auuuuuaucuaaaauccacuuu

SEQ ID NO: 118232 - RNA, 21 nt, Human
auuggcagaucucuggauugu

SEQ ID NO: 118233 - RNA, 17 nt, Human
auucuuauacucuguga

SEQ ID NO: 118234 - RNA, 22 nt, Human
auucugcaauaaucaguccuua

SEQ ID NO: 118235 - RNA, 22 nt, Human
auucugcauuucuaaccagguc

SEQ ID NO: 118236 - RNA, 22 nt, Human
auucuuauaaaaaguguugacu

SEQ ID NO: 118237 - RNA, 22 nt, Human
auucuacucuuuaaauaugaaa

SEQ ID NO: 118238 - RNA, 22 nt, Human
auugaagcauggagaugaggca

SEQ ID NO: 118239 - RNA, 22 nt, Human
auucuugauauagauaguuaau

SEQ ID NO: 118240 - RNA, 22 nt, Human
auuccauccuggcuuuuuccug

SEQ ID NO: 118241 - RNA, 22 nt, Human
auucuuuauuuucuguacuugc

SEQ ID NO: 118242 - RNA, 22 nt, Human
auucuaauaagcguuuugucgc

SEQ ID NO: 118243 - RNA, 22 nt, Human
auucucauguuuuaaaaaaguu

SEQ ID NO: 118244 - RNA, 22 nt, Human
auucuaugaaugacuguuagau

SEQ ID NO: 118245 - RNA, 22 nt, Human
auucuagaguuucaauccaagg

SEQ ID NO: 118246 - RNA, 23 nt, Human
auuaugaagaagacucgccuguu

SEQ ID NO: 118247 - RNA, 22 nt, Human
auuaugaauuguguuacgaaga

SEQ ID NO: 118248 - RNA, 22 nt, Human
auguugaguggaugaacaaaca

SEQ ID NO: 118249 - RNA, 22 nt, Human
auguuguuuauggguuaucaag

SEQ ID NO: 118250 - RNA, 21 nt, Human
auuaagacaauggcaaugggu

SEQ ID NO: 118251 - RNA, 22 nt, Human
auucuguugguuuaauagucaa

SEQ ID NO: 118252 - RNA, 22 nt, Human
auucuguuuuaccauuuucuuu

SEQ ID NO: 118253 - RNA, 22 nt, Human
auucauuuuuacaucaccaaua

SEQ ID NO: 118254 - RNA, 22 nt, Human
auucauucugaccucaagagaa

SEQ ID NO: 118255 - RNA, 17 nt, Human
auucaugaacauguccu

SEQ ID NO: 118256 - RNA, 20 nt, Human
auuauuucuucugcccaaag

SEQ ID NO: 118257 - RNA, 22 nt, Human
uuugugauaaguggauucaagg

SEQ ID NO: 118258 - RNA, 22 nt, Human
uuuguggugagcagggaacguc

SEQ ID NO: 118259 - RNA, 22 nt, Human
uuucuacacuucgugguguuuu

SEQ ID NO: 118260 - RNA, 22 nt, Human
uuucauggaggccaggacagag

SEQ ID NO: 118261 - RNA, 22 nt, Human
uuucuuugggcccuggcagucu

SEQ ID NO: 118262 - RNA, 22 nt, Human
uuugaagaaacagucuuaagag

SEQ ID NO: 118263 - RNA, 22 nt, Human
uuucuuccuucuugaucauuug

SEQ ID NO: 118264 - RNA, 22 nt, Human
uuucuauuuacagugcuaggua

SEQ ID NO: 118265 - RNA, 22 nt, Human
uuucucuccucgaaauucuuau

SEQ ID NO: 118266 - RNA, 22 nt, Human
uuucucuuucaaucugcaguac

SEQ ID NO: 118267 - RNA, 23 nt, Human
uuucugaguuuuuuaaaagucca

SEQ ID NO: 118268 - RNA, 22 nt, Human
uuugaugagaaaugacuuaagu

SEQ ID NO: 118269 - RNA, 22 nt, Human
uuugaauauacuucaaacaaag

SEQ ID NO: 118270 - RNA, 22 nt, Human
uuugcauuugagagaggaaaca

SEQ ID NO: 118271 - RNA, 22 nt, Human
uuugcugggaagccuucacucu

SEQ ID NO: 118272 - RNA, 22 nt, Human
uuugauuuuuugagcaguguau

SEQ ID NO: 118273 - RNA, 23 nt, Human
uuugcaaauuggacacaaccaca

SEQ ID NO: 118274 - RNA, 22 nt, Human
uuugcauuaguuuagauuucaa

SEQ ID NO: 118275 - RNA, 19 nt, Human
uuugguaggcuugagggaa

SEQ ID NO: 118276 - RNA, 22 nt, Human
uuuggugacuguaggaaaggau

SEQ ID NO: 118277 - RNA, 22 nt, Human
uuuggucaucaaagacaaguaa

SEQ ID NO: 118278 - RNA, 23 nt, Human
uuugucaucccucucacuuucug

SEQ ID NO: 118279 - RNA, 22 nt, Human
uuuguaguuguggaugcugaag

SEQ ID NO: 118280 - RNA, 22 nt, Human
uuuguauuguuuauuucauuuu

SEQ ID NO: 118281 - RNA, 22 nt, Human
uuuggcaagcagaugaagguag

SEQ ID NO: 118282 - RNA, 22 nt, Human
uuuggaggaaugaguuuaauau

SEQ ID NO: 118283 - RNA, 19 nt, Human
uuucacaaagagagcguga

SEQ ID NO: 118284 - RNA, 22 nt, Human
uuuauugcuaugucuugauugu

SEQ ID NO: 118285 - RNA, 22 nt, Human
uuuauugaccugaguaucagca

SEQ ID NO: 118286 - RNA, 22 nt, Human
uuuauuuagguaaacaugaguu

SEQ ID NO: 118287 - RNA, 22 nt, Human
uuuauuuggugguguuacuguu

SEQ ID NO: 118288 - RNA, 22 nt, Human
uuuaguugcuuuaguugagcug

SEQ ID NO: 118289 - RNA, 22 nt, Human
uuuauucacuuaucaggaacga

SEQ ID NO: 118290 - RNA, 22 nt, Human
uuuaugguacaggaaugcuguu

SEQ ID NO: 118291 - RNA, 22 nt, Human
uuguuuaaagaacuucugacuu

SEQ ID NO: 118292 - RNA, 22 nt, Human
uuguggcaggauggacagcaga

SEQ ID NO: 118293 - RNA, 22 nt, Human
uuguuauuauuauuuucguucu

SEQ ID NO: 118294 - RNA, 22 nt, Human
uuuagguccguguugcaguugg

SEQ ID NO: 118295 - RNA, 22 nt, Human
uuuaggaauuugcugggcauga

SEQ ID NO: 118296 - RNA, 22 nt, Human
uuuagugaagcuuugcauuuca

SEQ ID NO: 118297 - RNA, 22 nt, Human
uuuaguauaguaugugcucaaa

SEQ ID NO: 118298 - RNA, 22 nt, Human
uuuagguuguguucuggcaugu

SEQ ID NO: 118299 - RNA, 22 nt, Human
uuuaggugucugcucauugaag

SEQ ID NO: 118300 - RNA, 22 nt, Human
uuuacuaauuaguuuuggaaca

SEQ ID NO: 118301 - RNA, 22 nt, Human
uuuagaugcuguauguuauuuc

SEQ ID NO: 118302 - RNA, 22 nt, Human
uuuagcaguuuauuuaaggggg

SEQ ID NO: 118303 - RNA, 22 nt, Human
uuuacuauuaguauuucauuuu

SEQ ID NO: 118304 - RNA, 22 nt, Human
uuggccauuacugagccuggag

SEQ ID NO: 118305 - RNA, 22 nt, Human
uugauggaggaaaaguuggaau

SEQ ID NO: 118306 - RNA, 21 nt, Human
uugauuuagcagaucuagcug

SEQ ID NO: 118307 - RNA, 22 nt, Human
uugggauuggugggguggguuu

SEQ ID NO: 118308 - RNA, 22 nt, Human
uugggauucugucagugugugu

SEQ ID NO: 118309 - RNA, 22 nt, Human
uugguuuuauucguauuuguau

SEQ ID NO: 118310 - RNA, 22 nt, Human
uuguaagacuguagaaugcaaa

SEQ ID NO: 118311 - RNA, 22 nt, Human
uugguguuucacuuccuugucg

SEQ ID NO: 118312 - RNA, 22 nt, Human
uuuuacuuuucccacuuacagc

SEQ ID NO: 118313 - RNA, 23 nt, Human
uuuuacaagagugcauuugucuc

SEQ ID NO: 118314 - RNA, 22 nt, Human
uuuuaauucaacauuugcuuuu

SEQ ID NO: 118315 - RNA, 22 nt, Human
uuuuaaucagguauuugaguau

SEQ ID NO: 118316 - RNA, 23 nt, Human
uuuuccaaaucgacucucuaguu

SEQ ID NO: 118317 - RNA, 22 nt, Human
uuuuauguuccugaagcuaucu

SEQ ID NO: 118318 - RNA, 22 nt, Human
uuuuaucagagcuugcagugug

SEQ ID NO: 118319 - RNA, 22 nt, Human
uuuuaucuuacauggaaucucc

SEQ ID NO: 118320 - RNA, 22 nt, Human
uuuuauaauacccuugacuaau

SEQ ID NO: 118321 - RNA, 22 nt, Human
uuuuagccagcaucugggucga

SEQ ID NO: 118322 - RNA, 22 nt, Human
uucuauaagagaugaauacagu

SEQ ID NO: 118323 - RNA, 22 nt, Human
uuuucucuuugcuucucuaaaa

SEQ ID NO: 118324 - RNA, 22 nt, Human
uuuucuacaaaucuggacuuuu

SEQ ID NO: 118325 - RNA, 22 nt, Human
uuuucggagaauguuaaugugu

SEQ ID NO: 118326 - RNA, 22 nt, Human
uuuugguuugaguauuuuuuuu

SEQ ID NO: 118327 - RNA, 22 nt, Human
uuuugcuucuaguauauuuuuu

SEQ ID NO: 118328 - RNA, 22 nt, Human
uuuugcaaauuacuaaauuucu

SEQ ID NO: 118329 - RNA, 22 nt, Human
uuuugcuagaaaucaccaauac

SEQ ID NO: 118330 - RNA, 22 nt, Human
uucuuuuuagcugguuguaaga

SEQ ID NO: 118331 - RNA, 22 nt, Human
uugaaaaaaucugaggaggacc

SEQ ID NO: 118332 - RNA, 22 nt, Human
uucuuugcccauguuuccuaag

SEQ ID NO: 118333 - RNA, 22 nt, Human
uucuuucgaacaagagaaguuc

SEQ ID NO: 118334 - RNA, 22 nt, Human
uuuugucuguggaaagcugcua

SEQ ID NO: 118335 - RNA, 22 nt, Human
uucuuccagugaaacgugcauc

SEQ ID NO: 118336 - RNA, 22 nt, Human
uugaacauuagaauaaguaauu

SEQ ID NO: 118337 - RNA, 22 nt, Human
uugaacaguuuugucagguuca

SEQ ID NO: 118338 - RNA, 22 nt, Human
uuuuuguaaaugaaguuuuauu

SEQ ID NO: 118339 - RNA, 22 nt, Human
uuuuuguauaugcuucgaggau

SEQ ID NO: 118340 - RNA, 22 nt, Human
uuuuuuaaucaaguaggaaaca

SEQ ID NO: 118341 - RNA, 22 nt, Human
uugaauaaggcauaaagauacu

SEQ ID NO: 118342 - RNA, 22 nt, Human
uuuuuuccugguuacagauugu

SEQ ID NO: 118343 - RNA, 22 nt, Human
uugaccagaaaaguuaguaauu

SEQ ID NO: 118344 - RNA, 22 nt, Human
uucaauuacaucagaaucuaaa

SEQ ID NO: 118345 - RNA, 22 nt, Human
uuuauguugagcaaaauaccac

SEQ ID NO: 118346 - RNA, 22 nt, Human
uucagaauguacugauagaaca

SEQ ID NO: 118347 - RNA, 22 nt, Human
uucagaaagugaaucuuguuau

SEQ ID NO: 118348 - RNA, 22 nt, Human
uucacuuuuucucugcuugaga

SEQ ID NO: 118349 - RNA, 22 nt, Human
uucacagugguaaggguuguga

SEQ ID NO: 118350 - RNA, 22 nt, Human
uuugcuuugacuuugggaguau

SEQ ID NO: 118351 - RNA, 22 nt, Human
uuugcuguaaugcaugucagag

SEQ ID NO: 118352 - RNA, 22 nt, Human
uuugcuguccaauauucagggu

SEQ ID NO: 118353 - RNA, 22 nt, Human
uucaggugguuuaagaauugga

SEQ ID NO: 118354 - RNA, 22 nt, Human
uuuguguuggaagaaaugcuac

SEQ ID NO: 118355 - RNA, 18 nt, Human
uuccauuuuucagucuuc

SEQ ID NO: 118356 - RNA, 22 nt, Human
uuuguucaccuagcaaacuuuu

SEQ ID NO: 118357 - RNA, 22 nt, Human
uucauuauuaauaauagcagcu

SEQ ID NO: 118358 - RNA, 22 nt, Human
uucauuagcguaggauguguac

SEQ ID NO: 118359 - RNA, 22 nt, Human
uucaugucuuugauucugauaa

SEQ ID NO: 118360 - RNA, 20 nt, Human
uucaugcagugguugcugug

SEQ ID NO: 118361 - RNA, 22 nt, Human
uuccacauucggaauuuucuga

SEQ ID NO: 118362 - RNA, 22 nt, Human
uuuguuuauuuacuuugggccu

SEQ ID NO: 118363 - RNA, 22 nt, Human
uuccugcuggucaaaguugccu

SEQ ID NO: 118364 - RNA, 22 nt, Human
uuccuuuuuaauuaaucuaauu

SEQ ID NO: 118365 - RNA, 22 nt, Human
uuccuuuaaccaagagcaguac

SEQ ID NO: 118366 - RNA, 23 nt, Human
uuuuaauaguaugacaugagcug

SEQ ID NO: 118367 - RNA, 22 nt, Human
uuuuaauaguauaucuagacac

SEQ ID NO: 118368 - RNA, 22 nt, Human
uuuuaaauaaacuacacugauu

SEQ ID NO: 118369 - RNA, 22 nt, Human
uuuuaaauggcuuuuacuuuuc

SEQ ID NO: 118370 - RNA, 22 nt, Human
uuggauugugaaaguauucucu

SEQ ID NO: 118371 - RNA, 22 nt, Human
uuggaaguggcaaaggcuaaag

SEQ ID NO: 118372 - RNA, 22 nt, Human
uuggaauuugagaccaagaaaa

SEQ ID NO: 118373 - RNA, 22 nt, Human
uguguauaugugugugugugug

SEQ ID NO: 118374 - RNA, 22 nt, Human
uuggagaaagcugcaggcucug

SEQ ID NO: 118375 - RNA, 22 nt, Human
uuggaagagagauggggagaga

SEQ ID NO: 118376 - RNA, 22 nt, Human
uugcggauguccacgucacacu

SEQ ID NO: 118377 - RNA, 22 nt, Human
uuggcauuccagaugcuuuucu

SEQ ID NO: 118378 - RNA, 22 nt, Human
uugguauucaguuggauuugga

SEQ ID NO: 118379 - RNA, 22 nt, Human
uugguugcugaugagcuuugag

SEQ ID NO: 118380 - RNA, 22 nt, Human
uguuuuguuuagguuuguuuuu

SEQ ID NO: 118381 - RNA, 22 nt, Human
uguuuucuuuccccuucuuuuc

SEQ ID NO: 118382 - RNA, 22 nt, Human
uguuuucuauuaccugagauug

SEQ ID NO: 118383 - RNA, 22 nt, Human
uguuuguuuuguauuuuuaauu

SEQ ID NO: 118384 - RNA, 19 nt, Human
uugucuuagcugcauaaga

SEQ ID NO: 118385 - RNA, 22 nt, Human
uugugaggaugugcuuuuuagu

SEQ ID NO: 118386 - RNA, 21 nt, Human
uugugaaaguccaggaacaac

SEQ ID NO: 118387 - RNA, 22 nt, Human
uugucuuucguauggaacacua

SEQ ID NO: 118388 - RNA, 22 nt, Human
uugugacuauuuuucauugaag

SEQ ID NO: 118389 - RNA, 22 nt, Human
uuuacuuguuuugcucuuuucc

SEQ ID NO: 118390 - RNA, 18 nt, Human
uuuacgaacucacuugag

SEQ ID NO: 118391 - RNA, 22 nt, Human
uuaccuuuucuuguuuacaagu

SEQ ID NO: 118392 - RNA, 19 nt, Human
uuuaaugugugcugcaauc

SEQ ID NO: 118393 - RNA, 22 nt, Human
uuuaaugucuuuggccuuuaau

SEQ ID NO: 118394 - RNA, 22 nt, Human
uuuaccuuauguaaauaagagu

SEQ ID NO: 118395 - RNA, 22 nt, Human
uuaccuuggaccggguaucaga

SEQ ID NO: 118396 - RNA, 22 nt, Human
uuaauugggugcuuuguaaaua

SEQ ID NO: 118397 - RNA, 22 nt, Human
uuaauuguuagauagauuauag

SEQ ID NO: 118398 - RNA, 22 nt, Human
uuacaagaucuuugaaggcaag

SEQ ID NO: 118399 - RNA, 19 nt, Human
uuacaugacauaugaagga

SEQ ID NO: 118400 - RNA, 22 nt, Human
uuuaaucaguugguaauauuga

SEQ ID NO: 118401 - RNA, 22 nt, Human
uuuaaugaugucuaugccuguu

SEQ ID NO: 118402 - RNA, 22 nt, Human
uuuagauguucccucuacccug

SEQ ID NO: 118403 - RNA, 22 nt, Human
uuagaaaaaggcuguggucuua

SEQ ID NO: 118404 - RNA, 22 nt, Human
uuagaugaaaaucggaacaugu

SEQ ID NO: 118405 - RNA, 22 nt, Human
uuuauguuuguuuuugaaauaa

SEQ ID NO: 118406 - RNA, 22 nt, Human
uuuaugucaaaaguaaaaugaa

SEQ ID NO: 118407 - RNA, 22 nt, Human
uuuagugagugugaaucaaaug

SEQ ID NO: 118408 - RNA, 22 nt, Human
uuuauaaacacaagaugggcuc

SEQ ID NO: 118409 - RNA, 22 nt, Human
uuaaaauuguuaacuuugguga

SEQ ID NO: 118410 - RNA, 22 nt, Human
uuaacgaauugugcauaauucc

SEQ ID NO: 118411 - RNA, 22 nt, Human
uuaagagaagaguaucuagaac

SEQ ID NO: 118412 - RNA, 22 nt, Human
uuguuuggcaaaugugugugug

SEQ ID NO: 118413 - RNA, 22 nt, Human
uuaauaaauugugguaccagag

SEQ ID NO: 118414 - RNA, 22 nt, Human
uuguuuguaaggcucuuagaau

SEQ ID NO: 118415 - RNA, 22 nt, Human
uuaaucagacauucucaaguuu

SEQ ID NO: 118416 - RNA, 22 nt, Human
uuaauauuuauugguaaucacu

SEQ ID NO: 118417 - RNA, 22 nt, Human
uuaauauuaagauauugagugg

SEQ ID NO: 118418 - RNA, 22 nt, Human
uuaaucuauuucauauaaggga

SEQ ID NO: 118419 - RNA, 22 nt, Human
uuuaaaacagcauuuaaaaggu

SEQ ID NO: 118420 - RNA, 22 nt, Human
uuaauguuuuagaaugagagug

SEQ ID NO: 118421 - RNA, 22 nt, Human
uuaauguugacacacuagcaca

SEQ ID NO: 118422 - RNA, 22 nt, Human
uuaauucuugagcugucuuucc

SEQ ID NO: 118423 - RNA, 23 nt, Human
uguauacacccugugcaucuggg

SEQ ID NO: 118424 - RNA, 22 nt, Human
uugaauggaauuggaaucuuau

SEQ ID NO: 118425 - RNA, 22 nt, Human
uugaauaguuuuggauagcaua

SEQ ID NO: 118426 - RNA, 22 nt, Human
uugaaggugggaggauuuauau

SEQ ID NO: 118427 - RNA, 22 nt, Human
ugucauuuauucucuuauucua

SEQ ID NO: 118428 - RNA, 22 nt, Human
uugauuggguauaaugacagga

SEQ ID NO: 118429 - RNA, 22 nt, Human
uugauuuggcguuuuccuccug

SEQ ID NO: 118430 - RNA, 22 nt, Human
uugcagcuguugcaaagucucu

SEQ ID NO: 118431 - RNA, 22 nt, Human
uugaaagucuaagaauagguau

SEQ ID NO: 118432 - RNA, 22 nt, Human
uguauaaaauggaaugucagaa

SEQ ID NO: 118433 - RNA, 22 nt, Human
uugaaaaaugcccagcagacaa

SEQ ID NO: 118434 - RNA, 22 nt, Human
uguagaaguuaauugaugagua

SEQ ID NO: 118435 - RNA, 22 nt, Human
ugguuuuuuguaggauaaacau

SEQ ID NO: 118436 - RNA, 22 nt, Human
uugaaaaaauguguuuaaggag

SEQ ID NO: 118437 - RNA, 22 nt, Human
uucuuuucuucccuguuuauua

SEQ ID NO: 118438 - RNA, 22 nt, Human
uucuuuguccuagcauucuaca

SEQ ID NO: 118439 - RNA, 22 nt, Human
uucuuaaugcauccuguguuca

SEQ ID NO: 118440 - RNA, 19 nt, Human
uggugcgcuguuccugagc

SEQ ID NO: 118441 - RNA, 22 nt, Human
ugguccuuuccauuggagacac

SEQ ID NO: 118442 - RNA, 22 nt, Human
ugguucggcuguaaguauaucu

SEQ ID NO: 118443 - RNA, 22 nt, Human
uucuucuucuuccucauccuca

SEQ ID NO: 118444 - RNA, 22 nt, Human
uucuugcgaaagaaugagcuga

SEQ ID NO: 118445 - RNA, 21 nt, Human
uucuauauugagaauuggcua

SEQ ID NO: 118446 - RNA, 22 nt, Human
uucuaguuacagaagccuugcu

SEQ ID NO: 118447 - RNA, 23 nt, Human
uggguuucagugccaaugcugcc

SEQ ID NO: 118448 - RNA, 22 nt, Human
ugguaaaguguacugaauauga

SEQ ID NO: 118449 - RNA, 19 nt, Human
uucugcucaguaacacccu

SEQ ID NO: 118450 - RNA, 22 nt, Human
ugguacaaaaaagauuuuggac

SEQ ID NO: 118451 - RNA, 22 nt, Human
ugguauaaaaauuugugaaugu

SEQ ID NO: 118452 - RNA, 22 nt, Human
ugguauauuugaccauaugugu

SEQ ID NO: 118453 - RNA, 22 nt, Human
uuauggauuagaguuugauucu

SEQ ID NO: 118454 - RNA, 22 nt, Human
uuaugggguuaaauuucuccua

SEQ ID NO: 118455 - RNA, 22 nt, Human
uuccaaggagagcucgaccuca

SEQ ID NO: 118456 - RNA, 22 nt, Human
uuccaaggcugcuauuuguuuc

SEQ ID NO: 118457 - RNA, 22 nt, Human
uuaugugcuacacauaauuugu

SEQ ID NO: 118458 - RNA, 22 nt, Human
uuccaaaugacaaugggcugua

SEQ ID NO: 118459 - RNA, 22 nt, Human
ugggaauuuaugagaaaauaua

SEQ ID NO: 118460 - RNA, 22 nt, Human
ugggaaaauugugauucuuucu

SEQ ID NO: 118461 - RNA, 22 nt, Human
ugggaaaauagcuauuuugaaa

SEQ ID NO: 118462 - RNA, 22 nt, Human
uuccucuugaaucugucugacu

SEQ ID NO: 118463 - RNA, 22 nt, Human
ugggacaugaugcauuugaaag

SEQ ID NO: 118464 - RNA, 22 nt, Human
uucccuuggcuuugauuguguu

SEQ ID NO: 118465 - RNA, 22 nt, Human
uuccuaauugccaugaaguuau

SEQ ID NO: 118466 - RNA, 20 nt, Human
uuccuuaucuguaaagugga

SEQ ID NO: 118467 - RNA, 22 nt, Human
uguuuccuaagugucucugaag

SEQ ID NO: 118468 - RNA, 22 nt, Human
uguuuccuguaccacagguuuu

SEQ ID NO: 118469 - RNA, 22 nt, Human
uguuuaguuuugcaccaauaaa

SEQ ID NO: 118470 - RNA, 22 nt, Human
uguuuaucaguagacucaaguu

SEQ ID NO: 118471 - RNA, 22 nt, Human
uguuuuuauucuuaauguuuca

SEQ ID NO: 118472 - RNA, 22 nt, Human
uguuuuuagcuguuuuuuggau

SEQ ID NO: 118473 - RNA, 21 nt, Human
uguuuuguaauagauacuaug

SEQ ID NO: 118474 - RNA, 22 nt, Human
uguuuuuuagagugauacuuuu

SEQ ID NO: 118475 - RNA, 22 nt, Human
uguuuuucaagcauuuauuaau

SEQ ID NO: 118476 - RNA, 22 nt, Human
uuaaaagaauccuguuauccuc

SEQ ID NO: 118477 - RNA, 22 nt, Human
uguuuuuucccccccuucuaaa

SEQ ID NO: 118478 - RNA, 22 nt, Human
ugcugcucaagcugcagcaaaa

SEQ ID NO: 118479 - RNA, 22 nt, Human
uuaaagaguuuauuacuuguaa

SEQ ID NO: 118480 - RNA, 22 nt, Human
uuaaacauuuccacuugccagu

SEQ ID NO: 118481 - RNA, 20 nt, Human
ugcugggccaucuugcaugc

SEQ ID NO: 118482 - RNA, 21 nt, Human
uuaauugagggauggggguga

SEQ ID NO: 118483 - RNA, 22 nt, Human
ugcuucuuuccuuggugacuuc

SEQ ID NO: 118484 - RNA, 22 nt, Human
uuaaugcagguacuguuacaau

SEQ ID NO: 118485 - RNA, 22 nt, Human
uuaauaaggaccugugacaugc

SEQ ID NO: 118486 - RNA, 22 nt, Human
uuaaguauggaggccuaacuga

SEQ ID NO: 118487 - RNA, 22 nt, Human
uuaguauuuucaccauaugagg

SEQ ID NO: 118488 - RNA, 23 nt, Human
uggaagaaaaugguuuggcugug

SEQ ID NO: 118489 - RNA, 22 nt, Human
uggaagaagcuacaagcgguga

SEQ ID NO: 118490 - RNA, 22 nt, Human
uuagugaagaagcaucuuuagu

SEQ ID NO: 118491 - RNA, 22 nt, Human
uuaguuagucuaugccugacca

SEQ ID NO: 118492 - RNA, 20 nt, Human
uggaaggaaagguguaucuu

SEQ ID NO: 118493 - RNA, 22 nt, Human
uggaaggaaauguguaucauaa

SEQ ID NO: 118494 - RNA, 22 nt, Human
uggaaugaaagaaaaauuguag

SEQ ID NO: 118495 - RNA, 22 nt, Human
uggaauuaucugaagugauuug

SEQ ID NO: 118496 - RNA, 22 nt, Human
uuauauuaaaaaucgcuaacag

SEQ ID NO: 118497 - RNA, 22 nt, Human
uuauaucagaaggugagauuga

SEQ ID NO: 118498 - RNA, 22 nt, Human
uuauacuucugccagaggacaa

SEQ ID NO: 118499 - RNA, 22 nt, Human
uuaucuguuuuaaugaauaauu

SEQ ID NO: 118500 - RNA, 19 nt, Human
uuauccggacuuaauuuau

SEQ ID NO: 118501 - RNA, 22 nt, Human
uggagauauucuauauuuuaua

SEQ ID NO: 118502 - RNA, 22 nt, Human
uggagcaagaagggaggcagaa

SEQ ID NO: 118503 - RNA, 22 nt, Human
uuauauuuuauuuaauuaaaua

SEQ ID NO: 118504 - RNA, 22 nt, Human
uuaucaaaaaauaguacuuuga

SEQ ID NO: 118505 - RNA, 22 nt, Human
uggaaauacaagaaguauguca

SEQ ID NO: 118506 - RNA, 22 nt, Human
uuagacagagcuccuugagggc

SEQ ID NO: 118507 - RNA, 22 nt, Human
uuagagagaggagagagagaga

SEQ ID NO: 118508 - RNA, 22 nt, Human
uuagagaauagacuuuacccug

SEQ ID NO: 118509 - RNA, 22 nt, Human
uuacuuaucugaugugauuuuu

SEQ ID NO: 118510 - RNA, 22 nt, Human
uuacuuuuuucccccuuagaug

SEQ ID NO: 118511 - RNA, 22 nt, Human
uggaaaugcuuagaggugaucu

SEQ ID NO: 118512 - RNA, 22 nt, Human
uuagauaguaaauagcacuaag

SEQ ID NO: 118513 - RNA, 22 nt, Human
uuacacaugaagguccaauguu

SEQ ID NO: 118514 - RNA, 22 nt, Human
uuacaugcuugugcagguuuug

SEQ ID NO: 118515 - RNA, 21 nt, Human
ugcuuucugugcuuuuucugc

SEQ ID NO: 118516 - RNA, 22 nt, Human
ugcuuuaccuuccauuuaagga

SEQ ID NO: 118517 - RNA, 22 nt, Human
ucuuuuuaugucaaaaucgaug

SEQ ID NO: 118518 - RNA, 22 nt, Human
ucuuuugugauuuucugaagca

SEQ ID NO: 118519 - RNA, 22 nt, Human
ucuuuuucccugguuccuuuuu

SEQ ID NO: 118520 - RNA, 22 nt, Human
ugaaaaauauuuuuagaaauaa

SEQ ID NO: 118521 - RNA, 22 nt, Human
ugggugaagaggcuaugcuacu

SEQ ID NO: 118522 - RNA, 22 nt, Human
ugaccuuuuuaaauuauuuuua

SEQ ID NO: 118523 - RNA, 22 nt, Human
ugacuaauacagaaacuacaag

SEQ ID NO: 118524 - RNA, 22 nt, Human
ugagaaaacaguuuguaauaau

SEQ ID NO: 118525 - RNA, 22 nt, Human
ugagaacacuuuucucuuugcu

SEQ ID NO: 118526 - RNA, 22 nt, Human
ugguauaaaaaaaugaguauaa

SEQ ID NO: 118527 - RNA, 22 nt, Human
ugaggaugaggaagaagaagaa

SEQ ID NO: 118528 - RNA, 22 nt, Human
ugagggaagguugauaauguuc

SEQ ID NO: 118529 - RNA, 22 nt, Human
ugguuauauaaggauuaaauac

SEQ ID NO: 118530 - RNA, 22 nt, Human
ugagauuuagaacuggauuuca

SEQ ID NO: 118531 - RNA, 19 nt, Human
ugagauuguaugaggagau

SEQ ID NO: 118532 - RNA, 22 nt, Human
ugagcagccagucauucaaaaa

SEQ ID NO: 118533 - RNA, 22 nt, Human
ugguccgagaacuguccugguu

SEQ ID NO: 118534 - RNA, 21 nt, Human
ugguuuuaucuugguggcugc

SEQ ID NO: 118535 - RNA, 20 nt, Human
ugauccacucucauugcucu

SEQ ID NO: 118536 - RNA, 22 nt, Human
ugaugaucaugcagguugguuu

SEQ ID NO: 118537 - RNA, 22 nt, Human
ugauaguaucugauuauuucac

SEQ ID NO: 118538 - RNA, 20 nt, Human
ugauaugcgguacagagagg

SEQ ID NO: 118539 - RNA, 22 nt, Human
ugauuugaaaccuuuggcaaga

SEQ ID NO: 118540 - RNA, 22 nt, Human
ugcaaauuuuuuuauuuuuccu

SEQ ID NO: 118541 - RNA, 22 nt, Human
uguccuuucagagcuccuuuug

SEQ ID NO: 118542 - RNA, 22 nt, Human
ugcaaugagcuucuuugauaaa

SEQ ID NO: 118543 - RNA, 23 nt, Human
ugcaaugcagcuagauguaaaau

SEQ ID NO: 118544 - RNA, 22 nt, Human
ugugaaugacuuuguucuuugc

SEQ ID NO: 118545 - RNA, 23 nt, Human
ugugaauggccuucuuuagaggu

SEQ ID NO: 118546 - RNA, 22 nt, Human
ugugaagaauuaaugugaauca

SEQ ID NO: 118547 - RNA, 22 nt, Human
ugucuuuuaaaaauguguaaaa

SEQ ID NO: 118548 - RNA, 22 nt, Human
ugugagcugccacuucuaaucu

SEQ ID NO: 118549 - RNA, 22 nt, Human
ugccgcaggaggggcgauuucu

SEQ ID NO: 118550 - RNA, 22 nt, Human
ugcaugaucucacuuacaggug

SEQ ID NO: 118551 - RNA, 22 nt, Human
ucugaugaccacaugugggacu

SEQ ID NO: 118552 - RNA, 22 nt, Human
uggaagcuggcugaucugacuu

SEQ ID NO: 118553 - RNA, 22 nt, Human
uggaagcuagggguuucuguug

SEQ ID NO: 118554 - RNA, 22 nt, Human
ucuggcucuccagugcucuuag

SEQ ID NO: 118555 - RNA, 22 nt, Human
ucugugcuccuuccuugucauc

SEQ ID NO: 118556 - RNA, 22 nt, Human
uggauauuuuguaugugcguuu

SEQ ID NO: 118557 - RNA, 22 nt, Human
ucuguucagaagaggugaaagu

SEQ ID NO: 118558 - RNA, 22 nt, Human
uggaguaauggguguuuuugaa

SEQ ID NO: 118559 - RNA, 22 nt, Human
ucuguuuugugcuuuguuuucu

SEQ ID NO: 118560 - RNA, 22 nt, Human
ucuguuuuccaggaaucucaua

SEQ ID NO: 118561 - RNA, 22 nt, Human
ucuguuuuucagaccuuuuugg

SEQ ID NO: 118562 - RNA, 22 nt, Human
ucuugcuggagucaaggcuaca

SEQ ID NO: 118563 - RNA, 22 nt, Human
uggcgugaagcuggaaggcgga

SEQ ID NO: 118564 - RNA, 22 nt, Human
ucuucuauaucuacauaugcaa

SEQ ID NO: 118565 - RNA, 22 nt, Human
ucuucauuucuggggaauuggc

SEQ ID NO: 118566 - RNA, 22 nt, Human
ucuuccagauacuuccugacuu

SEQ ID NO: 118567 - RNA, 21 nt, Human
ucuuccaacacugacaccaug

SEQ ID NO: 118568 - RNA, 20 nt, Human
uggaugacuucaggcagccu

SEQ ID NO: 118569 - RNA, 22 nt, Human
ucuuauuucuuucuuuuccugu

SEQ ID NO: 118570 - RNA, 22 nt, Human
ugcuucuuuaggauguaguuau

SEQ ID NO: 118571 - RNA, 22 nt, Human
ugcuugaacccaggaaguggag

SEQ ID NO: 118572 - RNA, 22 nt, Human
ugcuuggauuuccaaaugguuu

SEQ ID NO: 118573 - RNA, 22 nt, Human
ugcuuguuuguuuucuuccauu

SEQ ID NO: 118574 - RNA, 22 nt, Human
ucucuucacuuguaugcuauca

SEQ ID NO: 118575 - RNA, 22 nt, Human
ugcuuuauucgacaucugguag

SEQ ID NO: 118576 - RNA, 22 nt, Human
ugcuuuggcccaacauugaugc

SEQ ID NO: 118577 - RNA, 22 nt, Human
ucucuuuuuuuaaaacucuaug

SEQ ID NO: 118578 - RNA, 22 nt, Human
uggaaaacgcaguuuaauuuuu

SEQ ID NO: 118579 - RNA, 22 nt, Human
uggaaaagaugucuuccugaau

SEQ ID NO: 118580 - RNA, 22 nt, Human
uggaaaauuuagaaagauuuau

SEQ ID NO: 118581 - RNA, 22 nt, Human
ugcuuuuguaucagaguauuca

SEQ ID NO: 118582 - RNA, 22 nt, Human
ucucaggcuuccuggugcugug

SEQ ID NO: 118583 - RNA, 22 nt, Human
ugcuggaaggguaguauuaacu

SEQ ID NO: 118584 - RNA, 22 nt, Human
ugcuuaaagcauuucucuuuaa

SEQ ID NO: 118585 - RNA, 22 nt, Human
ugcugugagaccauuuguugag

SEQ ID NO: 118586 - RNA, 23 nt, Human
ugcugcgggacccgagcgcgcgc

SEQ ID NO: 118587 - RNA, 22 nt, Human
ugcugcuguuuccuacaucuca

SEQ ID NO: 118588 - RNA, 22 nt, Human
ucuauuauauuuacacgagagu

SEQ ID NO: 118589 - RNA, 22 nt, Human
uccuagaccuacugaaucagac

SEQ ID NO: 118590 - RNA, 22 nt, Human
ugcauuguuuauggaauaaaau

SEQ ID NO: 118591 - RNA, 22 nt, Human
ugccuuuuguguuuggcuaauc

SEQ ID NO: 118592 - RNA, 22 nt, Human
ugcauaaauauuguugggagua

SEQ ID NO: 118593 - RNA, 22 nt, Human
ucccauauuauggggaaaaacu

SEQ ID NO: 118594 - RNA, 22 nt, Human
ucccucuccugucugcuucuuu

SEQ ID NO: 118595 - RNA, 22 nt, Human
ugauugguauguauguuuguca

SEQ ID NO: 118596 - RNA, 22 nt, Human
uccagcuucugccugcugcugc

SEQ ID NO: 118597 - RNA, 22 nt, Human
ugagacaaaguuguuggauguu

SEQ ID NO: 118598 - RNA, 22 nt, Human
ucuuccaaacaaaaaucugugu

SEQ ID NO: 118599 - RNA, 22 nt, Human
ucaggcuagcccagugcuuggg

SEQ ID NO: 118600 - RNA, 22 nt, Human
ugagaagaggucuuuugggaug

SEQ ID NO: 118601 - RNA, 22 nt, Human
ugagaaauauacaccagacaca

SEQ ID NO: 118602 - RNA, 22 nt, Human
ucaguuuaauuggaucuuuuuc

SEQ ID NO: 118603 - RNA, 22 nt, Human
ucaguugagguggucuauugcg

SEQ ID NO: 118604 - RNA, 22 nt, Human
ugaggaugagaaggaagagaag

SEQ ID NO: 118605 - RNA, 22 nt, Human
ucauaaaggugccacucaguuu

SEQ ID NO: 118606 - RNA, 22 nt, Human
ucauaaaaucaguguccauugu

SEQ ID NO: 118607 - RNA, 19 nt, Human
uccaaaauacuuguuacug

SEQ ID NO: 118608 - RNA, 22 nt, Human
ugauuagauacuucagaugaca

SEQ ID NO: 118609 - RNA, 20 nt, Human
ugauuauuccaacaagaaug

SEQ ID NO: 118610 - RNA, 22 nt, Human
ugauguuucugaagggguuacu

SEQ ID NO: 118611 - RNA, 22 nt, Human
uccaaggacuaaauucuagauu

SEQ ID NO: 118612 - RNA, 22 nt, Human
ugauguauaaaaagagugaaau

SEQ ID NO: 118613 - RNA, 22 nt, Human
ugauucuuugaccaaaaaauug

SEQ ID NO: 118614 - RNA, 22 nt, Human
ugauugaauaauguuaugugaa

SEQ ID NO: 118615 - RNA, 22 nt, Human
uaggauauuuuagaaugguaca

SEQ ID NO: 118616 - RNA, 23 nt, Human
uaguguuauuaauuaguaaggau

SEQ ID NO: 118617 - RNA, 22 nt, Human
uaguuauuucugcacuuaauga

SEQ ID NO: 118618 - RNA, 22 nt, Human
ucgauccaggaaggcugguuua

SEQ ID NO: 118619 - RNA, 22 nt, Human
uauaagaaaagucauuaucaaa

SEQ ID NO: 118620 - RNA, 21 nt, Human
ucucauuuuaacacagaguug

SEQ ID NO: 118621 - RNA, 22 nt, Human
uaguuucuaauguugaaauuau

SEQ ID NO: 118622 - RNA, 22 nt, Human
uaguuuuaagcugacauuguuc

SEQ ID NO: 118623 - RNA, 22 nt, Human
uaguuuucuuuuguguuauucu

SEQ ID NO: 118624 - RNA, 22 nt, Human
uauauuaaagugcuuugcagug

SEQ ID NO: 118625 - RNA, 22 nt, Human
uauauguagcucaaaaauuccc

SEQ ID NO: 118626 - RNA, 22 nt, Human
uauaugaggauauuuuaaagcu

SEQ ID NO: 118627 - RNA, 22 nt, Human
uauauauaugcaccacaugugu

SEQ ID NO: 118628 - RNA, 22 nt, Human
uauauaauacacaaauauguac

SEQ ID NO: 118629 - RNA, 18 nt, Human
ucugaaggaaugauucca

SEQ ID NO: 118630 - RNA, 22 nt, Human
ucugacuucuuuuauuaucauu

SEQ ID NO: 118631 - RNA, 22 nt, Human
uaugaaagguuuuuucuugaaa

SEQ ID NO: 118632 - RNA, 22 nt, Human
uauguuaauuaccagcacugau

SEQ ID NO: 118633 - RNA, 22 nt, Human
ucuggucugccgagauccauuu

SEQ ID NO: 118634 - RNA, 22 nt, Human
uauguuuugcaaauaucaaaca

SEQ ID NO: 118635 - RNA, 22 nt, Human
uauuaauugugguuauuguauu

SEQ ID NO: 118636 - RNA, 22 nt, Human
ucuuauugugaugaugaagaac

SEQ ID NO: 118637 - RNA, 22 nt, Human
ucuucaaauacagucauauuga

SEQ ID NO: 118638 - RNA, 22 nt, Human
ucuguucaugucuuuuuaagug

SEQ ID NO: 118639 - RNA, 22 nt, Human
uauucauuuuuauuugugacug

SEQ ID NO: 118640 - RNA, 22 nt, Human
uauuauggguuuuuguguaaau

SEQ ID NO: 118641 - RNA, 22 nt, Human
uaugguuucuccugcagauuug

SEQ ID NO: 118642 - RNA, 22 nt, Human
uaugcuguauucuguauguuag

SEQ ID NO: 118643 - RNA, 22 nt, Human
uaugucuauugacuuaggauuu

SEQ ID NO: 118644 - RNA, 22 nt, Human
uauguguaauuaaauacuauag

SEQ ID NO: 118645 - RNA, 22 nt, Human
uaugaauauaccacaauuuagg

SEQ ID NO: 118646 - RNA, 22 nt, Human
uaugcauaauuggauaaguaga

SEQ ID NO: 118647 - RNA, 22 nt, Human
ucugccuucaggagcagacucu

SEQ ID NO: 118648 - RNA, 17 nt, Human
ucugccaguuuuagaau

SEQ ID NO: 118649 - RNA, 22 nt, Human
uacagcgaaaauuuagcuugau

SEQ ID NO: 118650 - RNA, 22 nt, Human
uccaaggcuggaucuuuucuuu

SEQ ID NO: 118651 - RNA, 22 nt, Human
uccaaggacucuugucagcugu

SEQ ID NO: 118652 - RNA, 22 nt, Human
uccaaggcagacacauuuuuug

SEQ ID NO: 118653 - RNA, 22 nt, Human
uacuuuaauugcaaaaauaaau

SEQ ID NO: 118654 - RNA, 22 nt, Human
uacuuuuuucacuucuagcccc

SEQ ID NO: 118655 - RNA, 22 nt, Human
uagaaauaaacacugcuaccuu

SEQ ID NO: 118656 - RNA, 22 nt, Human
uagaacaaacagcauguuugau

SEQ ID NO: 118657 - RNA, 22 nt, Human
uagaacugcucucauacuugcu

SEQ ID NO: 118658 - RNA, 19 nt, Human
uagauuagagcauaggguu

SEQ ID NO: 118659 - RNA, 22 nt, Human
uccuggaagggaugguugagga

SEQ ID NO: 118660 - RNA, 22 nt, Human
uccuucuuuucgccggaguuga

SEQ ID NO: 118661 - RNA, 22 nt, Human
uagcuggaggggcaggaugcug

SEQ ID NO: 118662 - RNA, 22 nt, Human
uagcucuuaccagugaaguuug

SEQ ID NO: 118663 - RNA, 22 nt, Human
ucauaagucucauauaugucca

SEQ ID NO: 118664 - RNA, 22 nt, Human
uaagcuauuccugaagaagguu

SEQ ID NO: 118665 - RNA, 22 nt, Human
ucauuauuuggaauaugggacu

SEQ ID NO: 118666 - RNA, 22 nt, Human
ucauuagucuuuaauacauaau

SEQ ID NO: 118667 - RNA, 22 nt, Human
ucauuagaccucucugguucag

SEQ ID NO: 118668 - RNA, 22 nt, Human
uaauauaacugccaguuaaggu

SEQ ID NO: 118669 - RNA, 22 nt, Human
ucauuguuucugcuuuucauga

SEQ ID NO: 118670 - RNA, 22 nt, Human
ucauuuuaucaggaauggaauc

SEQ ID NO: 118671 - RNA, 22 nt, Human
uacaaucacccaaagagccaga

SEQ ID NO: 118672 - RNA, 22 nt, Human
uacaaagugauuuuggaauuga

SEQ ID NO: 118673 - RNA, 22 nt, Human
uaaaugaaaugaagugaaagcu

SEQ ID NO: 118674 - RNA, 22 nt, Human
ucaguauuagugcauuaucagg

SEQ ID NO: 118675 - RNA, 22 nt, Human
ucaagcuggaaaugaagaaucu

SEQ ID NO: 118676 - RNA, 22 nt, Human
uaaagcauguuucaguaagguu

SEQ ID NO: 118677 - RNA, 22 nt, Human
ucaagcaaggaauccuuuugua

SEQ ID NO: 118678 - RNA, 22 nt, Human
ucaggucacugauaaaguggaa

SEQ ID NO: 118679 - RNA, 22 nt, Human
uaaauguugcuugugcugcuca

SEQ ID NO: 118680 - RNA, 22 nt, Human
uaacuuuucuguucaauuuucc

SEQ ID NO: 118681 - RNA, 22 nt, Human
uaacuguuuugaauauuguggu

SEQ ID NO: 118682 - RNA, 22 nt, Human
uagcuaguugguucuucucugu

SEQ ID NO: 118683 - RNA, 19 nt, Human
uagcuguucuugaguguga

SEQ ID NO: 118684 - RNA, 22 nt, Human
uagcgggucacccugcugugaa

SEQ ID NO: 118685 - RNA, 22 nt, Human
uagcguaugcugugugaugaau

SEQ ID NO: 118686 - RNA, 22 nt, Human
gugagagugguuuauguccaug

SEQ ID NO: 118687 - RNA, 22 nt, Human
uagaagaugccuuaaaguugaa

SEQ ID NO: 118688 - RNA, 21 nt, Human
uagaagagggaauuugucuuu

SEQ ID NO: 118689 - RNA, 22 nt, Human
uagaagaacaugucaaacuaua

SEQ ID NO: 118690 - RNA, 22 nt, Human
uagaagagcaugucaaacuaua

SEQ ID NO: 118691 - RNA, 22 nt, Human
uagaaguagaaucauuagggcu

SEQ ID NO: 118692 - RNA, 22 nt, Human
gugcuuuaccuuauuggucucg

SEQ ID NO: 118693 - RNA, 22 nt, Human
gugcugggaggcccaggaugga

SEQ ID NO: 118694 - RNA, 22 nt, Human
guggacagacauaauccuaauu

SEQ ID NO: 118695 - RNA, 22 nt, Human
guggacuagaguaggaguugca

SEQ ID NO: 118696 - RNA, 22 nt, Human
guggaagauauuucugguccag

SEQ ID NO: 118697 - RNA, 22 nt, Human
uaggaagagauuuucacauggc

SEQ ID NO: 118698 - RNA, 22 nt, Human
guggaggaagaucuuugaugau

SEQ ID NO: 118699 - RNA, 22 nt, Human
uagucaauuagaaagaggccuu

SEQ ID NO: 118700 - RNA, 22 nt, Human
uagucauaauucuugcugccuu

SEQ ID NO: 118701 - RNA, 22 nt, Human
uagugcauaccuaacauuuuug

SEQ ID NO: 118702 - RNA, 22 nt, Human
uaguggaaccuucuaaaugacg

SEQ ID NO: 118703 - RNA, 22 nt, Human
uaguaauagcuguaaagugugu

SEQ ID NO: 118704 - RNA, 22 nt, Human
uagguggaaccauaugaaauuu

SEQ ID NO: 118705 - RNA, 22 nt, Human
uaggucuuggagguggggcugg

SEQ ID NO: 118706 - RNA, 22 nt, Human
guggcuuucuaccauuaaauug

SEQ ID NO: 118707 - RNA, 22 nt, Human
guggcaguaaagcuggaaaagu

SEQ ID NO: 118708 - RNA, 22 nt, Human
guggcagagagcaagugucuga

SEQ ID NO: 118709 - RNA, 22 nt, Human
uauccaaaggaacaaucacagc

SEQ ID NO: 118710 - RNA, 22 nt, Human
uaucauuaggagugcugcucgg

SEQ ID NO: 118711 - RNA, 22 nt, Human
uaucauuuuacugugacauuuu

SEQ ID NO: 118712 - RNA, 19 nt, Human
uaugaaguugauaaaaguu

SEQ ID NO: 118713 - RNA, 22 nt, Human
uaucuuugccuuggguuuuguu

SEQ ID NO: 118714 - RNA, 22 nt, Human
uauccaucuucuuugagaaugg

SEQ ID NO: 118715 - RNA, 22 nt, Human
uaugugguuugucauuuaauau

SEQ ID NO: 118716 - RNA, 22 nt, Human
uaugugaaauggaauauagaaa

SEQ ID NO: 118717 - RNA, 20 nt, Human
uaugugcaguuugguuuauc

SEQ ID NO: 118718 - RNA, 22 nt, Human
uauguauaacuugauaggauga

SEQ ID NO: 118719 - RNA, 22 nt, Human
guuauuaaauauuuuggugauu

SEQ ID NO: 118720 - RNA, 22 nt, Human
guucaaccaugauuaggaacug

SEQ ID NO: 118721 - RNA, 22 nt, Human
uauuuuaaaagcauuaauucuu

SEQ ID NO: 118722 - RNA, 22 nt, Human
guucuguucuucacagguuugu

SEQ ID NO: 118723 - RNA, 22 nt, Human
guucuguuguugaucuuuggag

SEQ ID NO: 118724 - RNA, 22 nt, Human
ucaaaaauaagauauucuggac

SEQ ID NO: 118725 - RNA, 22 nt, Human
uauuuuuguuuaccaguuaaca

SEQ ID NO: 118726 - RNA, 22 nt, Human
guuggugagaguuagggauuua

SEQ ID NO: 118727 - RNA, 22 nt, Human
ucaaauaugggccagaggaaau

SEQ ID NO: 118728 - RNA, 19 nt, Human
uaaguagaugacugaugcu

SEQ ID NO: 118729 - RNA, 22 nt, Human
uaaguaauugugguuuuugcca

SEQ ID NO: 118730 - RNA, 22 nt, Human
uaagauuuuuacaaauagagug

SEQ ID NO: 118731 - RNA, 22 nt, Human
uaagucaagagcuagaaaaagc

SEQ ID NO: 118732 - RNA, 22 nt, Human
guagauaauuuuggaaagcugg

SEQ ID NO: 118733 - RNA, 22 nt, Human
guagaaaauagauugucucuug

SEQ ID NO: 118734 - RNA, 19 nt, Human
uaagaaucaccaggggugu

SEQ ID NO: 118735 - RNA, 22 nt, Human
guauugauuguuuuaaaagauu

SEQ ID NO: 118736 - RNA, 22 nt, Human
uaauuuagugcauuuccuagua

SEQ ID NO: 118737 - RNA, 22 nt, Human
uaauugaacguucauuuuuaau

SEQ ID NO: 118738 - RNA, 22 nt, Human
uaauucuagauugacauuuuga

SEQ ID NO: 118739 - RNA, 22 nt, Human
guccuuuauuugaacaugacau

SEQ ID NO: 118740 - RNA, 22 nt, Human
uaauuauuaauuuuagguugcu

SEQ ID NO: 118741 - RNA, 22 nt, Human
uaauccaaaacugaaucugugg

SEQ ID NO: 118742 - RNA, 22 nt, Human
uaauaucuuuacacauuuucaa

SEQ ID NO: 118743 - RNA, 22 nt, Human
uaauuucauuuugcaaugaucu

SEQ ID NO: 118744 - RNA, 22 nt, Human
uacaaaauucaaauaauguuug

SEQ ID NO: 118745 - RNA, 22 nt, Human
uaauuuugucacagugacaugc

SEQ ID NO: 118746 - RNA, 22 nt, Human
gugaaaauaguaaccuggcuag

SEQ ID NO: 118747 - RNA, 22 nt, Human
gugaaaaauggccaucaggaca

SEQ ID NO: 118748 - RNA, 22 nt, Human
uacuucuuuuguaaaguauuga

SEQ ID NO: 118749 - RNA, 22 nt, Human
uacuucauucaaguucgcuaua

SEQ ID NO: 118750 - RNA, 22 nt, Human
uacuuugucauucuaaccuucc

SEQ ID NO: 118751 - RNA, 22 nt, Human
uacuugaacaucacuaagagaa

SEQ ID NO: 118752 - RNA, 22 nt, Human
guuuguuugccagcuuaguaaa

SEQ ID NO: 118753 - RNA, 22 nt, Human
uaaaacuaugcaaccuacuacc

SEQ ID NO: 118754 - RNA, 21 nt, Human
uaaaagaugacaagacagcuc

SEQ ID NO: 118755 - RNA, 22 nt, Human
guacauauccuuuacguuuugu

SEQ ID NO: 118756 - RNA, 22 nt, Human
uaaauuggaauaaugagaagug

SEQ ID NO: 118757 - RNA, 22 nt, Human
guaacuuuuuccucauuggcua

SEQ ID NO: 118758 - RNA, 22 nt, Human
uaaaugaaaggguuuaauuuau

SEQ ID NO: 118759 - RNA, 22 nt, Human
uaaaccuuauuugaauaccaac

SEQ ID NO: 118760 - RNA, 22 nt, Human
uaaacgaagcuucaugcuugaa

SEQ ID NO: 118761 - RNA, 22 nt, Human
guuggaaauaucagucacguga

SEQ ID NO: 118762 - RNA, 21 nt, Human
guugugaccaugggaguugcu

SEQ ID NO: 118763 - RNA, 22 nt, Human
guuuccuuuugugguuuuucua

SEQ ID NO: 118764 - RNA, 22 nt, Human
guuucuguguugauugugcccu

SEQ ID NO: 118765 - RNA, 22 nt, Human
guuuauucuuuuauuugugaga

SEQ ID NO: 118766 - RNA, 22 nt, Human
guuuaaaagcaaccaacaggcu

SEQ ID NO: 118767 - RNA, 22 nt, Human
ggcgauuggccgggaggaggca

SEQ ID NO: 118768 - RNA, 22 nt, Human
guauaaagaugccauacuuacu

SEQ ID NO: 118769 - RNA, 22 nt, Human
gguuuguggagcuggaaacacu

SEQ ID NO: 118770 - RNA, 22 nt, Human
gguuugauauguuugugauucu

SEQ ID NO: 118771 - RNA, 22 nt, Human
gguuuaucuuuacaaaugaaau

SEQ ID NO: 118772 - RNA, 22 nt, Human
guauucugugugaucaagugau

SEQ ID NO: 118773 - RNA, 22 nt, Human
guauuauauaaccauugguucu

SEQ ID NO: 118774 - RNA, 22 nt, Human
gucaaaguuaacuagcaggugc

SEQ ID NO: 118775 - RNA, 22 nt, Human
gucacuuugcuugcgaugcucc

SEQ ID NO: 118776 - RNA, 22 nt, Human
guccauauuuauccuuaaagua

SEQ ID NO: 118777 - RNA, 22 nt, Human
gucguuugucaauuuugaugug

SEQ ID NO: 118778 - RNA, 22 nt, Human
gucgagaacauucauuaugcaa

SEQ ID NO: 118779 - RNA, 22 nt, Human
gucucacuucauuuucuuagcc

SEQ ID NO: 118780 - RNA, 22 nt, Human
gucucuuuugauuuuucacuca

SEQ ID NO: 118781 - RNA, 22 nt, Human
ggcugggagguggcgaggaggc

SEQ ID NO: 118782 - RNA, 22 nt, Human
gugccuggaaucuuuucuucac

SEQ ID NO: 118783 - RNA, 22 nt, Human
gggaaaaaggaguuagagauaa

SEQ ID NO: 118784 - RNA, 22 nt, Human
gggaagaacugauuucacacca

SEQ ID NO: 118785 - RNA, 21 nt, Human
gggaagagaagagaaaggagg

SEQ ID NO: 118786 - RNA, 22 nt, Human
gugaaauuguacacucaguacc

SEQ ID NO: 118787 - RNA, 23 nt, Human
gugaacaaugcuccaggagauac

SEQ ID NO: 118788 - RNA, 22 nt, Human
gugaagcaagggucaccugugg

SEQ ID NO: 118789 - RNA, 18 nt, Human
ggcugggcugugccccuu

SEQ ID NO: 118790 - RNA, 22 nt, Human
gucuuuguaguuuuaauuugag

SEQ ID NO: 118791 - RNA, 22 nt, Human
gcuuagaaucagaccuggguca

SEQ ID NO: 118792 - RNA, 22 nt, Human
gggaacuguaguuuacgcugcc

SEQ ID NO: 118793 - RNA, 22 nt, Human
gggaagugagcuggaaucaagg

SEQ ID NO: 118794 - RNA, 22 nt, Human
gcuugcuuuguaaauaucugug

SEQ ID NO: 118795 - RNA, 20 nt, Human
gggaauggauggauugcucc

SEQ ID NO: 118796 - RNA, 22 nt, Human
gcuuuugaauacuacaggaguu

SEQ ID NO: 118797 - RNA, 22 nt, Human
gcuuuugcaaagcuggagaauu

SEQ ID NO: 118798 - RNA, 22 nt, Human
gcuuguuagcaaugcagaaucu

SEQ ID NO: 118799 - RNA, 22 nt, Human
gcuuucagggucacugucaaca

SEQ ID NO: 118800 - RNA, 22 nt, Human
ggaaaaauggguggugauauga

SEQ ID NO: 118801 - RNA, 22 nt, Human
ggaaaggaagggaaggagaugc

SEQ ID NO: 118802 - RNA, 22 nt, Human
ggaagacuuagaguagcaucag

SEQ ID NO: 118803 - RNA, 22 nt, Human
ggaauaaaaggagguggcgaga

SEQ ID NO: 118804 - RNA, 22 nt, Human
ggaauacggguuuauuuagucu

SEQ ID NO: 118805 - RNA, 22 nt, Human
ggaaucuucagccaugccaaga

SEQ ID NO: 118806 - RNA, 22 nt, Human
ggacuucuggggacuguagauu

SEQ ID NO: 118807 - RNA, 22 nt, Human
gggcuuguuaacuuggcuucca

SEQ ID NO: 118808 - RNA, 22 nt, Human
ggaaugcagugagcauuagaua

SEQ ID NO: 118809 - RNA, 22 nt, Human
ggaaugcuuggcaugagaaccu

SEQ ID NO: 118810 - RNA, 22 nt, Human
ggaauuaagaggcuggacaggg

SEQ ID NO: 118811 - RNA, 22 nt, Human
ggaugauuuucaguuguguggg

SEQ ID NO: 118812 - RNA, 22 nt, Human
ggaugauacuuggagaaauauu

SEQ ID NO: 118813 - RNA, 22 nt, Human
ggggcuuggguagagcagaaac

SEQ ID NO: 118814 - RNA, 22 nt, Human
ggagcaagagugagcaagcaga

SEQ ID NO: 118815 - RNA, 22 nt, Human
ggaagaagagggagcuguggga

SEQ ID NO: 118816 - RNA, 22 nt, Human
ggaauauaaaucagaugcuccg

SEQ ID NO: 118817 - RNA, 22 nt, Human
ggaauguuuuccagaccuagau

SEQ ID NO: 118818 - RNA, 22 nt, Human
ggacauaccgugccccaaugcg

SEQ ID NO: 118819 - RNA, 22 nt, Human
ggagcucacuacgaaauaagcu

SEQ ID NO: 118820 - RNA, 22 nt, Human
ggagugaagacagagugaacuu

SEQ ID NO: 118821 - RNA, 22 nt, Human
ggauaauugaugauuuauaaga

SEQ ID NO: 118822 - RNA, 22 nt, Human
ggcagaaaacaauaaccauuuc

SEQ ID NO: 118823 - RNA, 22 nt, Human
gcgugcauguguguaugcgugu

SEQ ID NO: 118824 - RNA, 22 nt, Human
gcucgauugucaguguuaggga

SEQ ID NO: 118825 - RNA, 22 nt, Human
gcucaacuucuaggacuucagg

SEQ ID NO: 118826 - RNA, 22 nt, Human
gcuagauugucacuugaguguc

SEQ ID NO: 118827 - RNA, 22 nt, Human
gcugagcagaacaauuagaaau

SEQ ID NO: 118828 - RNA, 22 nt, Human
gcauuuaaauuugaacuucaga

SEQ ID NO: 118829 - RNA, 22 nt, Human
gcuguauaucuuuugaagugau

SEQ ID NO: 118830 - RNA, 22 nt, Human
gcugucauggacaugucuguuu

SEQ ID NO: 118831 - RNA, 22 nt, Human
gcuguuuaaguggaauuuguuu

SEQ ID NO: 118832 - RNA, 22 nt, Human
gcuguggcuccaauggugagcc

SEQ ID NO: 118833 - RNA, 22 nt, Human
gcuuaugauguuuacauaaaag

SEQ ID NO: 118834 - RNA, 22 nt, Human
ggaacuaagcacauuaucugau

SEQ ID NO: 118835 - RNA, 17 nt, Human
ggaagaaaaggaucauc

SEQ ID NO: 118836 - RNA, 22 nt, Human
ggaaagagaaacaugaacuaga

SEQ ID NO: 118837 - RNA, 22 nt, Human
gccucuuugcucuuugguuguu

SEQ ID NO: 118838 - RNA, 22 nt, Human
gcuuguuuagcauaggucacug

SEQ ID NO: 118839 - RNA, 22 nt, Human
gcuuuuuaauuugcuucccugg

SEQ ID NO: 118840 - RNA, 22 nt, Human
gcuuuguucauuuaguuuuuuu

SEQ ID NO: 118841 - RNA, 22 nt, Human
gcuuuguugauggugagucugu

SEQ ID NO: 118842 - RNA, 22 nt, Human
gcuuuuaaauuaucugacaaug

SEQ ID NO: 118843 - RNA, 22 nt, Human
gaugaaguaguccacuggaagg

SEQ ID NO: 118844 - RNA, 22 nt, Human
gcaguagauccagcagccugca

SEQ ID NO: 118845 - RNA, 22 nt, Human
gcaguauuguguguggucaugg

SEQ ID NO: 118846 - RNA, 22 nt, Human
gaguaauuuucuuaaaacauca

SEQ ID NO: 118847 - RNA, 22 nt, Human
gaguauuagaagaguaguuauu

SEQ ID NO: 118848 - RNA, 22 nt, Human
gagucaaugugcagugcagccc

SEQ ID NO: 118849 - RNA, 22 nt, Human
gcauccaaggagcagaagugau

SEQ ID NO: 118850 - RNA, 22 nt, Human
gcauauuuuaaaguguaaccug

SEQ ID NO: 118851 - RNA, 22 nt, Human
gaugaagaaacucaaccaagaa

SEQ ID NO: 118852 - RNA, 22 nt, Human
gaugggaaggugguaaaguuua

SEQ ID NO: 118853 - RNA, 22 nt, Human
gauguuuugaaagaagaauaca

SEQ ID NO: 118854 - RNA, 22 nt, Human
gauuaagaaagauagaugugga

SEQ ID NO: 118855 - RNA, 22 nt, Human
gauuaaaggucuugauuauaag

SEQ ID NO: 118856 - RNA, 22 nt, Human
gauuaucaccaaauggccuccu

SEQ ID NO: 118857 - RNA, 22 nt, Human
gauuuugaaccuuauuuggaaa

SEQ ID NO: 118858 - RNA, 22 nt, Human
gcaauuggaaugaauucuauuu

SEQ ID NO: 118859 - RNA, 22 nt, Human
gcagauaaaauuuuugauggga

SEQ ID NO: 118860 - RNA, 22 nt, Human
gcagcauuaccaagacauggca

SEQ ID NO: 118861 - RNA, 22 nt, Human
gcagggcucagccgcucccacc

SEQ ID NO: 118862 - RNA, 22 nt, Human
gcaguaaauugagagucauguu

SEQ ID NO: 118863 - RNA, 22 nt, Human
gcgguuauggcagagauuacag

SEQ ID NO: 118864 - RNA, 22 nt, Human
gcuagaaacuguuuaaucucuu

SEQ ID NO: 118865 - RNA, 22 nt, Human
gcaucacacgcacauacacaca

SEQ ID NO: 118866 - RNA, 22 nt, Human
gcauggaaaagggaugcuaacu

SEQ ID NO: 118867 - RNA, 18 nt, Human
gcugaaauucuaaacaaa

SEQ ID NO: 118868 - RNA, 22 nt, Human
uuauauuuuauuuaauuaaaua

SEQ ID NO: 118869 - RNA, 22 nt, Human
uuuaaauuucugaaucuugagg

SEQ ID NO: 118870 - RNA, 22 nt, Human
uauuaaaagagaaaaagccacc

SEQ ID NO: 118871 - RNA, 22 nt, Human
guuuucuuguuaauuuugaacg

SEQ ID NO: 118872 - RNA, 22 nt, Human
guccuguguaaguacuugcuca

SEQ ID NO: 118873 - RNA, 22 nt, Human
uguacauacauagauauacaca

SEQ ID NO: 118874 - RNA, 22 nt, Human
uuauuucauguaaaauuuaugu

SEQ ID NO: 118875 - RNA, 19 nt, Human
uagaggagaauggcaaaga

SEQ ID NO: 118876 - RNA, 22 nt, Human
agagauacugcaggccauaaau

SEQ ID NO: 118877 - RNA, 22 nt, Human
uuuuaaaagguugcuguuauaa

SEQ ID NO: 118878 - RNA, 22 nt, Human
auuaaaaaaagauaaugaguua

SEQ ID NO: 118879 - RNA, 22 nt, Human
ucuucaucucuaaaaugggaac

SEQ ID NO: 118880 - RNA, 22 nt, Human
uuuucucaguuuuuuucaaaag

SEQ ID NO: 118881 - RNA, 22 nt, Human
ugcuuggagaaucagucccagc

SEQ ID NO: 118882 - RNA, 22 nt, Human
uacuauuuugacaugaaauuga

SEQ ID NO: 118883 - RNA, 22 nt, Human
cagcuuguucugaccugugauu

SEQ ID NO: 118884 - RNA, 22 nt, Human
aauucuguugguuagaguugga

SEQ ID NO: 118885 - RNA, 22 nt, Human
auuuuucuuucacauuuucuua

SEQ ID NO: 118886 - RNA, 22 nt, Human
ugaaauuuuuuggagauaauuu

SEQ ID NO: 118887 - RNA, 20 nt, Human
uuuuuuaaauagagcuguug

SEQ ID NO: 118888 - RNA, 22 nt, Human
ucaaauaugggccagaggaaau

SEQ ID NO: 118889 - RNA, 21 nt, Human
uuccuggaggcagaaacguga

SEQ ID NO: 118890 - RNA, 22 nt, Human
cuucuuaaaguugucacagcug

SEQ ID NO: 118891 - RNA, 20 nt, Human
uugauucacaaaaagcuuag

SEQ ID NO: 118892 - RNA, 22 nt, Human
guuuuaucuauguaauuauaaa

SEQ ID NO: 118893 - RNA, 22 nt, Human
ucauuauuuugauguauuuccu

SEQ ID NO: 118894 - RNA, 22 nt, Human
aaaauacuaggaaaauaaauca

SEQ ID NO: 118895 - RNA, 23 nt, Human
uugcuuuugccccaaaagaguua

SEQ ID NO: 118896 - RNA, 20 nt, Human
agugauuuguuaguacauug

SEQ ID NO: 118897 - RNA, 22 nt, Human
uuuaaaauguuuuauuuauuua

SEQ ID NO: 118898 - RNA, 22 nt, Human
ugaaaaauauuuuuagaaauaa

SEQ ID NO: 118899 - RNA, 22 nt, Human
ucauuguuucugcuuuucauga

SEQ ID NO: 118900 - RNA, 22 nt, Human
aaauauuugaaugguguaagau

SEQ ID NO: 118901 - RNA, 22 nt, Human
uuaacauuguccuuagcagauu

SEQ ID NO: 118902 - RNA, 22 nt, Human
guuuauuucuuaucaucacuau

SEQ ID NO: 118903 - RNA, 22 nt, Human
uuuucauagccagaaacugaaa

SEQ ID NO: 118904 - RNA, 22 nt, Human
auucuucauguugaagcuguca

SEQ ID NO: 118905 - RNA, 22 nt, Human
uuuauaauuacguaaaauauuu

SEQ ID NO: 118906 - RNA, 22 nt, Human
uauaaagaccuuauccuucaua

SEQ ID NO: 118907 - RNA, 22 nt, Human
uuuuuaaaagaugauuuaauga

SEQ ID NO: 118908 - RNA, 20 nt, Human
cauuccaugcaucuuggucc

SEQ ID NO: 118909 - RNA, 22 nt, Human
ccccauggaaaacccaccuagg

SEQ ID NO: 118910 - RNA, 22 nt, Human
ggagaggaaguuuaaagaauug

SEQ ID NO: 118911 - RNA, 22 nt, Human
uuucuaaaaccagaguuuauaa

SEQ ID NO: 118912 - RNA, 22 nt, Human
ugcagcuuuugguuucuagaug

SEQ ID NO: 118913 - RNA, 22 nt, Human
uguuggaaucuucuagucuucc

SEQ ID NO: 118914 - RNA, 22 nt, Human
uuuauuuuccaugucucuaggu

SEQ ID NO: 118915 - RNA, 22 nt, Human
gcuuauuagguuauuucaagga

SEQ ID NO: 118916 - RNA, 22 nt, Human
uauauuaaagugcuuugcagug

SEQ ID NO: 118917 - RNA, 18 nt, Human
acaaaaauagugcuuugg

SEQ ID NO: 118918 - RNA, 22 nt, Human
ucucucucucuuccagcauguu

SEQ ID NO: 118919 - RNA, 22 nt, Human
aauauuuugggacugaggaauu

SEQ ID NO: 118920 - RNA, 22 nt, Human
uugaaaauuaauagguguacaa

SEQ ID NO: 118921 - RNA, 22 nt, Human
gguagacugagcuccuugagga

SEQ ID NO: 118922 - RNA, 22 nt, Human
uucuucuuuccuauaauuaauu

SEQ ID NO: 118923 - RNA, 22 nt, Human
uugccaggagacaucuggagcc

SEQ ID NO: 118924 - RNA, 22 nt, Human
uuuuccuucuuccugccuugcc

SEQ ID NO: 118925 - RNA, 21 nt, Human
uuucauuaguacaucaauuug

SEQ ID NO: 118926 - RNA, 17 nt, Human
ugucuuuuuccuccucc

SEQ ID NO: 118927 - RNA, 22 nt, Human
uuuuaaaacaugucaaaaugug

SEQ ID NO: 118928 - RNA, 22 nt, Human
auuuucuugucucuguuguagg

SEQ ID NO: 118929 - RNA, 22 nt, Human
aacccugaacuuaguucuagga

SEQ ID NO: 118930 - RNA, 22 nt, Human
uuuacuguuuacagcuaaugca

SEQ ID NO: 118931 - RNA, 22 nt, Human
uguuuuuuagagugauacuuuu

SEQ ID NO: 118932 - RNA, 22 nt, Human
auuuucuucauuuugauuguau

SEQ ID NO: 118933 - RNA, 22 nt, Human
gaagaaggaagaucaugcuuga

SEQ ID NO: 118934 - RNA, 22 nt, Human
uuauuuaagaucuuaauauaua

SEQ ID NO: 118935 - RNA, 22 nt, Human
aacacuaaaggucaguuagaag

SEQ ID NO: 118936 - RNA, 22 nt, Human
ucacucuuuaucuuuuaugucu

SEQ ID NO: 118937 - RNA, 22 nt, Human
uaguuucuucaacugucccagc

SEQ ID NO: 118938 - RNA, 22 nt, Human
uaccuggauaaauguacaaccg

SEQ ID NO: 118939 - RNA, 22 nt, Human
uugugugugcccaccuguggcc

SEQ ID NO: 118940 - RNA, 22 nt, Human
uuuucauuguuaguuucuccuu

SEQ ID NO: 118941 - RNA, 22 nt, Human
uuucagaaauggcacugaaauc

SEQ ID NO: 118942 - RNA, 22 nt, Human
ccuuuuaucgcgaagaacucca

SEQ ID NO: 118943 - RNA, 22 nt, Human
guugagaaucucuagcuuagga

SEQ ID NO: 118944 - RNA, 22 nt, Human
uacuuacacugaagcaaagaua

SEQ ID NO: 118945 - RNA, 22 nt, Human
uccauguauugcuaacaaauag

SEQ ID NO: 118946 - RNA, 22 nt, Human
uguccuuuauauguuuuuuagu

SEQ ID NO: 118947 - RNA, 22 nt, Human
auuuuguugaaacccuuguugu

SEQ ID NO: 118948 - RNA, 22 nt, Human
uauuucaugagugaauaucuag

SEQ ID NO: 118949 - RNA, 22 nt, Human
uauuucuagggcaugaaaauaa

SEQ ID NO: 118950 - RNA, 22 nt, Human
guuguuuucagcccagcauuag

SEQ ID NO: 118951 - RNA, 22 nt, Human
uuaaaagaauccuguuauccuc

SEQ ID NO: 118952 - RNA, 22 nt, Human
uauuuuuacuguuugaugauuc

SEQ ID NO: 118953 - RNA, 22 nt, Human
aggcaguggagcuggaauaggc

SEQ ID NO: 118954 - RNA, 22 nt, Human
ugugugcuaguuuugucaguau

SEQ ID NO: 118955 - RNA, 22 nt, Human
uuuauguuuguuuuugaaauaa

SEQ ID NO: 118956 - RNA, 22 nt, Human
aggcaguguguagcuggaagag

SEQ ID NO: 118957 - RNA, 22 nt, Human
uucacuguucuuagagaagacc

SEQ ID NO: 118958 - RNA, 22 nt, Human
uuuaacauaugaaagaauauuu

SEQ ID NO: 118959 - RNA, 22 nt, Human
uuuuucuuugcuuuccacuggc

SEQ ID NO: 118960 - RNA, 22 nt, Human
ucuucaugaaauugauugcuua

SEQ ID NO: 118961 - RNA, 22 nt, Human
uuuuauuuguauguugaaugua

SEQ ID NO: 118962 - RNA, 22 nt, Human
auagaaauagacaaugcaaaga

SEQ ID NO: 118963 - RNA, 22 nt, Human
cuuucuuucaaguucugcuuua

SEQ ID NO: 118964 - RNA, 17 nt, Human
ucuuuuacuuucucucc

SEQ ID NO: 118965 - RNA, 22 nt, Human
uggucuuuccuucauuguccag

SEQ ID NO: 118966 - RNA, 22 nt, Human
uguauuuuuucccugaaauaaa

SEQ ID NO: 118967 - RNA, 22 nt, Human
ugcuuggauuuccaaaugguuu

SEQ ID NO: 118968 - RNA, 22 nt, Human
uuuuguuuacauuaaauuuuga

SEQ ID NO: 118969 - RNA, 22 nt, Human
uucuaauauuaugauuucuaag

SEQ ID NO: 118970 - RNA, 22 nt, Human
uuguuuuaguagaaguuacaug

SEQ ID NO: 118971 - RNA, 22 nt, Human
acuuuauacuagugauaguuug

SEQ ID NO: 118972 - RNA, 22 nt, Human
uuauuuuauaaagagaagacuu

SEQ ID NO: 118973 - RNA, 22 nt, Human
guuuucuccugcuauacagugc

SEQ ID NO: 118974 - RNA, 22 nt, Human
caaauguuugguggcauuuugu

SEQ ID NO: 118975 - RNA, 22 nt, Human
cagcuccaucuugcuuauacca

SEQ ID NO: 118976 - RNA, 22 nt, Human
aaauuuuguugaaaaauauuuu

SEQ ID NO: 118977 - RNA, 22 nt, Human
gugucccaaagauuagaaauca

SEQ ID NO: 118978 - RNA, 22 nt, Human
aaauguuucauucuauuuuuag

SEQ ID NO: 118979 - RNA, 22 nt, Human
gauuuuaaaagauguauaaggu

SEQ ID NO: 118980 - RNA, 22 nt, Human
uccauuuacuauucucauaucg

SEQ ID NO: 118981 - RNA, 17 nt, Human
auucaugaacauguccu

SEQ ID NO: 118982 - RNA, 22 nt, Human
aaucacuucuuugucuucuuca

SEQ ID NO: 118983 - RNA, 22 nt, Human
gugugucucaguugcuccgaag

SEQ ID NO: 118984 - RNA, 22 nt, Human
aguaaaugaaagcaauuuuaga

SEQ ID NO: 118985 - RNA, 22 nt, Human
gcugucccccaaagaugcuccu

SEQ ID NO: 118986 - RNA, 22 nt, Human
uucacugugauugggguggauu

SEQ ID NO: 118987 - RNA, 22 nt, Human
auguuccaugacuaugcaugaa

SEQ ID NO: 118988 - RNA, 22 nt, Human
ucauuguuuacugucuuuuuuc

SEQ ID NO: 118989 - RNA, 22 nt, Human
auuuccagcagcauauuugucu

SEQ ID NO: 118990 - RNA, 22 nt, Human
uacaaaugaucaucucuuugaa

SEQ ID NO: 118991 - RNA, 22 nt, Human
uaaaugauaguauugaagguag

SEQ ID NO: 118992 - RNA, 22 nt, Human
cuucuuuucuacuggccuagaa

SEQ ID NO: 118993 - RNA, 22 nt, Human
uucacugugauguuuaagagaa

SEQ ID NO: 118994 - RNA, 22 nt, Human
ggcuguggcagcuggaaguggu

SEQ ID NO: 118995 - RNA, 22 nt, Human
cauuucaaacaguuacagcugc

SEQ ID NO: 118996 - RNA, 22 nt, Human
uagcacauaguaggcacaggcu

SEQ ID NO: 118997 - RNA, 22 nt, Human
ugcuuucagauaucuguuucaa

SEQ ID NO: 118998 - RNA, 22 nt, Human
uucaaaaugcagaauaguuugg

SEQ ID NO: 118999 - RNA, 16 nt, Human
gaauuccauugcucug

SEQ ID NO: 119000 - RNA, 22 nt, Human
aaauguauuagccuaugugaga

SEQ ID NO: 119001 - RNA, 22 nt, Human
aauguugaaccuuuuuggccug

SEQ ID NO: 119002 - RNA, 22 nt, Human
uuauuucaggcauuuguaaaug

SEQ ID NO: 119003 - RNA, 22 nt, Human
uuuuuuccuguuugucuuuggg

SEQ ID NO: 119004 - RNA, 22 nt, Human
ucauacuuuuuugacccuugug

SEQ ID NO: 119005 - RNA, 19 nt, Human
augaaauagcauuuucuga

SEQ ID NO: 119006 - RNA, 22 nt, Human
aggcauauaguguuuaaaaaaa

SEQ ID NO: 119007 - RNA, 22 nt, Human
agagcuccaggguuuuguagug

SEQ ID NO: 119008 - RNA, 22 nt, Human
aaugauuuucugcaaacaguga

SEQ ID NO: 119009 - RNA, 21 nt, Human
uccccugugccuggcauacag

SEQ ID NO: 119010 - RNA, 22 nt, Human
guuuccaggcuuugguaugguu

SEQ ID NO: 119011 - RNA, 22 nt, Human
aucguuaugauagagaaagaga

SEQ ID NO: 119012 - RNA, 22 nt, Human
uauauacacgcacauauacaua

SEQ ID NO: 119013 - RNA, 22 nt, Human
uugccaggggacaucuggagcc

SEQ ID NO: 119014 - RNA, 22 nt, Human
uuuguuugcugagugaauucaa

SEQ ID NO: 119015 - RNA, 20 nt, Human
acuagaaagucacugggggg

SEQ ID NO: 119016 - RNA, 22 nt, Human
aaugaaaaucugucaguucaag

SEQ ID NO: 119017 - RNA, 22 nt, Human
auauauguauauaugugugugu

SEQ ID NO: 119018 - RNA, 19 nt, Human
caggucuucuuggaggacu

SEQ ID NO: 119019 - RNA, 19 nt, Human
agugaacuccauaucaggu

SEQ ID NO: 119020 - RNA, 22 nt, Human
uuauuuuuguuuguuaagccua

SEQ ID NO: 119021 - RNA, 22 nt, Human
uauuuuauuuagguuuaguugu

SEQ ID NO: 119022 - RNA, 22 nt, Human
uauuuguauugucuuaucacuu

SEQ ID NO: 119023 - RNA, 22 nt, Human
uuauuuuuaggaauguagaggu

SEQ ID NO: 119024 - RNA, 22 nt, Human
uuuaaucaguugguaauauuga

SEQ ID NO: 119025 - RNA, 22 nt, Human
cuccaugagccaggagggcuac

SEQ ID NO: 119026 - RNA, 22 nt, Human
uaauauaacugccaguuaaggu

SEQ ID NO: 119027 - RNA, 22 nt, Human
ggcagucuuucccuugagcucu

SEQ ID NO: 119028 - RNA, 22 nt, Human
uuuucacugacuuggucuggaa

SEQ ID NO: 119029 - RNA, 22 nt, Human
uuuuucuccucucucuuucauu

SEQ ID NO: 119030 - RNA, 22 nt, Human
uuuuccuuccugucucuuuauu

SEQ ID NO: 119031 - RNA, 22 nt, Human
uggagucuugcuuugggagugc

SEQ ID NO: 119032 - RNA, 22 nt, Human
gcuuucacugcaauagaugaau

SEQ ID NO: 119033 - RNA, 22 nt, Human
gcauaauauugagaaauuauua

SEQ ID NO: 119034 - RNA, 22 nt, Human
ucuucaaauacagucauauuga

SEQ ID NO: 119035 - RNA, 22 nt, Human
aaugaauaaauuuuaaagacag

SEQ ID NO: 119036 - RNA, 23 nt, Human
uuucugaguuuuuuaaaagucca

SEQ ID NO: 119037 - RNA, 23 nt, Human
cuuauauaaucauuagaaaccau

SEQ ID NO: 119038 - RNA, 22 nt, Human
uucacuuuuucucugcuugaga

SEQ ID NO: 119039 - RNA, 22 nt, Human
uccuuucaaauuuauuugacau

SEQ ID NO: 119040 - RNA, 22 nt, Human
ugcauucugaacguaaauguga

SEQ ID NO: 119041 - RNA, 22 nt, Human
uuaucuuuuaaaaacacuugug

SEQ ID NO: 119042 - RNA, 22 nt, Human
uuucuggacuaaagggagagau

SEQ ID NO: 119043 - RNA, 22 nt, Human
auucuuuauuuucuguacuugc

SEQ ID NO: 119044 - RNA, 22 nt, Human
cuuuuuuucuccauauuucugg

SEQ ID NO: 119045 - RNA, 22 nt, Human
gcuguggagaagcugccuaugg

SEQ ID NO: 119046 - RNA, 22 nt, Human
auuuuugguuucaccugcacgc

SEQ ID NO: 119047 - RNA, 22 nt, Human
uuuguuuccagccuuuugucuu

SEQ ID NO: 119048 - RNA, 22 nt, Human
uccaugaguuuuuuaguuucac

SEQ ID NO: 119049 - RNA, 23 nt, Human
cagagaaaauagaauaugcugug

SEQ ID NO: 119050 - RNA, 22 nt, Human
auuucacucuuaauugcuuccu

SEQ ID NO: 119051 - RNA, 22 nt, Human
augaaaacggaccagagcuauu

SEQ ID NO: 119052 - RNA, 22 nt, Human
caaaaaauccauagaaagaggu

SEQ ID NO: 119053 - RNA, 22 nt, Human
aacugcauaagcuucgggaccu

SEQ ID NO: 119054 - RNA, 22 nt, Human
cuaaauucuauauccuugcuuc

SEQ ID NO: 119055 - RNA, 22 nt, Human
gcuggaaauaacuuguguagaa

SEQ ID NO: 119056 - RNA, 22 nt, Human
ccuaggcuggcugucuucaggu

SEQ ID NO: 119057 - RNA, 22 nt, Human
uauuuuaaaagcauuaauucuu

SEQ ID NO: 119058 - RNA, 22 nt, Human
ucuuuuaucuguuguguaacaa

SEQ ID NO: 119059 - RNA, 22 nt, Human
guuuaaaagcaaccaacaggcu

SEQ ID NO: 119060 - RNA, 22 nt, Human
uuuuuaaaauuaggacggcacg

SEQ ID NO: 119061 - RNA, 22 nt, Human
uauuuucucugccacacuucca

SEQ ID NO: 119062 - RNA, 22 nt, Human
uugucuuucguauggaacacua

SEQ ID NO: 119063 - RNA, 22 nt, Human
uuguuauuauuauuuucguucu

SEQ ID NO: 119064 - RNA, 22 nt, Human
ccauuucacaucccugacaugu

SEQ ID NO: 119065 - RNA, 22 nt, Human
auguaugagagauucuuuuauu

SEQ ID NO: 119066 - RNA, 22 nt, Human
uuuuauaauacccuugacuaau

SEQ ID NO: 119067 - RNA, 22 nt, Human
auauaguacauguauauauaua

SEQ ID NO: 119068 - RNA, 22 nt, Human
aaugcuuuuugcgaaaugugca

SEQ ID NO: 119069 - RNA, 20 nt, Human
cuuauuuuggagaacuuuuc

SEQ ID NO: 119070 - RNA, 22 nt, Human
uuuucucuuugcuucucuaaaa

SEQ ID NO: 119071 - RNA, 22 nt, Human
uaauaaaaauuuaauucacauu

SEQ ID NO: 119072 - RNA, 22 nt, Human
auuaauaucaauauauuauaug

SEQ ID NO: 119073 - RNA, 22 nt, Human
augcaaaaucuuauuuuuucua

SEQ ID NO: 119074 - RNA, 22 nt, Human
uuauuuucgugugugugugugu

SEQ ID NO: 119075 - RNA, 22 nt, Human
gcuucucacccuuacuaucucu

SEQ ID NO: 119076 - RNA, 22 nt, Human
auuuucauauggguuauuugua

SEQ ID NO: 119077 - RNA, 22 nt, Human
auuuaaaaacugguacaacagg

SEQ ID NO: 119078 - RNA, 22 nt, Human
acuuuuccuggguagcuccugg

SEQ ID NO: 119079 - RNA, 22 nt, Human
auacauauaugcacauuaauau

SEQ ID NO: 119080 - RNA, 22 nt, Human
auacaucuuaacgcgcucuugg

SEQ ID NO: 119081 - RNA, 22 nt, Human
aggaaauaggaccagacaaagc

SEQ ID NO: 119082 - RNA, 22 nt, Human
gugugugucuacuuucaucucu

SEQ ID NO: 119083 - RNA, 22 nt, Human
uuacuuuuuucccccuuagaug

SEQ ID NO: 119084 - RNA, 22 nt, Human
aggcaguguggagggcuguugc

SEQ ID NO: 119085 - RNA, 22 nt, Human
aucuucuuucaucagccccuca

SEQ ID NO: 119086 - RNA, 22 nt, Human
ucuucacagaugcauauacuuc

SEQ ID NO: 119087 - RNA, 22 nt, Human
cuggagaacucugugcuucacu

SEQ ID NO: 119088 - RNA, 22 nt, Human
uucuuuucuucccuguuuauua

SEQ ID NO: 119089 - RNA, 22 nt, Human
uguuuuuauucuuaauguuuca

SEQ ID NO: 119090 - RNA, 22 nt, Human
auuuuuauuugccuaugauaua

SEQ ID NO: 119091 - RNA, 22 nt, Human
uauaagaaaagucauuaucaaa

SEQ ID NO: 119092 - RNA, 22 nt, Human
gaauuccaggugagagaaggua

SEQ ID NO: 119093 - RNA, 22 nt, Human
auucuuuucucuaaaugaugaa

SEQ ID NO: 119094 - RNA, 22 nt, Human
aacgagcugggggggccggggg

SEQ ID NO: 119095 - RNA, 22 nt, Human
uucuuuuaauuucugucugcag

SEQ ID NO: 119096 - RNA, 22 nt, Human
uuuaaaacagcauuuaaaaggu

SEQ ID NO: 119097 - RNA, 22 nt, Human
gucuuuguaguuuuaauuugag

SEQ ID NO: 119098 - RNA, 22 nt, Human
acucauuuggauuuuggaguuu

SEQ ID NO: 119099 - RNA, 23 nt, Human
uucuuuccuuaucccauuuacuu

SEQ ID NO: 119100 - RNA, 22 nt, Human
guuguuuuuguuaaaacaguga

SEQ ID NO: 119101 - RNA, 22 nt, Human
uauuuaaagucagcaacuuuuc

SEQ ID NO: 119102 - RNA, 22 nt, Human
aaaacauuuaggguuuuuuuua

SEQ ID NO: 119103 - RNA, 19 nt, Human
ccaguuuuuuaauauucaa

SEQ ID NO: 119104 - RNA, 22 nt, Human
ugagguauuuggauuuauauuu

SEQ ID NO: 119105 - RNA, 22 nt, Human
aauguaaauaauuguaaaauuu

SEQ ID NO: 119106 - RNA, 22 nt, Human
acugucuuguuguaugugagcu

SEQ ID NO: 119107 - RNA, 18 nt, Human
auucauuugcguuuggcu

SEQ ID NO: 119108 - RNA, 22 nt, Human
aguuauuuuucacuauuaggcu

SEQ ID NO: 119109 - RNA, 22 nt, Human
cuucuuuuggggaugaaaaugg

SEQ ID NO: 119110 - RNA, 22 nt, Human
uuaucaaaaaauaguacuuuga

SEQ ID NO: 119111 - RNA, 22 nt, Human
aaucauaacaaaagcaauuaua

SEQ ID NO: 119112 - RNA, 22 nt, Human
cuauguuucagauauauauaua

SEQ ID NO: 119113 - RNA, 22 nt, Human
uucauuagcacauuuccuuggu

SEQ ID NO: 119114 - RNA, 22 nt, Human
auauucaaugaggucauauaag

SEQ ID NO: 119115 - RNA, 22 nt, Human
uuaaacauuuccacuugccagu

SEQ ID NO: 119116 - RNA, 22 nt, Human
uggaguuuuaaucuguacagaa

SEQ ID NO: 119117 - RNA, 22 nt, Human
auuuuauuuugggaucuuuuua

SEQ ID NO: 119118 - RNA, 22 nt, Human
guucuucagauuccauuucagu

SEQ ID NO: 119119 - RNA, 22 nt, Human
ggcagaggagcuggaaacaugg

SEQ ID NO: 119120 - RNA, 22 nt, Human
uaaaaucaugacagauugacau

SEQ ID NO: 119121 - RNA, 22 nt, Human
auuuuuuuuccugucucuuuca

SEQ ID NO: 119122 - RNA, 22 nt, Human
auaaaaauguuuuuguguggua

SEQ ID NO: 119123 - RNA, 22 nt, Human
uggaaaauuuagaaagauuuau

SEQ ID NO: 119124 - RNA, 22 nt, Human
auauuuuugcagaauuuuucgu

SEQ ID NO: 119125 - RNA, 22 nt, Human
uucuuuuaauagagauccugug

SEQ ID NO: 119126 - RNA, 20 nt, Human
ugauuauuccaacaagaaug

SEQ ID NO: 119127 - RNA, 22 nt, Human
ugcuuucaaugaauuguauacu

SEQ ID NO: 119128 - RNA, 22 nt, Human
aaauauagugacacuuauaguc

SEQ ID NO: 119129 - RNA, 22 nt, Human
agcaaaauuccaaaaugcuaau

SEQ ID NO: 119130 - RNA, 22 nt, Human
guuaaaaugauuugugauuuau

SEQ ID NO: 119131 - RNA, 22 nt, Human
uuuccuaggaaaugauugaagu

SEQ ID NO: 119132 - RNA, 22 nt, Human
uuuucaauuuucauuugcaaga

SEQ ID NO: 119133 - RNA, 22 nt, Human
uuuugcuucuaguauauuuuuu

SEQ ID NO: 119134 - RNA, 22 nt, Human
aucacuagaguuacauugccag

SEQ ID NO: 119135 - RNA, 20 nt, Human
gaacauaaauaacucuuuac

SEQ ID NO: 119136 - RNA, 22 nt, Human
ugcuuucaaaacucagaggaau

SEQ ID NO: 119137 - RNA, 22 nt, Human
uaaaacuaugcaaccuacuacc

SEQ ID NO: 119138 - RNA, 22 nt, Human
uauuguuuuaagguguauuaau

SEQ ID NO: 119139 - RNA, 22 nt, Human
uuguuauaggaucagugucacu

SEQ ID NO: 119140 - RNA, 22 nt, Human
uuucacugaguaggagagcacu

SEQ ID NO: 119141 - RNA, 22 nt, Human
agucugugguccucuguaucuc

SEQ ID NO: 119142 - RNA, 22 nt, Human
accuccauggcccacaucuagu

SEQ ID NO: 119143 - RNA, 22 nt, Human
uucacccuucucuggcuuucag

SEQ ID NO: 119144 - RNA, 22 nt, Human
aaaauauucuauaucaaagaua

SEQ ID NO: 119145 - RNA, 22 nt, Human
uuagaaauguccuacuaauaug

SEQ ID NO: 119146 - RNA, 22 nt, Human
aagugugugugcgcaugugcau

SEQ ID NO: 119147 - RNA, 22 nt, Human
uuauuuaaguauuuauugaagu

SEQ ID NO: 119148 - RNA, 20 nt, Human
aauaaauauaacccauaauu

SEQ ID NO: 119149 - RNA, 22 nt, Human
uucucuugccuucucuuuuauc

SEQ ID NO: 119150 - RNA, 22 nt, Human
uuauuugcccauguuuagcaga

SEQ ID NO: 119151 - RNA, 22 nt, Human
uuauaucagaaggugagauuga

SEQ ID NO: 119152 - RNA, 22 nt, Human
uguuuucuuuccccuucuuuuc

SEQ ID NO: 119153 - RNA, 22 nt, Human
auauguuaugccauuuucaagg

SEQ ID NO: 119154 - RNA, 22 nt, Human
guuauuguuauugcguugucga

SEQ ID NO: 119155 - RNA, 22 nt, Human
uggggagacauggaguaaaaga

SEQ ID NO: 119156 - RNA, 23 nt, Human
uggaaguugagagucugcuuugu

SEQ ID NO: 119157 - RNA, 22 nt, Human
cuccccuuauuccucaacauga

SEQ ID NO: 119158 - RNA, 22 nt, Human
aagugaggagaccucuucuuca

SEQ ID NO: 119159 - RNA, 22 nt, Human
uuauuguuuggguauaauuuga

SEQ ID NO: 119160 - RNA, 22 nt, Human
uuuuacaaugcaaauucuugcu

SEQ ID NO: 119161 - RNA, 22 nt, Human
aaaugcuuuaauugaguucaug

SEQ ID NO: 119162 - RNA, 22 nt, Human
gaauauuuaucucagcugcaga

SEQ ID NO: 119163 - RNA, 22 nt, Human
uauuuuagccaacagaaugaug

SEQ ID NO: 119164 - RNA, 17 nt, Human
ccacuagauagguugug

SEQ ID NO: 119165 - RNA, 22 nt, Human
cagaccuggaaaacaggcuugc

SEQ ID NO: 119166 - RNA, 22 nt, Human
cuuuaaaaauguauuuuugugg

SEQ ID NO: 119167 - RNA, 22 nt, Human
ucuuuuucccugguuccuuuuu

SEQ ID NO: 119168 - RNA, 22 nt, Human
uuauuuuuguaacacuguauag

SEQ ID NO: 119169 - RNA, 22 nt, Human
uucaaacaguguagaauauaug

SEQ ID NO: 119170 - RNA, 22 nt, Human
aaggcuguuugagcacuggagc

SEQ ID NO: 119171 - RNA, 22 nt, Human
uauuuuuaccuaauuuaugaga

SEQ ID NO: 119172 - RNA, 22 nt, Human
uucuucuucuuccucauccuca

SEQ ID NO: 119173 - RNA, 22 nt, Human
uuuuaaauaaacuacacugauu

SEQ ID NO: 119174 - RNA, 22 nt, Human
augaaaacgugugugugugugu

SEQ ID NO: 119175 - RNA, 22 nt, Human
aaauuaaaguuuuauuuagagc

SEQ ID NO: 119176 - RNA, 22 nt, Human
uuauuuaaaauguagguuggga

SEQ ID NO: 119177 - RNA, 22 nt, Human
auagagcuggggaagaagcugg

SEQ ID NO: 119178 - RNA, 22 nt, Human
cugcaucacagcaggaggcaca

SEQ ID NO: 119179 - RNA, 22 nt, Human
ucugaggacagugcugugccug

SEQ ID NO: 119180 - RNA, 22 nt, Human
uacuuuaauugcaaaaauaaau

SEQ ID NO: 119181 - RNA, 22 nt, Human
auuguuuugugaaacauaguga

SEQ ID NO: 119182 - RNA, 22 nt, Human
uaguauuuguaauuaucaaagc

SEQ ID NO: 119183 - RNA, 22 nt, Human
uucauaugaauuggguuuuuuu

SEQ ID NO: 119184 - RNA, 22 nt, Human
cauaggcucuucagagaacuga

SEQ ID NO: 119185 - RNA, 22 nt, Human
uuuuagaagcauuuaugagauu

SEQ ID NO: 119186 - RNA, 22 nt, Human
gaaacauuuguugaguacuugc

SEQ ID NO: 119187 - RNA, 22 nt, Human
aauaucuugaguuauaaauuca

SEQ ID NO: 119188 - RNA, 22 nt, Human
agcacagugccugacauauaug

SEQ ID NO: 119189 - RNA, 22 nt, Human
uucauagaagggaguuuuuccu

SEQ ID NO: 119190 - RNA, 22 nt, Human
guuauuuugucuuguucaugaa

SEQ ID NO: 119191 - RNA, 22 nt, Human
aaaauaauauuauaccacugcu

SEQ ID NO: 119192 - RNA, 22 nt, Human
guucuucagcccucagguccua

SEQ ID NO: 119193 - RNA, 21 nt, Human
auauuguugggguuuucuuuu

SEQ ID NO: 119194 - RNA, 22 nt, Human
aaauucuuccaggaggaaauac

SEQ ID NO: 119195 - RNA, 20 nt, Human
ucucuuuuucuucuuuucuc

SEQ ID NO: 119196 - RNA, 22 nt, Human
uuuuaaauggcuuuuacuuuuc

SEQ ID NO: 119197 - RNA, 22 nt, Human
uuguuuucuaguguuuugaaua

SEQ ID NO: 119198 - RNA, 22 nt, Human
ugagauguaauguaguacuuug

SEQ ID NO: 119199 - RNA, 22 nt, Human
cuagcacagugcuuggcacaca

SEQ ID NO: 119200 - RNA, 22 nt, Human
aaauguaaacuguauuuauaaa

SEQ ID NO: 119201 - RNA, 22 nt, Human
uuuacaaggcaguuauuuuccu

SEQ ID NO: 119202 - RNA, 22 nt, Human
uagcugucauuggaucagaagg

SEQ ID NO: 119203 - RNA, 17 nt, Human
auuguuuuuaauuugca

SEQ ID NO: 119204 - RNA, 22 nt, Human
cagcuccagcccaggcagcucc

SEQ ID NO: 119205 - RNA, 22 nt, Human
gcacaaaagguacuucauguag

SEQ ID NO: 119206 - RNA, 22 nt, Human
acauuuuaaaaacaguaccugg

SEQ ID NO: 119207 - RNA, 22 nt, Human
ccagucuuggugucuguagcac

SEQ ID NO: 119208 - RNA, 22 nt, Human
acauauaugugcauacaacuau

SEQ ID NO: 119209 - RNA, 22 nt, Human
uaauuccacacucccgcaagcg

SEQ ID NO: 119210 - RNA, 22 nt, Human
aauuauguugaaauaugagaac

SEQ ID NO: 119211 - RNA, 22 nt, Human
uagacugugagcuccuugaggg

SEQ ID NO: 119212 - RNA, 22 nt, Human
gagaaaaauuucuuugcugcac

SEQ ID NO: 119213 - RNA, 22 nt, Human
augaagguggacagauuuuuuu

SEQ ID NO: 119214 - RNA, 22 nt, Human
aucuaaaacuacgaauacuacc

SEQ ID NO: 119215 - RNA, 22 nt, Human
auaaaucaagggcaguauuucc

SEQ ID NO: 119216 - RNA, 22 nt, Human
guaaauaucucacgaaugauuc

SEQ ID NO: 119217 - RNA, 22 nt, Human
aagaggcuacagcccugugucu

SEQ ID NO: 119218 - RNA, 22 nt, Human
uuucauguuggauacuguuuca

SEQ ID NO: 119219 - RNA, 22 nt, Human
cuucuucaucuuuuggaggaac

SEQ ID NO: 119220 - RNA, 21 nt, Human
cuauaaaaaugguucuuugcg

SEQ ID NO: 119221 - RNA, 22 nt, Human
auauuuuacagcucucguugaa

SEQ ID NO: 119222 - RNA, 22 nt, Human
ucgagcucagcagggaggugcg

SEQ ID NO: 119223 - RNA, 22 nt, Human
uauauaauacacaaauauguac

SEQ ID NO: 119224 - RNA, 22 nt, Human
gcuucuguuaggauguggcuua

SEQ ID NO: 119225 - RNA, 22 nt, Human
auuuuacuaugauaguugagaa

SEQ ID NO: 119226 - RNA, 22 nt, Human
aaauguuugguggauaaaagga

SEQ ID NO: 119227 - RNA, 22 nt, Human
ggcagagguagcuggaaccagg

SEQ ID NO: 119228 - RNA, 22 nt, Human
auuuuagagaaacaaacguagg

SEQ ID NO: 119229 - RNA, 22 nt, Human
uuuuaaaguaauugaagcuugu

SEQ ID NO: 119230 - RNA, 22 nt, Human
guccccugcguguucauccugg

SEQ ID NO: 119231 - RNA, 22 nt, Human
aaaucauagccaugaacauuug

SEQ ID NO: 119232 - RNA, 22 nt, Human
uauuuuuuuaacauuuauugua

SEQ ID NO: 119233 - RNA, 23 nt, Human
uuuuccaaaucgacucucuaguu

SEQ ID NO: 119234 - RNA, 22 nt, Human
aguuuccacuggagacacugug

SEQ ID NO: 119235 - RNA, 22 nt, Human
ugucuuuuaaaaauguguaaaa

SEQ ID NO: 119236 - RNA, 22 nt, Listeria monocytogenes EGD-e
cugguauugguagucaauucgu

SEQ ID NO: 119237 - RNA, 22 nt, Listeria monocytogenes EGD-e
uucgcuuaugaaaugauagaca

SEQ ID NO: 119238 - RNA, 22 nt, Listeria monocytogenes EGD-e
uuguuucagaguuaccaugguc

SEQ ID NO: 119239 - RNA, 22 nt, Listeria monocytogenes EGD-e
gcggaauuuuugguggaaguga

SEQ ID NO: 119240 - RNA, 19 nt, Listeria monocytogenes EGD-e
gcuauucgaggaggugaug

SEQ ID NO: 119241 - RNA, 22 nt, Listeria monocytogenes EGD-e
auuucuugaacggcauuuguau

SEQ ID NO: 119242 - RNA, 19 nt, Listeria monocytogenes EGD-e
cuaacggagguguuucuau

SEQ ID NO: 119243 - RNA, 22 nt, Listeria monocytogenes EGD-e
uucgauuacgcaugauuuggau

SEQ ID NO: 119244 - RNA, 22 nt, Listeria monocytogenes EGD-e
gguagcuguuucacucguuugg

SEQ ID NO: 119245 - RNA, 22 nt, Listeria monocytogenes EGD-e
cuggaauuuuugaugugguuaa

SEQ ID NO: 119246 - RNA, 22 nt, Listeria monocytogenes EGD-e
auacauuguagcuaaggcgacu

SEQ ID NO: 119247 - RNA, 22 nt, Listeria monocytogenes EGD-e
uuacaagucuuuuucuauuaau

SEQ ID NO: 119248 - RNA, 22 nt, Listeria monocytogenes EGD-e
gcauauggagguauuggauuug

SEQ ID NO: 119249 - RNA, 22 nt, Listeria monocytogenes EGD-e
acaugccaguuacggcagaagu

SEQ ID NO: 119250 - RNA, 22 nt, Listeria monocytogenes EGD-e
ugugcgaaaaauaaauuggcgg

SEQ ID NO: 119251 - RNA, 22 nt, Listeria monocytogenes EGD-e
guuucauuuggucgucgcuuag

SEQ ID NO: 119252 - RNA, 22 nt, Listeria monocytogenes EGD-e
acaaaugacuauccaguuauua

SEQ ID NO: 119253 - RNA, 22 nt, Listeria monocytogenes EGD-e
uagugcuugguauugcuuugau

SEQ ID NO: 119254 - RNA, 22 nt, Listeria monocytogenes EGD-e
uagugacagaagcuggauuugg

SEQ ID NO: 119255 - RNA, 22 nt, Listeria monocytogenes EGD-e
auguaacagagcgccaguugug

SEQ ID NO: 119256 - RNA, 22 nt, Listeria monocytogenes EGD-e
uguagcuuuuagaaguauuagc

SEQ ID NO: 119257 - RNA, 21 nt, Listeria monocytogenes EGD-e
uuagaagugaagcgucugacu

SEQ ID NO: 119258 - RNA, 22 nt, Listeria monocytogenes EGD-e
aagcuauucucaagugcggcga

SEQ ID NO: 119259 - RNA, 22 nt, Listeria monocytogenes EGD-e
auucauugcccaugauuuauca

SEQ ID NO: 119260 - RNA, 22 nt, Listeria monocytogenes EGD-e
cgagcuuguguacgggaaagca

SEQ ID NO: 119261 - RNA, 20 nt, Listeria monocytogenes EGD-e
agaaaucaaaaagcacuugc

SEQ ID NO: 119262 - RNA, 22 nt, Listeria monocytogenes EGD-e
uaagacaagggaaugucacguu

SEQ ID NO: 119263 - RNA, 22 nt, Listeria monocytogenes EGD-e
accgcaguuauaguaucugcac

SEQ ID NO: 119264 - RNA, 22 nt, Listeria monocytogenes EGD-e
cauuauguuuggcgugaaagaa

SEQ ID NO: 119265 - RNA, 22 nt, Listeria monocytogenes EGD-e
ugaacgcaaaaauuaguugcgu

SEQ ID NO: 119266 - RNA, 22 nt, Listeria monocytogenes EGD-e
ggacuauuaaucacuucaucaa

SEQ ID NO: 119267 - RNA, 22 nt, Listeria monocytogenes EGD-e
uugaagcgguaaacgagucuga

SEQ ID NO: 119268 - RNA, 22 nt, Listeria monocytogenes EGD-e
guauacauuaguagcaaauuua

SEQ ID NO: 119269 - RNA, 22 nt, Listeria monocytogenes EGD-e
ugaaccugcuuguaguugauua

SEQ ID NO: 119270 - RNA, 22 nt, Listeria monocytogenes EGD-e
aagcgcacgagauguagaagca

SEQ ID NO: 119271 - RNA, 22 nt, Listeria monocytogenes EGD-e
uuacaggaauuagaauccagaa

SEQ ID NO: 119272 - RNA, 18 nt, Listeria monocytogenes EGD-e
guggaacacggcauuuau

SEQ ID NO: 119273 - RNA, 22 nt, Listeria monocytogenes EGD-e
gacaaguacagcacuucgacua

SEQ ID NO: 119274 - RNA, 18 nt, Listeria monocytogenes EGD-e
ggcaacuuuccuuguuua

SEQ ID NO: 119275 - RNA, 21 nt, Listeria monocytogenes EGD-e
uugaaguuccuugcggcgguu

SEQ ID NO: 119276 - RNA, 22 nt, Listeria monocytogenes EGD-e
ugauuacuauagcuuuacagaa

SEQ ID NO: 119277 - RNA, 22 nt, Listeria monocytogenes EGD-e
uacaacuggcuuucgguauaua

SEQ ID NO: 119278 - RNA, 22 nt, Listeria monocytogenes EGD-e
cuaguagcuuauucucuaaagu

SEQ ID NO: 119279 - RNA, 22 nt, Listeria monocytogenes EGD-e
cgugaaaguaggauuuucaagu

SEQ ID NO: 119280 - RNA, 22 nt, Listeria monocytogenes EGD-e
caggaacuucgagugcaauucc

SEQ ID NO: 119281 - RNA, 22 nt, Listeria monocytogenes EGD-e
aucaucuggauuaacaagcacu

SEQ ID NO: 119282 - RNA, 22 nt, Listeria monocytogenes EGD-e
agauuugaagggcaugagcauu

SEQ ID NO: 119283 - RNA, 22 nt, Listeria monocytogenes EGD-e
uagccguuugagagagccuuca

SEQ ID NO: 119284 - RNA, 22 nt, Listeria monocytogenes EGD-e
cagucgauaugggugaugaaug

SEQ ID NO: 119285 - RNA, 22 nt, Listeria monocytogenes EGD-e
agcauauugacgcuaucguuug

SEQ ID NO: 119286 - RNA, 22 nt, Listeria monocytogenes EGD-e
uucaauagcaauuuuacggcuu

SEQ ID NO: 119287 - RNA, 22 nt, Listeria monocytogenes EGD-e
uagaaguagcucuugaaaagau

SEQ ID NO: 119288 - RNA, 22 nt, Listeria monocytogenes EGD-e
aaguaagcguggcguuuuuuag

SEQ ID NO: 119289 - RNA, 20 nt, Listeria monocytogenes EGD-e
acuaguuaugauuuuggagu

SEQ ID NO: 119290 - RNA, 23 nt, Listeria monocytogenes EGD-e
uaaauggcuguuuuuucacgccu

SEQ ID NO: 119291 - RNA, 21 nt, Listeria monocytogenes EGD-e
ucgguauuugauuguugcgcu

SEQ ID NO: 119292 - RNA, 22 nt, Listeria monocytogenes EGD-e
ccugaaauuguugacuuggcaa

SEQ ID NO: 119293 - RNA, 22 nt, Listeria monocytogenes EGD-e
uugagagcaucccauccauccu

SEQ ID NO: 119294 - RNA, 22 nt, Listeria monocytogenes EGD-e
aaggaacugauuucacucgcaa

SEQ ID NO: 119295 - RNA, 22 nt, Listeria monocytogenes EGD-e
guagaacagaaugcaaguaaaa

SEQ ID NO: 119296 - RNA, 20 nt, Listeria monocytogenes EGD-e
agcugcugccgauuuuguug

SEQ ID NO: 119297 - RNA, 22 nt, Listeria monocytogenes EGD-e
uaguucuuaugccaauguaucu

SEQ ID NO: 119298 - RNA, 22 nt, Listeria monocytogenes EGD-e
cuuguauaagaaaacaaaucau

SEQ ID NO: 119299 - RNA, 22 nt, Listeria monocytogenes EGD-e
ugugcauuccuugugaaauguu

SEQ ID NO: 119300 - RNA, 22 nt, Listeria monocytogenes EGD-e
uuugaugaagcaagugcucguu

SEQ ID NO: 119301 - RNA, 22 nt, Listeria monocytogenes EGD-e
augcauuaagucaaacaaauau

SEQ ID NO: 119302 - RNA, 22 nt, Listeria monocytogenes EGD-e
aacuagaacggauuuuagcaau

SEQ ID NO: 119303 - RNA, 22 nt, Listeria monocytogenes EGD-e
uggcagauuuucaccguguaaa

SEQ ID NO: 119304 - RNA, 22 nt, Listeria monocytogenes EGD-e
uuaucggaaauacuuauuuaaa

SEQ ID NO: 119305 - RNA, 20 nt, Listeria monocytogenes EGD-e
uucaauggcauuacguaaug

SEQ ID NO: 119306 - RNA, 22 nt, Listeria monocytogenes EGD-e
uucgccuaaguguuauaauuua

SEQ ID NO: 119307 - RNA, 18 nt, Listeria monocytogenes EGD-e
ugggauagauacuucggu

SEQ ID NO: 119308 - RNA, 22 nt, Listeria monocytogenes EGD-e
uaguaacaguucuaucuugaug

SEQ ID NO: 119309 - RNA, 20 nt, Listeria monocytogenes EGD-e
gcgacaagauuuaucuaacg

SEQ ID NO: 119310 - RNA, 22 nt, Listeria monocytogenes EGD-e
cuauuacagaaaaaguaauucc

SEQ ID NO: 119311 - RNA, 21 nt, Listeria monocytogenes EGD-e
ucugauacaucuuguauuucu

SEQ ID NO: 119312 - RNA, 22 nt, Listeria monocytogenes EGD-e
auauucgccguaucaaagaaau

SEQ ID NO: 119313 - RNA, 22 nt, Listeria monocytogenes EGD-e
ccaagauucccuugcaacaagu

SEQ ID NO: 119314 - RNA, 22 nt, Listeria monocytogenes EGD-e
auugaagcaggaacauuuauga

SEQ ID NO: 119315 - RNA, 22 nt, Listeria monocytogenes EGD-e
uugaucgacgccguuugagcgu

SEQ ID NO: 119316 - RNA, 22 nt, Listeria monocytogenes EGD-e
uguuagaagaaaaauucgguga

SEQ ID NO: 119317 - RNA, 22 nt, Listeria monocytogenes EGD-e
cacuuauccaagcagaagaugg

SEQ ID NO: 119318 - RNA, 22 nt, Listeria monocytogenes EGD-e
cgugaugagucuauguuguuug

SEQ ID NO: 119319 - RNA, 22 nt, Listeria monocytogenes EGD-e
agcauauuaggcgcagaauuau

SEQ ID NO: 119320 - RNA, 22 nt, Listeria monocytogenes EGD-e
agcagaugcuacuuuugauccg

SEQ ID NO: 119321 - RNA, 22 nt, Listeria monocytogenes EGD-e
gccaauuaauaaauuuguugcu

SEQ ID NO: 119322 - RNA, 22 nt, Listeria monocytogenes EGD-e
uuguucaauuguuucgauaauu

SEQ ID NO: 119323 - RNA, 21 nt, Listeria monocytogenes EGD-e
aucggguguuucaaguucuaa

SEQ ID NO: 119324 - RNA, 22 nt, Listeria monocytogenes EGD-e
agcggauuuucgaaacgaugga

SEQ ID NO: 119325 - RNA, 22 nt, Listeria monocytogenes EGD-e
cuguuaaaacugcauuuugaac

SEQ ID NO: 119326 - RNA, 22 nt, Listeria monocytogenes EGD-e
uugcucaucggcaacgauaaca

SEQ ID NO: 119327 - RNA, 22 nt, Listeria monocytogenes EGD-e
ccaucacuuauagcuaugaugg

SEQ ID NO: 119328 - RNA, 22 nt, Listeria monocytogenes EGD-e
aaagugauugcgaguggcuuuu

SEQ ID NO: 119329 - RNA, 22 nt, Listeria monocytogenes EGD-e
ucauaaugcccuuugacaaaau

SEQ ID NO: 119330 - RNA, 21 nt, Listeria monocytogenes EGD-e
acgauuuacuugaauagauug

SEQ ID NO: 119331 - RNA, 22 nt, Listeria monocytogenes EGD-e
auucgccuucuucaauagcuuu

SEQ ID NO: 119332 - RNA, 22 nt, Listeria monocytogenes EGD-e
agcaagcauuuugucaaaguca

SEQ ID NO: 119333 - RNA, 22 nt, Listeria monocytogenes EGD-e
aaguuuccguugaauaaugugg

SEQ ID NO: 119334 - RNA, 22 nt, Listeria monocytogenes EGD-e
auguugacuuuaaagauguuua

SEQ ID NO: 119335 - RNA, 22 nt, Listeria monocytogenes EGD-e
ugucgguauuagguggaauuua

SEQ ID NO: 119336 - RNA, 22 nt, Listeria monocytogenes EGD-e
aaguagauccagaaaucuugga

SEQ ID NO: 119337 - RNA, 22 nt, Listeria monocytogenes EGD-e
ggaaugcuuuuauugaauuaaa

SEQ ID NO: 119338 - RNA, 22 nt, Listeria monocytogenes EGD-e
aaagcguugauccgcaaaaccu

SEQ ID NO: 119339 - RNA, 22 nt, Listeria monocytogenes EGD-e
ugcuuuaucgcagauugaaauu

SEQ ID NO: 119340 - RNA, 22 nt, Listeria monocytogenes EGD-e
uuggucaugcauauauuuauaa

SEQ ID NO: 119341 - RNA, 22 nt, Listeria monocytogenes EGD-e
aaguccguaguuagaaacaucu

SEQ ID NO: 119342 - RNA, 22 nt, Listeria monocytogenes EGD-e
gaaauguuaggauuaucucuua

SEQ ID NO: 119343 - RNA, 22 nt, Listeria monocytogenes EGD-e
ucuggcauuaguuccaaacgaa

SEQ ID NO: 119344 - RNA, 22 nt, Listeria monocytogenes EGD-e
aacagucacagcuucaauaugu

SEQ ID NO: 119345 - RNA, 23 nt, Listeria monocytogenes EGD-e
uacaucugggugauuauguaaug

SEQ ID NO: 119346 - RNA, 22 nt, Listeria monocytogenes EGD-e
caaguaaagcgcgauacuuucu

SEQ ID NO: 119347 - RNA, 22 nt, Listeria monocytogenes EGD-e
aguaggugcuaaaguauacuua

SEQ ID NO: 119348 - RNA, 22 nt, Listeria monocytogenes EGD-e
gaagucaagccuuggauuuaga

SEQ ID NO: 119349 - RNA, 22 nt, Listeria monocytogenes EGD-e
uggugaauaagcauaucauuaa

SEQ ID NO: 119350 - RNA, 22 nt, Listeria monocytogenes EGD-e
uaucgggacauguuauugggaa

SEQ ID NO: 119351 - RNA, 22 nt, Listeria monocytogenes EGD-e
uaaaguugaagcaauuuaugga

SEQ ID NO: 119352 - RNA, 22 nt, Listeria monocytogenes EGD-e
aacagauagugggaaagcaggu

SEQ ID NO: 119353 - RNA, 22 nt, Listeria monocytogenes EGD-e
acuuaguuacaggaaacaacaa

SEQ ID NO: 119354 - RNA, 22 nt, Listeria monocytogenes EGD-e
agucguucauauugaucaagag

SEQ ID NO: 119355 - RNA, 22 nt, Listeria monocytogenes EGD-e
caaauuguaucaaguuauucca

SEQ ID NO: 119356 - RNA, 22 nt, Listeria monocytogenes EGD-e
uauccauugguuuacuucucua

SEQ ID NO: 119357 - RNA, 22 nt, Listeria monocytogenes EGD-e
ugaguuagauuggauggaaggu

SEQ ID NO: 119358 - RNA, 22 nt, Listeria monocytogenes EGD-e
uauuugcaggagaaaucagcgg

SEQ ID NO: 119359 - RNA, 22 nt, Listeria monocytogenes EGD-e
aaugugauacgcuuauuaugga

SEQ ID NO: 119360 - RNA, 22 nt, Listeria monocytogenes EGD-e
aagcagugguuuuauauggugc

SEQ ID NO: 119361 - RNA, 22 nt, Listeria monocytogenes EGD-e
uacuaacuauuacuuaugauga

SEQ ID NO: 119362 - RNA, 22 nt, Listeria monocytogenes EGD-e
aagugcuucuguuacauauuca

SEQ ID NO: 119363 - RNA, 22 nt, Listeria monocytogenes EGD-e
agcaagcaugugaaaggaagua

SEQ ID NO: 119364 - RNA, 23 nt, Listeria monocytogenes EGD-e
uaagaguaaguuuuaauaauucc

SEQ ID NO: 119365 - RNA, 22 nt, Listeria monocytogenes EGD-e
ucuggaaugacaggaagaccug

SEQ ID NO: 119366 - RNA, 22 nt, Listeria monocytogenes EGD-e
aacaugugaaaaauuccuuugc

SEQ ID NO: 119367 - RNA, 22 nt, Listeria monocytogenes EGD-e
aaagcauuguuuagggcuuugu

SEQ ID NO: 119368 - RNA, 22 nt, Listeria monocytogenes EGD-e
aacauuuccaucgacgggaaaa

SEQ ID NO: 119369 - RNA, 22 nt, Listeria monocytogenes EGD-e
gccaaacgaauccgauuuuagu

SEQ ID NO: 119370 - RNA, 22 nt, Listeria monocytogenes EGD-e
aguccgcugcguguuuuuauua

SEQ ID NO: 119371 - RNA, 22 nt, Listeria monocytogenes EGD-e
uuuggaaauaacaacuacuuaa

SEQ ID NO: 119372 - RNA, 22 nt, Listeria monocytogenes EGD-e
gaacuuugggaguugaaagaag

SEQ ID NO: 119373 - RNA, 22 nt, Listeria monocytogenes EGD-e
agaugcuuuaguugcgauggau

SEQ ID NO: 119374 - RNA, 22 nt, Listeria monocytogenes EGD-e
agcaguauauuguuuacgaucu

SEQ ID NO: 119375 - RNA, 22 nt, Listeria monocytogenes EGD-e
auggaugcacguuuuuuaugca

SEQ ID NO: 119376 - RNA, 22 nt, Listeria monocytogenes EGD-e
uauuugaccgguauuauuuuga

SEQ ID NO: 119377 - RNA, 22 nt, Listeria monocytogenes EGD-e
augauuugcguuauuuguuaga

SEQ ID NO: 119378 - RNA, 22 nt, Listeria monocytogenes EGD-e
uaauggaaaacggaaaaguugu

SEQ ID NO: 119379 - RNA, 22 nt, Listeria monocytogenes EGD-e
uuugaacuuugcuuguccggaa

SEQ ID NO: 119380 - RNA, 22 nt, Listeria monocytogenes EGD-e
ucgcuugaauuaauuuuucgcc

SEQ ID NO: 119381 - RNA, 22 nt, Listeria monocytogenes EGD-e
cgcgaaaucauucucuggcauu

SEQ ID NO: 119382 - RNA, 22 nt, Listeria monocytogenes EGD-e
uuaguugaauuagaggacuuag

SEQ ID NO: 119383 - RNA, 21 nt, Listeria monocytogenes EGD-e
acgaaugaaguuaaugcuuca

SEQ ID NO: 119384 - RNA, 22 nt, Listeria monocytogenes EGD-e
acuauucucgcaaccagcuuuu

SEQ ID NO: 119385 - RNA, 22 nt, Listeria monocytogenes EGD-e
uugucgcaugcauuuucauucc

SEQ ID NO: 119386 - RNA, 20 nt, Listeria monocytogenes EGD-e
acgugcuuuguucguuauuu

SEQ ID NO: 119387 - RNA, 22 nt, Listeria monocytogenes EGD-e
uuuggaaaguaaaguucggagg

SEQ ID NO: 119388 - RNA, 22 nt, Listeria monocytogenes EGD-e
agcgcaauagguugaauauuag

SEQ ID NO: 119389 - RNA, 22 nt, Listeria monocytogenes EGD-e
guucuuaugaaauucuuaccug

SEQ ID NO: 119390 - RNA, 20 nt, Listeria monocytogenes EGD-e
ugguagaauaggauuugugg

SEQ ID NO: 119391 - RNA, 22 nt, Listeria monocytogenes EGD-e
uagaaacacuacaaaaagcuau

SEQ ID NO: 119392 - RNA, 22 nt, Listeria monocytogenes EGD-e
auucacuuaguacacugauuua

SEQ ID NO: 119393 - RNA, 22 nt, Listeria monocytogenes EGD-e
agccgaguuguucaucgacgcg

SEQ ID NO: 119394 - RNA, 22 nt, Listeria monocytogenes EGD-e
auaaacgaacggaacaaauucu

SEQ ID NO: 119395 - RNA, 22 nt, Listeria monocytogenes EGD-e
ugguuauauugaagcaacugcu

SEQ ID NO: 119396 - RNA, 22 nt, Listeria monocytogenes EGD-e
caaguagcuaacuguauuugau

SEQ ID NO: 119397 - RNA, 22 nt, Listeria monocytogenes EGD-e
aaucgguucuaucguuuaguga

SEQ ID NO: 119398 - RNA, 22 nt, Listeria monocytogenes EGD-e
gaaguuguguaguaugaaauuu

SEQ ID NO: 119399 - RNA, 19 nt, Listeria monocytogenes EGD-e
ugcuagcuucuugauuuua

SEQ ID NO: 119400 - RNA, 22 nt, Listeria monocytogenes EGD-e
uaucauuguacuuuuagucgug

SEQ ID NO: 119401 - RNA, 22 nt, Listeria monocytogenes EGD-e
aaaucgcuuuuuccuauuuagc

SEQ ID NO: 119402 - RNA, 22 nt, Listeria monocytogenes EGD-e
auggcagaagggcacaugacaa

SEQ ID NO: 119403 - RNA, 22 nt, Listeria monocytogenes EGD-e
uaucacuuagacgaaucgcuaa

SEQ ID NO: 119404 - RNA, 22 nt, Listeria monocytogenes EGD-e
cuaggaaugauugcauuguuua

SEQ ID NO: 119405 - RNA, 22 nt, Listeria monocytogenes EGD-e
guaucguuauccaauuugauuu

SEQ ID NO: 119406 - RNA, 22 nt, Listeria monocytogenes EGD-e
ugaaguguuacuggauucugua

SEQ ID NO: 119407 - RNA, 22 nt, Listeria monocytogenes EGD-e
aguagaugccguucuuaucgcg

SEQ ID NO: 119408 - RNA, 22 nt, Listeria monocytogenes EGD-e
acauugaaacagcugcaaaaua

SEQ ID NO: 119409 - RNA, 22 nt, Listeria monocytogenes EGD-e
uuacugguggaaauguuuuaau

SEQ ID NO: 119410 - RNA, 22 nt, Listeria monocytogenes EGD-e
acgagugacagaaauuauuacg

SEQ ID NO: 119411 - RNA, 22 nt, Listeria monocytogenes EGD-e
uuggaaguauuacgauugauuc

SEQ ID NO: 119412 - RNA, 22 nt, Listeria monocytogenes EGD-e
accgauuuaauauucggauuua

SEQ ID NO: 119413 - RNA, 22 nt, Listeria monocytogenes EGD-e
aguaagauguuacuggguaagg

SEQ ID NO: 119414 - RNA, 22 nt, Listeria monocytogenes EGD-e
uucguauuuuaccuggagauaa

SEQ ID NO: 119415 - RNA, 22 nt, Listeria monocytogenes EGD-e
cggauaacuuuuauaguaguaa

SEQ ID NO: 119416 - RNA, 22 nt, Listeria monocytogenes EGD-e
aacauucagucuccaagcucca

SEQ ID NO: 119417 - RNA, 22 nt, Listeria monocytogenes EGD-e
uuacugucagaccauucuuuga

SEQ ID NO: 119418 - RNA, 22 nt, Listeria monocytogenes EGD-e
aacagucacagcuucaauaugu

SEQ ID NO: 119419 - RNA, 22 nt, Listeria monocytogenes EGD-e
acaaaugacuauccaguuauua

SEQ ID NO: 119420 - RNA, 22 nt, Listeria monocytogenes EGD-e
acaauuucuucgcgcucaaaaa

SEQ ID NO: 119421 - RNA, 22 nt, Listeria monocytogenes EGD-e
auucauugcccaugauuuauca

SEQ ID NO: 119422 - RNA, 22 nt, Listeria monocytogenes EGD-e
aguaucaaaaaagugcgaggaa

SEQ ID NO: 119423 - RNA, 22 nt, Listeria monocytogenes EGD-e
cugaaagugauuuuuggacuug

SEQ ID NO: 119424 - RNA, 20 nt, Listeria monocytogenes EGD-e
gccauauucguaauacaaga

SEQ ID NO: 119425 - RNA, 22 nt, Listeria monocytogenes EGD-e
uaucguuacacaugaucacacu

SEQ ID NO: 119426 - RNA, 22 nt, Listeria monocytogenes EGD-e
ucccauguaaccaguuuuuacg

SEQ ID NO: 119427 - RNA, 22 nt, Listeria monocytogenes EGD-e
ugucccagcugaacgaacaucu

SEQ ID NO: 119428 - RNA, 22 nt, Listeria monocytogenes EGD-e
uuuggaaauaacaacuacuuaa

SEQ ID NO: 119429 - RNA, 22 nt, Listeria monocytogenes EGD-e
uugcacaucguacaguuuucag

SEQ ID NO: 119430 - RNA, 22 nt, Listeria monocytogenes EGD-e
uuggaaguauuacgauugauuc

SEQ ID NO: 119431 - RNA, 22 nt, Listeria monocytogenes EGD-e
guaucguuauccaauuugauuu

SEQ ID NO: 119432 - RNA, 22 nt, Listeria monocytogenes EGD-e
uagaaacacuacaaaaagcuau

SEQ ID NO: 119433 - RNA, 22 nt, Listeria monocytogenes EGD-e
uaggauuuucuuaugaaauuca

SEQ ID NO: 119434 - RNA, 22 nt, Listeria monocytogenes EGD-e
ucaagggauaguuuuuuaguaa

SEQ ID NO: 119435 - RNA, 22 nt, Human
aaagacagccuguuggcuuucu

SEQ ID NO: 119436 - RNA, 22 nt, Human
aaagaccuucacuuucuggcug

SEQ ID NO: 119437 - RNA, 22 nt, Human
aaacccacauuccugcuuaggc

SEQ ID NO: 119438 - RNA, 22 nt, Human
aaacagcugcaguacacggccu

SEQ ID NO: 119439 - RNA, 22 nt, Human
aaacccauauaccagcugugcu

SEQ ID NO: 119440 - RNA, 22 nt, Human
aaagaucaguuaacgccaucaa

SEQ ID NO: 119441 - RNA, 22 nt, Human
aaauguguagaggggagagccg

SEQ ID NO: 119442 - RNA, 22 nt, Human
aacagguucaucuuggaagcag

SEQ ID NO: 119443 - RNA, 22 nt, Human
aacgagcugggggggccggggg

SEQ ID NO: 119444 - RNA, 22 nt, Human
aaccuggaggaccuuaugcuaa

SEQ ID NO: 119445 - RNA, 22 nt, Human
aaccuggguguacauuaugguc

SEQ ID NO: 119446 - RNA, 22 nt, Human
aacgggcacuuuauuuaaaaaa

SEQ ID NO: 119447 - RNA, 22 nt, Human
aaccucgggcugcacuuggcac

SEQ ID NO: 119448 - RNA, 22 nt, Human
aacgcagagaguaaugcugaac

SEQ ID NO: 119449 - RNA, 22 nt, Human
aacgcugugcacuggguccagg

SEQ ID NO: 119450 - RNA, 22 nt, Human
aacgaugauaaauuguucucug

SEQ ID NO: 119451 - RNA, 22 nt, Human
aacccaagacaagcacuggcca

SEQ ID NO: 119452 - RNA, 22 nt, Human
aaccagaagucaucagagcuga

SEQ ID NO: 119453 - RNA, 22 nt, Human
aaccaggcgagagagcggucag

SEQ ID NO: 119454 - RNA, 22 nt, Human
aagccagccaguuccagcagcu

SEQ ID NO: 119455 - RNA, 22 nt, Human
aagccgagggaggugauggaga

SEQ ID NO: 119456 - RNA, 22 nt, Human
aagcagaaaaacugagcuccaa

SEQ ID NO: 119457 - RNA, 21 nt, Human
aagagcgccgggcagggcuga

SEQ ID NO: 119458 - RNA, 23 nt, Human
aagaaugcuucugaagagcugcc

SEQ ID NO: 119459 - RNA, 22 nt, Human
aagaacaugggugugggcauuc

SEQ ID NO: 119460 - RNA, 22 nt, Human
aagaaguccuugaggcgcaccc

SEQ ID NO: 119461 - RNA, 22 nt, Human
aagaagguugaaugacuacuuu

SEQ ID NO: 119462 - RNA, 22 nt, Human
aagaaggcggaccagaagggag

SEQ ID NO: 119463 - RNA, 22 nt, Human
aagaaaggcacaagaaagaaaa

SEQ ID NO: 119464 - RNA, 22 nt, Human
aacuuucagaauccuaugcauu

SEQ ID NO: 119465 - RNA, 23 nt, Human
aacugcaagguugcugggaagua

SEQ ID NO: 119466 - RNA, 22 nt, Human
aacugggugauucaggcuguuu

SEQ ID NO: 119467 - RNA, 22 nt, Human
aacucugcaaugaaaucauguu

SEQ ID NO: 119468 - RNA, 22 nt, Human
aacugcauaagcuucgggaccu

SEQ ID NO: 119469 - RNA, 22 nt, Human
aacuacucugggguggcagguu

SEQ ID NO: 119470 - RNA, 22 nt, Human
aacgugcuuuacaaaugaccuu

SEQ ID NO: 119471 - RNA, 22 nt, Human
aacgucugagaccccuccucuc

SEQ ID NO: 119472 - RNA, 22 nt, Human
aacugaaguuuucagauuuugc

SEQ ID NO: 119473 - RNA, 22 nt, Human
aacucgaugcaauucacuuugu

SEQ ID NO: 119474 - RNA, 22 nt, Human
aacgccgggacucgcagggagc

SEQ ID NO: 119475 - RNA, 22 nt, Human
aaucucguuaugaagaugguug

SEQ ID NO: 119476 - RNA, 22 nt, Human
aauacagauggcaugugaagau

SEQ ID NO: 119477 - RNA, 23 nt, Human
aaguggugacugugcuacugaga

SEQ ID NO: 119478 - RNA, 22 nt, Human
aaguggugagacccugcugaaa

SEQ ID NO: 119479 - RNA, 22 nt, Human
aaguggcccuaauugggccaaa

SEQ ID NO: 119480 - RNA, 21 nt, Human
aaguacccuuuugcuacucag

SEQ ID NO: 119481 - RNA, 22 nt, Human
aagguggugaucaucuugaagg

SEQ ID NO: 119482 - RNA, 22 nt, Human
aaggugggacugagaggggaca

SEQ ID NO: 119483 - RNA, 22 nt, Human
aaggugcugaggguccuggcuu

SEQ ID NO: 119484 - RNA, 22 nt, Human
aaggggggcaccugcaugcccg

SEQ ID NO: 119485 - RNA, 22 nt, Human
aagguaaugcaucaggcaggga

SEQ ID NO: 119486 - RNA, 22 nt, Human
aagggaaguuugacacuuuuua

SEQ ID NO: 119487 - RNA, 22 nt, Human
aagggggacaagcauuggcuua

SEQ ID NO: 119488 - RNA, 22 nt, Human
aagggaaacagccaggcccugu

SEQ ID NO: 119489 - RNA, 22 nt, Human
aagggccuccuggggagccugg

SEQ ID NO: 119490 - RNA, 22 nt, Human
aagcccuuugaaaauguguguc

SEQ ID NO: 119491 - RNA, 22 nt, Human
aaggcacuugcccagagcugca

SEQ ID NO: 119492 - RNA, 22 nt, Human
aaggccacacuugcuggccagc

SEQ ID NO: 119493 - RNA, 22 nt, Human
aaggcgguuccgguucgcggcg

SEQ ID NO: 119494 - RNA, 22 nt, Human
aaggcggcggcggcggcugcgg

SEQ ID NO: 119495 - RNA, 22 nt, Human
aaggcgccacagugauugcaaa

SEQ ID NO: 119496 - RNA, 18 nt, Human
aaggaggaaugaauagca

SEQ ID NO: 119497 - RNA, 22 nt, Human
aaggagcuuucauuacagccuu

SEQ ID NO: 119498 - RNA, 22 nt, Human
aagcaguuuagucaucgggauu

SEQ ID NO: 119499 - RNA, 22 nt, Human
aagcagacugggccauaaggaa

SEQ ID NO: 119500 - RNA, 22 nt, Human
aagccucaugccagauccaggu

SEQ ID NO: 119501 - RNA, 22 nt, Human
accaccacugacaccagcucgg

SEQ ID NO: 119502 - RNA, 22 nt, Human
accaccacauaguaggcacuua

SEQ ID NO: 119503 - RNA, 22 nt, Human
accagcgcguuuucaguuucau

SEQ ID NO: 119504 - RNA, 22 nt, Human
accaggaguuuugaccaggggc

SEQ ID NO: 119505 - RNA, 19 nt, Human
accaaacaguggacggagc

SEQ ID NO: 119506 - RNA, 22 nt, Human
accaacuuuccaaagugccugg

SEQ ID NO: 119507 - RNA, 22 nt, Human
accaagaguccaagugagguug

SEQ ID NO: 119508 - RNA, 19 nt, Human
accauggguguguuaagaa

SEQ ID NO: 119509 - RNA, 22 nt, Human
acccccacuccgcaguagaacu

SEQ ID NO: 119510 - RNA, 22 nt, Human
acccggccuacucagugcccag

SEQ ID NO: 119511 - RNA, 22 nt, Human
accagguugagacuucggcuuu

SEQ ID NO: 119512 - RNA, 22 nt, Human
accagccacccugccgcguccg

SEQ ID NO: 119513 - RNA, 22 nt, Human
accagccacacacauuagucac

SEQ ID NO: 119514 - RNA, 22 nt, Human
accacguccugguggcuguugg

SEQ ID NO: 119515 - RNA, 22 nt, Human
acaugggcaaucgcuuuauuca

SEQ ID NO: 119516 - RNA, 20 nt, Human
acauccacugagugggauga

SEQ ID NO: 119517 - RNA, 22 nt, Human
acaucccccuacuuguguccug

SEQ ID NO: 119518 - RNA, 22 nt, Human
acauccagcagauuguccagag

SEQ ID NO: 119519 - RNA, 22 nt, Human
acagugugcaagaaauggggga

SEQ ID NO: 119520 - RNA, 22 nt, Human
acaugcacagcaagggugagag

SEQ ID NO: 119521 - RNA, 22 nt, Human
acauggacugguccauuaugac

SEQ ID NO: 119522 - RNA, 20 nt, Human
acauggagaagcgagguagg

SEQ ID NO: 119523 - RNA, 22 nt, Human
acauggaccucagauccuggcc

SEQ ID NO: 119524 - RNA, 22 nt, Human
acaugguguggcacuaggggcu

SEQ ID NO: 119525 - RNA, 22 nt, Human
acgucaucguugucaucgucau

SEQ ID NO: 119526 - RNA, 22 nt, Human
acguagggauuccucgucucau

SEQ ID NO: 119527 - RNA, 22 nt, Human
acggugagacuggcgaaggaaa

SEQ ID NO: 119528 - RNA, 22 nt, Human
acgaagggggcauggugagagu

SEQ ID NO: 119529 - RNA, 22 nt, Human
accuuggauauucuuacucggu

SEQ ID NO: 119530 - RNA, 23 nt, Human
acgcagacacauguaugggccuc

SEQ ID NO: 119531 - RNA, 23 nt, Human
acgggaggcggggcagggcugag

SEQ ID NO: 119532 - RNA, 22 nt, Human
acggcuugaacgcgccuguggg

SEQ ID NO: 119533 - RNA, 22 nt, Human
acggccgaugacuccagcaugg

SEQ ID NO: 119534 - RNA, 20 nt, Human
accuucuuugguagacggaa

SEQ ID NO: 119535 - RNA, 22 nt, Human
accugcagguguuuccacacuu

SEQ ID NO: 119536 - RNA, 22 nt, Human
accugcucucccucucgcaguc

SEQ ID NO: 119537 - RNA, 22 nt, Human
accuggauauuuucaguugcau

SEQ ID NO: 119538 - RNA, 22 nt, Human
acgaaauaaaauuaaagcccua

SEQ ID NO: 119539 - RNA, 22 nt, Human
acgauacaaucauauaguaccu

SEQ ID NO: 119540 - RNA, 22 nt, Human
accuucugaccucucggacuuc

SEQ ID NO: 119541 - RNA, 22 nt, Human
accugguuucuuacccaagaga

SEQ ID NO: 119542 - RNA, 19 nt, Human
accuguucaaccucgugcu

SEQ ID NO: 119543 - RNA, 23 nt, Human
accuccuuguugaguggggguga

SEQ ID NO: 119544 - RNA, 22 nt, Human
accuggaccugccaccuaugag

SEQ ID NO: 119545 - RNA, 22 nt, Human
accuggacucugaucacuuuug

SEQ ID NO: 119546 - RNA, 21 nt, Human
accugguuuacugaucccagg

SEQ ID NO: 119547 - RNA, 21 nt, Human
accuggugaugaaugggaggc

SEQ ID NO: 119548 - RNA, 23 nt, Human
accuggucccaugggugggccug

SEQ ID NO: 119549 - RNA, 22 nt, Human
accugguaaccugccugacuaa

SEQ ID NO: 119550 - RNA, 22 nt, Human
accuggcccugggucuccugac

SEQ ID NO: 119551 - RNA, 22 nt, Human
accgggcagcucugccccugcc

SEQ ID NO: 119552 - RNA, 22 nt, Human
accucuuucuauggauuuuuug

SEQ ID NO: 119553 - RNA, 22 nt, Human
accucccgacggcgcgggagaa

SEQ ID NO: 119554 - RNA, 22 nt, Human
accugaucugagaaguggaggg

SEQ ID NO: 119555 - RNA, 22 nt, Human
accugaccagguggcuucccaa

SEQ ID NO: 119556 - RNA, 22 nt, Human
accgauuucaaauggugcuaga

SEQ ID NO: 119557 - RNA, 22 nt, Human
accgauguggaaaauuucauuu

SEQ ID NO: 119558 - RNA, 22 nt, Human
accgagcaggguguuugcgcac

SEQ ID NO: 119559 - RNA, 23 nt, Human
accgccgcugccgccgcccccgc

SEQ ID NO: 119560 - RNA, 22 nt, Human
accgcuggcacuggggacgggg

SEQ ID NO: 119561 - RNA, 20 nt, Human
acccagaguccuccccgcgc

SEQ ID NO: 119562 - RNA, 22 nt, Human
acccuucugugaccugccuguc

SEQ ID NO: 119563 - RNA, 22 nt, Human
accgguucccaucuggagaguu

SEQ ID NO: 119564 - RNA, 22 nt, Human
accggucucaccaaacgcccca

SEQ ID NO: 119565 - RNA, 22 nt, Human
accccagcucugagccacacca

SEQ ID NO: 119566 - RNA, 22 nt, Human
acccaucauuagucuuucagga

SEQ ID NO: 119567 - RNA, 22 nt, Human
acccauggcucucugggaugcu

SEQ ID NO: 119568 - RNA, 22 nt, Human
accgugcccauucauuuacaaa

SEQ ID NO: 119569 - RNA, 22 nt, Human
acccuacggacuugacugggcg

SEQ ID NO: 119570 - RNA, 22 nt, Human
acccgguuuucccagcaccucc

SEQ ID NO: 119571 - RNA, 22 nt, Human
acccugacggugggcagcuuga

SEQ ID NO: 119572 - RNA, 22 nt, Human
agaggagaauguaaauuuguca

SEQ ID NO: 119573 - RNA, 22 nt, Human
agaggaguagcugagcucugca

SEQ ID NO: 119574 - RNA, 22 nt, Human
agagcugggacuuggacucaau

SEQ ID NO: 119575 - RNA, 22 nt, Human
agagggagccugcacagcuuuc

SEQ ID NO: 119576 - RNA, 22 nt, Human
agaggugcuuaugcucaugguu

SEQ ID NO: 119577 - RNA, 22 nt, Human
agaguggcaccuuaccugagac

SEQ ID NO: 119578 - RNA, 22 nt, Human
agagcacaggguuuugugccgg

SEQ ID NO: 119579 - RNA, 22 nt, Human
agagaaccauggcauccaggua

SEQ ID NO: 119580 - RNA, 20 nt, Human
agagaacaguuuggucacag

SEQ ID NO: 119581 - RNA, 22 nt, Human
agagaacauuuucaggguuuca

SEQ ID NO: 119582 - RNA, 22 nt, Human
agacuccuucuaagaccucauu

SEQ ID NO: 119583 - RNA, 22 nt, Human
agagagggaugguguccagaga

SEQ ID NO: 119584 - RNA, 22 nt, Human
agacgcgcagaaggaagcggcc

SEQ ID NO: 119585 - RNA, 22 nt, Human
agacugugagaagauggcugcg

SEQ ID NO: 119586 - RNA, 19 nt, Human
agacccaguuuucuagugu

SEQ ID NO: 119587 - RNA, 22 nt, Human
agaccccugcuggggcugcugu

SEQ ID NO: 119588 - RNA, 22 nt, Human
agaccguguguggguugcggug

SEQ ID NO: 119589 - RNA, 22 nt, Human
agacagcggugcaauaaauggu

SEQ ID NO: 119590 - RNA, 22 nt, Human
agaacaggaggaagccagcucc

SEQ ID NO: 119591 - RNA, 22 nt, Human
agaagaucccugugguuacgac

SEQ ID NO: 119592 - RNA, 22 nt, Human
agaagaagacccuaaggaaagg

SEQ ID NO: 119593 - RNA, 21 nt, Human
agaagcggucgaaucgcagac

SEQ ID NO: 119594 - RNA, 22 nt, Human
acugugaagagcauucuggcug

SEQ ID NO: 119595 - RNA, 22 nt, Human
acugugacugugucuucugggc

SEQ ID NO: 119596 - RNA, 22 nt, Human
acugggacuguaugugcuggac

SEQ ID NO: 119597 - RNA, 22 nt, Human
acugggcaaggauaugaugggu

SEQ ID NO: 119598 - RNA, 19 nt, Human
acuggggcaggcugggcuu

SEQ ID NO: 119599 - RNA, 22 nt, Human
acuggggcaggaaaguaugcug

SEQ ID NO: 119600 - RNA, 22 nt, Human
acuggggaggucuggauggauc

SEQ ID NO: 119601 - RNA, 18 nt, Human
acuguccucaggacguug

SEQ ID NO: 119602 - RNA, 22 nt, Human
acuguccucgaaguaccugugc

SEQ ID NO: 119603 - RNA, 22 nt, Human
acuggugcucuggccaccgcug

SEQ ID NO: 119604 - RNA, 22 nt, Human
acuguggcugcuacccuggcuc

SEQ ID NO: 119605 - RNA, 22 nt, Human
acuggcuuggaaauggguauuu

SEQ ID NO: 119606 - RNA, 19 nt, Human
acugggaugggcagugcca

SEQ ID NO: 119607 - RNA, 21 nt, Human
acugggcuagccugacuucug

SEQ ID NO: 119608 - RNA, 22 nt, Human
acuggagcccguggaggcgcag

SEQ ID NO: 119609 - RNA, 22 nt, Human
acugaggaagccugucaucauc

SEQ ID NO: 119610 - RNA, 22 nt, Human
acgugugugugcacguguguau

SEQ ID NO: 119611 - RNA, 22 nt, Human
agcuugauggauugcugaggca

SEQ ID NO: 119612 - RNA, 22 nt, Human
agcuugcccuuguaccagccag

SEQ ID NO: 119613 - RNA, 20 nt, Human
agcugucccugacacuagga

SEQ ID NO: 119614 - RNA, 22 nt, Human
agcuggauuaaucacagugacu

SEQ ID NO: 119615 - RNA, 22 nt, Human
aggacacuuccugaguggacaa

SEQ ID NO: 119616 - RNA, 22 nt, Human
aggacguaacccaggacagccu

SEQ ID NO: 119617 - RNA, 22 nt, Human
aggagaccugguugugugugug

SEQ ID NO: 119618 - RNA, 22 nt, Human
aggacuggucucuuuucuccaa

SEQ ID NO: 119619 - RNA, 22 nt, Human
aggacagagggaccagagccca

SEQ ID NO: 119620 - RNA, 22 nt, Human
aggaagucucucaaaacuggaa

SEQ ID NO: 119621 - RNA, 22 nt, Human
agcugaugucucaccuguuaga

SEQ ID NO: 119622 - RNA, 22 nt, Human
agcugcuaagcugcauaacuua

SEQ ID NO: 119623 - RNA, 22 nt, Human
agcugcuuuacuggucggcugg

SEQ ID NO: 119624 - RNA, 22 nt, Human
agcugugccuauucguggcaag

SEQ ID NO: 119625 - RNA, 20 nt, Human
agcuggcccccgguggccug

SEQ ID NO: 119626 - RNA, 22 nt, Human
agcuggaaucucggcaaagcgu

SEQ ID NO: 119627 - RNA, 22 nt, Human
agcuuccaaagaccaggauuga

SEQ ID NO: 119628 - RNA, 22 nt, Human
agcuguugaccuucccuuucag

SEQ ID NO: 119629 - RNA, 22 nt, Human
agcucuucugacucuaggcuca

SEQ ID NO: 119630 - RNA, 22 nt, Human
agcugaggccccgcagcagggu

SEQ ID NO: 119631 - RNA, 22 nt, Human
agcugaccugauugcuuuucag

SEQ ID NO: 119632 - RNA, 19 nt, Human
agcugcugauugguggagg

SEQ ID NO: 119633 - RNA, 22 nt, Human
agcugcuggcggauguuggacu

SEQ ID NO: 119634 - RNA, 22 nt, Human
agcugcugcaaguggugcuaac

SEQ ID NO: 119635 - RNA, 22 nt, Human
agcugagccagacagguaagca

SEQ ID NO: 119636 - RNA, 22 nt, Human
agcucggcuguccugugccccu

SEQ ID NO: 119637 - RNA, 22 nt, Human
agcuccugcgcacggugcacac

SEQ ID NO: 119638 - RNA, 22 nt, Human
agcucugugcaggcagaggcau

SEQ ID NO: 119639 - RNA, 19 nt, Human
agcuccucaccucucgcgg

SEQ ID NO: 119640 - RNA, 19 nt, Human
agcucaggcccaucguccc

SEQ ID NO: 119641 - RNA, 22 nt, Human
agcucugcuucuugggaagaug

SEQ ID NO: 119642 - RNA, 22 nt, Human
agcgucaugugaccagcgcgcc

SEQ ID NO: 119643 - RNA, 22 nt, Human
agcggcgcgucuccgagcugga

SEQ ID NO: 119644 - RNA, 22 nt, Human
agcgggucaugucggccgccca

SEQ ID NO: 119645 - RNA, 22 nt, Human
agcggcucaggccccgugggcu

SEQ ID NO: 119646 - RNA, 22 nt, Human
agcggugacauccuucugugcu

SEQ ID NO: 119647 - RNA, 22 nt, Human
agcgagccugugcacuucuaac

SEQ ID NO: 119648 - RNA, 19 nt, Human
agcgccucuacugcaugga

SEQ ID NO: 119649 - RNA, 22 nt, Human
agcggcaggaagcgcgcaagcg

SEQ ID NO: 119650 - RNA, 22 nt, Human
agcggcaagguguauguggcag

SEQ ID NO: 119651 - RNA, 19 nt, Human
agcggccgccgcgggcgcc

SEQ ID NO: 119652 - RNA, 22 nt, Human
agcgcccguugagucgcgcggu

SEQ ID NO: 119653 - RNA, 22 nt, Human
agcgcaguuaccgcgcggggcu

SEQ ID NO: 119654 - RNA, 22 nt, Human
agcccuucccuuucacuggugc

SEQ ID NO: 119655 - RNA, 22 nt, Human
agccgcgcuguuccugcugcug

SEQ ID NO: 119656 - RNA, 22 nt, Human
agccgcugaauuugaaacaagc

SEQ ID NO: 119657 - RNA, 22 nt, Human
agccuguuacuguccugugcca

SEQ ID NO: 119658 - RNA, 22 nt, Human
agccuucccuuucaacaauuug

SEQ ID NO: 119659 - RNA, 22 nt, Human
agcccugaccuguccuguucug

SEQ ID NO: 119660 - RNA, 22 nt, Human
agcauuucuacugugucagaaa

SEQ ID NO: 119661 - RNA, 22 nt, Human
agcaugucuaacucuucagggu

SEQ ID NO: 119662 - RNA, 23 nt, Human
agcccagcagagaaccuaggucc

SEQ ID NO: 119663 - RNA, 21 nt, Human
agcaucugaggcaguuuccua

SEQ ID NO: 119664 - RNA, 22 nt, Human
agccagcauauauauaguugaa

SEQ ID NO: 119665 - RNA, 19 nt, Human
agcaguggagccaugccug

SEQ ID NO: 119666 - RNA, 22 nt, Human
agccacggcaaugauaggcugc

SEQ ID NO: 119667 - RNA, 22 nt, Human
agcaggucagugguaaucaaaa

SEQ ID NO: 119668 - RNA, 22 nt, Human
agcauucccuuugcagugucau

SEQ ID NO: 119669 - RNA, 22 nt, Human
agcaggaggagagccuggcggu

SEQ ID NO: 119670 - RNA, 22 nt, Human
agcaucggacggagcaccugcu

SEQ ID NO: 119671 - RNA, 22 nt, Human
agcauacuaggauguuuucugg

SEQ ID NO: 119672 - RNA, 22 nt, Human
agcaugaauugccauuuauuaa

SEQ ID NO: 119673 - RNA, 22 nt, Human
agcagcaggcugggaugagucu

SEQ ID NO: 119674 - RNA, 22 nt, Human
agcacggugguuaagagagugg

SEQ ID NO: 119675 - RNA, 22 nt, Human
agauaggccauuaagaaggaua

SEQ ID NO: 119676 - RNA, 22 nt, Human
agcaggaggguuuuguagaguc

SEQ ID NO: 119677 - RNA, 22 nt, Human
agcaggguggcaagucuuucug

SEQ ID NO: 119678 - RNA, 22 nt, Human
agcaguucucugucuagcuaga

SEQ ID NO: 119679 - RNA, 22 nt, Human
aggcccagcaccagcggucuuc

SEQ ID NO: 119680 - RNA, 22 nt, Human
aggcccugcugaggccucccuc

SEQ ID NO: 119681 - RNA, 20 nt, Human
aggccgcccgcugccgcuuc

SEQ ID NO: 119682 - RNA, 22 nt, Human
aggagcacugggcaugucaccc

SEQ ID NO: 119683 - RNA, 22 nt, Human
aggagcccggucgucaugguaa

SEQ ID NO: 119684 - RNA, 22 nt, Human
aggccagggacaaugaggcaga

SEQ ID NO: 119685 - RNA, 22 nt, Human
aggcguggcuucugcuggguug

SEQ ID NO: 119686 - RNA, 22 nt, Human
aggcgguuggcuuugucugggu

SEQ ID NO: 119687 - RNA, 22 nt, Human
aggcggguuuaggacaaugcuu

SEQ ID NO: 119688 - RNA, 22 nt, Human
aggcuccucugggggccccgga

SEQ ID NO: 119689 - RNA, 22 nt, Human
aggccgcgguggcgaaggcguu

SEQ ID NO: 119690 - RNA, 22 nt, Human
aggccgguggaggagguggagg

SEQ ID NO: 119691 - RNA, 22 nt, Human
aggccugaggaccagauaaaug

SEQ ID NO: 119692 - RNA, 22 nt, Human
aggccugcuccucuucucaucc

SEQ ID NO: 119693 - RNA, 22 nt, Human
aggccugcccuuggggagccuu

SEQ ID NO: 119694 - RNA, 22 nt, Human
aggcgagcgcggccggugcccc

SEQ ID NO: 119695 - RNA, 22 nt, Human
agggacccucagcuuggauguc

SEQ ID NO: 119696 - RNA, 22 nt, Human
agggaccgugagcuccuugggg

SEQ ID NO: 119697 - RNA, 22 nt, Human
agggaguagggagccaugggug

SEQ ID NO: 119698 - RNA, 22 nt, Human
agggaggcccagcagacuggcg

SEQ ID NO: 119699 - RNA, 22 nt, Human
aggcugucucagccugcuugca

SEQ ID NO: 119700 - RNA, 18 nt, Human
aggcuggggaucacaggg

SEQ ID NO: 119701 - RNA, 22 nt, Human
aggcgaagggaccagacgguag

SEQ ID NO: 119702 - RNA, 22 nt, Human
aggccgcuggggcagcgcccga

SEQ ID NO: 119703 - RNA, 23 nt, Human
aggcugccacucagggugaggcu

SEQ ID NO: 119704 - RNA, 22 nt, Human
aggcugaagcacacucaugcag

SEQ ID NO: 119705 - RNA, 22 nt, Human
aggcugcuggcaggcguggacg

SEQ ID NO: 119706 - RNA, 23 nt, Human
aggcugcagaagaauagggucau

SEQ ID NO: 119707 - RNA, 19 nt, Human
aggcugccucacccucccu

SEQ ID NO: 119708 - RNA, 22 nt, Human
aggcugccuaugaaggcagaag

SEQ ID NO: 119709 - RNA, 22 nt, Human
agggaugugcagggcuugccau

SEQ ID NO: 119710 - RNA, 22 nt, Human
agggaggagggacagaaagagg

SEQ ID NO: 119711 - RNA, 22 nt, Human
agggccggggagggcugugggg

SEQ ID NO: 119712 - RNA, 22 nt, Human
agggcggucccugagacucucc

SEQ ID NO: 119713 - RNA, 22 nt, Human
agggcgugguggugcuggagca

SEQ ID NO: 119714 - RNA, 22 nt, Human
agggcucacuacaacccuggga

SEQ ID NO: 119715 - RNA, 22 nt, Human
agggcguacuuucgccccuccu

SEQ ID NO: 119716 - RNA, 22 nt, Human
agggcugcugcuccgggcccag

SEQ ID NO: 119717 - RNA, 22 nt, Human
aggggaagagugagguuuuggu

SEQ ID NO: 119718 - RNA, 22 nt, Human
aggggauggagcuggaaggcag

SEQ ID NO: 119719 - RNA, 22 nt, Human
aggggagaguuaaugugaaugu

SEQ ID NO: 119720 - RNA, 22 nt, Human
aggggcugagaguuugaugugg

SEQ ID NO: 119721 - RNA, 22 nt, Human
aggggcugugucauuuguccua

SEQ ID NO: 119722 - RNA, 22 nt, Human
aggggcuuguggaguugcuggu

SEQ ID NO: 119723 - RNA, 21 nt, Human
agguagauagccccaggaagg

SEQ ID NO: 119724 - RNA, 22 nt, Human
aggguggcuggaguggucuggu

SEQ ID NO: 119725 - RNA, 22 nt, Human
aggggcagaggaugauggaaga

SEQ ID NO: 119726 - RNA, 22 nt, Human
agggggccucucccgcggcgcc

SEQ ID NO: 119727 - RNA, 22 nt, Human
aggucgugggugagagagagac

SEQ ID NO: 119728 - RNA, 22 nt, Human
aggucggcuuuuuuccuuucac

SEQ ID NO: 119729 - RNA, 22 nt, Human
aggucguauaguuaccuccuug

SEQ ID NO: 119730 - RNA, 22 nt, Human
aggugcacugguacaggcuuca

SEQ ID NO: 119731 - RNA, 22 nt, Human
aguccucagauauggagaucug

SEQ ID NO: 119732 - RNA, 22 nt, Human
aguccauccagaaaacaaagcu

SEQ ID NO: 119733 - RNA, 22 nt, Human
aguccagggcuuagucagcggg

SEQ ID NO: 119734 - RNA, 18 nt, Human
agucauguuuuagucacu

SEQ ID NO: 119735 - RNA, 22 nt, Human
agucggggagcgugaccagaga

SEQ ID NO: 119736 - RNA, 22 nt, Human
agucggguugcagacacauccu

SEQ ID NO: 119737 - RNA, 22 nt, Human
agucagcuugucucuaggguug

SEQ ID NO: 119738 - RNA, 22 nt, Human
agucaagguggaccagaaaaau

SEQ ID NO: 119739 - RNA, 22 nt, Human
agucaacauuugagaugcaaug

SEQ ID NO: 119740 - RNA, 22 nt, Human
aggugucauuauagaccagaua

SEQ ID NO: 119741 - RNA, 22 nt, Human
aggugugcacccggucgcuucc

SEQ ID NO: 119742 - RNA, 22 nt, Human
aggucugcccaggaugcugcuu

SEQ ID NO: 119743 - RNA, 21 nt, Human
aggugaaggcgagggggacag

SEQ ID NO: 119744 - RNA, 22 nt, Human
agguggcguauguguucguguu

SEQ ID NO: 119745 - RNA, 22 nt, Human
aggugggcuuagaaaucuguau

SEQ ID NO: 119746 - RNA, 22 nt, Human
aggugggucgcaggcaucagug

SEQ ID NO: 119747 - RNA, 22 nt, Human
agguggucccaauggcugggca

SEQ ID NO: 119748 - RNA, 22 nt, Human
agguggucuuguggaugccgca

SEQ ID NO: 119749 - RNA, 22 nt, Human
auagaagguaaugccccaaggg

SEQ ID NO: 119750 - RNA, 22 nt, Human
agugacauuauuuuguguacua

SEQ ID NO: 119751 - RNA, 22 nt, Human
aucaucccuuucucccagugaa

SEQ ID NO: 119752 - RNA, 22 nt, Human
aucagugcacgcgaugggcaga

SEQ ID NO: 119753 - RNA, 22 nt, Human
aucauaccaguuuccaucagga

SEQ ID NO: 119754 - RNA, 22 nt, Human
auccaggguuggggucacgagu

SEQ ID NO: 119755 - RNA, 22 nt, Human
aucaugugacuagguuuggcca

SEQ ID NO: 119756 - RNA, 20 nt, Human
aucaugugcacugcugacag

SEQ ID NO: 119757 - RNA, 22 nt, Human
auccuagacuccuaugccccaa

SEQ ID NO: 119758 - RNA, 22 nt, Human
auccgugagcgagcgagcaccc

SEQ ID NO: 119759 - RNA, 23 nt, Human
aucgcccggguccagucccggcu

SEQ ID NO: 119760 - RNA, 22 nt, Human
auccaggggucugaauggauau

SEQ ID NO: 119761 - RNA, 22 nt, Human
auccacccugcaggccaacucu

SEQ ID NO: 119762 - RNA, 22 nt, Human
auccacggucaauuccccaucc

SEQ ID NO: 119763 - RNA, 22 nt, Human
auccugauggaaacugguauga

SEQ ID NO: 119764 - RNA, 22 nt, Human
aucagagcuaguacuugcaggu

SEQ ID NO: 119765 - RNA, 22 nt, Human
aucaucuaaaauuggcucagau

SEQ ID NO: 119766 - RNA, 22 nt, Human
aucaugcgguuaaggagugugu

SEQ ID NO: 119767 - RNA, 22 nt, Human
aucaugggauagugggacgagc

SEQ ID NO: 119768 - RNA, 22 nt, Human
aucaacacuguuggcggggacc

SEQ ID NO: 119769 - RNA, 19 nt, Human
aucagcaguuuugccugga

SEQ ID NO: 119770 - RNA, 22 nt, Human
aucagcucuugaugccuuucuu

SEQ ID NO: 119771 - RNA, 22 nt, Human
aucauccuagaaggaagcuagg

SEQ ID NO: 119772 - RNA, 22 nt, Human
aucaacucacagugugcuggca

SEQ ID NO: 119773 - RNA, 20 nt, Human
aucaagugucuugccaggca

SEQ ID NO: 119774 - RNA, 22 nt, Human
aucaagacaaaggaaaggcuaa

SEQ ID NO: 119775 - RNA, 22 nt, Human
augacagcucuagcacacagua

SEQ ID NO: 119776 - RNA, 22 nt, Human
aucugucagaccuuggucacag

SEQ ID NO: 119777 - RNA, 22 nt, Human
aucugcuguaguuggugccagu

SEQ ID NO: 119778 - RNA, 22 nt, Human
aucuggaacuucucugcauuga

SEQ ID NO: 119779 - RNA, 22 nt, Human
augcucggcuuucuuucuuucu

SEQ ID NO: 119780 - RNA, 22 nt, Human
augcugacaacaaagaaggaag

SEQ ID NO: 119781 - RNA, 18 nt, Human
augcugacacaaugugga

SEQ ID NO: 119782 - RNA, 22 nt, Human
augcugcuccuuuucaggcauu

SEQ ID NO: 119783 - RNA, 22 nt, Human
augcugugccuggaaagcggcu

SEQ ID NO: 119784 - RNA, 22 nt, Human
augcugcuuguccauuuauuug

SEQ ID NO: 119785 - RNA, 22 nt, Human
augcugccuaaagcuacuuaca

SEQ ID NO: 119786 - RNA, 22 nt, Human
augccugcugucaggaacucuu

SEQ ID NO: 119787 - RNA, 22 nt, Human
augccucuugagagccagugcu

SEQ ID NO: 119788 - RNA, 22 nt, Human
augcgcugugcacacucuuaac

SEQ ID NO: 119789 - RNA, 22 nt, Human
augccugggcuuuaggguucuc

SEQ ID NO: 119790 - RNA, 21 nt, Human
augcgcgguggagugagcgaa

SEQ ID NO: 119791 - RNA, 22 nt, Human
augcagcggucagaggaacuca

SEQ ID NO: 119792 - RNA, 22 nt, Human
augcaggcuaagaguaaagacg

SEQ ID NO: 119793 - RNA, 22 nt, Human
augccgggguggcuccagcacc

SEQ ID NO: 119794 - RNA, 22 nt, Human
augcggcugugggggaauggga

SEQ ID NO: 119795 - RNA, 19 nt, Human
auguucugaauuacuguaa

SEQ ID NO: 119796 - RNA, 22 nt, Human
auguucccaaaaucccuguaga

SEQ ID NO: 119797 - RNA, 22 nt, Human
auucaccaucuugauccccucu

SEQ ID NO: 119798 - RNA, 22 nt, Human
auucaagagcccauguuuccug

SEQ ID NO: 119799 - RNA, 22 nt, Human
auguccugguccacagaaggga

SEQ ID NO: 119800 - RNA, 23 nt, Human
augugaggcaaaggcaggcacuc

SEQ ID NO: 119801 - RNA, 22 nt, Human
augugggugaggaggccauugu

SEQ ID NO: 119802 - RNA, 22 nt, Human
auggccuuucucaguggugcuu

SEQ ID NO: 119803 - RNA, 18 nt, Human
auggcuccagugucuucc

SEQ ID NO: 119804 - RNA, 20 nt, Human
auggcgagucagcacaaaac

SEQ ID NO: 119805 - RNA, 22 nt, Human
auggugaaaugauuugauguca

SEQ ID NO: 119806 - RNA, 20 nt, Human
augucaggaagggagucagg

SEQ ID NO: 119807 - RNA, 22 nt, Human
augguugggggaugucagcagg

SEQ ID NO: 119808 - RNA, 22 nt, Human
caaggucagacagccaggacag

SEQ ID NO: 119809 - RNA, 22 nt, Human
caagagguaugagccgggauga

SEQ ID NO: 119810 - RNA, 22 nt, Human
caagcgcgccgcuuccuuccgc

SEQ ID NO: 119811 - RNA, 22 nt, Human
caagaugcaagaccagucaggc

SEQ ID NO: 119812 - RNA, 22 nt, Human
caacaaguugauuucacgcugc

SEQ ID NO: 119813 - RNA, 22 nt, Human
cacacacacacacacucucaca

SEQ ID NO: 119814 - RNA, 22 nt, Human
cacacaccagaaagccugggac

SEQ ID NO: 119815 - RNA, 22 nt, Human
caaugccaggaaccugggggaa

SEQ ID NO: 119816 - RNA, 22 nt, Human
caaaucuguuaauuucaaguug

SEQ ID NO: 119817 - RNA, 22 nt, Human
cacccgacugaggacgccgccc

SEQ ID NO: 119818 - RNA, 20 nt, Human
caccggguugcugguuucuu

SEQ ID NO: 119819 - RNA, 22 nt, Human
caccgagagccacuuccggaac

SEQ ID NO: 119820 - RNA, 20 nt, Human
cacccgguccucagcgacuc

SEQ ID NO: 119821 - RNA, 22 nt, Human
caagguauugaggccagugucc

SEQ ID NO: 119822 - RNA, 22 nt, Human
caagguugugacccaaugacca

SEQ ID NO: 119823 - RNA, 22 nt, Human
caccagcgacugugaccagcaa

SEQ ID NO: 119824 - RNA, 22 nt, Human
caaggaguuuggggaccaagga

SEQ ID NO: 119825 - RNA, 22 nt, Human
caagggcagaggcagggccccg

SEQ ID NO: 119826 - RNA, 22 nt, Human
cacaugugugugccuacaugca

SEQ ID NO: 119827 - RNA, 22 nt, Human
caaggaaaacagaugaucaaca

SEQ ID NO: 119828 - RNA, 22 nt, Human
caagccacugggagcugcacac

SEQ ID NO: 119829 - RNA, 22 nt, Human
caagagcuuuagaaaugcucau

SEQ ID NO: 119830 - RNA, 22 nt, Human
cacaucucagggcuacaggcag

SEQ ID NO: 119831 - RNA, 22 nt, Human
cacagaggaugcccaagcgauc

SEQ ID NO: 119832 - RNA, 22 nt, Human
cacagccaagacuuggccccau

SEQ ID NO: 119833 - RNA, 20 nt, Human
cacagcugacgaguauccaa

SEQ ID NO: 119834 - RNA, 22 nt, Human
caagagcucccagaccugggca

SEQ ID NO: 119835 - RNA, 22 nt, Human
caagagcgugugcagggcaagu

SEQ ID NO: 119836 - RNA, 19 nt, Human
caagagcaaagucuuauga

SEQ ID NO: 119837 - RNA, 22 nt, Human
caagaaguugacagccagguga

SEQ ID NO: 119838 - RNA, 22 nt, Human
caacuucuauucagucugcagu

SEQ ID NO: 119839 - RNA, 17 nt, Human
caaccaggaaaggaggg

SEQ ID NO: 119840 - RNA, 22 nt, Human
caacguggauucuuccaggggc

SEQ ID NO: 119841 - RNA, 22 nt, Human
caaccaguagcugaguucaaaa

SEQ ID NO: 119842 - RNA, 22 nt, Human
caaagaagagauuuacagagcu

SEQ ID NO: 119843 - RNA, 22 nt, Human
auuuucgcaccucgcgaguugc

SEQ ID NO: 119844 - RNA, 22 nt, Human
auuuccacaaauuaagauugca

SEQ ID NO: 119845 - RNA, 23 nt, Human
cagucgacugugcccucccgagc

SEQ ID NO: 119846 - RNA, 21 nt, Human
caggccaaaagguucaacauu

SEQ ID NO: 119847 - RNA, 22 nt, Human
caggccacagcuaaagaggauu

SEQ ID NO: 119848 - RNA, 22 nt, Human
caggcagggcugccuucugcuu

SEQ ID NO: 119849 - RNA, 22 nt, Human
caggucauaacuaugcaugaac

SEQ ID NO: 119850 - RNA, 22 nt, Human
cagggggcccagcugggagggg

SEQ ID NO: 119851 - RNA, 22 nt, Human
caggggaagccagcugccaugu

SEQ ID NO: 119852 - RNA, 22 nt, Human
cagggcacaguuauggaggugg

SEQ ID NO: 119853 - RNA, 20 nt, Human
caggccuucaggauggcugg

SEQ ID NO: 119854 - RNA, 22 nt, Human
caggccccagggacugggcgcu

SEQ ID NO: 119855 - RNA, 22 nt, Human
cagggacgugagccaugucagu

SEQ ID NO: 119856 - RNA, 22 nt, Human
cagggagcggggagaucucggg

SEQ ID NO: 119857 - RNA, 22 nt, Human
caggcgcauggugagcagauga

SEQ ID NO: 119858 - RNA, 22 nt, Human
caucccaacaggugaucuggua

SEQ ID NO: 119859 - RNA, 20 nt, Human
cagguugcugcccccgccuc

SEQ ID NO: 119860 - RNA, 19 nt, Human
caggggcuuaugcgaccuc

SEQ ID NO: 119861 - RNA, 22 nt, Human
caggugauuuuguuuucaaaug

SEQ ID NO: 119862 - RNA, 22 nt, Human
caugccugaucagcggccagca

SEQ ID NO: 119863 - RNA, 22 nt, Human
caguugcuauugagagaacaca

SEQ ID NO: 119864 - RNA, 22 nt, Human
caguugcagagugauguguuug

SEQ ID NO: 119865 - RNA, 22 nt, Human
caugcagcagaauaaugacuau

SEQ ID NO: 119866 - RNA, 20 nt, Human
caugaguccgugaguggccc

SEQ ID NO: 119867 - RNA, 22 nt, Human
cagugccggccaggaccuccug

SEQ ID NO: 119868 - RNA, 22 nt, Human
cagcuccagcccaggcagcucc

SEQ ID NO: 119869 - RNA, 22 nt, Human
cagcucuggcuauugaggacca

SEQ ID NO: 119870 - RNA, 22 nt, Human
cagcucgaauaauggagaacug

SEQ ID NO: 119871 - RNA, 22 nt, Human
caggcaggagaaaaggcgcggg

SEQ ID NO: 119872 - RNA, 22 nt, Human
caggcacagcuaagacuggcca

SEQ ID NO: 119873 - RNA, 22 nt, Human
caggaggaaaguuccacucaac

SEQ ID NO: 119874 - RNA, 22 nt, Human
caggccagcuggaggggcagcu

SEQ ID NO: 119875 - RNA, 22 nt, Human
cagggugaagaugcgccuccug

SEQ ID NO: 119876 - RNA, 22 nt, Human
caggggcuuuccuguuuaugga

SEQ ID NO: 119877 - RNA, 22 nt, Human
cagggcuugaaucaaggaaguc

SEQ ID NO: 119878 - RNA, 22 nt, Human
cagggccagggcuauggugaag

SEQ ID NO: 119879 - RNA, 22 nt, Human
cagggccaggccucaggggcgc

SEQ ID NO: 119880 - RNA, 22 nt, Human
cagcuuuugcagacuucuugcc

SEQ ID NO: 119881 - RNA, 22 nt, Human
cagccuggccucuggauauuug

SEQ ID NO: 119882 - RNA, 22 nt, Human
cagcuguggagauggggugcau

SEQ ID NO: 119883 - RNA, 22 nt, Human
cagcuugcccugauguggaaga

SEQ ID NO: 119884 - RNA, 22 nt, Human
cagaucacucugggcggcggga

SEQ ID NO: 119885 - RNA, 22 nt, Human
cagcagaugacuauuggagcug

SEQ ID NO: 119886 - RNA, 20 nt, Human
cagcagucagcucuccaaug

SEQ ID NO: 119887 - RNA, 22 nt, Human
cagcagccuccccggccgaccu

SEQ ID NO: 119888 - RNA, 22 nt, Human
cagcuggggagagacauggcag

SEQ ID NO: 119889 - RNA, 22 nt, Human
cagcaugcaaguccagaugugg

SEQ ID NO: 119890 - RNA, 22 nt, Human
cagcccaggcucagauguuggg

SEQ ID NO: 119891 - RNA, 22 nt, Human
cagagaagaggucuugaccccu

SEQ ID NO: 119892 - RNA, 22 nt, Human
cagaguccugcaccagcuccag

SEQ ID NO: 119893 - RNA, 22 nt, Human
cagagggagcuaaccagcagcc

SEQ ID NO: 119894 - RNA, 22 nt, Human
cagcccaucaaggggauccuga

SEQ ID NO: 119895 - RNA, 22 nt, Human
cagccccagcacuuagcugagu

SEQ ID NO: 119896 - RNA, 22 nt, Human
cagcugacaagaguccuuggag

SEQ ID NO: 119897 - RNA, 22 nt, Human
cagcugcgcagcgccgggccug

SEQ ID NO: 119898 - RNA, 22 nt, Human
cagcugcugguguaucgggucc

SEQ ID NO: 119899 - RNA, 22 nt, Human
cagcucugcugggaggaugcag

SEQ ID NO: 119900 - RNA, 22 nt, Human
cagaggcugagcugcgggauga

SEQ ID NO: 119901 - RNA, 22 nt, Human
cagauggagaaagagugaaugg

SEQ ID NO: 119902 - RNA, 22 nt, Human
cagaucacauccauccgucacc

SEQ ID NO: 119903 - RNA, 22 nt, Human
caauugcuuccuucuguaagua

SEQ ID NO: 119904 - RNA, 22 nt, Human
cagagcugagucuucaagguug

SEQ ID NO: 119905 - RNA, 22 nt, Human
cagagaugaggcuggcgugguu

SEQ ID NO: 119906 - RNA, 22 nt, Human
cacacagcuagugacaggagaa

SEQ ID NO: 119907 - RNA, 22 nt, Human
cacgggcgacgugaucuaggac

SEQ ID NO: 119908 - RNA, 22 nt, Human
cuggagaacucugugcuucacu

SEQ ID NO: 119909 - RNA, 22 nt, Human
cuggagaacagagcuguuuaga

SEQ ID NO: 119910 - RNA, 22 nt, Human
cugagaggcacaaggcauuucg

SEQ ID NO: 119911 - RNA, 19 nt, Human
cugagcagggaaaaacccu

SEQ ID NO: 119912 - RNA, 22 nt, Human
cugaccugugagcuaugccggc

SEQ ID NO: 119913 - RNA, 22 nt, Human
cuggcagcucugagucccuucu

SEQ ID NO: 119914 - RNA, 22 nt, Human
cuggcccugucagcacagaauc

SEQ ID NO: 119915 - RNA, 22 nt, Human
cuggaugucugggaggcuuccc

SEQ ID NO: 119916 - RNA, 22 nt, Human
cuggaucgccccgaugugcccc

SEQ ID NO: 119917 - RNA, 22 nt, Human
cuggagcuucaggguucucggg

SEQ ID NO: 119918 - RNA, 20 nt, Human
cuggaguguagcaguggcug

SEQ ID NO: 119919 - RNA, 22 nt, Human
cucuccagucauauucucaguc

SEQ ID NO: 119920 - RNA, 22 nt, Human
cucggagggcaaguacuggcug

SEQ ID NO: 119921 - RNA, 22 nt, Human
cuccucguccucuucauccucu

SEQ ID NO: 119922 - RNA, 22 nt, Human
cuccuggagcagcaggcgcagg

SEQ ID NO: 119923 - RNA, 22 nt, Human
cugggacccagcccaagucuuu

SEQ ID NO: 119924 - RNA, 22 nt, Human
cugggagaggaaccucgagggu

SEQ ID NO: 119925 - RNA, 22 nt, Human
cugggaccugugugccugggcc

SEQ ID NO: 119926 - RNA, 22 nt, Human
cucccucacaaagcauucucuu

SEQ ID NO: 119927 - RNA, 21 nt, Human
cugggaacccgaccaaggccu

SEQ ID NO: 119928 - RNA, 22 nt, Human
cuccaggcccagggccaagagc

SEQ ID NO: 119929 - RNA, 22 nt, Human
cuccaggacugaggacagagcu

SEQ ID NO: 119930 - RNA, 22 nt, Human
cuccagcucgcgagcucugcuc

SEQ ID NO: 119931 - RNA, 22 nt, Human
cuggcgagcugggccuggggga

SEQ ID NO: 119932 - RNA, 22 nt, Human
cugagcuauauauuaugcauag

SEQ ID NO: 119933 - RNA, 22 nt, Human
cugagcugcucccgcugcagcg

SEQ ID NO: 119934 - RNA, 22 nt, Human
cugacugaggaucaguucauca

SEQ ID NO: 119935 - RNA, 22 nt, Human
cugaauucuuguugucggagca

SEQ ID NO: 119936 - RNA, 19 nt, Human
cugacccaacauuaguuca

SEQ ID NO: 119937 - RNA, 22 nt, Human
cugaccgugccgcgguacugcu

SEQ ID NO: 119938 - RNA, 22 nt, Human
cugaaucaaaugacuuagccau

SEQ ID NO: 119939 - RNA, 22 nt, Human
cuguguugggauggugcgcgca

SEQ ID NO: 119940 - RNA, 22 nt, Human
cuguguguauaauguuugauaa

SEQ ID NO: 119941 - RNA, 22 nt, Human
cugugugcagggcacaauggaa

SEQ ID NO: 119942 - RNA, 22 nt, Human
cuguguggccuaaguggagaca

SEQ ID NO: 119943 - RNA, 22 nt, Human
cucuggacaucugcggugcuuc

SEQ ID NO: 119944 - RNA, 22 nt, Human
cugucucugauaagcucgaggg

SEQ ID NO: 119945 - RNA, 22 nt, Human
cuguggguggcugugccccagg

SEQ ID NO: 119946 - RNA, 22 nt, Human
cuguggcuaggaagcuguggga

SEQ ID NO: 119947 - RNA, 22 nt, Human
cuguggcugcgcccugggggag

SEQ ID NO: 119948 - RNA, 20 nt, Human
cuggugccuucugcgauuua

SEQ ID NO: 119949 - RNA, 19 nt, Human
cucuggcuccugggcugcc

SEQ ID NO: 119950 - RNA, 22 nt, Human
cugcgcgagcacugccggcggg

SEQ ID NO: 119951 - RNA, 22 nt, Human
cugcgguucuguuuaguggcga

SEQ ID NO: 119952 - RNA, 22 nt, Human
cugcgcagaucugcuguucucu

SEQ ID NO: 119953 - RNA, 22 nt, Human
cugcggcaccaaccccuucaug

SEQ ID NO: 119954 - RNA, 22 nt, Human
cugcuugguuuggagggcccac

SEQ ID NO: 119955 - RNA, 22 nt, Human
cugcuguuuuccccaccaucuc

SEQ ID NO: 119956 - RNA, 22 nt, Human
cuuggugagcuccuggcgcagc

SEQ ID NO: 119957 - RNA, 22 nt, Human
cuuggggauuuuaaagaccucu

SEQ ID NO: 119958 - RNA, 22 nt, Human
cugcuguugagguuccaggcca

SEQ ID NO: 119959 - RNA, 22 nt, Human
cugcugccagcuuaauacucac

SEQ ID NO: 119960 - RNA, 22 nt, Human
cugcugugcagacagacucucu

SEQ ID NO: 119961 - RNA, 22 nt, Human
cugcugucuuuauuucacugcu

SEQ ID NO: 119962 - RNA, 22 nt, Human
cuggaugagcuucgugcgcacg

SEQ ID NO: 119963 - RNA, 22 nt, Human
cuuuagugaguguggagcuaga

SEQ ID NO: 119964 - RNA, 22 nt, Human
cuggagaucaguuggacaacag

SEQ ID NO: 119965 - RNA, 22 nt, Human
cuggaagcgucggaggaagggc

SEQ ID NO: 119966 - RNA, 19 nt, Human
cuuguggcuaugcagauac

SEQ ID NO: 119967 - RNA, 22 nt, Human
cugccgaugcgcaguggcgccu

SEQ ID NO: 119968 - RNA, 22 nt, Human
cugcccugcagcuccacggacu

SEQ ID NO: 119969 - RNA, 22 nt, Human
cugcccauggcuccuggcugug

SEQ ID NO: 119970 - RNA, 22 nt, Human
cugcccgcaugcaggaaugcug

SEQ ID NO: 119971 - RNA, 22 nt, Human
cugccucucaugccugcuugcu

SEQ ID NO: 119972 - RNA, 22 nt, Human
cugccuggggaaugugaggauu

SEQ ID NO: 119973 - RNA, 22 nt, Human
cuugccagggacucagucaggg

SEQ ID NO: 119974 - RNA, 22 nt, Human
cuugccaguguugcagaagcuc

SEQ ID NO: 119975 - RNA, 22 nt, Human
cuucuguguggauacagucccu

SEQ ID NO: 119976 - RNA, 22 nt, Human
cuuccugcaacaccuguguugc

SEQ ID NO: 119977 - RNA, 22 nt, Human
cugccacuaccaugcuggauga

SEQ ID NO: 119978 - RNA, 22 nt, Human
cugcaucacagcaggaggcaca

SEQ ID NO: 119979 - RNA, 22 nt, Human
cugccaggagaggccagggccc

SEQ ID NO: 119980 - RNA, 22 nt, Human
cugccaguaucuuuggggcugu

SEQ ID NO: 119981 - RNA, 22 nt, Human
cugcacuggguacauagaaaca

SEQ ID NO: 119982 - RNA, 22 nt, Human
gagcaggcuggcagggccaggg

SEQ ID NO: 119983 - RNA, 22 nt, Human
gagcagggagaggcagagaggc

SEQ ID NO: 119984 - RNA, 22 nt, Human
gagcagcugagcuggaaugaga

SEQ ID NO: 119985 - RNA, 22 nt, Human
gagcaguuagggaccgcaggcu

SEQ ID NO: 119986 - RNA, 22 nt, Human
gagcacauguggagagucuggg

SEQ ID NO: 119987 - RNA, 22 nt, Human
gagcagcucgagaaggaagcag

SEQ ID NO: 119988 - RNA, 22 nt, Human
gagcagccugaggauucugcuc

SEQ ID NO: 119989 - RNA, 22 nt, Human
gagauuguggcagcagcuguuu

SEQ ID NO: 119990 - RNA, 22 nt, Human
gagaugugguucaaggguguuu

SEQ ID NO: 119991 - RNA, 22 nt, Human
gagaucuguguuugcugaagcu

SEQ ID NO: 119992 - RNA, 22 nt, Human
gagaggugaagcuaauuaauuu

SEQ ID NO: 119993 - RNA, 22 nt, Human
gagaggcagcucaggaggucag

SEQ ID NO: 119994 - RNA, 22 nt, Human
gagaggcugagcaguccggguu

SEQ ID NO: 119995 - RNA, 22 nt, Human
gagaagguggaccugaaggagc

SEQ ID NO: 119996 - RNA, 22 nt, Human
gacuucaucagagcguacuguu

SEQ ID NO: 119997 - RNA, 22 nt, Human
gacuggggcauuagaguagcuu

SEQ ID NO: 119998 - RNA, 22 nt, Human
gacuccugccucucuacuucug

SEQ ID NO: 119999 - RNA, 22 nt, Human
gacuccuuaauguggcugaugu

SEQ ID NO: 120000 - RNA, 22 nt, Human
gacccggauguuguacucgagg

SEQ ID NO: 120001 - RNA, 20 nt, Human
gacaugagggagcaaagagc

SEQ ID NO: 120002 - RNA, 22 nt, Human
gaccaggagauuugagcuaggc

SEQ ID NO: 120003 - RNA, 19 nt, Human
gaauugcacgagcagaggc

SEQ ID NO: 120004 - RNA, 22 nt, Human
gacgacgggccccguggccacc

SEQ ID NO: 120005 - RNA, 22 nt, Human
gaauggaacauagcaacaucuu

SEQ ID NO: 120006 - RNA, 22 nt, Human
gaaugccugggguucuucgauc

SEQ ID NO: 120007 - RNA, 22 nt, Human
cuugggguuugggggcuugacc

SEQ ID NO: 120008 - RNA, 22 nt, Human
cuuggugcgaagagucagggga

SEQ ID NO: 120009 - RNA, 22 nt, Human
cuugcuguccgaugggucugua

SEQ ID NO: 120010 - RNA, 22 nt, Human
cuugcugggagagcuuuagaga

SEQ ID NO: 120011 - RNA, 22 nt, Human
cuucuuuccauguguuuugguu

SEQ ID NO: 120012 - RNA, 22 nt, Human
cuucuugggaggggcggagcuc

SEQ ID NO: 120013 - RNA, 22 nt, Human
cuugccuuugaaagcauuucuc

SEQ ID NO: 120014 - RNA, 22 nt, Human
gaagcggguucacuggauggcu

SEQ ID NO: 120015 - RNA, 22 nt, Human
gaagcuccaggaugccugcacu

SEQ ID NO: 120016 - RNA, 22 nt, Human
gaagcuucucaacugguggaau

SEQ ID NO: 120017 - RNA, 22 nt, Human
cuucauccguaccacggccaca

SEQ ID NO: 120018 - RNA, 22 nt, Human
gaaggcugaauuauuuguuccu

SEQ ID NO: 120019 - RNA, 22 nt, Human
cuucagagugacucagcaucuu

SEQ ID NO: 120020 - RNA, 22 nt, Human
cuucagcgucgucaguguugcu

SEQ ID NO: 120021 - RNA, 22 nt, Human
cuguucagugcauauguauuga

SEQ ID NO: 120022 - RNA, 20 nt, Human
cuguucucuugccacaugag

SEQ ID NO: 120023 - RNA, 20 nt, Human
cuguuugcuaucaugagcug

SEQ ID NO: 120024 - RNA, 22 nt, Human
cuguuuggaugccauggucaag

SEQ ID NO: 120025 - RNA, 22 nt, Human
cuguuuggcuuccacugcuucu

SEQ ID NO: 120026 - RNA, 22 nt, Human
cugugcuucgagggcuccccgc

SEQ ID NO: 120027 - RNA, 21 nt, Human
cuuugccuccagcagccgcag

SEQ ID NO: 120028 - RNA, 22 nt, Human
cuggccugugggcugucuccgg

SEQ ID NO: 120029 - RNA, 22 nt, Human
cuggccaggugggggguagugg

SEQ ID NO: 120030 - RNA, 22 nt, Human
cuggccagccucccagguaccc

SEQ ID NO: 120031 - RNA, 20 nt, Human
cugaccagcagccugucucc

SEQ ID NO: 120032 - RNA, 19 nt, Human
cggggcuugguggguucuc

SEQ ID NO: 120033 - RNA, 19 nt, Human
cggugaagagaguuuagau

SEQ ID NO: 120034 - RNA, 19 nt, Human
cggugcugauuggugcagu

SEQ ID NO: 120035 - RNA, 22 nt, Human
cgguccugcucuuccucccguu

SEQ ID NO: 120036 - RNA, 22 nt, Human
cggucggagagaaugaccugga

SEQ ID NO: 120037 - RNA, 22 nt, Human
cggggaggagccagcggaggau

SEQ ID NO: 120038 - RNA, 22 nt, Human
cggggcuccgaagagcucgguu

SEQ ID NO: 120039 - RNA, 22 nt, Human
cggggcgggcgugggaggugga

SEQ ID NO: 120040 - RNA, 22 nt, Human
cggggcuggcguuagggaggca

SEQ ID NO: 120041 - RNA, 22 nt, Human
cggggcucugcacaggccagga

SEQ ID NO: 120042 - RNA, 22 nt, Human
cggcuucucgggucggauuccg

SEQ ID NO: 120043 - RNA, 22 nt, Human
cgggagagacagaggaggcgcc

SEQ ID NO: 120044 - RNA, 20 nt, Human
cgggacacucaagcucuggg

SEQ ID NO: 120045 - RNA, 22 nt, Human
cgggcacucagggucgaggugg

SEQ ID NO: 120046 - RNA, 22 nt, Human
cgggcccaggcaggggcucccc

SEQ ID NO: 120047 - RNA, 22 nt, Human
cgggcuccaagcuuucacccca

SEQ ID NO: 120048 - RNA, 22 nt, Human
cgggaggcggagcuccgcgggg

SEQ ID NO: 120049 - RNA, 22 nt, Human
cgggcacagguugagguagaug

SEQ ID NO: 120050 - RNA, 22 nt, Human
cgggagcagcucuggggcuggg

SEQ ID NO: 120051 - RNA, 22 nt, Human
cugaaacuauggggaggggagc

SEQ ID NO: 120052 - RNA, 22 nt, Human
cggcggcgaaccgaccugggug

SEQ ID NO: 120053 - RNA, 22 nt, Human
cggcuacccaugucauauucgu

SEQ ID NO: 120054 - RNA, 22 nt, Human
cggcugcagcggagcaggcugg

SEQ ID NO: 120055 - RNA, 22 nt, Human
cggcugcgguucaccuagggca

SEQ ID NO: 120056 - RNA, 22 nt, Human
cucuggggaagugcacucgcug

SEQ ID NO: 120057 - RNA, 22 nt, Human
cucuggcaacgauggugcuuau

SEQ ID NO: 120058 - RNA, 18 nt, Human
cucuggacagcaggcauc

SEQ ID NO: 120059 - RNA, 22 nt, Human
cucucacucccuccuucccucu

SEQ ID NO: 120060 - RNA, 22 nt, Human
cuccuugguuccggcguuggag

SEQ ID NO: 120061 - RNA, 22 nt, Human
cucgccugacucggaugggcug

SEQ ID NO: 120062 - RNA, 22 nt, Human
cucccgagccuuacucuguucc

SEQ ID NO: 120063 - RNA, 22 nt, Human
cucggcccuggucuuacgggac

SEQ ID NO: 120064 - RNA, 22 nt, Human
cucggggcguggcaguagcaug

SEQ ID NO: 120065 - RNA, 22 nt, Human
cucguccugguuuaaguguccu

SEQ ID NO: 120066 - RNA, 22 nt, Human
cucuauucuaauggauucuggg

SEQ ID NO: 120067 - RNA, 22 nt, Human
cggccuuuggcuucuccugugu

SEQ ID NO: 120068 - RNA, 22 nt, Human
cggacugaccugcucggggaga

SEQ ID NO: 120069 - RNA, 22 nt, Human
cggagcauacugccuggagaug

SEQ ID NO: 120070 - RNA, 21 nt, Human
cucauuccccgucccggcccc

SEQ ID NO: 120071 - RNA, 22 nt, Human
cggaagcacuagacacugacac

SEQ ID NO: 120072 - RNA, 22 nt, Human
cgcuuugguaauagggcagccu

SEQ ID NO: 120073 - RNA, 22 nt, Human
cgcuucauugugggggccccca

SEQ ID NO: 120074 - RNA, 22 nt, Human
cuccaucccccugugugucaau

SEQ ID NO: 120075 - RNA, 22 nt, Human
cucccaucacaauucagggccu

SEQ ID NO: 120076 - RNA, 22 nt, Human
cucaccugccuccccgcccucc

SEQ ID NO: 120077 - RNA, 22 nt, Human
cucacgguuugcaucaagagug

SEQ ID NO: 120078 - RNA, 22 nt, Human
cucacccaaacuauaucuuuaa

SEQ ID NO: 120079 - RNA, 22 nt, Human
cucagaugaugucuucagggaa

SEQ ID NO: 120080 - RNA, 22 nt, Human
cgcugcagcggcugagucccgc

SEQ ID NO: 120081 - RNA, 22 nt, Human
cgcugcugucaucgucuacggu

SEQ ID NO: 120082 - RNA, 19 nt, Human
cgcugcucccgcuguggcu

SEQ ID NO: 120083 - RNA, 22 nt, Human
cgccugucugcauggccacugg

SEQ ID NO: 120084 - RNA, 22 nt, Human
cgagcccaacccucccguccuc

SEQ ID NO: 120085 - RNA, 22 nt, Human
cgacgacaggcgcccgaggagg

SEQ ID NO: 120086 - RNA, 20 nt, Human
cguugccagcccggcccggg

SEQ ID NO: 120087 - RNA, 22 nt, Human
cgucauacagaugaacaaucuc

SEQ ID NO: 120088 - RNA, 22 nt, Human
cggugcuuuccauaucagcagc

SEQ ID NO: 120089 - RNA, 22 nt, Human
cgugcaggagcuggagguccga

SEQ ID NO: 120090 - RNA, 22 nt, Human
cgggucgcacaggagaaaggcg

SEQ ID NO: 120091 - RNA, 22 nt, Human
cgggucgagugcuguaguucga

SEQ ID NO: 120092 - RNA, 22 nt, Human
cggugccccuagcgcgccgccc

SEQ ID NO: 120093 - RNA, 22 nt, Human
cgguggcccauuguacgcagcu

SEQ ID NO: 120094 - RNA, 22 nt, Human
cgguugcaggaugugcgggcag

SEQ ID NO: 120095 - RNA, 22 nt, Human
cggggugugacggugcgggccu

SEQ ID NO: 120096 - RNA, 22 nt, Human
cgggguguggggcgguagugug

SEQ ID NO: 120097 - RNA, 22 nt, Human
ccuguuccaacccucccuggcu

SEQ ID NO: 120098 - RNA, 22 nt, Human
cggggucuggaguuguggugug

SEQ ID NO: 120099 - RNA, 22 nt, Human
ccugugcaugccaggguacacc

SEQ ID NO: 120100 - RNA, 22 nt, Human
ccugugacucugucugaugguc

SEQ ID NO: 120101 - RNA, 22 nt, Human
cggggcaaggggggcuggugga

SEQ ID NO: 120102 - RNA, 22 nt, Human
cggggcggcgagcgggccgggc

SEQ ID NO: 120103 - RNA, 22 nt, Human
ccugggcucgcgcacuucaccc

SEQ ID NO: 120104 - RNA, 22 nt, Human
ccugggugaugugcugcccucg

SEQ ID NO: 120105 - RNA, 22 nt, Human
ccuggguccucacaaucccagg

SEQ ID NO: 120106 - RNA, 22 nt, Human
ccugggcauuuguuucacaggu

SEQ ID NO: 120107 - RNA, 22 nt, Human
cggcgccccgcgcgggcggcuc

SEQ ID NO: 120108 - RNA, 22 nt, Human
ccugcugagccuggugggcagc

SEQ ID NO: 120109 - RNA, 22 nt, Human
cggcgcugguacaguggaagag

SEQ ID NO: 120110 - RNA, 22 nt, Human
ccugcaguuuuuccaugauaca

SEQ ID NO: 120111 - RNA, 22 nt, Human
ccugccagccugccaucccaca

SEQ ID NO: 120112 - RNA, 22 nt, Human
cggccgcgggauggcgggcagc

SEQ ID NO: 120113 - RNA, 22 nt, Human
ccugcucuaauucauucaugcu

SEQ ID NO: 120114 - RNA, 22 nt, Human
ccugaauuuaucugaauggugg

SEQ ID NO: 120115 - RNA, 22 nt, Human
ccugaccauuugccacaugggu

SEQ ID NO: 120116 - RNA, 22 nt, Human
cgcgcgguguuccgcauucugc

SEQ ID NO: 120117 - RNA, 22 nt, Human
cgcccccgaucggggccgccgc

SEQ ID NO: 120118 - RNA, 22 nt, Human
ccugcaguagagguugguaggg

SEQ ID NO: 120119 - RNA, 22 nt, Human
ccugcacuaccuggggcugcug

SEQ ID NO: 120120 - RNA, 22 nt, Human
cgcucggugagccaguggcgga

SEQ ID NO: 120121 - RNA, 22 nt, Human
cgcucggcuuucccuccgccgg

SEQ ID NO: 120122 - RNA, 22 nt, Human
cgcgcuuugggcaguguggcug

SEQ ID NO: 120123 - RNA, 22 nt, Human
cgcgggcuugggcaccugcgga

SEQ ID NO: 120124 - RNA, 22 nt, Human
ccugcugcugaugcuguuucac

SEQ ID NO: 120125 - RNA, 22 nt, Human
ccugcuggagucuaguuggucu

SEQ ID NO: 120126 - RNA, 21 nt, Human
ccgaggagugcggggagcccc

SEQ ID NO: 120127 - RNA, 22 nt, Human
ccgcaccgucugccauacacgc

SEQ ID NO: 120128 - RNA, 22 nt, Human
ccgcagggcccggcgggcucag

SEQ ID NO: 120129 - RNA, 22 nt, Human
cgacagauuauuuugugacugc

SEQ ID NO: 120130 - RNA, 22 nt, Human
ccgccccaggcccugagccaag

SEQ ID NO: 120131 - RNA, 22 nt, Human
cgacaagagaaaugcuuuguuu

SEQ ID NO: 120132 - RNA, 22 nt, Human
ccucucccugcagggcccaggg

SEQ ID NO: 120133 - RNA, 22 nt, Human
cgaccccugaaaauggcagcca

SEQ ID NO: 120134 - RNA, 22 nt, Human
cgacuacuaacuacuguagaaa

SEQ ID NO: 120135 - RNA, 19 nt, Human
ccucggggucugaagucag

SEQ ID NO: 120136 - RNA, 22 nt, Human
cgcacaggcacagacacuggga

SEQ ID NO: 120137 - RNA, 23 nt, Human
cgagagccugcaggaccuucgga

SEQ ID NO: 120138 - RNA, 22 nt, Human
cgagcccacacuccuguccucu

SEQ ID NO: 120139 - RNA, 22 nt, Human
cgccaguggcagcuggaacagg

SEQ ID NO: 120140 - RNA, 22 nt, Human
cgcacuugugagcgacagggcu

SEQ ID NO: 120141 - RNA, 22 nt, Human
cgcaucggguagaggagcugga

SEQ ID NO: 120142 - RNA, 22 nt, Human
cccuuuucuaauuuagccuguu

SEQ ID NO: 120143 - RNA, 21 nt, Human
ccugcacuucccuccucaagu

SEQ ID NO: 120144 - RNA, 22 nt, Human
ccugcaugacuuugucagaccu

SEQ ID NO: 120145 - RNA, 19 nt, Human
ccugcugaagugaugcagc

SEQ ID NO: 120146 - RNA, 22 nt, Human
ccugcucccccugcaagccuug

SEQ ID NO: 120147 - RNA, 18 nt, Human
ccugcguggauguccucu

SEQ ID NO: 120148 - RNA, 22 nt, Human
ccugccugggcucacuugccag

SEQ ID NO: 120149 - RNA, 22 nt, Human
ccugcccaucccaccccagcau

SEQ ID NO: 120150 - RNA, 22 nt, Human
cccuggucucugacuugauccu

SEQ ID NO: 120151 - RNA, 22 nt, Human
ccugaggcccuggcugugcuga

SEQ ID NO: 120152 - RNA, 21 nt, Human
ccugagccuguuuauccagaa

SEQ ID NO: 120153 - RNA, 20 nt, Human
cccuggcuggcaucuggacu

SEQ ID NO: 120154 - RNA, 22 nt, Human
cccugggccccgaacugcugag

SEQ ID NO: 120155 - RNA, 22 nt, Human
cccuggacuccauuuucccgua

SEQ ID NO: 120156 - RNA, 20 nt, Human
cccuggaaugagaugcauau

SEQ ID NO: 120157 - RNA, 22 nt, Human
cccugcacuguguggacucugg

SEQ ID NO: 120158 - RNA, 22 nt, Human
ccugacagcgugucccuggccc

SEQ ID NO: 120159 - RNA, 22 nt, Human
ccugaagaugguugauccccuu

SEQ ID NO: 120160 - RNA, 22 nt, Human
cccgguugggguuccagggcgc

SEQ ID NO: 120161 - RNA, 22 nt, Human
cccgggcucuggcagaggcggu

SEQ ID NO: 120162 - RNA, 22 nt, Human
cccgggccgagucuuccagcga

SEQ ID NO: 120163 - RNA, 22 nt, Human
cccuccgccagugcccgccccg

SEQ ID NO: 120164 - RNA, 22 nt, Human
cccgugggaugagaggcccugg

SEQ ID NO: 120165 - RNA, 22 nt, Human
cccuccuuggccccagacccgc

SEQ ID NO: 120166 - RNA, 19 nt, Human
cccucggcuucugguuacu

SEQ ID NO: 120167 - RNA, 22 nt, Human
ccccuuucucccgcgucuggcc

SEQ ID NO: 120168 - RNA, 22 nt, Human
ccucccaccguaucucaguggc

SEQ ID NO: 120169 - RNA, 22 nt, Human
cccgccggccacaccggccgcc

SEQ ID NO: 120170 - RNA, 22 nt, Human
cccgaaaauuguuguacugcag

SEQ ID NO: 120171 - RNA, 22 nt, Human
cccgaggagagguccaggcccu

SEQ ID NO: 120172 - RNA, 22 nt, Human
cccgacuccuccugguaccuaa

SEQ ID NO: 120173 - RNA, 22 nt, Human
cccgcucaccccacuccaccag

SEQ ID NO: 120174 - RNA, 22 nt, Human
cccggcucggcuucuuccccac

SEQ ID NO: 120175 - RNA, 22 nt, Human
ccuccgguucucagggcuccac

SEQ ID NO: 120176 - RNA, 22 nt, Human
ccuccuuucaggaaguaggugg

SEQ ID NO: 120177 - RNA, 22 nt, Human
ccuccugggccuugcucuguga

SEQ ID NO: 120178 - RNA, 22 nt, Human
ccucgcucauggauucugccug

SEQ ID NO: 120179 - RNA, 22 nt, Human
cccaggaaugagcaggcagggg

SEQ ID NO: 120180 - RNA, 22 nt, Human
cccagcugaacuugcauuccaa

SEQ ID NO: 120181 - RNA, 22 nt, Human
cccagcuggcaaaggcguccuu

SEQ ID NO: 120182 - RNA, 22 nt, Human
cccaggccguguaaucagcagc

SEQ ID NO: 120183 - RNA, 22 nt, Human
ccgggcuuccuuagagcaagau

SEQ ID NO: 120184 - RNA, 19 nt, Human
ccggucaugcauuccuuug

SEQ ID NO: 120185 - RNA, 22 nt, Human
ccggcggguggagcaugcgcgg

SEQ ID NO: 120186 - RNA, 22 nt, Human
ccggcugagccucgccgcggcc

SEQ ID NO: 120187 - RNA, 22 nt, Human
ccggcggaaacauggcggcgcc

SEQ ID NO: 120188 - RNA, 22 nt, Human
cccagccgcuguggucuagggu

SEQ ID NO: 120189 - RNA, 22 nt, Human
ccgggcggcauccagccguucc

SEQ ID NO: 120190 - RNA, 22 nt, Human
cccagccuuugcuuccugguuc

SEQ ID NO: 120191 - RNA, 22 nt, Human
ccgcuggaagcgaguggugggc

SEQ ID NO: 120192 - RNA, 22 nt, Human
ccggaggaaauugcauugguug

SEQ ID NO: 120193 - RNA, 22 nt, Human
ccgcuggccgacuuccgagagc

SEQ ID NO: 120194 - RNA, 22 nt, Human
cccagagacuuuguccgacgac

SEQ ID NO: 120195 - RNA, 18 nt, Human
cccagaggaaugccugga

SEQ ID NO: 120196 - RNA, 22 nt, Human
cccagaccagagugccuggacg

SEQ ID NO: 120197 - RNA, 22 nt, Human
ccgcggauggggagucaccacc

SEQ ID NO: 120198 - RNA, 22 nt, Human
ccgcgggcagggcuucaccuuu

SEQ ID NO: 120199 - RNA, 22 nt, Human
cccagaagaguauguguuugcu

SEQ ID NO: 120200 - RNA, 22 nt, Human
ccgcggcugcgcggugccccuc

SEQ ID NO: 120201 - RNA, 22 nt, Human
ccucacuucuuucucuucacuu

SEQ ID NO: 120202 - RNA, 22 nt, Human
ccccugggcccugagccgcgau

SEQ ID NO: 120203 - RNA, 22 nt, Human
ccccaguuccugucaaggguaa

SEQ ID NO: 120204 - RNA, 22 nt, Human
ccccucuguagcccgagcugcu

SEQ ID NO: 120205 - RNA, 22 nt, Human
ccccguggcugggggacagagc

SEQ ID NO: 120206 - RNA, 22 nt, Human
ccccagugguugcaacagcaga

SEQ ID NO: 120207 - RNA, 22 nt, Human
ccgguguggguuucucgguagu

SEQ ID NO: 120208 - RNA, 22 nt, Human
ccguccgcuccuccagccgcug

SEQ ID NO: 120209 - RNA, 22 nt, Human
ccgugcaguuucucacacacau

SEQ ID NO: 120210 - RNA, 22 nt, Human
cccaggucgucagcaguguggu

SEQ ID NO: 120211 - RNA, 22 nt, Human
cccaguuguuccuauucuucuu

SEQ ID NO: 120212 - RNA, 22 nt, Human
cccauggaaggguuggcccaga

SEQ ID NO: 120213 - RNA, 22 nt, Human
cccaugacucucauucacaguc

SEQ ID NO: 120214 - RNA, 22 nt, Human
ccagugcuuccaggaauacggu

SEQ ID NO: 120215 - RNA, 22 nt, Human
cccuguccuucccuccaucuga

SEQ ID NO: 120216 - RNA, 22 nt, Human
cccuguccugcuaggcccuggu

SEQ ID NO: 120217 - RNA, 22 nt, Human
cccuggcucaggcagcuuuguu

SEQ ID NO: 120218 - RNA, 22 nt, Human
ccagggcuggaggaggucagga

SEQ ID NO: 120219 - RNA, 22 nt, Human
ccagggaggucauagugcuggu

SEQ ID NO: 120220 - RNA, 22 nt, Human
ccagggcugcugccugggcugg

SEQ ID NO: 120221 - RNA, 22 nt, Human
cccgggucugugugaaauucca

SEQ ID NO: 120222 - RNA, 22 nt, Human
cccgguggagaugugggacagg

SEQ ID NO: 120223 - RNA, 22 nt, Human
cccguggugggaugacaccaug

SEQ ID NO: 120224 - RNA, 22 nt, Human
ccagggcuggguuugucggugu

SEQ ID NO: 120225 - RNA, 22 nt, Human
ccagggucggcaucagcguggg

SEQ ID NO: 120226 - RNA, 22 nt, Human
ccagucagccuaguucuucuuu

SEQ ID NO: 120227 - RNA, 22 nt, Human
ccaguccacgucaagaagaggu

SEQ ID NO: 120228 - RNA, 22 nt, Human
ccaggggagagucugagucguu

SEQ ID NO: 120229 - RNA, 17 nt, Human
cccugcacccuacucuc

SEQ ID NO: 120230 - RNA, 22 nt, Human
cccugauaaaucagcaccucag

SEQ ID NO: 120231 - RNA, 22 nt, Human
cccugaggcccacaagucccag

SEQ ID NO: 120232 - RNA, 23 nt, Human
cccucgcuccucgguuccccugu

SEQ ID NO: 120233 - RNA, 22 nt, Human
cccuucuguaucuucugaguuu

SEQ ID NO: 120234 - RNA, 21 nt, Human
cccuugccugcacuccucggc

SEQ ID NO: 120235 - RNA, 22 nt, Human
ccgaaccacacgacagugcuca

SEQ ID NO: 120236 - RNA, 22 nt, Human
ccgagguccugaagcaagggcc

SEQ ID NO: 120237 - RNA, 22 nt, Human
ccgcagucugcaaucucccugg

SEQ ID NO: 120238 - RNA, 22 nt, Human
ccgagcagggcgcccugcccca

SEQ ID NO: 120239 - RNA, 19 nt, Human
ccgagcagauugauguuuc

SEQ ID NO: 120240 - RNA, 22 nt, Human
ccauggccaauugcaccuugcu

SEQ ID NO: 120241 - RNA, 22 nt, Human
ccgaggaguagggugucuacgg

SEQ ID NO: 120242 - RNA, 22 nt, Human
cccaaccagaaauugacagaga

SEQ ID NO: 120243 - RNA, 18 nt, Human
cccaccugcccagguuca

SEQ ID NO: 120244 - RNA, 23 nt, Human
ccaugugcaggguucagcacuua

SEQ ID NO: 120245 - RNA, 22 nt, Human
ccgccacggggcaugggaggca

SEQ ID NO: 120246 - RNA, 22 nt, Human
ccagcugggucccugcuggggc

SEQ ID NO: 120247 - RNA, 22 nt, Human
ccagcugcugcaccgugcaugg

SEQ ID NO: 120248 - RNA, 22 nt, Human
ccccugcucagggaggagaccg

SEQ ID NO: 120249 - RNA, 22 nt, Human
ccccccaaaacuacuggccugu

SEQ ID NO: 120250 - RNA, 22 nt, Human
ccccauggaaaacccaccuagg

SEQ ID NO: 120251 - RNA, 22 nt, Human
ccagccugagcuugcugcccuc

SEQ ID NO: 120252 - RNA, 22 nt, Human
ccagccugccaagcccagcccu

SEQ ID NO: 120253 - RNA, 19 nt, Human
cccgauggagacuuagcag

SEQ ID NO: 120254 - RNA, 22 nt, Human
cccggagcagucgggcuccggg

SEQ ID NO: 120255 - RNA, 22 nt, Human
ccagggacuauuaguuguguau

SEQ ID NO: 120256 - RNA, 22 nt, Human
ccaggcuccccaggaggcccuu

SEQ ID NO: 120257 - RNA, 22 nt, Human
cccggcgccucguuuccuaguc

SEQ ID NO: 120258 - RNA, 23 nt, Human
cccgggaagugcugcuuaucugg

SEQ ID NO: 120259 - RNA, 20 nt, Human
caucaacaccuugucagccu

SEQ ID NO: 120260 - RNA, 22 nt, Human
cccagcaccauaacucaggccu

SEQ ID NO: 120261 - RNA, 22 nt, Human
cccagcccaucauuccugcaaa

SEQ ID NO: 120262 - RNA, 22 nt, Human
cccagccugaucucggccagcu

SEQ ID NO: 120263 - RNA, 22 nt, Human
cccagccgaaugcucccuuccc

SEQ ID NO: 120264 - RNA, 22 nt, Human
ccagcaaguaagucagugucag

SEQ ID NO: 120265 - RNA, 22 nt, Human
ccccaggcagcccuccaggagc

SEQ ID NO: 120266 - RNA, 22 nt, Human
ccagcaggagacuagcaacaua

SEQ ID NO: 120267 - RNA, 22 nt, Human
ccagcaucagcucuuggcuggc

SEQ ID NO: 120268 - RNA, 22 nt, Human
cccaggcuggggcuccuccagc

SEQ ID NO: 120269 - RNA, 22 nt, Human
cccagggguugaggccguaggg

SEQ ID NO: 120270 - RNA, 22 nt, Human
cccagcgccugcccuccgccgc

SEQ ID NO: 120271 - RNA, 22 nt, Human
uuuuucuccauuccaggugccu

SEQ ID NO: 120272 - RNA, 23 nt, Human
gaugauggcaacuacauccggug

SEQ ID NO: 120273 - RNA, 22 nt, Human
gagauccccagugugucucggc

SEQ ID NO: 120274 - RNA, 22 nt, Human
gagcccgugugugugugugugu

SEQ ID NO: 120275 - RNA, 22 nt, Human
gauggacgguuuuaccagacag

SEQ ID NO: 120276 - RNA, 22 nt, Human
gagaggacaggauccggagggc

SEQ ID NO: 120277 - RNA, 22 nt, Human
gaugccggggucguagccgugg

SEQ ID NO: 120278 - RNA, 22 nt, Human
gagagaggggaagagaagcucu

SEQ ID NO: 120279 - RNA, 22 nt, Human
gagagcugucagcguagcaccg

SEQ ID NO: 120280 - RNA, 22 nt, Human
gagcagcaggccagguugcagg

SEQ ID NO: 120281 - RNA, 22 nt, Human
gaugucccuggaggggacagga

SEQ ID NO: 120282 - RNA, 22 nt, Human
gaugugugugcccugggccugc

SEQ ID NO: 120283 - RNA, 22 nt, Human
gagcagacugcacaguucuugc

SEQ ID NO: 120284 - RNA, 22 nt, Human
gagcagcacagaccaaacagaa

SEQ ID NO: 120285 - RNA, 22 nt, Human
gaugguggggggcagcugggag

SEQ ID NO: 120286 - RNA, 22 nt, Human
gaugguggaggaaucgcugaag

SEQ ID NO: 120287 - RNA, 22 nt, Human
gagauggauuuuuuugccaguc

SEQ ID NO: 120288 - RNA, 22 nt, Human
gagcuggagaaacacauaagaa

SEQ ID NO: 120289 - RNA, 22 nt, Human
gagcggcggugagaaguguggg

SEQ ID NO: 120290 - RNA, 18 nt, Human
gagcucuucccuuuucuc

SEQ ID NO: 120291 - RNA, 21 nt, Human
gcaaccagaccacagggcagu

SEQ ID NO: 120292 - RNA, 22 nt, Human
gagccggggcucccugaggucc

SEQ ID NO: 120293 - RNA, 22 nt, Human
gagcgcacagaaggaagcagcc

SEQ ID NO: 120294 - RNA, 22 nt, Human
gagcgcgcaaucucuccagcug

SEQ ID NO: 120295 - RNA, 22 nt, Human
gagccuguuaggcaccuguguu

SEQ ID NO: 120296 - RNA, 22 nt, Human
gagcgacucuuuuaguccagag

SEQ ID NO: 120297 - RNA, 22 nt, Human
gauugcugccagcguguccgug

SEQ ID NO: 120298 - RNA, 22 nt, Human
gagcccuguagcaagucauguc

SEQ ID NO: 120299 - RNA, 22 nt, Human
gagccgcagcugcguagggucc

SEQ ID NO: 120300 - RNA, 22 nt, Human
gagcagucuuugaaaggcacca

SEQ ID NO: 120301 - RNA, 22 nt, Human
gauguuggugcauucacuucug

SEQ ID NO: 120302 - RNA, 22 nt, Human
gagcagguuauuagaaauggaa

SEQ ID NO: 120303 - RNA, 22 nt, Human
gagcaggucucaguucugccuc

SEQ ID NO: 120304 - RNA, 22 nt, Human
gagcaugacgcaacaccaagug

SEQ ID NO: 120305 - RNA, 22 nt, Human
gagccaugagauaagagcaccu

SEQ ID NO: 120306 - RNA, 22 nt, Human
gaggagacaguggagccgcuac

SEQ ID NO: 120307 - RNA, 22 nt, Human
gaggagcaggcaggaucugguc

SEQ ID NO: 120308 - RNA, 22 nt, Human
gaggagaaacagccgugauagu

SEQ ID NO: 120309 - RNA, 22 nt, Human
gcaaggaagcagaguugcuauc

SEQ ID NO: 120310 - RNA, 22 nt, Human
gaggaggagacggaggccuggg

SEQ ID NO: 120311 - RNA, 22 nt, Human
gaggagcugggucagggagaca

SEQ ID NO: 120312 - RNA, 22 nt, Human
gcacaggcugcacgaccccagc

SEQ ID NO: 120313 - RNA, 22 nt, Human
gcacagauaaucugccuuacca

SEQ ID NO: 120314 - RNA, 19 nt, Human
gcacacccugcaccaccau

SEQ ID NO: 120315 - RNA, 23 nt, Human
gcacuguuugaggagcacugugc

SEQ ID NO: 120316 - RNA, 22 nt, Human
gcagaaguauuguacgguggga

SEQ ID NO: 120317 - RNA, 22 nt, Human
gaggcuccgccggggcgggccg

SEQ ID NO: 120318 - RNA, 22 nt, Human
gaggcggcgacgcgggcccggg

SEQ ID NO: 120319 - RNA, 22 nt, Human
gaggcggugguggcgagaguca

SEQ ID NO: 120320 - RNA, 22 nt, Human
gcacugagacuuuagauuggag

SEQ ID NO: 120321 - RNA, 22 nt, Human
gcacucugggucaucugcugcc

SEQ ID NO: 120322 - RNA, 23 nt, Human
gcacuccgagggcacgugucucu

SEQ ID NO: 120323 - RNA, 22 nt, Human
gaggaugacaaagaaggcagac

SEQ ID NO: 120324 - RNA, 22 nt, Human
gaggcagaggaaacagcucauu

SEQ ID NO: 120325 - RNA, 22 nt, Human
gcaccacccaaaggcggggcuc

SEQ ID NO: 120326 - RNA, 22 nt, Human
gaggcaggcggggcccaggugg

SEQ ID NO: 120327 - RNA, 22 nt, Human
gaggccauguggcccgggcugc

SEQ ID NO: 120328 - RNA, 22 nt, Human
gaggcccugagauugcugcccu

SEQ ID NO: 120329 - RNA, 22 nt, Human
gaggccuucauuucuccgucug

SEQ ID NO: 120330 - RNA, 22 nt, Human
gcaccgagaaggaagcaugccu

SEQ ID NO: 120331 - RNA, 22 nt, Human
gcacggucagggugggggagug

SEQ ID NO: 120332 - RNA, 22 nt, Human
gcagcucagcacgcacagguaa

SEQ ID NO: 120333 - RNA, 22 nt, Human
gcaggaagauugcagaaggcug

SEQ ID NO: 120334 - RNA, 22 nt, Human
gcaggcaggauucagagauaca

SEQ ID NO: 120335 - RNA, 22 nt, Human
gaggugauuccucccauguaau

SEQ ID NO: 120336 - RNA, 22 nt, Human
gaggucggaagugaggguaacu

SEQ ID NO: 120337 - RNA, 22 nt, Human
gaggguuucagugggacggguu

SEQ ID NO: 120338 - RNA, 23 nt, Human
gcagccaacccacgugagagaag

SEQ ID NO: 120339 - RNA, 22 nt, Human
gaggggacugucuggcuccgag

SEQ ID NO: 120340 - RNA, 22 nt, Human
gaggggcacaguggggccuggg

SEQ ID NO: 120341 - RNA, 22 nt, Human
gcagaggcugccgugggcagga

SEQ ID NO: 120342 - RNA, 22 nt, Human
gcagagcugucuaagucacuuc

SEQ ID NO: 120343 - RNA, 22 nt, Human
gagggcucaacuacuacuaggc

SEQ ID NO: 120344 - RNA, 22 nt, Human
gagggagugggcccgugggcac

SEQ ID NO: 120345 - RNA, 22 nt, Human
gcagaggcaaagucuggaugac

SEQ ID NO: 120346 - RNA, 22 nt, Human
gagggggaaaagggcagcagag

SEQ ID NO: 120347 - RNA, 22 nt, Human
gaggggcucuugggcaugaagg

SEQ ID NO: 120348 - RNA, 22 nt, Human
gaggguggagccuccuggaagu

SEQ ID NO: 120349 - RNA, 22 nt, Human
gagggguuguuaacaaagaaua

SEQ ID NO: 120350 - RNA, 22 nt, Human
gaggggcuccagguguugagga

SEQ ID NO: 120351 - RNA, 22 nt, Human
gaggggcggggcgggaggagag

SEQ ID NO: 120352 - RNA, 22 nt, Human
gcauuucauaaccagccaugcu

SEQ ID NO: 120353 - RNA, 22 nt, Human
gauauuuugugaaaaaacaacu

SEQ ID NO: 120354 - RNA, 22 nt, Human
gaugaaguaguccacuggaagg

SEQ ID NO: 120355 - RNA, 22 nt, Human
gccaugguggggccucccugac

SEQ ID NO: 120356 - RNA, 22 nt, Human
gccauguucuugaaucuggguc

SEQ ID NO: 120357 - RNA, 22 nt, Human
gaugcucuugauuggaccaggg

SEQ ID NO: 120358 - RNA, 22 nt, Human
gcccguuuagcaaacgccuccu

SEQ ID NO: 120359 - RNA, 20 nt, Human
gcccacccgcacucccgccg

SEQ ID NO: 120360 - RNA, 22 nt, Human
gcccgccaacuugccagcggug

SEQ ID NO: 120361 - RNA, 22 nt, Human
gcccagccucagggcaucagcu

SEQ ID NO: 120362 - RNA, 23 nt, Human
gcccagaggccccuggccugagc

SEQ ID NO: 120363 - RNA, 22 nt, Human
gcaugguuuccugcaacguucu

SEQ ID NO: 120364 - RNA, 22 nt, Human
gaguuggggcugcguguuucca

SEQ ID NO: 120365 - RNA, 20 nt, Human
gcauggcuggcugcugucug

SEQ ID NO: 120366 - RNA, 22 nt, Human
gaggugggaggcgggccugcau

SEQ ID NO: 120367 - RNA, 20 nt, Human
gagguugcucagaguggggu

SEQ ID NO: 120368 - RNA, 22 nt, Human
gcaggccgauuuguuagaaguc

SEQ ID NO: 120369 - RNA, 22 nt, Human
gccucaaaaguguuguagaggg

SEQ ID NO: 120370 - RNA, 22 nt, Human
gccuccggagucgcagugucuu

SEQ ID NO: 120371 - RNA, 22 nt, Human
gccuccuccaucauugcuucau

SEQ ID NO: 120372 - RNA, 22 nt, Human
gccucucagagcuguucaguuu

SEQ ID NO: 120373 - RNA, 22 nt, Human
gcaaaaacaguguagucuucug

SEQ ID NO: 120374 - RNA, 22 nt, Human
gcaacuccuaggcgaggccuuc

SEQ ID NO: 120375 - RNA, 22 nt, Human
gccuucgauaugaggguuugcc

SEQ ID NO: 120376 - RNA, 22 nt, Human
gccuucccuccucugcucucag

SEQ ID NO: 120377 - RNA, 22 nt, Human
gccugggugcugugggguggag

SEQ ID NO: 120378 - RNA, 22 nt, Human
gccuggggaacuugauccuguc

SEQ ID NO: 120379 - RNA, 22 nt, Human
gccugggccgggcgcggccccc

SEQ ID NO: 120380 - RNA, 20 nt, Human
gccugggagaagaucaggga

SEQ ID NO: 120381 - RNA, 22 nt, Human
gccugagucaagauguggcacc

SEQ ID NO: 120382 - RNA, 22 nt, Human
gccuggccaaucgccgucuagg

SEQ ID NO: 120383 - RNA, 22 nt, Human
gccuggaaugcaaugugacgaa

SEQ ID NO: 120384 - RNA, 22 nt, Human
gcccugaaggccuccaggacuc

SEQ ID NO: 120385 - RNA, 22 nt, Human
gccgcagauucugagacgugua

SEQ ID NO: 120386 - RNA, 22 nt, Human
gcccuuuuaucaacuccuagaa

SEQ ID NO: 120387 - RNA, 22 nt, Human
gauuccuuucgccugccgagcu

SEQ ID NO: 120388 - RNA, 15 nt, Human
gccgcgcuggggagc

SEQ ID NO: 120389 - RNA, 22 nt, Human
gccgccgcucaccugggcgccg

SEQ ID NO: 120390 - RNA, 22 nt, Human
gccggcugggggcggagggcag

SEQ ID NO: 120391 - RNA, 22 nt, Human
gccggagagccaacaccacgga

SEQ ID NO: 120392 - RNA, 22 nt, Human
gccggguguuccugggaagaug

SEQ ID NO: 120393 - RNA, 21 nt, Human
gccgugcgccuccaggcgcgc

SEQ ID NO: 120394 - RNA, 22 nt, Human
gcccagaagguagcgaguaguc

SEQ ID NO: 120395 - RNA, 22 nt, Human
gcccagacaucuguugggaccu

SEQ ID NO: 120396 - RNA, 22 nt, Human
gccauggugagccaccuggugg

SEQ ID NO: 120397 - RNA, 22 nt, Human
gcuggauuuaggguucccuccu

SEQ ID NO: 120398 - RNA, 22 nt, Human
gcuggaugucugugccaggcac

SEQ ID NO: 120399 - RNA, 22 nt, Human
gccaucuucggcagccgccugg

SEQ ID NO: 120400 - RNA, 22 nt, Human
gccaguggucagugggagggug

SEQ ID NO: 120401 - RNA, 22 nt, Human
gcugcuggcggagcuggcgcug

SEQ ID NO: 120402 - RNA, 22 nt, Human
gcugcuacagagcuggaggggg

SEQ ID NO: 120403 - RNA, 22 nt, Human
gcugcucaaaaaaacacuagcu

SEQ ID NO: 120404 - RNA, 22 nt, Human
gccaggagaaaaggcgaaugau

SEQ ID NO: 120405 - RNA, 22 nt, Human
gccagggcucgagcaggccagc

SEQ ID NO: 120406 - RNA, 22 nt, Human
gcugcuucgcugcacacccgag

SEQ ID NO: 120407 - RNA, 22 nt, Human
gccagucgucuuuauuacagcu

SEQ ID NO: 120408 - RNA, 22 nt, Human
gcugagcagaacaauuagaaau

SEQ ID NO: 120409 - RNA, 22 nt, Human
gcugagcaaugcacugccgcau

SEQ ID NO: 120410 - RNA, 22 nt, Human
gcugagaguguaggauguuuac

SEQ ID NO: 120411 - RNA, 22 nt, Human
gcucuggcuacuguggcuaccg

SEQ ID NO: 120412 - RNA, 22 nt, Human
gccaaccagucgguccaggaag

SEQ ID NO: 120413 - RNA, 20 nt, Human
gccaaggaggagaaacaggc

SEQ ID NO: 120414 - RNA, 20 nt, Human
gccaccucugcucuuucccg

SEQ ID NO: 120415 - RNA, 22 nt, Human
gcugcagggagcuggaaggcuc

SEQ ID NO: 120416 - RNA, 23 nt, Human
gcugcagugaauguuguuguugu

SEQ ID NO: 120417 - RNA, 22 nt, Human
gcugcccauugcucucccacuc

SEQ ID NO: 120418 - RNA, 22 nt, Human
gcugcccucccagggcaagcuu

SEQ ID NO: 120419 - RNA, 22 nt, Human
gccagcuuagaucccccagccc

SEQ ID NO: 120420 - RNA, 22 nt, Human
gccagccggugaguggaagcgg

SEQ ID NO: 120421 - RNA, 18 nt, Human
gccagcccuccaaccucc

SEQ ID NO: 120422 - RNA, 23 nt, Human
gcugccguuucccaucgugguga

SEQ ID NO: 120423 - RNA, 22 nt, Human
gcugcgccgggagccggggccg

SEQ ID NO: 120424 - RNA, 22 nt, Human
gccacucaguuuaggggcaagc

SEQ ID NO: 120425 - RNA, 22 nt, Human
gcugccuugaacuuggccuggg

SEQ ID NO: 120426 - RNA, 22 nt, Human
gcucaagaccaagggagcgggg

SEQ ID NO: 120427 - RNA, 23 nt, Human
gcucuccaucacaugguguggca

SEQ ID NO: 120428 - RNA, 22 nt, Human
gcuccggggguuccagaucauc

SEQ ID NO: 120429 - RNA, 17 nt, Human
gcuaguuguuuccagua

SEQ ID NO: 120430 - RNA, 22 nt, Human
gcaguugguccagccucggcug

SEQ ID NO: 120431 - RNA, 22 nt, Human
gcuacaacugugucuguggggc

SEQ ID NO: 120432 - RNA, 22 nt, Human
gcgugugugauaugccucugca

SEQ ID NO: 120433 - RNA, 22 nt, Human
gcgugcauguguguaugcgugu

SEQ ID NO: 120434 - RNA, 22 nt, Human
gcggcgucccagcuccgacggc

SEQ ID NO: 120435 - RNA, 19 nt, Human
gcggcggugccggcuggga

SEQ ID NO: 120436 - RNA, 22 nt, Human
gcagcguguggcuaauggcucu

SEQ ID NO: 120437 - RNA, 22 nt, Human
gcgguuguucugugugcaugga

SEQ ID NO: 120438 - RNA, 22 nt, Human
gcggguggaggagggacgggca

SEQ ID NO: 120439 - RNA, 22 nt, Human
gcgggugagauucgagagaugg

SEQ ID NO: 120440 - RNA, 22 nt, Human
gcgguggcuacuaaaguucgaa

SEQ ID NO: 120441 - RNA, 22 nt, Human
gcagccaauggcgagccccaca

SEQ ID NO: 120442 - RNA, 22 nt, Human
gcggagaggcagagacuccgcg

SEQ ID NO: 120443 - RNA, 22 nt, Human
gcgauugguuuggggccagagu

SEQ ID NO: 120444 - RNA, 22 nt, Human
gcagccauggcuggccgggcau

SEQ ID NO: 120445 - RNA, 22 nt, Human
gcagccuccggccuggcccccu

SEQ ID NO: 120446 - RNA, 22 nt, Human
gcagccugaguuuagcucgucg

SEQ ID NO: 120447 - RNA, 22 nt, Human
gcggccucuuugcugccucagg

SEQ ID NO: 120448 - RNA, 22 nt, Human
gcggcaguccuuccaguacagg

SEQ ID NO: 120449 - RNA, 22 nt, Human
gcagcgcugagaugauuuguug

SEQ ID NO: 120450 - RNA, 22 nt, Human
ggggcaucguugauugcauggu

SEQ ID NO: 120451 - RNA, 22 nt, Human
ggggccaaggcaaacuugaggg

SEQ ID NO: 120452 - RNA, 22 nt, Human
ggagaccagaaggaagcuucga

SEQ ID NO: 120453 - RNA, 22 nt, Human
ggagaccaauuaaugaaggaau

SEQ ID NO: 120454 - RNA, 22 nt, Human
ggagagcguggaugggcuucca

SEQ ID NO: 120455 - RNA, 22 nt, Human
ggagagcuagugagcuggaggu

SEQ ID NO: 120456 - RNA, 22 nt, Human
ggagacagauggcgucucaguu

SEQ ID NO: 120457 - RNA, 22 nt, Human
ggggacggcuggccggggcccc

SEQ ID NO: 120458 - RNA, 22 nt, Human
ggggacugccgacagucucaaa

SEQ ID NO: 120459 - RNA, 22 nt, Human
gggcugaugcuuauacauacug

SEQ ID NO: 120460 - RNA, 22 nt, Human
gggcuggggcucuggggcuagg

SEQ ID NO: 120461 - RNA, 22 nt, Human
gggcuguggggccugcagaagg

SEQ ID NO: 120462 - RNA, 22 nt, Human
ggaccagagcuaaugcgcgccc

SEQ ID NO: 120463 - RNA, 22 nt, Human
gggcugagagcuggaaucugag

SEQ ID NO: 120464 - RNA, 22 nt, Human
gggcugcuccgcccgcugcgcc

SEQ ID NO: 120465 - RNA, 22 nt, Human
ggggccaugauggacgagguga

SEQ ID NO: 120466 - RNA, 22 nt, Human
ggagaucuuggacuggccggcc

SEQ ID NO: 120467 - RNA, 22 nt, Human
ggggccgggccggcagacuggg

SEQ ID NO: 120468 - RNA, 22 nt, Human
ggggcggcgugggcgcggugau

SEQ ID NO: 120469 - RNA, 22 nt, Human
ggggcguugccacggggacggg

SEQ ID NO: 120470 - RNA, 22 nt, Human
gggguguuagucuuacccagag

SEQ ID NO: 120471 - RNA, 22 nt, Human
ggggugggcuggguguccaagg

SEQ ID NO: 120472 - RNA, 22 nt, Human
gggguacgaugguggggggcga

SEQ ID NO: 120473 - RNA, 22 nt, Human
ggggugugcugggagaagggau

SEQ ID NO: 120474 - RNA, 22 nt, Human
gggucggcacucuggcagcacc

SEQ ID NO: 120475 - RNA, 22 nt, Human
gggugguuccuggaucugacug

SEQ ID NO: 120476 - RNA, 22 nt, Human
ggaguguuagacuaaauuggga

SEQ ID NO: 120477 - RNA, 19 nt, Human
ggaguugccaggagaagga

SEQ ID NO: 120478 - RNA, 20 nt, Human
gggcucugcauccaucagcc

SEQ ID NO: 120479 - RNA, 22 nt, Human
ggacagggagcaaaaacguccc

SEQ ID NO: 120480 - RNA, 18 nt, Human
ggacaguuguagaggacu

SEQ ID NO: 120481 - RNA, 22 nt, Human
ggacagagcaacccuacgcagc

SEQ ID NO: 120482 - RNA, 22 nt, Human
ggacagacuuuacagccccggg

SEQ ID NO: 120483 - RNA, 22 nt, Human
gggcggggcucacggugcggca

SEQ ID NO: 120484 - RNA, 22 nt, Human
gggcggugccugucuccgaagc

SEQ ID NO: 120485 - RNA, 22 nt, Human
gggcggggcuuccguccuccac

SEQ ID NO: 120486 - RNA, 22 nt, Human
gggcggcguccucagucgggug

SEQ ID NO: 120487 - RNA, 22 nt, Human
gggcgcuguguuaggugcugua

SEQ ID NO: 120488 - RNA, 22 nt, Human
gggcgcgcggagccucgccggg

SEQ ID NO: 120489 - RNA, 22 nt, Human
ggaagcuguugugagugcagca

SEQ ID NO: 120490 - RNA, 20 nt, Human
ggaacccuagacuugcgcag

SEQ ID NO: 120491 - RNA, 22 nt, Human
gggcaggggcagugguggcauu

SEQ ID NO: 120492 - RNA, 22 nt, Human
gggcaugcagcaauucuguggu

SEQ ID NO: 120493 - RNA, 22 nt, Human
gggcaugugauggacgugugcc

SEQ ID NO: 120494 - RNA, 18 nt, Human
ggaaggugcuggagugca

SEQ ID NO: 120495 - RNA, 22 nt, Human
gggccaaggggagcuggaaggg

SEQ ID NO: 120496 - RNA, 22 nt, Human
gggcgccgggagugagagugag

SEQ ID NO: 120497 - RNA, 22 nt, Human
gggcgcgccaggagcugcgcgg

SEQ ID NO: 120498 - RNA, 22 nt, Human
ggaaaagccauauuauaggcaa

SEQ ID NO: 120499 - RNA, 22 nt, Human
gggagggggauucuggcgagaa

SEQ ID NO: 120500 - RNA, 22 nt, Human
gggaggucgaggcugggccgca

SEQ ID NO: 120501 - RNA, 22 nt, Human
gggcaagagaggaagagauggc

SEQ ID NO: 120502 - RNA, 22 nt, Human
gggcaagaggguuugacaugag

SEQ ID NO: 120503 - RNA, 22 nt, Human
gggagggaggagccccggccau

SEQ ID NO: 120504 - RNA, 22 nt, Human
gggagcuggagcuggaagacuc

SEQ ID NO: 120505 - RNA, 22 nt, Human
gcuguggaaaaugggucuccaa

SEQ ID NO: 120506 - RNA, 22 nt, Human
ggugucaucugggcuggagaua

SEQ ID NO: 120507 - RNA, 22 nt, Human
ggccagcgugggggaguagcgg

SEQ ID NO: 120508 - RNA, 22 nt, Human
ggccagcuuugagcugcaggaa

SEQ ID NO: 120509 - RNA, 22 nt, Human
ggccgccacacagauucccccg

SEQ ID NO: 120510 - RNA, 22 nt, Human
gguugcggaccagcugggcugc

SEQ ID NO: 120511 - RNA, 22 nt, Human
gguugauuuuuaugaagccaug

SEQ ID NO: 120512 - RNA, 22 nt, Human
guacugguuuucuuacucuggc

SEQ ID NO: 120513 - RNA, 22 nt, Human
guaggugggcuuccaagguccu

SEQ ID NO: 120514 - RNA, 22 nt, Human
guagguggaggcaacacagcca

SEQ ID NO: 120515 - RNA, 22 nt, Human
guagggguggggagguggucug

SEQ ID NO: 120516 - RNA, 22 nt, Human
ggccgggugggaggcagcggag

SEQ ID NO: 120517 - RNA, 18 nt, Human
ggccucagccuggccgga

SEQ ID NO: 120518 - RNA, 22 nt, Human
ggccuggcacauaguaggcagu

SEQ ID NO: 120519 - RNA, 22 nt, Human
ggccugcuaccagcugugaccu

SEQ ID NO: 120520 - RNA, 22 nt, Human
ggugggaauccaggccuucauc

SEQ ID NO: 120521 - RNA, 22 nt, Human
ggugcugcugcugaacccagcu

SEQ ID NO: 120522 - RNA, 22 nt, Human
ggcagugguaggagcccaggag

SEQ ID NO: 120523 - RNA, 22 nt, Human
ggugggccaaauuaaacauaua

SEQ ID NO: 120524 - RNA, 22 nt, Human
gguggggugagggggcgaggcc

SEQ ID NO: 120525 - RNA, 22 nt, Human
gguggggacuuggggucagcgg

SEQ ID NO: 120526 - RNA, 19 nt, Human
ggugggacaggugagauau

SEQ ID NO: 120527 - RNA, 22 nt, Human
gguguacgaagaggcgggaguc

SEQ ID NO: 120528 - RNA, 22 nt, Human
ggugacuucugaaccuggagug

SEQ ID NO: 120529 - RNA, 22 nt, Human
ggugguucagugguuagggcca

SEQ ID NO: 120530 - RNA, 22 nt, Human
ggcaggauggagcagggcuaaa

SEQ ID NO: 120531 - RNA, 22 nt, Human
ggcagggagagcgccgccaugc

SEQ ID NO: 120532 - RNA, 22 nt, Human
ggcagguccugaguccugaggc

SEQ ID NO: 120533 - RNA, 22 nt, Human
ggcagcagaacuggcccuguau

SEQ ID NO: 120534 - RNA, 22 nt, Human
ggcagcagaaccaacuguggcu

SEQ ID NO: 120535 - RNA, 22 nt, Human
ggcaaagaguacaucguccugg

SEQ ID NO: 120536 - RNA, 22 nt, Human
ggcaccuuucaucccaucuaga

SEQ ID NO: 120537 - RNA, 22 nt, Human
ggcaagcacugggugucuuagc

SEQ ID NO: 120538 - RNA, 22 nt, Human
ggucuucauaugccacagaguc

SEQ ID NO: 120539 - RNA, 22 nt, Human
ggucuuccuugggggacuugaa

SEQ ID NO: 120540 - RNA, 22 nt, Human
ggucugcgauggcaagggucuu

SEQ ID NO: 120541 - RNA, 22 nt, Human
ggucugagcaaguuaccauggg

SEQ ID NO: 120542 - RNA, 22 nt, Human
ggucuagcucggugcuggcgac

SEQ ID NO: 120543 - RNA, 22 nt, Human
ggguguggaggugacacauuug

SEQ ID NO: 120544 - RNA, 22 nt, Human
ggguguuuuuggugacagggag

SEQ ID NO: 120545 - RNA, 22 nt, Human
gguacgagcccugccuaguguc

SEQ ID NO: 120546 - RNA, 22 nt, Human
ggcuggggccuguugaagaugc

SEQ ID NO: 120547 - RNA, 18 nt, Human
ggcugggcugugccccuu

SEQ ID NO: 120548 - RNA, 22 nt, Human
ggcugguggcgggcagcacaga

SEQ ID NO: 120549 - RNA, 22 nt, Human
ggcugggaggcggaggcugaga

SEQ ID NO: 120550 - RNA, 22 nt, Human
ggcugggagguggcgaggaggc

SEQ ID NO: 120551 - RNA, 22 nt, Human
gcugguuacuucauuagguccu

SEQ ID NO: 120552 - RNA, 22 nt, Human
gcuggggaucgaaggcagagcc

SEQ ID NO: 120553 - RNA, 22 nt, Human
gcugguggcagagcuccgcggc

SEQ ID NO: 120554 - RNA, 22 nt, Human
gcuggucuggcaauccucaugg

SEQ ID NO: 120555 - RNA, 20 nt, Human
gcugugccaugacccucgag

SEQ ID NO: 120556 - RNA, 22 nt, Human
ggcuucucuuggccaugguccc

SEQ ID NO: 120557 - RNA, 22 nt, Human
gcugucccccaaagaugcuccu

SEQ ID NO: 120558 - RNA, 22 nt, Human
ggcugugggguccuguggugug

SEQ ID NO: 120559 - RNA, 22 nt, Human
gcugucaggaacaugccuuggu

SEQ ID NO: 120560 - RNA, 18 nt, Human
gcuguccgguagcuggug

SEQ ID NO: 120561 - RNA, 22 nt, Human
gcugucauggacaugucuguuu

SEQ ID NO: 120562 - RNA, 22 nt, Human
gcugugacaagaggcugcuucu

SEQ ID NO: 120563 - RNA, 22 nt, Human
gcuggaagggccagcuuucagg

SEQ ID NO: 120564 - RNA, 22 nt, Human
ggcucacuguaccugccgccgc

SEQ ID NO: 120565 - RNA, 22 nt, Human
ggcucccccauggcugacagac

SEQ ID NO: 120566 - RNA, 22 nt, Human
ggcugaggccucuggggaggga

SEQ ID NO: 120567 - RNA, 22 nt, Human
ggcugaugacgccugagucuga

SEQ ID NO: 120568 - RNA, 22 nt, Human
ggcugcuugauagauaugagua

SEQ ID NO: 120569 - RNA, 22 nt, Human
ggcugcuauuggucuggcuugg

SEQ ID NO: 120570 - RNA, 22 nt, Human
ggcugcuggaguugggucucuc

SEQ ID NO: 120571 - RNA, 22 nt, Human
ggcugcugcccaccccugcaug

SEQ ID NO: 120572 - RNA, 21 nt, Human
ggcugcucgugaugaacuuca

SEQ ID NO: 120573 - RNA, 22 nt, Human
ggcugcagggaacaggaugggu

SEQ ID NO: 120574 - RNA, 22 nt, Human
ggcugcagugcaacucuuucua

SEQ ID NO: 120575 - RNA, 21 nt, Human
gcuggcugucucuuacacggu

SEQ ID NO: 120576 - RNA, 22 nt, Human
gcugggacacacagucuucuuu

SEQ ID NO: 120577 - RNA, 22 nt, Human
gcugggagaggcagcuuucgga

SEQ ID NO: 120578 - RNA, 22 nt, Human
gcugggagucgcgucuguggcc

SEQ ID NO: 120579 - RNA, 22 nt, Human
gcuggcggguuggggaggcgga

SEQ ID NO: 120580 - RNA, 22 nt, Human
gcuggcgauggccgagucuccg

SEQ ID NO: 120581 - RNA, 22 nt, Human
gcuggccugcgagggcaggcug

SEQ ID NO: 120582 - RNA, 20 nt, Human
gcucuucuccgggucugccu

SEQ ID NO: 120583 - RNA, 22 nt, Human
gcucccaguucccaaagugacc

SEQ ID NO: 120584 - RNA, 21 nt, Human
gcucccgaagugcucggcguu

SEQ ID NO: 120585 - RNA, 22 nt, Human
gcugccgcugcggggcgcgggc

SEQ ID NO: 120586 - RNA, 22 nt, Human
gcugcacgguccuggcaccacg

SEQ ID NO: 120587 - RNA, 22 nt, Human
gcugcaggaggugguagggucu

SEQ ID NO: 120588 - RNA, 22 nt, Human
ggcccuggggcaggagcagagg

SEQ ID NO: 120589 - RNA, 22 nt, Human
ggcccugcuuccccaguguaca

SEQ ID NO: 120590 - RNA, 22 nt, Human
ggccgccacuuuccagugcugc

SEQ ID NO: 120591 - RNA, 22 nt, Human
ggccgccgcuuagcugagcccc

SEQ ID NO: 120592 - RNA, 22 nt, Human
ggccccggaggccguuagcuua

SEQ ID NO: 120593 - RNA, 22 nt, Human
ggcccucucuacauguuagacg

SEQ ID NO: 120594 - RNA, 22 nt, Human
ggccuggccuccugcuuuucca

SEQ ID NO: 120595 - RNA, 22 nt, Human
ggccugcucuggcuguggucag

SEQ ID NO: 120596 - RNA, 22 nt, Human
ggccgggcaugcgagcugagcg

SEQ ID NO: 120597 - RNA, 20 nt, Human
ggccugagcauggcuggcag

SEQ ID NO: 120598 - RNA, 22 nt, Human
ggccugagaagcaaggacacaa

SEQ ID NO: 120599 - RNA, 22 nt, Human
ggcgggggagccaggaacccag

SEQ ID NO: 120600 - RNA, 22 nt, Human
ggcgggucuagggcccuggagu

SEQ ID NO: 120601 - RNA, 22 nt, Human
ggcguccuccucgucugaggcg

SEQ ID NO: 120602 - RNA, 22 nt, Human
ggcgucuugcgggcgguagcgc

SEQ ID NO: 120603 - RNA, 22 nt, Human
ggcggcaagggaauggagaaga

SEQ ID NO: 120604 - RNA, 22 nt, Human
ggcggaggucacgcacccgcca

SEQ ID NO: 120605 - RNA, 22 nt, Human
ggcgcccucccuguccgucuuc

SEQ ID NO: 120606 - RNA, 22 nt, Human
ggcgcuccccgccugcgucgcg

SEQ ID NO: 120607 - RNA, 22 nt, Human
ggcgccugguauucuuccucuc

SEQ ID NO: 120608 - RNA, 22 nt, Human
ggcgccuuguggaaugagagcu

SEQ ID NO: 120609 - RNA, 22 nt, Human
ggcgccauuuuugccuucggag

SEQ ID NO: 120610 - RNA, 22 nt, Human
ggccuucuuuucaugucuuucg

SEQ ID NO: 120611 - RNA, 22 nt, Human
ggcgacuacugaaugcuugaaa

SEQ ID NO: 120612 - RNA, 22 nt, Human
ggccuugauuccggucauugaa

SEQ ID NO: 120613 - RNA, 22 nt, Human
ggcgaugaggucuuagaaucua

SEQ ID NO: 120614 - RNA, 22 nt, Human
gcugcuggcuuccugcuguuuu

SEQ ID NO: 120615 - RNA, 22 nt, Human
gcugcgcugggacgccaccaac

SEQ ID NO: 120616 - RNA, 22 nt, Human
gcugcgcgcagccggcgccgag

SEQ ID NO: 120617 - RNA, 22 nt, Human
gcggcccggguccccagcagca

SEQ ID NO: 120618 - RNA, 22 nt, Human
gcggcggcggaggcgggggcag

SEQ ID NO: 120619 - RNA, 22 nt, Human
ggauggugauguacccagucau

SEQ ID NO: 120620 - RNA, 19 nt, Human
gcgggcucuccaccccauc

SEQ ID NO: 120621 - RNA, 22 nt, Human
gcgggccggcaggggaggaguu

SEQ ID NO: 120622 - RNA, 22 nt, Human
gcggcuggcuguccaaacuggg

SEQ ID NO: 120623 - RNA, 22 nt, Human
ggaucaccagguuuguuguugg

SEQ ID NO: 120624 - RNA, 22 nt, Human
ggaucagcgagaagggcugaaa

SEQ ID NO: 120625 - RNA, 22 nt, Human
ggaucccaucgagcuggcuguc

SEQ ID NO: 120626 - RNA, 22 nt, Human
ggagcaucuaccauuucuagau

SEQ ID NO: 120627 - RNA, 22 nt, Human
ggagccuggaguuucugauggg

SEQ ID NO: 120628 - RNA, 22 nt, Human
gcucccagcuuuuguccacggc

SEQ ID NO: 120629 - RNA, 18 nt, Human
ggcagggcucagcugcuc

SEQ ID NO: 120630 - RNA, 22 nt, Human
ggcagggagagcaugcugauaa

SEQ ID NO: 120631 - RNA, 22 nt, Human
ggcagaggaagcuggaaguggg

SEQ ID NO: 120632 - RNA, 22 nt, Human
ggcagaggagcuggaaacaugg

SEQ ID NO: 120633 - RNA, 22 nt, Human
gcggggggcucgggcagcucgg

SEQ ID NO: 120634 - RNA, 22 nt, Human
gcggggcucuacuuggccugga

SEQ ID NO: 120635 - RNA, 22 nt, Human
ggcagagguagcuggaaccagg

SEQ ID NO: 120636 - RNA, 22 nt, Human
gcgggcuuggcuccagggccca

SEQ ID NO: 120637 - RNA, 22 nt, Human
ggcaggaaguaaggaugcuaca

SEQ ID NO: 120638 - RNA, 22 nt, Human
gcgguguuuuaacacucccucg

SEQ ID NO: 120639 - RNA, 22 nt, Human
ggagaucucauugauacugaua

SEQ ID NO: 120640 - RNA, 21 nt, Human
gcgcgcucgugcucgacgcgc

SEQ ID NO: 120641 - RNA, 22 nt, Human
gcgccgacccucccugccggac

SEQ ID NO: 120642 - RNA, 22 nt, Human
ggagaaacuaguuagauccaau

SEQ ID NO: 120643 - RNA, 22 nt, Human
ggagaggaggugagaggaagua

SEQ ID NO: 120644 - RNA, 22 nt, Human
ggacagacagcauggaaccaua

SEQ ID NO: 120645 - RNA, 22 nt, Human
gccuuucuugguuugucaggca

SEQ ID NO: 120646 - RNA, 21 nt, Human
ggacucguucgccgugccagc

SEQ ID NO: 120647 - RNA, 22 nt, Human
ggacucucaggcugucggcuuc

SEQ ID NO: 120648 - RNA, 22 nt, Human
gcucuccuugcuagagguucua

SEQ ID NO: 120649 - RNA, 20 nt, Human
ggacccuggguucuucugag

SEQ ID NO: 120650 - RNA, 22 nt, Human
ggacggggagcuggaaagggga

SEQ ID NO: 120651 - RNA, 22 nt, Human
ggaaguggauucagggcugcua

SEQ ID NO: 120652 - RNA, 22 nt, Human
gcugggccucuuacuucuuacg

SEQ ID NO: 120653 - RNA, 22 nt, Human
gcuggguaguucuuguuuggga

SEQ ID NO: 120654 - RNA, 22 nt, Human
gcuggguuguucuccuggucca

SEQ ID NO: 120655 - RNA, 22 nt, Human
gcugggucucucccugguccug

SEQ ID NO: 120656 - RNA, 19 nt, Human
gcugggauaggauguauuu

SEQ ID NO: 120657 - RNA, 22 nt, Human
gcccagcucucuggccugucuu

SEQ ID NO: 120658 - RNA, 22 nt, Human
gugcuugcgcauaacuggggcc

SEQ ID NO: 120659 - RNA, 22 nt, Human
ggccuugggauguggcugcagc

SEQ ID NO: 120660 - RNA, 22 nt, Human
guggaagauauuucugguccag

SEQ ID NO: 120661 - RNA, 22 nt, Human
gggcagucagauucgggggccu

SEQ ID NO: 120662 - RNA, 22 nt, Human
gggccaggaugugguucauuuu

SEQ ID NO: 120663 - RNA, 22 nt, Human
gggcccggguaggggaagagag

SEQ ID NO: 120664 - RNA, 22 nt, Human
guggaggguuugcaaugugcag

SEQ ID NO: 120665 - RNA, 19 nt, Human
gggccucacccacaccucc

SEQ ID NO: 120666 - RNA, 22 nt, Human
gggccggagaagguagcugaag

SEQ ID NO: 120667 - RNA, 22 nt, Human
guggacuuuggucugugccauc

SEQ ID NO: 120668 - RNA, 22 nt, Human
guggagaaauauguucagcuuc

SEQ ID NO: 120669 - RNA, 22 nt, Human
guggccaaggcagagaaagagc

SEQ ID NO: 120670 - RNA, 22 nt, Human
guggccugacagaucggaacag

SEQ ID NO: 120671 - RNA, 22 nt, Human
guggcgucgaugauggugucau

SEQ ID NO: 120672 - RNA, 22 nt, Human
guggcuggguggaacugagucu

SEQ ID NO: 120673 - RNA, 22 nt, Human
guggcaguaaagcuggaaaagu

SEQ ID NO: 120674 - RNA, 22 nt, Human
guggcagguguacagcucagcu

SEQ ID NO: 120675 - RNA, 22 nt, Human
gugggagggaguccugggagca

SEQ ID NO: 120676 - RNA, 22 nt, Human
gugggaguggagcucagcaugu

SEQ ID NO: 120677 - RNA, 18 nt, Human
gugggcacacacucuguu

SEQ ID NO: 120678 - RNA, 22 nt, Human
guggggcgggucccccgccugg

SEQ ID NO: 120679 - RNA, 22 nt, Human
gugggggcagaagcgagugcag

SEQ ID NO: 120680 - RNA, 22 nt, Human
gggccuuggaggagaaggacuu

SEQ ID NO: 120681 - RNA, 22 nt, Human
gggccuguccccccaggagaac

SEQ ID NO: 120682 - RNA, 22 nt, Human
gugggugaguggggccgccuga

SEQ ID NO: 120683 - RNA, 22 nt, Human
gugguggugaggcaaggggugu

SEQ ID NO: 120684 - RNA, 22 nt, Human
gugguggggaguuggauggaag

SEQ ID NO: 120685 - RNA, 22 nt, Human
gggcucaaccauagcacaaaga

SEQ ID NO: 120686 - RNA, 22 nt, Human
gggcuagggucagggggccacu

SEQ ID NO: 120687 - RNA, 22 nt, Human
gugguaccaguaggucagccau

SEQ ID NO: 120688 - RNA, 22 nt, Human
guggguuggguuuuugaaggga

SEQ ID NO: 120689 - RNA, 22 nt, Human
gugggugauacugccgugggag

SEQ ID NO: 120690 - RNA, 22 nt, Human
gggcgcaagcaugugucugggu

SEQ ID NO: 120691 - RNA, 22 nt, Human
gggcgagcgucucagccgggcg

SEQ ID NO: 120692 - RNA, 22 nt, Human
guggugaacauuugcaucugcu

SEQ ID NO: 120693 - RNA, 22 nt, Human
gggcggggggagcuggaaugaa

SEQ ID NO: 120694 - RNA, 22 nt, Human
gggcggccugcucuguggggag

SEQ ID NO: 120695 - RNA, 22 nt, Human
ggggaagagagaagaaugaucu

SEQ ID NO: 120696 - RNA, 19 nt, Human
guguucuguuauacaguug

SEQ ID NO: 120697 - RNA, 22 nt, Human
gggcuuguuaacuuggcuucca

SEQ ID NO: 120698 - RNA, 20 nt, Human
gggcuuugagcucagggcuu

SEQ ID NO: 120699 - RNA, 18 nt, Human
gggcuuugggguucuauc

SEQ ID NO: 120700 - RNA, 22 nt, Human
gugugguguuaagcaaauuaau

SEQ ID NO: 120701 - RNA, 22 nt, Human
gugucacuuucaggagcucuaa

SEQ ID NO: 120702 - RNA, 22 nt, Human
guguccuguagaaacuguucca

SEQ ID NO: 120703 - RNA, 22 nt, Human
gggcuggcaguuuucugaguuc

SEQ ID NO: 120704 - RNA, 22 nt, Human
gggugugcuaaaccuacgcaca

SEQ ID NO: 120705 - RNA, 20 nt, Human
ggguugagcguggccccucu

SEQ ID NO: 120706 - RNA, 22 nt, Human
ggguuccuuggaacacuguuug

SEQ ID NO: 120707 - RNA, 22 nt, Human
ggguuccugaagugguucagga

SEQ ID NO: 120708 - RNA, 22 nt, Human
gguaacagaagagcacuuggca

SEQ ID NO: 120709 - RNA, 22 nt, Human
gguaagcauuaagugagggaau

SEQ ID NO: 120710 - RNA, 22 nt, Human
gguaccuggcccuggggcugcu

SEQ ID NO: 120711 - RNA, 22 nt, Human
guucuacaacuucgcuugcaga

SEQ ID NO: 120712 - RNA, 22 nt, Human
gggucuggagauccgggugaag

SEQ ID NO: 120713 - RNA, 22 nt, Human
gggugcucagugccaaggagug

SEQ ID NO: 120714 - RNA, 22 nt, Human
gggugcuuaagcuuguuuguaa

SEQ ID NO: 120715 - RNA, 22 nt, Human
guuccucucacaggcuggagcu

SEQ ID NO: 120716 - RNA, 22 nt, Human
guuccgcugcaaggccaggaaa

SEQ ID NO: 120717 - RNA, 22 nt, Human
ggguggggcaugcucucuucug

SEQ ID NO: 120718 - RNA, 22 nt, Human
guucucuccugcuggugaugga

SEQ ID NO: 120719 - RNA, 22 nt, Human
guucuggaggagagccuggugu

SEQ ID NO: 120720 - RNA, 22 nt, Human
gggugguggagguuugacagac

SEQ ID NO: 120721 - RNA, 22 nt, Human
ggguggugauacugcuucugcc

SEQ ID NO: 120722 - RNA, 22 nt, Human
ggguggugagagaacuuugcag

SEQ ID NO: 120723 - RNA, 22 nt, Human
ggggcugggaggccggcgcgca

SEQ ID NO: 120724 - RNA, 22 nt, Human
ggggcuggguuugcgcaggcuc

SEQ ID NO: 120725 - RNA, 22 nt, Human
gggggcgccgccgcucaucuca

SEQ ID NO: 120726 - RNA, 22 nt, Human
gggggaggcucggcgccgcggu

SEQ ID NO: 120727 - RNA, 22 nt, Human
gggggggcagguuggaugucag

SEQ ID NO: 120728 - RNA, 22 nt, Human
ggggucugaucccuucuggcuu

SEQ ID NO: 120729 - RNA, 22 nt, Human
guucaaccaugauuaggaacug

SEQ ID NO: 120730 - RNA, 22 nt, Human
gggucagggaggccccaccaug

SEQ ID NO: 120731 - RNA, 22 nt, Human
gggguguuuugaagagguucag

SEQ ID NO: 120732 - RNA, 22 nt, Human
ggggugaggcagggcagggguc

SEQ ID NO: 120733 - RNA, 23 nt, Human
guuaccgaccugauucggcagcc

SEQ ID NO: 120734 - RNA, 17 nt, Human
ggggcguguauuugaug

SEQ ID NO: 120735 - RNA, 22 nt, Human
ggggcggggagcaugagcuggg

SEQ ID NO: 120736 - RNA, 22 nt, Human
ggggcgaguguggaccgcagcc

SEQ ID NO: 120737 - RNA, 21 nt, Human
ggggcccccacacaugccucc

SEQ ID NO: 120738 - RNA, 22 nt, Human
ggggaggaagcuggaacacggg

SEQ ID NO: 120739 - RNA, 22 nt, Human
ggggaagugguggggcuccgag

SEQ ID NO: 120740 - RNA, 22 nt, Human
guguugugauuggucagucacu

SEQ ID NO: 120741 - RNA, 22 nt, Human
ggggaggugugcaggacaccuc

SEQ ID NO: 120742 - RNA, 22 nt, Human
ggggagggcugagcacgguuga

SEQ ID NO: 120743 - RNA, 22 nt, Human
guaguucuccaggggcuguuca

SEQ ID NO: 120744 - RNA, 22 nt, Human
guauauccaauaggugaugaaa

SEQ ID NO: 120745 - RNA, 22 nt, Human
guaugugguaccaugcaacggg

SEQ ID NO: 120746 - RNA, 22 nt, Human
gucacuguuucacuguucauua

SEQ ID NO: 120747 - RNA, 22 nt, Human
gucagacucuggggccccaggc

SEQ ID NO: 120748 - RNA, 23 nt, Human
gucaccuccccuugccuucuccc

SEQ ID NO: 120749 - RNA, 22 nt, Human
gucaccgguuuuuagguaaaca

SEQ ID NO: 120750 - RNA, 22 nt, Human
gguguuccgguucugcucuggg

SEQ ID NO: 120751 - RNA, 23 nt, Human
gguuggcuguacccaggcucccu

SEQ ID NO: 120752 - RNA, 22 nt, Human
gguggcauguaccucacagacu

SEQ ID NO: 120753 - RNA, 22 nt, Human
gguggcagaggaggcgggagag

SEQ ID NO: 120754 - RNA, 22 nt, Human
gguggccggcaccccacccucg

SEQ ID NO: 120755 - RNA, 22 nt, Human
guuuucuccugcuauacagugc

SEQ ID NO: 120756 - RNA, 22 nt, Human
ggucauacaaggcacuggugau

SEQ ID NO: 120757 - RNA, 22 nt, Human
ggugcuucgauagguguccaua

SEQ ID NO: 120758 - RNA, 22 nt, Human
guugcuggggcugaguccccag

SEQ ID NO: 120759 - RNA, 22 nt, Human
gucugcagcacugugcacgguc

SEQ ID NO: 120760 - RNA, 22 nt, Human
gucugcccuuggccugggacuu

SEQ ID NO: 120761 - RNA, 20 nt, Human
uacccgcagcugggucuggc

SEQ ID NO: 120762 - RNA, 23 nt, Human
uaccagacccugaaagaaagugu

SEQ ID NO: 120763 - RNA, 22 nt, Human
gugaagcacaugggcguugggu

SEQ ID NO: 120764 - RNA, 22 nt, Human
gugcgaaagaagcgacuccagu

SEQ ID NO: 120765 - RNA, 22 nt, Human
gugccuggugcaggauaaucac

SEQ ID NO: 120766 - RNA, 20 nt, Human
gugcggcucuaccacucggu

SEQ ID NO: 120767 - RNA, 22 nt, Human
gugccugcucauucucaauauu

SEQ ID NO: 120768 - RNA, 22 nt, Human
gugccgggcugcggcaaggugu

SEQ ID NO: 120769 - RNA, 22 nt, Human
gugcccaguugaggccaggacu

SEQ ID NO: 120770 - RNA, 22 nt, Human
uagcaccuagaguauuuuauca

SEQ ID NO: 120771 - RNA, 22 nt, Human
gugccaccagaugcuguugcua

SEQ ID NO: 120772 - RNA, 22 nt, Human
uagaucccauugguugguuggu

SEQ ID NO: 120773 - RNA, 22 nt, Human
gucugcucauguuugguuugug

SEQ ID NO: 120774 - RNA, 22 nt, Human
uagaccuccagcggaggagauu

SEQ ID NO: 120775 - RNA, 22 nt, Human
gugaugaaggccugcaccuggu

SEQ ID NO: 120776 - RNA, 22 nt, Human
gugaggugauugcugguguuug

SEQ ID NO: 120777 - RNA, 22 nt, Human
gugaguugugugaguaagcaga

SEQ ID NO: 120778 - RNA, 22 nt, Human
gugauggucgagcgcuuguugu

SEQ ID NO: 120779 - RNA, 22 nt, Human
gugaugaagguggagaaucaga

SEQ ID NO: 120780 - RNA, 19 nt, Human
uagaggagaauggcaaaga

SEQ ID NO: 120781 - RNA, 22 nt, Human
gugauucaucuggggccuuauu

SEQ ID NO: 120782 - RNA, 17 nt, Human
uccuacaggugugcuga

SEQ ID NO: 120783 - RNA, 20 nt, Human
uccuacauugacccucuucc

SEQ ID NO: 120784 - RNA, 22 nt, Human
uccuaccucaaaaggcaccagc

SEQ ID NO: 120785 - RNA, 22 nt, Human
uccuacccccuucuccagcucc

SEQ ID NO: 120786 - RNA, 22 nt, Human
uccucacaugcaaaaugguauu

SEQ ID NO: 120787 - RNA, 16 nt, Human
uccucacuguagccug

SEQ ID NO: 120788 - RNA, 22 nt, Human
uagaggaccacagggugcagag

SEQ ID NO: 120789 - RNA, 22 nt, Human
uagaccugugggggcagcgggc

SEQ ID NO: 120790 - RNA, 22 nt, Human
uccugcaugcuagugagugcuu

SEQ ID NO: 120791 - RNA, 23 nt, Human
uccugcagauaagcugguugaca

SEQ ID NO: 120792 - RNA, 21 nt, Human
uccugcagggcagcagagugg

SEQ ID NO: 120793 - RNA, 21 nt, Human
uccugccuggccuucugacua

SEQ ID NO: 120794 - RNA, 23 nt, Human
uagcggccaugacgggggucaca

SEQ ID NO: 120795 - RNA, 22 nt, Human
uagucggcuaggagggccuucu

SEQ ID NO: 120796 - RNA, 22 nt, Human
ucgggggucgggcggcggucca

SEQ ID NO: 120797 - RNA, 21 nt, Human
ucgggcggcggcugaggcggc

SEQ ID NO: 120798 - RNA, 21 nt, Human
uccucucuaaguuccgccccg

SEQ ID NO: 120799 - RNA, 22 nt, Human
ucgcuugaacccaggaagugga

SEQ ID NO: 120800 - RNA, 19 nt, Human
ucggaaugugggaagcaug

SEQ ID NO: 120801 - RNA, 22 nt, Human
ucggcuccucccuggaaagggg

SEQ ID NO: 120802 - RNA, 22 nt, Human
uaggcagauuccauauuuuggc

SEQ ID NO: 120803 - RNA, 20 nt, Human
ucgcugcaagggaaauggag

SEQ ID NO: 120804 - RNA, 22 nt, Human
ucgaaugccaacaccgaaguuu

SEQ ID NO: 120805 - RNA, 22 nt, Human
ucgacuccauuuuucuugguuc

SEQ ID NO: 120806 - RNA, 22 nt, Human
ucgacguuguuuuuucucuguc

SEQ ID NO: 120807 - RNA, 22 nt, Human
ucgagaccagcuagaaggaagu

SEQ ID NO: 120808 - RNA, 22 nt, Human
ucgagcacaccagacuugcaga

SEQ ID NO: 120809 - RNA, 22 nt, Human
ucgcccagguuggagugcagug

SEQ ID NO: 120810 - RNA, 22 nt, Human
ucgaugcuggcgcagguuucac

SEQ ID NO: 120811 - RNA, 22 nt, Human
ucgccauguacaugaagggcgg

SEQ ID NO: 120812 - RNA, 22 nt, Human
ucgcgcgugccacgcgccgcgg

SEQ ID NO: 120813 - RNA, 23 nt, Human
uaccauugauuuuaugguuuucu

SEQ ID NO: 120814 - RNA, 19 nt, Human
uacccggauagccagguag

SEQ ID NO: 120815 - RNA, 22 nt, Human
uaccgcagagucauugugagga

SEQ ID NO: 120816 - RNA, 22 nt, Human
uccagguucaguucaucaucua

SEQ ID NO: 120817 - RNA, 22 nt, Human
uccaggucgggggugggccggc

SEQ ID NO: 120818 - RNA, 22 nt, Human
uccaguggcaccuuggcccuca

SEQ ID NO: 120819 - RNA, 22 nt, Human
uccagugccagcuguuaaaguu

SEQ ID NO: 120820 - RNA, 22 nt, Human
uccagguuuggcuuuauaacuu

SEQ ID NO: 120821 - RNA, 22 nt, Human
uccagguggcuuuccuggggga

SEQ ID NO: 120822 - RNA, 22 nt, Human
ucccacgugccaucugcucugu

SEQ ID NO: 120823 - RNA, 22 nt, Human
uacugggugagcugggcuggga

SEQ ID NO: 120824 - RNA, 22 nt, Human
uacaccaugcuccagcaggaca

SEQ ID NO: 120825 - RNA, 22 nt, Human
uccacagggaugccugcggcuu

SEQ ID NO: 120826 - RNA, 22 nt, Human
uccaccaccaucacagucagac

SEQ ID NO: 120827 - RNA, 22 nt, Human
ucauccugaagaaccugcuucc

SEQ ID NO: 120828 - RNA, 21 nt, Human
ucauccagguccugcuucuuc

SEQ ID NO: 120829 - RNA, 22 nt, Human
ucauccgcaaccacuuuagccu

SEQ ID NO: 120830 - RNA, 22 nt, Human
ucaucauccuuuuuugaagagu

SEQ ID NO: 120831 - RNA, 22 nt, Human
uaagaggucugaaacgguggga

SEQ ID NO: 120832 - RNA, 22 nt, Human
ucagagugagcuggggcugcuu

SEQ ID NO: 120833 - RNA, 22 nt, Human
uaagaccuuuuugaaaucacug

SEQ ID NO: 120834 - RNA, 22 nt, Human
uaagugguagaaagagaaaggu

SEQ ID NO: 120835 - RNA, 22 nt, Human
uacaaauuguuuugccacaaag

SEQ ID NO: 120836 - RNA, 22 nt, Human
ucagcucucucuuggugaucuc

SEQ ID NO: 120837 - RNA, 22 nt, Human
ucagcgucuccaaaagagcccg

SEQ ID NO: 120838 - RNA, 19 nt, Human
ucagcagauuuugcaaaca

SEQ ID NO: 120839 - RNA, 23 nt, Human
ucagaccaaccucuugcuggaac

SEQ ID NO: 120840 - RNA, 22 nt, Human
guuuugugugugugcccacacg

SEQ ID NO: 120841 - RNA, 21 nt, Human
ucagaccaacucuuguauccu

SEQ ID NO: 120842 - RNA, 22 nt, Human
ucacuguuucaccgucugaagg

SEQ ID NO: 120843 - RNA, 22 nt, Human
ucacucgccuuuucguucgccg

SEQ ID NO: 120844 - RNA, 23 nt, Human
ucacugccaagaaaaguuacaga

SEQ ID NO: 120845 - RNA, 22 nt, Human
ucacugccuagggcuacugugc

SEQ ID NO: 120846 - RNA, 22 nt, Human
ucaccaugcccuucucugcucu

SEQ ID NO: 120847 - RNA, 22 nt, Human
ucaccauguacaugaagggcgg

SEQ ID NO: 120848 - RNA, 22 nt, Human
ucaccauguuuucauaggaaca

SEQ ID NO: 120849 - RNA, 22 nt, Human
ucaccgucucaguacggaggga

SEQ ID NO: 120850 - RNA, 22 nt, Human
ucacccagacugucugacucuu

SEQ ID NO: 120851 - RNA, 22 nt, Human
ucaccuggagagcuugcuaaua

SEQ ID NO: 120852 - RNA, 22 nt, Human
guuucuguguugauugugcccu

SEQ ID NO: 120853 - RNA, 22 nt, Human
ucaaguccuuggcauaggauaa

SEQ ID NO: 120854 - RNA, 19 nt, Human
guuguguuugguucuuuug

SEQ ID NO: 120855 - RNA, 22 nt, Human
guugugcaaaacaggaaggucu

SEQ ID NO: 120856 - RNA, 22 nt, Human
guucaccaguagcugggcuguu

SEQ ID NO: 120857 - RNA, 22 nt, Human
guuccgcggccucgcgcugagc

SEQ ID NO: 120858 - RNA, 21 nt, Human
guuaccacugaugcaacagga

SEQ ID NO: 120859 - RNA, 22 nt, Human
guguucccauccacaccaagcc

SEQ ID NO: 120860 - RNA, 22 nt, Human
guguguggacgucugagcccag

SEQ ID NO: 120861 - RNA, 22 nt, Human
guucuacaugacacucaacauu

SEQ ID NO: 120862 - RNA, 22 nt, Human
guguggcgacucagagcugccu

SEQ ID NO: 120863 - RNA, 22 nt, Human
gugugucucaguugcuccgaag

SEQ ID NO: 120864 - RNA, 22 nt, Human
gugugcacaaucuggcaugugc

SEQ ID NO: 120865 - RNA, 22 nt, Human
guguccaaagguaggaggaggg

SEQ ID NO: 120866 - RNA, 22 nt, Human
uaugacccccugcacaugugac

SEQ ID NO: 120867 - RNA, 23 nt, Human
uaguuucaucuccacccugcccu

SEQ ID NO: 120868 - RNA, 22 nt, Human
ugacgcauggccagcucugucu

SEQ ID NO: 120869 - RNA, 22 nt, Human
ugacgggacacaggugccaaca

SEQ ID NO: 120870 - RNA, 23 nt, Human
ucagccgcuggcgaguccacugg

SEQ ID NO: 120871 - RNA, 21 nt, Human
ucagccuguccaguguuaacc

SEQ ID NO: 120872 - RNA, 22 nt, Human
ucagauggucauucacuagggu

SEQ ID NO: 120873 - RNA, 22 nt, Human
ucagauagcaagggauaccugu

SEQ ID NO: 120874 - RNA, 22 nt, Human
ucagcguuggccuccuccaggg

SEQ ID NO: 120875 - RNA, 22 nt, Human
ucagcugggagaaaguuuuagg

SEQ ID NO: 120876 - RNA, 22 nt, Human
ucagcuucaucuugagcccaca

SEQ ID NO: 120877 - RNA, 22 nt, Human
ucaggaggucugcugcggggug

SEQ ID NO: 120878 - RNA, 18 nt, Human
ucagaggagauaccuaaa

SEQ ID NO: 120879 - RNA, 22 nt, Human
ugacauccuacaccccuggguc

SEQ ID NO: 120880 - RNA, 17 nt, Human
ugacagcuaaggggcuu

SEQ ID NO: 120881 - RNA, 22 nt, Human
ucacccuguggcuauaaggcaa

SEQ ID NO: 120882 - RNA, 22 nt, Human
ucacagauguuauccugaggau

SEQ ID NO: 120883 - RNA, 22 nt, Human
ucaccaggauugggcuguaggc

SEQ ID NO: 120884 - RNA, 22 nt, Human
ucaccuguucaacagcaauaau

SEQ ID NO: 120885 - RNA, 22 nt, Human
ucaccccagccuuaugacucag

SEQ ID NO: 120886 - RNA, 22 nt, Human
ucaccugccuggguggucaccu

SEQ ID NO: 120887 - RNA, 19 nt, Human
ucacggucaaccagagccu

SEQ ID NO: 120888 - RNA, 22 nt, Human
ucaauuuauguggcuauucauu

SEQ ID NO: 120889 - RNA, 22 nt, Human
ucaagcacugugcaaugagcuu

SEQ ID NO: 120890 - RNA, 22 nt, Human
ugaaggggaaagucuugcuaua

SEQ ID NO: 120891 - RNA, 22 nt, Human
ugaaggccagggauuugcagcc

SEQ ID NO: 120892 - RNA, 22 nt, Human
ugaagccacacuagcuuguccu

SEQ ID NO: 120893 - RNA, 22 nt, Human
ugaagacuucuuuuggucacca

SEQ ID NO: 120894 - RNA, 22 nt, Human
ucaagaagauaaugucuagggu

SEQ ID NO: 120895 - RNA, 22 nt, Human
ugaaccgcuucauggugccugu

SEQ ID NO: 120896 - RNA, 22 nt, Human
ugaaccuaacauuucuggcagu

SEQ ID NO: 120897 - RNA, 22 nt, Human
ucuuggucccugagcucuuuca

SEQ ID NO: 120898 - RNA, 22 nt, Human
ucuugggcaguccucuacuggu

SEQ ID NO: 120899 - RNA, 22 nt, Human
ucuuggcaguucuugugcuuuu

SEQ ID NO: 120900 - RNA, 22 nt, Human
ucuugcuguggcagaucuggag

SEQ ID NO: 120901 - RNA, 22 nt, Human
ucuucccgggcaucucugcuca

SEQ ID NO: 120902 - RNA, 23 nt, Human
ucuagcccuaaaaagagagcaga

SEQ ID NO: 120903 - RNA, 22 nt, Human
ucuuccagauacuuccugacuu

SEQ ID NO: 120904 - RNA, 22 nt, Human
ucuacgugacagaacagacuga

SEQ ID NO: 120905 - RNA, 20 nt, Human
uaguggaccuugaaggccuc

SEQ ID NO: 120906 - RNA, 22 nt, Human
ucccagcaggcaccgcuucugc

SEQ ID NO: 120907 - RNA, 17 nt, Human
ucccacuucauuuucca

SEQ ID NO: 120908 - RNA, 22 nt, Human
uccccggagucccuggccaggg

SEQ ID NO: 120909 - RNA, 19 nt, Human
ugcagcuguaugagcuuaa

SEQ ID NO: 120910 - RNA, 22 nt, Human
ugcagcgugaggacagcugagc

SEQ ID NO: 120911 - RNA, 22 nt, Human
ugcacagagggaggcauaaaau

SEQ ID NO: 120912 - RNA, 16 nt, Human
ugcaccgggaacacug

SEQ ID NO: 120913 - RNA, 22 nt, Human
ugcaacuacccccaggauuuua

SEQ ID NO: 120914 - RNA, 22 nt, Human
uccaugcgcgauggccuggcuu

SEQ ID NO: 120915 - RNA, 22 nt, Human
ugcaaggcacccacucugcuuu

SEQ ID NO: 120916 - RNA, 22 nt, Human
uccacagcagagcacgguaccu

SEQ ID NO: 120917 - RNA, 22 nt, Human
uccaccacgaaacugcagcugc

SEQ ID NO: 120918 - RNA, 22 nt, Human
ugauguggaucuauaacuguaa

SEQ ID NO: 120919 - RNA, 22 nt, Human
uccaccugucccugcuuccugc

SEQ ID NO: 120920 - RNA, 22 nt, Human
uccacgggagcgucggucucgg

SEQ ID NO: 120921 - RNA, 20 nt, Human
uccacugagcgucacggcag

SEQ ID NO: 120922 - RNA, 22 nt, Human
uccagguaggagaccaggcugu

SEQ ID NO: 120923 - RNA, 22 nt, Human
uccacuguguagucucccaagu

SEQ ID NO: 120924 - RNA, 18 nt, Human
uccauccucugcucuuca

SEQ ID NO: 120925 - RNA, 22 nt, Human
uccagguccuacuggcccauag

SEQ ID NO: 120926 - RNA, 23 nt, Human
ucauugcucaagauaaugguuga

SEQ ID NO: 120927 - RNA, 22 nt, Human
ugauaccugagucuuccccguu

SEQ ID NO: 120928 - RNA, 19 nt, Human
ugaucuccaguacagacau

SEQ ID NO: 120929 - RNA, 22 nt, Human
ugagguguuugugcaccaucug

SEQ ID NO: 120930 - RNA, 23 nt, Human
ugaggucuuggaaguucuguuug

SEQ ID NO: 120931 - RNA, 22 nt, Human
ugaggucaggcagggguuuggc

SEQ ID NO: 120932 - RNA, 22 nt, Human
ucaggcgcucuucguggcugcc

SEQ ID NO: 120933 - RNA, 22 nt, Human
ugccagugugccuuccgcucac

SEQ ID NO: 120934 - RNA, 16 nt, Human
ugccaagggguuaaug

SEQ ID NO: 120935 - RNA, 22 nt, Human
ugcauuccagcucccuucuggc

SEQ ID NO: 120936 - RNA, 23 nt, Human
ugcaugagcaucuccaccucagu

SEQ ID NO: 120937 - RNA, 22 nt, Human
ugcccaaucaauuguagcuauu

SEQ ID NO: 120938 - RNA, 22 nt, Human
ugccaucuuugccccuauuuua

SEQ ID NO: 120939 - RNA, 22 nt, Human
ugcccugcagacccugcagugu

SEQ ID NO: 120940 - RNA, 22 nt, Human
uccugggcuugcucuuuccauu

SEQ ID NO: 120941 - RNA, 22 nt, Human
uccugaggaaauuucaccuagu

SEQ ID NO: 120942 - RNA, 22 nt, Human
uccugaaggccugaguuccacc

SEQ ID NO: 120943 - RNA, 22 nt, Human
ugccuguguauuuccggccugc

SEQ ID NO: 120944 - RNA, 22 nt, Human
ugccuggugcggagugaguggc

SEQ ID NO: 120945 - RNA, 22 nt, Human
uccuucagaggacggcagccag

SEQ ID NO: 120946 - RNA, 19 nt, Human
ugccggccgcgggguuccu

SEQ ID NO: 120947 - RNA, 22 nt, Human
ugccgggcugagcaagugcugc

SEQ ID NO: 120948 - RNA, 22 nt, Human
ugcccugucccuagguuugugg

SEQ ID NO: 120949 - RNA, 22 nt, Human
ugccgcaggaggggcgauuucu

SEQ ID NO: 120950 - RNA, 22 nt, Human
ugccgccgugggucccgacgcg

SEQ ID NO: 120951 - RNA, 23 nt, Human
ugccggaucuacuuuggguucuc

SEQ ID NO: 120952 - RNA, 19 nt, Human
ugcgggcugcggucagggc

SEQ ID NO: 120953 - RNA, 22 nt, Human
ugcguugaggaccgcgagggcg

SEQ ID NO: 120954 - RNA, 22 nt, Human
ucgagcgcucccugugcucucg

SEQ ID NO: 120955 - RNA, 22 nt, Human
ucgccccccgccucacccucgg

SEQ ID NO: 120956 - RNA, 22 nt, Human
ugcuagggcaggaggugaggag

SEQ ID NO: 120957 - RNA, 22 nt, Human
ugcuccucugcaugucugcggc

SEQ ID NO: 120958 - RNA, 22 nt, Human
ucggcgaccugucauggaccaa

SEQ ID NO: 120959 - RNA, 22 nt, Human
ucggccggagggggcgggcgca

SEQ ID NO: 120960 - RNA, 23 nt, Human
ugcucgccuucaggacuugggcu

SEQ ID NO: 120961 - RNA, 22 nt, Human
ucggauuggggaugggugggag

SEQ ID NO: 120962 - RNA, 22 nt, Human
ucguccaauaaccugccagcgc

SEQ ID NO: 120963 - RNA, 22 nt, Human
ucgugaagaaauguggacuuca

SEQ ID NO: 120964 - RNA, 22 nt, Human
ucguguuggaacugcuuuguaa

SEQ ID NO: 120965 - RNA, 22 nt, Human
ugcugcacucacaggaagaguu

SEQ ID NO: 120966 - RNA, 22 nt, Human
ugcugcacccuucauuuuccca

SEQ ID NO: 120967 - RNA, 22 nt, Human
ucggguguguguguuggguaug

SEQ ID NO: 120968 - RNA, 22 nt, Human
ugcugaccggccuccccccagc

SEQ ID NO: 120969 - RNA, 23 nt, Human
ucgucgucagccacuaccucccc

SEQ ID NO: 120970 - RNA, 22 nt, Human
ugcucugguccucccucggcgc

SEQ ID NO: 120971 - RNA, 22 nt, Human
ugcucuuuguagcugcuuugcu

SEQ ID NO: 120972 - RNA, 22 nt, Human
ucgggcgaauguuguuuuucuc

SEQ ID NO: 120973 - RNA, 22 nt, Human
ucgggccacauccacacaucca

SEQ ID NO: 120974 - RNA, 22 nt, Human
ucgggcccggcucccgacgccc

SEQ ID NO: 120975 - RNA, 22 nt, Human
ucgggacccccgcccgggcccg

SEQ ID NO: 120976 - RNA, 22 nt, Human
ucgggaggaggcggagcucguu

SEQ ID NO: 120977 - RNA, 22 nt, Human
ugcucgggcuccuuugagugag

SEQ ID NO: 120978 - RNA, 22 nt, Human
ucgggggaaccggcccgggccu

SEQ ID NO: 120979 - RNA, 22 nt, Human
uggagcugguucuggggaagcu

SEQ ID NO: 120980 - RNA, 22 nt, Human
uggagcugaaguacucucacua

SEQ ID NO: 120981 - RNA, 22 nt, Human
uggaagaucugguguagcuccu

SEQ ID NO: 120982 - RNA, 22 nt, Human
ucugggccacccgccuccaggg

SEQ ID NO: 120983 - RNA, 22 nt, Human
ucugggccaacccuuccauggg

SEQ ID NO: 120984 - RNA, 22 nt, Human
uggaagggagcuggaauuugga

SEQ ID NO: 120985 - RNA, 22 nt, Human
ucuggguaacugaggcuaauau

SEQ ID NO: 120986 - RNA, 22 nt, Human
uggaaggggagcuggaaagggg

SEQ ID NO: 120987 - RNA, 22 nt, Human
uggacccaccccagggccugcu

SEQ ID NO: 120988 - RNA, 21 nt, Human
ucuagaccuugggcagucacu

SEQ ID NO: 120989 - RNA, 22 nt, Human
ucuacgugggaguucaggauuc

SEQ ID NO: 120990 - RNA, 22 nt, Human
ugcugccgccgccaccgccgcc

SEQ ID NO: 120991 - RNA, 22 nt, Human
ugcugccucccaucccucccga

SEQ ID NO: 120992 - RNA, 22 nt, Human
ucuggaggucucagggcgggaa

SEQ ID NO: 120993 - RNA, 22 nt, Human
uggaacuagugucugagauggg

SEQ ID NO: 120994 - RNA, 22 nt, Human
uggaacugguuugcuucagacu

SEQ ID NO: 120995 - RNA, 23 nt, Human
ucugccuccuaauuguugguguc

SEQ ID NO: 120996 - RNA, 22 nt, Human
ucugcaugccucaggaggccug

SEQ ID NO: 120997 - RNA, 22 nt, Human
ucugcggccggaauucccuuca

SEQ ID NO: 120998 - RNA, 22 nt, Human
uggcccaucagggcaccugaga

SEQ ID NO: 120999 - RNA, 20 nt, Human
uggcccagcacgacgaggac

SEQ ID NO: 121000 - RNA, 22 nt, Human
uggcccaagggaggcuuggccu

SEQ ID NO: 121001 - RNA, 22 nt, Human
uggccaugagaaucuuugcugu

SEQ ID NO: 121002 - RNA, 21 nt, Human
uggcaggcagcuggaagcuug

SEQ ID NO: 121003 - RNA, 22 nt, Human
uggcagccugcgugaaggagcu

SEQ ID NO: 121004 - RNA, 22 nt, Human
uggcagcucauuuggaaaugga

SEQ ID NO: 121005 - RNA, 22 nt, Human
uggcacugaagcuggaaagccu

SEQ ID NO: 121006 - RNA, 22 nt, Human
uggcacaguuaaaguuguagaa

SEQ ID NO: 121007 - RNA, 22 nt, Human
uggcacugcccugucucggugg

SEQ ID NO: 121008 - RNA, 22 nt, Human
uggauuagugcugaaaugaugg

SEQ ID NO: 121009 - RNA, 22 nt, Human
ucuguucucuuguucugacggu

SEQ ID NO: 121010 - RNA, 19 nt, Human
ucuguugcuuuguguccuc

SEQ ID NO: 121011 - RNA, 22 nt, Human
ugacacagaccaaguggugcug

SEQ ID NO: 121012 - RNA, 22 nt, Human
ugacagugugcccggagguuag

SEQ ID NO: 121013 - RNA, 22 nt, Human
ugacagucacagcagaaacucg

SEQ ID NO: 121014 - RNA, 22 nt, Human
uggggcgccuggcugaggcugc

SEQ ID NO: 121015 - RNA, 22 nt, Human
uggggcuuucgcggagcgucgg

SEQ ID NO: 121016 - RNA, 22 nt, Human
ugggaggcugugggaauggguc

SEQ ID NO: 121017 - RNA, 20 nt, Human
ugggauggaaucaccugcac

SEQ ID NO: 121018 - RNA, 22 nt, Human
ugaagguggcuugcagcuaguc

SEQ ID NO: 121019 - RNA, 22 nt, Human
ugggcagggagcuggaaccaca

SEQ ID NO: 121020 - RNA, 22 nt, Human
uggggaagaacuugccauuuca

SEQ ID NO: 121021 - RNA, 22 nt, Human
ugggccucuguuuccucaucug

SEQ ID NO: 121022 - RNA, 22 nt, Human
ugggccgugagacgucucuggg

SEQ ID NO: 121023 - RNA, 22 nt, Human
ugggcccaucauugcugugggc

SEQ ID NO: 121024 - RNA, 22 nt, Human
ugggauauagaauuggcagagu

SEQ ID NO: 121025 - RNA, 23 nt, Human
ugggagcuauguuuggaaugggg

SEQ ID NO: 121026 - RNA, 22 nt, Human
ugggagccuuccacugggggaa

SEQ ID NO: 121027 - RNA, 22 nt, Human
ugaacuucccauguacagacug

SEQ ID NO: 121028 - RNA, 22 nt, Human
uggcuuuuuauuccuaugugau

SEQ ID NO: 121029 - RNA, 22 nt, Human
uggcuuuuuucuccccuuggau

SEQ ID NO: 121030 - RNA, 22 nt, Human
ugggaaaauugugauucuuucu

SEQ ID NO: 121031 - RNA, 22 nt, Human
ugggaagaggaggcagggggca

SEQ ID NO: 121032 - RNA, 22 nt, Human
ugaaccugagggcaaagggaca

SEQ ID NO: 121033 - RNA, 22 nt, Human
ugaacuggauuugugagcuccu

SEQ ID NO: 121034 - RNA, 22 nt, Human
uggcggcuggacuggggggcca

SEQ ID NO: 121035 - RNA, 22 nt, Human
uggccugauuuugcuaagagaa

SEQ ID NO: 121036 - RNA, 22 nt, Human
uggcugggagcuggaacugggc

SEQ ID NO: 121037 - RNA, 23 nt, Human
uggcucugagcuuccugguggcc

SEQ ID NO: 121038 - RNA, 22 nt, Human
uggcuucagacuucugcuacgu

SEQ ID NO: 121039 - RNA, 22 nt, Human
uggcuugagcugggcccaccug

SEQ ID NO: 121040 - RNA, 22 nt, Human
uggcuuuucaccugcuccucug

SEQ ID NO: 121041 - RNA, 21 nt, Human
ugaacaccaggagaaaucggu

SEQ ID NO: 121042 - RNA, 22 nt, Human
uguccagcuauauguguaugug

SEQ ID NO: 121043 - RNA, 22 nt, Human
ugcaagagcccaaacuauauac

SEQ ID NO: 121044 - RNA, 22 nt, Human
ugcacgcgcccuucgauggccc

SEQ ID NO: 121045 - RNA, 22 nt, Human
ugcacgcacuugcucuccagcg

SEQ ID NO: 121046 - RNA, 18 nt, Human
ugcacccuaagggcccca

SEQ ID NO: 121047 - RNA, 22 nt, Human
ugcacccacuuagcugaaguuc

SEQ ID NO: 121048 - RNA, 22 nt, Human
ugucaaguuguuaaguucuggg

SEQ ID NO: 121049 - RNA, 22 nt, Human
uguaucuguguguauguguuua

SEQ ID NO: 121050 - RNA, 22 nt, Human
ugauggaucuguuggcggguuu

SEQ ID NO: 121051 - RNA, 18 nt, Human
ugauggcuaagagccggg

SEQ ID NO: 121052 - RNA, 22 nt, Human
ugaucauguucuccaaaagcgu

SEQ ID NO: 121053 - RNA, 22 nt, Human
ugaguucugacugagcaugggg

SEQ ID NO: 121054 - RNA, 22 nt, Human
ugguuuacucuguaaaccagga

SEQ ID NO: 121055 - RNA, 22 nt, Human
ugagggucgcaagcaccaggcc

SEQ ID NO: 121056 - RNA, 23 nt, Human
uggugugaggaaggaagacuuua

SEQ ID NO: 121057 - RNA, 21 nt, Human
ugagcccaaagcuguauuggu

SEQ ID NO: 121058 - RNA, 23 nt, Human
uggugcagcgcaggccggguggc

SEQ ID NO: 121059 - RNA, 22 nt, Human
ugagggaugccucuccuuccgg

SEQ ID NO: 121060 - RNA, 22 nt, Human
ugguggagucugggggaggcuu

SEQ ID NO: 121061 - RNA, 22 nt, Human
ugguggaggugggggguauuuu

SEQ ID NO: 121062 - RNA, 22 nt, Human
uggugcagacaggagccccgcu

SEQ ID NO: 121063 - RNA, 17 nt, Human
ugaggcugucucccugg

SEQ ID NO: 121064 - RNA, 22 nt, Human
ugaggccaagccuccucugcca

SEQ ID NO: 121065 - RNA, 22 nt, Human
ugaccgucagcugucuuccauu

SEQ ID NO: 121066 - RNA, 22 nt, Human
ugggggguuuagaaucugcccu

SEQ ID NO: 121067 - RNA, 22 nt, Human
uggggugccccccucgguuugc

SEQ ID NO: 121068 - RNA, 23 nt, Human
uggggucaaggcugccuuggggu

SEQ ID NO: 121069 - RNA, 22 nt, Human
ugggggcacccagccgaugagg

SEQ ID NO: 121070 - RNA, 22 nt, Human
ugcgcgccgacggcuccgugac

SEQ ID NO: 121071 - RNA, 22 nt, Human
ugcggcucaaagggaaggccuu

SEQ ID NO: 121072 - RNA, 22 nt, Human
ugcggugcgcccgggcgagugc

SEQ ID NO: 121073 - RNA, 22 nt, Human
ugcggugcagcccugcccucuc

SEQ ID NO: 121074 - RNA, 22 nt, Human
ugcguggauuuaggagugaggg

SEQ ID NO: 121075 - RNA, 22 nt, Human
uguugaucucuuuccaaauucu

SEQ ID NO: 121076 - RNA, 22 nt, Human
uguguuguuuggggauguccau

SEQ ID NO: 121077 - RNA, 22 nt, Human
uguguuccugucuuauucuuau

SEQ ID NO: 121078 - RNA, 19 nt, Human
uguguuccauccaccaccc

SEQ ID NO: 121079 - RNA, 22 nt, Human
uguguucagaagaggcugccgg

SEQ ID NO: 121080 - RNA, 22 nt, Human
ugccugaagccugccccugggu

SEQ ID NO: 121081 - RNA, 19 nt, Human
ugccuggcaccagcuccac

SEQ ID NO: 121082 - RNA, 22 nt, Human
uguguuucucugaggggucccu

SEQ ID NO: 121083 - RNA, 22 nt, Human
ugcgccaggacacccguggcgg

SEQ ID NO: 121084 - RNA, 22 nt, Human
ugccuuccuucuccccuccuuc

SEQ ID NO: 121085 - RNA, 22 nt, Human
ugcgccuccugcugccugcccu

SEQ ID NO: 121086 - RNA, 22 nt, Human
ugccaacaggcuugccugaugu

SEQ ID NO: 121087 - RNA, 22 nt, Human
ugugggaggaugggccccuaga

SEQ ID NO: 121088 - RNA, 22 nt, Human
ugccaucaugucagauuuggga

SEQ ID NO: 121089 - RNA, 22 nt, Human
ugcccacaggaagacaccagcg

SEQ ID NO: 121090 - RNA, 22 nt, Human
ugugugggcgaagacagccuuu

SEQ ID NO: 121091 - RNA, 22 nt, Human
uguguacggugcacacacacag

SEQ ID NO: 121092 - RNA, 22 nt, Human
uguggguggucagcgugugaug

SEQ ID NO: 121093 - RNA, 22 nt, Human
ugcaggagcaccagcucacccu

SEQ ID NO: 121094 - RNA, 22 nt, Human
ugugcgucuguguacagaugug

SEQ ID NO: 121095 - RNA, 22 nt, Human
ugcaggagaaaguacggagcgu

SEQ ID NO: 121096 - RNA, 22 nt, Human
ugugcagaaggagguucuccgg

SEQ ID NO: 121097 - RNA, 22 nt, Human
ugugcaucuggaggcaauguuu

SEQ ID NO: 121098 - RNA, 22 nt, Human
ugcaggucuggacccccacuuu

SEQ ID NO: 121099 - RNA, 21 nt, Human
uguggccauuugaaaacaggg

SEQ ID NO: 121100 - RNA, 20 nt, Human
ugggggugcccaucuccccu

SEQ ID NO: 121101 - RNA, 22 nt, Human
uucguugaagcaacgacuuugg

SEQ ID NO: 121102 - RNA, 22 nt, Human
uggggaguaggaggggaacaga

SEQ ID NO: 121103 - RNA, 20 nt, Human
uucucugcagcaggcggccc

SEQ ID NO: 121104 - RNA, 22 nt, Human
uggguccaggauucuguguuuc

SEQ ID NO: 121105 - RNA, 22 nt, Human
uggggagucccaacgguggaag

SEQ ID NO: 121106 - RNA, 22 nt, Human
uggggcugguaccguaauauau

SEQ ID NO: 121107 - RNA, 21 nt, Human
uggggaugcauugcagaggca

SEQ ID NO: 121108 - RNA, 22 nt, Human
ugggauucucagaaacacagag

SEQ ID NO: 121109 - RNA, 22 nt, Human
ugggcagggauuuggggaaacu

SEQ ID NO: 121110 - RNA, 22 nt, Human
ugggccacguggagucuguagg

SEQ ID NO: 121111 - RNA, 22 nt, Human
ugggccaaaugucugcauaagu

SEQ ID NO: 121112 - RNA, 22 nt, Human
uggcccagaucucugaccuuga

SEQ ID NO: 121113 - RNA, 21 nt, Human
uggccaaggaauagaagcucu

SEQ ID NO: 121114 - RNA, 22 nt, Human
uggccaaauuggccugauguau

SEQ ID NO: 121115 - RNA, 22 nt, Human
uggccagucuuagcugugccug

SEQ ID NO: 121116 - RNA, 22 nt, Human
uggccuucagcucuggggugca

SEQ ID NO: 121117 - RNA, 22 nt, Human
uucaugcgcuuuucaggagugu

SEQ ID NO: 121118 - RNA, 22 nt, Human
uggccccauuuuucuggagccu

SEQ ID NO: 121119 - RNA, 23 nt, Human
uggccguccccugacucucuggc

SEQ ID NO: 121120 - RNA, 22 nt, Human
uggcccugaaucaaggccagca

SEQ ID NO: 121121 - RNA, 22 nt, Human
uuccagauguuuaaguucugcu

SEQ ID NO: 121122 - RNA, 22 nt, Human
uuccagguggcuuuccuggggg

SEQ ID NO: 121123 - RNA, 22 nt, Human
uggcucaggccuacgacgccuu

SEQ ID NO: 121124 - RNA, 22 nt, Human
uggcucacaggaggcagaggug

SEQ ID NO: 121125 - RNA, 22 nt, Human
uucauccucuuuaucuaccugu

SEQ ID NO: 121126 - RNA, 22 nt, Human
uggcggagacauggacuucaga

SEQ ID NO: 121127 - RNA, 22 nt, Human
uggcgugaagcuggaaggcgga

SEQ ID NO: 121128 - RNA, 22 nt, Human
uggcggcggggagguaggcaga

SEQ ID NO: 121129 - RNA, 22 nt, Human
uggcagugggaagcuggaaguc

SEQ ID NO: 121130 - RNA, 22 nt, Human
uggcaguugcaguaacuuguau

SEQ ID NO: 121131 - RNA, 23 nt, Human
uucagcucuccugaagcaucugu

SEQ ID NO: 121132 - RNA, 18 nt, Human
uggcaugcuuugauacau

SEQ ID NO: 121133 - RNA, 20 nt, Human
uggcaugcucucuuuuuagg

SEQ ID NO: 121134 - RNA, 18 nt, Human
uucaggcucuugcaugaa

SEQ ID NO: 121135 - RNA, 20 nt, Human
uucaggaccuuccaguccau

SEQ ID NO: 121136 - RNA, 22 nt, Human
uggcaggggaaaagggguggga

SEQ ID NO: 121137 - RNA, 22 nt, Human
ugcgucccagcauguagggcag

SEQ ID NO: 121138 - RNA, 22 nt, Human
uucacucagagcaggacagccc

SEQ ID NO: 121139 - RNA, 22 nt, Human
uggcagcauuuuuuccagaaca

SEQ ID NO: 121140 - RNA, 22 nt, Human
uggcagccucugguccuuaguu

SEQ ID NO: 121141 - RNA, 22 nt, Human
uggcacguuggauugggaguuc

SEQ ID NO: 121142 - RNA, 22 nt, Human
uggcagaaugaagacuggggcc

SEQ ID NO: 121143 - RNA, 22 nt, Human
uucacccuucucuggcuuucag

SEQ ID NO: 121144 - RNA, 22 nt, Human
uggcaacucaauuucuacaaga

SEQ ID NO: 121145 - RNA, 22 nt, Human
uggcaagcuguuggcagauagc

SEQ ID NO: 121146 - RNA, 22 nt, Human
uggaugccuugggggaggagga

SEQ ID NO: 121147 - RNA, 22 nt, Human
uggaugccauuugauuaaggcu

SEQ ID NO: 121148 - RNA, 20 nt, Human
uggaugacuucaggcagccu

SEQ ID NO: 121149 - RNA, 21 nt, Human
uucaaccagcaauuggcagaa

SEQ ID NO: 121150 - RNA, 22 nt, Human
uggaguucauauuggacauaag

SEQ ID NO: 121151 - RNA, 22 nt, Human
uucaaacaguguagaauauaug

SEQ ID NO: 121152 - RNA, 21 nt, Human
uggaggcguaaucacuguuga

SEQ ID NO: 121153 - RNA, 22 nt, Human
uggagucagaaugcgacaggcc

SEQ ID NO: 121154 - RNA, 19 nt, Human
uggaggcggguggcccaga

SEQ ID NO: 121155 - RNA, 22 nt, Human
uggaggcccagcugggggccgg

SEQ ID NO: 121156 - RNA, 22 nt, Human
uggaggaggagaacuuggcacu

SEQ ID NO: 121157 - RNA, 22 nt, Human
ugcuauucuuggagcugaugga

SEQ ID NO: 121158 - RNA, 22 nt, Human
uuaugugcuuuuugagcucuaa

SEQ ID NO: 121159 - RNA, 20 nt, Human
ugcuccaggaacacuggccg

SEQ ID NO: 121160 - RNA, 22 nt, Human
ugcucagaagacuuacugguua

SEQ ID NO: 121161 - RNA, 22 nt, Human
uucuguucugcuuucuccaucc

SEQ ID NO: 121162 - RNA, 22 nt, Human
uggugcaggauuuauuuaacua

SEQ ID NO: 121163 - RNA, 22 nt, Human
ugguggcaauuuuuggggucaa

SEQ ID NO: 121164 - RNA, 22 nt, Human
ugguggcuuuucguagguucac

SEQ ID NO: 121165 - RNA, 22 nt, Human
ugguggccucaguggcuucugu

SEQ ID NO: 121166 - RNA, 21 nt, Human
ugguguacauuuccauaguuu

SEQ ID NO: 121167 - RNA, 22 nt, Human
ugguugugcuucuuugccucag

SEQ ID NO: 121168 - RNA, 22 nt, Human
uucuuugcccauguuuccuaag

SEQ ID NO: 121169 - RNA, 18 nt, Human
ugguuggugggggugaag

SEQ ID NO: 121170 - RNA, 22 nt, Human
ugucugggauguuggcagccac

SEQ ID NO: 121171 - RNA, 22 nt, Human
ugucugcauucgaguucaugga

SEQ ID NO: 121172 - RNA, 19 nt, Human
ugugaagaccucagugcgg

SEQ ID NO: 121173 - RNA, 21 nt, Human
uguccucggaucaguccacaa

SEQ ID NO: 121174 - RNA, 22 nt, Human
uugcacagaugcacaugguugc

SEQ ID NO: 121175 - RNA, 23 nt, Human
ugucugccuaucaugugaaggac

SEQ ID NO: 121176 - RNA, 22 nt, Human
ugugaugagaugaacuguagac

SEQ ID NO: 121177 - RNA, 22 nt, Human
uguauugaggauucauuuuugu

SEQ ID NO: 121178 - RNA, 22 nt, Human
ugucacggccggguggcaccga

SEQ ID NO: 121179 - RNA, 22 nt, Human
uuggugaugcccaccuuuucau

SEQ ID NO: 121180 - RNA, 22 nt, Human
uuggugaugcuaggaauguagu

SEQ ID NO: 121181 - RNA, 19 nt, Human
uguugcagcuugaucggua

SEQ ID NO: 121182 - RNA, 22 nt, Human
uguuggaauaagugcuugaagg

SEQ ID NO: 121183 - RNA, 22 nt, Human
uguuggaaucuucuagucuucc

SEQ ID NO: 121184 - RNA, 22 nt, Human
uguuggugcacugaaaggcagg

SEQ ID NO: 121185 - RNA, 22 nt, Human
uguugaugaccacaauuuaugc

SEQ ID NO: 121186 - RNA, 22 nt, Human
uuggggaauuuggggccguccg

SEQ ID NO: 121187 - RNA, 22 nt, Human
uuggcgcuauuauuaccacauu

SEQ ID NO: 121188 - RNA, 22 nt, Human
uuggccguuucacugggcaguu

SEQ ID NO: 121189 - RNA, 22 nt, Human
uuggcuucuugcuaggaagcug

SEQ ID NO: 121190 - RNA, 22 nt, Human
uguucccgaugacaggaccagg

SEQ ID NO: 121191 - RNA, 22 nt, Human
uguuccggucuaucgugucaau

SEQ ID NO: 121192 - RNA, 22 nt, Human
uuggccuuacgcauggucggca

SEQ ID NO: 121193 - RNA, 22 nt, Human
ugugggcugcuguuuccuugua

SEQ ID NO: 121194 - RNA, 22 nt, Human
ugugugcuaguuuugucaguau

SEQ ID NO: 121195 - RNA, 22 nt, Human
uguguggccuccauaggguacu

SEQ ID NO: 121196 - RNA, 22 nt, Human
ugugugguaaugagagauccaa

SEQ ID NO: 121197 - RNA, 19 nt, Human
uuggagcaucccaaaggcu

SEQ ID NO: 121198 - RNA, 20 nt, Human
uuggagaucacguguccagg

SEQ ID NO: 121199 - RNA, 22 nt, Human
uguggugcucagggaggauggg

SEQ ID NO: 121200 - RNA, 22 nt, Human
uguggugcagcgggaacagcuu

SEQ ID NO: 121201 - RNA, 22 nt, Human
ugugguuggggucagauaggga

SEQ ID NO: 121202 - RNA, 22 nt, Human
ugugcgcgugugcuuugugugu

SEQ ID NO: 121203 - RNA, 22 nt, Human
ugugcuggcuucugugagcuga

SEQ ID NO: 121204 - RNA, 22 nt, Human
ugugggcguggguuggggaggg

SEQ ID NO: 121205 - RNA, 22 nt, Human
ugugggaggauuuaggugaauc

SEQ ID NO: 121206 - RNA, 22 nt, Human
uuucagauuauguucauggguu

SEQ ID NO: 121207 - RNA, 22 nt, Human
uuucaugauuaacuuagugaau

SEQ ID NO: 121208 - RNA, 22 nt, Human
uuucagugaaugaauggcuaac

SEQ ID NO: 121209 - RNA, 22 nt, Human
uuagagagaggagagagagaga

SEQ ID NO: 121210 - RNA, 19 nt, Human
uuucuggguucaccucuug

SEQ ID NO: 121211 - RNA, 22 nt, Human
uuucugggggucgugcuggcug

SEQ ID NO: 121212 - RNA, 17 nt, Human
uuucugcaugauuggac

SEQ ID NO: 121213 - RNA, 22 nt, Human
uucaacacaaguugugcaguaa

SEQ ID NO: 121214 - RNA, 22 nt, Human
uuccccgagccuggggaagcug

SEQ ID NO: 121215 - RNA, 22 nt, Human
uuuguggaaaagagcccaggag

SEQ ID NO: 121216 - RNA, 20 nt, Human
uugcaugcagccggaugcug

SEQ ID NO: 121217 - RNA, 22 nt, Human
uugcggauguccacgucacacu

SEQ ID NO: 121218 - RNA, 22 nt, Human
uugcucaccugagaagaauaga

SEQ ID NO: 121219 - RNA, 20 nt, Human
uugcucucuuguguugaugu

SEQ ID NO: 121220 - RNA, 22 nt, Human
uugcccuaccccaggccuuuuu

SEQ ID NO: 121221 - RNA, 22 nt, Human
uugccgacuggccaaggaguaa

SEQ ID NO: 121222 - RNA, 22 nt, Human
uuggaagacagccgucuuuauu

SEQ ID NO: 121223 - RNA, 22 nt, Human
uuggagaaagcugcaggcucug

SEQ ID NO: 121224 - RNA, 22 nt, Human
uugcugguggcucugauuucau

SEQ ID NO: 121225 - RNA, 22 nt, Human
uugcugugucauuuguuuaauc

SEQ ID NO: 121226 - RNA, 22 nt, Human
uugcuugcggccuuugugccuu

SEQ ID NO: 121227 - RNA, 22 nt, Human
uugcuggaguagaaaacuuaac

SEQ ID NO: 121228 - RNA, 21 nt, Human
uugcuggagcaauguaaauca

SEQ ID NO: 121229 - RNA, 22 nt, Human
uugcugggauucauugaagggu

SEQ ID NO: 121230 - RNA, 22 nt, Human
uugcugcgcugaccuccaguga

SEQ ID NO: 121231 - RNA, 22 nt, Human
uugcugccagcgcccugcaggg

SEQ ID NO: 121232 - RNA, 22 nt, Human
uugcucuuaccauuauguguga

SEQ ID NO: 121233 - RNA, 22 nt, Human
uuggucaagacugauaucaaga

SEQ ID NO: 121234 - RNA, 22 nt, Human
uuggggccggcgcggaggaggg

SEQ ID NO: 121235 - RNA, 22 nt, Human
uuggcacagagcugcagccugg

SEQ ID NO: 121236 - RNA, 22 nt, Human
uuggccaaaaaagucauuagaa

SEQ ID NO: 121237 - RNA, 22 nt, Human
uuggugaugaaagugcugcgcu

SEQ ID NO: 121238 - RNA, 22 nt, Human
uuggugauguagcagcaauugu

SEQ ID NO: 121239 - RNA, 22 nt, Human
uuguagccaugucacaagcaca

SEQ ID NO: 121240 - RNA, 22 nt, Human
uugucuuggcauaccguuauau

SEQ ID NO: 121241 - RNA, 22 nt, Human
uucuugagaacaaauuccugga

SEQ ID NO: 121242 - RNA, 22 nt, Human
uuuuuagcuguuauuguggaag

SEQ ID NO: 121243 - RNA, 21 nt, Human
uuuuucuccagaguuuccacu

SEQ ID NO: 121244 - RNA, 22 nt, Human
uuuuucuccucucucuuucauu

SEQ ID NO: 121245 - RNA, 22 nt, Human
uucuggggccgugacgaggggc

SEQ ID NO: 121246 - RNA, 19 nt, Human
uucugcucaguaacacccu

SEQ ID NO: 121247 - RNA, 21 nt, Human
uucugcuguucaccaccaccc

SEQ ID NO: 121248 - RNA, 22 nt, Human
uucuggacuuccaaauggcuuc

SEQ ID NO: 121249 - RNA, 22 nt, Human
uucuggugauuugccucuuuag

SEQ ID NO: 121250 - RNA, 22 nt, Human
uucugggguaagcacugaggau

SEQ ID NO: 121251 - RNA, 22 nt, Human
uucucugcgcuccggcccaguu

SEQ ID NO: 121252 - RNA, 20 nt, Human
uucugcucuagagucuagaa

SEQ ID NO: 121253 - RNA, 22 nt, Human
aaaauauuuaucuagcucuuaa

SEQ ID NO: 121254 - RNA, 22 nt, Human
aaaauauucuauaucaaagaua

SEQ ID NO: 121255 - RNA, 18 nt, Human
aaacccacguauucaggc

SEQ ID NO: 121256 - RNA, 22 nt, Human
aaaccgguacccuccugccugc

SEQ ID NO: 121257 - RNA, 18 nt, Human
aaacgguuucaugcugua

SEQ ID NO: 121258 - RNA, 22 nt, Human
aaaggcaugugcaacuacaaau

SEQ ID NO: 121259 - RNA, 22 nt, Human
aaagcccuccaggguauacauu

SEQ ID NO: 121260 - RNA, 22 nt, Human
aaagcagguugcaauuacagug

SEQ ID NO: 121261 - RNA, 23 nt, Human
aaagaggugaauccaggacaagc

SEQ ID NO: 121262 - RNA, 22 nt, Human
aaagagccaacuaccgcaaauu

SEQ ID NO: 121263 - RNA, 22 nt, Human
aacacaucagcacacuaacgga

SEQ ID NO: 121264 - RNA, 22 nt, Human
aaauauuugaaugguguaagau

SEQ ID NO: 121265 - RNA, 22 nt, Human
aaaucaagucagcugaauucca

SEQ ID NO: 121266 - RNA, 22 nt, Human
aaagguggugguuagggaauau

SEQ ID NO: 121267 - RNA, 22 nt, Human
aaaggucagaugugucgaggag

SEQ ID NO: 121268 - RNA, 22 nt, Human
aagagugaguagcuugguuggu

SEQ ID NO: 121269 - RNA, 21 nt, Human
aagcagcugcagaauuucagu

SEQ ID NO: 121270 - RNA, 22 nt, Human
aagcagcauaugacagcaucca

SEQ ID NO: 121271 - RNA, 23 nt, Human
aagcaacagacuucaucagauau

SEQ ID NO: 121272 - RNA, 22 nt, Human
aagauagaaugauguuggcuca

SEQ ID NO: 121273 - RNA, 22 nt, Human
aagaucugaccgugauggcggc

SEQ ID NO: 121274 - RNA, 22 nt, Human
aagacccuaccccuggagagga

SEQ ID NO: 121275 - RNA, 22 nt, Human
aagaagcuacugucacuaucag

SEQ ID NO: 121276 - RNA, 22 nt, Human
aagaaggaaggcaagagauggg

SEQ ID NO: 121277 - RNA, 22 nt, Human
aagaaaccauauuaguuccugg

SEQ ID NO: 121278 - RNA, 22 nt, Human
aaggcgaggggcacagcugaga

SEQ ID NO: 121279 - RNA, 22 nt, Human
aaggacaaaacagcuguucuaa

SEQ ID NO: 121280 - RNA, 20 nt, Human
aaggaggcuuaaaguuagaa

SEQ ID NO: 121281 - RNA, 22 nt, Human
aaggaguacagggagggucccu

SEQ ID NO: 121282 - RNA, 20 nt, Human
aagcuguguucaagauggga

SEQ ID NO: 121283 - RNA, 22 nt, Human
aagcugcagacccccugucuca

SEQ ID NO: 121284 - RNA, 22 nt, Human
aagcugccugggaggaagggcu

SEQ ID NO: 121285 - RNA, 22 nt, Human
aagcucugggacugaggcuccu

SEQ ID NO: 121286 - RNA, 22 nt, Human
aagcgggcagcggccugcgcca

SEQ ID NO: 121287 - RNA, 22 nt, Human
aaggcgauuuaaagauguuagg

SEQ ID NO: 121288 - RNA, 22 nt, Human
aagcgcggccgccgcggucgcu

SEQ ID NO: 121289 - RNA, 22 nt, Human
aagccugguuauuugaggaugu

SEQ ID NO: 121290 - RNA, 22 nt, Human
aagcagugacucucagaggcag

SEQ ID NO: 121291 - RNA, 22 nt, Human
aagcaauucacaguucacuuaa

SEQ ID NO: 121292 - RNA, 23 nt, Human
aagugcucaguggacagcauugc

SEQ ID NO: 121293 - RNA, 23 nt, Human
aaggugaagccaccaggugagga

SEQ ID NO: 121294 - RNA, 22 nt, Human
aaggugccacuucccucagacu

SEQ ID NO: 121295 - RNA, 23 nt, Human
aagggcgauuaacauucgcucga

SEQ ID NO: 121296 - RNA, 22 nt, Human
aaggucucucgggcuuugcuga

SEQ ID NO: 121297 - RNA, 22 nt, Human
aaggucuuggcucuggccgcac

SEQ ID NO: 121298 - RNA, 22 nt, Human
aaggcuuguugucacgcucuug

SEQ ID NO: 121299 - RNA, 22 nt, Human
aaggcuuugugcugaguugucg

SEQ ID NO: 121300 - RNA, 22 nt, Human
acagugguggagggcuguccug

SEQ ID NO: 121301 - RNA, 21 nt, Human
acauccaggguccucacugcc

SEQ ID NO: 121302 - RNA, 22 nt, Human
acaggacgugugugcgcaugug

SEQ ID NO: 121303 - RNA, 22 nt, Human
acaggcugcccgcuccccaccu

SEQ ID NO: 121304 - RNA, 19 nt, Human
acagccuguugguggggcu

SEQ ID NO: 121305 - RNA, 22 nt, Human
acaggacaaaaaucuggauggc

SEQ ID NO: 121306 - RNA, 22 nt, Human
acagcuggaggucugugagcac

SEQ ID NO: 121307 - RNA, 22 nt, Human
acagcugguugaaggggaccaa

SEQ ID NO: 121308 - RNA, 22 nt, Human
acagcugagaugcuacuugugg

SEQ ID NO: 121309 - RNA, 22 nt, Human
acagcucaggcccaucaacccc

SEQ ID NO: 121310 - RNA, 23 nt, Human
acagaggcaucagagcagcaggc

SEQ ID NO: 121311 - RNA, 22 nt, Human
acagagggagugacggccaacc

SEQ ID NO: 121312 - RNA, 22 nt, Human
acagcauagaggaaauguggaa

SEQ ID NO: 121313 - RNA, 23 nt, Human
acagcaagaggaccagaugugag

SEQ ID NO: 121314 - RNA, 22 nt, Human
acacugguucucuuaacccuau

SEQ ID NO: 121315 - RNA, 22 nt, Human
acacucaugcucagcuggugcu

SEQ ID NO: 121316 - RNA, 22 nt, Human
acacgguggccagcaguaggug

SEQ ID NO: 121317 - RNA, 21 nt, Human
acacagcuggagcaucccggu

SEQ ID NO: 121318 - RNA, 20 nt, Human
acacaccugcucagacugag

SEQ ID NO: 121319 - RNA, 22 nt, Human
acacgauguuuuaagccccuaa

SEQ ID NO: 121320 - RNA, 22 nt, Human
acacgcacaccugugcacucgu

SEQ ID NO: 121321 - RNA, 22 nt, Human
acacagaguauuuagaaggggu

SEQ ID NO: 121322 - RNA, 19 nt, Human
acacaccagugccugugac

SEQ ID NO: 121323 - RNA, 22 nt, Human
acaaggccugagggugacagca

SEQ ID NO: 121324 - RNA, 22 nt, Human
acaagaccagcagggagggugc

SEQ ID NO: 121325 - RNA, 22 nt, Human
acaaggccaagcauucuagcaa

SEQ ID NO: 121326 - RNA, 22 nt, Human
acaacccacacguuccgggugg

SEQ ID NO: 121327 - RNA, 22 nt, Human
acaagguugauucuggcaucug

SEQ ID NO: 121328 - RNA, 22 nt, Human
acaagaaaggucugggaacaau

SEQ ID NO: 121329 - RNA, 22 nt, Human
acaacuuuaauggguuucagcu

SEQ ID NO: 121330 - RNA, 22 nt, Human
aauuauucucucaacugagaug

SEQ ID NO: 121331 - RNA, 20 nt, Human
acaaccacugcucacaguuu

SEQ ID NO: 121332 - RNA, 22 nt, Human
acaaacugggauaggauccugu

SEQ ID NO: 121333 - RNA, 21 nt, Human
acaaaaccuaacuuggcugcu

SEQ ID NO: 121334 - RNA, 22 nt, Human
aaugcugugggauagggcuccu

SEQ ID NO: 121335 - RNA, 22 nt, Human
aaugcuaaagaagaaggaguag

SEQ ID NO: 121336 - RNA, 22 nt, Human
acuucugcccuggcgagggcgu

SEQ ID NO: 121337 - RNA, 21 nt, Human
acuuccacaucacugaguaga

SEQ ID NO: 121338 - RNA, 22 nt, Human
acuucccacugcagugacugag

SEQ ID NO: 121339 - RNA, 23 nt, Human
acuggauuguucuugggcgcuga

SEQ ID NO: 121340 - RNA, 22 nt, Human
acuggcgucugucuccccugcc

SEQ ID NO: 121341 - RNA, 22 nt, Human
acugcugauuauugaaguagag

SEQ ID NO: 121342 - RNA, 22 nt, Human
acuguugagggaagcagaugaa

SEQ ID NO: 121343 - RNA, 22 nt, Human
acuguucacccagcacuagcag

SEQ ID NO: 121344 - RNA, 22 nt, Human
acuuggucguggugcagcaugg

SEQ ID NO: 121345 - RNA, 22 nt, Human
acuuugccagcucccugcuggc

SEQ ID NO: 121346 - RNA, 22 nt, Human
agacaagagcugaggacauauu

SEQ ID NO: 121347 - RNA, 22 nt, Human
agaaugucaagucaagaacaau

SEQ ID NO: 121348 - RNA, 22 nt, Human
agacccugauucugcuggcggu

SEQ ID NO: 121349 - RNA, 22 nt, Human
agaccccuggggaggauuauag

SEQ ID NO: 121350 - RNA, 22 nt, Human
agaauccucuagggauggcagg

SEQ ID NO: 121351 - RNA, 22 nt, Human
agaagcagaaggaagcagggcc

SEQ ID NO: 121352 - RNA, 22 nt, Human
agaaggcagaaaagcuuuacaa

SEQ ID NO: 121353 - RNA, 19 nt, Human
agaacccccuuccucugcu

SEQ ID NO: 121354 - RNA, 22 nt, Human
agaaggcaucugcucgcuucca

SEQ ID NO: 121355 - RNA, 22 nt, Human
agaagguggaguagaacaagcu

SEQ ID NO: 121356 - RNA, 16 nt, Human
agaaggcuaguaacag

SEQ ID NO: 121357 - RNA, 22 nt, Human
acugaacuaaagaaaugggcaa

SEQ ID NO: 121358 - RNA, 22 nt, Human
acugacuacauguccugucauu

SEQ ID NO: 121359 - RNA, 22 nt, Human
acugagcaaaacugauccuguu

SEQ ID NO: 121360 - RNA, 18 nt, Human
acugagcccaggacacac

SEQ ID NO: 121361 - RNA, 22 nt, Human
acugaugacaaugugaguguuc

SEQ ID NO: 121362 - RNA, 22 nt, Human
acugauuccaagcuuguggagg

SEQ ID NO: 121363 - RNA, 22 nt, Human
acugaucuguguaauauguuac

SEQ ID NO: 121364 - RNA, 22 nt, Human
acugcaggucccaucaccugcg

SEQ ID NO: 121365 - RNA, 22 nt, Human
acugcuguugugauggguauuu

SEQ ID NO: 121366 - RNA, 21 nt, Human
acuccagccacugacugucuc

SEQ ID NO: 121367 - RNA, 22 nt, Human
acucggcggccucgagugcugg

SEQ ID NO: 121368 - RNA, 22 nt, Human
acucgggggccgcugcagggag

SEQ ID NO: 121369 - RNA, 22 nt, Human
acucggaggccaaggccaacgg

SEQ ID NO: 121370 - RNA, 22 nt, Human
acuaggugggugucacugacuc

SEQ ID NO: 121371 - RNA, 22 nt, Human
acguccgcugauucuuuggaag

SEQ ID NO: 121372 - RNA, 22 nt, Human
acggguuccuugagggcaggau

SEQ ID NO: 121373 - RNA, 22 nt, Human
acgguguuucucguucaggguu

SEQ ID NO: 121374 - RNA, 20 nt, Human
acuaccaugcaauuccgcuu

SEQ ID NO: 121375 - RNA, 22 nt, Human
acaucuaugucugaggccuugg

SEQ ID NO: 121376 - RNA, 22 nt, Human
acauccaguaucagaagcauca

SEQ ID NO: 121377 - RNA, 22 nt, Human
acgccaggagcuucuccguuca

SEQ ID NO: 121378 - RNA, 20 nt, Human
acgccgcgaggugagcuggu

SEQ ID NO: 121379 - RNA, 20 nt, Human
acgcauguauaugcaucacc

SEQ ID NO: 121380 - RNA, 22 nt, Human
acgggugcuuguucccgcugcu

SEQ ID NO: 121381 - RNA, 22 nt, Human
acgcugagcucauggagaugca

SEQ ID NO: 121382 - RNA, 22 nt, Human
acguccaccccguaccagauca

SEQ ID NO: 121383 - RNA, 22 nt, Human
acggcggguuccgggccagccc

SEQ ID NO: 121384 - RNA, 22 nt, Human
acggagggagagagggaggaga

SEQ ID NO: 121385 - RNA, 22 nt, Human
acgccggguaaggucauucugc

SEQ ID NO: 121386 - RNA, 22 nt, Human
acgccugccuguacuugugggg

SEQ ID NO: 121387 - RNA, 22 nt, Human
acgccuugagccuugccugaau

SEQ ID NO: 121388 - RNA, 22 nt, Human
acgcgcuccagcaggugcuuca

SEQ ID NO: 121389 - RNA, 22 nt, Human
acgcggagccagaggguguggg

SEQ ID NO: 121390 - RNA, 22 nt, Human
agaugaccaguaagugguugaa

SEQ ID NO: 121391 - RNA, 22 nt, Human
agaucugucaccauccuggagc

SEQ ID NO: 121392 - RNA, 22 nt, Human
agaguuaguggccucagcaggg

SEQ ID NO: 121393 - RNA, 22 nt, Human
agaguucuauccagacucaugu

SEQ ID NO: 121394 - RNA, 22 nt, Human
agagccggagucuucuuguuug

SEQ ID NO: 121395 - RNA, 22 nt, Human
agaggggaaggaugugauguga

SEQ ID NO: 121396 - RNA, 22 nt, Human
agagggagagaccuccgugccu

SEQ ID NO: 121397 - RNA, 23 nt, Human
agaggccaacuucuugccccucc

SEQ ID NO: 121398 - RNA, 22 nt, Human
agagcagaggcauggccguggg

SEQ ID NO: 121399 - RNA, 22 nt, Human
agacuacggggaggggagggaa

SEQ ID NO: 121400 - RNA, 22 nt, Human
agacgacucuuaaggcagaauu

SEQ ID NO: 121401 - RNA, 22 nt, Human
agaccccuguggugaugguggu

SEQ ID NO: 121402 - RNA, 22 nt, Human
agcaaagccucuuugaaaaaaa

SEQ ID NO: 121403 - RNA, 22 nt, Human
agcaagggucucucauggcuug

SEQ ID NO: 121404 - RNA, 22 nt, Human
agauggcuccaguguccagagg

SEQ ID NO: 121405 - RNA, 22 nt, Human
agauggcugggagcucuguuug

SEQ ID NO: 121406 - RNA, 22 nt, Human
agauggaguccugaagccagaa

SEQ ID NO: 121407 - RNA, 22 nt, Human
agauucgucuuuaauucaccau

SEQ ID NO: 121408 - RNA, 20 nt, Human
agaugcccaacucuguuuug

SEQ ID NO: 121409 - RNA, 21 nt, Human
agaugcaguuugcaggugggu

SEQ ID NO: 121410 - RNA, 22 nt, Human
agaugaugugugucuucagcua

SEQ ID NO: 121411 - RNA, 22 nt, Human
agauauucugccuaacagguuu

SEQ ID NO: 121412 - RNA, 22 nt, Human
agauggaggaaagcaguuagaa

SEQ ID NO: 121413 - RNA, 22 nt, Human
agcccagguggagugugugggg

SEQ ID NO: 121414 - RNA, 22 nt, Human
agccccggugagggaguccugu

SEQ ID NO: 121415 - RNA, 22 nt, Human
agccauggaggaugugcagcau

SEQ ID NO: 121416 - RNA, 22 nt, Human
agccagauuuuuugagaggcga

SEQ ID NO: 121417 - RNA, 22 nt, Human
agccacacuuagucacaaagau

SEQ ID NO: 121418 - RNA, 22 nt, Human
agccaugcuguuuugccuggga

SEQ ID NO: 121419 - RNA, 22 nt, Human
agcauucagacaucugauggau

SEQ ID NO: 121420 - RNA, 22 nt, Human
agcccugugugcuuguguuccu

SEQ ID NO: 121421 - RNA, 22 nt, Human
agcccgggagggcugucuggga

SEQ ID NO: 121422 - RNA, 22 nt, Human
agccccaauuacagcugugcug

SEQ ID NO: 121423 - RNA, 22 nt, Human
agccccuaaaguagcuguucuu

SEQ ID NO: 121424 - RNA, 22 nt, Human
agccagugcagcuggaaauuca

SEQ ID NO: 121425 - RNA, 22 nt, Human
agcaggggcaggguuuugugcu

SEQ ID NO: 121426 - RNA, 22 nt, Human
agccuggacagcuacggagaac

SEQ ID NO: 121427 - RNA, 22 nt, Human
agcgacuguaagagggccccgg

SEQ ID NO: 121428 - RNA, 22 nt, Human
agccggccucggacagagggag

SEQ ID NO: 121429 - RNA, 21 nt, Human
agccgggacaacguggacccc

SEQ ID NO: 121430 - RNA, 22 nt, Human
agccgcgcagccucauuaagga

SEQ ID NO: 121431 - RNA, 22 nt, Human
agccuggagcaggcucugcucu

SEQ ID NO: 121432 - RNA, 22 nt, Human
agccugugcuguguuugcucca

SEQ ID NO: 121433 - RNA, 22 nt, Human
agccugggucgagagacgagaa

SEQ ID NO: 121434 - RNA, 21 nt, Human
agcgcugcauccaccauggcu

SEQ ID NO: 121435 - RNA, 22 nt, Human
agcgcucauuuuccuccugcuc

SEQ ID NO: 121436 - RNA, 22 nt, Human
agcgcggccuuacacccagggg

SEQ ID NO: 121437 - RNA, 22 nt, Human
agcgccgcugugauuggugagg

SEQ ID NO: 121438 - RNA, 22 nt, Human
agcgcgcggggcugcggcaggg

SEQ ID NO: 121439 - RNA, 22 nt, Human
agcaaggagcugaaaccgggcu

SEQ ID NO: 121440 - RNA, 22 nt, Human
agcaccuuguucagaucuuaca

SEQ ID NO: 121441 - RNA, 22 nt, Human
agcagcaaugacaauucaacca

SEQ ID NO: 121442 - RNA, 22 nt, Human
agcacgcccaccuccugcggcg

SEQ ID NO: 121443 - RNA, 22 nt, Human
agcacuaccggucacggccaug

SEQ ID NO: 121444 - RNA, 22 nt, Human
agcagcugagccccagcuguga

SEQ ID NO: 121445 - RNA, 22 nt, Human
agcaggccuuucaccucugucc

SEQ ID NO: 121446 - RNA, 22 nt, Human
agcaggaaggcuagaagcagga

SEQ ID NO: 121447 - RNA, 22 nt, Human
agcaggacuugcugagcccucc

SEQ ID NO: 121448 - RNA, 22 nt, Human
agcaggagagacuggcccaaaa

SEQ ID NO: 121449 - RNA, 22 nt, Human
agcaggagaaagaguaugggcu

SEQ ID NO: 121450 - RNA, 17 nt, Human
agcagcuggguugaucu

SEQ ID NO: 121451 - RNA, 22 nt, Human
agcagccgccgccgccgcgcac

SEQ ID NO: 121452 - RNA, 22 nt, Human
agcagcaccuguccucgcugcu

SEQ ID NO: 121453 - RNA, 22 nt, Human
agcagcaggugaccucgaugcc

SEQ ID NO: 121454 - RNA, 23 nt, Human
aggcagcaugcaacaggccauuu

SEQ ID NO: 121455 - RNA, 21 nt, Human
aggcagcgauuuucauauugc

SEQ ID NO: 121456 - RNA, 22 nt, Human
aggcaagauuaggaccagaaga

SEQ ID NO: 121457 - RNA, 22 nt, Human
aggcagaugggagcuggaaguu

SEQ ID NO: 121458 - RNA, 20 nt, Human
aggcagacaaggagucuguu

SEQ ID NO: 121459 - RNA, 22 nt, Human
aggcagcagggagggagaaaug

SEQ ID NO: 121460 - RNA, 22 nt, Human
aggcaggagcugugguggugag

SEQ ID NO: 121461 - RNA, 22 nt, Human
aggcaucguguuuuucugcuuu

SEQ ID NO: 121462 - RNA, 22 nt, Human
aggcaggcucaaugcccagucu

SEQ ID NO: 121463 - RNA, 22 nt, Human
aggccaggcgccggcgcgagac

SEQ ID NO: 121464 - RNA, 22 nt, Human
aggccacucagggggccaagau

SEQ ID NO: 121465 - RNA, 22 nt, Human
aggcugcucucgccggcggugu

SEQ ID NO: 121466 - RNA, 22 nt, Human
aggccgagaugacagagccacu

SEQ ID NO: 121467 - RNA, 22 nt, Human
aggcccucucggucccccgccg

SEQ ID NO: 121468 - RNA, 22 nt, Human
aggcuaagugauuagugacaua

SEQ ID NO: 121469 - RNA, 22 nt, Human
aggcugggaaguguguccugag

SEQ ID NO: 121470 - RNA, 21 nt, Human
aggccaaguuggauuucuuca

SEQ ID NO: 121471 - RNA, 22 nt, Human
aggcagugccuggaccccagcu

SEQ ID NO: 121472 - RNA, 22 nt, Human
aggccagugcagcuggaacaga

SEQ ID NO: 121473 - RNA, 22 nt, Human
aggcauguugcuucgggcuuug

SEQ ID NO: 121474 - RNA, 22 nt, Human
aggcagagaggucuuccuggaa

SEQ ID NO: 121475 - RNA, 22 nt, Human
aggagggcggggcuaaaaggga

SEQ ID NO: 121476 - RNA, 22 nt, Human
aggacaaaggaccagaucugga

SEQ ID NO: 121477 - RNA, 22 nt, Human
aggacaagacaaggaccagaga

SEQ ID NO: 121478 - RNA, 16 nt, Human
aggagcagaaagcagu

SEQ ID NO: 121479 - RNA, 22 nt, Human
aggagcccaaagcacuuggcug

SEQ ID NO: 121480 - RNA, 22 nt, Human
aggagcugccggauggggcaug

SEQ ID NO: 121481 - RNA, 22 nt, Human
aggaggaggacucgccaggcca

SEQ ID NO: 121482 - RNA, 22 nt, Human
aggaggcguuugcuaaacgggc

SEQ ID NO: 121483 - RNA, 22 nt, Human
agcggccucgcugccugcucag

SEQ ID NO: 121484 - RNA, 22 nt, Human
agcgcugugaaggcugggccac

SEQ ID NO: 121485 - RNA, 22 nt, Human
agcggcaggacgucuucuucga

SEQ ID NO: 121486 - RNA, 22 nt, Human
agcgcuguguucccgugggcau

SEQ ID NO: 121487 - RNA, 22 nt, Human
agcggaggaggcggagcaggga

SEQ ID NO: 121488 - RNA, 21 nt, Human
aguaccugugugccugugugu

SEQ ID NO: 121489 - RNA, 22 nt, Human
agguucaucaauaacucagaga

SEQ ID NO: 121490 - RNA, 22 nt, Human
aggugggaauaauaaucaaagc

SEQ ID NO: 121491 - RNA, 22 nt, Human
agguggcuaugaggaugcaguc

SEQ ID NO: 121492 - RNA, 22 nt, Human
aggugcagcugguggagucugg

SEQ ID NO: 121493 - RNA, 22 nt, Human
aggugcauuuacuuggggcccu

SEQ ID NO: 121494 - RNA, 22 nt, Human
aggugcucaguaauugauuguu

SEQ ID NO: 121495 - RNA, 22 nt, Human
aggugcccaaaucuucuguuuu

SEQ ID NO: 121496 - RNA, 19 nt, Human
aggugaugugacucuagaa

SEQ ID NO: 121497 - RNA, 22 nt, Human
agguuaauaugaacagcagaag

SEQ ID NO: 121498 - RNA, 22 nt, Human
agguggugacgaugcuccguac

SEQ ID NO: 121499 - RNA, 22 nt, Human
agguggggacuccaccgaugcu

SEQ ID NO: 121500 - RNA, 21 nt, Human
aggugcccaggauuauuuuuu

SEQ ID NO: 121501 - RNA, 22 nt, Human
agggggaauccugcuuauggau

SEQ ID NO: 121502 - RNA, 22 nt, Human
aggguauguuuuuaucuacugu

SEQ ID NO: 121503 - RNA, 22 nt, Human
agggucgucuggguccgugggg

SEQ ID NO: 121504 - RNA, 22 nt, Human
agggcugggcuuggcaggcugg

SEQ ID NO: 121505 - RNA, 22 nt, Human
aggggcagccucacaauccucu

SEQ ID NO: 121506 - RNA, 22 nt, Human
aggguggcacucugggggcucc

SEQ ID NO: 121507 - RNA, 22 nt, Human
aggguggaggacaggccaguga

SEQ ID NO: 121508 - RNA, 22 nt, Human
aggcugucucaccucaggaggg

SEQ ID NO: 121509 - RNA, 22 nt, Human
agggcaguuuuacugaaaggug

SEQ ID NO: 121510 - RNA, 22 nt, Human
agggcaggguuggugcuggugc

SEQ ID NO: 121511 - RNA, 22 nt, Human
agggcaugugaaguaaccuagg

SEQ ID NO: 121512 - RNA, 22 nt, Human
agggagucuggccgucggcugg

SEQ ID NO: 121513 - RNA, 22 nt, Human
agggcaguguggugggacugac

SEQ ID NO: 121514 - RNA, 21 nt, Human
agggccagaucaccaaggagc

SEQ ID NO: 121515 - RNA, 22 nt, Human
agggccaagaaagaguggcuuu

SEQ ID NO: 121516 - RNA, 22 nt, Human
agggccagcagcuuggccaacc

SEQ ID NO: 121517 - RNA, 22 nt, Human
agggcccauagaucgucagcuu

SEQ ID NO: 121518 - RNA, 22 nt, Human
agggcccaccuuggugcugagg

SEQ ID NO: 121519 - RNA, 20 nt, Human
agugaguuaucagcuacagu

SEQ ID NO: 121520 - RNA, 23 nt, Human
agugaugcaguaucugggucugu

SEQ ID NO: 121521 - RNA, 23 nt, Human
agugaagcugguuagugaugacc

SEQ ID NO: 121522 - RNA, 22 nt, Human
agugaugcuuuggagaagaucc

SEQ ID NO: 121523 - RNA, 22 nt, Human
agugaugauccaaaugaauuga

SEQ ID NO: 121524 - RNA, 22 nt, Human
agugccuggcugauggguccug

SEQ ID NO: 121525 - RNA, 22 nt, Human
agugcgagaugaggacagaagc

SEQ ID NO: 121526 - RNA, 22 nt, Human
agugcucagggaaugccacuga

SEQ ID NO: 121527 - RNA, 22 nt, Human
aggugcccucucuggcuccucc

SEQ ID NO: 121528 - RNA, 22 nt, Human
aguggcuguuccaggugaggac

SEQ ID NO: 121529 - RNA, 22 nt, Human
aguggugccuaagcgcggaggc

SEQ ID NO: 121530 - RNA, 23 nt, Human
aguggccgaucaucucgggcuug

SEQ ID NO: 121531 - RNA, 22 nt, Human
aguucauccucauuuacaagga

SEQ ID NO: 121532 - RNA, 20 nt, Human
aguguugaacuacacuuccc

SEQ ID NO: 121533 - RNA, 22 nt, Human
agugugacccauggcaagggca

SEQ ID NO: 121534 - RNA, 22 nt, Human
aguguggccaaugaggaugggc

SEQ ID NO: 121535 - RNA, 22 nt, Human
aguguucaucacaggcuagaga

SEQ ID NO: 121536 - RNA, 22 nt, Human
aguggcugugaaauacauggga

SEQ ID NO: 121537 - RNA, 22 nt, Human
aguggcuggcaggggagggucc

SEQ ID NO: 121538 - RNA, 22 nt, Human
agugugaguuacaaagugugaa

SEQ ID NO: 121539 - RNA, 22 nt, Human
agugucuuuagucgcugagcaa

SEQ ID NO: 121540 - RNA, 23 nt, Human
aguguucagcauguaguaaauac

SEQ ID NO: 121541 - RNA, 22 nt, Human
aguguucaauuugagcucaaag

SEQ ID NO: 121542 - RNA, 22 nt, Human
aguggggcccaagaaucugcau

SEQ ID NO: 121543 - RNA, 18 nt, Human
auaccaggauagggacaa

SEQ ID NO: 121544 - RNA, 22 nt, Human
auacaucuuaacgcgcucuugg

SEQ ID NO: 121545 - RNA, 22 nt, Human
aguuguucucagcagaagaacu

SEQ ID NO: 121546 - RNA, 22 nt, Human
aguugguguuagaguuuuucag

SEQ ID NO: 121547 - RNA, 22 nt, Human
aguuuccacuggagacacugug

SEQ ID NO: 121548 - RNA, 22 nt, Human
aguuucccucacaggucugcau

SEQ ID NO: 121549 - RNA, 22 nt, Human
aguugguggaagcuaagcuucu

SEQ ID NO: 121550 - RNA, 22 nt, Human
aguuggaagacacccugaaauc

SEQ ID NO: 121551 - RNA, 22 nt, Human
aguugcugccagguccugggag

SEQ ID NO: 121552 - RNA, 22 nt, Human
aguucccgcgggagggcgcagg

SEQ ID NO: 121553 - RNA, 22 nt, Human
aguuccucagaagggccuggga

SEQ ID NO: 121554 - RNA, 22 nt, Human
aguucggauuguaauagauaau

SEQ ID NO: 121555 - RNA, 22 nt, Human
aguucugggaggugcacgucca

SEQ ID NO: 121556 - RNA, 21 nt, Human
auucugaguugucagucuuca

SEQ ID NO: 121557 - RNA, 17 nt, Human
auucaugaacauguccu

SEQ ID NO: 121558 - RNA, 22 nt, Human
auucaagauagaaggauuuuca

SEQ ID NO: 121559 - RNA, 22 nt, Human
auguugcugauccuguggcugu

SEQ ID NO: 121560 - RNA, 22 nt, Human
auucgcggcuugaucugcuugc

SEQ ID NO: 121561 - RNA, 20 nt, Human
auucucaccaugugacaugg

SEQ ID NO: 121562 - RNA, 22 nt, Human
auucgaucacugccgaggaccu

SEQ ID NO: 121563 - RNA, 22 nt, Human
auuccaccccauccucccaggu

SEQ ID NO: 121564 - RNA, 22 nt, Human
auugagcuguugaagucccaca

SEQ ID NO: 121565 - RNA, 21 nt, Human
auuggcagaucucuggauugu

SEQ ID NO: 121566 - RNA, 22 nt, Human
auuggccaguggacagcgccgu

SEQ ID NO: 121567 - RNA, 22 nt, Human
auuggcugucagcccggauggg

SEQ ID NO: 121568 - RNA, 22 nt, Human
augugacaagugugggcagggc

SEQ ID NO: 121569 - RNA, 22 nt, Human
auggugaugaugaugaugauaa

SEQ ID NO: 121570 - RNA, 22 nt, Human
auggugugugugugugugugug

SEQ ID NO: 121571 - RNA, 22 nt, Human
auggggaucugcaguguugauc

SEQ ID NO: 121572 - RNA, 22 nt, Human
augggucccuggccgcccucgg

SEQ ID NO: 121573 - RNA, 22 nt, Human
auguggaaagcuugucuuagag

SEQ ID NO: 121574 - RNA, 22 nt, Human
auggaagagacaaugcuaucug

SEQ ID NO: 121575 - RNA, 22 nt, Human
auggaacccgggcgucugcucu

SEQ ID NO: 121576 - RNA, 22 nt, Human
augggcauggauggccgagucu

SEQ ID NO: 121577 - RNA, 22 nt, Human
auggcaucuucgguuggacugc

SEQ ID NO: 121578 - RNA, 22 nt, Human
auggccguggccagggucaggg

SEQ ID NO: 121579 - RNA, 22 nt, Human
auggagggcagccccacuaaag

SEQ ID NO: 121580 - RNA, 22 nt, Human
augggcauacaaaugcuacccu

SEQ ID NO: 121581 - RNA, 22 nt, Human
auggaggaugugcagcaugggc

SEQ ID NO: 121582 - RNA, 22 nt, Human
auggaguguggccaggcaguaa

SEQ ID NO: 121583 - RNA, 22 nt, Human
augggcggugcauuugcacagu

SEQ ID NO: 121584 - RNA, 22 nt, Human
augggggccagggacccuggca

SEQ ID NO: 121585 - RNA, 22 nt, Human
auggaaggggagguagggagga

SEQ ID NO: 121586 - RNA, 22 nt, Human
auggagcgggaggauggaggag

SEQ ID NO: 121587 - RNA, 22 nt, Human
augcccagaacccccuggaugg

SEQ ID NO: 121588 - RNA, 22 nt, Human
augcugccuccucuucagccgc

SEQ ID NO: 121589 - RNA, 17 nt, Human
augcccagggcucccug

SEQ ID NO: 121590 - RNA, 22 nt, Human
augcccugggagugcuguacca

SEQ ID NO: 121591 - RNA, 22 nt, Human
augaggagucaaggagucggag

SEQ ID NO: 121592 - RNA, 22 nt, Human
augaaacuggagcgccuggagg

SEQ ID NO: 121593 - RNA, 22 nt, Human
augaaacucuagcuuucagcac

SEQ ID NO: 121594 - RNA, 22 nt, Human
aucuuggccuucuccuggagug

SEQ ID NO: 121595 - RNA, 21 nt, Human
aucugugucauuagguggcag

SEQ ID NO: 121596 - RNA, 22 nt, Human
aucuguuccccuaugcucucua

SEQ ID NO: 121597 - RNA, 23 nt, Human
aucugagccuggucccacccgcu

SEQ ID NO: 121598 - RNA, 22 nt, Human
aucguggcacgucgccgcagcg

SEQ ID NO: 121599 - RNA, 22 nt, Human
aucuucaaggacgccaagaucc

SEQ ID NO: 121600 - RNA, 20 nt, Human
auccuggucuuuggaagcuu

SEQ ID NO: 121601 - RNA, 22 nt, Human
auccuggcuuuccugauuuacu

SEQ ID NO: 121602 - RNA, 22 nt, Human
auccugugggguauugcugcau

SEQ ID NO: 121603 - RNA, 22 nt, Human
aucugcugccuaggguuugucu

SEQ ID NO: 121604 - RNA, 18 nt, Human
auccuucggccuagugga

SEQ ID NO: 121605 - RNA, 22 nt, Human
aucugugguacaugacggcugc

SEQ ID NO: 121606 - RNA, 22 nt, Human
aucugggaaggggaaaaugcug

SEQ ID NO: 121607 - RNA, 22 nt, Human
aucugcugcuccuucuucuugc

SEQ ID NO: 121608 - RNA, 22 nt, Human
cagcuucuccauucuucuggcu

SEQ ID NO: 121609 - RNA, 22 nt, Human
cagcuucaugacaaacaguuuu

SEQ ID NO: 121610 - RNA, 22 nt, Human
cagcuucaaaggcccugauggu

SEQ ID NO: 121611 - RNA, 22 nt, Human
caggugccucugccccacgcgg

SEQ ID NO: 121612 - RNA, 22 nt, Human
caggugcucugauauggggcug

SEQ ID NO: 121613 - RNA, 22 nt, Human
cagcuggaggagcagcuuccag

SEQ ID NO: 121614 - RNA, 22 nt, Human
caggaggaggccgggaggaagc

SEQ ID NO: 121615 - RNA, 22 nt, Human
caggaggugugucccaccgggu

SEQ ID NO: 121616 - RNA, 22 nt, Human
cagcuacuaccuguagacaaag

SEQ ID NO: 121617 - RNA, 23 nt, Human
caggggacaggugaccugggcuc

SEQ ID NO: 121618 - RNA, 22 nt, Human
caggcgcugacgggaccgggcu

SEQ ID NO: 121619 - RNA, 22 nt, Human
caggccgcccucuccuguuagc

SEQ ID NO: 121620 - RNA, 22 nt, Human
caggaucccuggccuccgccca

SEQ ID NO: 121621 - RNA, 22 nt, Human
caggccgccacugcagcagcug

SEQ ID NO: 121622 - RNA, 22 nt, Human
cagcuucacuuaaaacaugcaa

SEQ ID NO: 121623 - RNA, 22 nt, Human
cagaggagcgaguuggacgcca

SEQ ID NO: 121624 - RNA, 22 nt, Human
cagcccuugcgacacccuggcu

SEQ ID NO: 121625 - RNA, 22 nt, Human
cagccgcucaugggcccggagc

SEQ ID NO: 121626 - RNA, 22 nt, Human
caggaacagcaccaggagcuag

SEQ ID NO: 121627 - RNA, 22 nt, Human
cagcauggagacaaagugggca

SEQ ID NO: 121628 - RNA, 22 nt, Human
cagcaugguggagcugcucuuu

SEQ ID NO: 121629 - RNA, 22 nt, Human
cagcgguggcaaggugacugug

SEQ ID NO: 121630 - RNA, 22 nt, Human
caggacuuccucuaugguggcg

SEQ ID NO: 121631 - RNA, 22 nt, Human
caggacccaacggugcaauguc

SEQ ID NO: 121632 - RNA, 22 nt, Human
caggacagaaauaaggaauaua

SEQ ID NO: 121633 - RNA, 19 nt, Human
caggacaguuugccaagaa

SEQ ID NO: 121634 - RNA, 21 nt, Human
cagcccccauacccugcccag

SEQ ID NO: 121635 - RNA, 22 nt, Human
cagccccgcuggccucgccucc

SEQ ID NO: 121636 - RNA, 22 nt, Human
cagccccucuucucuccucgga

SEQ ID NO: 121637 - RNA, 22 nt, Human
cagcccugagagaaccaucuau

SEQ ID NO: 121638 - RNA, 22 nt, Human
cagguggauggcgagcccugca

SEQ ID NO: 121639 - RNA, 22 nt, Human
cauaucuuaaacaucaucucug

SEQ ID NO: 121640 - RNA, 22 nt, Human
caggugggauuuugcugcuuga

SEQ ID NO: 121641 - RNA, 22 nt, Human
caguggggcuuccagacgcuga

SEQ ID NO: 121642 - RNA, 22 nt, Human
caggcacaaugagcgccaucuu

SEQ ID NO: 121643 - RNA, 22 nt, Human
cagugcuggaggggugcuugca

SEQ ID NO: 121644 - RNA, 22 nt, Human
cagugcuccugccccugcccuu

SEQ ID NO: 121645 - RNA, 22 nt, Human
caggacccaaccucccugcucu

SEQ ID NO: 121646 - RNA, 22 nt, Human
caggaagagaacugcucagccu

SEQ ID NO: 121647 - RNA, 22 nt, Human
cagguggccggguaggaggugg

SEQ ID NO: 121648 - RNA, 22 nt, Human
cagguguugcaguugaagacug

SEQ ID NO: 121649 - RNA, 22 nt, Human
cagacacgucccuguugaccug

SEQ ID NO: 121650 - RNA, 22 nt, Human
cacagcuggggaagcugaggcc

SEQ ID NO: 121651 - RNA, 22 nt, Human
caaugcacauggacaucaggcu

SEQ ID NO: 121652 - RNA, 22 nt, Human
cacacgagcccuggagccagca

SEQ ID NO: 121653 - RNA, 22 nt, Human
cacugcugaggcccguguuacu

SEQ ID NO: 121654 - RNA, 22 nt, Human
cacugcguaguggcccgaagcu

SEQ ID NO: 121655 - RNA, 22 nt, Human
caccaucagacuucugggcagg

SEQ ID NO: 121656 - RNA, 22 nt, Human
caccaccaguaccaucacacgc

SEQ ID NO: 121657 - RNA, 22 nt, Human
caccacuuggcccugagguccu

SEQ ID NO: 121658 - RNA, 22 nt, Human
cacccccaggcuccccuucugg

SEQ ID NO: 121659 - RNA, 22 nt, Human
cacccugacuggcccugcagga

SEQ ID NO: 121660 - RNA, 22 nt, Human
caccugcaaauuccagauuucu

SEQ ID NO: 121661 - RNA, 22 nt, Human
caccuggaggcagcaccgggcu

SEQ ID NO: 121662 - RNA, 22 nt, Human
caccucagagcuccuucuucuc

SEQ ID NO: 121663 - RNA, 22 nt, Human
caccgaacuuugcaaaugcaau

SEQ ID NO: 121664 - RNA, 22 nt, Human
caccuuccgcccacugaccgcc

SEQ ID NO: 121665 - RNA, 22 nt, Human
cagaccagaaggaagccgacaa

SEQ ID NO: 121666 - RNA, 23 nt, Human
cacucgcaggcccagcucucagg

SEQ ID NO: 121667 - RNA, 22 nt, Human
cagacuccugcuccucuggggc

SEQ ID NO: 121668 - RNA, 22 nt, Human
cagaccuggaaaacaggcuugc

SEQ ID NO: 121669 - RNA, 22 nt, Human
cacuguugaagauacuuccucu

SEQ ID NO: 121670 - RNA, 22 nt, Human
cacugugagugcaagcaggggu

SEQ ID NO: 121671 - RNA, 22 nt, Human
cacugcacuccagccugggcaa

SEQ ID NO: 121672 - RNA, 22 nt, Human
cagccagaucgccuuccgccuc

SEQ ID NO: 121673 - RNA, 23 nt, Human
cagaccccuggcucugacccccu

SEQ ID NO: 121674 - RNA, 22 nt, Human
cagaccucucaggcuguucuug

SEQ ID NO: 121675 - RNA, 22 nt, Human
cagcauucuacuuugugaacug

SEQ ID NO: 121676 - RNA, 22 nt, Human
cagagagcguccauccggugcc

SEQ ID NO: 121677 - RNA, 22 nt, Human
cagcccuggccucuucgcuuuc

SEQ ID NO: 121678 - RNA, 22 nt, Human
cagcccuguugcgcuuccggcg

SEQ ID NO: 121679 - RNA, 22 nt, Human
cagcagaggagguggcagcacc

SEQ ID NO: 121680 - RNA, 21 nt, Human
cagcagaugccagggucucug

SEQ ID NO: 121681 - RNA, 22 nt, Human
cagaacugaauaaagccaggau

SEQ ID NO: 121682 - RNA, 22 nt, Human
cagcacaggugugaggccugau

SEQ ID NO: 121683 - RNA, 22 nt, Human
cacuguugagcaauguacagug

SEQ ID NO: 121684 - RNA, 22 nt, Human
cauugcuguuaauugucucuag

SEQ ID NO: 121685 - RNA, 22 nt, Human
cauccagcuccugggggccacc

SEQ ID NO: 121686 - RNA, 22 nt, Human
cauccagggguacccuggagcc

SEQ ID NO: 121687 - RNA, 22 nt, Human
caucgagaauuggcagcuaaag

SEQ ID NO: 121688 - RNA, 22 nt, Human
cauccagagcugccugaccccg

SEQ ID NO: 121689 - RNA, 22 nt, Human
caucacggagcaugagaagaca

SEQ ID NO: 121690 - RNA, 22 nt, Human
caucaacagucuacuuuuugcc

SEQ ID NO: 121691 - RNA, 22 nt, Human
caucagucugaaagccagggag

SEQ ID NO: 121692 - RNA, 21 nt, Human
caucaagaucaauggagggcu

SEQ ID NO: 121693 - RNA, 23 nt, Human
ccacuccucccaggccacccugc

SEQ ID NO: 121694 - RNA, 22 nt, Human
ccaccuggcagcaggcucggca

SEQ ID NO: 121695 - RNA, 22 nt, Human
ccaccccagaaagggaaggcca

SEQ ID NO: 121696 - RNA, 22 nt, Human
ccacccacuucucugcccucca

SEQ ID NO: 121697 - RNA, 22 nt, Human
ccacccugguuacugugccagg

SEQ ID NO: 121698 - RNA, 22 nt, Human
ccaccacugaggcacaggagcc

SEQ ID NO: 121699 - RNA, 19 nt, Human
ccacacacuggucucuggg

SEQ ID NO: 121700 - RNA, 22 nt, Human
ccacagcauugaaaucuauaau

SEQ ID NO: 121701 - RNA, 22 nt, Human
caugugguauugugagauccac

SEQ ID NO: 121702 - RNA, 22 nt, Human
ccaccacauuugccuagacuuu

SEQ ID NO: 121703 - RNA, 22 nt, Human
ccaaggugcagcccauggugaa

SEQ ID NO: 121704 - RNA, 22 nt, Human
caugguaccuagccucauggau

SEQ ID NO: 121705 - RNA, 22 nt, Human
ccaaccaguuaucuccuaaggu

SEQ ID NO: 121706 - RNA, 22 nt, Human
ccaagcguguuuaggaaaugcu

SEQ ID NO: 121707 - RNA, 22 nt, Human
ccaaggcugcagccgugacgcg

SEQ ID NO: 121708 - RNA, 22 nt, Human
caugcgucugcauuggguggug

SEQ ID NO: 121709 - RNA, 22 nt, Human
caugcuggcacugaccagccua

SEQ ID NO: 121710 - RNA, 22 nt, Human
caugggcucuucuggacugcac

SEQ ID NO: 121711 - RNA, 22 nt, Human
cauggcggcgcucucccugccu

SEQ ID NO: 121712 - RNA, 19 nt, Human
cauggcgguaaagaggcug

SEQ ID NO: 121713 - RNA, 22 nt, Human
caugccaguagccggcuugacu

SEQ ID NO: 121714 - RNA, 20 nt, Human
caugaugcaaacaguaacgu

SEQ ID NO: 121715 - RNA, 22 nt, Human
caugaugagaguaauaacacag

SEQ ID NO: 121716 - RNA, 22 nt, Human
ccaaagaagcaaugagaauagu

SEQ ID NO: 121717 - RNA, 19 nt, Human
ccaacaguacugaagcacu

SEQ ID NO: 121718 - RNA, 22 nt, Human
ccaaagaauuuggaaaaucuga

SEQ ID NO: 121719 - RNA, 22 nt, Human
ccauaaaagagaaucuaaauga

SEQ ID NO: 121720 - RNA, 22 nt, Human
ccacuacauugagugcuuucuc

SEQ ID NO: 121721 - RNA, 22 nt, Human
ccacguguugcucagacagggu

SEQ ID NO: 121722 - RNA, 22 nt, Human
ccaugauguugccuacacugcu

SEQ ID NO: 121723 - RNA, 16 nt, Human
ccacccagagaauauu

SEQ ID NO: 121724 - RNA, 22 nt, Human
ccaccucuaccuggccggccuu

SEQ ID NO: 121725 - RNA, 22 nt, Human
ccagaacgacgggcagaggcgc

SEQ ID NO: 121726 - RNA, 19 nt, Human
ccagaagggcaagcaaagg

SEQ ID NO: 121727 - RNA, 22 nt, Human
cccacccuacugcuacccagga

SEQ ID NO: 121728 - RNA, 22 nt, Human
cccaagcuccacauuuuagcuu

SEQ ID NO: 121729 - RNA, 16 nt, Human
cccaccuggacuaccu

SEQ ID NO: 121730 - RNA, 22 nt, Human
cccacgccuucuuucuucaaau

SEQ ID NO: 121731 - RNA, 22 nt, Human
ccaugggugucuggagcacccu

SEQ ID NO: 121732 - RNA, 22 nt, Human
ccagguggacggcgaguacagg

SEQ ID NO: 121733 - RNA, 22 nt, Human
ccagggcggacaaggucuuuga

SEQ ID NO: 121734 - RNA, 22 nt, Human
ccagggagggccacagggccau

SEQ ID NO: 121735 - RNA, 22 nt, Human
ccaggcucaccuggagccccug

SEQ ID NO: 121736 - RNA, 22 nt, Human
ccaguguguuuuucucugacuc

SEQ ID NO: 121737 - RNA, 22 nt, Human
ccaaggcuguggggcugugcag

SEQ ID NO: 121738 - RNA, 22 nt, Human
ccaaggcuggagggcuuaugua

SEQ ID NO: 121739 - RNA, 22 nt, Human
ccagucuuggugucuguagcac

SEQ ID NO: 121740 - RNA, 23 nt, Human
ccagucgagucccaaccuucacc

SEQ ID NO: 121741 - RNA, 23 nt, Human
ccagucgagucccaaccuucgcc

SEQ ID NO: 121742 - RNA, 22 nt, Human
ccagucugccggcccggccccu

SEQ ID NO: 121743 - RNA, 17 nt, Human
ccagcugcucccucaga

SEQ ID NO: 121744 - RNA, 23 nt, Human
ccagcugugccuggcccaggagc

SEQ ID NO: 121745 - RNA, 22 nt, Human
ccaggcccugcuccucacacca

SEQ ID NO: 121746 - RNA, 22 nt, Human
ccaggcccugccugugguuccu

SEQ ID NO: 121747 - RNA, 22 nt, Human
ccaggcagaggggucuggagca

SEQ ID NO: 121748 - RNA, 22 nt, Human
ccaggaguccgugggucuugag

SEQ ID NO: 121749 - RNA, 22 nt, Human
ccagcucgaggcaggggcugca

SEQ ID NO: 121750 - RNA, 22 nt, Human
ccagcagaagcucccgcugggu

SEQ ID NO: 121751 - RNA, 22 nt, Human
ccagccacagcuuccagcuccu

SEQ ID NO: 121752 - RNA, 22 nt, Human
ccagagaugcagugggugcagu

SEQ ID NO: 121753 - RNA, 22 nt, Human
ccagcaagacucgcagugggau

SEQ ID NO: 121754 - RNA, 22 nt, Human
ccagaugggggcugugggaggg

SEQ ID NO: 121755 - RNA, 22 nt, Human
ccagaggcuuaugcagcugcug

SEQ ID NO: 121756 - RNA, 22 nt, Human
ccagagcaccgaaacgagcuuu

SEQ ID NO: 121757 - RNA, 22 nt, Human
ccacuuucuaaauuggcgauuu

SEQ ID NO: 121758 - RNA, 22 nt, Human
ccagaacguuugugcgaggcag

SEQ ID NO: 121759 - RNA, 22 nt, Human
cauugcugccaaggugagcugg

SEQ ID NO: 121760 - RNA, 22 nt, Human
ccgcggcuguaguggaggugga

SEQ ID NO: 121761 - RNA, 22 nt, Human
ccuuggaucugcauaucagcua

SEQ ID NO: 121762 - RNA, 22 nt, Human
ccuucgcuggcaucuccaggua

SEQ ID NO: 121763 - RNA, 22 nt, Human
ccuuccaguucuugguuguaau

SEQ ID NO: 121764 - RNA, 22 nt, Human
ccggcugcugaggcggccccgg

SEQ ID NO: 121765 - RNA, 22 nt, Human
ccggauuugggagccaccaggg

SEQ ID NO: 121766 - RNA, 22 nt, Human
ccgcucgggugcagagggcaga

SEQ ID NO: 121767 - RNA, 19 nt, Human
cccagaggaaugccuggaa

SEQ ID NO: 121768 - RNA, 22 nt, Human
ccuggaccgacacaggaaggga

SEQ ID NO: 121769 - RNA, 22 nt, Human
ccgagaucagaguaggauuugg

SEQ ID NO: 121770 - RNA, 22 nt, Human
ccgcgcccccggcugugccccc

SEQ ID NO: 121771 - RNA, 21 nt, Human
ccgacggcgcagaugccggcc

SEQ ID NO: 121772 - RNA, 22 nt, Human
ccgcggcagaggcgggggcgcc

SEQ ID NO: 121773 - RNA, 22 nt, Human
ccuggccacagggcucugcauu

SEQ ID NO: 121774 - RNA, 20 nt, Human
ccugggcuccaggagccccg

SEQ ID NO: 121775 - RNA, 22 nt, Human
ccugggccuaaacaaacaagag

SEQ ID NO: 121776 - RNA, 22 nt, Human
ccuggggcucugcacagagcag

SEQ ID NO: 121777 - RNA, 22 nt, Human
ccuggcccagcuggaagcggga

SEQ ID NO: 121778 - RNA, 22 nt, Human
ccugggcauaaaucacuccaag

SEQ ID NO: 121779 - RNA, 23 nt, Human
ccuggcugaccugaagguguagu

SEQ ID NO: 121780 - RNA, 20 nt, Human
ccuguucacugcgcaguuuc

SEQ ID NO: 121781 - RNA, 22 nt, Human
ccugugucaucagcuguggcua

SEQ ID NO: 121782 - RNA, 22 nt, Human
cgcuuuccaggcacauccucuu

SEQ ID NO: 121783 - RNA, 22 nt, Human
cggagcgagaaggggaaagccc

SEQ ID NO: 121784 - RNA, 22 nt, Human
cggaggagcugcgcggaggggg

SEQ ID NO: 121785 - RNA, 22 nt, Human
cggagguccagucacaaguaac

SEQ ID NO: 121786 - RNA, 22 nt, Human
cgggacaauagcagugcugaug

SEQ ID NO: 121787 - RNA, 22 nt, Human
cggagggcccucaggacugggu

SEQ ID NO: 121788 - RNA, 22 nt, Human
ccugagccgagcgcucuuucuc

SEQ ID NO: 121789 - RNA, 22 nt, Human
ccugagacucuccugugcagcc

SEQ ID NO: 121790 - RNA, 22 nt, Human
cgccgugcagucagcccagaag

SEQ ID NO: 121791 - RNA, 22 nt, Human
cgccgccgccugcccgcgcccc

SEQ ID NO: 121792 - RNA, 22 nt, Human
ccugacucugauuucgcugcau

SEQ ID NO: 121793 - RNA, 22 nt, Human
cgaggcuugcaaggacgaggag

SEQ ID NO: 121794 - RNA, 22 nt, Human
cgagggcuggaggggagacaga

SEQ ID NO: 121795 - RNA, 22 nt, Human
cgaggccgcuucauggcuggca

SEQ ID NO: 121796 - RNA, 22 nt, Human
cgagugauuauucuggcugaga

SEQ ID NO: 121797 - RNA, 22 nt, Human
ccucccagccuggagaggagcc

SEQ ID NO: 121798 - RNA, 21 nt, Human
ccuccagccagagggucugga

SEQ ID NO: 121799 - RNA, 19 nt, Human
ccuccguguuaccuguccu

SEQ ID NO: 121800 - RNA, 22 nt, Human
ccucggacuugggugggcuccu

SEQ ID NO: 121801 - RNA, 22 nt, Human
ccuaggcccauuaauuccccuu

SEQ ID NO: 121802 - RNA, 22 nt, Human
cgaacggcagagagcccguccc

SEQ ID NO: 121803 - RNA, 22 nt, Human
ccgugggugggguacgggcugg

SEQ ID NO: 121804 - RNA, 22 nt, Human
ccggguucuuguucuaggaugu

SEQ ID NO: 121805 - RNA, 22 nt, Human
ccggguccagugggcacugggc

SEQ ID NO: 121806 - RNA, 22 nt, Human
cgucauuuguaaaugaucaaga

SEQ ID NO: 121807 - RNA, 22 nt, Human
cgugaucuguuauauagugagc

SEQ ID NO: 121808 - RNA, 17 nt, Human
cgugaggaccaggcagc

SEQ ID NO: 121809 - RNA, 22 nt, Human
cgugaagaaguaauagguggug

SEQ ID NO: 121810 - RNA, 22 nt, Human
ccuggcccugcugcuugccagc

SEQ ID NO: 121811 - RNA, 19 nt, Human
ccuggccaacgucaacauu

SEQ ID NO: 121812 - RNA, 22 nt, Human
cgccuggccccgcagcgcuugu

SEQ ID NO: 121813 - RNA, 21 nt, Human
ccuggagacaaagacagggug

SEQ ID NO: 121814 - RNA, 22 nt, Human
cgggagaugaggagagcuucgg

SEQ ID NO: 121815 - RNA, 22 nt, Human
ccuucugcuggucaucccagug

SEQ ID NO: 121816 - RNA, 21 nt, Human
ccuugcacucaucccaugccc

SEQ ID NO: 121817 - RNA, 22 nt, Human
cgcacuggagcuggaacgaguc

SEQ ID NO: 121818 - RNA, 22 nt, Human
cgcacacaaaugcauacgccag

SEQ ID NO: 121819 - RNA, 22 nt, Human
cgagguuuaugaguuuguguuc

SEQ ID NO: 121820 - RNA, 22 nt, Human
cuacuucucccuagaucagaaa

SEQ ID NO: 121821 - RNA, 22 nt, Human
cgugucauggcggcgcaggugg

SEQ ID NO: 121822 - RNA, 20 nt, Human
cguguacauuuaugccccug

SEQ ID NO: 121823 - RNA, 22 nt, Human
cuaccccaggccccucgaugcc

SEQ ID NO: 121824 - RNA, 22 nt, Human
cgaggagguccaggagcaguag

SEQ ID NO: 121825 - RNA, 22 nt, Human
cucugcccacaguccccgagga

SEQ ID NO: 121826 - RNA, 22 nt, Human
cggcccggccucgcggcgcaug

SEQ ID NO: 121827 - RNA, 22 nt, Human
cuccggggacgcagucgccgcc

SEQ ID NO: 121828 - RNA, 22 nt, Human
cuccugauuucuaggccuuauc

SEQ ID NO: 121829 - RNA, 22 nt, Human
cuccugcuuuuucuucuuccga

SEQ ID NO: 121830 - RNA, 22 nt, Human
cgcuggagagcaagugcgugca

SEQ ID NO: 121831 - RNA, 22 nt, Human
cgcugggugguugauguacagc

SEQ ID NO: 121832 - RNA, 22 nt, Human
cuccagcagaaagggcgagugg

SEQ ID NO: 121833 - RNA, 22 nt, Human
cuccagauuugggggauauacu

SEQ ID NO: 121834 - RNA, 22 nt, Human
cuccagagagaaaggaggccgc

SEQ ID NO: 121835 - RNA, 22 nt, Human
cuccacagccccuccaguggca

SEQ ID NO: 121836 - RNA, 22 nt, Human
cuccggccuucugacuccccug

SEQ ID NO: 121837 - RNA, 22 nt, Human
cgccgugucuggucuguacguc

SEQ ID NO: 121838 - RNA, 22 nt, Human
cucaagacacccuggccucuac

SEQ ID NO: 121839 - RNA, 22 nt, Human
cucaauuguuuggucucugguu

SEQ ID NO: 121840 - RNA, 22 nt, Human
cucaagugacucagccugguug

SEQ ID NO: 121841 - RNA, 22 nt, Human
cucagcaacccacacacggucu

SEQ ID NO: 121842 - RNA, 22 nt, Human
cucagcgagggaaagaggccgc

SEQ ID NO: 121843 - RNA, 22 nt, Human
cucagcgggagucuggccgaac

SEQ ID NO: 121844 - RNA, 22 nt, Human
cucaggugagcgagcuaaauua

SEQ ID NO: 121845 - RNA, 22 nt, Human
cgccaaccaggcuguccuccca

SEQ ID NO: 121846 - RNA, 22 nt, Human
cgcagcuucagggccaggaggg

SEQ ID NO: 121847 - RNA, 22 nt, Human
cuaggucagaggacacagcuua

SEQ ID NO: 121848 - RNA, 22 nt, Human
cgcccggcugagacgcucgccc

SEQ ID NO: 121849 - RNA, 22 nt, Human
cgcccguacuuugccggcauga

SEQ ID NO: 121850 - RNA, 21 nt, Human
cgcccggccggaaaccccuuc

SEQ ID NO: 121851 - RNA, 22 nt, Human
cugauggagagugugauuuggg

SEQ ID NO: 121852 - RNA, 22 nt, Human
cguggccacaguggagcugagc

SEQ ID NO: 121853 - RNA, 22 nt, Human
cguggcaguagagcuggaacuu

SEQ ID NO: 121854 - RNA, 22 nt, Human
cgugccugguggagagcgaggg

SEQ ID NO: 121855 - RNA, 22 nt, Human
cguggaggucgcauauuccucu

SEQ ID NO: 121856 - RNA, 21 nt, Human
cgucccggcgugagagagcug

SEQ ID NO: 121857 - RNA, 22 nt, Human
cugaggaguaguucuggaggac

SEQ ID NO: 121858 - RNA, 22 nt, Human
cugagcggugagggcauacagc

SEQ ID NO: 121859 - RNA, 22 nt, Human
cgucagccacagcugccccggg

SEQ ID NO: 121860 - RNA, 22 nt, Human
cugcaguguccgcuugcucagc

SEQ ID NO: 121861 - RNA, 22 nt, Human
cugauguuuaucucaagaguuc

SEQ ID NO: 121862 - RNA, 22 nt, Human
cugauuucaaauggugcuagau

SEQ ID NO: 121863 - RNA, 21 nt, Human
cugcacugugauuuaaaaugu

SEQ ID NO: 121864 - RNA, 22 nt, Human
cgugugugugcgugugcgugug

SEQ ID NO: 121865 - RNA, 22 nt, Human
cgugugcguauguguuuguaug

SEQ ID NO: 121866 - RNA, 22 nt, Human
cgugcuaccugagcugacagcu

SEQ ID NO: 121867 - RNA, 22 nt, Human
cgugggggcaacgaccccuccc

SEQ ID NO: 121868 - RNA, 22 nt, Human
cugaugugcauguggggggaug

SEQ ID NO: 121869 - RNA, 22 nt, Human
cguugguggguguguggucgga

SEQ ID NO: 121870 - RNA, 22 nt, Human
cugcuguuuucugggcuucuua

SEQ ID NO: 121871 - RNA, 22 nt, Human
cugcugcuugauugcaggaagu

SEQ ID NO: 121872 - RNA, 22 nt, Human
cugcuggugcugcccacacggu

SEQ ID NO: 121873 - RNA, 21 nt, Human
cugcugaaggaaccccaugga

SEQ ID NO: 121874 - RNA, 22 nt, Human
cuagguggcagcacuccgaggu

SEQ ID NO: 121875 - RNA, 22 nt, Human
cugcuacgguguccgguggggc

SEQ ID NO: 121876 - RNA, 22 nt, Human
cuaccagcacgccuuccucuac

SEQ ID NO: 121877 - RNA, 22 nt, Human
cugccggcugcugcagagaggu

SEQ ID NO: 121878 - RNA, 23 nt, Human
cugagggcuggucugaagucugc

SEQ ID NO: 121879 - RNA, 22 nt, Human
cugaagaaagaaaauggccauc

SEQ ID NO: 121880 - RNA, 22 nt, Human
cuguuguguuauuugcagugca

SEQ ID NO: 121881 - RNA, 22 nt, Human
cuguucuccacuccugacuucu

SEQ ID NO: 121882 - RNA, 22 nt, Human
cuguguuguuugaguagcuuga

SEQ ID NO: 121883 - RNA, 22 nt, Human
cugaaacucaagauaggaggaa

SEQ ID NO: 121884 - RNA, 22 nt, Human
cugugcauguucucuagcugau

SEQ ID NO: 121885 - RNA, 22 nt, Human
cuggugggucacgugugggugg

SEQ ID NO: 121886 - RNA, 22 nt, Human
cuggugaagccuucggagaccc

SEQ ID NO: 121887 - RNA, 22 nt, Human
cuggugagaccgacuuccacuu

SEQ ID NO: 121888 - RNA, 19 nt, Human
cuguccacacacucgcuuc

SEQ ID NO: 121889 - RNA, 22 nt, Human
cuguccugauggugccacuggu

SEQ ID NO: 121890 - RNA, 22 nt, Human
cuggcgauugcgagagucgccu

SEQ ID NO: 121891 - RNA, 22 nt, Human
cuggcggugaucccgauggugu

SEQ ID NO: 121892 - RNA, 22 nt, Human
cuggcggcccgaggcagaggag

SEQ ID NO: 121893 - RNA, 22 nt, Human
cucccucauaugguugcuuauc

SEQ ID NO: 121894 - RNA, 22 nt, Human
cuccacccuagagggcccaugc

SEQ ID NO: 121895 - RNA, 22 nt, Human
cugggagggguagccaauccua

SEQ ID NO: 121896 - RNA, 22 nt, Human
cugggaggagacaggggauggg

SEQ ID NO: 121897 - RNA, 22 nt, Human
cuccgccuguccugggcccacg

SEQ ID NO: 121898 - RNA, 22 nt, Human
cucccugagaugcaggagagag

SEQ ID NO: 121899 - RNA, 22 nt, Human
cuccgaaaugcaucccagggca

SEQ ID NO: 121900 - RNA, 22 nt, Human
cuccgcagcugggguuggcgcu

SEQ ID NO: 121901 - RNA, 22 nt, Human
cuggucaauaaucauguaguac

SEQ ID NO: 121902 - RNA, 22 nt, Human
cucugagcucgugcaguacuuc

SEQ ID NO: 121903 - RNA, 22 nt, Human
cugggugugugugaacagagau

SEQ ID NO: 121904 - RNA, 22 nt, Human
cucuaccugcacaugccugacu

SEQ ID NO: 121905 - RNA, 22 nt, Human
cuggguguggugggugcugccg

SEQ ID NO: 121906 - RNA, 22 nt, Human
cugggcaugggaacuucaaggc

SEQ ID NO: 121907 - RNA, 22 nt, Human
cugggguggugcaggccucaug

SEQ ID NO: 121908 - RNA, 22 nt, Human
cugcuucacccugccugagaac

SEQ ID NO: 121909 - RNA, 22 nt, Human
cucaugaauggcucuuugugcu

SEQ ID NO: 121910 - RNA, 22 nt, Human
cucaugcugcaaauggcuguuu

SEQ ID NO: 121911 - RNA, 22 nt, Human
cucaugagucugucagagucau

SEQ ID NO: 121912 - RNA, 22 nt, Human
cuggcaguguccagcucgugau

SEQ ID NO: 121913 - RNA, 22 nt, Human
cucagcacauuccuaagggaug

SEQ ID NO: 121914 - RNA, 22 nt, Human
cuguccccauugcugucccugg

SEQ ID NO: 121915 - RNA, 22 nt, Human
cuguccuguggccugcuccggu

SEQ ID NO: 121916 - RNA, 22 nt, Human
cuggugcuguagccugauugag

SEQ ID NO: 121917 - RNA, 22 nt, Human
gaaccauuuaauggagaugcuc

SEQ ID NO: 121918 - RNA, 22 nt, Human
gaaccuggcagcccuauaucug

SEQ ID NO: 121919 - RNA, 22 nt, Human
gaacggccucguuccucggugu

SEQ ID NO: 121920 - RNA, 22 nt, Human
cuguuacggaggcuuucuaguu

SEQ ID NO: 121921 - RNA, 22 nt, Human
cuguuguucacuuugcugguga

SEQ ID NO: 121922 - RNA, 22 nt, Human
gaacugggguagggguagcuuu

SEQ ID NO: 121923 - RNA, 22 nt, Human
gaagaaggaagaucaugcuuga

SEQ ID NO: 121924 - RNA, 22 nt, Human
cuguccauuuucgugccuccuu

SEQ ID NO: 121925 - RNA, 22 nt, Human
cugugggcucucaugggaccug

SEQ ID NO: 121926 - RNA, 22 nt, Human
gaacaaggauucccaaagaaga

SEQ ID NO: 121927 - RNA, 22 nt, Human
gaaagaggcugucagggaaugg

SEQ ID NO: 121928 - RNA, 22 nt, Human
cugggcuuucaggcccuaaggc

SEQ ID NO: 121929 - RNA, 22 nt, Human
cugggcucccucucccgccucg

SEQ ID NO: 121930 - RNA, 22 nt, Human
cugggugagcuggccagagggu

SEQ ID NO: 121931 - RNA, 22 nt, Human
cugggggacagagagaggcggu

SEQ ID NO: 121932 - RNA, 22 nt, Human
cugggugggcacccagccuggg

SEQ ID NO: 121933 - RNA, 22 nt, Human
cuuuuggcaucagccucaggaa

SEQ ID NO: 121934 - RNA, 22 nt, Human
cugggaaucuagagggcucauu

SEQ ID NO: 121935 - RNA, 22 nt, Human
cugggacacguugugcuuuaac

SEQ ID NO: 121936 - RNA, 22 nt, Human
cugggagaugacucagagcagg

SEQ ID NO: 121937 - RNA, 22 nt, Human
cugggaugagcuguuuccuggu

SEQ ID NO: 121938 - RNA, 22 nt, Human
cuggagcucugggcaucucagg

SEQ ID NO: 121939 - RNA, 22 nt, Human
cuggagucagcaaggacgaggc

SEQ ID NO: 121940 - RNA, 22 nt, Human
cugaugcucuggauguagucaa

SEQ ID NO: 121941 - RNA, 22 nt, Human
cugauccuauauugguaugagg

SEQ ID NO: 121942 - RNA, 21 nt, Human
cuggcucgccaugguucuuuu

SEQ ID NO: 121943 - RNA, 22 nt, Human
cuggcuguguguuugugcaucu

SEQ ID NO: 121944 - RNA, 22 nt, Human
cuggcuuucauggcgcaguuga

SEQ ID NO: 121945 - RNA, 22 nt, Human
cuggccuuaucacaaagcuaga

SEQ ID NO: 121946 - RNA, 22 nt, Human
gacaagaagaacggagguuuca

SEQ ID NO: 121947 - RNA, 22 nt, Human
cuugugggaucuggagacaccg

SEQ ID NO: 121948 - RNA, 22 nt, Human
gacaccuucuacugacuaugga

SEQ ID NO: 121949 - RNA, 22 nt, Human
gacacccgccggcgccugccuc

SEQ ID NO: 121950 - RNA, 20 nt, Human
gacaagccacagcucccaga

SEQ ID NO: 121951 - RNA, 22 nt, Human
cuuggggcuugcuguuguagcc

SEQ ID NO: 121952 - RNA, 22 nt, Human
gaagaugcugcuuguucacggg

SEQ ID NO: 121953 - RNA, 22 nt, Human
gaaggugcugaaacagaaauuu

SEQ ID NO: 121954 - RNA, 23 nt, Human
cuucggcgcucgcugggcggagg

SEQ ID NO: 121955 - RNA, 22 nt, Human
cuugcagccuggagcucagccu

SEQ ID NO: 121956 - RNA, 22 nt, Human
gaaggggccuggggcaaggcua

SEQ ID NO: 121957 - RNA, 22 nt, Human
gagaacaaggaagagucggcag

SEQ ID NO: 121958 - RNA, 22 nt, Human
gagacugcguggcucugacaca

SEQ ID NO: 121959 - RNA, 22 nt, Human
gaaaacccuguauguagcguuu

SEQ ID NO: 121960 - RNA, 22 nt, Human
gagaccaagcgugggugauaau

SEQ ID NO: 121961 - RNA, 22 nt, Human
gagaaaaauuucuuugcugcac

SEQ ID NO: 121962 - RNA, 22 nt, Human
cuuuggggcugaggaggagguu

SEQ ID NO: 121963 - RNA, 22 nt, Human
gaccgggcucugcugacggucu

SEQ ID NO: 121964 - RNA, 22 nt, Human
gacccugaggauucccugcuga

SEQ ID NO: 121965 - RNA, 23 nt, Human
gaccucuuccuccagccucugaa

SEQ ID NO: 121966 - RNA, 22 nt, Human
gaccugaccucauuagcaaguu

SEQ ID NO: 121967 - RNA, 22 nt, Human
gaccugguggccauugucccag

SEQ ID NO: 121968 - RNA, 22 nt, Human
gacagaccucugcugacuggag

SEQ ID NO: 121969 - RNA, 22 nt, Human
gacacugccaagugccccgaga

SEQ ID NO: 121970 - RNA, 22 nt, Human
gacagcuauggaguucacuucu

SEQ ID NO: 121971 - RNA, 22 nt, Human
gagaaugagucagagcuggcug

SEQ ID NO: 121972 - RNA, 22 nt, Human
gagaaguagcgucuucccgggg

SEQ ID NO: 121973 - RNA, 22 nt, Human
gagaaaacauacuuaguguccu

SEQ ID NO: 121974 - RNA, 23 nt, Human
gacuucacacucucaaccacugc

SEQ ID NO: 121975 - RNA, 22 nt, Human
gauaccugccaagcugcacuca

SEQ ID NO: 121976 - RNA, 22 nt, Human
gacugucaaauaaaucguuuac

SEQ ID NO: 121977 - RNA, 22 nt, Human
gaguuucacguagaucaggguc

SEQ ID NO: 121978 - RNA, 22 nt, Human
gacuggucuuuugugauggaug

SEQ ID NO: 121979 - RNA, 22 nt, Human
gacugggacucaacccaccauu

SEQ ID NO: 121980 - RNA, 22 nt, Human
gaguaucagauuggaguccuca

SEQ ID NO: 121981 - RNA, 22 nt, Human
gaguagccucagucugcaagug

SEQ ID NO: 121982 - RNA, 22 nt, Human
gacaucuguccauggcacugga

SEQ ID NO: 121983 - RNA, 22 nt, Human
gacccgacaaguaaucagguga

SEQ ID NO: 121984 - RNA, 22 nt, Human
gaguggccugccccagccaggc

SEQ ID NO: 121985 - RNA, 22 nt, Human
gacggggcagccagcugguggc

SEQ ID NO: 121986 - RNA, 22 nt, Human
gacggaggacaucagcaguguc

SEQ ID NO: 121987 - RNA, 20 nt, Human
gacgaacuagaacaguggua

SEQ ID NO: 121988 - RNA, 22 nt, Human
gaccugcucagcccuguguguu

SEQ ID NO: 121989 - RNA, 22 nt, Human
gagggugugguauggauguguu

SEQ ID NO: 121990 - RNA, 22 nt, Human
gagggggcaggcucggcaccgg

SEQ ID NO: 121991 - RNA, 22 nt, Human
gagggggcggccccugugggca

SEQ ID NO: 121992 - RNA, 22 nt, Human
gacaagaugacaucauggcuuc

SEQ ID NO: 121993 - RNA, 22 nt, Human
gagggugguggcggccggcacc

SEQ ID NO: 121994 - RNA, 22 nt, Human
gaggguggggaauagacugcua

SEQ ID NO: 121995 - RNA, 22 nt, Human
gagguccaggguggggccugag

SEQ ID NO: 121996 - RNA, 22 nt, Human
gaggucagcaagccaugcuugu

SEQ ID NO: 121997 - RNA, 22 nt, Human
gagguagcgugcagggcccgaa

SEQ ID NO: 121998 - RNA, 22 nt, Human
gacaguggagccacguugggag

SEQ ID NO: 121999 - RNA, 22 nt, Human
gagguguguuacuaaauuuauc

SEQ ID NO: 122000 - RNA, 22 nt, Human
gacaggaccgagguggggcggg

SEQ ID NO: 122001 - RNA, 22 nt, Human
gaggugcaggggcccgggcugg

SEQ ID NO: 122002 - RNA, 22 nt, Human
gacaggcagagaggaagagaga

SEQ ID NO: 122003 - RNA, 22 nt, Human
gacagcguguuuugcaugaaca

SEQ ID NO: 122004 - RNA, 22 nt, Human
gaggugaacccaggugcuucac

SEQ ID NO: 122005 - RNA, 22 nt, Human
gaggggcugggguugacuccaa

SEQ ID NO: 122006 - RNA, 22 nt, Human
gaggggcaagaaguuggccucu

SEQ ID NO: 122007 - RNA, 22 nt, Human
gaggggcgaggacgcugaagua

SEQ ID NO: 122008 - RNA, 22 nt, Human
gagggcugccacguugggcgag

SEQ ID NO: 122009 - RNA, 22 nt, Human
gaggggaaggauuucuucagaa

SEQ ID NO: 122010 - RNA, 22 nt, Human
gagggagagaugcuggaccggg

SEQ ID NO: 122011 - RNA, 22 nt, Human
gaggaucuuuagcgggacugcu

SEQ ID NO: 122012 - RNA, 22 nt, Human
gaagucagaucuuuugacuccc

SEQ ID NO: 122013 - RNA, 22 nt, Human
gaggcagaggaugggacuguau

SEQ ID NO: 122014 - RNA, 20 nt, Human
gaaucuggucaaaugucuau

SEQ ID NO: 122015 - RNA, 22 nt, Human
gaaugcacacgugugugcaugc

SEQ ID NO: 122016 - RNA, 22 nt, Human
gaggcgcgcugcgagggcgcgg

SEQ ID NO: 122017 - RNA, 22 nt, Human
gaggccagcacccagaugcaug

SEQ ID NO: 122018 - RNA, 22 nt, Human
gaggagcuucagaggaaucuua

SEQ ID NO: 122019 - RNA, 22 nt, Human
gaggaggagaagcggcggcgga

SEQ ID NO: 122020 - RNA, 22 nt, Human
gaggagggagcuggaagcucuu

SEQ ID NO: 122021 - RNA, 22 nt, Human
gaggaggcuggagaggccagga

SEQ ID NO: 122022 - RNA, 22 nt, Human
gaggaggucaccuggugagcaa

SEQ ID NO: 122023 - RNA, 22 nt, Human
gaggauaaugaaucugaaucau

SEQ ID NO: 122024 - RNA, 22 nt, Human
gaggagcggugcaugugggggc

SEQ ID NO: 122025 - RNA, 22 nt, Human
gaagggccaggggcaggcugga

SEQ ID NO: 122026 - RNA, 22 nt, Human
gaaggcuguggcuggucucagu

SEQ ID NO: 122027 - RNA, 22 nt, Human
gaaggcagucuggggagcagcc

SEQ ID NO: 122028 - RNA, 22 nt, Human
cuggggccccagcucggccccu

SEQ ID NO: 122029 - RNA, 22 nt, Human
gaggacuucaggccuggccagg

SEQ ID NO: 122030 - RNA, 22 nt, Human
gaggacccuuaggucagacaga

SEQ ID NO: 122031 - RNA, 22 nt, Human
gagcuggacauacaggaaacca

SEQ ID NO: 122032 - RNA, 22 nt, Human
gaaggcaguaaauggcuguuuu

SEQ ID NO: 122033 - RNA, 21 nt, Human
gaagcugcuaugaagggggac

SEQ ID NO: 122034 - RNA, 22 nt, Human
gagcucucgggcuggggcguug

SEQ ID NO: 122035 - RNA, 22 nt, Human
gagcgugaggcagcuuucuaag

SEQ ID NO: 122036 - RNA, 22 nt, Human
gagcggcucaguggccauguga

SEQ ID NO: 122037 - RNA, 22 nt, Human
gaagcccuggaggggcuggagg

SEQ ID NO: 122038 - RNA, 22 nt, Human
gagccuggagcuggaacgaagc

SEQ ID NO: 122039 - RNA, 19 nt, Human
gagccgcucccgcagccgg

SEQ ID NO: 122040 - RNA, 22 nt, Human
gaagcagguucuucaggaugaa

SEQ ID NO: 122041 - RNA, 22 nt, Human
gaagcaccuggacggugccugg

SEQ ID NO: 122042 - RNA, 17 nt, Human
uuugugauggcagaugc

SEQ ID NO: 122043 - RNA, 23 nt, Human
gcugaagcccacucccugggucu

SEQ ID NO: 122044 - RNA, 22 nt, Human
gcaugcuguuuggaaacgauaa

SEQ ID NO: 122045 - RNA, 22 nt, Human
gcucggcuggcucaucucaugu

SEQ ID NO: 122046 - RNA, 22 nt, Human
gcaugcgugcgugcgugcaugu

SEQ ID NO: 122047 - RNA, 22 nt, Human
gcucaugggcccagagcagccc

SEQ ID NO: 122048 - RNA, 23 nt, Human
gcaucgcaggucuaagauuagcu

SEQ ID NO: 122049 - RNA, 22 nt, Human
gcaucacacgcacauacacaca

SEQ ID NO: 122050 - RNA, 22 nt, Human
gcucagcuggagagggacgggu

SEQ ID NO: 122051 - RNA, 22 nt, Human
gcucagagaugucugcugccuu

SEQ ID NO: 122052 - RNA, 22 nt, Human
gcuaguucugccuccccuagug

SEQ ID NO: 122053 - RNA, 22 nt, Human
gcuaggagccucgacucuggag

SEQ ID NO: 122054 - RNA, 22 nt, Human
gcgguuggacguucgccucggg

SEQ ID NO: 122055 - RNA, 22 nt, Human
gcagguggaagcagcagacuca

SEQ ID NO: 122056 - RNA, 22 nt, Human
gcguggccugcugaaggacuuc

SEQ ID NO: 122057 - RNA, 22 nt, Human
gcaguccuugcuguguaauaaa

SEQ ID NO: 122058 - RNA, 22 nt, Human
gcaguccuguagcgacuuuuuu

SEQ ID NO: 122059 - RNA, 22 nt, Human
gcagugccauguggaggaucuc

SEQ ID NO: 122060 - RNA, 22 nt, Human
gcagggcucagccgcucccacc

SEQ ID NO: 122061 - RNA, 22 nt, Human
gcaggccuccccugcuggagcu

SEQ ID NO: 122062 - RNA, 22 nt, Human
gcaggcagauccagaagcacua

SEQ ID NO: 122063 - RNA, 22 nt, Human
gcaggagggggccuggagccca

SEQ ID NO: 122064 - RNA, 22 nt, Human
gcgggcgcuguggccccggccu

SEQ ID NO: 122065 - RNA, 23 nt, Human
gcgggcggagccgggaggcgggg

SEQ ID NO: 122066 - RNA, 20 nt, Human
gcagcugacccuagugcuug

SEQ ID NO: 122067 - RNA, 22 nt, Human
gcggacaauggaagaugucauu

SEQ ID NO: 122068 - RNA, 22 nt, Human
gcgcggcgcggguccucggccu

SEQ ID NO: 122069 - RNA, 22 nt, Human
gcgcacaaccccguggcgguga

SEQ ID NO: 122070 - RNA, 22 nt, Human
gcagauccaaauauaguucuug

SEQ ID NO: 122071 - RNA, 20 nt, Human
gcgcaguuccgggcgcgucu

SEQ ID NO: 122072 - RNA, 22 nt, Human
gcgcgcucugcgaggacacgcu

SEQ ID NO: 122073 - RNA, 22 nt, Human
gcgccuugccuguccucuaacc

SEQ ID NO: 122074 - RNA, 22 nt, Human
gcgcgccugccucccgcggugc

SEQ ID NO: 122075 - RNA, 22 nt, Human
gcagagcacccugcagugguau

SEQ ID NO: 122076 - RNA, 21 nt, Human
gccugcuguucacccugccac

SEQ ID NO: 122077 - RNA, 22 nt, Human
gccugcugggcucuuccugcug

SEQ ID NO: 122078 - RNA, 21 nt, Human
gcagaacuaggacuugaacau

SEQ ID NO: 122079 - RNA, 22 nt, Human
gcagagaaugucagauuuuguu

SEQ ID NO: 122080 - RNA, 22 nt, Human
gccugcaggaaggugugccugu

SEQ ID NO: 122081 - RNA, 22 nt, Human
gcacccagggcaggaagugagg

SEQ ID NO: 122082 - RNA, 18 nt, Human
gccugccagccgagggac

SEQ ID NO: 122083 - RNA, 22 nt, Human
gccugccucugacuggggcuga

SEQ ID NO: 122084 - RNA, 22 nt, Human
gcaaggacagaagcccacacag

SEQ ID NO: 122085 - RNA, 22 nt, Human
gauuccugcuauucacagggcu

SEQ ID NO: 122086 - RNA, 22 nt, Human
gcccugccauugaucggcccag

SEQ ID NO: 122087 - RNA, 20 nt, Human
gcccuucccccuccgcgagc

SEQ ID NO: 122088 - RNA, 22 nt, Human
gcccuguguguuugcacugauu

SEQ ID NO: 122089 - RNA, 22 nt, Human
gcccgaccgcgccggcccgcac

SEQ ID NO: 122090 - RNA, 22 nt, Human
gcccccgccuugcugggccagg

SEQ ID NO: 122091 - RNA, 22 nt, Human
gaugucauguuggcagacaguu

SEQ ID NO: 122092 - RNA, 22 nt, Human
gaugggaggaugaauuggaccu

SEQ ID NO: 122093 - RNA, 22 nt, Human
gcccauggagaccucaggcugg

SEQ ID NO: 122094 - RNA, 22 nt, Human
gaucccccaucuacuaucccca

SEQ ID NO: 122095 - RNA, 22 nt, Human
gauggugauggcccuaagcuga

SEQ ID NO: 122096 - RNA, 22 nt, Human
gauggugcaauuaucgugcaug

SEQ ID NO: 122097 - RNA, 23 nt, Human
gccaucugcugggugccccggcc

SEQ ID NO: 122098 - RNA, 22 nt, Human
gcccagcuuuuugaggcaggca

SEQ ID NO: 122099 - RNA, 22 nt, Human
gccccaaccccuccuuggucua

SEQ ID NO: 122100 - RNA, 22 nt, Human
gaucuuacucacuucagcuggc

SEQ ID NO: 122101 - RNA, 22 nt, Human
gaucugguuccaggacauugca

SEQ ID NO: 122102 - RNA, 22 nt, Human
gaucccagaggcggggauagga

SEQ ID NO: 122103 - RNA, 22 nt, Human
gauccagauauuugggcuggua

SEQ ID NO: 122104 - RNA, 22 nt, Human
gccaggcggcccaggagauggc

SEQ ID NO: 122105 - RNA, 22 nt, Human
gccaggugauuucaaaguccuu

SEQ ID NO: 122106 - RNA, 22 nt, Human
gccaggcagcagcgaggauggu

SEQ ID NO: 122107 - RNA, 22 nt, Human
gccaggccuggguggagcgcuc

SEQ ID NO: 122108 - RNA, 22 nt, Human
gcaugcaggaagggcuugggga

SEQ ID NO: 122109 - RNA, 22 nt, Human
gcauccugacuauggugguggu

SEQ ID NO: 122110 - RNA, 19 nt, Human
gccacccaucauauggagg

SEQ ID NO: 122111 - RNA, 22 nt, Human
gccaaucaggaggcuguacauc

SEQ ID NO: 122112 - RNA, 21 nt, Human
gcauccucguacucuucaggu

SEQ ID NO: 122113 - RNA, 22 nt, Human
gaguggugagaauacaacggaa

SEQ ID NO: 122114 - RNA, 22 nt, Human
gagugaucuguaggcagcaugg

SEQ ID NO: 122115 - RNA, 22 nt, Human
gaguccuggagagcccgagcgc

SEQ ID NO: 122116 - RNA, 22 nt, Human
gcaguuguagcuguuucuacuc

SEQ ID NO: 122117 - RNA, 23 nt, Human
gcaguggagcgagaacuuccugu

SEQ ID NO: 122118 - RNA, 22 nt, Human
gcagugcugcgacagucgggug

SEQ ID NO: 122119 - RNA, 22 nt, Human
gcagguccgagagggucgggua

SEQ ID NO: 122120 - RNA, 22 nt, Human
gaucuguccuggcaguuaacac

SEQ ID NO: 122121 - RNA, 22 nt, Human
gcaggucacagcugauuggcca

SEQ ID NO: 122122 - RNA, 22 nt, Human
gcaggggguaaggggcagggcu

SEQ ID NO: 122123 - RNA, 22 nt, Human
gcagggcucuggagucaggcug

SEQ ID NO: 122124 - RNA, 21 nt, Human
gcaggggugugugagcugggg

SEQ ID NO: 122125 - RNA, 22 nt, Human
gauccucagacccuccucuggu

SEQ ID NO: 122126 - RNA, 22 nt, Human
gcuuuggcuucuccuggcagga

SEQ ID NO: 122127 - RNA, 22 nt, Human
gcuugggcugaaggccuggguc

SEQ ID NO: 122128 - RNA, 22 nt, Human
gccgcgggucugggucuggcuc

SEQ ID NO: 122129 - RNA, 18 nt, Human
gccgccuugcucgugaac

SEQ ID NO: 122130 - RNA, 22 nt, Human
gccgcguggcagucuuggugac

SEQ ID NO: 122131 - RNA, 22 nt, Human
gccuccuuccgaccucaguccu

SEQ ID NO: 122132 - RNA, 22 nt, Human
gccuccgccuuccugucucccc

SEQ ID NO: 122133 - RNA, 22 nt, Human
gccguuccuacucucucugugu

SEQ ID NO: 122134 - RNA, 22 nt, Human
gccuagaagaaugagcgcaggg

SEQ ID NO: 122135 - RNA, 20 nt, Human
gccggggcauaggggccguc

SEQ ID NO: 122136 - RNA, 22 nt, Human
gccgggagaggcggcgcagggg

SEQ ID NO: 122137 - RNA, 22 nt, Human
gccgggagugcagcgggcgcgc

SEQ ID NO: 122138 - RNA, 22 nt, Human
gccggcccugcgcggggcggaa

SEQ ID NO: 122139 - RNA, 22 nt, Human
gccugcacucaaacacucucuu

SEQ ID NO: 122140 - RNA, 22 nt, Human
gccugcagccagggaguucucu

SEQ ID NO: 122141 - RNA, 22 nt, Human
gcuuccuccaucuggggcuugc

SEQ ID NO: 122142 - RNA, 22 nt, Human
gcuucucacccuuacuaucucu

SEQ ID NO: 122143 - RNA, 22 nt, Human
gcuucugugagugcagaugcug

SEQ ID NO: 122144 - RNA, 21 nt, Human
gccgaugugacucuacguagu

SEQ ID NO: 122145 - RNA, 22 nt, Human
gccgccgccgccuuuguugcgg

SEQ ID NO: 122146 - RNA, 22 nt, Human
gccgcaacggacccugggaguc

SEQ ID NO: 122147 - RNA, 22 nt, Human
gcuguggcuccaauggugagcc

SEQ ID NO: 122148 - RNA, 22 nt, Human
gcuguggguuccuccccugucc

SEQ ID NO: 122149 - RNA, 22 nt, Human
gcuguggacacagcucucuuca

SEQ ID NO: 122150 - RNA, 22 nt, Human
gcuguguaugaugcaggcaccu

SEQ ID NO: 122151 - RNA, 22 nt, Human
gcuguccugggaacaggcacua

SEQ ID NO: 122152 - RNA, 22 nt, Human
gcuguggagaagcugccuaugg

SEQ ID NO: 122153 - RNA, 22 nt, Human
gcuguuguugcacggaaggugg

SEQ ID NO: 122154 - RNA, 22 nt, Human
gcuguuucuuuggcaaacugau

SEQ ID NO: 122155 - RNA, 22 nt, Human
gcuguugugaggaucagcauau

SEQ ID NO: 122156 - RNA, 22 nt, Human
gcuggugugagauucucgaggg

SEQ ID NO: 122157 - RNA, 22 nt, Human
gcccuggucguggagggcaaca

SEQ ID NO: 122158 - RNA, 22 nt, Human
gcccuggcauuucuauucaugu

SEQ ID NO: 122159 - RNA, 22 nt, Human
gcccuguuuucuggguuccuug

SEQ ID NO: 122160 - RNA, 22 nt, Human
gcccuguuauagucugaggccu

SEQ ID NO: 122161 - RNA, 22 nt, Human
gcccugucagcucucauggaca

SEQ ID NO: 122162 - RNA, 22 nt, Human
gccccaggggaggugcccugca

SEQ ID NO: 122163 - RNA, 22 nt, Human
gcccccauuccugcggccuuca

SEQ ID NO: 122164 - RNA, 22 nt, Human
gccccgcgcgcguagcgccgcu

SEQ ID NO: 122165 - RNA, 22 nt, Human
gcccuagaguugagagcaccca

SEQ ID NO: 122166 - RNA, 22 nt, Human
gcugacuauaaggcugcucugu

SEQ ID NO: 122167 - RNA, 22 nt, Human
gcugacuguagcugggggaaga

SEQ ID NO: 122168 - RNA, 22 nt, Human
gcauuccagaguugcuggaaaa

SEQ ID NO: 122169 - RNA, 22 nt, Human
gcauguucaaguuaguauauuu

SEQ ID NO: 122170 - RNA, 22 nt, Human
gcugagcagcgaaggcacaugc

SEQ ID NO: 122171 - RNA, 21 nt, Human
ggcauguagccagcaaaggua

SEQ ID NO: 122172 - RNA, 22 nt, Human
ggcauuccgggguccccuucuc

SEQ ID NO: 122173 - RNA, 22 nt, Human
ggcaugcaaaugugggugaccu

SEQ ID NO: 122174 - RNA, 20 nt, Human
ggcaucugacaacuaguugc

SEQ ID NO: 122175 - RNA, 22 nt, Human
ggcaguguggauccuggagaag

SEQ ID NO: 122176 - RNA, 22 nt, Human
gcuagcugugcuuggaaguuug

SEQ ID NO: 122177 - RNA, 20 nt, Human
gcuaggggacuggagggagg

SEQ ID NO: 122178 - RNA, 22 nt, Human
ggcagguggcacugcugcuccc

SEQ ID NO: 122179 - RNA, 22 nt, Human
gcucaaggucacacagggguga

SEQ ID NO: 122180 - RNA, 22 nt, Human
gcguggaugauuuugagucggu

SEQ ID NO: 122181 - RNA, 22 nt, Human
gcgucucugggcugacccaggu

SEQ ID NO: 122182 - RNA, 22 nt, Human
gcguaccugaaauuacggcacu

SEQ ID NO: 122183 - RNA, 22 nt, Human
gcguagaagaaagcugcugcua

SEQ ID NO: 122184 - RNA, 20 nt, Human
ggcagcaaccauaugcuaca

SEQ ID NO: 122185 - RNA, 22 nt, Human
ggcagcccuggacccuggagaa

SEQ ID NO: 122186 - RNA, 21 nt, Human
ggcagccuggcaggggcacug

SEQ ID NO: 122187 - RNA, 22 nt, Human
gcuagagaagagcccacaccgg

SEQ ID NO: 122188 - RNA, 22 nt, Human
ggcagcgcuuggcugcucgaca

SEQ ID NO: 122189 - RNA, 22 nt, Human
ggcaauauuauaagggcauuua

SEQ ID NO: 122190 - RNA, 22 nt, Human
ggcacgagccaguguguguguu

SEQ ID NO: 122191 - RNA, 22 nt, Human
ggcacuggguugcagagagaga

SEQ ID NO: 122192 - RNA, 22 nt, Human
ggcacaggcugguaccaguuca

SEQ ID NO: 122193 - RNA, 22 nt, Human
ggaguucacagcaauggaacag

SEQ ID NO: 122194 - RNA, 22 nt, Human
ggagcucacuacgaaauaagcu

SEQ ID NO: 122195 - RNA, 22 nt, Human
ggagcucaggaguugauuauuu

SEQ ID NO: 122196 - RNA, 22 nt, Human
gcgcugagcuuuucuuauugaa

SEQ ID NO: 122197 - RNA, 22 nt, Human
gcggagcuaaagauuggcuccu

SEQ ID NO: 122198 - RNA, 22 nt, Human
gcggaucuccuugagugggcaa

SEQ ID NO: 122199 - RNA, 22 nt, Human
gcgcucuccugcagacagccuc

SEQ ID NO: 122200 - RNA, 22 nt, Human
gcgcgggugagucacgggcgga

SEQ ID NO: 122201 - RNA, 20 nt, Human
gcgcuucccuacgcucugcu

SEQ ID NO: 122202 - RNA, 23 nt, Human
ggagaaggaugucaucaaaagac

SEQ ID NO: 122203 - RNA, 22 nt, Human
ggagcugaacccuuaacuggcu

SEQ ID NO: 122204 - RNA, 22 nt, Human
ggaggaugaggguggugguguu

SEQ ID NO: 122205 - RNA, 22 nt, Human
ggaggccgugcugugcugccag

SEQ ID NO: 122206 - RNA, 22 nt, Human
ggaggcccagaaggaagcccag

SEQ ID NO: 122207 - RNA, 22 nt, Human
ggagggagugcaggcaggcaga

SEQ ID NO: 122208 - RNA, 23 nt, Human
ggaggcccagaggucggccccac

SEQ ID NO: 122209 - RNA, 19 nt, Human
ggaggguguccucaguguc

SEQ ID NO: 122210 - RNA, 22 nt, Human
ggagucguguuugggaucggag

SEQ ID NO: 122211 - RNA, 22 nt, Human
ggagguguguucuguuuuagug

SEQ ID NO: 122212 - RNA, 22 nt, Human
ggagguggagcuggaaguucca

SEQ ID NO: 122213 - RNA, 22 nt, Human
ggacauggaaagugugugauuu

SEQ ID NO: 122214 - RNA, 22 nt, Human
ggacauggccguaguccccacg

SEQ ID NO: 122215 - RNA, 22 nt, Human
ggacuggugaagccuucggaga

SEQ ID NO: 122216 - RNA, 22 nt, Human
ggacuucuggggacuguagauu

SEQ ID NO: 122217 - RNA, 17 nt, Human
ggacuuucugccugucc

SEQ ID NO: 122218 - RNA, 22 nt, Human
ggagaagaggagcuggaagccu

SEQ ID NO: 122219 - RNA, 22 nt, Human
gccugggcuuccgggacccggg

SEQ ID NO: 122220 - RNA, 22 nt, Human
gccugggguuugcggggcugca

SEQ ID NO: 122221 - RNA, 22 nt, Human
ggaagaagagggagcuguggga

SEQ ID NO: 122222 - RNA, 22 nt, Human
ggaagaggaagaugaggcagca

SEQ ID NO: 122223 - RNA, 22 nt, Human
ggagcagaggaaagaguagcau

SEQ ID NO: 122224 - RNA, 22 nt, Human
ggagaugacaucccagcccggc

SEQ ID NO: 122225 - RNA, 22 nt, Human
gggcuuuuccaacacucuggag

SEQ ID NO: 122226 - RNA, 22 nt, Human
gggcuuuuccauuccaggguuc

SEQ ID NO: 122227 - RNA, 18 nt, Human
gggcuuuacagaguggag

SEQ ID NO: 122228 - RNA, 22 nt, Human
ggggcuuccagcgcccgccggu

SEQ ID NO: 122229 - RNA, 22 nt, Human
ggagaugucugugccacgucuc

SEQ ID NO: 122230 - RNA, 22 nt, Human
gggggcagguuccaggccagcu

SEQ ID NO: 122231 - RNA, 22 nt, Human
ggaggagggaguucaggaguau

SEQ ID NO: 122232 - RNA, 22 nt, Human
ggaggaggggcggggaggggag

SEQ ID NO: 122233 - RNA, 22 nt, Human
ggaggccagagaagagccaggc

SEQ ID NO: 122234 - RNA, 22 nt, Human
ggaggccccccaugcagcucca

SEQ ID NO: 122235 - RNA, 22 nt, Human
ggaggcacugaaaguccuacag

SEQ ID NO: 122236 - RNA, 21 nt, Human
gggugcacagcaaauuugaga

SEQ ID NO: 122237 - RNA, 22 nt, Human
gggugcucauggauaaggcgaa

SEQ ID NO: 122238 - RNA, 20 nt, Human
ggagcgggcauuuguguucc

SEQ ID NO: 122239 - RNA, 22 nt, Human
gggggcgcguggagggccgugg

SEQ ID NO: 122240 - RNA, 22 nt, Human
gggggcugugugcccgcucccc

SEQ ID NO: 122241 - RNA, 22 nt, Human
ggguuuuggggaggaagugagc

SEQ ID NO: 122242 - RNA, 22 nt, Human
ggguuuccugcucgcggguagc

SEQ ID NO: 122243 - RNA, 22 nt, Human
ggguuuugugauugccucugaa

SEQ ID NO: 122244 - RNA, 23 nt, Human
ggauccugacauauaccaucacc

SEQ ID NO: 122245 - RNA, 22 nt, Human
ggguuggaggcauugaaacaga

SEQ ID NO: 122246 - RNA, 22 nt, Human
ggguuacgaugauuucaugugu

SEQ ID NO: 122247 - RNA, 22 nt, Human
ggguggcaagucuuucugcaac

SEQ ID NO: 122248 - RNA, 22 nt, Human
gggugggguaggugacucucgc

SEQ ID NO: 122249 - RNA, 22 nt, Human
gggugcuucauaggugaugcug

SEQ ID NO: 122250 - RNA, 22 nt, Human
ggaggcggaaguccaagcaggu

SEQ ID NO: 122251 - RNA, 22 nt, Human
ggaggguggaggagggaauuga

SEQ ID NO: 122252 - RNA, 22 nt, Human
ggaggucagcuggaggggaggc

SEQ ID NO: 122253 - RNA, 22 nt, Human
ggaugcagcagagaccuggagu

SEQ ID NO: 122254 - RNA, 23 nt, Human
ggauggacauacguaugcacagg

SEQ ID NO: 122255 - RNA, 22 nt, Human
ggaugcugcuccacaucccaca

SEQ ID NO: 122256 - RNA, 22 nt, Human
ggaugggcuuggggaggucuag

SEQ ID NO: 122257 - RNA, 22 nt, Human
ggucaucacugagagcagaucc

SEQ ID NO: 122258 - RNA, 22 nt, Human
ggucgagcagcacccguucggc

SEQ ID NO: 122259 - RNA, 22 nt, Human
ggucccacgauguaccugucug

SEQ ID NO: 122260 - RNA, 20 nt, Human
ggucagccaagaaguuaccu

SEQ ID NO: 122261 - RNA, 22 nt, Human
ggcagagcugugcgcccaccca

SEQ ID NO: 122262 - RNA, 20 nt, Human
ggcagagcuaugucuguugc

SEQ ID NO: 122263 - RNA, 22 nt, Human
ggcaaggaagaaagcagaaguu

SEQ ID NO: 122264 - RNA, 22 nt, Human
ggcacagcgacuaccaucgaaa

SEQ ID NO: 122265 - RNA, 19 nt, Human
ggcacccagagucccccug

SEQ ID NO: 122266 - RNA, 22 nt, Human
ggcacccugcauuggcuugagu

SEQ ID NO: 122267 - RNA, 22 nt, Human
ggugugggcagaugcccuacuu

SEQ ID NO: 122268 - RNA, 19 nt, Human
ggccacacuauuaaaagau

SEQ ID NO: 122269 - RNA, 22 nt, Human
ggccacauuccagagggcugaa

SEQ ID NO: 122270 - RNA, 21 nt, Human
ggccagauucucccauagcug

SEQ ID NO: 122271 - RNA, 22 nt, Human
ggccaagagaggauggagggau

SEQ ID NO: 122272 - RNA, 22 nt, Human
gguggccuaacaaugguggcaa

SEQ ID NO: 122273 - RNA, 22 nt, Human
ggcauggugggggaggacuugg

SEQ ID NO: 122274 - RNA, 22 nt, Human
ggcauuccucucuguucaugga

SEQ ID NO: 122275 - RNA, 22 nt, Human
ggaauugagcaagggguggggc

SEQ ID NO: 122276 - RNA, 22 nt, Human
gggcuguuugcauauguuuaua

SEQ ID NO: 122277 - RNA, 22 nt, Human
ggacugggagaauggaggcaag

SEQ ID NO: 122278 - RNA, 22 nt, Human
ggacuccuguguuuuggcugag

SEQ ID NO: 122279 - RNA, 22 nt, Human
ggacggcuagcagcagaauuca

SEQ ID NO: 122280 - RNA, 23 nt, Human
ggacgugaggcgcccuuuuuccc

SEQ ID NO: 122281 - RNA, 22 nt, Human
gggauggggagcuggaaagggg

SEQ ID NO: 122282 - RNA, 22 nt, Human
ggaaucuucagccaugccaaga

SEQ ID NO: 122283 - RNA, 22 nt, Human
ggaagcugucugcccggcgcuc

SEQ ID NO: 122284 - RNA, 22 nt, Human
gggccucccggagcugcuccca

SEQ ID NO: 122285 - RNA, 21 nt, Human
gggccugggccagggccgggu

SEQ ID NO: 122286 - RNA, 22 nt, Human
gggccugcgcuggggggagccg

SEQ ID NO: 122287 - RNA, 22 nt, Human
gggccggcuggggcggggcggg

SEQ ID NO: 122288 - RNA, 22 nt, Human
ggaagccugggcgcaggcaggg

SEQ ID NO: 122289 - RNA, 22 nt, Human
gggcccaacuguuggcagccuc

SEQ ID NO: 122290 - RNA, 22 nt, Human
gggccgcagccucuccggccug

SEQ ID NO: 122291 - RNA, 20 nt, Human
gggccagguggaccaggggc

SEQ ID NO: 122292 - RNA, 22 nt, Human
gggccccgggcgcggcugcggg

SEQ ID NO: 122293 - RNA, 22 nt, Human
ggaaauauaagcaguuugugug

SEQ ID NO: 122294 - RNA, 22 nt, Human
gggcagagggcgagcugggaga

SEQ ID NO: 122295 - RNA, 22 nt, Human
gggcaggcuggguggugguccc

SEQ ID NO: 122296 - RNA, 22 nt, Human
gggacugguuguguguggugug

SEQ ID NO: 122297 - RNA, 22 nt, Human
gcuuuugcaaagcuggagaauu

SEQ ID NO: 122298 - RNA, 22 nt, Human
gggaugaaugccuggcuccccc

SEQ ID NO: 122299 - RNA, 22 nt, Human
gggagcugagcuggaagagaau

SEQ ID NO: 122300 - RNA, 22 nt, Human
gggagcucaccaugcucugcau

SEQ ID NO: 122301 - RNA, 22 nt, Human
gcuugcugaacaggaaccuggc

SEQ ID NO: 122302 - RNA, 22 nt, Human
gcuucuguuaggauguggcuua

SEQ ID NO: 122303 - RNA, 20 nt, Human
gcuugcgugggaggaggggg

SEQ ID NO: 122304 - RNA, 20 nt, Human
gcuugcggacagguggcuca

SEQ ID NO: 122305 - RNA, 22 nt, Human
gggacagcuggggguaaagcau

SEQ ID NO: 122306 - RNA, 22 nt, Human
gggacgggcuagcugccguggc

SEQ ID NO: 122307 - RNA, 22 nt, Human
gggacugcgagauucucaaggg

SEQ ID NO: 122308 - RNA, 22 nt, Human
gcuucccacagcuggacugggg

SEQ ID NO: 122309 - RNA, 21 nt, Human
gcuucaauucauccaccucuc

SEQ ID NO: 122310 - RNA, 22 nt, Human
gggaaaucugcuuccuagggcu

SEQ ID NO: 122311 - RNA, 23 nt, Human
gggaaaucaaaagauauuucuuc

SEQ ID NO: 122312 - RNA, 22 nt, Human
gcuguuggaggaguucagugcu

SEQ ID NO: 122313 - RNA, 22 nt, Human
gcuguugcaaucaaggccaugg

SEQ ID NO: 122314 - RNA, 22 nt, Human
ggcuuugggaggaugaggcggu

SEQ ID NO: 122315 - RNA, 22 nt, Human
gcuguguucauccugcccaggu

SEQ ID NO: 122316 - RNA, 22 nt, Human
ggccaaagagcacaaugaauag

SEQ ID NO: 122317 - RNA, 20 nt, Human
ggcauuuuuuaguugagcuu

SEQ ID NO: 122318 - RNA, 22 nt, Human
ggccaccuaagguugugcauca

SEQ ID NO: 122319 - RNA, 22 nt, Human
ggccacgggguuugcugaaacu

SEQ ID NO: 122320 - RNA, 22 nt, Human
ggcugugguggacgcgggaaac

SEQ ID NO: 122321 - RNA, 22 nt, Human
ggcuuacgcgcuaacagugaau

SEQ ID NO: 122322 - RNA, 22 nt, Human
ggcuguggcagcuggaaguggu

SEQ ID NO: 122323 - RNA, 22 nt, Human
ggcuuuuguuauaaucaggccu

SEQ ID NO: 122324 - RNA, 19 nt, Human
ggcuuugcccuucgcuccg

SEQ ID NO: 122325 - RNA, 22 nt, Human
ggcuuguccuucugguugucuu

SEQ ID NO: 122326 - RNA, 22 nt, Human
ggcuucaaaacacaugucaaga

SEQ ID NO: 122327 - RNA, 22 nt, Human
gggaagccugggugauccuaaa

SEQ ID NO: 122328 - RNA, 22 nt, Human
gugaucagaagaaccugccgaa

SEQ ID NO: 122329 - RNA, 17 nt, Human
gugagcugagucaggac

SEQ ID NO: 122330 - RNA, 22 nt, Human
gggaacuguaguuuacgcugcc

SEQ ID NO: 122331 - RNA, 22 nt, Human
gugaccagacagagucuagccc

SEQ ID NO: 122332 - RNA, 21 nt, Human
gugaccuguuaugcaaaggca

SEQ ID NO: 122333 - RNA, 22 nt, Human
gugccuggaaucuuuucuucac

SEQ ID NO: 122334 - RNA, 20 nt, Human
gggaucgaguaccuccgggu

SEQ ID NO: 122335 - RNA, 22 nt, Human
gggaguggagagugaagcuaau

SEQ ID NO: 122336 - RNA, 22 nt, Human
gggagggcuuggacccagaugu

SEQ ID NO: 122337 - RNA, 22 nt, Human
gugccgaugaggccuggcauuc

SEQ ID NO: 122338 - RNA, 22 nt, Human
gugccgcuggagcuggaauuga

SEQ ID NO: 122339 - RNA, 22 nt, Human
gugcucaagacauuaggaauau

SEQ ID NO: 122340 - RNA, 22 nt, Human
gggcaagaagcuggaagcauuc

SEQ ID NO: 122341 - RNA, 22 nt, Human
gugcugcaugagcaucacguag

SEQ ID NO: 122342 - RNA, 22 nt, Human
gugcugcaaggauggagaggca

SEQ ID NO: 122343 - RNA, 22 nt, Human
gugcucuagaaauugucagugg

SEQ ID NO: 122344 - RNA, 22 nt, Human
gggcacggaaggcgccaggggu

SEQ ID NO: 122345 - RNA, 22 nt, Human
gggacaggacuccuggggccug

SEQ ID NO: 122346 - RNA, 22 nt, Human
gggaccaaaugcuaccauucua

SEQ ID NO: 122347 - RNA, 22 nt, Human
gggagaaccagccagugcaagg

SEQ ID NO: 122348 - RNA, 19 nt, Human
gugaugaugccacuccaac

SEQ ID NO: 122349 - RNA, 22 nt, Human
gugauggggagagcgcagcuuu

SEQ ID NO: 122350 - RNA, 19 nt, Human
gugcacugucacuuugcuc

SEQ ID NO: 122351 - RNA, 22 nt, Human
gugcagcugguggagucugggg

SEQ ID NO: 122352 - RNA, 22 nt, Human
gugcacuugaucuagacagauu

SEQ ID NO: 122353 - RNA, 22 nt, Human
gugcagcugggcgcugaccuuc

SEQ ID NO: 122354 - RNA, 22 nt, Human
gggagccagcagggcauggagc

SEQ ID NO: 122355 - RNA, 22 nt, Human
gggagcccuggacgggcgguau

SEQ ID NO: 122356 - RNA, 22 nt, Human
ggcuggagcaggcugcacagug

SEQ ID NO: 122357 - RNA, 22 nt, Human
ggcuggacuuucugcugggcuc

SEQ ID NO: 122358 - RNA, 22 nt, Human
gucuggagccacugcugcugcu

SEQ ID NO: 122359 - RNA, 22 nt, Human
gucuccugcccacccugguccc

SEQ ID NO: 122360 - RNA, 22 nt, Human
gucgagcuggaggagcgaaugg

SEQ ID NO: 122361 - RNA, 22 nt, Human
gucgccuaauuaggguauccua

SEQ ID NO: 122362 - RNA, 22 nt, Human
gucgcuuuccugaggggucuca

SEQ ID NO: 122363 - RNA, 22 nt, Human
gucggagcggcugcacaggggg

SEQ ID NO: 122364 - RNA, 17 nt, Human
ggcugccaggcaacaua

SEQ ID NO: 122365 - RNA, 22 nt, Human
gucgucgcucccaccuuccgcu

SEQ ID NO: 122366 - RNA, 22 nt, Human
ggcuggaacuucuucuggcauu

SEQ ID NO: 122367 - RNA, 22 nt, Human
ggcugcuugggcuguuucuuuu

SEQ ID NO: 122368 - RNA, 22 nt, Human
ggcucccgugggaugguggagc

SEQ ID NO: 122369 - RNA, 22 nt, Human
ggcuagggaucuagaccaggac

SEQ ID NO: 122370 - RNA, 22 nt, Human
ggcucagaggagcuggaacggu

SEQ ID NO: 122371 - RNA, 23 nt, Human
ggcgugcugggcugacccuuggc

SEQ ID NO: 122372 - RNA, 22 nt, Human
ggcucuccacuauggaugagaa

SEQ ID NO: 122373 - RNA, 22 nt, Human
guccuggagcagcuggaagaug

SEQ ID NO: 122374 - RNA, 22 nt, Human
guccuguccugcugagcuccug

SEQ ID NO: 122375 - RNA, 22 nt, Human
guccuggugccaccugcgggau

SEQ ID NO: 122376 - RNA, 22 nt, Human
guccccugcuguggaucugugg

SEQ ID NO: 122377 - RNA, 22 nt, Human
guccucugggagccuugagccu

SEQ ID NO: 122378 - RNA, 22 nt, Human
gucacuuugcuugcgaugcucc

SEQ ID NO: 122379 - RNA, 22 nt, Human
gucacgucgggacagacugggg

SEQ ID NO: 122380 - RNA, 20 nt, Human
gucaauguuuucuuggcccu

SEQ ID NO: 122381 - RNA, 22 nt, Human
gucaaaggcggugcaggaggag

SEQ ID NO: 122382 - RNA, 22 nt, Human
gucagacugaguuccuggguac

SEQ ID NO: 122383 - RNA, 22 nt, Human
gucaucugagggacgagauuuc

SEQ ID NO: 122384 - RNA, 22 nt, Human
ggcggugcgaggaugcagggcu

SEQ ID NO: 122385 - RNA, 22 nt, Human
ggcggcugcuccuugcccucgg

SEQ ID NO: 122386 - RNA, 22 nt, Human
ggcggcccaggugcuccaggcg

SEQ ID NO: 122387 - RNA, 21 nt, Human
gguuucugcaaaccuuguaca

SEQ ID NO: 122388 - RNA, 22 nt, Human
ggcccgcgcugcuggcgcgcca

SEQ ID NO: 122389 - RNA, 22 nt, Human
ggccagucaaggggauccugaa

SEQ ID NO: 122390 - RNA, 22 nt, Human
ggccaguauacaaacuuccggu

SEQ ID NO: 122391 - RNA, 22 nt, Human
ggcgauuggccgggaggaggca

SEQ ID NO: 122392 - RNA, 22 nt, Human
ggcgcaguguucgcccucucgc

SEQ ID NO: 122393 - RNA, 22 nt, Human
ggcgaggcgggccgcggggucu

SEQ ID NO: 122394 - RNA, 22 nt, Human
guauccuccccgcuggccuuca

SEQ ID NO: 122395 - RNA, 22 nt, Human
ggcggagggcuguguccccggc

SEQ ID NO: 122396 - RNA, 22 nt, Human
ggucugauaccugcagguuguc

SEQ ID NO: 122397 - RNA, 19 nt, Human
ggucugcggggugaccgug

SEQ ID NO: 122398 - RNA, 22 nt, Human
ggucuucauucuaccagacuuu

SEQ ID NO: 122399 - RNA, 22 nt, Human
ggugaucucuggcucugcuugu

SEQ ID NO: 122400 - RNA, 22 nt, Human
ggugaaggaucccucuuggccu

SEQ ID NO: 122401 - RNA, 22 nt, Human
ggugacucacauuaggacuucg

SEQ ID NO: 122402 - RNA, 22 nt, Human
ggugaucucagucuagaugguu

SEQ ID NO: 122403 - RNA, 18 nt, Human
ggugagggagcuggaagc

SEQ ID NO: 122404 - RNA, 23 nt, Human
ggugagccuuucuaguagucuug

SEQ ID NO: 122405 - RNA, 22 nt, Human
ggugaggagaaacucugccccu

SEQ ID NO: 122406 - RNA, 22 nt, Human
guugucuggcucugaccauucu

SEQ ID NO: 122407 - RNA, 22 nt, Human
ggucgacuaauguuucauuuca

SEQ ID NO: 122408 - RNA, 22 nt, Human
gguccgcgcgcagaggcccugg

SEQ ID NO: 122409 - RNA, 22 nt, Human
guuguugcuauguuauuguuau

SEQ ID NO: 122410 - RNA, 22 nt, Human
ggucggggcuggccggcguggu

SEQ ID NO: 122411 - RNA, 22 nt, Human
ggucgucuguccugucgccgcu

SEQ ID NO: 122412 - RNA, 22 nt, Human
gugcuggcaaagagaacaucuu

SEQ ID NO: 122413 - RNA, 22 nt, Human
guuggaggaaggacaggaacag

SEQ ID NO: 122414 - RNA, 22 nt, Human
guuggcgaaggaccuggaggag

SEQ ID NO: 122415 - RNA, 20 nt, Human
guugggagaagugucagcug

SEQ ID NO: 122416 - RNA, 22 nt, Human
guugggguuucaguggcaguca

SEQ ID NO: 122417 - RNA, 22 nt, Human
guaagcagcaugacgguuggau

SEQ ID NO: 122418 - RNA, 22 nt, Human
guaauugcucauauggcaccug

SEQ ID NO: 122419 - RNA, 22 nt, Human
guacugggaauggagccugggc

SEQ ID NO: 122420 - RNA, 22 nt, Human
ggugugugugugugugugugug

SEQ ID NO: 122421 - RNA, 22 nt, Human
gguguggguguuaguuugcuua

SEQ ID NO: 122422 - RNA, 22 nt, Human
ggugugaauagagccuggagca

SEQ ID NO: 122423 - RNA, 22 nt, Human
gguguggcaguggaccugugaa

SEQ ID NO: 122424 - RNA, 22 nt, Human
ggugucguuucacaugacccag

SEQ ID NO: 122425 - RNA, 22 nt, Human
ggugucagccacuuugucggag

SEQ ID NO: 122426 - RNA, 22 nt, Human
gguggguccuuugacagagaug

SEQ ID NO: 122427 - RNA, 22 nt, Human
gguggucaggagcgcccguugg

SEQ ID NO: 122428 - RNA, 22 nt, Human
ggugcagucuggggcacauuau

SEQ ID NO: 122429 - RNA, 22 nt, Human
ggugccugggcacggaaagcau

SEQ ID NO: 122430 - RNA, 19 nt, Human
ggugaucugucccuugcuc

SEQ ID NO: 122431 - RNA, 22 nt, Human
ggugcguggcccauccuccacc

SEQ ID NO: 122432 - RNA, 22 nt, Human
ggugcuggggaaauuaggguag

SEQ ID NO: 122433 - RNA, 22 nt, Human
gugaaggcaugugugcugugcu

SEQ ID NO: 122434 - RNA, 22 nt, Human
uacuucccacuggggucuacca

SEQ ID NO: 122435 - RNA, 22 nt, Human
gugaaacuggaugugaaaacaa

SEQ ID NO: 122436 - RNA, 22 nt, Human
gucuaccuucuuucucaacugg

SEQ ID NO: 122437 - RNA, 22 nt, Human
gucuggugguggguguagggca

SEQ ID NO: 122438 - RNA, 22 nt, Human
gucgguacuaguacugguguug

SEQ ID NO: 122439 - RNA, 22 nt, Human
guccucgggcucacucccaggg

SEQ ID NO: 122440 - RNA, 22 nt, Human
gucccuggucuaccguggcuuc

SEQ ID NO: 122441 - RNA, 22 nt, Human
guccaggucauuuaaaaagucc

SEQ ID NO: 122442 - RNA, 22 nt, Human
gucaugaugauacagguggagg

SEQ ID NO: 122443 - RNA, 22 nt, Human
guccuucgcggcugaggccauu

SEQ ID NO: 122444 - RNA, 22 nt, Human
guccugauggccauuuuucacu

SEQ ID NO: 122445 - RNA, 22 nt, Human
guccuguccuguccuggagaca

SEQ ID NO: 122446 - RNA, 22 nt, Human
gucacuccuucccagagggagc

SEQ ID NO: 122447 - RNA, 22 nt, Human
gucaggugcaccuccaccaaca

SEQ ID NO: 122448 - RNA, 20 nt, Human
gucaucucagggacugucug

SEQ ID NO: 122449 - RNA, 22 nt, Human
ucaaaggcuugugguucuggga

SEQ ID NO: 122450 - RNA, 22 nt, Human
ucaaccagcuuaucugcaggau

SEQ ID NO: 122451 - RNA, 22 nt, Human
guugggcugaagugugugcuua

SEQ ID NO: 122452 - RNA, 22 nt, Human
guugggugccagaggcuucacg

SEQ ID NO: 122453 - RNA, 22 nt, Human
ucaaccucccugcucaccccuc

SEQ ID NO: 122454 - RNA, 21 nt, Human
ucaaccagguguugaaggcac

SEQ ID NO: 122455 - RNA, 22 nt, Human
guugguggaggcgagagaagaa

SEQ ID NO: 122456 - RNA, 22 nt, Human
guugcggaguguagcgaugcuu

SEQ ID NO: 122457 - RNA, 22 nt, Human
guucugcccaggccuccccaac

SEQ ID NO: 122458 - RNA, 21 nt, Human
guucucacagcugaggugguu

SEQ ID NO: 122459 - RNA, 22 nt, Human
guucaaggagcagcuugcuaca

SEQ ID NO: 122460 - RNA, 22 nt, Human
guucgucuguggugugaggugc

SEQ ID NO: 122461 - RNA, 22 nt, Human
guuccugagcaguuccuggcca

SEQ ID NO: 122462 - RNA, 22 nt, Human
guucggcuuccuaugucaugag

SEQ ID NO: 122463 - RNA, 22 nt, Human
guguuggugagcucauuuccac

SEQ ID NO: 122464 - RNA, 22 nt, Human
guguugaugugucuguauucua

SEQ ID NO: 122465 - RNA, 22 nt, Human
guguugacacagccaucuuguc

SEQ ID NO: 122466 - RNA, 21 nt, Human
guguugugagguugguguuag

SEQ ID NO: 122467 - RNA, 22 nt, Human
uauguggcaggugggagaucag

SEQ ID NO: 122468 - RNA, 22 nt, Human
guguucucagcacccacuucau

SEQ ID NO: 122469 - RNA, 22 nt, Human
guggugguguuggugacaaguu

SEQ ID NO: 122470 - RNA, 22 nt, Human
gugggugucaguaucuuuaacg

SEQ ID NO: 122471 - RNA, 22 nt, Human
guggucaagaccgggaauagga

SEQ ID NO: 122472 - RNA, 22 nt, Human
guggugggcgugguguaugccu

SEQ ID NO: 122473 - RNA, 22 nt, Human
guggugauuugggucuagcuuu

SEQ ID NO: 122474 - RNA, 22 nt, Human
guggcagagagcaagugucuga

SEQ ID NO: 122475 - RNA, 22 nt, Human
guggcagagccuugcggcuuug

SEQ ID NO: 122476 - RNA, 22 nt, Human
guggcaaguuuucugacaagga

SEQ ID NO: 122477 - RNA, 20 nt, Human
guggcagugguggcagcagu

SEQ ID NO: 122478 - RNA, 22 nt, Human
guggcauggggagcagcuagaa

SEQ ID NO: 122479 - RNA, 22 nt, Human
uaggccugcugaagagcaagcu

SEQ ID NO: 122480 - RNA, 22 nt, Human
uaggggcccgugggauggacag

SEQ ID NO: 122481 - RNA, 18 nt, Human
guggccauugaccagcuu

SEQ ID NO: 122482 - RNA, 22 nt, Human
guggccuuccuguuccuuugaa

SEQ ID NO: 122483 - RNA, 22 nt, Human
uaguggaaacagacugagcccg

SEQ ID NO: 122484 - RNA, 22 nt, Human
uaguggccacugaagugcuaga

SEQ ID NO: 122485 - RNA, 22 nt, Human
uagggaggguuugggguggagg

SEQ ID NO: 122486 - RNA, 22 nt, Human
guggguccaaccugugugugug

SEQ ID NO: 122487 - RNA, 22 nt, Human
uagucauaauucuugcugccuu

SEQ ID NO: 122488 - RNA, 22 nt, Human
gugggcacguccuacugucacu

SEQ ID NO: 122489 - RNA, 22 nt, Human
gugggccaguuccucacaggua

SEQ ID NO: 122490 - RNA, 22 nt, Human
gugggaaacagccuugcuucua

SEQ ID NO: 122491 - RNA, 22 nt, Human
gugggggcuaaauugaggggug

SEQ ID NO: 122492 - RNA, 22 nt, Human
gugggcuuuuuugaaaccugaa

SEQ ID NO: 122493 - RNA, 22 nt, Human
gugggcccaagcagcggcggcc

SEQ ID NO: 122494 - RNA, 22 nt, Human
guggagaucuggugcccccugg

SEQ ID NO: 122495 - RNA, 22 nt, Human
guggagauauuugugauagggg

SEQ ID NO: 122496 - RNA, 22 nt, Human
guggauggagcuggaagccauu

SEQ ID NO: 122497 - RNA, 22 nt, Human
guggagaugagauauaccccuu

SEQ ID NO: 122498 - RNA, 22 nt, Human
uaggacuuguccauccaggaca

SEQ ID NO: 122499 - RNA, 22 nt, Human
guggaaggaauuaacagacuag

SEQ ID NO: 122500 - RNA, 22 nt, Human
guggaagggaaaccgcacuggc

SEQ ID NO: 122501 - RNA, 22 nt, Human
gugcugggaggcccaggaugga

SEQ ID NO: 122502 - RNA, 22 nt, Human
gugcugucguggaacugggcug

SEQ ID NO: 122503 - RNA, 22 nt, Human
gugcuguuagcgguuuauaaca

SEQ ID NO: 122504 - RNA, 22 nt, Human
uagcgggucacccugcugugaa

SEQ ID NO: 122505 - RNA, 22 nt, Human
gugcucgagcugugcgcgcugc

SEQ ID NO: 122506 - RNA, 22 nt, Human
gugcucuauguugauuccuuga

SEQ ID NO: 122507 - RNA, 22 nt, Human
ucagucauguuuaccagacgua

SEQ ID NO: 122508 - RNA, 23 nt, Human
ucagugccaaggagaacuuggug

SEQ ID NO: 122509 - RNA, 19 nt, Human
ucaggaggucgaccuggca

SEQ ID NO: 122510 - RNA, 22 nt, Human
ucaagagauauaugcugguuua

SEQ ID NO: 122511 - RNA, 21 nt, Human
ucaagcggcagagcaguuauu

SEQ ID NO: 122512 - RNA, 22 nt, Human
ucaagcuggaaaugaagaaucu

SEQ ID NO: 122513 - RNA, 22 nt, Human
ucagucacugucucagacagga

SEQ ID NO: 122514 - RNA, 21 nt, Human
uccaaaggagacugagugugu

SEQ ID NO: 122515 - RNA, 22 nt, Human
uccaagcgcuucuggagcuccu

SEQ ID NO: 122516 - RNA, 22 nt, Human
uccaagacagauaccuagaaga

SEQ ID NO: 122517 - RNA, 22 nt, Human
ucaugccugcgauugucccugg

SEQ ID NO: 122518 - RNA, 22 nt, Human
ucaugggcaaacuuggggauca

SEQ ID NO: 122519 - RNA, 22 nt, Human
ucaucuauaaguagcaucuggg

SEQ ID NO: 122520 - RNA, 22 nt, Human
ucaucggcugucaucuucacgu

SEQ ID NO: 122521 - RNA, 17 nt, Human
ucaguugugcgagcagc

SEQ ID NO: 122522 - RNA, 22 nt, Human
uagcuggaggggcaggaugcug

SEQ ID NO: 122523 - RNA, 22 nt, Human
uccuggccuuggggagagaagu

SEQ ID NO: 122524 - RNA, 22 nt, Human
uccuggccucugagucaagaac

SEQ ID NO: 122525 - RNA, 22 nt, Human
uccuggcgugggcuggcugcag

SEQ ID NO: 122526 - RNA, 20 nt, Human
uccuccuugcagagcccaga

SEQ ID NO: 122527 - RNA, 21 nt, Human
uccugccuuaguccagagcag

SEQ ID NO: 122528 - RNA, 20 nt, Human
uccugaaauuacgugauuca

SEQ ID NO: 122529 - RNA, 22 nt, Human
ucccuuuuagccccgcccuccu

SEQ ID NO: 122530 - RNA, 23 nt, Human
ucccuguuucagggccagaacug

SEQ ID NO: 122531 - RNA, 22 nt, Human
ucccuguuuccugcgcuccuuc

SEQ ID NO: 122532 - RNA, 23 nt, Human
uagauccuuccaacuacucuuac

SEQ ID NO: 122533 - RNA, 22 nt, Human
uagaggccagggugucuugagu

SEQ ID NO: 122534 - RNA, 22 nt, Human
uccguugaggcugccaggcgag

SEQ ID NO: 122535 - RNA, 22 nt, Human
uccucagcaagacgcuggcagc

SEQ ID NO: 122536 - RNA, 18 nt, Human
uccggaggucagaguaaa

SEQ ID NO: 122537 - RNA, 22 nt, Human
uccuccacuuagcgccacuggg

SEQ ID NO: 122538 - RNA, 22 nt, Human
uccucagcaaacacuucacucu

SEQ ID NO: 122539 - RNA, 22 nt, Human
uccguccacacuuagagaguuu

SEQ ID NO: 122540 - RNA, 22 nt, Human
uccgggagcccccggaggagga

SEQ ID NO: 122541 - RNA, 21 nt, Human
uagaccagcugugcuccucgg

SEQ ID NO: 122542 - RNA, 22 nt, Human
uccgcguugguuagagagggcu

SEQ ID NO: 122543 - RNA, 22 nt, Human
uccgagggugacuaccgcuucc

SEQ ID NO: 122544 - RNA, 22 nt, Human
uccggcgaccuccagauguucc

SEQ ID NO: 122545 - RNA, 22 nt, Human
ucccggcaccgggagccccugc

SEQ ID NO: 122546 - RNA, 22 nt, Human
ucccguuucacuccuugccagc

SEQ ID NO: 122547 - RNA, 22 nt, Human
ucccugagcucacauggcagga

SEQ ID NO: 122548 - RNA, 22 nt, Human
ucccugccuccuggcagugcca

SEQ ID NO: 122549 - RNA, 22 nt, Human
uacugacguaguagaguugcuu

SEQ ID NO: 122550 - RNA, 22 nt, Human
uacugccauuauccugcugaaa

SEQ ID NO: 122551 - RNA, 23 nt, Human
uccccagcugcccgugucccggg

SEQ ID NO: 122552 - RNA, 22 nt, Human
uccccaccuaagauacccaucu

SEQ ID NO: 122553 - RNA, 22 nt, Human
uccaaggcagacacauuuuuug

SEQ ID NO: 122554 - RNA, 22 nt, Human
uacagcgaaaauuuagcuugau

SEQ ID NO: 122555 - RNA, 22 nt, Human
uacaggaggaugugcagccagg

SEQ ID NO: 122556 - RNA, 22 nt, Human
uccagcugugcuccaggaggug

SEQ ID NO: 122557 - RNA, 22 nt, Human
uccaggagucagacagauggug

SEQ ID NO: 122558 - RNA, 22 nt, Human
uccaggaggacugagggggcug

SEQ ID NO: 122559 - RNA, 22 nt, Human
uccaggacgccgacgugucggc

SEQ ID NO: 122560 - RNA, 22 nt, Human
uccauggucgauggcugcuggg

SEQ ID NO: 122561 - RNA, 22 nt, Human
uaccuggauaaauguacaaccg

SEQ ID NO: 122562 - RNA, 22 nt, Human
uccaggucauucucuccgaccg

SEQ ID NO: 122563 - RNA, 22 nt, Human
uaccugguuucuuaaacccaaa

SEQ ID NO: 122564 - RNA, 22 nt, Human
ucugcccguucaaauccuuguu

SEQ ID NO: 122565 - RNA, 22 nt, Human
ucugcccaggaggucccauggg

SEQ ID NO: 122566 - RNA, 22 nt, Human
ucugcggccuagcgcccggcgc

SEQ ID NO: 122567 - RNA, 22 nt, Human
ucugcgggccuggcucccagcg

SEQ ID NO: 122568 - RNA, 21 nt, Human
ucugccaguuucucuuacuuu

SEQ ID NO: 122569 - RNA, 22 nt, Human
uaugaucuuaggauggaacuuc

SEQ ID NO: 122570 - RNA, 22 nt, Human
ucugcagggcccuuggcuccug

SEQ ID NO: 122571 - RNA, 22 nt, Human
ucugaucagaagacaaaugagg

SEQ ID NO: 122572 - RNA, 22 nt, Human
ucugcacagcucaccucccugg

SEQ ID NO: 122573 - RNA, 22 nt, Human
ucuggcaguugccgcuucaguc

SEQ ID NO: 122574 - RNA, 21 nt, Human
ucuggccuauaaaguagucgc

SEQ ID NO: 122575 - RNA, 22 nt, Human
ucuggcucaggagcuguguuca

SEQ ID NO: 122576 - RNA, 22 nt, Human
ucugcguggcgugguucugugc

SEQ ID NO: 122577 - RNA, 21 nt, Human
uauucgcauuucugucuuuac

SEQ ID NO: 122578 - RNA, 22 nt, Human
ucuguucaugucuuuuuaagug

SEQ ID NO: 122579 - RNA, 22 nt, Human
ucuguucagaagaggugaaagu

SEQ ID NO: 122580 - RNA, 20 nt, Human
ucuguggcagguggcgcuug

SEQ ID NO: 122581 - RNA, 22 nt, Human
ucuguggcaaacacagugacca

SEQ ID NO: 122582 - RNA, 22 nt, Human
ucugggagaguagauaaaggaa

SEQ ID NO: 122583 - RNA, 22 nt, Human
ucugggucuaucccaugccuuu

SEQ ID NO: 122584 - RNA, 21 nt, Human
ucuggggacaagguccaggaa

SEQ ID NO: 122585 - RNA, 22 nt, Human
ucugguuccugcauucauucaa

SEQ ID NO: 122586 - RNA, 22 nt, Human
ucuguaacaucaguguaauuuu

SEQ ID NO: 122587 - RNA, 22 nt, Human
ucugagcaggaaagagcagaga

SEQ ID NO: 122588 - RNA, 22 nt, Human
ucugaggacagugcugugccug

SEQ ID NO: 122589 - RNA, 22 nt, Human
ucugacguugguucugcccuuu

SEQ ID NO: 122590 - RNA, 22 nt, Human
ucugaccaggcucuuguagccu

SEQ ID NO: 122591 - RNA, 22 nt, Human
ucugaccccccuugccuccacu

SEQ ID NO: 122592 - RNA, 22 nt, Human
ucucuccuccacaccgggugcu

SEQ ID NO: 122593 - RNA, 22 nt, Human
ucucucggagcuaccggaaguu

SEQ ID NO: 122594 - RNA, 22 nt, Human
ucucucgguacagcuggcugga

SEQ ID NO: 122595 - RNA, 22 nt, Human
ucucugguggcuccaucaguag

SEQ ID NO: 122596 - RNA, 22 nt, Human
ucucccaaaucuuucuagcaca

SEQ ID NO: 122597 - RNA, 19 nt, Human
ucucccaugccugugucua

SEQ ID NO: 122598 - RNA, 22 nt, Human
ucucccgcuuccugcuggcugc

SEQ ID NO: 122599 - RNA, 22 nt, Human
ucuccuuuggggccucaggguu

SEQ ID NO: 122600 - RNA, 17 nt, Human
ucuccuggcucuaucag

SEQ ID NO: 122601 - RNA, 22 nt, Human
ucgauccaggaaggcugguuua

SEQ ID NO: 122602 - RNA, 22 nt, Human
uaggacuugaauucagccucca

SEQ ID NO: 122603 - RNA, 22 nt, Human
ucgaggagagucgccagcugcu

SEQ ID NO: 122604 - RNA, 22 nt, Human
ucgagcucagcagggaggugcg

SEQ ID NO: 122605 - RNA, 21 nt, Human
ucucaagguaacauuuaagau

SEQ ID NO: 122606 - RNA, 23 nt, Human
ucucacucauucuccucugucca

SEQ ID NO: 122607 - RNA, 22 nt, Human
ucucaggcuuccuggugcugug

SEQ ID NO: 122608 - RNA, 22 nt, Human
ucuaugcuacguuccucugaaa

SEQ ID NO: 122609 - RNA, 22 nt, Human
ugauugcucagcuagccucuuu

SEQ ID NO: 122610 - RNA, 19 nt, Human
uccaccgcgugcaccucua

SEQ ID NO: 122611 - RNA, 22 nt, Human
uccaaggacucuugucagcugu

SEQ ID NO: 122612 - RNA, 22 nt, Human
uccaaggcuggaucuuuucuuu

SEQ ID NO: 122613 - RNA, 22 nt, Human
ugauggugagaugucccguguu

SEQ ID NO: 122614 - RNA, 22 nt, Human
ucauccucguccucuggugccc

SEQ ID NO: 122615 - RNA, 21 nt, Human
ugaggccugccagucucagaa

SEQ ID NO: 122616 - RNA, 22 nt, Human
ucauccugucucuguucggaau

SEQ ID NO: 122617 - RNA, 22 nt, Human
ucaucgauggggagcucuacaa

SEQ ID NO: 122618 - RNA, 22 nt, Human
ugaggagggcuagagucuccug

SEQ ID NO: 122619 - RNA, 22 nt, Human
ugaggaggugggcacacagagu

SEQ ID NO: 122620 - RNA, 22 nt, Human
ugaggaugaggaagaagaagaa

SEQ ID NO: 122621 - RNA, 22 nt, Human
ugaggaggugcuaccagcgucu

SEQ ID NO: 122622 - RNA, 22 nt, Human
ucaguguccuucguucuuguug

SEQ ID NO: 122623 - RNA, 22 nt, Human
ugagcaccaggcaccacagcuc

SEQ ID NO: 122624 - RNA, 23 nt, Human
ugagacacuggaaggcaagaaaa

SEQ ID NO: 122625 - RNA, 22 nt, Human
ucuucaucucuaaaaugggaac

SEQ ID NO: 122626 - RNA, 21 nt, Human
uccaggagcacgggacuagga

SEQ ID NO: 122627 - RNA, 22 nt, Human
uccagcacacagguggcucuca

SEQ ID NO: 122628 - RNA, 22 nt, Human
uccagccauaucuuguagcccu

SEQ ID NO: 122629 - RNA, 22 nt, Human
uccagccugaacuuuguccaga

SEQ ID NO: 122630 - RNA, 22 nt, Human
ucccaagugcuccucuggcccc

SEQ ID NO: 122631 - RNA, 22 nt, Human
ucccuacuccucuggucccucu

SEQ ID NO: 122632 - RNA, 22 nt, Human
ucccgcccugcguucucccaug

SEQ ID NO: 122633 - RNA, 22 nt, Human
ugcacugccuuucuuggcauga

SEQ ID NO: 122634 - RNA, 22 nt, Human
uccccgcugcgcccgcugcugc

SEQ ID NO: 122635 - RNA, 20 nt, Human
ugcacggcugugugugugca

SEQ ID NO: 122636 - RNA, 22 nt, Human
ucccagccugacagugcaucaa

SEQ ID NO: 122637 - RNA, 22 nt, Human
ucccacugucuucucgugcucg

SEQ ID NO: 122638 - RNA, 22 nt, Human
ugcaguugcguuugcauuccau

SEQ ID NO: 122639 - RNA, 22 nt, Human
ugcagguggcagcggggcacca

SEQ ID NO: 122640 - RNA, 22 nt, Human
uccgugguguuggcucuccggc

SEQ ID NO: 122641 - RNA, 22 nt, Human
uccgaccuuuacuucuugucuc

SEQ ID NO: 122642 - RNA, 22 nt, Human
uccgggcagcuccuggagcugu

SEQ ID NO: 122643 - RNA, 22 nt, Human
ucccucuaggggcgggaggcug

SEQ ID NO: 122644 - RNA, 22 nt, Human
ucccugcaggcauguacucuga

SEQ ID NO: 122645 - RNA, 22 nt, Human
ugcaggaagcucagcggggccg

SEQ ID NO: 122646 - RNA, 22 nt, Human
uccgacacacgugcucgcagcg

SEQ ID NO: 122647 - RNA, 20 nt, Human
uccgaaucaugacuuugcac

SEQ ID NO: 122648 - RNA, 22 nt, Human
ugcaggagcccaggaauacuau

SEQ ID NO: 122649 - RNA, 22 nt, Human
ugcagggucuccuguacuuggg

SEQ ID NO: 122650 - RNA, 18 nt, Human
ugcaggggaggggugaua

SEQ ID NO: 122651 - RNA, 22 nt, Human
ugccuuguagccaccgggucac

SEQ ID NO: 122652 - RNA, 22 nt, Human
ugccuucugccaaggacggugc

SEQ ID NO: 122653 - RNA, 22 nt, Human
ucgagauguuuguuguggugau

SEQ ID NO: 122654 - RNA, 22 nt, Human
ugcgcgcaccugcauauauaug

SEQ ID NO: 122655 - RNA, 22 nt, Human
ugcgccucugucacucagcauc

SEQ ID NO: 122656 - RNA, 22 nt, Human
ugccuggacgacaucacaguga

SEQ ID NO: 122657 - RNA, 21 nt, Human
ugccuggccuuugcuuuuccu

SEQ ID NO: 122658 - RNA, 22 nt, Human
ugccuguguuugggguggggaa

SEQ ID NO: 122659 - RNA, 20 nt, Human
ugccuuccgccccgggcacc

SEQ ID NO: 122660 - RNA, 17 nt, Human
ugccuucgucuucaguu

SEQ ID NO: 122661 - RNA, 22 nt, Human
uccugcccuguccuugccucug

SEQ ID NO: 122662 - RNA, 22 nt, Human
ugcaugguuauauacuacuagu

SEQ ID NO: 122663 - RNA, 22 nt, Human
ugccaaagauagagguuugagu

SEQ ID NO: 122664 - RNA, 22 nt, Human
ugcauuuucuaccacacccacu

SEQ ID NO: 122665 - RNA, 22 nt, Human
ugcaucccugaggcauuauccu

SEQ ID NO: 122666 - RNA, 21 nt, Human
uccguucgguuaaaaaggccc

SEQ ID NO: 122667 - RNA, 22 nt, Human
ugcaucccaaacaugguuuccu

SEQ ID NO: 122668 - RNA, 22 nt, Human
uccuccuuccugccccuaacuu

SEQ ID NO: 122669 - RNA, 22 nt, Human
uccuccuuuccccgcuggagcc

SEQ ID NO: 122670 - RNA, 18 nt, Human
ugcccaccagaagaggga

SEQ ID NO: 122671 - RNA, 22 nt, Human
ugcccagagccucuuaccucca

SEQ ID NO: 122672 - RNA, 22 nt, Human
uccucgccgucacgcagccucu

SEQ ID NO: 122673 - RNA, 22 nt, Human
uccuccucgccacgacucugcu

SEQ ID NO: 122674 - RNA, 22 nt, Human
uccucuccaggugagccgaaau

SEQ ID NO: 122675 - RNA, 22 nt, Human
uccucguccucauccgcgucau

SEQ ID NO: 122676 - RNA, 22 nt, Human
ucucacucuuccccaugucaga

SEQ ID NO: 122677 - RNA, 23 nt, Human
ucucaccaggauaugacugucac

SEQ ID NO: 122678 - RNA, 23 nt, Human
ugcugcgggacccgagcgcgcgc

SEQ ID NO: 122679 - RNA, 22 nt, Human
ugcugcucaagcugcagcaaaa

SEQ ID NO: 122680 - RNA, 22 nt, Human
ugcggagggagcagucggcugu

SEQ ID NO: 122681 - RNA, 22 nt, Human
ugcgccccgcgggccuucgggc

SEQ ID NO: 122682 - RNA, 22 nt, Human
ucgccuccucccagaucaacaa

SEQ ID NO: 122683 - RNA, 22 nt, Human
ucgcggccgcuccacaugcaca

SEQ ID NO: 122684 - RNA, 22 nt, Human
ucgcucgcuggcuccugcccgc

SEQ ID NO: 122685 - RNA, 22 nt, Human
ucgcuguguccuuuucacuuau

SEQ ID NO: 122686 - RNA, 22 nt, Human
ugcugugcuggcggcagaggcc

SEQ ID NO: 122687 - RNA, 22 nt, Human
ucuccaggggcagggucuggag

SEQ ID NO: 122688 - RNA, 22 nt, Human
ucuccagcugaggccuucuucc

SEQ ID NO: 122689 - RNA, 22 nt, Human
ucuccaccccugggaggcagaa

SEQ ID NO: 122690 - RNA, 23 nt, Human
ucucccagaaguucucggggacu

SEQ ID NO: 122691 - RNA, 22 nt, Human
ugcuguacaagacccucuguuu

SEQ ID NO: 122692 - RNA, 18 nt, Human
ucuccgaccccgcggucc

SEQ ID NO: 122693 - RNA, 22 nt, Human
ugcuggagccauguuuucucua

SEQ ID NO: 122694 - RNA, 22 nt, Human
ugcuggaguggcacuguguggc

SEQ ID NO: 122695 - RNA, 22 nt, Human
ugcugggagcugggccucgaca

SEQ ID NO: 122696 - RNA, 22 nt, Human
ugcuggugauuaaauccugaag

SEQ ID NO: 122697 - RNA, 22 nt, Human
ucuccaggaaagacacuggacu

SEQ ID NO: 122698 - RNA, 22 nt, Human
ugcugcucuucaccauggccuc

SEQ ID NO: 122699 - RNA, 22 nt, Human
ugcugcuguuuccuacaucuca

SEQ ID NO: 122700 - RNA, 22 nt, Human
ucucugaccuccaccccaggag

SEQ ID NO: 122701 - RNA, 22 nt, Human
ugcuucuuuaggauguaguuau

SEQ ID NO: 122702 - RNA, 22 nt, Human
ucucgcuguuccugcuucaggu

SEQ ID NO: 122703 - RNA, 20 nt, Human
uggaucgaccucacuuccau

SEQ ID NO: 122704 - RNA, 22 nt, Human
ucuuccacuugaaccuucuguc

SEQ ID NO: 122705 - RNA, 22 nt, Human
uggcaaggccacaggugcaguu

SEQ ID NO: 122706 - RNA, 22 nt, Human
uggcuacauuuauacucucauu

SEQ ID NO: 122707 - RNA, 22 nt, Human
uggcuacguacaauggaacuuu

SEQ ID NO: 122708 - RNA, 22 nt, Human
uggcucagcgcggccuggucuu

SEQ ID NO: 122709 - RNA, 22 nt, Human
uggcgcgcagccugcuggugcu

SEQ ID NO: 122710 - RNA, 22 nt, Human
uggcgcgcucgcucucgcugag

SEQ ID NO: 122711 - RNA, 22 nt, Human
uggcgcucacccugcggcccug

SEQ ID NO: 122712 - RNA, 22 nt, Human
uggcaucacagacaaggcagca

SEQ ID NO: 122713 - RNA, 22 nt, Human
uggcaucucggugcugguucuu

SEQ ID NO: 122714 - RNA, 20 nt, Human
uggccgacccugaggaguug

SEQ ID NO: 122715 - RNA, 21 nt, Human
uggcccgagccgggguuggcu

SEQ ID NO: 122716 - RNA, 20 nt, Human
uggcccgcgcuccuccugcu

SEQ ID NO: 122717 - RNA, 22 nt, Human
uggccgaugagcaugcgcugau

SEQ ID NO: 122718 - RNA, 22 nt, Human
ucuguucacaauuacacacacu

SEQ ID NO: 122719 - RNA, 22 nt, Human
ucugggaccuagacccauuguu

SEQ ID NO: 122720 - RNA, 22 nt, Human
ucuggugcacucugauauuuga

SEQ ID NO: 122721 - RNA, 22 nt, Human
uggaagugucagcaggcugguu

SEQ ID NO: 122722 - RNA, 22 nt, Human
ucuggguuuccuucacaagcac

SEQ ID NO: 122723 - RNA, 17 nt, Human
ucuggguuucugauuua

SEQ ID NO: 122724 - RNA, 22 nt, Human
ucugcuguugaucaugacuagc

SEQ ID NO: 122725 - RNA, 22 nt, Human
ucugcuggugucauuuuugcua

SEQ ID NO: 122726 - RNA, 22 nt, Human
ucugaucuuucauccuaaaugg

SEQ ID NO: 122727 - RNA, 23 nt, Human
uggaagaaaaugguuuggcugug

SEQ ID NO: 122728 - RNA, 22 nt, Human
ugcaugacugaucuguuuguca

SEQ ID NO: 122729 - RNA, 17 nt, Human
ugcaugcgucugugaua

SEQ ID NO: 122730 - RNA, 22 nt, Human
ugcaugcagcuggucgggcgcc

SEQ ID NO: 122731 - RNA, 22 nt, Human
ugcaucugagcacuacggugga

SEQ ID NO: 122732 - RNA, 22 nt, Human
ugcaugacaauugccgucaagu

SEQ ID NO: 122733 - RNA, 22 nt, Human
ugugcuugucguggagccaggc

SEQ ID NO: 122734 - RNA, 22 nt, Human
ugcagugcagcuggaaguuggc

SEQ ID NO: 122735 - RNA, 22 nt, Human
ugugcugcagcgagagcuacga

SEQ ID NO: 122736 - RNA, 20 nt, Human
ugcagcucccccgcaguuuc

SEQ ID NO: 122737 - RNA, 22 nt, Human
ugcagccuuuguccuugggcua

SEQ ID NO: 122738 - RNA, 18 nt, Human
ugcagcuuugugauuggc

SEQ ID NO: 122739 - RNA, 22 nt, Human
ugccgcuuucuggcccucaguc

SEQ ID NO: 122740 - RNA, 22 nt, Human
ugccgccccggggcccccagcc

SEQ ID NO: 122741 - RNA, 22 nt, Human
ugccccuugccaggccucugcc

SEQ ID NO: 122742 - RNA, 20 nt, Human
ugccagagagcucauacccu

SEQ ID NO: 122743 - RNA, 23 nt, Human
ugccaggaagaaugaccucugcu

SEQ ID NO: 122744 - RNA, 22 nt, Human
ugccagauuaugucuccagggc

SEQ ID NO: 122745 - RNA, 22 nt, Human
uguggccaccagagcugcuauu

SEQ ID NO: 122746 - RNA, 22 nt, Human
ugcccagcagggagcuaccugg

SEQ ID NO: 122747 - RNA, 22 nt, Human
ugcccccggcugcccaggggaa

SEQ ID NO: 122748 - RNA, 22 nt, Human
ugccagcuccgaggagcugcag

SEQ ID NO: 122749 - RNA, 19 nt, Human
ugcagcacuaaaaacuuuc

SEQ ID NO: 122750 - RNA, 22 nt, Human
ugcagcagaauauggcugcagg

SEQ ID NO: 122751 - RNA, 22 nt, Human
ugcagccucacgcauccgcauu

SEQ ID NO: 122752 - RNA, 22 nt, Human
ugugaaggaaaguaggagggac

SEQ ID NO: 122753 - RNA, 22 nt, Human
ugcagaacacaguagacagaac

SEQ ID NO: 122754 - RNA, 22 nt, Human
ugucuucuuuucccuuagcccu

SEQ ID NO: 122755 - RNA, 22 nt, Human
ugucuuucuuucucuugacaga

SEQ ID NO: 122756 - RNA, 22 nt, Human
ugcaagugccauggauucaggu

SEQ ID NO: 122757 - RNA, 22 nt, Human
ugucccuggacuccaggagcca

SEQ ID NO: 122758 - RNA, 20 nt, Human
ugucccuggagagcugcaga

SEQ ID NO: 122759 - RNA, 23 nt, Human
ugucacugcggaguggccugcag

SEQ ID NO: 122760 - RNA, 22 nt, Human
ugucaucuuggugcugugagag

SEQ ID NO: 122761 - RNA, 22 nt, Human
ugaucaacagggcuggaaagag

SEQ ID NO: 122762 - RNA, 22 nt, Human
ugaugaucaugcagguugguuu

SEQ ID NO: 122763 - RNA, 20 nt, Human
ugauccacucucauugcucu

SEQ ID NO: 122764 - RNA, 22 nt, Human
ugguuuucuuaauuagcaguca

SEQ ID NO: 122765 - RNA, 22 nt, Human
ugguucugucugugcugggggg

SEQ ID NO: 122766 - RNA, 22 nt, Human
ugguuucagacagacucgaacu

SEQ ID NO: 122767 - RNA, 22 nt, Human
ugagugacuguugucaagaugg

SEQ ID NO: 122768 - RNA, 22 nt, Human
ugagugcuuuucgguguaccgu

SEQ ID NO: 122769 - RNA, 22 nt, Human
ugagucuguugcuagggggaau

SEQ ID NO: 122770 - RNA, 22 nt, Human
uggucuccucuuaauugccuac

SEQ ID NO: 122771 - RNA, 22 nt, Human
uggugccuuccgagagcuguga

SEQ ID NO: 122772 - RNA, 22 nt, Human
ugguucacaagaauccagguag

SEQ ID NO: 122773 - RNA, 22 nt, Human
ugguucggcuguaaguauaucu

SEQ ID NO: 122774 - RNA, 20 nt, Human
ugguguacauuuccauaguu

SEQ ID NO: 122775 - RNA, 21 nt, Human
ugguccaaggacucauaccug

SEQ ID NO: 122776 - RNA, 22 nt, Human
uggucccuagugugggagcuug

SEQ ID NO: 122777 - RNA, 22 nt, Human
ugguccaaaccagugcuguggu

SEQ ID NO: 122778 - RNA, 22 nt, Human
ugagaccuaaaccgucuguccu

SEQ ID NO: 122779 - RNA, 22 nt, Human
ugguagacaacagcagugggac

SEQ ID NO: 122780 - RNA, 22 nt, Human
uggguguggaagcagcgugggg

SEQ ID NO: 122781 - RNA, 22 nt, Human
ugacucugaugcaguguguuua

SEQ ID NO: 122782 - RNA, 19 nt, Human
ugacuggguucuaggcagg

SEQ ID NO: 122783 - RNA, 22 nt, Human
ugacugaggaaggugggguggg

SEQ ID NO: 122784 - RNA, 22 nt, Human
uggguggugaaauggaugggaa

SEQ ID NO: 122785 - RNA, 22 nt, Human
ugggugccgcaucuugcuguuc

SEQ ID NO: 122786 - RNA, 22 nt, Human
uggguggauucgggaacuuguu

SEQ ID NO: 122787 - RNA, 22 nt, Human
ugggugaagaggcuaugcuacu

SEQ ID NO: 122788 - RNA, 22 nt, Human
ugggucaguagccuugcagaac

SEQ ID NO: 122789 - RNA, 22 nt, Human
ugggucagauugagccccuggu

SEQ ID NO: 122790 - RNA, 22 nt, Human
ugcuuucaaaacucagaggaau

SEQ ID NO: 122791 - RNA, 22 nt, Human
uuagcagacagauggagagaga

SEQ ID NO: 122792 - RNA, 22 nt, Human
uggaacugauuaaaagggcaga

SEQ ID NO: 122793 - RNA, 22 nt, Human
uggagagcaaugaggggcaggc

SEQ ID NO: 122794 - RNA, 22 nt, Human
uggacuguaauguguguggacc

SEQ ID NO: 122795 - RNA, 22 nt, Human
uggagaugcacgagcaggugga

SEQ ID NO: 122796 - RNA, 22 nt, Human
uggaaugccgggccaggcuccg

SEQ ID NO: 122797 - RNA, 22 nt, Human
uggaaugaaagaaaaauuguag

SEQ ID NO: 122798 - RNA, 22 nt, Human
uggaagugggcaucaccaucca

SEQ ID NO: 122799 - RNA, 20 nt, Human
uggaaggaaagguguaucuu

SEQ ID NO: 122800 - RNA, 22 nt, Human
uggaagcuggcugaucugacuu

SEQ ID NO: 122801 - RNA, 22 nt, Human
uggaagucuucucucccaugga

SEQ ID NO: 122802 - RNA, 22 nt, Human
uggaagggguuacgcagcagga

SEQ ID NO: 122803 - RNA, 22 nt, Human
uggaaggggccaggcgcggagu

SEQ ID NO: 122804 - RNA, 22 nt, Human
uuaguccucaugaccaccaagu

SEQ ID NO: 122805 - RNA, 22 nt, Human
uggaagaaaugguugagccaug

SEQ ID NO: 122806 - RNA, 22 nt, Human
ugcuguugacuuuguuguucuu

SEQ ID NO: 122807 - RNA, 20 nt, Human
ugcuguggguaagcuuuaua

SEQ ID NO: 122808 - RNA, 20 nt, Human
ugcugugugucuacuguggg

SEQ ID NO: 122809 - RNA, 22 nt, Human
ugcuucuuuccuuggugacuuc

SEQ ID NO: 122810 - RNA, 22 nt, Human
ugcuugacucagcaucggcaau

SEQ ID NO: 122811 - RNA, 20 nt, Human
ugcugggccaucuugcaugc

SEQ ID NO: 122812 - RNA, 22 nt, Human
ugcuggagucucuugacccugg

SEQ ID NO: 122813 - RNA, 22 nt, Human
ugcugguuucugaguaaccaca

SEQ ID NO: 122814 - RNA, 22 nt, Human
ugcugcuguuaucauuuuacca

SEQ ID NO: 122815 - RNA, 22 nt, Human
ugcuggaaggguaguauuaacu

SEQ ID NO: 122816 - RNA, 22 nt, Human
ugcugcggcgcaggcacuccag

SEQ ID NO: 122817 - RNA, 23 nt, Human
ugcugcuggaguaucuacaaugc

SEQ ID NO: 122818 - RNA, 22 nt, Human
ugcugcggauauacaggaucug

SEQ ID NO: 122819 - RNA, 22 nt, Human
ugcugccucugaauggagcagu

SEQ ID NO: 122820 - RNA, 22 nt, Human
uguuugagaauuugcugauguu

SEQ ID NO: 122821 - RNA, 22 nt, Human
ugcugcacuuauggcucugagg

SEQ ID NO: 122822 - RNA, 19 nt, Human
ugcugcaggaauucucaag

SEQ ID NO: 122823 - RNA, 22 nt, Human
uguuucguugguggagagcuac

SEQ ID NO: 122824 - RNA, 22 nt, Human
ugcucgauuauuucauuuugca

SEQ ID NO: 122825 - RNA, 22 nt, Human
uguugguuucaagcaggagccu

SEQ ID NO: 122826 - RNA, 18 nt, Human
uguugguguucacucacu

SEQ ID NO: 122827 - RNA, 21 nt, Human
uguuggccuucauucucuguc

SEQ ID NO: 122828 - RNA, 22 nt, Human
uuccuggaguggagggagguga

SEQ ID NO: 122829 - RNA, 22 nt, Human
uggggcauacgugaaauaauuu

SEQ ID NO: 122830 - RNA, 22 nt, Human
uggggccaggcuguuggcuucc

SEQ ID NO: 122831 - RNA, 22 nt, Human
uucgucaauaugcagccuguga

SEQ ID NO: 122832 - RNA, 22 nt, Human
uggggcgcaggcccagcgggcu

SEQ ID NO: 122833 - RNA, 22 nt, Human
uucggugagcugcgggcgagga

SEQ ID NO: 122834 - RNA, 22 nt, Human
uucccggccgccccccgcucgg

SEQ ID NO: 122835 - RNA, 22 nt, Human
uuccugacacuggcaggcuucu

SEQ ID NO: 122836 - RNA, 22 nt, Human
uggcuguuggagcuggaagaug

SEQ ID NO: 122837 - RNA, 22 nt, Human
uggcugagugaacauguccauu

SEQ ID NO: 122838 - RNA, 22 nt, Human
uggcugaugucuguucuguuau

SEQ ID NO: 122839 - RNA, 22 nt, Human
uggcugagcugcagcguggcuu

SEQ ID NO: 122840 - RNA, 22 nt, Human
uuccaagcaccaugaaggccuc

SEQ ID NO: 122841 - RNA, 22 nt, Human
uuccaugccuaagagccugaag

SEQ ID NO: 122842 - RNA, 22 nt, Human
uggagcuggcuuguggaaguug

SEQ ID NO: 122843 - RNA, 22 nt, Human
uggagccagcaggacucagagg

SEQ ID NO: 122844 - RNA, 22 nt, Human
uucuggucucucugaccuagga

SEQ ID NO: 122845 - RNA, 22 nt, Human
uggucaagcaaugaauuuauuu

SEQ ID NO: 122846 - RNA, 22 nt, Human
uggucacgucgggguauugcca

SEQ ID NO: 122847 - RNA, 22 nt, Human
ugguccgagaacuguccugguu

SEQ ID NO: 122848 - RNA, 22 nt, Human
ugguccucacccuacccagcug

SEQ ID NO: 122849 - RNA, 18 nt, Human
uucugcggugacagauau

SEQ ID NO: 122850 - RNA, 17 nt, Human
uucugcucaggaacaga

SEQ ID NO: 122851 - RNA, 22 nt, Human
ugggugggcagagucuaagaua

SEQ ID NO: 122852 - RNA, 22 nt, Human
ugggugaugagguccccagccc

SEQ ID NO: 122853 - RNA, 22 nt, Human
ugggugugcaccuacgaucucu

SEQ ID NO: 122854 - RNA, 22 nt, Human
uggguguuccuggggugcaagg

SEQ ID NO: 122855 - RNA, 22 nt, Human
uggggcuggccaggaggagucu

SEQ ID NO: 122856 - RNA, 22 nt, Human
uggggcuccuccuggcaggagg

SEQ ID NO: 122857 - RNA, 22 nt, Human
uggggcggaaggaggagaggug

SEQ ID NO: 122858 - RNA, 22 nt, Human
ugggucacuggccaagcucgac

SEQ ID NO: 122859 - RNA, 22 nt, Human
uucuccacguucuucucggccu

SEQ ID NO: 122860 - RNA, 22 nt, Human
uucuccugcccuuggacuucca

SEQ ID NO: 122861 - RNA, 22 nt, Human
uucuccucuuugucacugcuuu

SEQ ID NO: 122862 - RNA, 22 nt, Human
uucuccucagcaaggcagcuuu

SEQ ID NO: 122863 - RNA, 19 nt, Human
ugguggaggugcaccugac

SEQ ID NO: 122864 - RNA, 20 nt, Human
ugguguccuaugcuugugcu

SEQ ID NO: 122865 - RNA, 22 nt, Human
ugguguccccugaguuucuauc

SEQ ID NO: 122866 - RNA, 22 nt, Human
uucuuugcucaccugccgcucc

SEQ ID NO: 122867 - RNA, 22 nt, Human
uggugugggauccugggaagga

SEQ ID NO: 122868 - RNA, 22 nt, Human
ugguccuuuccauuggagacac

SEQ ID NO: 122869 - RNA, 22 nt, Human
uggucggugguguggggaggca

SEQ ID NO: 122870 - RNA, 22 nt, Human
uggucugauggucccaccaccg

SEQ ID NO: 122871 - RNA, 22 nt, Human
uggugcacgugggcagucggcc

SEQ ID NO: 122872 - RNA, 19 nt, Human
uggugcgcuguuccugagc

SEQ ID NO: 122873 - RNA, 22 nt, Human
uggugcccguggaaagagggag

SEQ ID NO: 122874 - RNA, 22 nt, Human
uggugcucucgauauauaaggc

SEQ ID NO: 122875 - RNA, 22 nt, Human
uggugcuuuuguggaugcuaac

SEQ ID NO: 122876 - RNA, 22 nt, Human
uggugcucuugauauauaaggc

SEQ ID NO: 122877 - RNA, 22 nt, Human
ugguuuuuuguaggauaaacau

SEQ ID NO: 122878 - RNA, 19 nt, Human
uucuguggucccaggccuu

SEQ ID NO: 122879 - RNA, 22 nt, Human
uugcaucagcaggcauaauugg

SEQ ID NO: 122880 - RNA, 22 nt, Human
uugcaucaaauauguaccacag

SEQ ID NO: 122881 - RNA, 22 nt, Human
ugugccuguugguguagacaua

SEQ ID NO: 122882 - RNA, 20 nt, Human
ugucugguaagacgcccauc

SEQ ID NO: 122883 - RNA, 22 nt, Human
ugucucuuccuccucuugguac

SEQ ID NO: 122884 - RNA, 22 nt, Human
ugucugauccuucaggagcccc

SEQ ID NO: 122885 - RNA, 21 nt, Human
ugucugcaauuccagggaacc

SEQ ID NO: 122886 - RNA, 22 nt, Human
uugaugacuaaagaaagcugcu

SEQ ID NO: 122887 - RNA, 22 nt, Human
ugucagccacggugugaccggc

SEQ ID NO: 122888 - RNA, 20 nt, Human
uugaggagauauugaauacu

SEQ ID NO: 122889 - RNA, 22 nt, Human
uugaccauguggcccaggccaa

SEQ ID NO: 122890 - RNA, 22 nt, Human
uuguuccuaguuguccaucaca

SEQ ID NO: 122891 - RNA, 22 nt, Human
uuguugcaagccuggaaucugg

SEQ ID NO: 122892 - RNA, 22 nt, Human
uuuaccugucuguagaacauaa

SEQ ID NO: 122893 - RNA, 22 nt, Human
uuguggcaggauggacagcaga

SEQ ID NO: 122894 - RNA, 22 nt, Human
uugugaggaugugcuuuuuagu

SEQ ID NO: 122895 - RNA, 22 nt, Human
uuggggaugccccuacgggcua

SEQ ID NO: 122896 - RNA, 22 nt, Human
uguuguucuuuuucuucuuguu

SEQ ID NO: 122897 - RNA, 22 nt, Human
uguuuagcucugacuaugugau

SEQ ID NO: 122898 - RNA, 22 nt, Human
uguguucuuugcuuaauuaaag

SEQ ID NO: 122899 - RNA, 19 nt, Human
uguucuacuugcuaguauu

SEQ ID NO: 122900 - RNA, 22 nt, Human
uguuccuggggaccugccuucc

SEQ ID NO: 122901 - RNA, 22 nt, Human
uguucggaaaagggcaagcuau

SEQ ID NO: 122902 - RNA, 22 nt, Human
uuggccaaggaccuuuuuggag

SEQ ID NO: 122903 - RNA, 22 nt, Human
uguuccacgcguaguuccugcu

SEQ ID NO: 122904 - RNA, 22 nt, Human
uguuccucuuagucuuaugugu

SEQ ID NO: 122905 - RNA, 23 nt, Human
uguuccugaugccucguccuguc

SEQ ID NO: 122906 - RNA, 20 nt, Human
uugcggccuaacagccccuu

SEQ ID NO: 122907 - RNA, 22 nt, Human
uugcggaucuucauggccucag

SEQ ID NO: 122908 - RNA, 22 nt, Human
uuggaagagagauggggagaga

SEQ ID NO: 122909 - RNA, 22 nt, Human
uuggacugggauggccgaggcu

SEQ ID NO: 122910 - RNA, 22 nt, Human
uguguguguguguaugugcgug

SEQ ID NO: 122911 - RNA, 22 nt, Human
ugugucgccaacaauugugucu

SEQ ID NO: 122912 - RNA, 21 nt, Human
uucgaaugggucguugcugcc

SEQ ID NO: 122913 - RNA, 22 nt, Human
uucgcggccaggcggggaggcc

SEQ ID NO: 122914 - RNA, 21 nt, Human
uuccuggaggcagaaacguga

SEQ ID NO: 122915 - RNA, 22 nt, Human
uuccugcuggucaaaguugccu

SEQ ID NO: 122916 - RNA, 22 nt, Human
uuccugaucuuuucccagaguu

SEQ ID NO: 122917 - RNA, 22 nt, Human
uuccucauucuggggcauguug

SEQ ID NO: 122918 - RNA, 22 nt, Human
uuccagaacaauguggacguau

SEQ ID NO: 122919 - RNA, 22 nt, Human
uucccgcugcuggaguuggggc

SEQ ID NO: 122920 - RNA, 22 nt, Human
uuccccuucuaauacucaauuu

SEQ ID NO: 122921 - RNA, 22 nt, Human
uucauaugaauuggguuuuuuu

SEQ ID NO: 122922 - RNA, 22 nt, Human
uucauccucuaguacugaagug

SEQ ID NO: 122923 - RNA, 22 nt, Human
uuugcuguccaauauucagggu

SEQ ID NO: 122924 - RNA, 22 nt, Human
uucagcugcuugccugaaguca

SEQ ID NO: 122925 - RNA, 22 nt, Human
uuugccggaucugucuccagcu

SEQ ID NO: 122926 - RNA, 22 nt, Human
uuugcugggaagccuucacucu

SEQ ID NO: 122927 - RNA, 22 nt, Human
uucagcacuggacagcgagucu

SEQ ID NO: 122928 - RNA, 22 nt, Human
uucagcauaggcugcucuucaa

SEQ ID NO: 122929 - RNA, 22 nt, Human
uucacccaaaucaagcuggccu

SEQ ID NO: 122930 - RNA, 23 nt, Human
uucaccaaugcuguccaaguacc

SEQ ID NO: 122931 - RNA, 22 nt, Human
uucaccucuuuuuggggacauc

SEQ ID NO: 122932 - RNA, 20 nt, Human
uucacggaggccgcgccccc

SEQ ID NO: 122933 - RNA, 22 nt, Human
uugaugacauuuagcauaauug

SEQ ID NO: 122934 - RNA, 22 nt, Human
uucuuccagugaaacgugcauc

SEQ ID NO: 122935 - RNA, 22 nt, Human
uuuuguggacugauccgaggac

SEQ ID NO: 122936 - RNA, 22 nt, Human
uuuucggggcgacuuagguucu

SEQ ID NO: 122937 - RNA, 22 nt, Human
uucgucauuaugcagccuguga

SEQ ID NO: 122938 - RNA, 22 nt, Human
uucgucauuguuguugguuuuc

SEQ ID NO: 122939 - RNA, 18 nt, Human
uucgucauggggaucgua

SEQ ID NO: 122940 - RNA, 22 nt, Human
uucgcucuucacacagugcuga

SEQ ID NO: 122941 - RNA, 22 nt, Human
uugguuccauuuuaccagcucu

SEQ ID NO: 122942 - RNA, 22 nt, Human
uuggugauugggaauggauggg

SEQ ID NO: 122943 - RNA, 22 nt, Human
uuggggauugggugcaagggac

SEQ ID NO: 122944 - RNA, 22 nt, Human
uuggccugcuccagaacaaggg

SEQ ID NO: 122945 - RNA, 22 nt, Human
uuggcguuuccuguucugggug

SEQ ID NO: 122946 - RNA, 22 nt, Human
uuggccauuacugagccuggag

SEQ ID NO: 122947 - RNA, 22 nt, Human
uuggaggcagagucuugcugag

SEQ ID NO: 122948 - RNA, 22 nt, Human
uuguugcuguugaacccugcug

SEQ ID NO: 122949 - RNA, 22 nt, Human
uuugggccugucugccugcuuu

SEQ ID NO: 122950 - RNA, 22 nt, Human
uuuguccuguuggcaugaaaau

SEQ ID NO: 122951 - RNA, 19 nt, Human
uuugccugugguucagaag

SEQ ID NO: 122952 - RNA, 19 nt, Human
uuucucacugagucguuug

SEQ ID NO: 122953 - RNA, 22 nt, Human
uuucuugggaaaugucagaagu

SEQ ID NO: 122954 - RNA, 21 nt, Human
uuuccagaggcagccggacuc

SEQ ID NO: 122955 - RNA, 22 nt, Human
uuucagcaugacuguuaucuuu

SEQ ID NO: 122956 - RNA, 22 nt, Human
gcacauaugcuguaagcacaug

SEQ ID NO: 122957 - RNA, 22 nt, Human
aagaggaggacgguucccagaa

SEQ ID NO: 122958 - RNA, 22 nt, Human
uggcaggggaaaagggguggga

SEQ ID NO: 122959 - RNA, 22 nt, Human
auauuauuaaaauagauggaua

SEQ ID NO: 122960 - RNA, 22 nt, Human
ggaugaguuguauauaggauuc

SEQ ID NO: 122961 - RNA, 22 nt, Human
uaggcaaguggaccagagguuu

SEQ ID NO: 122962 - RNA, 22 nt, Human
cuuaggaaauccuguacucccc

SEQ ID NO: 122963 - RNA, 22 nt, Human
ggcagucuuucccuugagcucu

SEQ ID NO: 122964 - RNA, 22 nt, Human
aggcaguguggagggcuguugc

SEQ ID NO: 122965 - RNA, 22 nt, Human
uuuaugauguagccuagagcug

SEQ ID NO: 122966 - RNA, 22 nt, Human
ucacaucugugugauugucauu

SEQ ID NO: 122967 - RNA, 22 nt, Human
uaaaaauuagauauguauuuag

SEQ ID NO: 122968 - RNA, 22 nt, Human
aauaauuuuuuugugauuaugu

SEQ ID NO: 122969 - RNA, 20 nt, Human
uuccccauaaaaauguucca

SEQ ID NO: 122970 - RNA, 22 nt, Human
uuuaugucaaaaguaaaaugaa

SEQ ID NO: 122971 - RNA, 22 nt, Human
cugugucucccaaggaggguca

SEQ ID NO: 122972 - RNA, 22 nt, Human
ucauaagucucauauaugucca

SEQ ID NO: 122973 - RNA, 22 nt, Human
gcauaacaacagacucuguguu

SEQ ID NO: 122974 - RNA, 22 nt, Human
uaauucuucaauccaguguuca

SEQ ID NO: 122975 - RNA, 22 nt, Human
aguggcugugaaauacauggga

SEQ ID NO: 122976 - RNA, 23 nt, Human
gcccagaggccccuggccugagc

SEQ ID NO: 122977 - RNA, 23 nt, Human
ucucccagaaguucucggggacu

SEQ ID NO: 122978 - RNA, 22 nt, Human
ugcauuuucuaccacacccacu

SEQ ID NO: 122979 - RNA, 22 nt, Human
ggcagguccugaguccugaggc

SEQ ID NO: 122980 - RNA, 22 nt, Human
auguuagcaucuggcacuaugg

SEQ ID NO: 122981 - RNA, 22 nt, Human
uacagucauaagguuucucucc

SEQ ID NO: 122982 - RNA, 22 nt, Human
ucccauauuauggggaaaaacu

SEQ ID NO: 122983 - RNA, 22 nt, Human
ggaggagggaguucaggaguau

SEQ ID NO: 122984 - RNA, 22 nt, Human
ucagucucuggggcuucuguuu

SEQ ID NO: 122985 - RNA, 22 nt, Human
aaggcuguuugagcacuggagc

SEQ ID NO: 122986 - RNA, 20 nt, Human
aggggcuguaguuagaugac

SEQ ID NO: 122987 - RNA, 22 nt, Human
ucuucaugaaauugauugcuua

SEQ ID NO: 122988 - RNA, 22 nt, Human
aauuugcuccaaugucaguucu

SEQ ID NO: 122989 - RNA, 20 nt, Human
ugggauggaaucaccugcac

SEQ ID NO: 122990 - RNA, 22 nt, Human
uggaaaauuuagaaagauuuau

SEQ ID NO: 122991 - RNA, 22 nt, Human
ggcugguggcgggcagcacaga

SEQ ID NO: 122992 - RNA, 22 nt, Human
aguggcuguuccaggugaggac

SEQ ID NO: 122993 - RNA, 22 nt, Human
ugguggaggugggggguauuuu

SEQ ID NO: 122994 - RNA, 22 nt, Human
cuuuuuuucuccauauuucugg

SEQ ID NO: 122995 - RNA, 22 nt, Human
auucuuuauuuucuguacuugc

SEQ ID NO: 122996 - RNA, 22 nt, Human
ugcagacuguuucuugacugaa

SEQ ID NO: 122997 - RNA, 22 nt, Human
cuucuuucuuuucuucuucucu

SEQ ID NO: 122998 - RNA, 22 nt, Human
aaaauacuaggaaaauaaauca

SEQ ID NO: 122999 - RNA, 22 nt, Human
auagagcuggggaagaagcugg

SEQ ID NO: 123000 - RNA, 22 nt, Human
aggcugggaaguguguccugag

SEQ ID NO: 123001 - RNA, 22 nt, Human
uccaugaguuuuuuaguuucac

SEQ ID NO: 123002 - RNA, 22 nt, Human
aauauuuaccuaccugucaucu

SEQ ID NO: 123003 - RNA, 22 nt, Human
guauuauauaaccauugguucu

SEQ ID NO: 123004 - RNA, 22 nt, Human
ucagccuugguuuugguguugg

SEQ ID NO: 123005 - RNA, 22 nt, Human
cccagccuuugcuuccugguuc

SEQ ID NO: 123006 - RNA, 22 nt, Human
uuauuuuuaggaauguagaggu

SEQ ID NO: 123007 - RNA, 22 nt, Human
aauguucucuaaucuuucucuu

SEQ ID NO: 123008 - RNA, 22 nt, Human
gcuguggagaagcugccuaugg

SEQ ID NO: 123009 - RNA, 22 nt, Human
cuucuuaaaguugucacagcug

SEQ ID NO: 123010 - RNA, 21 nt, Human
uccugcagggcagcagagugg

SEQ ID NO: 123011 - RNA, 22 nt, Human
uguuaaaaagucccuguuuugu

SEQ ID NO: 123012 - RNA, 22 nt, Human
cguuuugaguagauagccauau

SEQ ID NO: 123013 - RNA, 22 nt, Human
gcaguaaauugagagucauguu

SEQ ID NO: 123014 - RNA, 22 nt, Human
aaggggaggccugcgcuuucgg

SEQ ID NO: 123015 - RNA, 22 nt, Human
cauuuaaccccuugguacugaa

SEQ ID NO: 123016 - RNA, 22 nt, Human
acucacuguuuugaaauugaac

SEQ ID NO: 123017 - RNA, 22 nt, Human
cugguuuauuucauaguuuguu

SEQ ID NO: 123018 - RNA, 22 nt, Human
uggucacgucgggguauugcca

SEQ ID NO: 123019 - RNA, 22 nt, Human
gauuuucauuauagcuaguuuc

SEQ ID NO: 123020 - RNA, 22 nt, Human
aaauauuaaugaugaagguagu

SEQ ID NO: 123021 - RNA, 22 nt, Human
aucuggaacuucucugcauuga

SEQ ID NO: 123022 - RNA, 22 nt, Human
auuucacucuuaauugcuuccu

SEQ ID NO: 123023 - RNA, 22 nt, Human
aggcuuagaugaguucccacau

SEQ ID NO: 123024 - RNA, 23 nt, Human
ucucacucauucuccucugucca

SEQ ID NO: 123025 - RNA, 22 nt, Human
uaacauuagcuuugcucaugca

SEQ ID NO: 123026 - RNA, 22 nt, Human
cagaucacauccauccgucacc

SEQ ID NO: 123027 - RNA, 22 nt, Human
agagacaggguuuugucguguu

SEQ ID NO: 123028 - RNA, 22 nt, Human
aauauuuaaauagaauuacauc

SEQ ID NO: 123029 - RNA, 22 nt, Human
uccaggaggacugagggggcug

SEQ ID NO: 123030 - RNA, 22 nt, Human
ccagcaggagacuagcaacaua

SEQ ID NO: 123031 - RNA, 22 nt, Human
acuggguuguuugucucaugag

SEQ ID NO: 123032 - RNA, 22 nt, Human
ggagggaggggugggagaugga

SEQ ID NO: 123033 - RNA, 22 nt, Human
guuuucuuguuaauuuugaacg

SEQ ID NO: 123034 - RNA, 22 nt, Human
uucuguuuauaauuugcaguug

SEQ ID NO: 123035 - RNA, 22 nt, Human
aauggaaaaagaacuguuuaaa

SEQ ID NO: 123036 - RNA, 22 nt, Human
ggcuucuuaacauuuggacacc

SEQ ID NO: 123037 - RNA, 20 nt, Human
aaaaacaguaaugcugaaga

SEQ ID NO: 123038 - RNA, 22 nt, Human
aaucaauuauccauuuguuagu

SEQ ID NO: 123039 - RNA, 22 nt, Human
uuuuuaauuuuaagcuauuugu

SEQ ID NO: 123040 - RNA, 22 nt, Human
aucucccaaauuagccucuuga

SEQ ID NO: 123041 - RNA, 21 nt, Human
auauuguugggguuuucuuuu

SEQ ID NO: 123042 - RNA, 22 nt, Human
aauagaguccuguacugaauga

SEQ ID NO: 123043 - RNA, 21 nt, Human
uuuuucuccagaguuuccacu

SEQ ID NO: 123044 - RNA, 19 nt, Human
ccagaagggcaagcaaagg

SEQ ID NO: 123045 - RNA, 22 nt, Human
auuuauuugaagagccauugca

SEQ ID NO: 123046 - RNA, 22 nt, Human
caaaacccaagugcuauugcaa

SEQ ID NO: 123047 - RNA, 22 nt, Human
auuuuauuuugggaucuuuuua

SEQ ID NO: 123048 - RNA, 22 nt, Human
cggcugcagcggagcaggcugg

SEQ ID NO: 123049 - RNA, 22 nt, Human
uuucuauauucaguuucauaaa

SEQ ID NO: 123050 - RNA, 22 nt, Human
aaauauauauaauauauauauu

SEQ ID NO: 123051 - RNA, 22 nt, Human
cagcuucaugacaaacaguuuu

SEQ ID NO: 123052 - RNA, 20 nt, Human
ggcagagcuaugucuguugc

SEQ ID NO: 123053 - RNA, 22 nt, Human
cagcagaggagguggcagcacc

SEQ ID NO: 123054 - RNA, 22 nt, Human
gaggucagugugggggcaaggg

SEQ ID NO: 123055 - RNA, 22 nt, Human
guuaaaaugauuugugauuuau

SEQ ID NO: 123056 - RNA, 22 nt, Human
uuuggcugucauuugaaaaugu

SEQ ID NO: 123057 - RNA, 22 nt, Human
guacugguuuucuuacucuggc

SEQ ID NO: 123058 - RNA, 22 nt, Human
uuuguuaugguuggaagcagga

SEQ ID NO: 123059 - RNA, 22 nt, Human
cucugcuagaaggucaaucucu

SEQ ID NO: 123060 - RNA, 22 nt, Human
cuuuacauuaauuucuacugau

SEQ ID NO: 123061 - RNA, 22 nt, Human
uguugaaacagcuauugacuuu

SEQ ID NO: 123062 - RNA, 22 nt, Human
uaagaaacauuuuuaugacagu

SEQ ID NO: 123063 - RNA, 22 nt, Human
aauguacucgaaugauguuaag

SEQ ID NO: 123064 - RNA, 22 nt, Human
ccugacucugauuucgcugcau

SEQ ID NO: 123065 - RNA, 22 nt, Human
ugaggaggugggcacacagagu

SEQ ID NO: 123066 - RNA, 22 nt, Human
cuacuucucccuagaucagaaa

SEQ ID NO: 123067 - RNA, 22 nt, Human
uuuuuaagguuuguuuauauau

SEQ ID NO: 123068 - RNA, 22 nt, Human
aucauguauauuuuugcuauua

SEQ ID NO: 123069 - RNA, 23 nt, Human
aaauaauaauuucucuguuggga

SEQ ID NO: 123070 - RNA, 22 nt, Human
cauuuaucacuugcuaaacaua

SEQ ID NO: 123071 - RNA, 22 nt, Human
auguaaauauuuauauaugcau

SEQ ID NO: 123072 - RNA, 22 nt, Human
auucauuuuuacaucaccaaua

SEQ ID NO: 123073 - RNA, 22 nt, Human
ugaguuuuggaagauguuacag

SEQ ID NO: 123074 - RNA, 22 nt, Human
uguacauuuacaaaagcuuuau

SEQ ID NO: 123075 - RNA, 22 nt, Human
acuaaguagaggagugaugauu

SEQ ID NO: 123076 - RNA, 22 nt, Human
gauacugugggcacucauaaua

SEQ ID NO: 123077 - RNA, 22 nt, Human
auuaaaaaugagaguagggauu

SEQ ID NO: 123078 - RNA, 22 nt, Human
aauacagcacucacaccucccu

SEQ ID NO: 123079 - RNA, 22 nt, Human
aauuuuauuagacaggcauaau

SEQ ID NO: 123080 - RNA, 22 nt, Human
uuuuugggccaaauauauuuac

SEQ ID NO: 123081 - RNA, 22 nt, Human
aggugcuugcauacugcuugac

SEQ ID NO: 123082 - RNA, 22 nt, Human
auuauacauuaggagauugauu

SEQ ID NO: 123083 - RNA, 22 nt, Human
gguuuucacgauccucccuuuu

SEQ ID NO: 123084 - RNA, 20 nt, Human
cauuccaugcaucuuggucc

SEQ ID NO: 123085 - RNA, 22 nt, Human
uguuuaaauagaacauacugca

SEQ ID NO: 123086 - RNA, 22 nt, Human
ggagaggaggugagaggaagua

SEQ ID NO: 123087 - RNA, 22 nt, Human
gcuggaaauaacuuguguagaa

SEQ ID NO: 123088 - RNA, 22 nt, Human
cuugcuuuaucugguuucucau

SEQ ID NO: 123089 - RNA, 22 nt, Human
cagagguagaaguagauguuug

SEQ ID NO: 123090 - RNA, 22 nt, Human
aggggauggagcuggaaggcag

SEQ ID NO: 123091 - RNA, 22 nt, Human
cuggguguggugggugcugccg

SEQ ID NO: 123092 - RNA, 22 nt, Human
aacucugcaaugaaaucauguu

SEQ ID NO: 123093 - RNA, 22 nt, Human
ucccaagugcuccucuggcccc

SEQ ID NO: 123094 - RNA, 22 nt, Human
ccagcaaguaagucagugucag

SEQ ID NO: 123095 - RNA, 22 nt, Human
gaggaggucaccuggugagcaa

SEQ ID NO: 123096 - RNA, 22 nt, Human
uguagggaggaaggguuggaaa

SEQ ID NO: 123097 - RNA, 22 nt, Human
auacauauaugcacauuaauau

SEQ ID NO: 123098 - RNA, 22 nt, Human
gccugcaggaaggugugccugu

SEQ ID NO: 123099 - RNA, 19 nt, Human
agggaggcaagagaaaugu

SEQ ID NO: 123100 - RNA, 22 nt, Human
agaguucuauccagacucaugu

SEQ ID NO: 123101 - RNA, 22 nt, Human
ucgcccagguuggagugcagug

SEQ ID NO: 123102 - RNA, 22 nt, Human
aaaaaguaccacuuggacacuu

SEQ ID NO: 123103 - RNA, 20 nt, Human
agugauuuguuaguacauug

SEQ ID NO: 123104 - RNA, 22 nt, Human
ucacaggagucaaggaauagua

SEQ ID NO: 123105 - RNA, 21 nt, Human
uucugcuguucaccaccaccc

SEQ ID NO: 123106 - RNA, 22 nt, Human
ucucccaaaucuuucuagcaca

SEQ ID NO: 123107 - RNA, 22 nt, Human
uggccaaauuggccugauguau

SEQ ID NO: 123108 - RNA, 22 nt, Human
agcaggaggguuuuguagaguc

SEQ ID NO: 123109 - RNA, 22 nt, Human
uucucaauggcaacuuguugcu

SEQ ID NO: 123110 - RNA, 22 nt, Human
gcagaugagagugugaucuggg

SEQ ID NO: 123111 - RNA, 22 nt, Human
aucuucuuucaucagccccuca

SEQ ID NO: 123112 - RNA, 22 nt, Human
uugguuuacucuggggauaucu

SEQ ID NO: 123113 - RNA, 22 nt, Human
aaaaggucacuguaaaaugacg

SEQ ID NO: 123114 - RNA, 22 nt, Human
caaagcuucaucuguuguuuug

SEQ ID NO: 123115 - RNA, 22 nt, Human
aaauguaaacuguauuuauaaa

SEQ ID NO: 123116 - RNA, 22 nt, Human
uagcauaaaguuucuguguggu

SEQ ID NO: 123117 - RNA, 22 nt, Human
ccugcccaucccaccccagcau

SEQ ID NO: 123118 - RNA, 19 nt, Human
ugcagcuguaugagcuuaa

SEQ ID NO: 123119 - RNA, 22 nt, Human
agauauuauuuucuauuuauca

SEQ ID NO: 123120 - RNA, 22 nt, Human
aaggugcugaggguccuggcuu

SEQ ID NO: 123121 - RNA, 22 nt, Human
ucaguauuagugcauuaucagg

SEQ ID NO: 123122 - RNA, 22 nt, Human
ggcagaggaagcuggaaguggg

SEQ ID NO: 123123 - RNA, 22 nt, Human
gguagacugagcuccuugagga

SEQ ID NO: 123124 - RNA, 22 nt, Human
guggcaaguuuucugacaagga

SEQ ID NO: 123125 - RNA, 22 nt, Human
accugcucucccucucgcaguc

SEQ ID NO: 123126 - RNA, 22 nt, Human
aaacccuagcguuguuuauuga

SEQ ID NO: 123127 - RNA, 22 nt, Human
cuucauuucaggcugaagaaua

SEQ ID NO: 123128 - RNA, 22 nt, Human
cugagguccucagagggaaagg

SEQ ID NO: 123129 - RNA, 22 nt, Human
acauuuugggagaaaguuguua

SEQ ID NO: 123130 - RNA, 22 nt, Human
cacugcacuccagccugggcaa

SEQ ID NO: 123131 - RNA, 22 nt, Human
augcccagaacccccuggaugg

SEQ ID NO: 123132 - RNA, 22 nt, Human
auuucauaaaaacuuuaccuga

SEQ ID NO: 123133 - RNA, 22 nt, Human
ucugcccaggaggucccauggg

SEQ ID NO: 123134 - RNA, 22 nt, Human
cucuaagcuuugguguuucacu

SEQ ID NO: 123135 - RNA, 22 nt, Human
uucagcaagugucucuacuguc

SEQ ID NO: 123136 - RNA, 22 nt, Human
cauccagcuccugggggccacc

SEQ ID NO: 123137 - RNA, 22 nt, Human
aacuuucuuugcaucuaaguuu

SEQ ID NO: 123138 - RNA, 22 nt, Human
caaggaaaacagaugaucaaca

SEQ ID NO: 123139 - RNA, 22 nt, Human
guggauggagcuggaagccauu

SEQ ID NO: 123140 - RNA, 22 nt, Human
uugcuuucuuuguagguuuucc

SEQ ID NO: 123141 - RNA, 22 nt, Human
uuuaauuauaucugggcaguua

SEQ ID NO: 123142 - RNA, 22 nt, Human
aagagaaagggaaaaugguaaa

SEQ ID NO: 123143 - RNA, 22 nt, Human
gugugugucuacuuucaucucu

SEQ ID NO: 123144 - RNA, 22 nt, Human
ggaggucagcuggaggggaggc

SEQ ID NO: 123145 - RNA, 22 nt, Human
aauuuuauuuuuuccccuagau

SEQ ID NO: 123146 - RNA, 22 nt, Human
cagcucugcugggaggaugcag

SEQ ID NO: 123147 - RNA, 22 nt, Human
caggaacagcaccaggagcuag

SEQ ID NO: 123148 - RNA, 22 nt, Human
ugucuuucuuucucuugacaga

SEQ ID NO: 123149 - RNA, 22 nt, Human
cugaaagacgaggggaagucgg

SEQ ID NO: 123150 - RNA, 22 nt, Human
uugggaacaggcuucccacugg

SEQ ID NO: 123151 - RNA, 22 nt, Human
auaaaaauguuuuuguguggua

SEQ ID NO: 123152 - RNA, 22 nt, Human
gcugcagggagcuggaaggcuc

SEQ ID NO: 123153 - RNA, 22 nt, Human
agaaaaggaagcuuagacugua

SEQ ID NO: 123154 - RNA, 22 nt, Human
uaaaugauaguauugaagguag

SEQ ID NO: 123155 - RNA, 22 nt, Human
cauuuacauaacaguaacgcug

SEQ ID NO: 123156 - RNA, 22 nt, Human
agacuucucuuggcuauauuau

SEQ ID NO: 123157 - RNA, 22 nt, Human
ggagaggaaguuuaaagaauug

SEQ ID NO: 123158 - RNA, 22 nt, Human
cccauuuuuuggauguguggau

SEQ ID NO: 123159 - RNA, 22 nt, Human
gaaagugaauguaacauguuau

SEQ ID NO: 123160 - RNA, 22 nt, Human
gauauauuucaaauucuuuugc

SEQ ID NO: 123161 - RNA, 22 nt, Human
augaaaacggaccagagcuauu

SEQ ID NO: 123162 - RNA, 22 nt, Human
uauaaugucuuuguugaaaucu

SEQ ID NO: 123163 - RNA, 22 nt, Human
cugaaagacagccaggcaaagc

SEQ ID NO: 123164 - RNA, 18 nt, Human
acucugaagcuaagucac

SEQ ID NO: 123165 - RNA, 22 nt, Human
ugcgccccgcgggccuucgggc

SEQ ID NO: 123166 - RNA, 22 nt, Human
aauguaaauaauuguaaaauuu

SEQ ID NO: 123167 - RNA, 22 nt, Human
auaccaaugaaucccugagaau

SEQ ID NO: 123168 - RNA, 22 nt, Human
aagauauauaaggaaguucagu

SEQ ID NO: 123169 - RNA, 22 nt, Human
uguaaauucuauacacuuaaaa

SEQ ID NO: 123170 - RNA, 22 nt, Human
augguguaagacuguauuucuu

SEQ ID NO: 123171 - RNA, 22 nt, Human
ugauucacagacuucacaaggc

SEQ ID NO: 123172 - RNA, 22 nt, Human
auuaaaaaaagauaaugaguua

SEQ ID NO: 123173 - RNA, 22 nt, Human
uacuuacacugaagcaaagaua

SEQ ID NO: 123174 - RNA, 22 nt, Human
gcaggaaugguacauaccuguu

SEQ ID NO: 123175 - RNA, 22 nt, Human
gcaggcaggauucagagauaca

SEQ ID NO: 123176 - RNA, 22 nt, Human
ucugaggacagugcugugccug

SEQ ID NO: 123177 - RNA, 20 nt, Human
gggcucugcauccaucagcc

SEQ ID NO: 123178 - RNA, 19 nt, Human
auacacguguauacauaca

SEQ ID NO: 123179 - RNA, 22 nt, Human
uaauugaacguucauuuuuaau

SEQ ID NO: 123180 - RNA, 22 nt, Human
cccagccugaucucggccagcu

SEQ ID NO: 123181 - RNA, 22 nt, Human
uccugagaagcacuuaauacac

SEQ ID NO: 123182 - RNA, 22 nt, Human
ggagggagugcaggcaggcaga

SEQ ID NO: 123183 - RNA, 22 nt, Human
ucuucacagaugcauauacuuc

SEQ ID NO: 123184 - RNA, 22 nt, Human
cauuuuccucugcugguguuca

SEQ ID NO: 123185 - RNA, 22 nt, Human
ucauacuuuuuugacccuugug

SEQ ID NO: 123186 - RNA, 20 nt, Human
gaacauaaauaacucuuuac

SEQ ID NO: 123187 - RNA, 22 nt, Human
agccacagucuguagccagcuu

SEQ ID NO: 123188 - RNA, 20 nt, Human
aaccuauuguaauauucuaa

SEQ ID NO: 123189 - RNA, 22 nt, Human
aaaauauaaaggauguggguuu

SEQ ID NO: 123190 - RNA, 22 nt, Human
uuauaagugccucuuuauuuuc

SEQ ID NO: 123191 - RNA, 22 nt, Human
aguaggauguuuagcccuucuu

SEQ ID NO: 123192 - RNA, 22 nt, Human
aaugaguuuguucuauuauuug

SEQ ID NO: 123193 - RNA, 22 nt, Human
guagucauugggucugugguca

SEQ ID NO: 123194 - RNA, 23 nt, Human
agggcacugaagcuggaauuggg

SEQ ID NO: 123195 - RNA, 22 nt, Human
uucauuuccauuuuauagauaa

SEQ ID NO: 123196 - RNA, 22 nt, Human
gaagaaggaagaucaugcuuga

SEQ ID NO: 123197 - RNA, 22 nt, Human
ugguucuagaugagaugaugag

SEQ ID NO: 123198 - RNA, 22 nt, Human
uugaagccaccacuguaaguca

SEQ ID NO: 123199 - RNA, 22 nt, Human
caagaaguugacagccagguga

SEQ ID NO: 123200 - RNA, 23 nt, Human
uauuuuccccuguaauauguauu

SEQ ID NO: 123201 - RNA, 22 nt, Human
auuuccagcagcauauuugucu

SEQ ID NO: 123202 - RNA, 22 nt, Human
gcgccgacccucccugccggac

SEQ ID NO: 123203 - RNA, 22 nt, Human
uagguggaaccauaugaaauuu

SEQ ID NO: 123204 - RNA, 22 nt, Human
ucucaaagagcuacuggucuau

SEQ ID NO: 123205 - RNA, 22 nt, Human
ucuguuucaggggucuggaaug

SEQ ID NO: 123206 - RNA, 22 nt, Human
aagugagaugggagucagagga

SEQ ID NO: 123207 - RNA, 20 nt, Human
cucuuuaugagaccacuguc

SEQ ID NO: 123208 - RNA, 22 nt, Human
gagaacuguguauucuuuuuca

SEQ ID NO: 123209 - RNA, 22 nt, Human
uaaaaucaugacagauugacau

SEQ ID NO: 123210 - RNA, 22 nt, Human
cauuagggucuuuagacagcuc

SEQ ID NO: 123211 - RNA, 22 nt, Human
ucaguuacucugauguccugug

SEQ ID NO: 123212 - RNA, 22 nt, Human
uuuauuuagguaaacaugaguu

SEQ ID NO: 123213 - RNA, 22 nt, Human
gaauaagaauccacuucuggca

SEQ ID NO: 123214 - RNA, 22 nt, Human
uuuaaaccuaucuaagaaauag

SEQ ID NO: 123215 - RNA, 22 nt, Human
aaagccaagguccauguacuuu

SEQ ID NO: 123216 - RNA, 22 nt, Human
agagggagagauuggcaaucag

SEQ ID NO: 123217 - RNA, 22 nt, Human
cuuggcuccuucacagggagau

SEQ ID NO: 123218 - RNA, 21 nt, Human
gcagcucaggauauagacuug

SEQ ID NO: 123219 - RNA, 22 nt, Human
auuaugaauuguguuacgaaga

SEQ ID NO: 123220 - RNA, 21 nt, Human
uuccauggacccugucagugu

SEQ ID NO: 123221 - RNA, 22 nt, Human
uaaaugaaaggguuuaauuuau

SEQ ID NO: 123222 - RNA, 22 nt, Human
agacacugacaggguccaugga

SEQ ID NO: 123223 - RNA, 22 nt, Human
cuuccauucugauggcuaauua

SEQ ID NO: 123224 - RNA, 22 nt, Human
aggggcugagaguuugaugugg

SEQ ID NO: 123225 - RNA, 22 nt, Human
cuaauuguaagcuccuugaggg

SEQ ID NO: 123226 - RNA, 22 nt, Human
aggggagggcuggccuuuggau

SEQ ID NO: 123227 - RNA, 22 nt, Human
aacugaaguuuucagauuuugc

SEQ ID NO: 123228 - RNA, 22 nt, Human
acccccaggacacugccucuga

SEQ ID NO: 123229 - RNA, 21 nt, Human
ccgaggagugcggggagcccc

SEQ ID NO: 123230 - RNA, 22 nt, Human
gcugcaggaggugguagggucu

SEQ ID NO: 123231 - RNA, 22 nt, Human
ucccagguugaggccuugccug

SEQ ID NO: 123232 - RNA, 22 nt, Human
ggggaggugugcaggacaccuc

SEQ ID NO: 123233 - RNA, 22 nt, Human
agcuuucuauauaugaguugcu

SEQ ID NO: 123234 - RNA, 22 nt, Human
gaggagggagcuggaagcucuu

SEQ ID NO: 123235 - RNA, 22 nt, Human
cagaguaaugugauuuccaugu

SEQ ID NO: 123236 - RNA, 22 nt, Human
aauaucuugaguuauaaauuca

SEQ ID NO: 123237 - RNA, 22 nt, Human
cucuuucauucuguccuuguuu

SEQ ID NO: 123238 - RNA, 22 nt, Human
uggguucaaauccugguuccac

SEQ ID NO: 123239 - RNA, 22 nt, Human
uucuccaccugcuccucccacc

SEQ ID NO: 123240 - RNA, 22 nt, Human
cugggagaugacucagagcagg

SEQ ID NO: 123241 - RNA, 23 nt, Human
cauuugauccucacaauaaaugg

SEQ ID NO: 123242 - RNA, 22 nt, Human
accaggaguuuugaccaggggc

SEQ ID NO: 123243 - RNA, 22 nt, Human
uucauagaagggaguuuuuccu

SEQ ID NO: 123244 - RNA, 22 nt, Human
gugggugaguggggccgccuga

SEQ ID NO: 123245 - RNA, 22 nt, Human
aaacccauauaccagcugugcu

SEQ ID NO: 123246 - RNA, 21 nt, Human
ucauccagguccugcuucuuc

SEQ ID NO: 123247 - RNA, 22 nt, Human
ccccauggaaaacccaccuagg

SEQ ID NO: 123248 - RNA, 22 nt, Human
aaauucuuccaggaggaaauac

SEQ ID NO: 123249 - RNA, 22 nt, Human
gagaacagauaugaugacuuca

SEQ ID NO: 123250 - RNA, 22 nt, Human
uuucucuuucaaucugcaguac

SEQ ID NO: 123251 - RNA, 22 nt, Human
gugugucucaguugcuccgaag

SEQ ID NO: 123252 - RNA, 21 nt, Human
ugcuuucugugcuuuuucugc

SEQ ID NO: 123253 - RNA, 19 nt, Human
ccaguuuuuuaauauucaa

SEQ ID NO: 123254 - RNA, 22 nt, Human
uuggugaugcccaccuuuucau

SEQ ID NO: 123255 - RNA, 22 nt, Human
cuguuucucugccugcacacau

SEQ ID NO: 123256 - RNA, 22 nt, Human
uaugggcaagagauaggugguc

SEQ ID NO: 123257 - RNA, 22 nt, Human
gggucagggaggccccaccaug

SEQ ID NO: 123258 - RNA, 22 nt, Human
aggagaaagaccagccugccga

SEQ ID NO: 123259 - RNA, 22 nt, Human
gggggaggcucggcgccgcggu

SEQ ID NO: 123260 - RNA, 22 nt, Human
uauuucaugagugaauaucuag

SEQ ID NO: 123261 - RNA, 22 nt, Human
cauccagggguacccuggagcc

SEQ ID NO: 123262 - RNA, 22 nt, Human
auucauauagcgcuuacagccu

SEQ ID NO: 123263 - RNA, 22 nt, Human
cuucauccguaccacggccaca

SEQ ID NO: 123264 - RNA, 22 nt, Human
uguuggaaucuucuagucuucc

SEQ ID NO: 123265 - RNA, 22 nt, Human
gagcacugagcuggaauuggag

SEQ ID NO: 123266 - RNA, 19 nt, Human
auuuccuggcauauaucac

SEQ ID NO: 123267 - RNA, 22 nt, Human
uuuaaaacagcauuuaaaaggu

SEQ ID NO: 123268 - RNA, 22 nt, Human
aaaguuacacgacuauuuaugu

SEQ ID NO: 123269 - RNA, 22 nt, Human
uuaaaauuguuaacuuugguga

SEQ ID NO: 123270 - RNA, 22 nt, Human
acuauuguccgauuucuuuacu

SEQ ID NO: 123271 - RNA, 22 nt, Human
gugcugggaggcccaggaugga

SEQ ID NO: 123272 - RNA, 18 nt, Human
ucagaggagauaccuaaa

SEQ ID NO: 123273 - RNA, 22 nt, Human
gcugggacacacagucuucuuu

SEQ ID NO: 123274 - RNA, 21 nt, Human
uggcaggcagcuggaagcuug

SEQ ID NO: 123275 - RNA, 22 nt, Human
guauugauuguuuuaaaagauu

SEQ ID NO: 123276 - RNA, 22 nt, Human
auuuccacaaauuaagauugca

SEQ ID NO: 123277 - RNA, 22 nt, Human
ccagaggcuuaugcagcugcug

SEQ ID NO: 123278 - RNA, 22 nt, Human
uggcaaggccacaggugcaguu

SEQ ID NO: 123279 - RNA, 22 nt, Human
uuucagaaauggcacugaaauc

SEQ ID NO: 123280 - RNA, 22 nt, Human
gcaucacacgcacauacacaca

SEQ ID NO: 123281 - RNA, 22 nt, Human
uggcuucagacuucugcuacgu

SEQ ID NO: 123282 - RNA, 22 nt, Human
caauccccaggucccagaacag

SEQ ID NO: 123283 - RNA, 22 nt, Human
aaucccaguugacagaacuguu

SEQ ID NO: 123284 - RNA, 22 nt, Human
uuauaucagaaggugagauuga

SEQ ID NO: 123285 - RNA, 22 nt, Human
ugaugaugaagaaauauuauca

SEQ ID NO: 123286 - RNA, 22 nt, Human
uuuaaucaguugguaauauuga

SEQ ID NO: 123287 - RNA, 22 nt, Human
cugggaggagacaggggauggg

SEQ ID NO: 123288 - RNA, 22 nt, Human
uccagggaggggcggcaggggu

SEQ ID NO: 123289 - RNA, 22 nt, Human
aaaguuacccaaucucuaugaa

SEQ ID NO: 123290 - RNA, 22 nt, Human
agugagaguauuaaugugaacu

SEQ ID NO: 123291 - RNA, 22 nt, Human
ggccagcuuugagcugcaggaa

SEQ ID NO: 123292 - RNA, 22 nt, Human
aaucaaauuucuugugguuguu

SEQ ID NO: 123293 - RNA, 22 nt, Human
uauuuuaaaagcauuaauucuu

SEQ ID NO: 123294 - RNA, 22 nt, Human
guacauauccuuuacguuuugu

SEQ ID NO: 123295 - RNA, 22 nt, Human
auauaguacauguauauauaua

SEQ ID NO: 123296 - RNA, 22 nt, Human
uacaggaggaugugcagccagg

SEQ ID NO: 123297 - RNA, 22 nt, Human
ccagggagggccacagggccau

SEQ ID NO: 123298 - RNA, 22 nt, Human
uguaucuguguguauguguuua

SEQ ID NO: 123299 - RNA, 22 nt, Human
guuuaaaagcaaccaacaggcu

SEQ ID NO: 123300 - RNA, 22 nt, Human
cagguggauggcgagcccugca

SEQ ID NO: 123301 - RNA, 22 nt, Human
uggcacagcuugucauaaacuc

SEQ ID NO: 123302 - RNA, 22 nt, Human
caguacugucuuccugauggca

SEQ ID NO: 123303 - RNA, 22 nt, Human
gagaggaagugccugcucccag

SEQ ID NO: 123304 - RNA, 22 nt, Human
aggcauauaguguuuaaaaaaa

SEQ ID NO: 123305 - RNA, 22 nt, Human
cuugcaaugaaggcacacuuau

SEQ ID NO: 123306 - RNA, 22 nt, Human
cggggcuggcguuagggaggca

SEQ ID NO: 123307 - RNA, 22 nt, Human
aggccacucagggggccaagau

SEQ ID NO: 123308 - RNA, 22 nt, Human
aaggaaaaccugacugaagaac

SEQ ID NO: 123309 - RNA, 22 nt, Human
uaguauuuguaauuaucaaagc

SEQ ID NO: 123310 - RNA, 22 nt, Human
aauguuguaaauauucuuugag

SEQ ID NO: 123311 - RNA, 22 nt, Human
cuccagggcuaccagguuuuag

SEQ ID NO: 123312 - RNA, 22 nt, Human
aguuuccacuggagacacugug

SEQ ID NO: 123313 - RNA, 22 nt, Human
acaacuuuaauggguuucagcu

SEQ ID NO: 123314 - RNA, 22 nt, Human
agccugugacucugugaaacca

SEQ ID NO: 123315 - RNA, 22 nt, Human
guuuggguggcuagagaaagaa

SEQ ID NO: 123316 - RNA, 21 nt, Human
uugauuuagcagaucuagcug

SEQ ID NO: 123317 - RNA, 22 nt, Human
aauagcaauuacccuucaacuc

SEQ ID NO: 123318 - RNA, 22 nt, Human
guacauauggcacaugcuauuu

SEQ ID NO: 123319 - RNA, 22 nt, Human
cuuauuagaaagaaaagacaug

SEQ ID NO: 123320 - RNA, 22 nt, Human
aaugauuuucugcaaacaguga

SEQ ID NO: 123321 - RNA, 22 nt, Human
uuuuuggacccaucuucuuuuu

SEQ ID NO: 123322 - RNA, 23 nt, Human
uccugcagauaagcugguugaca

SEQ ID NO: 123323 - RNA, 22 nt, Human
gccugggcuuccgggacccggg

SEQ ID NO: 123324 - RNA, 17 nt, Human
agggaaguagggugggc

SEQ ID NO: 123325 - RNA, 22 nt, Human
aagucauuaucucuucuaaucu

SEQ ID NO: 123326 - RNA, 23 nt, Human
aggcugcagaagaauagggucau

SEQ ID NO: 123327 - RNA, 22 nt, Human
cagccccagcacuuagcugagu

SEQ ID NO: 123328 - RNA, 22 nt, Human
ucccagccugacagugcaucaa

SEQ ID NO: 123329 - RNA, 22 nt, Human
agugcucagggaaugccacuga

SEQ ID NO: 123330 - RNA, 22 nt, Human
aaggaaaguuaagguaaacucu

SEQ ID NO: 123331 - RNA, 22 nt, Human
guugauaauuaauagcuuuuga

SEQ ID NO: 123332 - RNA, 22 nt, Human
aaagccauaucuauucuauucu

SEQ ID NO: 123333 - RNA, 22 nt, Human
agagcuccaggguuuuguagug

SEQ ID NO: 123334 - RNA, 22 nt, Human
guuuugaugugauuucucaugu

SEQ ID NO: 123335 - RNA, 22 nt, Human
aggaggcaaaugagagggcuca

SEQ ID NO: 123336 - RNA, 22 nt, Human
accugcagguguuuccacacuu

SEQ ID NO: 123337 - RNA, 22 nt, Human
cuccacagccccuccaguggca

SEQ ID NO: 123338 - RNA, 22 nt, Human
uuguuuaaagaacuucugacuu

SEQ ID NO: 123339 - RNA, 23 nt, Human
uggguuucagugccaaugcugcc

SEQ ID NO: 123340 - RNA, 22 nt, Human
uugccaggggacaucuggagcc

SEQ ID NO: 123341 - RNA, 22 nt, Human
auagcaguauuaugagauaacu

SEQ ID NO: 123342 - RNA, 22 nt, Human
ugaauguggucaggaaauuguu

SEQ ID NO: 123343 - RNA, 22 nt, Human
uucaugucuuugauucugauaa

SEQ ID NO: 123344 - RNA, 22 nt, Human
aggggaggcugcgggcugccgu

SEQ ID NO: 123345 - RNA, 22 nt, Human
ccacuuugagaagcugaugaaa

SEQ ID NO: 123346 - RNA, 22 nt, Human
aggaaaauggaccagaguuguu

SEQ ID NO: 123347 - RNA, 22 nt, Human
uuacuguguguaaaauaucuuu

SEQ ID NO: 123348 - RNA, 22 nt, Human
cuccaugagccaggagggcuac

SEQ ID NO: 123349 - RNA, 22 nt, Human
uuaaucagacauucucaaguuu

SEQ ID NO: 123350 - RNA, 18 nt, Human
uuccauuuuucagucuuc

SEQ ID NO: 123351 - RNA, 22 nt, Human
aagaggcuacagcccugugucu

SEQ ID NO: 123352 - RNA, 22 nt, Human
cuucuucaucuuuuggaggaac

SEQ ID NO: 123353 - RNA, 22 nt, Human
guggagaaauauguucagcuuc

SEQ ID NO: 123354 - RNA, 22 nt, Human
auaguaaauguuaacagcaaca

SEQ ID NO: 123355 - RNA, 22 nt, Human
ugggaggcugugggaauggguc

SEQ ID NO: 123356 - RNA, 22 nt, Human
auuauaauucauuaggcuuagu

SEQ ID NO: 123357 - RNA, 18 nt, Human
auucauuugcguuuggcu

SEQ ID NO: 123358 - RNA, 22 nt, Human
agggagcagcuagagggggucc

SEQ ID NO: 123359 - RNA, 22 nt, Human
uuuaucaggccaucuuaugucu

SEQ ID NO: 123360 - RNA, 22 nt, Human
gggaggcagacgcuggagccca

SEQ ID NO: 123361 - RNA, 22 nt, Human
uuucacuucgaucagaguuuuu

SEQ ID NO: 123362 - RNA, 22 nt, Human
uggaaggugauucucugguuaa

SEQ ID NO: 123363 - RNA, 22 nt, Human
uacccauuuugguucuugaugc

SEQ ID NO: 123364 - RNA, 20 nt, Human
uggcccagcacgacgaggac

SEQ ID NO: 123365 - RNA, 22 nt, Human
auuaagucugacuggauuguau

SEQ ID NO: 123366 - RNA, 22 nt, Human
ggaggaugaggguggugguguu

SEQ ID NO: 123367 - RNA, 22 nt, Human
aauuagaagcuguuagcaaaau

SEQ ID NO: 123368 - RNA, 22 nt, Human
auguacugacuguacuuuuaaa

SEQ ID NO: 123369 - RNA, 22 nt, Human
uuuuuucuucucuaucuuaaua

SEQ ID NO: 123370 - RNA, 22 nt, Human
auuuucauauggguuauuugua

SEQ ID NO: 123371 - RNA, 22 nt, Human
uauauacuugaaaauugcugag

SEQ ID NO: 123372 - RNA, 22 nt, Human
cugggacacguugugcuuuaac

SEQ ID NO: 123373 - RNA, 22 nt, Human
agugccaucuuuaacuguccca

SEQ ID NO: 123374 - RNA, 22 nt, Human
ugucccaucacagaggagacua

SEQ ID NO: 123375 - RNA, 22 nt, Human
caaaucuguuaauuucaaguug

SEQ ID NO: 123376 - RNA, 22 nt, Human
uaucuguagucucaugguuccu

SEQ ID NO: 123377 - RNA, 22 nt, Human
ugcuuucagauaucuguuucaa

SEQ ID NO: 123378 - RNA, 22 nt, Human
aauugcuuucacaaguguuaua

SEQ ID NO: 123379 - RNA, 22 nt, Human
guguugaugugucuguauucua

SEQ ID NO: 123380 - RNA, 22 nt, Human
cagaccuggaaaacaggcuugc

SEQ ID NO: 123381 - RNA, 21 nt, Human
agcaucugaggcaguuuccua

SEQ ID NO: 123382 - RNA, 21 nt, Human
uugugaaaguccaggaacaac

SEQ ID NO: 123383 - RNA, 22 nt, Human
uauuuuuuuaacauuuauugua

SEQ ID NO: 123384 - RNA, 22 nt, Human
acucugaaaggcuacaaaugcu

SEQ ID NO: 123385 - RNA, 22 nt, Human
ucccaaguguuuggcgaggaga

SEQ ID NO: 123386 - RNA, 22 nt, Human
uucacaauuuuaaaaaguggaa

SEQ ID NO: 123387 - RNA, 22 nt, Human
auauuucuacaggcugauuuua

SEQ ID NO: 123388 - RNA, 23 nt, Human
uggaaguugagagucugcuuugu

SEQ ID NO: 123389 - RNA, 21 nt, Human
uucuauauugagaauuggcua

SEQ ID NO: 123390 - RNA, 22 nt, Human
gggggcugugugcccgcucccc

SEQ ID NO: 123391 - RNA, 22 nt, Human
agaauuuguaucuacggugugc

SEQ ID NO: 123392 - RNA, 22 nt, Human
aauaaagcuugaaagcagggaa

SEQ ID NO: 123393 - RNA, 22 nt, Human
uuuuuguaaaugaaguuuuauu

SEQ ID NO: 123394 - RNA, 22 nt, Human
ucaccuuuugaauugcuguugu

SEQ ID NO: 123395 - RNA, 22 nt, Human
ucagucugcuauagguauuugu

SEQ ID NO: 123396 - RNA, 22 nt, Human
uuuuaaaacaugucaaaaugug

SEQ ID NO: 123397 - RNA, 22 nt, Human
uggggagacauggaguaaaaga

SEQ ID NO: 123398 - RNA, 22 nt, Human
uaggaagagauuuucacauggc

SEQ ID NO: 123399 - RNA, 19 nt, Human
auucuucucuuccugcugu

SEQ ID NO: 123400 - RNA, 21 nt, Human
ccugcacuucccuccucaagu

SEQ ID NO: 123401 - RNA, 22 nt, Human
cagcuccaucuugcuuauacca

SEQ ID NO: 123402 - RNA, 22 nt, Human
uaauauauuuuuuaagggaugu

SEQ ID NO: 123403 - RNA, 22 nt, Human
ggcagggagagcaugcugauaa

SEQ ID NO: 123404 - RNA, 22 nt, Human
aucaaaauuuucagauacuaca

SEQ ID NO: 123405 - RNA, 21 nt, Human
uccaggagcacgggacuagga

SEQ ID NO: 123406 - RNA, 22 nt, Human
cugccaggagaggccagggccc

SEQ ID NO: 123407 - RNA, 22 nt, Human
acugcauuaucaccaagaugua

SEQ ID NO: 123408 - RNA, 22 nt, Human
gaauggcagaaugaagcagugu

SEQ ID NO: 123409 - RNA, 19 nt, Human
gauauugagcugagaauuc

SEQ ID NO: 123410 - RNA, 22 nt, Human
agaggcagagcugggguuugac

SEQ ID NO: 123411 - RNA, 22 nt, Human
cuuacauuuguuuaguguuucc

SEQ ID NO: 123412 - RNA, 22 nt, Human
aaucauaacaaaagcaauuaua

SEQ ID NO: 123413 - RNA, 22 nt, Human
gcacugagacuuuagauuggag

SEQ ID NO: 123414 - RNA, 22 nt, Human
aaugcuuuuugcgaaaugugca

SEQ ID NO: 123415 - RNA, 22 nt, Human
cccaggaaugagcaggcagggg

SEQ ID NO: 123416 - RNA, 22 nt, Human
agugaagauagagccaggucug

SEQ ID NO: 123417 - RNA, 22 nt, Human
uugcugccagcgcccugcaggg

SEQ ID NO: 123418 - RNA, 22 nt, Human
agguuaggaggggagugccaca

SEQ ID NO: 123419 - RNA, 22 nt, Human
uggaagggguuacgcagcagga

SEQ ID NO: 123420 - RNA, 19 nt, Human
ugccccacccucuauccag

SEQ ID NO: 123421 - RNA, 22 nt, Human
gugaaaaauggccaucaggaca

SEQ ID NO: 123422 - RNA, 22 nt, Human
aucuguuccccuaugcucucua

SEQ ID NO: 123423 - RNA, 22 nt, Human
gaaucucuuugucccugaguuu

SEQ ID NO: 123424 - RNA, 22 nt, Human
uuuguuuuggugucaugcguga

SEQ ID NO: 123425 - RNA, 22 nt, Human
ugagggaugccucuccuuccgg

SEQ ID NO: 123426 - RNA, 22 nt, Human
auuuuuucaugugugguugaga

SEQ ID NO: 123427 - RNA, 20 nt, Human
uggagggaggaggggcccaa

SEQ ID NO: 123428 - RNA, 22 nt, Human
cccccucuggcuccagucugac

SEQ ID NO: 123429 - RNA, 22 nt, Human
cuuacaauuuucuuggacuuuu

SEQ ID NO: 123430 - RNA, 21 nt, Human
uaauaauugggggcagggugg

SEQ ID NO: 123431 - RNA, 22 nt, Human
guugggugccagaggcuucacg

SEQ ID NO: 123432 - RNA, 22 nt, Human
augugaaauuugggcucuggga

SEQ ID NO: 123433 - RNA, 22 nt, Human
ucauuuaauuuggaacucagag

SEQ ID NO: 123434 - RNA, 22 nt, Human
ucucucucucuuccagcauguu

SEQ ID NO: 123435 - RNA, 22 nt, Human
aggggcugugucauuuguccua

SEQ ID NO: 123436 - RNA, 22 nt, Human
augcuaaucaaacuuucugcag

SEQ ID NO: 123437 - RNA, 22 nt, Human
agagggagcuccaagaucaagg

SEQ ID NO: 123438 - RNA, 18 nt, Human
uguugguguucacucacu

SEQ ID NO: 123439 - RNA, 22 nt, Human
ugaggggaggggagaaaauggu

SEQ ID NO: 123440 - RNA, 22 nt, Human
uuuuccuucugauacuccauuu

SEQ ID NO: 123441 - RNA, 22 nt, Human
uuuuacaaugcaaauucuugcu

SEQ ID NO: 123442 - RNA, 22 nt, Human
guggaagauauuucugguccag

SEQ ID NO: 123443 - RNA, 22 nt, Human
ugagaccuaaaccgucuguccu

SEQ ID NO: 123444 - RNA, 22 nt, Human
ucuccuaauuacauacuugauu

SEQ ID NO: 123445 - RNA, 22 nt, Human
uuugaagaaacagucuuaagag

SEQ ID NO: 123446 - RNA, 22 nt, Human
uaaaguguacaagucauaagua

SEQ ID NO: 123447 - RNA, 22 nt, Human
cccuuuuuuauggaguuggcca

SEQ ID NO: 123448 - RNA, 23 nt, Human
cauguacacacagcuguacagug

SEQ ID NO: 123449 - RNA, 22 nt, Human
ggcugugaaguacguugaaggu

SEQ ID NO: 123450 - RNA, 22 nt, Human
uuaugccuguuaggcagcaucu

SEQ ID NO: 123451 - RNA, 21 nt, Human
uccccugugccuggcauacag

SEQ ID NO: 123452 - RNA, 22 nt, Human
guucuucagcccucagguccua

SEQ ID NO: 123453 - RNA, 20 nt, Human
uucacagaggacucagguca

SEQ ID NO: 123454 - RNA, 22 nt, Human
aaggagaggagucauugggaua

SEQ ID NO: 123455 - RNA, 22 nt, Human
ugcucuuuguagcugcuuugcu

SEQ ID NO: 123456 - RNA, 20 nt, Human
agaaggagagaugaggcaaa

SEQ ID NO: 123457 - RNA, 22 nt, Human
agugaaaacugaaucaccuucc

SEQ ID NO: 123458 - RNA, 22 nt, Human
aucuucaaggacgccaagaucc

SEQ ID NO: 123459 - RNA, 22 nt, Human
cuggguuuggcugugcuugaau

SEQ ID NO: 123460 - RNA, 21 nt, Human
auuggcagaucucuggauugu

SEQ ID NO: 123461 - RNA, 22 nt, Human
cuucuggaggcugcagaaaaga

SEQ ID NO: 123462 - RNA, 22 nt, Human
uuggaagacagccgucuuuauu

SEQ ID NO: 123463 - RNA, 22 nt, Human
agaggagaauguaaauuuguca

SEQ ID NO: 123464 - RNA, 22 nt, Human
ugaagcuaguauuaacucagau

SEQ ID NO: 123465 - RNA, 22 nt, Human
cagggccaggccucaggggcgc

SEQ ID NO: 123466 - RNA, 19 nt, Human
agauggcaaaaugcaaaga

SEQ ID NO: 123467 - RNA, 22 nt, Human
auuucaacagaguuugaaggca

SEQ ID NO: 123468 - RNA, 22 nt, Human
aaauagauuugacuacuuggug

SEQ ID NO: 123469 - RNA, 22 nt, Human
ugagguuacauuaggaauaacc

SEQ ID NO: 123470 - RNA, 22 nt, Human
ggcuguggcagcuggaaguggu

SEQ ID NO: 123471 - RNA, 22 nt, Human
uuuauguuuguuuuugaaauaa

SEQ ID NO: 123472 - RNA, 22 nt, Human
guccccugcguguucauccugg

SEQ ID NO: 123473 - RNA, 22 nt, Human
auuuuguugaaacccuuguugu

SEQ ID NO: 123474 - RNA, 22 nt, Human
ucaggagaguguucaguggagg

SEQ ID NO: 123475 - RNA, 23 nt, Human
uuucugaguuuuuuaaaagucca

SEQ ID NO: 123476 - RNA, 22 nt, Human
aagcucugggacugaggcuccu

SEQ ID NO: 123477 - RNA, 22 nt, Human
cagcuggggagagacauggcag

SEQ ID NO: 123478 - RNA, 22 nt, Human
cacuguugagcaauguacagug

SEQ ID NO: 123479 - RNA, 22 nt, Human
ugcuagggcaggaggugaggag

SEQ ID NO: 123480 - RNA, 22 nt, Human
uauaagaaaagucauuaucaaa

SEQ ID NO: 123481 - RNA, 22 nt, Human
ugcuuaaccagccccuucccuu

SEQ ID NO: 123482 - RNA, 22 nt, Human
auauauacuuugacacauucug

SEQ ID NO: 123483 - RNA, 22 nt, Human
gcagguggaagcagcagacuca

SEQ ID NO: 123484 - RNA, 22 nt, Human
uuggaagagagauggggagaga

SEQ ID NO: 123485 - RNA, 22 nt, Human
ccucaucagaaagcagaaagca

SEQ ID NO: 123486 - RNA, 22 nt, Human
uaauuuugucacagugacaugc

SEQ ID NO: 123487 - RNA, 22 nt, Human
aucacacaccuguuaaauugug

SEQ ID NO: 123488 - RNA, 22 nt, Human
uggacagguacuucacauuauu

SEQ ID NO: 123489 - RNA, 22 nt, Human
cagagcugucauuugccaguga

SEQ ID NO: 123490 - RNA, 22 nt, Human
ugaguuucuuacucaggagcug

SEQ ID NO: 123491 - RNA, 22 nt, Human
auagauuuuaucagauuuuauc

SEQ ID NO: 123492 - RNA, 22 nt, Human
uuucuggacuaaagggagagau

SEQ ID NO: 123493 - RNA, 22 nt, Human
gcucccagcuuuuguccacggc

SEQ ID NO: 123494 - RNA, 22 nt, Human
gaaaaagucuuaaaguaaggca

SEQ ID NO: 123495 - RNA, 22 nt, Human
ggaggggaguuugccucugggg

SEQ ID NO: 123496 - RNA, 23 nt, Human
aggcugccacucagggugaggcu

SEQ ID NO: 123497 - RNA, 22 nt, Human
acauuuuaccaucuguggauga

SEQ ID NO: 123498 - RNA, 22 nt, Human
ugcaugaucucacuuacaggug

SEQ ID NO: 123499 - RNA, 22 nt, Human
ugcuuguuuuguggcuucagcu

SEQ ID NO: 123500 - RNA, 22 nt, Human
uggagucuugcuuugggagugc

SEQ ID NO: 123501 - RNA, 22 nt, Human
cucuauuuuuucaucuuucagg

SEQ ID NO: 123502 - RNA, 22 nt, Human
agggaccacauccccucugugg

SEQ ID NO: 123503 - RNA, 22 nt, Human
uugugugugcccaccuguggcc

SEQ ID NO: 123504 - RNA, 22 nt, Human
uucuugucuuuguuauguagga

SEQ ID NO: 123505 - RNA, 18 nt, Human
ggcugggcugugccccuu

SEQ ID NO: 123506 - RNA, 22 nt, Human
aacacuguaucagucuucaaua

SEQ ID NO: 123507 - RNA, 22 nt, Human
ggcagagguagcuggaaccagg

SEQ ID NO: 123508 - RNA, 20 nt, Human
agcuuucaccaguacuucca

SEQ ID NO: 123509 - RNA, 22 nt, Human
uuuucucuuugcuucucuaaaa

SEQ ID NO: 123510 - RNA, 22 nt, Human
gggagcugagcuggaagagaau

SEQ ID NO: 123511 - RNA, 22 nt, Human
uucaaaaugcagaauaguuugg

SEQ ID NO: 123512 - RNA, 22 nt, Human
auauucaaugaggucauauaag

SEQ ID NO: 123513 - RNA, 22 nt, Human
ugagauuuagaacuggauuuca

SEQ ID NO: 123514 - RNA, 22 nt, Human
uucuguacuagaucuuaucagu

SEQ ID NO: 123515 - RNA, 20 nt, Human
agguugguuuacuagucugu

SEQ ID NO: 123516 - RNA, 22 nt, Human
ugaccucaagcaugcggagggc

SEQ ID NO: 123517 - RNA, 22 nt, Human
uuaauauuuauugguaaucacu

SEQ ID NO: 123518 - RNA, 17 nt, Human
auucaugaacauguccu

SEQ ID NO: 123519 - RNA, 22 nt, Human
uauauauacauauagaauaugu

SEQ ID NO: 123520 - RNA, 22 nt, Human
auuagaagagcuuuuuacucuu

SEQ ID NO: 123521 - RNA, 22 nt, Human
uggugcucuugauauauaaggc

SEQ ID NO: 123522 - RNA, 22 nt, Human
aggcaguguguagcuggaagag

SEQ ID NO: 123523 - RNA, 22 nt, Human
uugcaugauuuaagaauaucug

SEQ ID NO: 123524 - RNA, 22 nt, Human
gucagacucuggggccccaggc

SEQ ID NO: 123525 - RNA, 21 nt, Human
gccugcuguucacccugccac

SEQ ID NO: 123526 - RNA, 22 nt, Human
uuuuauaaaaccuguuugaccu

SEQ ID NO: 123527 - RNA, 22 nt, Human
cugggaguugacgaggcuugua

SEQ ID NO: 123528 - RNA, 22 nt, Human
guuuugugugugugcccacacg

SEQ ID NO: 123529 - RNA, 23 nt, Human
uuugaaucauuguggggcuuuug

SEQ ID NO: 123530 - RNA, 22 nt, Human
ucccagaaauccaggcuuaaau

SEQ ID NO: 123531 - RNA, 22 nt, Human
uuuguuuccagccuuuugucuu

SEQ ID NO: 123532 - RNA, 22 nt, Human
aaaugcacaauaaaguaaaggc

SEQ ID NO: 123533 - RNA, 22 nt, Human
ggugugaauagagccuggagca

SEQ ID NO: 123534 - RNA, 22 nt, Human
uaauauaacugccaguuaaggu

SEQ ID NO: 123535 - RNA, 22 nt, Human
acagcucaggcccaucaacccc

SEQ ID NO: 123536 - RNA, 22 nt, Human
auaaaucaagggcaguauuucc

SEQ ID NO: 123537 - RNA, 22 nt, Human
ugaggagggcuagagucuccug

SEQ ID NO: 123538 - RNA, 22 nt, Human
cuuucucucaaacacacauaca

SEQ ID NO: 123539 - RNA, 21 nt, Human
aaguuucucccuaauuguugc

SEQ ID NO: 123540 - RNA, 22 nt, Human
gucuuucuuuuacauauuugug

SEQ ID NO: 123541 - RNA, 20 nt, Human
caggccuucaggauggcugg

SEQ ID NO: 123542 - RNA, 22 nt, Human
aaauauagugacacuuauaguc

SEQ ID NO: 123543 - RNA, 22 nt, Human
uuuucaauuuucauuugcaaga

SEQ ID NO: 123544 - RNA, 22 nt, Human
acuucauuugaaaugguugaau

SEQ ID NO: 123545 - RNA, 22 nt, Human
uaauuauuaauuuuagguugcu

SEQ ID NO: 123546 - RNA, 22 nt, Human
acauggcaugaauaauguguac

SEQ ID NO: 123547 - RNA, 22 nt, Human
aauggaaaaauccacagggaac

SEQ ID NO: 123548 - RNA, 20 nt, Human
acagagauccucucuuuauc

SEQ ID NO: 123549 - RNA, 22 nt, Human
agcucugauccuuuaaaggaga

SEQ ID NO: 123550 - RNA, 22 nt, Human
acucauucgccuugcccaaggc

SEQ ID NO: 123551 - RNA, 22 nt, Human
auguuguugaacucuuugcaug

SEQ ID NO: 123552 - RNA, 22 nt, Human
gaaauagagacaguaagugucu

SEQ ID NO: 123553 - RNA, 22 nt, Human
cugugaaugguggccacgcguu

SEQ ID NO: 123554 - RNA, 22 nt, Human
aggcagagaggucuuccuggaa

SEQ ID NO: 123555 - RNA, 22 nt, Human
ccucaggaauuuauucuucugu

SEQ ID NO: 123556 - RNA, 22 nt, Human
gccugagauuggacauuauuua

SEQ ID NO: 123557 - RNA, 22 nt, Human
auggucugcucagucucuugac

SEQ ID NO: 123558 - RNA, 22 nt, Human
aguucauccucauuuacaagga

SEQ ID NO: 123559 - RNA, 22 nt, Human
aguggagguuacagcuguacau

SEQ ID NO: 123560 - RNA, 22 nt, Human
aauuuaauugguuuuuacuugu

SEQ ID NO: 123561 - RNA, 18 nt, Human
uucucucuggauaguagu

SEQ ID NO: 123562 - RNA, 22 nt, Human
uuuuuuuagaaagaucauaguu

SEQ ID NO: 123563 - RNA, 22 nt, Human
agagagggaugguguccagaga

SEQ ID NO: 123564 - RNA, 22 nt, Human
uucuucuucuuccucauccuca

SEQ ID NO: 123565 - RNA, 22 nt, Human
ucuuucugaugggaagggucaa

SEQ ID NO: 123566 - RNA, 22 nt, Human
gggagguaaugggggugcaggg

SEQ ID NO: 123567 - RNA, 22 nt, Human
uuguuuuaguagaaguuacaug

SEQ ID NO: 123568 - RNA, 22 nt, Human
gauaaauaguguuuggggacau

SEQ ID NO: 123569 - RNA, 22 nt, Human
uuuuguuuacauuaaauuuuga

SEQ ID NO: 123570 - RNA, 22 nt, Human
gugcccaguugaggccaggacu

SEQ ID NO: 123571 - RNA, 22 nt, Human
aaaauauucuauaucaaagaua

SEQ ID NO: 123572 - RNA, 22 nt, Human
guugagaaucucuagcuuagga

SEQ ID NO: 123573 - RNA, 22 nt, Human
uccucagcaaacacuucacucu

SEQ ID NO: 123574 - RNA, 22 nt, Human
aaggaugguaacaguuucauuu

SEQ ID NO: 123575 - RNA, 22 nt, Human
aaaaaaacuaauuuuaaaugug

SEQ ID NO: 123576 - RNA, 22 nt, Human
uuguccacuaagaaagugcccu

SEQ ID NO: 123577 - RNA, 22 nt, Human
aagaaaagcaucuuuguaguag

SEQ ID NO: 123578 - RNA, 22 nt, Human
cauuugcuuaucacucuucuuu

SEQ ID NO: 123579 - RNA, 22 nt, Human
auggagggcagccccacuaaag

SEQ ID NO: 123580 - RNA, 22 nt, Human
uuccagcaaagguaguguguua

SEQ ID NO: 123581 - RNA, 22 nt, Human
gcugcgccgggagccggggccg

SEQ ID NO: 123582 - RNA, 22 nt, Human
guugguggaggcgagagaagaa

SEQ ID NO: 123583 - RNA, 22 nt, Human
cacauuuuccagaagaaucaga

SEQ ID NO: 123584 - RNA, 22 nt, Human
aagacagaaaagcagagagagg

SEQ ID NO: 123585 - RNA, 22 nt, Human
agucugugguccucuguaucuc

SEQ ID NO: 123586 - RNA, 22 nt, Human
aauuauuauguggaagacgacg

SEQ ID NO: 123587 - RNA, 22 nt, Human
ugugucucucuuagguugucug

SEQ ID NO: 123588 - RNA, 22 nt, Human
auuugcuuguucaccaguacuu

SEQ ID NO: 123589 - RNA, 22 nt, Human
uagugcuuaaaacagaauuuuc

SEQ ID NO: 123590 - RNA, 22 nt, Human
uauuuccugcguuucugugagc

SEQ ID NO: 123591 - RNA, 22 nt, Human
uugcacgucacccuucccaccu

SEQ ID NO: 123592 - RNA, 22 nt, Human
uuuuauuuguauguugaaugua

SEQ ID NO: 123593 - RNA, 23 nt, Human
uggcaaacgggaauaaaggaauu

SEQ ID NO: 123594 - RNA, 22 nt, Human
ucugcagggcccuuggcuccug

SEQ ID NO: 123595 - RNA, 22 nt, Human
uacugcaguuccugcugucucc

SEQ ID NO: 123596 - RNA, 22 nt, Human
auaaaacagaucaggagaauga

SEQ ID NO: 123597 - RNA, 22 nt, Human
gccugcagccagggaguucucu

SEQ ID NO: 123598 - RNA, 22 nt, Human
aaacgcaauuucuugcauguca

SEQ ID NO: 123599 - RNA, 22 nt, Human
caagcacaauuucuacauguua

SEQ ID NO: 123600 - RNA, 22 nt, Human
ggagguggagcuggaaguucca

SEQ ID NO: 123601 - RNA, 22 nt, Human
auuuucuugucucuguuguagg

SEQ ID NO: 123602 - RNA, 22 nt, Human
uuggaaaagaaauacucauaua

SEQ ID NO: 123603 - RNA, 22 nt, Human
uuuaccuuauguaaauaagagu

SEQ ID NO: 123604 - RNA, 21 nt, Human
aacaaaagggaagaacagcug

SEQ ID NO: 123605 - RNA, 22 nt, Human
caggcagggagcuggaaaggau

SEQ ID NO: 123606 - RNA, 22 nt, Human
ugguuauauaaggauuaaauac

SEQ ID NO: 123607 - RNA, 21 nt, Human
aggcuuggaucuagacaggcc

SEQ ID NO: 123608 - RNA, 22 nt, Human
uaacauuuaguuuuaagauggu

SEQ ID NO: 123609 - RNA, 22 nt, Human
ggagacagauggcgucucaguu

SEQ ID NO: 123610 - RNA, 22 nt, Human
aagccugguuauuugaggaugu

SEQ ID NO: 123611 - RNA, 22 nt, Human
gcaguuaccuauuuuguagaaa

SEQ ID NO: 123612 - RNA, 22 nt, Human
agaggcaggcagcagagaagau

SEQ ID NO: 123613 - RNA, 22 nt, Human
ggaagcucaauacuuuccucuu

SEQ ID NO: 123614 - RNA, 22 nt, Human
caaauuuuuauuuaccaucugc

SEQ ID NO: 123615 - RNA, 22 nt, Human
augugaaagagguguucagugg

SEQ ID NO: 123616 - RNA, 22 nt, Human
gaagcccuggaggggcuggagg

SEQ ID NO: 123617 - RNA, 22 nt, Human
ggaaagagaaacaugaacuaga

SEQ ID NO: 123618 - RNA, 22 nt, Human
caugaugagaguaauaacacag

SEQ ID NO: 123619 - RNA, 19 nt, Human
gcugggauaggauguauuu

SEQ ID NO: 123620 - RNA, 22 nt, Human
uugccaggagacaucuggagcc

SEQ ID NO: 123621 - RNA, 20 nt, Human
uggcccgcgcuccuccugcu

SEQ ID NO: 123622 - RNA, 22 nt, Human
agcagagggucaguuuuuuagu

SEQ ID NO: 123623 - RNA, 22 nt, Human
uagggaggguuugggguggagg

SEQ ID NO: 123624 - RNA, 20 nt, Human
ucacuguaauugccuacauu

SEQ ID NO: 123625 - RNA, 22 nt, Human
ucaacagaagugauagcuauua

SEQ ID NO: 123626 - RNA, 22 nt, Human
ucuuuaaggggccuuuguguca

SEQ ID NO: 123627 - RNA, 22 nt, Human
ucagcaggugcuuuguuuacuc

SEQ ID NO: 123628 - RNA, 22 nt, Human
ggcugggaggcggaggcugaga

SEQ ID NO: 123629 - RNA, 22 nt, Human
uuuuuaaaauuaggacggcacg

SEQ ID NO: 123630 - RNA, 22 nt, Human
uggucugggaagaucacaauua

SEQ ID NO: 123631 - RNA, 22 nt, Human
aaugcagaugugucuuuaauuu

SEQ ID NO: 123632 - RNA, 22 nt, Human
uuagucauucccucuugauauu

SEQ ID NO: 123633 - RNA, 20 nt, Human
uggguucaguuguuucuggc

SEQ ID NO: 123634 - RNA, 22 nt, Human
uugaaaaaugcccagcagacaa

SEQ ID NO: 123635 - RNA, 22 nt, Human
caaaacauucagagagcucacu

SEQ ID NO: 123636 - RNA, 23 nt, Human
aaaguacuuaaucugcaaaccac

SEQ ID NO: 123637 - RNA, 20 nt, Human
gugaacuggagaacugaugu

SEQ ID NO: 123638 - RNA, 22 nt, Human
gagggggaaaagggcagcagag

SEQ ID NO: 123639 - RNA, 22 nt, Human
ugaauaaauaaacuuuuacuac

SEQ ID NO: 123640 - RNA, 22 nt, Human
gcacuguauuuaaauauuuaaa

SEQ ID NO: 123641 - RNA, 20 nt, Human
cuuauuuuggagaacuuuuc

SEQ ID NO: 123642 - RNA, 22 nt, Human
agauuucaauggauauugcaag

SEQ ID NO: 123643 - RNA, 22 nt, Human
gagggaggugacaaggacauag

SEQ ID NO: 123644 - RNA, 22 nt, Human
augugcauguauguaucauauu

SEQ ID NO: 123645 - RNA, 22 nt, Human
gccuuuuaaggcagagggagau

SEQ ID NO: 123646 - RNA, 22 nt, Human
aggcugccuaugaaggcagaag

SEQ ID NO: 123647 - RNA, 19 nt, Human
uccuacaugagacagagag

SEQ ID NO: 123648 - RNA, 22 nt, Human
caguggacacuuccucuacaau

SEQ ID NO: 123649 - RNA, 22 nt, Human
uuuauugcuaugucuugauugu

SEQ ID NO: 123650 - RNA, 22 nt, Human
aguugugagaaugaacacugaa

SEQ ID NO: 123651 - RNA, 22 nt, Human
aaacugcuuucucugccuuucc

SEQ ID NO: 123652 - RNA, 22 nt, Human
cuauacuuagaacuccauuuuc

SEQ ID NO: 123653 - RNA, 22 nt, Human
aaauauauccuucuguccugcc

SEQ ID NO: 123654 - RNA, 22 nt, Human
gauuugucuauauucaaauaug

SEQ ID NO: 123655 - RNA, 22 nt, Human
agcaaaauuccaaaaugcuaau

SEQ ID NO: 123656 - RNA, 22 nt, Human
gaauuagacggcaucacauggg

SEQ ID NO: 123657 - RNA, 22 nt, Human
ucagcucacaauguugagaaag

SEQ ID NO: 123658 - RNA, 22 nt, Human
cuaauaauuuacugagugcuac

SEQ ID NO: 123659 - RNA, 21 nt, Human
auacaguucagcuuuuacuau

SEQ ID NO: 123660 - RNA, 22 nt, Human
guucuucagauuccauuucagu

SEQ ID NO: 123661 - RNA, 22 nt, Human
uuuauuuuccaugucucuaggu

SEQ ID NO: 123662 - RNA, 22 nt, Human
ucccacgugccaucugcucugu

SEQ ID NO: 123663 - RNA, 22 nt, Human
guucaaucucucaugcauuuuc

SEQ ID NO: 123664 - RNA, 22 nt, Human
ucuucaucucuaaaaugggaac

SEQ ID NO: 123665 - RNA, 22 nt, Human
agucauuugucauuuuuuugag

SEQ ID NO: 123666 - RNA, 22 nt, Human
agggcugcugcuccgggcccag

SEQ ID NO: 123667 - RNA, 22 nt, Human
ucccagaacggguucuucccag

SEQ ID NO: 123668 - RNA, 21 nt, Human
gcagcaugagaaagccccaaa

SEQ ID NO: 123669 - RNA, 23 nt, Human
uaagccugugccugcuaccugcu

SEQ ID NO: 123670 - RNA, 20 nt, Human
gacaugagggagcaaagagc

SEQ ID NO: 123671 - RNA, 22 nt, Human
ggcuagggaucuagaccaggac

SEQ ID NO: 123672 - RNA, 22 nt, Human
caaauacaaauacgggcagcuu

SEQ ID NO: 123673 - RNA, 22 nt, Human
cacugugagugcaagcaggggu

SEQ ID NO: 123674 - RNA, 22 nt, Human
augcaugaucccgguaugugaa

SEQ ID NO: 123675 - RNA, 22 nt, Human
auggcagcggagcuggaaauga

SEQ ID NO: 123676 - RNA, 22 nt, Human
aucuuugauuuuggcuuuuagg

SEQ ID NO: 123677 - RNA, 22 nt, Human
uaauaaaaauuuaauucacauu

SEQ ID NO: 123678 - RNA, 20 nt, Human
uccaguuuuggagacauucu

SEQ ID NO: 123679 - RNA, 22 nt, Human
gaguaaaagaugaggcaguaga

SEQ ID NO: 123680 - RNA, 22 nt, Human
aaaauaauauuauaccacugcu

SEQ ID NO: 123681 - RNA, 22 nt, Human
ucaguuuaauuggaucuuuuuc

SEQ ID NO: 123682 - RNA, 22 nt, Human
gcagguuguuuaaauuaggauu

SEQ ID NO: 123683 - RNA, 22 nt, Human
uguuuucuuuccccuucuuuuc

SEQ ID NO: 123684 - RNA, 22 nt, Human
cuuuucauuucauggaauacaa

SEQ ID NO: 123685 - RNA, 22 nt, Human
gcaggagggggccuggagccca

SEQ ID NO: 123686 - RNA, 22 nt, Human
ccagucuuggugucuguagcac

SEQ ID NO: 123687 - RNA, 22 nt, Human
caggaggaggccgggaggaagc

SEQ ID NO: 123688 - RNA, 22 nt, Human
ucuccucucugaucuugcuccg

SEQ ID NO: 123689 - RNA, 22 nt, Human
uacuuaaaacacauuuagcauu

SEQ ID NO: 123690 - RNA, 22 nt, Human
uauucuucaacuuuucuccucu

SEQ ID NO: 123691 - RNA, 20 nt, Human
aauaaauauaacccauaauu

SEQ ID NO: 123692 - RNA, 22 nt, Human
cucuuuucaaaccuguuuaugg

SEQ ID NO: 123693 - RNA, 21 nt, Human
gaaaaucuaaugugacaaugc

SEQ ID NO: 123694 - RNA, 22 nt, Human
uucacugugauugggguggauu

SEQ ID NO: 123695 - RNA, 22 nt, Human
ugccuuuuguguuuggcuaauc

SEQ ID NO: 123696 - RNA, 22 nt, Human
gaggguggggaauagacugcua

SEQ ID NO: 123697 - RNA, 22 nt, Human
cagguuguucugggcauggagg

SEQ ID NO: 123698 - RNA, 22 nt, Human
ugcauguuucuguauguuaaug

SEQ ID NO: 123699 - RNA, 22 nt, Human
gaaaagaaaggaugguaugugu

SEQ ID NO: 123700 - RNA, 22 nt, Human
auugugaaugccugucagucuu

SEQ ID NO: 123701 - RNA, 22 nt, Human
ucuaaaaauuagaaauuagguc

SEQ ID NO: 123702 - RNA, 22 nt, Human
gggacaggacuccuggggccug

SEQ ID NO: 123703 - RNA, 22 nt, Human
ucagggaggagaggcaggggga

SEQ ID NO: 123704 - RNA, 22 nt, Human
uuguuguuguuguuauuuaguu

SEQ ID NO: 123705 - RNA, 22 nt, Human
uuucucuuguauuugaaucacu

SEQ ID NO: 123706 - RNA, 22 nt, Human
ucauaaguuguugacuagcaaa

SEQ ID NO: 123707 - RNA, 22 nt, Human
cccuccagugucccagugggga

SEQ ID NO: 123708 - RNA, 22 nt, Human
ugaauucaaacuuuuuaacaag

SEQ ID NO: 123709 - RNA, 22 nt, Human
auguuuucauuuagaagcuaau

SEQ ID NO: 123710 - RNA, 22 nt, Human
acaaucuuauuaguaguauaga

SEQ ID NO: 123711 - RNA, 22 nt, Human
uucugaguguugucaccaugug

SEQ ID NO: 123712 - RNA, 22 nt, Human
acauaaaccccccuuccccagg

SEQ ID NO: 123713 - RNA, 22 nt, Human
uuugcauuaguuuagauuucaa

SEQ ID NO: 123714 - RNA, 22 nt, Human
uuuccuaggaaaugauugaagu

SEQ ID NO: 123715 - RNA, 22 nt, Human
auccuagacuccuaugccccaa

SEQ ID NO: 123716 - RNA, 22 nt, Human
cagacagagcucacaagucuuu

SEQ ID NO: 123717 - RNA, 22 nt, Human
ggagagaacguaaucuaguauu

SEQ ID NO: 123718 - RNA, 22 nt, Human
uauuaauugugguuauuguauu

SEQ ID NO: 123719 - RNA, 22 nt, Human
aagaguggagcuggaaaguggg

SEQ ID NO: 123720 - RNA, 22 nt, Human
caugccugaucagcggccagca

SEQ ID NO: 123721 - RNA, 22 nt, Human
uucagaauguacugauagaaca

SEQ ID NO: 123722 - RNA, 22 nt, Human
auucuacucuuuaaauaugaaa

SEQ ID NO: 123723 - RNA, 22 nt, Human
aaagaugaaguucagcgaagaa

SEQ ID NO: 123724 - RNA, 22 nt, Human
uucuggagucuauuuugaaaag

SEQ ID NO: 123725 - RNA, 17 nt, Human
ccacuagauagguugug

SEQ ID NO: 123726 - RNA, 19 nt, Human
uagaggagaauggcaaaga

SEQ ID NO: 123727 - RNA, 19 nt, Human
gagcaugacuggccuugca

SEQ ID NO: 123728 - RNA, 22 nt, Human
uucuaauauuaugauuucuaag

SEQ ID NO: 123729 - RNA, 22 nt, Human
auauauguauauacacauauau

SEQ ID NO: 123730 - RNA, 22 nt, Human
gaugucccuggaggggacagga

SEQ ID NO: 123731 - RNA, 23 nt, Human
gugagaccagagccuauucucag

SEQ ID NO: 123732 - RNA, 22 nt, Human
ugagaaaacaguuuguaauaau

SEQ ID NO: 123733 - RNA, 22 nt, Human
ugucacagagcgugcaacagaa

SEQ ID NO: 123734 - RNA, 22 nt, Human
gaggaggagacggaggccuggg

SEQ ID NO: 123735 - RNA, 22 nt, Human
ucccagaaccuuuuagcuucac

SEQ ID NO: 123736 - RNA, 17 nt, Human
ccagcugcucccucaga

SEQ ID NO: 123737 - RNA, 22 nt, Human
guuuccaggcuuugguaugguu

SEQ ID NO: 123738 - RNA, 22 nt, Human
ggggcucauuugcaggggggag

SEQ ID NO: 123739 - RNA, 22 nt, Human
gcugucccccaaagaugcuccu

SEQ ID NO: 123740 - RNA, 22 nt, Human
gugguuuagccuucauuaaccu

SEQ ID NO: 123741 - RNA, 22 nt, Human
uccugggcuugcucuuuccauu

SEQ ID NO: 123742 - RNA, 20 nt, Human
cagagacaagagggaaggga

SEQ ID NO: 123743 - RNA, 22 nt, Human
aaguuccacuagugacccagaa

SEQ ID NO: 123744 - RNA, 22 nt, Human
agaguacagaagcauuucagau

SEQ ID NO: 123745 - RNA, 22 nt, Human
gccugggccgggcgcggccccc

SEQ ID NO: 123746 - RNA, 22 nt, Human
aaacauaugccuucuuuuguaa

SEQ ID NO: 123747 - RNA, 22 nt, Human
gaggacccuuaggucagacaga

SEQ ID NO: 123748 - RNA, 22 nt, Human
guaagaauauacccaggaguca

SEQ ID NO: 123749 - RNA, 22 nt, Human
ugaggaggugcuaccagcgucu

SEQ ID NO: 123750 - RNA, 22 nt, Human
uuugauuuuguuuauagugccg

SEQ ID NO: 123751 - RNA, 22 nt, Human
auuuaagacuguggugcaguuu

SEQ ID NO: 123752 - RNA, 22 nt, Human
guaagguuggaugcaaucaacu

SEQ ID NO: 123753 - RNA, 22 nt, Human
agcucugcuucuugggaagaug

SEQ ID NO: 123754 - RNA, 22 nt, Human
uagcauuucacugaucuucacu

SEQ ID NO: 123755 - RNA, 22 nt, Human
aaggaaaaaauggcuugugaua

SEQ ID NO: 123756 - RNA, 22 nt, Human
agaaacaagcccuagaaguccu

SEQ ID NO: 123757 - RNA, 22 nt, Human
ugcugccucccaucccucccga

SEQ ID NO: 123758 - RNA, 22 nt, Human
uuuugauacaaguuguaaaaaa

SEQ ID NO: 123759 - RNA, 22 nt, Human
ugucuuuagagugaacagaaga

SEQ ID NO: 123760 - RNA, 22 nt, Human
uucaaacaguguagaauauaug

SEQ ID NO: 123761 - RNA, 22 nt, Human
uuagaaauguccuacuaauaug

SEQ ID NO: 123762 - RNA, 23 nt, Human
uuuuccaaaucgacucucuaguu

SEQ ID NO: 123763 - RNA, 22 nt, Human
auuguuuugugaaacauaguga

SEQ ID NO: 123764 - RNA, 22 nt, Human
cuggaugucugggaggcuuccc

SEQ ID NO: 123765 - RNA, 22 nt, Human
uugaaaaaauguguuuaaggag

SEQ ID NO: 123766 - RNA, 22 nt, Human
auaaaguaaugcauauaaugug

SEQ ID NO: 123767 - RNA, 22 nt, Human
guuuauucuuuuauuugugaga

SEQ ID NO: 123768 - RNA, 22 nt, Human
uuuguauuguuuauuucauuuu

SEQ ID NO: 123769 - RNA, 22 nt, Human
auuuuuuuggucauaugagaua

SEQ ID NO: 123770 - RNA, 22 nt, Human
uuuuuauaagagcagcagaguu

SEQ ID NO: 123771 - RNA, 22 nt, Human
uauuuuuaccuaauuuaugaga

SEQ ID NO: 123772 - RNA, 16 nt, Human
gaauuccauugcucug

SEQ ID NO: 123773 - RNA, 22 nt, Human
ucaccaugcccuucucugcucu

SEQ ID NO: 123774 - RNA, 22 nt, Human
cagggagguuggauuggggccu

SEQ ID NO: 123775 - RNA, 22 nt, Human
uucuuuucuucccuguuuauua

SEQ ID NO: 123776 - RNA, 22 nt, Human
aaucccaguccuccugggggau

SEQ ID NO: 123777 - RNA, 22 nt, Human
agauaacauguugcagauucug

SEQ ID NO: 123778 - RNA, 22 nt, Human
ugaaucaaugaauugcacuuca

SEQ ID NO: 123779 - RNA, 22 nt, Human
ugcccacuuugucuccaugcug

SEQ ID NO: 123780 - RNA, 22 nt, Human
auuuuuauuugccuaugauaua

SEQ ID NO: 123781 - RNA, 22 nt, Human
uuuauguugagcaaaauaccac

SEQ ID NO: 123782 - RNA, 22 nt, Human
agagcuauuucuuaaaagcugu

SEQ ID NO: 123783 - RNA, 22 nt, Human
gaggcaggcggggcccaggugg

SEQ ID NO: 123784 - RNA, 22 nt, Human
aauggcaauagugcauuaugua

SEQ ID NO: 123785 - RNA, 22 nt, Human
aggaaaguugcuuguagugcug

SEQ ID NO: 123786 - RNA, 22 nt, Human
aacugcauaagcuucgggaccu

SEQ ID NO: 123787 - RNA, 22 nt, Human
uugaguuuacauuguauuagcc

SEQ ID NO: 123788 - RNA, 19 nt, Human
uccaaaauacuuguuacug

SEQ ID NO: 123789 - RNA, 22 nt, Human
cagcacuuccuccgugagcccc

SEQ ID NO: 123790 - RNA, 22 nt, Human
gcauaauauugagaaauuauua

SEQ ID NO: 123791 - RNA, 22 nt, Human
gcauuuuaauuggggcaguuag

SEQ ID NO: 123792 - RNA, 22 nt, Human
gagcaggucucaguucugccuc

SEQ ID NO: 123793 - RNA, 22 nt, Human
cagcuucacuuaaaacaugcaa

SEQ ID NO: 123794 - RNA, 22 nt, Human
agcauucuguggucuucuaugg

SEQ ID NO: 123795 - RNA, 22 nt, Human
caaaaauacuugccuguaucug

SEQ ID NO: 123796 - RNA, 22 nt, Human
ccaaagaauuuggaaaaucuga

SEQ ID NO: 123797 - RNA, 22 nt, Human
ggaaaaauggguggugauauga

SEQ ID NO: 123798 - RNA, 22 nt, Human
cucagaauugucaccucaaaaa

SEQ ID NO: 123799 - RNA, 22 nt, Human
guugggcugaagugugugcuua

SEQ ID NO: 123800 - RNA, 22 nt, Human
uccagaaaucucuguugauugu

SEQ ID NO: 123801 - RNA, 22 nt, Human
caaaaaauccauagaaagaggu

SEQ ID NO: 123802 - RNA, 22 nt, Human
uaggucugaggcugcaucuugg

SEQ ID NO: 123803 - RNA, 21 nt, Human
aaguuuuggcuguacaguugu

SEQ ID NO: 123804 - RNA, 22 nt, Human
uguauauguguguagcauguua

SEQ ID NO: 123805 - RNA, 22 nt, Human
ugcuuuuguaucagaguauuca

SEQ ID NO: 123806 - RNA, 22 nt, Human
uuugauuaccuggggcccucug

SEQ ID NO: 123807 - RNA, 22 nt, Human
auugcaggucguguggaaguga

SEQ ID NO: 123808 - RNA, 22 nt, Human
cuucucuuccuucucauccuca

SEQ ID NO: 123809 - RNA, 22 nt, Human
uucuuauuuuucguaaauccug

SEQ ID NO: 123810 - RNA, 22 nt, Human
agagauacugcaggccauaaau

SEQ ID NO: 123811 - RNA, 22 nt, Human
auaaaagcacaauagaguuaug

SEQ ID NO: 123812 - RNA, 22 nt, Human
uaagugcuagaauuccagguuu

SEQ ID NO: 123813 - RNA, 22 nt, Human
uuucuaaaaccagaguuuauaa

SEQ ID NO: 123814 - RNA, 22 nt, Human
gcugcgcugggacgccaccaac

SEQ ID NO: 123815 - RNA, 22 nt, Human
auugaaauuaauuucugcuuuc

SEQ ID NO: 123816 - RNA, 22 nt, Human
guuuacaacaucuuguccuuca

SEQ ID NO: 123817 - RNA, 22 nt, Human
ccuaggcuggcugucuucaggu

SEQ ID NO: 123818 - RNA, 22 nt, Human
gaaacauuuguugaguacuugc

SEQ ID NO: 123819 - RNA, 21 nt, Human
ugaagcccugugaggugcuua

SEQ ID NO: 123820 - RNA, 23 nt, Human
cugaaauucagaugcuaaagaua

SEQ ID NO: 123821 - RNA, 22 nt, Human
acacaggacacaaaagucacca

SEQ ID NO: 123822 - RNA, 22 nt, Human
uucacauucauuucuuauguuu

SEQ ID NO: 123823 - RNA, 22 nt, Human
uauguauaacuugauaggauga

SEQ ID NO: 123824 - RNA, 22 nt, Human
uucuggccagggaagagggguc

SEQ ID NO: 123825 - RNA, 22 nt, Human
uggaaggggagcuggaaagggg

SEQ ID NO: 123826 - RNA, 22 nt, Human
uuugauuuuuugagcaguguau

SEQ ID NO: 123827 - RNA, 22 nt, Human
uguacuguuuucuaggcaaaaa

SEQ ID NO: 123828 - RNA, 22 nt, Human
augaacugcaguauaaacuugg

SEQ ID NO: 123829 - RNA, 22 nt, Human
uuuuaaauggcuuuuacuuuuc

SEQ ID NO: 123830 - RNA, 22 nt, Human
uggaagugggcaucaccaucca

SEQ ID NO: 123831 - RNA, 22 nt, Human
aaauggaaguuuguucucagcc

SEQ ID NO: 123832 - RNA, 22 nt, Human
ucuucagacuguuguucuuuug

SEQ ID NO: 123833 - RNA, 22 nt, Human
cugcaucacagcaggaggcaca

SEQ ID NO: 123834 - RNA, 22 nt, Human
caaauguuugguggcauuuugu

SEQ ID NO: 123835 - RNA, 22 nt, Human
gcaggggguaaggggcagggcu

SEQ ID NO: 123836 - RNA, 22 nt, Human
aagaaauagauagaggaauacu

SEQ ID NO: 123837 - RNA, 22 nt, Human
uggagggaagcaaacacuagau

SEQ ID NO: 123838 - RNA, 20 nt, Human
uggaucaccauccuguugcu

SEQ ID NO: 123839 - RNA, 22 nt, Human
caagcagauauuuuagucaaga

SEQ ID NO: 123840 - RNA, 22 nt, Human
aaauagucagaaaucaacgugc

SEQ ID NO: 123841 - RNA, 22 nt, Human
uaaagugaaguucagaauggcu

SEQ ID NO: 123842 - RNA, 22 nt, Human
uuuaauauuacacuuaccuugu

SEQ ID NO: 123843 - RNA, 22 nt, Human
aaaauaaccuucauuugcauug

SEQ ID NO: 123844 - RNA, 22 nt, Human
uuuuaauccucuugguaucuua

SEQ ID NO: 123845 - RNA, 22 nt, Human
acuuuuaauaguagauuuuuaa

SEQ ID NO: 123846 - RNA, 22 nt, Human
cacugcaaccuccaccucccgg

SEQ ID NO: 123847 - RNA, 22 nt, Human
ugaaguuuagaaaaagugccuu

SEQ ID NO: 123848 - RNA, 22 nt, Human
uauauauaugcaccacaugugu

SEQ ID NO: 123849 - RNA, 22 nt, Human
uaaaauaccacauauggugcuc

SEQ ID NO: 123850 - RNA, 22 nt, Human
cgaaggaaucacuuaacacuuu

SEQ ID NO: 123851 - RNA, 22 nt, Human
aguuucuugaagacugauguuu

SEQ ID NO: 123852 - RNA, 22 nt, Human
ugucacagggauaccauggggc

SEQ ID NO: 123853 - RNA, 19 nt, Human
agcucaggcccaucguccc

SEQ ID NO: 123854 - RNA, 22 nt, Human
agucauuugaggcaugauuaug

SEQ ID NO: 123855 - RNA, 22 nt, Human
uuaaugcagguacuguuacaau

SEQ ID NO: 123856 - RNA, 19 nt, Human
uuccucaggugugaguuag

SEQ ID NO: 123857 - RNA, 22 nt, Human
uccaggagucagacagauggug

SEQ ID NO: 123858 - RNA, 22 nt, Human
aauuacuuuaggaaaacuccuc

SEQ ID NO: 123859 - RNA, 22 nt, Human
cuguuacggaggcuuucuaguu

SEQ ID NO: 123860 - RNA, 22 nt, Human
uuaggcuuuauugaaaacaaua

SEQ ID NO: 123861 - RNA, 22 nt, Human
uuugaagaccuuaucucuaaau

SEQ ID NO: 123862 - RNA, 19 nt, Human
agggagagucccaagagaa

SEQ ID NO: 123863 - RNA, 22 nt, Human
aaauauugaauuugaggaugua

SEQ ID NO: 123864 - RNA, 22 nt, Human
uugaaagaacaauucugugaug

SEQ ID NO: 123865 - RNA, 22 nt, Human
agucacuguucugucaugucaa

SEQ ID NO: 123866 - RNA, 22 nt, Human
augagugugugguucuaaauga

SEQ ID NO: 123867 - RNA, 22 nt, Human
uaucauuuuacugugacauuuu

SEQ ID NO: 123868 - RNA, 22 nt, Human
ugcagagagccagcucucucgg

SEQ ID NO: 123869 - RNA, 22 nt, Human
cuuuaaaaauguauuuuugugg

SEQ ID NO: 123870 - RNA, 22 nt, Human
auuaucugacugaguagucugu

SEQ ID NO: 123871 - RNA, 22 nt, Human
uuuugaugaccauucuucuuuu

SEQ ID NO: 123872 - RNA, 22 nt, Human
uuuuuuuccaguuauucauuuu

SEQ ID NO: 123873 - RNA, 22 nt, Human
auuaauaucaauauauuauaug

SEQ ID NO: 123874 - RNA, 22 nt, Human
gugcagcugggcgcugaccuuc

SEQ ID NO: 123875 - RNA, 22 nt, Human
uuaaaagaauccuguuauccuc

SEQ ID NO: 123876 - RNA, 22 nt, Human
cuauguuucagauauauauaua

SEQ ID NO: 123877 - RNA, 20 nt, Human
uacaauauucccacuuugcu

SEQ ID NO: 123878 - RNA, 22 nt, Human
agauucucccuccuggcgcugu

SEQ ID NO: 123879 - RNA, 22 nt, Human
cucugcuuguaucacauuugcu

SEQ ID NO: 123880 - RNA, 22 nt, Human
uacaaagugauuuuggaauuga

SEQ ID NO: 123881 - RNA, 22 nt, Human
auuuacugagguaaauaaacug

SEQ ID NO: 123882 - RNA, 22 nt, Human
auacaugacucacacauucugc

SEQ ID NO: 123883 - RNA, 22 nt, Human
agucaccuacagcucaugcuuc

SEQ ID NO: 123884 - RNA, 22 nt, Human
agauggaggaaagcaguuagaa

SEQ ID NO: 123885 - RNA, 22 nt, Human
agagggagagaccuccgugccu

SEQ ID NO: 123886 - RNA, 21 nt, Human
agaugaggauacugaggccua

SEQ ID NO: 123887 - RNA, 22 nt, Human
cagcuucuccauucuucuggcu

SEQ ID NO: 123888 - RNA, 22 nt, Human
cuguuuuugccugugacaaaaa

SEQ ID NO: 123889 - RNA, 22 nt, Human
uuaaguccuugguaauuuucuu

SEQ ID NO: 123890 - RNA, 22 nt, Human
ugcauuuugaaggaaaaaaaug

SEQ ID NO: 123891 - RNA, 22 nt, Human
ugaggcaguucuuacuuguauu

SEQ ID NO: 123892 - RNA, 22 nt, Human
gggagggaggagccccggccau

SEQ ID NO: 123893 - RNA, 22 nt, Human
gaaguaaaacaguaacuuuguu

SEQ ID NO: 123894 - RNA, 22 nt, Human
uuuuucugacugcuaacaaaaa

SEQ ID NO: 123895 - RNA, 22 nt, Human
ugcuuggagaaucagucccagc

SEQ ID NO: 123896 - RNA, 22 nt, Human
ucugaauauguuuaucaucucu

SEQ ID NO: 123897 - RNA, 22 nt, Human
augauuaagguacgucauuucu

SEQ ID NO: 123898 - RNA, 22 nt, Human
uguuccucuuagucuuaugugu

SEQ ID NO: 123899 - RNA, 22 nt, Human
cuccagcagaaagggcgagugg

SEQ ID NO: 123900 - RNA, 22 nt, Human
cguggaggucgcauauuccucu

SEQ ID NO: 123901 - RNA, 22 nt, Human
uuuuuuuaaguuuugauuuuag

SEQ ID NO: 123902 - RNA, 22 nt, Human
uauuucuagggcaugaaaauaa

SEQ ID NO: 123903 - RNA, 22 nt, Human
aaauggauaaucaagauaauca

SEQ ID NO: 123904 - RNA, 22 nt, Human
caaagccuggggagaguaagga

SEQ ID NO: 123905 - RNA, 22 nt, Human
gagacugugucugucaagcuag

SEQ ID NO: 123906 - RNA, 22 nt, Human
gaaugcacacgugugugcaugc

SEQ ID NO: 123907 - RNA, 22 nt, Human
ugagagggagacagcucuagca

SEQ ID NO: 123908 - RNA, 22 nt, Human
gaauagauuagaaagaguaugu

SEQ ID NO: 123909 - RNA, 22 nt, Human
aaacagcugcaguacacggccu

SEQ ID NO: 123910 - RNA, 22 nt, Human
auuauugcaagcagugaaggga

SEQ ID NO: 123911 - RNA, 22 nt, Human
aagagugaguagcuugguuggu

SEQ ID NO: 123912 - RNA, 22 nt, Human
aacauuuauguuuugaccaagu

SEQ ID NO: 123913 - RNA, 22 nt, Human
uuauuuuuguaacacuguauag

SEQ ID NO: 123914 - RNA, 22 nt, Human
cccagagggcugaggauaugaa

SEQ ID NO: 123915 - RNA, 22 nt, Human
uuuauaauuguuauguuaccca

SEQ ID NO: 123916 - RNA, 22 nt, Human
cugaguuuuucaaaucugaauu

SEQ ID NO: 123917 - RNA, 20 nt, Human
ucauucagaaucaguaugca

SEQ ID NO: 123918 - RNA, 22 nt, Human
aacacuaaaggucaguuagaag

SEQ ID NO: 123919 - RNA, 22 nt, Human
aauguugaaccuuuuuggccug

SEQ ID NO: 123920 - RNA, 22 nt, Human
auguauauauacauguauugua

SEQ ID NO: 123921 - RNA, 22 nt, Human
ugcuugaacccaggaaguggag

SEQ ID NO: 123922 - RNA, 22 nt, Human
cagaggagcgaguuggacgcca

SEQ ID NO: 123923 - RNA, 22 nt, Human
cugccucucaugccugcuugcu

SEQ ID NO: 123924 - RNA, 22 nt, Human
gggagggggauucuggcgagaa

SEQ ID NO: 123925 - RNA, 22 nt, Human
ugaacauuuuugcuugcagcuu

SEQ ID NO: 123926 - RNA, 22 nt, Human
aucauguauaugcagcguuugu

SEQ ID NO: 123927 - RNA, 21 nt, Human
uccauucuuggugguucugca

SEQ ID NO: 123928 - RNA, 22 nt, Human
agcccagguggagugugugggg

SEQ ID NO: 123929 - RNA, 22 nt, Human
gauuaaaggucuugauuauaag

SEQ ID NO: 123930 - RNA, 22 nt, Human
auuuuucuuucacauuuucuua

SEQ ID NO: 123931 - RNA, 22 nt, Human
agggaggcccagcagacuggcg

SEQ ID NO: 123932 - RNA, 22 nt, Human
gucccucauaacuggcaggugu

SEQ ID NO: 123933 - RNA, 22 nt, Human
uguugucaugcagucaguggua

SEQ ID NO: 123934 - RNA, 22 nt, Human
uccucagcaagacgcuggcagc

SEQ ID NO: 123935 - RNA, 23 nt, Human
uugcuuuugccccaaaagaguua

SEQ ID NO: 123936 - RNA, 22 nt, Human
uaaaugcucuuuaaaagugcuu

SEQ ID NO: 123937 - RNA, 22 nt, Human
uuuguuugcuaguauuuuguuu

SEQ ID NO: 123938 - RNA, 22 nt, Human
cuucuuuucuacuggccuagaa

SEQ ID NO: 123939 - RNA, 22 nt, Human
acauccagcagauuguccagag

SEQ ID NO: 123940 - RNA, 22 nt, Human
ccccauuugaagauugggggua

SEQ ID NO: 123941 - RNA, 19 nt, Human
acugggaugggcagugcca

SEQ ID NO: 123942 - RNA, 22 nt, Human
cauuuugguaauguucguuugc

SEQ ID NO: 123943 - RNA, 22 nt, Human
ccugggccuaaacaaacaagag

SEQ ID NO: 123944 - RNA, 22 nt, Human
uugcaucagcaggcauaauugg

SEQ ID NO: 123945 - RNA, 22 nt, Human
uccacagcagagcacgguaccu

SEQ ID NO: 123946 - RNA, 22 nt, Human
uauuuugaggugaaagaguuug

SEQ ID NO: 123947 - RNA, 22 nt, Human
gaauacaaauaauaccaaggug

SEQ ID NO: 123948 - RNA, 22 nt, Human
uuuauucuuugcuagguuccau

SEQ ID NO: 123949 - RNA, 22 nt, Human
aagcucuuuccacuaaaccacu

SEQ ID NO: 123950 - RNA, 23 nt, Human
ugccaggaagaaugaccucugcu

SEQ ID NO: 123951 - RNA, 22 nt, Human
uacucauuggagaauuacgagg

SEQ ID NO: 123952 - RNA, 22 nt, Human
acaauaauguuuuuagguuauu

SEQ ID NO: 123953 - RNA, 22 nt, Human
guuguuuuuguuaaaacaguga

SEQ ID NO: 123954 - RNA, 22 nt, Human
ugagauguaauguaguacuuug

SEQ ID NO: 123955 - RNA, 22 nt, Human
cuccugcuuuuucuucuuccga

SEQ ID NO: 123956 - RNA, 22 nt, Human
uaauaauuaacagugauggguc

SEQ ID NO: 123957 - RNA, 22 nt, Human
auagaagugaaaagggaugacu

SEQ ID NO: 123958 - RNA, 20 nt, Human
caugaugcaaacaguaacgu

SEQ ID NO: 123959 - RNA, 22 nt, Human
aauucuuuguuccucugccaag

SEQ ID NO: 123960 - RNA, 22 nt, Human
cugacacagccauuguccuugu

SEQ ID NO: 123961 - RNA, 22 nt, Human
gucuugugaagacggcagaaag

SEQ ID NO: 123962 - RNA, 22 nt, Human
agcaagggucucucauggcuug

SEQ ID NO: 123963 - RNA, 22 nt, Human
ugcaaggcacccacucugcuuu

SEQ ID NO: 123964 - RNA, 22 nt, Human
ugcugcucaagcugcagcaaaa

SEQ ID NO: 123965 - RNA, 22 nt, Human
uugguuaccuucagaaaugagu

SEQ ID NO: 123966 - RNA, 22 nt, Human
guaaauacuaugagauaaugaa

SEQ ID NO: 123967 - RNA, 22 nt, Human
agagggagccugcacagcuuuc

SEQ ID NO: 123968 - RNA, 22 nt, Human
gaauacaagccugccaccugga

SEQ ID NO: 123969 - RNA, 22 nt, Human
aucuugaaacauauaugcauuu

SEQ ID NO: 123970 - RNA, 21 nt, Human
acuccagccacugacugucuc

SEQ ID NO: 123971 - RNA, 22 nt, Human
acugucuuguuguaugugagcu

SEQ ID NO: 123972 - RNA, 22 nt, Human
uaaaggcaaacucuccaaggau

SEQ ID NO: 123973 - RNA, 22 nt, Human
acauuccugaagguaaugagaa

SEQ ID NO: 123974 - RNA, 22 nt, Human
uucuucuuuccuauaauuaauu

SEQ ID NO: 123975 - RNA, 22 nt, Human
uguuuuguuuagguuuguuuuu

SEQ ID NO: 123976 - RNA, 22 nt, Human
ucagagaaguaggcuaauggug

SEQ ID NO: 123977 - RNA, 22 nt, Human
cagcuccagcccaggcagcucc

SEQ ID NO: 123978 - RNA, 17 nt, Human
ucauuucaguaaaucca

SEQ ID NO: 123979 - RNA, 22 nt, Human
uuuuuuuuacuccggacagcuc

SEQ ID NO: 123980 - RNA, 22 nt, Human
cuggagaacucugugcuucacu

SEQ ID NO: 123981 - RNA, 22 nt, Human
uauuuuagccaacagaaugaug

SEQ ID NO: 123982 - RNA, 22 nt, Human
aucuuuguaaguaaucaaagcu

SEQ ID NO: 123983 - RNA, 22 nt, Human
cuccccuuauuccucaacauga

SEQ ID NO: 123984 - RNA, 22 nt, Human
gaaaaagagaaggaguucagua

SEQ ID NO: 123985 - RNA, 22 nt, Human
uuauuuaagaucuuaauauaua

SEQ ID NO: 123986 - RNA, 22 nt, Human
ucucuggacggacauuuaaggu

SEQ ID NO: 123987 - RNA, 22 nt, Human
cuucagagugacucagcaucuu

SEQ ID NO: 123988 - RNA, 22 nt, Human
ggcagggaauucagagggaagg

SEQ ID NO: 123989 - RNA, 22 nt, Human
uuguuauuauuauuuucguucu

SEQ ID NO: 123990 - RNA, 22 nt, Human
uuuuauaauacccuugacuaau

SEQ ID NO: 123991 - RNA, 22 nt, Human
gauggcaaugcuagaaauuuag

SEQ ID NO: 123992 - RNA, 22 nt, Human
ccauuucacaucccugacaugu

SEQ ID NO: 123993 - RNA, 22 nt, Human
uccuugaauugcguccacaaga

SEQ ID NO: 123994 - RNA, 22 nt, Human
agaauacaauuguucaguaaua

SEQ ID NO: 123995 - RNA, 22 nt, Human
gggagaguagcuggaagguucu

SEQ ID NO: 123996 - RNA, 22 nt, Human
ccacccugguuacugugccagg

SEQ ID NO: 123997 - RNA, 21 nt, Human
ucucauuuuaacacagaguug

SEQ ID NO: 123998 - RNA, 22 nt, Human
uguuuuuuagagugauacuuuu

SEQ ID NO: 123999 - RNA, 22 nt, Human
ccuucugcuggucaucccagug

SEQ ID NO: 124000 - RNA, 22 nt, Human
cuucuuuuggggaugaaaaugg

SEQ ID NO: 124001 - RNA, 17 nt, Human
aguuacugcacuugcca

SEQ ID NO: 124002 - RNA, 22 nt, Human
ccaggcagaggggucuggagca

SEQ ID NO: 124003 - RNA, 22 nt, Human
aggcaguggagcuggaauaggc

SEQ ID NO: 124004 - RNA, 22 nt, Human
uuuuccuucuuccugccuugcc

SEQ ID NO: 124005 - RNA, 21 nt, Human
uuucauuaguacaucaauuug

SEQ ID NO: 124006 - RNA, 22 nt, Human
ucacuguuucaccgucugaagg

SEQ ID NO: 124007 - RNA, 22 nt, Human
uucugcuuuaaagcucauguuu

SEQ ID NO: 124008 - RNA, 22 nt, Human
gcuuucagggucacugucaaca

SEQ ID NO: 124009 - RNA, 22 nt, Human
uuauuucaggcauuuguaaaug

SEQ ID NO: 124010 - RNA, 22 nt, Human
aauuuauccuuuugcuaaagca

SEQ ID NO: 124011 - RNA, 22 nt, Human
aagaggaauaauaaaaauugca

SEQ ID NO: 124012 - RNA, 22 nt, Human
ggcucacuguaccugccgccgc

SEQ ID NO: 124013 - RNA, 20 nt, Human
accccuccccacuccucgcc

SEQ ID NO: 124014 - RNA, 22 nt, Human
ggcagggagagcgccgccaugc

SEQ ID NO: 124015 - RNA, 22 nt, Human
aacaaaacauuuuacgaauaua

SEQ ID NO: 124016 - RNA, 22 nt, Human
gauguuaauauguuucaccaaa

SEQ ID NO: 124017 - RNA, 22 nt, Human
guuuucuaaaacacauauaagu

SEQ ID NO: 124018 - RNA, 22 nt, Human
aagaggaggcuggaauccuaaa

SEQ ID NO: 124019 - RNA, 22 nt, Human
ccugccugggcucacuugccag

SEQ ID NO: 124020 - RNA, 22 nt, Human
gaaagagaugucguuugucuuc

SEQ ID NO: 124021 - RNA, 20 nt, Human
gcauggcuggcugcugucug

SEQ ID NO: 124022 - RNA, 22 nt, Human
auugacagaaaauuggauggca

SEQ ID NO: 124023 - RNA, 22 nt, Human
gaggagcugggucagggagaca

SEQ ID NO: 124024 - RNA, 22 nt, Human
uagacugugagcuccuugaggg

SEQ ID NO: 124025 - RNA, 18 nt, Human
uuuaauaagccuguuaug

SEQ ID NO: 124026 - RNA, 23 nt, Human
uuugcaaauuggacacaaccaca

SEQ ID NO: 124027 - RNA, 22 nt, Human
cagcuuguucugaccugugauu

SEQ ID NO: 124028 - RNA, 22 nt, Human
uuuucugauccuucuaacuuga

SEQ ID NO: 124029 - RNA, 22 nt, Human
uaggauauuuuagaaugguaca

SEQ ID NO: 124030 - RNA, 22 nt, Human
ucaccauguacaugaagggcgg

SEQ ID NO: 124031 - RNA, 22 nt, Human
uuuaaugucuuggaaaaagacu

SEQ ID NO: 124032 - RNA, 22 nt, Human
cccagaggcugaguugggagca

SEQ ID NO: 124033 - RNA, 20 nt, Human
gagaaugucauuccuuuuuu

SEQ ID NO: 124034 - RNA, 22 nt, Human
gaaggaaaagacgugcuaagua

SEQ ID NO: 124035 - RNA, 22 nt, Human
agauuuucuuuuccaucuuugu

SEQ ID NO: 124036 - RNA, 22 nt, Human
aaaucuuucacauauuuuuuau

SEQ ID NO: 124037 - RNA, 22 nt, Human
ggcagaggagcuggaaacaugg

SEQ ID NO: 124038 - RNA, 23 nt, Human
ggccuuuuuaaccgcgagcgaca

SEQ ID NO: 124039 - RNA, 22 nt, Human
uuauauuaaaaaucgcuaacag

SEQ ID NO: 124040 - RNA, 22 nt, Human
ugaaaaaugcuuuaaugcaugu

SEQ ID NO: 124041 - RNA, 22 nt, Human
uucaauuacaucagaaucuaaa

SEQ ID NO: 124042 - RNA, 22 nt, Human
ugggccaaaugucugcauaagu

SEQ ID NO: 124043 - RNA, 22 nt, Human
gcauccaaggagcagaagugau

SEQ ID NO: 124044 - RNA, 22 nt, Human
uguucugauggauuacaugucu

SEQ ID NO: 124045 - RNA, 22 nt, Human
uggagagauagucauucuagag

SEQ ID NO: 124046 - RNA, 22 nt, Human
aaugaaugaaugaaugauuaug

SEQ ID NO: 124047 - RNA, 19 nt, Human
ugguggaggugcaccugac

SEQ ID NO: 124048 - RNA, 22 nt, Human
ugcauucugaacguaaauguga

SEQ ID NO: 124049 - RNA, 22 nt, Human
uggcgcgcagccugcuggugcu

SEQ ID NO: 124050 - RNA, 22 nt, Human
uuuuagaagcauuuaugagauu

SEQ ID NO: 124051 - RNA, 22 nt, Human
cauauacauauacaugcauaca

SEQ ID NO: 124052 - RNA, 22 nt, Human
uaguucugaauagcauugaaga

SEQ ID NO: 124053 - RNA, 20 nt, Human
uuuuuuaaauagagcuguug

SEQ ID NO: 124054 - RNA, 22 nt, Human
acucagcaccuagaaagugugc

SEQ ID NO: 124055 - RNA, 22 nt, Human
uuuucaaucaaguuuauuuaua

SEQ ID NO: 124056 - RNA, 22 nt, Human
cagcacugcccuaccccuccac

SEQ ID NO: 124057 - RNA, 22 nt, Human
uuuaaauuucugaaucuugagg

SEQ ID NO: 124058 - RNA, 22 nt, Human
uucuagcucauggugacagauc

SEQ ID NO: 124059 - RNA, 22 nt, Human
gugucccaaagauuagaaauca

SEQ ID NO: 124060 - RNA, 22 nt, Human
uuauauuuuauuuaauuaaaua

SEQ ID NO: 124061 - RNA, 22 nt, Human
aguauuuuaaaauacauuaucc

SEQ ID NO: 124062 - RNA, 22 nt, Human
auuuaaagaguaauacaaucca

SEQ ID NO: 124063 - RNA, 22 nt, Human
gccacucaguuuaggggcaagc

SEQ ID NO: 124064 - RNA, 22 nt, Human
gaugauaacagcauuucaacug

SEQ ID NO: 124065 - RNA, 22 nt, Human
agaugaugugugucuucagcua

SEQ ID NO: 124066 - RNA, 22 nt, Human
aaaacauuuaggguuuuuuuua

SEQ ID NO: 124067 - RNA, 22 nt, Human
uccagaaagccguugacuuauu

SEQ ID NO: 124068 - RNA, 22 nt, Human
auucaucuguacuucaauaucu

SEQ ID NO: 124069 - RNA, 22 nt, Human
cgaaaaagaagugcaccauguu

SEQ ID NO: 124070 - RNA, 22 nt, Human
uaccuggauaaauguacaaccg

SEQ ID NO: 124071 - RNA, 22 nt, Human
aaaauauuuaucuagcucuuaa

SEQ ID NO: 124072 - RNA, 22 nt, Human
guuuuucuuugauuuagaacca

SEQ ID NO: 124073 - RNA, 22 nt, Human
cagagcagaaaccugggugauu

SEQ ID NO: 124074 - RNA, 22 nt, Human
agcagggagacagugcagcauu

SEQ ID NO: 124075 - RNA, 22 nt, Human
acagagggagugacggccaacc

SEQ ID NO: 124076 - RNA, 22 nt, Human
ggagacagugacuuagagacug

SEQ ID NO: 124077 - RNA, 22 nt, Human
guggaggguuugcaaugugcag

SEQ ID NO: 124078 - RNA, 17 nt, Human
agcagcuggguugaucu

SEQ ID NO: 124079 - RNA, 22 nt, Human
augggagggugaggaggcagcu

SEQ ID NO: 124080 - RNA, 22 nt, Human
aagagaaacauauggccagauu

SEQ ID NO: 124081 - RNA, 22 nt, Human
aaaucauagccaugaacauuug

SEQ ID NO: 124082 - RNA, 22 nt, Human
auuuuuuuaggcugucagccgc

SEQ ID NO: 124083 - RNA, 22 nt, Human
ugaaauuuuuuggagauaauuu

SEQ ID NO: 124084 - RNA, 22 nt, Human
gcucagccuuuuguucuauuca

SEQ ID NO: 124085 - RNA, 22 nt, Human
aaaagguuauagcuuugccuug

SEQ ID NO: 124086 - RNA, 22 nt, Human
cacaauuuccauugagcagcag

SEQ ID NO: 124087 - RNA, 22 nt, Human
augaggguggggaaugggccau

SEQ ID NO: 124088 - RNA, 22 nt, Human
aagccuccgugcugcuggaucu

SEQ ID NO: 124089 - RNA, 17 nt, Human
ggaagaaaaggaucauc

SEQ ID NO: 124090 - RNA, 22 nt, Human
aaucacuuagaacccaggaagu

SEQ ID NO: 124091 - RNA, 22 nt, Human
uucuauaagagaugaauacagu

SEQ ID NO: 124092 - RNA, 22 nt, Human
agaggggaaggaugugauguga

SEQ ID NO: 124093 - RNA, 22 nt, Human
auggagugggaggacaugaagg

SEQ ID NO: 124094 - RNA, 22 nt, Human
uauuguauuagcucuuggagau

SEQ ID NO: 124095 - RNA, 22 nt, Human
uggcagcauuuuuuccagaaca

SEQ ID NO: 124096 - RNA, 22 nt, Human
cacugguugccucuuucuguuc

SEQ ID NO: 124097 - RNA, 22 nt, Human
ugugaagaauuaaugugaauca

SEQ ID NO: 124098 - RNA, 22 nt, Human
uaguggaaccuucuaaaugacg

SEQ ID NO: 124099 - RNA, 22 nt, Human
uuuacaaggcaguuauuuuccu

SEQ ID NO: 124100 - RNA, 22 nt, Human
uuuuaaaagguugcuguuauaa

SEQ ID NO: 124101 - RNA, 22 nt, Human
ccaugauguugccuacacugcu

SEQ ID NO: 124102 - RNA, 22 nt, Human
cgaggagguccaggagcaguag

SEQ ID NO: 124103 - RNA, 22 nt, Human
uccuuucaaauuuauuugacau

SEQ ID NO: 124104 - RNA, 22 nt, Human
cuuuuucuugugguuaauaucu

SEQ ID NO: 124105 - RNA, 22 nt, Human
ggcaagcacugggugucuuagc

SEQ ID NO: 124106 - RNA, 22 nt, Human
gcuggucuggcaauccucaugg

SEQ ID NO: 124107 - RNA, 22 nt, Human
aggaggaggacucgccaggcca

SEQ ID NO: 124108 - RNA, 22 nt, Human
cuucauaagauuguugugagga

SEQ ID NO: 124109 - RNA, 18 nt, Human
ggugagggagcuggaagc

SEQ ID NO: 124110 - RNA, 22 nt, Human
aagugugugugcgcaugugcau

SEQ ID NO: 124111 - RNA, 22 nt, Human
cuggccagccucccagguaccc

SEQ ID NO: 124112 - RNA, 22 nt, Human
caacaaguugauuucacgcugc

SEQ ID NO: 124113 - RNA, 22 nt, Human
agcggaggaggcggagcaggga

SEQ ID NO: 124114 - RNA, 22 nt, Human
gcccagccucagggcaucagcu

SEQ ID NO: 124115 - RNA, 17 nt, Human
uagccagcuugugauuu

SEQ ID NO: 124116 - RNA, 22 nt, Human
ggaaggugagugcugugugauu

SEQ ID NO: 124117 - RNA, 22 nt, Human
uaugugaaauggaauauagaaa

SEQ ID NO: 124118 - RNA, 22 nt, Human
gcuucuguuaggauguggcuua

SEQ ID NO: 124119 - RNA, 22 nt, Human
cagggcaucucugaaucuucac

SEQ ID NO: 124120 - RNA, 22 nt, Human
ucagcucucucuuggugaucuc

SEQ ID NO: 124121 - RNA, 23 nt, Human
gccaaacugcccguucucucugc

SEQ ID NO: 124122 - RNA, 22 nt, Human
cuaaaccaauauauuuucuucc

SEQ ID NO: 124123 - RNA, 22 nt, Human
guuauuuugucuuguucaugaa

SEQ ID NO: 124124 - RNA, 22 nt, Human
ugagggucgcaagcaccaggcc

SEQ ID NO: 124125 - RNA, 22 nt, Human
ggcagagcugugcgcccaccca

SEQ ID NO: 124126 - RNA, 22 nt, Human
cuggaaaaauggauccugucuu

SEQ ID NO: 124127 - RNA, 22 nt, Human
gaggaggagaagcggcggcgga

SEQ ID NO: 124128 - RNA, 22 nt, Human
auacacuucauguuuucaucug

SEQ ID NO: 124129 - RNA, 22 nt, Human
uuccuguggggugucaucauag

SEQ ID NO: 124130 - RNA, 22 nt, Human
uugaccagaaaaguuaguaauu

SEQ ID NO: 124131 - RNA, 22 nt, Human
gaggaaaauggaguguaauuaa

SEQ ID NO: 124132 - RNA, 22 nt, Human
cagaaacacuguauuuagggaa

SEQ ID NO: 124133 - RNA, 22 nt, Human
gguggggacuuggggucagcgg

SEQ ID NO: 124134 - RNA, 22 nt, Human
caacuucugcuuucuuccuugc

SEQ ID NO: 124135 - RNA, 22 nt, Human
ugcuuggauuuccaaaugguuu

SEQ ID NO: 124136 - RNA, 22 nt, Human
gccugcugggcucuuccugcug

SEQ ID NO: 124137 - RNA, 22 nt, Human
ggcuagggagacagagggcaug

SEQ ID NO: 124138 - RNA, 22 nt, Human
uggggcuggccaggaggagucu

SEQ ID NO: 124139 - RNA, 22 nt, Human
uggcagcucauuuggaaaugga

SEQ ID NO: 124140 - RNA, 22 nt, Human
cagagaggagcacaaagugaag

SEQ ID NO: 124141 - RNA, 22 nt, Human
acuuuauacuagugauaguuug

SEQ ID NO: 124142 - RNA, 21 nt, Human
gggagaguagcgguagggagg

SEQ ID NO: 124143 - RNA, 22 nt, Human
acuuugugaauagaacuggaug

SEQ ID NO: 124144 - RNA, 22 nt, Human
acuguugagggaagcagaugaa

SEQ ID NO: 124145 - RNA, 22 nt, Human
uaaaaugcucagauaaauauau

SEQ ID NO: 124146 - RNA, 22 nt, Human
gaguucuagauguauuauuaau

SEQ ID NO: 124147 - RNA, 22 nt, Human
cagugcucauagcuguuccucc

SEQ ID NO: 124148 - RNA, 22 nt, Human
uuuaacauaugaaagaauauuu

SEQ ID NO: 124149 - RNA, 19 nt, Human
uccaccgcgugcaccucua

SEQ ID NO: 124150 - RNA, 22 nt, Human
ugagggauuucuggccuuaacu

SEQ ID NO: 124151 - RNA, 22 nt, Human
uuccucauuuggcacaucugag

SEQ ID NO: 124152 - RNA, 22 nt, Human
gaggagagcuggccagguuucu

SEQ ID NO: 124153 - RNA, 22 nt, Human
cuagcacagugcuuggcacaca

SEQ ID NO: 124154 - RNA, 22 nt, Human
ggggaggguuuggaugagaguc

SEQ ID NO: 124155 - RNA, 22 nt, Human
gaauuccaggugagagaaggua

SEQ ID NO: 124156 - RNA, 22 nt, Human
guagaaaauagauugucucuug

SEQ ID NO: 124157 - RNA, 22 nt, Human
aggggaggggaguaucaggauu

SEQ ID NO: 124158 - RNA, 22 nt, Human
uuauuuuauaaagagaagacuu

SEQ ID NO: 124159 - RNA, 22 nt, Human
auguuuucuugucuggagaagu

SEQ ID NO: 124160 - RNA, 22 nt, Human
uugaauaguuuuggauagcaua

SEQ ID NO: 124161 - RNA, 22 nt, Human
ccuuuuuagaugugcgaauguu

SEQ ID NO: 124162 - RNA, 22 nt, Human
caggagagucucugucuguacu

SEQ ID NO: 124163 - RNA, 19 nt, Human
uggaggcacuaacaaacuc

SEQ ID NO: 124164 - RNA, 22 nt, Human
agaguguagugaaaagagauua

SEQ ID NO: 124165 - RNA, 22 nt, Human
ugccuaguuuaaaucauuuucu

SEQ ID NO: 124166 - RNA, 22 nt, Human
aauggcaagccacaugcuuuuc

SEQ ID NO: 124167 - RNA, 22 nt, Human
ccagcugcugcaccgugcaugg

SEQ ID NO: 124168 - RNA, 22 nt, Human
ucgagaccagcuagaaggaagu

SEQ ID NO: 124169 - RNA, 22 nt, Human
guggcaguaaagcuggaaaagu

SEQ ID NO: 124170 - RNA, 22 nt, Human
aguucauaucuacuuuuccauc

SEQ ID NO: 124171 - RNA, 22 nt, Human
auguuugugauugcugaaaaga

SEQ ID NO: 124172 - RNA, 22 nt, Human
ggaggaggggcggggaggggag

SEQ ID NO: 124173 - RNA, 22 nt, Human
gggaaaaaggaaccuuauuacu

SEQ ID NO: 124174 - RNA, 22 nt, Human
guuuuguagucuggagacuguc

SEQ ID NO: 124175 - RNA, 22 nt, Human
ugcagaggagcuggaaggcugg

SEQ ID NO: 124176 - RNA, 22 nt, Human
auuuucuucauuuugauuguau

SEQ ID NO: 124177 - RNA, 20 nt, Human
guugggagaagugucagcug

SEQ ID NO: 124178 - RNA, 22 nt, Human
ugguccaccgccucauucucug

SEQ ID NO: 124179 - RNA, 22 nt, Human
auagaaauagacaaugcaaaga

SEQ ID NO: 124180 - RNA, 22 nt, Human
cuucucuuggguguggugucuu

SEQ ID NO: 124181 - RNA, 22 nt, Human
auuugcauguuuauuucuuaga

SEQ ID NO: 124182 - RNA, 22 nt, Human
caacaagcgcucagagcaaagc

SEQ ID NO: 124183 - RNA, 22 nt, Human
gcuuuucaaguuacaauuagcu

SEQ ID NO: 124184 - RNA, 22 nt, Human
ugggauggacuuuagagaaucg

SEQ ID NO: 124185 - RNA, 22 nt, Human
aauaaugguuugauucucacau

SEQ ID NO: 124186 - RNA, 22 nt, Human
acauauggcagguugaucaaug

SEQ ID NO: 124187 - RNA, 20 nt, Human
uauuucaaugugccaaguuu

SEQ ID NO: 124188 - RNA, 23 nt, Human
acgggaggcggggcagggcugag

SEQ ID NO: 124189 - RNA, 22 nt, Human
gaggaggcuggagaggccagga

SEQ ID NO: 124190 - RNA, 20 nt, Human
aaagauacuuuuuguaaugg

SEQ ID NO: 124191 - RNA, 22 nt, Human
agguguaauuacucuugcaguu

SEQ ID NO: 124192 - RNA, 22 nt, Human
uacagcuuccucuaugguggcc

SEQ ID NO: 124193 - RNA, 22 nt, Human
agauuaagcauuauaauuauaa

SEQ ID NO: 124194 - RNA, 22 nt, Human
gugguggugaggcaaggggugu

SEQ ID NO: 124195 - RNA, 22 nt, Human
uuucugagccacauauaauuug

SEQ ID NO: 124196 - RNA, 22 nt, Human
gauuuugcuuuagugaaggaag

SEQ ID NO: 124197 - RNA, 22 nt, Human
ggggagggcugagcacgguuga

SEQ ID NO: 124198 - RNA, 22 nt, Human
aucacuagaguuacauugccag

SEQ ID NO: 124199 - RNA, 17 nt, Human
cccugcacccuacucuc

SEQ ID NO: 124200 - RNA, 22 nt, Human
aacgagcugggggggccggggg

SEQ ID NO: 124201 - RNA, 22 nt, Human
ucaccauguuuucauaggaaca

SEQ ID NO: 124202 - RNA, 22 nt, Human
agggcaggguuggugcuggugc

SEQ ID NO: 124203 - RNA, 22 nt, Human
aauauuuugggacugaggaauu

SEQ ID NO: 124204 - RNA, 22 nt, Human
gggcaagaagcuggaagcauuc

SEQ ID NO: 124205 - RNA, 22 nt, Human
ccauuuggccauucaguuguuc

SEQ ID NO: 124206 - RNA, 22 nt, Human
ucgagcucagcagggaggugcg

SEQ ID NO: 124207 - RNA, 22 nt, Human
agcagggagaccaucucuuccu

SEQ ID NO: 124208 - RNA, 22 nt, Human
auguugagaaucucucuucuaa

SEQ ID NO: 124209 - RNA, 22 nt, Human
aagacacuuucuaaauagaagu

SEQ ID NO: 124210 - RNA, 22 nt, Human
acaggcugcccgcuccccaccu

SEQ ID NO: 124211 - RNA, 22 nt, Human
ucuauuguuauccuuuccauuu

SEQ ID NO: 124212 - RNA, 22 nt, Human
ugcauaagguuaaauuagcaga

SEQ ID NO: 124213 - RNA, 22 nt, Human
ggugucucagauuguaaaaugu

SEQ ID NO: 124214 - RNA, 19 nt, Human
ggaacgcugggcuccccuc

SEQ ID NO: 124215 - RNA, 22 nt, Human
ggcugggagguggcgaggaggc

SEQ ID NO: 124216 - RNA, 22 nt, Human
uucuugugugaauauaauuaca

SEQ ID NO: 124217 - RNA, 22 nt, Human
gcuguguaugaugcaggcaccu

SEQ ID NO: 124218 - RNA, 22 nt, Human
uauauaauacacaaauauguac

SEQ ID NO: 124219 - RNA, 22 nt, Human
augaaaacgugugugugugugu

SEQ ID NO: 124220 - RNA, 22 nt, Human
aauauauaugggugcaugucug

SEQ ID NO: 124221 - RNA, 22 nt, Human
auguuuaauuugaaauuuuauu

SEQ ID NO: 124222 - RNA, 22 nt, Human
gugccugcucauucucaauauu

SEQ ID NO: 124223 - RNA, 22 nt, Human
uucuguguauggaagaaugucc

SEQ ID NO: 124224 - RNA, 22 nt, Human
uuccacaugaucauuguaauaa

SEQ ID NO: 124225 - RNA, 22 nt, Human
ggaaauauaagcaguuugugug

SEQ ID NO: 124226 - RNA, 22 nt, Human
gauucuaucauucuguauauua

SEQ ID NO: 124227 - RNA, 22 nt, Human
auauuuuacagcucucguugaa

SEQ ID NO: 124228 - RNA, 22 nt, Human
uagugcuucauucuauugguuu

SEQ ID NO: 124229 - RNA, 22 nt, Human
aggggaggcugggcuggggggc

SEQ ID NO: 124230 - RNA, 22 nt, Human
ggaagcuguugugagugcagca

SEQ ID NO: 124231 - RNA, 22 nt, Human
ugaauuagagugaaggaaagcu

SEQ ID NO: 124232 - RNA, 22 nt, Human
agacuccuucuaagaccucauu

SEQ ID NO: 124233 - RNA, 22 nt, Human
gauacuuuguggaauccuggau

SEQ ID NO: 124234 - RNA, 22 nt, Human
uuucuauuuacagugcuaggua

SEQ ID NO: 124235 - RNA, 23 nt, Human
cagagaaaauagaauaugcugug

SEQ ID NO: 124236 - RNA, 22 nt, Human
cuaaaaauguucuaguaguuca

SEQ ID NO: 124237 - RNA, 22 nt, Human
aucuaaaacuacgaauacuacc

SEQ ID NO: 124238 - RNA, 22 nt, Human
acagagcucccagccaucuccu

SEQ ID NO: 124239 - RNA, 22 nt, Human
cuucccaucaagcuggaggaug

SEQ ID NO: 124240 - RNA, 22 nt, Human
acuuuaaaucuguugcuuagcu

SEQ ID NO: 124241 - RNA, 20 nt, Human
caacacugcccauuguuugc

SEQ ID NO: 124242 - RNA, 21 nt, Human
ggcugcucgugaugaacuuca

SEQ ID NO: 124243 - RNA, 22 nt, Human
guuuuuaguuuaaguuuuugca

SEQ ID NO: 124244 - RNA, 22 nt, Human
cugucucugauaagcucgaggg

SEQ ID NO: 124245 - RNA, 22 nt, Human
gggauggggagcuggaaagggg

SEQ ID NO: 124246 - RNA, 19 nt, Human
aacucugccgaggcaagcc

SEQ ID NO: 124247 - RNA, 22 nt, Human
aaauuuauaacuuaaagugaau

SEQ ID NO: 124248 - RNA, 22 nt, Human
auaaauucuaugauggauuggg

SEQ ID NO: 124249 - RNA, 22 nt, Human
ugcauguuuuaagugaagcuga

SEQ ID NO: 124250 - RNA, 22 nt, Human
ccugcuggagucuaguuggucu

SEQ ID NO: 124251 - RNA, 22 nt, Human
agguuuggaaguggcgauccau

SEQ ID NO: 124252 - RNA, 22 nt, Human
ggcugcagggaacaggaugggu

SEQ ID NO: 124253 - RNA, 22 nt, Human
aguuuaaauuguucuaucagaa

SEQ ID NO: 124254 - RNA, 22 nt, Human
auuuuugguuauaaaauaguuu

SEQ ID NO: 124255 - RNA, 22 nt, Human
aggcagaugggagcuggaaguu

SEQ ID NO: 124256 - RNA, 23 nt, Human
gcuuugaaaaugcuuucuuccag

SEQ ID NO: 124257 - RNA, 22 nt, Human
uacaacuuacuugaauggcuuu

SEQ ID NO: 124258 - RNA, 22 nt, Human
auacuaagcucauuacauuuug

SEQ ID NO: 124259 - RNA, 19 nt, Human
agagucuccacuccacuug

SEQ ID NO: 124260 - RNA, 22 nt, Human
uacauuugauuuuugcuucuuu

SEQ ID NO: 124261 - RNA, 19 nt, Human
gaguaaaacuagagagaaa

SEQ ID NO: 124262 - RNA, 22 nt, Human
auucauucugaccucaagagaa

SEQ ID NO: 124263 - RNA, 22 nt, Human
uagaccugugggggcagcgggc

SEQ ID NO: 124264 - RNA, 22 nt, Human
uuuuuauaagauuuaaaaugua

SEQ ID NO: 124265 - RNA, 22 nt, Human
cagcaugguggagcugcucuuu

SEQ ID NO: 124266 - RNA, 22 nt, Human
gagguagaggaaaagauuauca

SEQ ID NO: 124267 - RNA, 22 nt, Human
guggugguguuggugacaaguu

SEQ ID NO: 124268 - RNA, 22 nt, Human
uugugcauuuuguuuuacuuau

SEQ ID NO: 124269 - RNA, 22 nt, Human
uaugaauauaccacaauuuagg

SEQ ID NO: 124270 - RNA, 23 nt, Human
aguggaggucgggguggggagac

SEQ ID NO: 124271 - RNA, 22 nt, Human
uggucucuacggaggaaagcug

SEQ ID NO: 124272 - RNA, 22 nt, Human
acauauaugugcauacaacuau

SEQ ID NO: 124273 - RNA, 23 nt, Human
guuauugcuggugcuggccagcc

SEQ ID NO: 124274 - RNA, 22 nt, Human
agcagcugagccccagcuguga

SEQ ID NO: 124275 - RNA, 22 nt, Human
ugcaaauuuuuuuauuuuuccu

SEQ ID NO: 124276 - RNA, 22 nt, Human
auauuugucuguuuuaguggca

SEQ ID NO: 124277 - RNA, 22 nt, Human
ccauagucacuuguccucuuuu

SEQ ID NO: 124278 - RNA, 22 nt, Human
aaaugcuuuaauugaguucaug

SEQ ID NO: 124279 - RNA, 22 nt, Human
uggucucaaagcaaggaaggaa

SEQ ID NO: 124280 - RNA, 22 nt, Human
uuuucauagccagaaacugaaa

SEQ ID NO: 124281 - RNA, 22 nt, Human
gggagcuggagcuggaagacuc

SEQ ID NO: 124282 - RNA, 22 nt, Human
aggcaacagacaggcuugguuc

SEQ ID NO: 124283 - RNA, 22 nt, Human
ucacuucuaugaucugucucuu

SEQ ID NO: 124284 - RNA, 22 nt, Human
ucagacacacaacuucugcuua

SEQ ID NO: 124285 - RNA, 22 nt, Human
uugggauucugucagugugugu

SEQ ID NO: 124286 - RNA, 22 nt, Human
acuuagaacagccuaugggaag

SEQ ID NO: 124287 - RNA, 22 nt, Human
cagaaaacauuguguguauaag

SEQ ID NO: 124288 - RNA, 22 nt, Human
uucacccuucucuggcuuucag

SEQ ID NO: 124289 - RNA, 22 nt, Human
ucagucacugucucagacagga

SEQ ID NO: 124290 - RNA, 22 nt, Human
gggaaaaaggaguuagagauaa

SEQ ID NO: 124291 - RNA, 22 nt, Human
uuaggggcuuaggcagaguuug

SEQ ID NO: 124292 - RNA, 22 nt, Human
gagaaaaauuucuuugcugcac

SEQ ID NO: 124293 - RNA, 22 nt, Human
uccuccauguugugcacuugaa

SEQ ID NO: 124294 - RNA, 16 nt, Human
acauggcacacaguuu

SEQ ID NO: 124295 - RNA, 22 nt, Human
auguuccaugacuaugcaugaa

SEQ ID NO: 124296 - RNA, 22 nt, Human
cagcucuggcuauugaggacca

SEQ ID NO: 124297 - RNA, 22 nt, Human
aaugaauaaauuuuaaagacag

SEQ ID NO: 124298 - RNA, 22 nt, Human
ucagucacugugaaaugaauuu

SEQ ID NO: 124299 - RNA, 22 nt, Human
accuuuggaggacuagggucau

SEQ ID NO: 124300 - RNA, 22 nt, Human
ugaaaaauauuuuuagaaauaa

SEQ ID NO: 124301 - RNA, 22 nt, Human
ugauguuucugaagggguuacu

SEQ ID NO: 124302 - RNA, 22 nt, Human
uuuugcuucuaguauauuuuuu

SEQ ID NO: 124303 - RNA, 20 nt, Human
ccuuguggaugucuuuuuug

SEQ ID NO: 124304 - RNA, 22 nt, Human
agucuagagcuuuuaucaggcc

SEQ ID NO: 124305 - RNA, 22 nt, Human
ugguggagucugggggaggcuu

SEQ ID NO: 124306 - RNA, 22 nt, Human
auggagggguuguugcuugagu

SEQ ID NO: 124307 - RNA, 22 nt, Human
gacggaggacaucagcaguguc

SEQ ID NO: 124308 - RNA, 22 nt, Human
cagacagaaggcuccuugaggu

SEQ ID NO: 124309 - RNA, 22 nt, Human
guccuguguaaguacuugcuca

SEQ ID NO: 124310 - RNA, 22 nt, Human
gauaagugauucugauucacau

SEQ ID NO: 124311 - RNA, 22 nt, Human
ugcaggaacucgaaaacuauag

SEQ ID NO: 124312 - RNA, 22 nt, Human
ggacauaguugcuauggagagu

SEQ ID NO: 124313 - RNA, 22 nt, Human
aggaaauaggaccagacaaagc

SEQ ID NO: 124314 - RNA, 22 nt, Human
cugccacuaccaugcuggauga

SEQ ID NO: 124315 - RNA, 22 nt, Human
aucauuugaacagaauuuguuu

SEQ ID NO: 124316 - RNA, 22 nt, Human
ucugacuucuuuuauuaucauu

SEQ ID NO: 124317 - RNA, 22 nt, Human
gcagagcugucuaagucacuuc

SEQ ID NO: 124318 - RNA, 22 nt, Human
ugagggaggggaaugugugcag

SEQ ID NO: 124319 - RNA, 21 nt, Human
cuauaaaaaugguucuuugcg

SEQ ID NO: 124320 - RNA, 22 nt, Human
gcucccaauuccuuuuacaauu

SEQ ID NO: 124321 - RNA, 18 nt, Human
gacaaaaguacagacaga

SEQ ID NO: 124322 - RNA, 18 nt, Human
uucaggcucuugcaugaa

SEQ ID NO: 124323 - RNA, 22 nt, Human
uggcaagcuguuggcagauagc

SEQ ID NO: 124324 - RNA, 22 nt, Human
auguucucagguuguauuuauu

SEQ ID NO: 124325 - RNA, 22 nt, Human
uccuucagaggacggcagccag

SEQ ID NO: 124326 - RNA, 22 nt, Human
aggcaggggagcuggaagggua

SEQ ID NO: 124327 - RNA, 22 nt, Human
ucugaguuaaaauuccagaggu

SEQ ID NO: 124328 - RNA, 22 nt, Human
cauauuaugcauguuguucuuu

SEQ ID NO: 124329 - RNA, 22 nt, Human
gguggcagaggaggcgggagag

SEQ ID NO: 124330 - RNA, 22 nt, Human
uucacuguucuuagagaagacc

SEQ ID NO: 124331 - RNA, 22 nt, Human
gcugcccauugcucucccacuc

SEQ ID NO: 124332 - RNA, 22 nt, Human
gagagaggggaagagaagcucu

SEQ ID NO: 124333 - RNA, 22 nt, Human
gaggagagaaauguuuucugug

SEQ ID NO: 124334 - RNA, 22 nt, Human
uuuugaauaauucagaaacagc

SEQ ID NO: 124335 - RNA, 22 nt, Human
auauguuaugccauuuucaagg

SEQ ID NO: 124336 - RNA, 22 nt, Human
ggagguguguucuguuuuagug

SEQ ID NO: 124337 - RNA, 22 nt, Human
uacaaaauucaaauaauguuug

SEQ ID NO: 124338 - RNA, 22 nt, Human
cauaaauuuuaccuuguaagug

SEQ ID NO: 124339 - RNA, 22 nt, Human
auuauucaaggugaggguaaaa

SEQ ID NO: 124340 - RNA, 22 nt, Human
gagaaggagcagaaaaucuccu

SEQ ID NO: 124341 - RNA, 18 nt, Human
acaaaaauagugcuuugg

SEQ ID NO: 124342 - RNA, 22 nt, Human
aaacccaggguuuugucuuccc

SEQ ID NO: 124343 - RNA, 22 nt, Human
gaauauuuaucucagcugcaga

SEQ ID NO: 124344 - RNA, 22 nt, Human
ugagggaguguggauacaguag

SEQ ID NO: 124345 - RNA, 22 nt, Human
caggggcuccaggugagccugg

SEQ ID NO: 124346 - RNA, 22 nt, Human
cacccccaggcuccccuucugg

SEQ ID NO: 124347 - RNA, 17 nt, Human
augcccagggcucccug

SEQ ID NO: 124348 - RNA, 23 nt, Human
ucugccuccuaauuguugguguc

SEQ ID NO: 124349 - RNA, 22 nt, Human
ccagccuucugaugggacccuc

SEQ ID NO: 124350 - RNA, 22 nt, Human
uuccucauucuggggcauguug

SEQ ID NO: 124351 - RNA, 22 nt, Human
gugguggggaguuggauggaag

SEQ ID NO: 124352 - RNA, 22 nt, Human
aaauuuuguugaaaaauauuuu

SEQ ID NO: 124353 - RNA, 22 nt, Human
aacccugaacuuaguucuagga

SEQ ID NO: 124354 - RNA, 22 nt, Human
cagagacuuuugcuccgauucu

SEQ ID NO: 124355 - RNA, 22 nt, Human
acagcugagaugcuacuugugg

SEQ ID NO: 124356 - RNA, 22 nt, Human
uaacaguauacuacaucauauu

SEQ ID NO: 124357 - RNA, 22 nt, Human
guacuugauucauuauugcauu

SEQ ID NO: 124358 - RNA, 22 nt, Human
augcggcugugggggaauggga

SEQ ID NO: 124359 - RNA, 22 nt, Human
aguaauaaacaacucauuuugg

SEQ ID NO: 124360 - RNA, 22 nt, Human
uggugcucucgauauauaaggc

SEQ ID NO: 124361 - RNA, 22 nt, Human
uaaagcacucaaaauuguagcu

SEQ ID NO: 124362 - RNA, 22 nt, Human
aggaaaaagaagaaaagaauca

SEQ ID NO: 124363 - RNA, 22 nt, Human
gggccaaggggagcuggaaggg

SEQ ID NO: 124364 - RNA, 22 nt, Human
gauuuuaaaagauguauaaggu

SEQ ID NO: 124365 - RNA, 22 nt, Human
uuacuuaucugaugugauuuuu

SEQ ID NO: 124366 - RNA, 22 nt, Human
guuuuguucaugaacauugggu

SEQ ID NO: 124367 - RNA, 23 nt, Human
uguaaaacaccguuauugcaccu

SEQ ID NO: 124368 - RNA, 22 nt, Human
uuucaugauuaacuuagugaau

SEQ ID NO: 124369 - RNA, 22 nt, Human
uugucucuacagagaguaguag

SEQ ID NO: 124370 - RNA, 18 nt, Human
aaacccacguauucaggc

SEQ ID NO: 124371 - RNA, 22 nt, Human
uggggcugguaccguaauauau

SEQ ID NO: 124372 - RNA, 22 nt, Human
uuauuuaaguauuuauugaagu

SEQ ID NO: 124373 - RNA, 22 nt, Human
accugagauuuuuacucaguaa

SEQ ID NO: 124374 - RNA, 22 nt, Human
cagguugucuaauuccaagggg

SEQ ID NO: 124375 - RNA, 22 nt, Human
augaguuaaguagcccuucaug

SEQ ID NO: 124376 - RNA, 22 nt, Human
ugcauugccucuauucauuaua

SEQ ID NO: 124377 - RNA, 22 nt, Human
agaugggacauuugucccuagg

SEQ ID NO: 124378 - RNA, 22 nt, Human
gaaaauaguucaucacaaugau

SEQ ID NO: 124379 - RNA, 22 nt, Human
uucugaaccauugagcacugcc

SEQ ID NO: 124380 - RNA, 22 nt, Human
guggagaaagcuggaaucugag

SEQ ID NO: 124381 - RNA, 22 nt, Human
aaaggaaacuaugaaucucugg

SEQ ID NO: 124382 - RNA, 22 nt, Human
aagacagugacagucacaauug

SEQ ID NO: 124383 - RNA, 22 nt, Human
aguauuuaguauucuauauuag

SEQ ID NO: 124384 - RNA, 22 nt, Human
uuucagagaaagcccaaagacu

SEQ ID NO: 124385 - RNA, 22 nt, Human
uccaugcaguagaggcgcuggg

SEQ ID NO: 124386 - RNA, 22 nt, Human
uuucuaaaauuacugcagucgg

SEQ ID NO: 124387 - RNA, 20 nt, Human
ugcagcucccccgcaguuuc

SEQ ID NO: 124388 - RNA, 22 nt, Human
gagcagcucgagaaggaagcag

SEQ ID NO: 124389 - RNA, 22 nt, Human
cucacugucagcugcagggcuu

SEQ ID NO: 124390 - RNA, 20 nt, Human
cuggaguguagcaguggcug

SEQ ID NO: 124391 - RNA, 22 nt, Human
uugaauaaggcauaaagauacu

SEQ ID NO: 124392 - RNA, 22 nt, Human
auuagugguguauuuggcacua

SEQ ID NO: 124393 - RNA, 22 nt, Human
ugaagacaguuuuacucaugag

SEQ ID NO: 124394 - RNA, 22 nt, Human
auggaagagacaaugcuaucug

SEQ ID NO: 124395 - RNA, 22 nt, Human
auuuuugguuucaccugcacgc

SEQ ID NO: 124396 - RNA, 22 nt, Human
cuaaaacuuuuccaaauuaugu

SEQ ID NO: 124397 - RNA, 22 nt, Human
cacuauguacauaauagcugcu

SEQ ID NO: 124398 - RNA, 22 nt, Human
accuccauggcccacaucuagu

SEQ ID NO: 124399 - RNA, 22 nt, Human
auauuuuugcagaauuuuucgu

SEQ ID NO: 124400 - RNA, 22 nt, Human
ggcagggacugggauauggaga

SEQ ID NO: 124401 - RNA, 20 nt, Human
ggagagggaaaggcuguacu

SEQ ID NO: 124402 - RNA, 22 nt, Human
gacuggcucuaucaggauaaau

SEQ ID NO: 124403 - RNA, 22 nt, Human
auggaguguggccaggcaguaa

SEQ ID NO: 124404 - RNA, 22 nt, Human
uuaacauuguccuuagcagauu

SEQ ID NO: 124405 - RNA, 22 nt, Human
caagaaaaaacaugaugagugu

SEQ ID NO: 124406 - RNA, 22 nt, Human
auaaauuugacagcucuucaug

SEQ ID NO: 124407 - RNA, 22 nt, Human
gagggagagaugcuggaccggg

SEQ ID NO: 124408 - RNA, 22 nt, Human
ucacuguaggaaucucuaaauu

SEQ ID NO: 124409 - RNA, 22 nt, Human
ugaauaaucuuggguauuaaua

SEQ ID NO: 124410 - RNA, 22 nt, Human
uaguuucuucaacugucccagc

SEQ ID NO: 124411 - RNA, 22 nt, Human
aauggcaaaaguuucggaaauu

SEQ ID NO: 124412 - RNA, 22 nt, Human
aggccagggacaaugaggcaga

SEQ ID NO: 124413 - RNA, 22 nt, Human
gacaacuucaguaaaguagauu

SEQ ID NO: 124414 - RNA, 22 nt, Human
cagaguccugcaccagcuccag

SEQ ID NO: 124415 - RNA, 22 nt, Human
gaaccauuuaauggagaugcuc

SEQ ID NO: 124416 - RNA, 22 nt, Human
gccaggagaaaaggcgaaugau

SEQ ID NO: 124417 - RNA, 22 nt, Human
auucuuuucucuaaaugaugaa

SEQ ID NO: 124418 - RNA, 22 nt, Human
agaacccaaggcccagggaugu

SEQ ID NO: 124419 - RNA, 22 nt, Human
cucaaaauccauaaaaucaggu

SEQ ID NO: 124420 - RNA, 22 nt, Human
uugaaaaaaucugaggaggacc

SEQ ID NO: 124421 - RNA, 22 nt, Human
uuuauaauuacguaaaauauuu

SEQ ID NO: 124422 - RNA, 22 nt, Human
uuaucaaaaaauaguacuuuga

SEQ ID NO: 124423 - RNA, 17 nt, Human
guucucaaacugacuga

SEQ ID NO: 124424 - RNA, 22 nt, Human
uuuauaaacacaagaugggcuc

SEQ ID NO: 124425 - RNA, 22 nt, Human
acuucccacugcagugacugag

SEQ ID NO: 124426 - RNA, 19 nt, Human
cugggacaaugaaagcauc

SEQ ID NO: 124427 - RNA, 22 nt, Human
ucacuuccuugcagcuguagaa

SEQ ID NO: 124428 - RNA, 22 nt, Human
auuuuuuuuccugucucuuuca

SEQ ID NO: 124429 - RNA, 22 nt, Human
guauauuuaugagcauuagccu

SEQ ID NO: 124430 - RNA, 20 nt, Human
acccagaguccuccccgcgc

SEQ ID NO: 124431 - RNA, 22 nt, Human
caauaccucuuggugauugggc

SEQ ID NO: 124432 - RNA, 22 nt, Human
uauuaaaagagaaaaagccacc

SEQ ID NO: 124433 - RNA, 22 nt, Human
uacuuaauuuuaaaagcuagau

SEQ ID NO: 124434 - RNA, 22 nt, Human
uuuuuuaaucaaguaggaaaca

SEQ ID NO: 124435 - RNA, 22 nt, Human
uggggcuccuccuggcaggagg

SEQ ID NO: 124436 - RNA, 22 nt, Human
uggcucagcgcggccuggucuu

SEQ ID NO: 124437 - RNA, 22 nt, Human
aggacacuuccugaguggacaa

SEQ ID NO: 124438 - RNA, 22 nt, Human
ucucuucacuuguaugcuauca

SEQ ID NO: 124439 - RNA, 22 nt, Human
ucaaauaugggccagaggaaau

SEQ ID NO: 124440 - RNA, 23 nt, Human
aagaaugcuucugaagagcugcc

SEQ ID NO: 124441 - RNA, 22 nt, Human
uauauauaauguguacagguga

SEQ ID NO: 124442 - RNA, 22 nt, Human
auaaauuugccagcauauguuc

SEQ ID NO: 124443 - RNA, 20 nt, Human
ucuugucuggcagccuggag

SEQ ID NO: 124444 - RNA, 22 nt, Human
uugcagagaacuaaagggagua

SEQ ID NO: 124445 - RNA, 22 nt, Human
aaauguuucauucuauuuuuag

SEQ ID NO: 124446 - RNA, 23 nt, Human
aaugugaaauugaguuuuuguua

SEQ ID NO: 124447 - RNA, 22 nt, Human
ugcucacugcuuguguucaguu

SEQ ID NO: 124448 - RNA, 22 nt, Human
caauguuuuuccuuccuuaaua

SEQ ID NO: 124449 - RNA, 22 nt, Human
aguacuuuuuguucaauugugc

SEQ ID NO: 124450 - RNA, 22 nt, Human
ugagggagggggagccguucua

SEQ ID NO: 124451 - RNA, 22 nt, Human
aguucaugugguuuaacuuaau

SEQ ID NO: 124452 - RNA, 22 nt, Human
acuuugaauuagaauuuugcug

SEQ ID NO: 124453 - RNA, 22 nt, Human
gucucacuucauuuucuuagcc

SEQ ID NO: 124454 - RNA, 22 nt, Human
agccagcauauauauaguugaa

SEQ ID NO: 124455 - RNA, 22 nt, Human
aauuucuuucagcugcuuuaag

SEQ ID NO: 124456 - RNA, 22 nt, Human
guuuauuucuuaucaucacuau

SEQ ID NO: 124457 - RNA, 20 nt, Human
aagacacuguccccacugga

SEQ ID NO: 124458 - RNA, 22 nt, Human
cuuauucuucuggacuuggagu

SEQ ID NO: 124459 - RNA, 22 nt, Human
uauuuuuacuguuugaugauuc

SEQ ID NO: 124460 - RNA, 22 nt, Human
acuuuuccuggguagcuccugg

SEQ ID NO: 124461 - RNA, 22 nt, Human
aaauuaaaguuuuauuuagagc

SEQ ID NO: 124462 - RNA, 22 nt, Human
aagugauuuucccaccaucuac

SEQ ID NO: 124463 - RNA, 22 nt, Human
accuugggcccagaccggcacg

SEQ ID NO: 124464 - RNA, 22 nt, Human
ucaguagcauuuaauguucagu

SEQ ID NO: 124465 - RNA, 22 nt, Human
agagggcaggcugguugggguc

SEQ ID NO: 124466 - RNA, 22 nt, Human
uguaauuugguuagauuucuuu

SEQ ID NO: 124467 - RNA, 22 nt, Human
aagcugccugggaggaagggcu

SEQ ID NO: 124468 - RNA, 22 nt, Human
uggaguuuuaaucuguacagaa

SEQ ID NO: 124469 - RNA, 22 nt, Human
aaaguaaagccuauuuaauaau

SEQ ID NO: 124470 - RNA, 22 nt, Human
auguaugagagauucuuuuauu

SEQ ID NO: 124471 - RNA, 22 nt, Human
caacauuucaaggucuuuagga

SEQ ID NO: 124472 - RNA, 22 nt, Human
cauuuagagaagauuacaagga

SEQ ID NO: 124473 - RNA, 22 nt, Human
uuaaaucaggcaucauuucagu

SEQ ID NO: 124474 - RNA, 20 nt, Human
auggaaacacgcagccccaa

SEQ ID NO: 124475 - RNA, 17 nt, Human
auuguuuuuaauuugca

SEQ ID NO: 124476 - RNA, 22 nt, Human
uuuuagagacagcauggagaaa

SEQ ID NO: 124477 - RNA, 22 nt, Human
aagaaaagguaaccgcuuaucu

SEQ ID NO: 124478 - RNA, 22 nt, Human
aauucugaggccauuuauuucc

SEQ ID NO: 124479 - RNA, 22 nt, Human
auucccucaagagacccacagc

SEQ ID NO: 124480 - RNA, 22 nt, Human
uucugaaacauugcuauuuucc

SEQ ID NO: 124481 - RNA, 22 nt, Human
uucagguuuuuaaguucugccu

SEQ ID NO: 124482 - RNA, 22 nt, Human
cagacagaguuguuucuucucc

SEQ ID NO: 124483 - RNA, 22 nt, Human
cuaaauucuauauccuugcuuc

SEQ ID NO: 124484 - RNA, 22 nt, Human
cauaucuccagguucugcugga

SEQ ID NO: 124485 - RNA, 22 nt, Human
cugauaauaaccauuuuaaaau

SEQ ID NO: 124486 - RNA, 18 nt, Human
cccagaggaaugccugga

SEQ ID NO: 124487 - RNA, 22 nt, Human
aauaauacaauuggugucaugu

SEQ ID NO: 124488 - RNA, 22 nt, Human
uugaauuuagguuuaugugaaa

SEQ ID NO: 124489 - RNA, 22 nt, Human
gauaauuauaggcuaagccacu

SEQ ID NO: 124490 - RNA, 23 nt, Human
aggcagcaugcaacaggccauuu

SEQ ID NO: 124491 - RNA, 22 nt, Human
auuugaaaaucuaugaugugca

SEQ ID NO: 124492 - RNA, 22 nt, Human
agucacuguuuaaucuagcuaa

SEQ ID NO: 124493 - RNA, 22 nt, Human
ugaacuguccuuguugucuaga

SEQ ID NO: 124494 - RNA, 22 nt, Human
ugauauaaaagauucuuauuga

SEQ ID NO: 124495 - RNA, 22 nt, Human
cuuuuucuuaucuuuuucuaug

SEQ ID NO: 124496 - RNA, 22 nt, Human
cggggaggagccagcggaggau

SEQ ID NO: 124497 - RNA, 22 nt, Human
ggccugcuaccagcugugaccu

SEQ ID NO: 124498 - RNA, 22 nt, Human
cucuugugucaccauggauaaa

SEQ ID NO: 124499 - RNA, 22 nt, Human
agugugaguuacaaagugugaa

SEQ ID NO: 124500 - RNA, 22 nt, Human
gucccagaggacagggucacau

SEQ ID NO: 124501 - RNA, 22 nt, Human
aagggaggguaggaagagggag

SEQ ID NO: 124502 - RNA, 22 nt, Human
ucuuuaagugugugccuccagg

SEQ ID NO: 124503 - RNA, 22 nt, Human
acagcagguuauuguuauggca

SEQ ID NO: 124504 - RNA, 22 nt, Human
guaggaaaugaauaagguaccu

SEQ ID NO: 124505 - RNA, 22 nt, Human
gcucugaacugucaugaauugg

SEQ ID NO: 124506 - RNA, 22 nt, Human
agaagaaugguuugaaagauuu

SEQ ID NO: 124507 - RNA, 22 nt, Human
aaaaguuguaauauuuccuuua

SEQ ID NO: 124508 - RNA, 22 nt, Human
gcauucuugucaguggggucag

SEQ ID NO: 124509 - RNA, 22 nt, Human
gaauuacagaguuguuaaguca

SEQ ID NO: 124510 - RNA, 22 nt, Human
uaauuccacacucccgcaagcg

SEQ ID NO: 124511 - RNA, 22 nt, Human
caggaacucggagcccaucucu

SEQ ID NO: 124512 - RNA, 22 nt, Human
uaagcuauuccugaagaagguu

SEQ ID NO: 124513 - RNA, 22 nt, Human
augcuuucucuucuauuucuca

SEQ ID NO: 124514 - RNA, 22 nt, Human
caggggcuuuccuguuuaugga

SEQ ID NO: 124515 - RNA, 22 nt, Human
ugaauuuguaggaauucuccau

SEQ ID NO: 124516 - RNA, 22 nt, Human
acugaacuaaagaaaugggcaa

SEQ ID NO: 124517 - RNA, 22 nt, Human
cauuauucaggcuuuggaauuu

SEQ ID NO: 124518 - RNA, 22 nt, Human
uuggggagaagagcuggucagg

SEQ ID NO: 124519 - RNA, 21 nt, Human
agucaagcugccugcuuggca

SEQ ID NO: 124520 - RNA, 22 nt, Human
uuaauauuaagauauugagugg

SEQ ID NO: 124521 - RNA, 20 nt, Human
auaaauaggauuuucugaca

SEQ ID NO: 124522 - RNA, 22 nt, Human
auauauguauauaugugugugu

SEQ ID NO: 124523 - RNA, 22 nt, Human
caggaaaauaauggugauggga

SEQ ID NO: 124524 - RNA, 22 nt, Human
uuuuaucagagcuugcagugug

SEQ ID NO: 124525 - RNA, 22 nt, Human
cugcagauguagcugcuuuccu

SEQ ID NO: 124526 - RNA, 22 nt, Human
auuaaauagcagaagaaagaug

SEQ ID NO: 124527 - RNA, 22 nt, Human
aggcaggcucaaugcccagucu

SEQ ID NO: 124528 - RNA, 22 nt, Human
ugcuucuuuaggauguaguuau

SEQ ID NO: 124529 - RNA, 22 nt, Human
caugccucuguuuuaguuguug

SEQ ID NO: 124530 - RNA, 22 nt, Human
auuucauuuuagaaauaagugu

SEQ ID NO: 124531 - RNA, 22 nt, Human
agaaccaauacuacagcaagua

SEQ ID NO: 124532 - RNA, 22 nt, Human
ucauuuuaucaggaauggaauc

SEQ ID NO: 124533 - RNA, 22 nt, Human
cuauuaauggccaggagucaug

SEQ ID NO: 124534 - RNA, 22 nt, Human
caguagcuuuuugcagacaaga

SEQ ID NO: 124535 - RNA, 22 nt, Human
ccagggaggucauagugcuggu

SEQ ID NO: 124536 - RNA, 22 nt, Human
acauuuuaaaaacaguaccugg

SEQ ID NO: 124537 - RNA, 22 nt, Human
acucugcaguaaggaauuguuu

SEQ ID NO: 124538 - RNA, 22 nt, Human
auucuccucaaaacaucugcug

SEQ ID NO: 124539 - RNA, 22 nt, Human
uaauagauagggagaguugcug

SEQ ID NO: 124540 - RNA, 22 nt, Human
guaugucuuaggguucaguaac

SEQ ID NO: 124541 - RNA, 22 nt, Human
uuauuucauguaaaauuuaugu

SEQ ID NO: 124542 - RNA, 22 nt, Human
uaguuuuaagcugacauuguuc

SEQ ID NO: 124543 - RNA, 22 nt, Human
guaaauaucucacgaaugauuc

SEQ ID NO: 124544 - RNA, 22 nt, Human
ugugugcuaguuuugucaguau

SEQ ID NO: 124545 - RNA, 22 nt, Human
auuuaaaaacugguacaacagg

SEQ ID NO: 124546 - RNA, 22 nt, Human
gcacucugggucaucugcugcc

SEQ ID NO: 124547 - RNA, 22 nt, Human
aggaagaagggacagaauuuug

SEQ ID NO: 124548 - RNA, 22 nt, Human
ccugaguucuuauuuccaguca

SEQ ID NO: 124549 - RNA, 22 nt, Human
uauuuuauuuagguuuaguugu

SEQ ID NO: 124550 - RNA, 22 nt, Human
aauguguauguguauauauaug

SEQ ID NO: 124551 - RNA, 18 nt, Human
ccuucaucucugcuucuu

SEQ ID NO: 124552 - RNA, 23 nt, Human
uaaauuuuauucugauaacacag

SEQ ID NO: 124553 - RNA, 22 nt, Human
aguaagaaagaaugauaggccu

SEQ ID NO: 124554 - RNA, 22 nt, Human
uguauuuuuucccugaaauaaa

SEQ ID NO: 124555 - RNA, 22 nt, Human
aagaaauacagaaauggcagua

SEQ ID NO: 124556 - RNA, 22 nt, Human
ucaguggaacacacagaguggg

SEQ ID NO: 124557 - RNA, 22 nt, Human
ccaccccagaaagggaaggcca

SEQ ID NO: 124558 - RNA, 22 nt, Human
uuuaaauaguugguuuuuuugc

SEQ ID NO: 124559 - RNA, 22 nt, Human
gcaacuccuaggcgaggccuuc

SEQ ID NO: 124560 - RNA, 22 nt, Human
uuguugcaagccuggaaucugg

SEQ ID NO: 124561 - RNA, 22 nt, Human
agugucugcgggcagaggagcg

SEQ ID NO: 124562 - RNA, 22 nt, Human
cuuuuuaaaguaaauggcuaga

SEQ ID NO: 124563 - RNA, 22 nt, Human
aaauguuugguggauaaaagga

SEQ ID NO: 124564 - RNA, 22 nt, Human
agucccugauggacuggaugag

SEQ ID NO: 124565 - RNA, 22 nt, Human
uaguuauuucugcacuuaauga

SEQ ID NO: 124566 - RNA, 22 nt, Human
cgggaggcggagcuccgcgggg

SEQ ID NO: 124567 - RNA, 22 nt, Human
gcugcccucccagggcaagcuu

SEQ ID NO: 124568 - RNA, 22 nt, Human
uggcaaacacaauauggguaca

SEQ ID NO: 124569 - RNA, 22 nt, Human
uauguuaaauguuugauguuua

SEQ ID NO: 124570 - RNA, 22 nt, Human
auucuucauguugaagcuguca

SEQ ID NO: 124571 - RNA, 22 nt, Human
aacugguaauuuaguauuacug

SEQ ID NO: 124572 - RNA, 22 nt, Human
uggaagaaaugguugagccaug

SEQ ID NO: 124573 - RNA, 22 nt, Human
agauggggccugaggacacugu

SEQ ID NO: 124574 - RNA, 22 nt, Human
uuuuccuuagaaauacauugau

SEQ ID NO: 124575 - RNA, 20 nt, Human
agucacagacccucagguag

SEQ ID NO: 124576 - RNA, 22 nt, Human
uuugcaggaaauguacugaaug

SEQ ID NO: 124577 - RNA, 22 nt, Human
aguuuuugccucgaauucugcg

SEQ ID NO: 124578 - RNA, 22 nt, Human
auacaucuuaacgcgcucuugg

SEQ ID NO: 124579 - RNA, 22 nt, Human
uuuagguuguguucuggcaugu

SEQ ID NO: 124580 - RNA, 22 nt, Human
uuucuugugauuuugaugaacu

SEQ ID NO: 124581 - RNA, 22 nt, Human
uauguauguauguauguauaug

SEQ ID NO: 124582 - RNA, 22 nt, Human
aggguggcuggaguggucuggu

SEQ ID NO: 124583 - RNA, 22 nt, Human
gagcagcugagcuggaaugaga

SEQ ID NO: 124584 - RNA, 22 nt, Human
aaaacauuuuacugccaucuca

SEQ ID NO: 124585 - RNA, 22 nt, Human
ugcaaaaguuuuauacacagau

SEQ ID NO: 124586 - RNA, 22 nt, Human
aagaacaacugcuuuaaaagca

SEQ ID NO: 124587 - RNA, 22 nt, Human
aaauguauuagccuaugugaga

SEQ ID NO: 124588 - RNA, 22 nt, Human
ugucuuuuaaaaauguguaaaa

SEQ ID NO: 124589 - RNA, 22 nt, Human
aguucaauuguuuuguaaaagu

SEQ ID NO: 124590 - RNA, 22 nt, Human
uucacugugauguuuaagagaa

SEQ ID NO: 124591 - RNA, 22 nt, Human
gaaggcagucuggggagcagcc

SEQ ID NO: 124592 - RNA, 22 nt, Human
uagcacauaguaggcacaggcu

SEQ ID NO: 124593 - RNA, 22 nt, Human
gcccuagaguugagagcaccca

SEQ ID NO: 124594 - RNA, 22 nt, Human
auuuauuuucccucaaguaccu

SEQ ID NO: 124595 - RNA, 22 nt, Human
cagggcagaguuaagaugcugg

SEQ ID NO: 124596 - RNA, 22 nt, Human
auaccuauagcagacugagacu

SEQ ID NO: 124597 - RNA, 22 nt, Human
gaaaacccuguauguagcguuu

SEQ ID NO: 124598 - RNA, 22 nt, Human
uacuuuaauugcaaaaauaaau

SEQ ID NO: 124599 - RNA, 22 nt, Human
gucugcagcacugugcacgguc

SEQ ID NO: 124600 - RNA, 22 nt, Human
gugaaauuguacacucaguacc

SEQ ID NO: 124601 - RNA, 19 nt, Human
ugccuggcaccagcuccac

SEQ ID NO: 124602 - RNA, 22 nt, Human
ucccugcugggcgaucuucucu

SEQ ID NO: 124603 - RNA, 22 nt, Human
cucaucagagcccuccucuggc

SEQ ID NO: 124604 - RNA, 19 nt, Human
caggucuucuuggaggacu

SEQ ID NO: 124605 - RNA, 22 nt, Human
uuuaaaauguuuuauuuauuua

SEQ ID NO: 124606 - RNA, 17 nt, Human
ucuccuggcucuaucag

SEQ ID NO: 124607 - RNA, 22 nt, Human
acugcaggucccaucaccugcg

SEQ ID NO: 124608 - RNA, 22 nt, Human
uauauuaaagugcuuugcagug

SEQ ID NO: 124609 - RNA, 18 nt, Human
aggcuggggaucacaggg

SEQ ID NO: 124610 - RNA, 20 nt, Human
gauuuaacgcugcgucuguc

SEQ ID NO: 124611 - RNA, 21 nt, Human
aucagaggacaucucagggcc

SEQ ID NO: 124612 - RNA, 22 nt, Human
uaaauuugugaauuagcuauca

SEQ ID NO: 124613 - RNA, 22 nt, Human
uuauuaauacaugcaccugcau

SEQ ID NO: 124614 - RNA, 22 nt, Human
aauuaaauguuugguuugagcu

SEQ ID NO: 124615 - RNA, 22 nt, Human
cauuuuaucagcacacgucacu

SEQ ID NO: 124616 - RNA, 22 nt, Human
ugucacagugcacagcuaagaa

SEQ ID NO: 124617 - RNA, 22 nt, Human
augccugcugucaggaacucuu

SEQ ID NO: 124618 - RNA, 22 nt, Human
cucccaucacaauucagggccu

SEQ ID NO: 124619 - RNA, 22 nt, Human
cuguuaauugugaauuuuacau

SEQ ID NO: 124620 - RNA, 22 nt, Human
ccuccuuuccuguuuuccugag

SEQ ID NO: 124621 - RNA, 22 nt, Human
gagaggugaagcuaauuaauuu

SEQ ID NO: 124622 - RNA, 23 nt, Human
cuuauauaaucauuagaaaccau

SEQ ID NO: 124623 - RNA, 22 nt, Human
ccucccaccguaucucaguggc

SEQ ID NO: 124624 - RNA, 22 nt, Human
agcaaggguugguuuucugaca

SEQ ID NO: 124625 - RNA, 22 nt, Human
ugagagguagaacuuguagugu

SEQ ID NO: 124626 - RNA, 22 nt, Human
uuuuuauguaaaauauuaaaag

SEQ ID NO: 124627 - RNA, 22 nt, Human
uuuuuaaaagaugauuuaauga

SEQ ID NO: 124628 - RNA, 22 nt, Human
aauuauguugaaauaugagaac

SEQ ID NO: 124629 - RNA, 22 nt, Human
ccuuugcccugagaaauguucc

SEQ ID NO: 124630 - RNA, 21 nt, Human
uuccuggaggcagaaacguga

SEQ ID NO: 124631 - RNA, 22 nt, Human
aaauauuugaaugguguaagau

SEQ ID NO: 124632 - RNA, 22 nt, Human
uuacuuucugggauaucaaaug

SEQ ID NO: 124633 - RNA, 22 nt, Human
uucauggauuugugaaauuuag

SEQ ID NO: 124634 - RNA, 22 nt, Human
ugaguacauuugauuaucagag

SEQ ID NO: 124635 - RNA, 22 nt, Human
gcacauauuuagaucuugaugu

SEQ ID NO: 124636 - RNA, 22 nt, Human
gugcucaagacauuaggaauau

SEQ ID NO: 124637 - RNA, 22 nt, Human
uauguacauauauguguauaua

SEQ ID NO: 124638 - RNA, 22 nt, Human
uccagccugaacuuuguccaga

SEQ ID NO: 124639 - RNA, 21 nt, Human
ucagccuguccaguguuaacc

SEQ ID NO: 124640 - RNA, 22 nt, Human
cagaaaaaaaugcagacuagca

SEQ ID NO: 124641 - RNA, 22 nt, Human
auguaaugucaaucuucagugg

SEQ ID NO: 124642 - RNA, 22 nt, Human
guauaaauaucuauauuguuac

SEQ ID NO: 124643 - RNA, 22 nt, Human
cgugccugguggagagcgaggg

SEQ ID NO: 124644 - RNA, 22 nt, Human
uggcucaguaaucgagucuccu

SEQ ID NO: 124645 - RNA, 22 nt, Mycobacterium avium subsp. paratuberculosis
cgccgaucggggugcgcagcug

SEQ ID NO: 124646 - RNA, 22 nt, Mycobacterium avium subsp. paratuberculosis
agcgggguuuuugauugcgcuu

SEQ ID NO: 124647 - RNA, 22 nt, Mycobacterium avium subsp. paratuberculosis
aacacgcuggaggcgccgaugu

SEQ ID NO: 124648 - RNA, 22 nt, Mycobacterium avium subsp. paratuberculosis
caacgugcugacgcugacggug

SEQ ID NO: 124649 - RNA, 22 nt, Mycobacterium avium subsp. paratuberculosis
gcgcaggccgguuuccuggucc

SEQ ID NO: 124650 - RNA, 20 nt, Mycobacterium avium subsp. paratuberculosis
uggugguggcgcccaguucg

SEQ ID NO: 124651 - RNA, 22 nt, Mycobacterium avium subsp. paratuberculosis
uccgcgcgggugugccgacguc

SEQ ID NO: 124652 - RNA, 22 nt, Mycobacterium avium subsp. paratuberculosis
ucggucaguuccggccuggugc

SEQ ID NO: 124653 - RNA, 22 nt, Mycobacterium avium subsp. paratuberculosis
cgcaccaucgacgggguggaca

SEQ ID NO: 124654 - RNA, 22 nt, Mycobacterium avium subsp. paratuberculosis
gagcgugcacugguagcgaaga

SEQ ID NO: 124655 - RNA, 22 nt, Mycobacterium avium subsp. paratuberculosis
aaguucgggucgcgggcgucca

SEQ ID NO: 124656 - RNA, 22 nt, Mycobacterium avium subsp. paratuberculosis
gaccucuucggcggccgagcgg

SEQ ID NO: 124657 - RNA, 22 nt, Mycobacterium avium subsp. paratuberculosis
cggccaccuuguccggcggcgc

SEQ ID NO: 124658 - RNA, 22 nt, Mycobacterium avium subsp. paratuberculosis
ccgugcaucugcccggcaucgc

SEQ ID NO: 124659 - RNA, 22 nt, Mycobacterium avium subsp. paratuberculosis
ucgccgccagugcacguucggc

SEQ ID NO: 124660 - RNA, 20 nt, Mycobacterium avium subsp. paratuberculosis
uggccgacccgaccgucguc

SEQ ID NO: 124661 - RNA, 22 nt, Mycobacterium avium subsp. paratuberculosis
ccgaagaucagcgccgccgucg

SEQ ID NO: 124662 - RNA, 22 nt, Mycobacterium avium subsp. paratuberculosis
aucgggucgcccggcacgcaca

SEQ ID NO: 124663 - RNA, 22 nt, Mycobacterium avium subsp. paratuberculosis
ucuccugcgagcugccgcugca

SEQ ID NO: 124664 - RNA, 22 nt, Mycobacterium avium subsp. paratuberculosis
cacguugggaaucguuggcgug

SEQ ID NO: 124665 - RNA, 22 nt, Mycobacterium avium subsp. paratuberculosis
accggcgcgggcuggugagcga

SEQ ID NO: 124666 - RNA, 22 nt, Mycobacterium avium subsp. paratuberculosis
gucggguccagguggccgcccg

SEQ ID NO: 124667 - RNA, 22 nt, Mycobacterium avium subsp. paratuberculosis
gggccggagacgucgccgacca

SEQ ID NO: 124668 - RNA, 22 nt, Mycobacterium avium subsp. paratuberculosis
gcauggcccugcccgucgucag

SEQ ID NO: 124669 - RNA, 22 nt, Mycobacterium avium subsp. paratuberculosis
uuuucgcagugguugcacgcuc

SEQ ID NO: 124670 - RNA, 22 nt, Mycobacterium avium subsp. paratuberculosis
cccacgaccagcaggaaggcgc

SEQ ID NO: 124671 - RNA, 22 nt, Mycobacterium avium subsp. paratuberculosis
gucaccaaguucgccgccgggg

SEQ ID NO: 124672 - RNA, 22 nt, Mycobacterium avium subsp. paratuberculosis
gggcgugacguuguuggacguc

SEQ ID NO: 124673 - RNA, 23 nt, Mycobacterium avium subsp. paratuberculosis
ggucuugccggugccggccgggc

SEQ ID NO: 124674 - RNA, 22 nt, Mycobacterium avium subsp. paratuberculosis
ccgccggcaggacaugcugcgc

SEQ ID NO: 124675 - RNA, 22 nt, Mycobacterium avium subsp. paratuberculosis
cuguucgaggaagccguccggg

SEQ ID NO: 124676 - RNA, 22 nt, Mycobacterium avium subsp. paratuberculosis
ggcgaucgggccgaucgccgug

SEQ ID NO: 124677 - RNA, 22 nt, Mycobacterium avium subsp. paratuberculosis
ucgacggccaucucggcggugg

SEQ ID NO: 124678 - RNA, 22 nt, Mycobacterium avium subsp. paratuberculosis
ggcgccgcgaucgugagccuga

SEQ ID NO: 124679 - RNA, 22 nt, Mycobacterium avium subsp. paratuberculosis
caucgucggcgucgguaacugc

SEQ ID NO: 124680 - RNA, 22 nt, Mycobacterium avium subsp. paratuberculosis
agcccggcgaucugcuggcugc

SEQ ID NO: 124681 - RNA, 22 nt, Mycobacterium avium subsp. paratuberculosis
aaggcgcugcuggcccaggacg

SEQ ID NO: 124682 - RNA, 22 nt, Mycobacterium avium subsp. paratuberculosis
ggccgccgaacggcggguggcc

SEQ ID NO: 124683 - RNA, 22 nt, Mycobacterium avium subsp. paratuberculosis
cgcguccaagccgauccgguug

SEQ ID NO: 124684 - RNA, 22 nt, Mycobacterium avium subsp. paratuberculosis
gucggggcugcagcgccgcugg

SEQ ID NO: 124685 - RNA, 22 nt, Mycobacterium avium subsp. paratuberculosis
cuggcgaucgagcucgucacgc

SEQ ID NO: 124686 - RNA, 22 nt, Mycobacterium avium subsp. paratuberculosis
uccucgcggaugggcucgcgcg

SEQ ID NO: 124687 - RNA, 20 nt, Mycobacterium avium subsp. paratuberculosis
agcucgucgaucugcugcug

SEQ ID NO: 124688 - RNA, 22 nt, Mycobacterium avium subsp. paratuberculosis
aucgccgacgaggucggcgcca

SEQ ID NO: 124689 - RNA, 22 nt, Mycobacterium avium subsp. paratuberculosis
gugggcagcgugcgcaucgggg

SEQ ID NO: 124690 - RNA, 20 nt, Mycobacterium avium subsp. paratuberculosis
acgcuggcgugacgcucggc

SEQ ID NO: 124691 - RNA, 22 nt, Mycobacterium avium subsp. paratuberculosis
ucggccggccaggauccggcgc

SEQ ID NO: 124692 - RNA, 22 nt, Mycobacterium avium subsp. paratuberculosis
cgcgagccgucgguggugauga

SEQ ID NO: 124693 - RNA, 22 nt, Mycobacterium avium subsp. paratuberculosis
gcgaugguuucggcgacgucca

SEQ ID NO: 124694 - RNA, 22 nt, Mycobacterium avium subsp. paratuberculosis
guugggcgagaucgcuucacga

SEQ ID NO: 124695 - RNA, 22 nt, Mycobacterium avium subsp. paratuberculosis
cgggaugaaccuggucgccaag

SEQ ID NO: 124696 - RNA, 22 nt, Mycobacterium avium subsp. paratuberculosis
uucggcuggccggugcgcaccu

SEQ ID NO: 124697 - RNA, 22 nt, Mycobacterium avium subsp. paratuberculosis
auccagacguguacgccgaggu

SEQ ID NO: 124698 - RNA, 22 nt, Mycobacterium avium subsp. paratuberculosis
accggcaucaccacggcgaugg

SEQ ID NO: 124699 - RNA, 22 nt, Mycobacterium avium subsp. paratuberculosis
aauccggacgucaugcccaugc

SEQ ID NO: 124700 - RNA, 22 nt, Mycobacterium avium subsp. paratuberculosis
guguacccgggccgcagccagu

SEQ ID NO: 124701 - RNA, 22 nt, Mycobacterium avium subsp. paratuberculosis
agcgcgaccgcggugagccggu

SEQ ID NO: 124702 - RNA, 22 nt, Mycobacterium avium subsp. paratuberculosis
gggcuggccgaccgacuucuug

SEQ ID NO: 124703 - RNA, 22 nt, Mycobacterium avium subsp. paratuberculosis
cgucgacgacgacuucuuccug

SEQ ID NO: 124704 - RNA, 22 nt, Mycobacterium avium subsp. paratuberculosis
cacggggcgcagcccgccugca

SEQ ID NO: 124705 - RNA, 22 nt, Mycobacterium avium subsp. paratuberculosis
gccgaauuagaguccauggcaa

SEQ ID NO: 124706 - RNA, 22 nt, Mycobacterium avium subsp. paratuberculosis
cugccgguaucccucgccgguc

SEQ ID NO: 124707 - RNA, 22 nt, Mycobacterium avium subsp. paratuberculosis
cagacgcaaaagcccccgacac

SEQ ID NO: 124708 - RNA, 22 nt, Mycobacterium avium subsp. paratuberculosis
caacuggucgacgacgucgucg

SEQ ID NO: 124709 - RNA, 22 nt, Mycobacterium avium subsp. paratuberculosis
ggcgucgaugugcucgucggcg

SEQ ID NO: 124710 - RNA, 22 nt, Mycobacterium avium subsp. paratuberculosis
auucgagcaccgugucgcgcac

SEQ ID NO: 124711 - RNA, 22 nt, Mycobacterium avium subsp. paratuberculosis
gcggccgggucgaagacgguca

SEQ ID NO: 124712 - RNA, 22 nt, Mycobacterium avium subsp. paratuberculosis
cgaugccgccgaucagugcgug

SEQ ID NO: 124713 - RNA, 22 nt, Mycobacterium avium subsp. paratuberculosis
caccccgcugcugucggucgag

SEQ ID NO: 124714 - RNA, 22 nt, Mycobacterium avium subsp. paratuberculosis
augcgguuggacgcgugcguga

SEQ ID NO: 124715 - RNA, 22 nt, Mycobacterium avium subsp. paratuberculosis
gagggcgugccgccgaccgaca

SEQ ID NO: 124716 - RNA, 22 nt, Mycobacterium avium subsp. paratuberculosis
acucggugucguugucgaacga

SEQ ID NO: 124717 - RNA, 22 nt, Mycobacterium avium subsp. paratuberculosis
agacucacgcgauggcccucua

SEQ ID NO: 124718 - RNA, 22 nt, Mycobacterium avium subsp. paratuberculosis
aguggguggauuccgagcgccc

SEQ ID NO: 124719 - RNA, 22 nt, Mycobacterium avium subsp. paratuberculosis
gccgccggugacggacuguucg

SEQ ID NO: 124720 - RNA, 21 nt, Mycobacterium avium subsp. paratuberculosis
cauccggucgacgguggucgg

SEQ ID NO: 124721 - RNA, 22 nt, Mycobacterium avium subsp. paratuberculosis
ucaccggaguuccccaucggag

SEQ ID NO: 124722 - RNA, 22 nt, Mycobacterium avium subsp. paratuberculosis
aguuccucgaagcgcgggauga

SEQ ID NO: 124723 - RNA, 22 nt, Mycobacterium avium subsp. paratuberculosis
cccuccagcaacucgcgcgccu

SEQ ID NO: 124724 - RNA, 22 nt, Mycobacterium avium subsp. paratuberculosis
cggguguugcagccgugcggga

SEQ ID NO: 124725 - RNA, 20 nt, Mycobacterium avium subsp. paratuberculosis
cgacggcgaggcuuggcucg

SEQ ID NO: 124726 - RNA, 22 nt, Mycobacterium avium subsp. paratuberculosis
cggcugauggcaacccggucac

SEQ ID NO: 124727 - RNA, 22 nt, Mycobacterium avium subsp. paratuberculosis
ugguggcguuguucugccgcgg

SEQ ID NO: 124728 - RNA, 22 nt, Mycobacterium avium subsp. paratuberculosis
ccgacgauuucgucggugcggu

SEQ ID NO: 124729 - RNA, 22 nt, Mycobacterium avium subsp. paratuberculosis
guggaguuccugcucgacgaac

SEQ ID NO: 124730 - RNA, 22 nt, Mycobacterium avium subsp. paratuberculosis
gugcagcgcuggggcgaguugu

SEQ ID NO: 124731 - RNA, 22 nt, Mycobacterium avium subsp. paratuberculosis
ccguucgaugauccucagggcg

SEQ ID NO: 124732 - RNA, 22 nt, Mycobacterium avium subsp. paratuberculosis
ggucggcgaaguggcuaucguc

SEQ ID NO: 124733 - RNA, 22 nt, Mycobacterium avium subsp. paratuberculosis
cgaccugagauuuguuggcuga

SEQ ID NO: 124734 - RNA, 22 nt, Mycobacterium avium subsp. paratuberculosis
ggucggaaauucgugcgccugg

SEQ ID NO: 124735 - RNA, 22 nt, Mycobacterium avium subsp. paratuberculosis
ugacgccaguucuccgcgccga

SEQ ID NO: 124736 - RNA, 22 nt, Mycobacterium avium subsp. paratuberculosis
aguacgucgacuggcugaucga

SEQ ID NO: 124737 - RNA, 22 nt, Mycobacterium avium subsp. paratuberculosis
cgccccgggcauggcuccgccg

SEQ ID NO: 124738 - RNA, 22 nt, Mycobacterium avium subsp. paratuberculosis
acccgacgcagguggucggauu

SEQ ID NO: 124739 - RNA, 22 nt, Mycobacterium avium subsp. paratuberculosis
augacgucgagcgccgacuucc

SEQ ID NO: 124740 - RNA, 22 nt, Mycobacterium avium subsp. paratuberculosis
ugcuggucggguauugcgcggg

SEQ ID NO: 124741 - RNA, 22 nt, Mycobacterium avium subsp. paratuberculosis
ucccgugugcacccucguagcc

SEQ ID NO: 124742 - RNA, 22 nt, Mycobacterium avium subsp. paratuberculosis
gcaucaccaccgucgaacucgu

SEQ ID NO: 124743 - RNA, 22 nt, Mycobacterium avium subsp. paratuberculosis
cccaggcuggccaggaugccca

SEQ ID NO: 124744 - RNA, 22 nt, Mycobacterium avium subsp. paratuberculosis
gagcagcugcuugaucaugguc

SEQ ID NO: 124745 - RNA, 22 nt, Mycobacterium avium subsp. paratuberculosis
augguguugucgacgaucagcg

SEQ ID NO: 124746 - RNA, 22 nt, Mycobacterium avium subsp. paratuberculosis
cgcgcgcucgagcuuggaucgu

SEQ ID NO: 124747 - RNA, 22 nt, Mycobacterium avium subsp. paratuberculosis
cgcgggcccgcugguguucacc

SEQ ID NO: 124748 - RNA, 22 nt, Mycobacterium avium subsp. paratuberculosis
ucaaguucggcggcggaggccg

SEQ ID NO: 124749 - RNA, 22 nt, Mycobacterium avium subsp. paratuberculosis
uggcggcgaagguggugagccc

SEQ ID NO: 124750 - RNA, 22 nt, Mycobacterium avium subsp. paratuberculosis
guugaucggcuugacuugccgc

SEQ ID NO: 124751 - RNA, 22 nt, Mycobacterium avium subsp. paratuberculosis
ugguggugcgccggaugcccaa

SEQ ID NO: 124752 - RNA, 22 nt, Mycobacterium avium subsp. paratuberculosis
cgcggcuuucaggccgaauggc

SEQ ID NO: 124753 - RNA, 22 nt, Mycobacterium avium subsp. paratuberculosis
gcgcgcucagcagcaccugccc

SEQ ID NO: 124754 - RNA, 22 nt, Mycobacterium avium subsp. paratuberculosis
ugcuggccuuucucgacgucga

SEQ ID NO: 124755 - RNA, 22 nt, Mycobacterium avium subsp. paratuberculosis
gcugaacaugucccaggucgcc

SEQ ID NO: 124756 - RNA, 22 nt, Mycobacterium avium subsp. paratuberculosis
ugcgcccgcaguuggucggcga

SEQ ID NO: 124757 - RNA, 22 nt, Mycobacterium avium subsp. paratuberculosis
gcgcagugggugcagcucgacg

SEQ ID NO: 124758 - RNA, 22 nt, Mycobacterium avium subsp. paratuberculosis
ggcgccacgcggaaucgccagc

SEQ ID NO: 124759 - RNA, 18 nt, Mycobacterium avium subsp. paratuberculosis
gagccagcugcugccgau

SEQ ID NO: 124760 - RNA, 22 nt, Mycobacterium avium subsp. paratuberculosis
gccgguagcguucguaggcgag

SEQ ID NO: 124761 - RNA, 21 nt, Mycobacterium avium subsp. paratuberculosis
ugcgggucguacuccagggcg

SEQ ID NO: 124762 - RNA, 22 nt, Mycobacterium avium subsp. paratuberculosis
ccggccuucgacugcagcagga

SEQ ID NO: 124763 - RNA, 22 nt, Mycobacterium avium subsp. paratuberculosis
agcucgucaaagagcaccgccu

SEQ ID NO: 124764 - RNA, 22 nt, Mycobacterium avium subsp. paratuberculosis
cucggugauguagaucggcgcc

SEQ ID NO: 124765 - RNA, 22 nt, Mycobacterium avium subsp. paratuberculosis
cgugcugauguacgccguggug

SEQ ID NO: 124766 - RNA, 22 nt, Mycobacterium avium subsp. paratuberculosis
caaguuccuggagggguugacg

SEQ ID NO: 124767 - RNA, 22 nt, Mycobacterium avium subsp. paratuberculosis
uggugggcaucuccggcucggg

SEQ ID NO: 124768 - RNA, 22 nt, Mycobacterium avium subsp. paratuberculosis
gcugucgcucgguugcugauga

SEQ ID NO: 124769 - RNA, 22 nt, Mycobacterium avium subsp. paratuberculosis
caccguguuacgccgggaacgc

SEQ ID NO: 124770 - RNA, 22 nt, Mycobacterium avium subsp. paratuberculosis
ccgauggccggcgggcccggca

SEQ ID NO: 124771 - RNA, 22 nt, Mycobacterium avium subsp. paratuberculosis
accaucgcgaugucggugacgc

SEQ ID NO: 124772 - RNA, 22 nt, Mycobacterium avium subsp. paratuberculosis
aaaagaucuucaccagcgagcu

SEQ ID NO: 124773 - RNA, 22 nt, Mycobacterium avium subsp. paratuberculosis
aucucgccaugaguacacacuc

SEQ ID NO: 124774 - RNA, 22 nt, Mycobacterium avium subsp. paratuberculosis
gccaggcaucgucgggccgccc

SEQ ID NO: 124775 - RNA, 22 nt, Mycobacterium avium subsp. paratuberculosis
ugugaccgcaugacgcugcgcu

SEQ ID NO: 124776 - RNA, 22 nt, Mycobacterium avium subsp. paratuberculosis
ggcguuggugugcugggcgcgc

SEQ ID NO: 124777 - RNA, 21 nt, Mycobacterium avium subsp. paratuberculosis
ucccaacgagaucauguuggc

SEQ ID NO: 124778 - RNA, 22 nt, Mycobacterium avium subsp. paratuberculosis
uaccccagcuucgcgcacgugg

SEQ ID NO: 124779 - RNA, 22 nt, Mycobacterium avium subsp. paratuberculosis
gcaacugcucagccacuccuug

SEQ ID NO: 124780 - RNA, 22 nt, Mycobacterium avium subsp. paratuberculosis
cgucccgggcggcaucgaggug

SEQ ID NO: 124781 - RNA, 22 nt, Mycobacterium avium subsp. paratuberculosis
cacgucgcggcuggcgcgguuc

SEQ ID NO: 124782 - RNA, 22 nt, Mycobacterium avium subsp. paratuberculosis
gugucgagcaccaggucgcggc

SEQ ID NO: 124783 - RNA, 22 nt, Mycobacterium avium subsp. paratuberculosis
gaccggauccagcguucggggc

SEQ ID NO: 124784 - RNA, 22 nt, Mycobacterium avium subsp. paratuberculosis
caggccguugacgggggccgcg

SEQ ID NO: 124785 - RNA, 22 nt, Mycobacterium avium subsp. paratuberculosis
gugaccgugucggugccgagca

SEQ ID NO: 124786 - RNA, 23 nt, Mycobacterium avium subsp. paratuberculosis
uccgccgcaaugccguccaccac

SEQ ID NO: 124787 - RNA, 22 nt, Mycobacterium avium subsp. paratuberculosis
gcuucggcggaugcggcccggc

SEQ ID NO: 124788 - RNA, 22 nt, Mycobacterium avium subsp. paratuberculosis
cuugucggugacggucagcugg

SEQ ID NO: 124789 - RNA, 22 nt, Mycobacterium avium subsp. paratuberculosis
ggcgcugcuguuuucgcggucg

SEQ ID NO: 124790 - RNA, 22 nt, Mycobacterium avium subsp. paratuberculosis
ccgccgacccgaggugggugac

SEQ ID NO: 124791 - RNA, 22 nt, Mycobacterium avium subsp. paratuberculosis
gcucuucuaccaccgguaucgg

SEQ ID NO: 124792 - RNA, 22 nt, Mycobacterium avium subsp. paratuberculosis
ccgagcguguacucaccgcgaa

SEQ ID NO: 124793 - RNA, 22 nt, Mycobacterium avium subsp. paratuberculosis
cgacggugagcgugucgaugac

SEQ ID NO: 124794 - RNA, 19 nt, Mycobacterium avium subsp. paratuberculosis
ccaugcgggccaccgacgu

SEQ ID NO: 124795 - RNA, 22 nt, Mycobacterium avium subsp. paratuberculosis
ucgggcguagcacgacgggccc

SEQ ID NO: 124796 - RNA, 22 nt, Mycobacterium avium subsp. paratuberculosis
ucgcgcugcggccgcuggagaa

SEQ ID NO: 124797 - RNA, 22 nt, Mycobacterium avium subsp. paratuberculosis
caaccucaccgagauccgcgag

SEQ ID NO: 124798 - RNA, 22 nt, Mycobacterium avium subsp. paratuberculosis
gcgcuacccgcugccgucggcc

SEQ ID NO: 124799 - RNA, 22 nt, Mycobacterium avium subsp. paratuberculosis
ggagccguccagaucgacggca

SEQ ID NO: 124800 - RNA, 22 nt, Mycobacterium avium subsp. paratuberculosis
gccacaccaggucgugcucggc

SEQ ID NO: 124801 - RNA, 22 nt, Mycobacterium avium subsp. paratuberculosis
cgccccgacgguguggcugugu

SEQ ID NO: 124802 - RNA, 22 nt, Mycobacterium avium subsp. paratuberculosis
gacggccucgucggucauguag

SEQ ID NO: 124803 - RNA, 22 nt, Mycobacterium avium subsp. paratuberculosis
gcagucgcugguggacaucgcc

SEQ ID NO: 124804 - RNA, 22 nt, Mycobacterium avium subsp. paratuberculosis
caugucguggugcugcggcagc

SEQ ID NO: 124805 - RNA, 22 nt, Mycobacterium avium subsp. paratuberculosis
cggcagcccaccgcggugcugc

SEQ ID NO: 124806 - RNA, 22 nt, Mycobacterium avium subsp. paratuberculosis
accucgauggugagccgggugg

SEQ ID NO: 124807 - RNA, 22 nt, Mycobacterium avium subsp. paratuberculosis
caggccgcgggauggcguuccu

SEQ ID NO: 124808 - RNA, 22 nt, Mycobacterium avium subsp. paratuberculosis
aacgugaagcuaguuucacguu

SEQ ID NO: 124809 - RNA, 22 nt, Mycobacterium avium subsp. paratuberculosis
agcgugaaguuaacuucacgcu

SEQ ID NO: 124810 - RNA, 22 nt, Mycobacterium avium subsp. paratuberculosis
agcuggaucggcggcaggucga

SEQ ID NO: 124811 - RNA, 22 nt, Mycobacterium avium subsp. paratuberculosis
uccgccagucccgcaggaucgc

SEQ ID NO: 124812 - RNA, 22 nt, Mycobacterium avium subsp. paratuberculosis
cgcgcuggugucggucguggcg

SEQ ID NO: 124813 - RNA, 22 nt, Mycobacterium avium subsp. paratuberculosis
accgcgagcagacgcaaaaacc

SEQ ID NO: 124814 - RNA, 22 nt, Mycobacterium avium subsp. paratuberculosis
ucgguguaaucgacgaacaccu

SEQ ID NO: 124815 - RNA, 22 nt, Mycobacterium avium subsp. paratuberculosis
gucgagccguugguguggaucg

SEQ ID NO: 124816 - RNA, 22 nt, Mycobacterium avium subsp. paratuberculosis
ggcggcgaccgacucgcccgga

SEQ ID NO: 124817 - RNA, 22 nt, Mycobacterium avium subsp. paratuberculosis
accagcaguaugggcgccgguu

SEQ ID NO: 124818 - RNA, 22 nt, Mycobacterium avium subsp. paratuberculosis
agcagcaugccgucgcggcgaa

SEQ ID NO: 124819 - RNA, 22 nt, Mycobacterium avium subsp. paratuberculosis
accgucgaguacgccaucggca

SEQ ID NO: 124820 - RNA, 22 nt, Mycobacterium avium subsp. paratuberculosis
uaaccgacgugacggcgccgac

SEQ ID NO: 124821 - RNA, 22 nt, Mycobacterium avium subsp. paratuberculosis
gcuggguggcgaccaucgccgg

SEQ ID NO: 124822 - RNA, 22 nt, Mycobacterium avium subsp. paratuberculosis
gcccugcagcaggaugaacaug

SEQ ID NO: 124823 - RNA, 22 nt, Mycobacterium avium subsp. paratuberculosis
gugggcguucgcgcaguacgcg

SEQ ID NO: 124824 - RNA, 22 nt, Mycobacterium avium subsp. paratuberculosis
cgccgagcgugggcccugugca

SEQ ID NO: 124825 - RNA, 22 nt, Mycobacterium avium subsp. paratuberculosis
ggcgccgccuaucugccgaucg

SEQ ID NO: 124826 - RNA, 22 nt, Mycobacterium avium subsp. paratuberculosis
cgucacggcgcaggucagcgcg

SEQ ID NO: 124827 - RNA, 22 nt, Mycobacterium avium subsp. paratuberculosis
gaaugaucaaggugggcaccgu

SEQ ID NO: 124828 - RNA, 22 nt, Mycobacterium avium subsp. paratuberculosis
uaccggaucaccuaugacgggu

SEQ ID NO: 124829 - RNA, 19 nt, Mycobacterium avium subsp. paratuberculosis
cggcagucgggaagguguc

SEQ ID NO: 124830 - RNA, 22 nt, Mycobacterium avium subsp. paratuberculosis
gcgagcagacgcaaaagcuccc

SEQ ID NO: 124831 - RNA, 22 nt, Mycobacterium avium subsp. paratuberculosis
agcggcgcguagcuuucgaugu

SEQ ID NO: 124832 - RNA, 23 nt, Mycobacterium avium subsp. paratuberculosis
gcaaucaccggggugugacaagc

SEQ ID NO: 124833 - RNA, 22 nt, Mycobacterium avium subsp. paratuberculosis
ggaacaccuugccgaugugcug

SEQ ID NO: 124834 - RNA, 18 nt, Mycobacterium avium subsp. paratuberculosis
accacccaggagaucguc

SEQ ID NO: 124835 - RNA, 22 nt, Mycobacterium avium subsp. paratuberculosis
cccugaucgccagcgaucgcgu

SEQ ID NO: 124836 - RNA, 18 nt, Mycobacterium avium subsp. paratuberculosis
ucggcuucaccagguccg

SEQ ID NO: 124837 - RNA, 22 nt, Mycobacterium avium subsp. paratuberculosis
gacguucggcgcgcaguggcug

SEQ ID NO: 124838 - RNA, 22 nt, Mycobacterium avium subsp. paratuberculosis
agcgcgacgacggugcgggcca

SEQ ID NO: 124839 - RNA, 20 nt, Mycobacterium avium subsp. paratuberculosis
aucguucucgucgcgcacga

SEQ ID NO: 124840 - RNA, 22 nt, Mycobacterium avium subsp. paratuberculosis
uggauucgcauauuagugcgug

SEQ ID NO: 124841 - RNA, 22 nt, Mycobacterium avium subsp. paratuberculosis
cgauccgcauggugaagacggu

SEQ ID NO: 124842 - RNA, 22 nt, Mycobacterium avium subsp. paratuberculosis
gaggugcucgccgcggcggacc

SEQ ID NO: 124843 - RNA, 22 nt, Mycobacterium avium subsp. paratuberculosis
gucgccuaucaggccaccacga

SEQ ID NO: 124844 - RNA, 22 nt, Mycobacterium avium subsp. paratuberculosis
uucggggagcgcgacaccguuu

SEQ ID NO: 124845 - RNA, 22 nt, Mycobacterium avium subsp. paratuberculosis
cauggccgccgaguucggguug

SEQ ID NO: 124846 - RNA, 22 nt, Mycobacterium avium subsp. paratuberculosis
uucuugguggcagcgucgucgu

SEQ ID NO: 124847 - RNA, 22 nt, Mycobacterium avium subsp. paratuberculosis
ccggcguggagguguccagggc

SEQ ID NO: 124848 - RNA, 22 nt, Mycobacterium avium subsp. paratuberculosis
cccggucuggaacgcgacgugg

SEQ ID NO: 124849 - RNA, 22 nt, Mycobacterium avium subsp. paratuberculosis
uaccggugaccgcgaaccaacc

SEQ ID NO: 124850 - RNA, 22 nt, Mycobacterium avium subsp. paratuberculosis
cagauggacaagccggacgugg

SEQ ID NO: 124851 - RNA, 22 nt, Mycobacterium avium subsp. paratuberculosis
cagcgucgcggacggcaccgac

SEQ ID NO: 124852 - RNA, 22 nt, Mycobacterium avium subsp. paratuberculosis
acgaucgacggggugcgggugc

SEQ ID NO: 124853 - RNA, 23 nt, Mycobacterium avium subsp. paratuberculosis
uggcgggucgggcucgcauucac

SEQ ID NO: 124854 - RNA, 22 nt, Mycobacterium avium subsp. paratuberculosis
cccuguucgcgaugagcuugcu

SEQ ID NO: 124855 - RNA, 22 nt, Mycobacterium avium subsp. paratuberculosis
ugccgcaacuucccgacgguua

SEQ ID NO: 124856 - RNA, 23 nt, Mycobacterium avium subsp. paratuberculosis
gugucacgccagcgugacggucg

SEQ ID NO: 124857 - RNA, 22 nt, Mycobacterium avium subsp. paratuberculosis
ucguucaccugacgguugaggc

SEQ ID NO: 124858 - RNA, 22 nt, Mycobacterium avium subsp. paratuberculosis
uggcacacguucuggcacagga

SEQ ID NO: 124859 - RNA, 22 nt, Mycobacterium avium subsp. paratuberculosis
gaugcgaacguucggcggacag

SEQ ID NO: 124860 - RNA, 22 nt, Mycobacterium avium subsp. paratuberculosis
uucugguccuucauccggugcg

SEQ ID NO: 124861 - RNA, 22 nt, Mycobacterium avium subsp. paratuberculosis
ccggcccggugauccagucgau

SEQ ID NO: 124862 - RNA, 22 nt, Mycobacterium avium subsp. paratuberculosis
ccggcgcggucacccgguggac

SEQ ID NO: 124863 - RNA, 22 nt, Mycobacterium avium subsp. paratuberculosis
gcgcggcgucuacggcaucucg

SEQ ID NO: 124864 - RNA, 22 nt, Mycobacterium avium subsp. paratuberculosis
gucgcgcaggucggcagggugg

SEQ ID NO: 124865 - RNA, 23 nt, Mycobacterium avium subsp. paratuberculosis
cucacggugaucagccggccguu

SEQ ID NO: 124866 - RNA, 22 nt, Mycobacterium avium subsp. paratuberculosis
ucgcccacgcgccggccggacu

SEQ ID NO: 124867 - RNA, 22 nt, Mycobacterium avium subsp. paratuberculosis
caugaucugcgagcgguucacc

SEQ ID NO: 124868 - RNA, 22 nt, Mycobacterium avium subsp. paratuberculosis
guucccgcucgcuccgcugcgc

SEQ ID NO: 124869 - RNA, 22 nt, Mycobacterium avium subsp. paratuberculosis
agcugggcgacuuucgcggagu

SEQ ID NO: 124870 - RNA, 22 nt, Mycobacterium avium subsp. paratuberculosis
gccgcccgcaccggugagggug

SEQ ID NO: 124871 - RNA, 22 nt, Mycobacterium avium subsp. paratuberculosis
guggcccguuguugaugacggc

SEQ ID NO: 124872 - RNA, 22 nt, Mycobacterium avium subsp. paratuberculosis
cgcucggccagggccgggugga

SEQ ID NO: 124873 - RNA, 22 nt, Mycobacterium avium subsp. paratuberculosis
uaccuggugcgccugcacgagg

SEQ ID NO: 124874 - RNA, 22 nt, Mycobacterium avium subsp. paratuberculosis
gcagcccggccgaacugguggc

SEQ ID NO: 124875 - RNA, 22 nt, Mycobacterium avium subsp. paratuberculosis
gccgcggcaccgaugguguuga

SEQ ID NO: 124876 - RNA, 21 nt, Mycobacterium avium subsp. paratuberculosis
gcccggguggcgaccagccgc

SEQ ID NO: 124877 - RNA, 22 nt, Mycobacterium avium subsp. paratuberculosis
ggcggcgucgauguuggacugg

SEQ ID NO: 124878 - RNA, 22 nt, Mycobacterium avium subsp. paratuberculosis
gggcuuuugcgucugcucgcgg

SEQ ID NO: 124879 - RNA, 22 nt, Mycobacterium avium subsp. paratuberculosis
gugcggcggucgucgcugacca

SEQ ID NO: 124880 - RNA, 22 nt, Mycobacterium avium subsp. paratuberculosis
ccgagcgagucggcgaaccggg

SEQ ID NO: 124881 - RNA, 22 nt, Mycobacterium avium subsp. paratuberculosis
ucgcccgucagcaucaucaccg

SEQ ID NO: 124882 - RNA, 22 nt, Mycobacterium avium subsp. paratuberculosis
ucagcucuucgaccgcgguggc

SEQ ID NO: 124883 - RNA, 22 nt, Mycobacterium avium subsp. paratuberculosis
gugcucacgcugcugcuggccg

SEQ ID NO: 124884 - RNA, 22 nt, Mycobacterium avium subsp. paratuberculosis
uagacccggucgggcgcgaggc

SEQ ID NO: 124885 - RNA, 22 nt, Mycobacterium avium subsp. paratuberculosis
cuccggucggcgggaccgcgca

SEQ ID NO: 124886 - RNA, 22 nt, Mycobacterium avium subsp. paratuberculosis
ucgguuucgacggcgacagcgc

SEQ ID NO: 124887 - RNA, 22 nt, Mycobacterium avium subsp. paratuberculosis
uccgcgaauacgguuaccugau

SEQ ID NO: 124888 - RNA, 22 nt, Mycobacterium avium subsp. paratuberculosis
ccgugcccgccgaucgccauca

SEQ ID NO: 124889 - RNA, 22 nt, Mycobacterium avium subsp. paratuberculosis
gccgggcguaacgccacggcga

SEQ ID NO: 124890 - RNA, 22 nt, Mycobacterium avium subsp. paratuberculosis
cugcuggaccggguggaccugc

SEQ ID NO: 124891 - RNA, 19 nt, Mycobacterium avium subsp. paratuberculosis
ugcuggaggacucguucuc

SEQ ID NO: 124892 - RNA, 22 nt, Mycobacterium avium subsp. paratuberculosis
gcgcggccggucugcucgagca

SEQ ID NO: 124893 - RNA, 22 nt, Mycobacterium avium subsp. paratuberculosis
aaccugguggccuucggugagc

SEQ ID NO: 124894 - RNA, 22 nt, Mycobacterium avium subsp. paratuberculosis
accgcccgguucggggucgguc

SEQ ID NO: 124895 - RNA, 22 nt, Mycobacterium avium subsp. paratuberculosis
cccaacgugcacucagcgcgaa

SEQ ID NO: 124896 - RNA, 22 nt, Mycobacterium avium subsp. paratuberculosis
gcguggugaucguguuccccgg

SEQ ID NO: 124897 - RNA, 22 nt, Mycobacterium avium subsp. paratuberculosis
ucccgccgcgcugcagacugcg

SEQ ID NO: 124898 - RNA, 22 nt, Mycobacterium avium subsp. paratuberculosis
cuagcacacgaauacccuccgg

SEQ ID NO: 124899 - RNA, 22 nt, Mycobacterium avium subsp. paratuberculosis
aucgugcugcugcacggcgagc

SEQ ID NO: 124900 - RNA, 22 nt, Mycobacterium avium subsp. paratuberculosis
guggugggcagcucgucgcgaa

SEQ ID NO: 124901 - RNA, 22 nt, Mycobacterium avium subsp. paratuberculosis
gcgcccgguagucgcagucgua

SEQ ID NO: 124902 - RNA, 22 nt, Mycobacterium avium subsp. paratuberculosis
uucuucgauuucaucgucacgc

SEQ ID NO: 124903 - RNA, 22 nt, Mycobacterium avium subsp. paratuberculosis
cggguggccgagaucgacgucg

SEQ ID NO: 124904 - RNA, 22 nt, Mycobacterium avium subsp. paratuberculosis
gagacgagcgccuguaugaccg

SEQ ID NO: 124905 - RNA, 22 nt, Mycobacterium avium subsp. paratuberculosis
cguugagcgucuugcgcgaaaa

SEQ ID NO: 124906 - RNA, 22 nt, Mycobacterium avium subsp. paratuberculosis
ucgacccggcgucgcgggcgug

SEQ ID NO: 124907 - RNA, 22 nt, Mycobacterium avium subsp. paratuberculosis
cgcugaugccguccuugucgcg

SEQ ID NO: 124908 - RNA, 22 nt, Mycobacterium avium subsp. paratuberculosis
cgggaucagcggcagcgugauc

SEQ ID NO: 124909 - RNA, 22 nt, Mycobacterium avium subsp. paratuberculosis
gggcgccggggucgaugccgcc

SEQ ID NO: 124910 - RNA, 21 nt, Mycobacterium avium subsp. paratuberculosis
uugccggucgggauggcggcg

SEQ ID NO: 124911 - RNA, 22 nt, Mycobacterium avium subsp. paratuberculosis
uucccgcgucgucgacggcggc

SEQ ID NO: 124912 - RNA, 20 nt, Mycobacterium avium subsp. paratuberculosis
ccgucacgccggugucgccg

SEQ ID NO: 124913 - RNA, 22 nt, Mycobacterium avium subsp. paratuberculosis
ugugccccaccuuucgucuuuc

SEQ ID NO: 124914 - RNA, 22 nt, Mycobacterium avium subsp. paratuberculosis
augucggugagcgccuugaccg

SEQ ID NO: 124915 - RNA, 22 nt, Mycobacterium avium subsp. paratuberculosis
guggugcucugggaugcccugc

SEQ ID NO: 124916 - RNA, 22 nt, Mycobacterium avium subsp. paratuberculosis
ucaacggcaagccgcugcgcga

SEQ ID NO: 124917 - RNA, 22 nt, Mycobacterium avium subsp. paratuberculosis
gacaccgcggugaccgcggcga

SEQ ID NO: 124918 - RNA, 20 nt, Mycobacterium avium subsp. paratuberculosis
gggggcuuuugcgucugcuc

SEQ ID NO: 124919 - RNA, 22 nt, Mycobacterium avium subsp. paratuberculosis
caccgccgcgacggcuagcggg

SEQ ID NO: 124920 - RNA, 22 nt, Mycobacterium avium subsp. paratuberculosis
agcggcagcaccagauggcggc

SEQ ID NO: 124921 - RNA, 22 nt, Mycobacterium avium subsp. paratuberculosis
cacgccgccgaagcugaugccg

SEQ ID NO: 124922 - RNA, 22 nt, Mycobacterium avium subsp. paratuberculosis
uggcccgcagcagggcgaccgc

SEQ ID NO: 124923 - RNA, 22 nt, Mycobacterium avium subsp. paratuberculosis
ggucccgacggggagaucgagg

SEQ ID NO: 124924 - RNA, 22 nt, Mycobacterium avium subsp. paratuberculosis
gccuucuggucgaugacgcgcc

SEQ ID NO: 124925 - RNA, 22 nt, Mycobacterium avium subsp. paratuberculosis
guggcgcggguguugcgcccug

SEQ ID NO: 124926 - RNA, 22 nt, Mycobacterium avium subsp. paratuberculosis
gcggcgaugcggcgcugggaca

SEQ ID NO: 124927 - RNA, 22 nt, Mycobacterium avium subsp. paratuberculosis
ggcccgaucugcgcggaguugu

SEQ ID NO: 124928 - RNA, 22 nt, Mycobacterium avium subsp. paratuberculosis
ucggcuuugaucaugaaguagg

SEQ ID NO: 124929 - RNA, 22 nt, Mycobacterium avium subsp. paratuberculosis
gagcagacgcaaaagcccccga

SEQ ID NO: 124930 - RNA, 22 nt, Mycobacterium avium subsp. paratuberculosis
ggugucacuccugcgugacgcu

SEQ ID NO: 124931 - RNA, 22 nt, Mycobacterium avium subsp. paratuberculosis
aacgcagcaccuacguggugcu

SEQ ID NO: 124932 - RNA, 22 nt, Mycobacterium avium subsp. paratuberculosis
ucaggugaacgauucguucggc

SEQ ID NO: 124933 - RNA, 22 nt, Mycobacterium avium subsp. paratuberculosis
cggacggccggcaccgccguca

SEQ ID NO: 124934 - RNA, 22 nt, Mycobacterium avium subsp. paratuberculosis
guccaucuucgccagcucgcgc

SEQ ID NO: 124935 - RNA, 22 nt, Mycobacterium avium subsp. paratuberculosis
ggucgcagccccagcuccggcc

SEQ ID NO: 124936 - RNA, 22 nt, Mycobacterium avium subsp. paratuberculosis
agcugguguacuccccggcggu

SEQ ID NO: 124937 - RNA, 22 nt, Mycobacterium avium subsp. paratuberculosis
acgaugucgaacgaugaguccg

SEQ ID NO: 124938 - RNA, 22 nt, Mycobacterium avium subsp. paratuberculosis
ggccggauccggcugcacgugc

SEQ ID NO: 124939 - RNA, 22 nt, Mycobacterium avium subsp. paratuberculosis
gcugaccaaccugucgcgggca

SEQ ID NO: 124940 - RNA, 22 nt, Mycobacterium avium subsp. paratuberculosis
ggauugagcaugaugccgggcg

SEQ ID NO: 124941 - RNA, 22 nt, Mycobacterium avium subsp. paratuberculosis
accgggucguccgucggcgccg

SEQ ID NO: 124942 - RNA, 22 nt, Mycobacterium avium subsp. paratuberculosis
cuuggucugcaacgcguugacc

SEQ ID NO: 124943 - RNA, 20 nt, Mycobacterium avium subsp. paratuberculosis
accaggacgcgcucgcgguc

SEQ ID NO: 124944 - RNA, 22 nt, Mycobacterium avium subsp. paratuberculosis
ggcaacucaggcaccaacgcgc

SEQ ID NO: 124945 - RNA, 22 nt, Mycobacterium avium subsp. paratuberculosis
ccgaggucaaucuggcgcggcg

SEQ ID NO: 124946 - RNA, 22 nt, Mycobacterium avium subsp. paratuberculosis
aucggguugacucacgcggcgc

SEQ ID NO: 124947 - RNA, 22 nt, Mycobacterium avium subsp. paratuberculosis
agcguggcguagcaacggaauu

SEQ ID NO: 124948 - RNA, 22 nt, Mycobacterium avium subsp. paratuberculosis
ccgcggaauggcacaccgcguu

SEQ ID NO: 124949 - RNA, 19 nt, Mycobacterium avium subsp. paratuberculosis
acugcgacgaucaaccggc

SEQ ID NO: 124950 - RNA, 22 nt, Mycobacterium avium subsp. paratuberculosis
ucccgcaaccggcucgccgacc

SEQ ID NO: 124951 - RNA, 22 nt, Mycobacterium avium subsp. paratuberculosis
caucaccuacggcauucagccc

SEQ ID NO: 124952 - RNA, 21 nt, Mycobacterium avium subsp. paratuberculosis
cggcccgcaggucuuucucgg

SEQ ID NO: 124953 - RNA, 22 nt, Mycobacterium avium subsp. paratuberculosis
cgccgccaaucccguuggccgu

SEQ ID NO: 124954 - RNA, 22 nt, Mycobacterium avium subsp. paratuberculosis
ggucccagccgcggucggcggg

SEQ ID NO: 124955 - RNA, 22 nt, Mycobacterium avium subsp. paratuberculosis
cucgucgucgcgggccgggcug

SEQ ID NO: 124956 - RNA, 22 nt, Mycobacterium avium subsp. paratuberculosis
caggcccuguaccgcgagggcu

SEQ ID NO: 124957 - RNA, 22 nt, Mycobacterium avium subsp. paratuberculosis
acgagcuguggguuuccaggua

SEQ ID NO: 124958 - RNA, 22 nt, Mycobacterium avium subsp. paratuberculosis
gcagcgucgguagaugcacucu

SEQ ID NO: 124959 - RNA, 22 nt, Mycobacterium avium subsp. paratuberculosis
aacccgacgcgcggaugcgggc

SEQ ID NO: 124960 - RNA, 22 nt, Mycobacterium avium subsp. paratuberculosis
cggaccgcuggugcuggccguc

SEQ ID NO: 124961 - RNA, 22 nt, Mycobacterium avium subsp. paratuberculosis
ugguuuucggcgaccgagaccg

SEQ ID NO: 124962 - RNA, 22 nt, Mycobacterium avium subsp. paratuberculosis
cgccguugcugcugugcccgua

SEQ ID NO: 124963 - RNA, 22 nt, Mycobacterium avium subsp. paratuberculosis
ucguggucggcuucaccgaauc

SEQ ID NO: 124964 - RNA, 18 nt, Mycobacterium avium subsp. paratuberculosis
ucccggaucggcacggug

SEQ ID NO: 124965 - RNA, 22 nt, Mycobacterium avium subsp. paratuberculosis
ccggauccuggccggccgaauu

SEQ ID NO: 124966 - RNA, 22 nt, Mycobacterium avium subsp. paratuberculosis
cgucgacguggccgucuuuccg

SEQ ID NO: 124967 - RNA, 22 nt, Mycobacterium avium subsp. paratuberculosis
cgucaucacgguggagaucgcg

SEQ ID NO: 124968 - RNA, 21 nt, Mycobacterium avium subsp. paratuberculosis
uccgcguccggucugaucgag

SEQ ID NO: 124969 - RNA, 22 nt, Mycobacterium avium subsp. paratuberculosis
agccgcgcgaccacacgguaac

SEQ ID NO: 124970 - RNA, 21 nt, Mycobacterium avium subsp. paratuberculosis
acgugccagcgcgcgcuggug

SEQ ID NO: 124971 - RNA, 22 nt, Mycobacterium avium subsp. paratuberculosis
gugucguucaucgucgcgauca

SEQ ID NO: 124972 - RNA, 22 nt, Mycobacterium avium subsp. paratuberculosis
accaggguguugccgacggcca

SEQ ID NO: 124973 - RNA, 22 nt, Mycobacterium avium subsp. paratuberculosis
uucgccgugagugcacguucgg

SEQ ID NO: 124974 - RNA, 22 nt, Mycobacterium avium subsp. paratuberculosis
gacgccgcaccgaucgggcggg

SEQ ID NO: 124975 - RNA, 21 nt, Mycobacterium avium subsp. paratuberculosis
ggagaucaccgcagauggcgc

SEQ ID NO: 124976 - RNA, 22 nt, Mycobacterium avium subsp. paratuberculosis
ggggcuacuggcgcgacguggg

SEQ ID NO: 124977 - RNA, 22 nt, Mycobacterium avium subsp. paratuberculosis
gccgggcgguugggcaucgagc

SEQ ID NO: 124978 - RNA, 22 nt, Mycobacterium avium subsp. paratuberculosis
uggcgucgaucucgcgguucgc

SEQ ID NO: 124979 - RNA, 22 nt, Mycobacterium avium subsp. paratuberculosis
gcgcgagcagacgcaaaagccc

SEQ ID NO: 124980 - RNA, 22 nt, Mycobacterium avium subsp. paratuberculosis
ucgugggugugcugccagucgg

SEQ ID NO: 124981 - RNA, 22 nt, Mycobacterium avium subsp. paratuberculosis
uccgaagcgcccgaagagguuu

SEQ ID NO: 124982 - RNA, 22 nt, Mycobacterium avium subsp. paratuberculosis
agucguccugucacugguggcc

SEQ ID NO: 124983 - RNA, 22 nt, Mycobacterium avium subsp. paratuberculosis
ggccgcugcuggccggggagag

SEQ ID NO: 124984 - RNA, 22 nt, Mycobacterium avium subsp. paratuberculosis
cgcugccuggaaugcggcaccu

SEQ ID NO: 124985 - RNA, 22 nt, Mycobacterium avium subsp. paratuberculosis
ggcugauuuugcgggccgcccg

SEQ ID NO: 124986 - RNA, 22 nt, Mycobacterium avium subsp. paratuberculosis
agaagcucggcgcugacguggu

SEQ ID NO: 124987 - RNA, 22 nt, Mycobacterium avium subsp. paratuberculosis
gcccgucgucguucgggugcgc

SEQ ID NO: 124988 - RNA, 22 nt, Mycobacterium avium subsp. paratuberculosis
accguugggcgucggggugccg

SEQ ID NO: 124989 - RNA, 22 nt, Mycobacterium avium subsp. paratuberculosis
guaccagcggccgucgcgcagc

SEQ ID NO: 124990 - RNA, 23 nt, Mycobacterium avium subsp. paratuberculosis
cgucgggcauuggaucgucgacc

SEQ ID NO: 124991 - RNA, 22 nt, Mycobacterium avium subsp. paratuberculosis
cggcccgccgcccugcgugguc

SEQ ID NO: 124992 - RNA, 22 nt, Mycobacterium avium subsp. paratuberculosis
gcgucgaucucuucacggaugg

SEQ ID NO: 124993 - RNA, 22 nt, Mycobacterium avium subsp. paratuberculosis
cggcgaggucgucgaggucggc

SEQ ID NO: 124994 - RNA, 22 nt, Mycobacterium avium subsp. paratuberculosis
aucggcgccgacgcggugaucg

SEQ ID NO: 124995 - RNA, 22 nt, Mycobacterium avium subsp. paratuberculosis
gucgggcugauggaugccgacc

SEQ ID NO: 124996 - RNA, 22 nt, Mycobacterium avium subsp. paratuberculosis
gccggucggucucguggccgcg

SEQ ID NO: 124997 - RNA, 22 nt, Mycobacterium avium subsp. paratuberculosis
cgccgccgucacgcuggcguga

SEQ ID NO: 124998 - RNA, 22 nt, Mycobacterium avium subsp. paratuberculosis
ucgacgaacaccagcaccgggg

SEQ ID NO: 124999 - RNA, 22 nt, Mycobacterium avium subsp. paratuberculosis
aggugcucgucaagcagauuca

SEQ ID NO: 125000 - RNA, 22 nt, Mycobacterium avium subsp. paratuberculosis
gcuuuugugacugcucgcgcug

SEQ ID NO: 125001 - RNA, 22 nt, Mycobacterium avium subsp. paratuberculosis
guggcgcugcgcacggugucgg

SEQ ID NO: 125002 - RNA, 22 nt, Mycobacterium avium subsp. paratuberculosis
gcaacaaccccacguucggcgu

SEQ ID NO: 125003 - RNA, 22 nt, Mycobacterium avium subsp. paratuberculosis
ucggguuggcgaucaccucggc

SEQ ID NO: 125004 - RNA, 22 nt, Mycobacterium avium subsp. paratuberculosis
caccaggucggccugcuugccc

SEQ ID NO: 125005 - RNA, 23 nt, Mycobacterium avium subsp. paratuberculosis
cgucacgcuggcgugacgcucgg

SEQ ID NO: 125006 - RNA, 22 nt, Mycobacterium avium subsp. paratuberculosis
ucgcgcaacuaguccacgcucg

SEQ ID NO: 125007 - RNA, 22 nt, Mycobacterium avium subsp. paratuberculosis
ucgccgggaacguuggcgcucg

SEQ ID NO: 125008 - RNA, 22 nt, Mycobacterium avium subsp. paratuberculosis
ucaccugcccuggcaguggggc

SEQ ID NO: 125009 - RNA, 22 nt, Mycobacterium avium subsp. paratuberculosis
ucaucgccgacagcgccggaac

SEQ ID NO: 125010 - RNA, 22 nt, Mycobacterium avium subsp. paratuberculosis
auggucaggaugucgaccucga

SEQ ID NO: 125011 - RNA, 22 nt, Mycobacterium avium subsp. paratuberculosis
gcagcgcggccagguuguccga

SEQ ID NO: 125012 - RNA, 22 nt, Mycobacterium avium subsp. paratuberculosis
aucggcgccggugaugaugacg

SEQ ID NO: 125013 - RNA, 22 nt, Mycobacterium avium subsp. paratuberculosis
accgcgcgguucgugugcccgu

SEQ ID NO: 125014 - RNA, 22 nt, Mycobacterium avium subsp. paratuberculosis
gcccaacguggacuuguugggc

SEQ ID NO: 125015 - RNA, 22 nt, Mycobacterium avium subsp. paratuberculosis
cgacgacauggacguguuccug

SEQ ID NO: 125016 - RNA, 22 nt, Mycobacterium avium subsp. paratuberculosis
cccgguucaaggccuggcgcgu

SEQ ID NO: 125017 - RNA, 22 nt, Mycobacterium avium subsp. paratuberculosis
uuggcgaucagguugcccagca

SEQ ID NO: 125018 - RNA, 22 nt, Mycobacterium avium subsp. paratuberculosis
gagcggguggaacaucagcggc

SEQ ID NO: 125019 - RNA, 22 nt, Mycobacterium avium subsp. paratuberculosis
uccaccacccgcaugggcgccu

SEQ ID NO: 125020 - RNA, 22 nt, Mycobacterium avium subsp. paratuberculosis
uacggcgugauggcggugacga

SEQ ID NO: 125021 - RNA, 22 nt, Mycobacterium avium subsp. paratuberculosis
cggcggccaucugcaugccgua

SEQ ID NO: 125022 - RNA, 22 nt, Mycobacterium avium subsp. paratuberculosis
cguggcgauccuggcagugcuc

SEQ ID NO: 125023 - RNA, 22 nt, Mycobacterium avium subsp. paratuberculosis
aucucgaucggguccaucuuuu

SEQ ID NO: 125024 - RNA, 22 nt, Mycobacterium avium subsp. paratuberculosis
ggccaccgcgaucaucggcuac

SEQ ID NO: 125025 - RNA, 22 nt, Mycobacterium avium subsp. paratuberculosis
ggacgccagcaggucggcgacg

SEQ ID NO: 125026 - RNA, 22 nt, Mycobacterium avium subsp. paratuberculosis
cggcgaucauguucaucaggug

SEQ ID NO: 125027 - RNA, 22 nt, Mycobacterium avium subsp. paratuberculosis
gccggccgucacgcuggcguga

SEQ ID NO: 125028 - RNA, 22 nt, Mycobacterium avium subsp. paratuberculosis
gcguagaacgauacucucgugu

SEQ ID NO: 125029 - RNA, 22 nt, Mycobacterium avium subsp. paratuberculosis
acugggcgcuggacucgaccag

SEQ ID NO: 125030 - RNA, 22 nt, Mycobacterium avium subsp. paratuberculosis
gggacccgucgucaccgaccgg

SEQ ID NO: 125031 - RNA, 22 nt, Mycobacterium avium subsp. paratuberculosis
cggcgguguucuucgagacgcc

SEQ ID NO: 125032 - RNA, 22 nt, Mycobacterium avium subsp. paratuberculosis
cgauggucuggcgcacgcccag

SEQ ID NO: 125033 - RNA, 22 nt, Mycobacterium avium subsp. paratuberculosis
ggccuggugacgggcgucugcu

SEQ ID NO: 125034 - RNA, 22 nt, Mycobacterium avium subsp. paratuberculosis
uucuucgcuaccagugcacgcu

SEQ ID NO: 125035 - RNA, 22 nt, Mycobacterium avium subsp. paratuberculosis
cggcugcggguccgcccgggcc

SEQ ID NO: 125036 - RNA, 22 nt, Mycobacterium avium subsp. paratuberculosis
ccguuguugugcagcgucgguc

SEQ ID NO: 125037 - RNA, 22 nt, Mycobacterium avium subsp. paratuberculosis
ccgguccgggcaaccgcuggcc

SEQ ID NO: 125038 - RNA, 20 nt, Mycobacterium avium subsp. paratuberculosis
gucgcccggcuugaucggcg

SEQ ID NO: 125039 - RNA, 22 nt, Mycobacterium avium subsp. paratuberculosis
ugcccugcagauccaugccggc

SEQ ID NO: 125040 - RNA, 22 nt, Mycobacterium avium subsp. paratuberculosis
ugcccguaaccgucgugcuggu

SEQ ID NO: 125041 - RNA, 22 nt, Mycobacterium avium subsp. paratuberculosis
cgccaacgucgacuuguugucg

SEQ ID NO: 125042 - RNA, 22 nt, Mycobacterium avium subsp. paratuberculosis
gcagcgcacgguuggucauguc

SEQ ID NO: 125043 - RNA, 23 nt, Mycobacterium avium subsp. paratuberculosis
ccggcaugaccuggucgaaugug

SEQ ID NO: 125044 - RNA, 22 nt, Mycobacterium avium subsp. paratuberculosis
accaccgcucggugucgaucgg

SEQ ID NO: 125045 - RNA, 22 nt, Mycobacterium avium subsp. paratuberculosis
gcggcggagaaguuguggauga

SEQ ID NO: 125046 - RNA, 22 nt, Mycobacterium avium subsp. paratuberculosis
ucguugcgggagcgggucagau

SEQ ID NO: 125047 - RNA, 22 nt, Mycobacterium avium subsp. paratuberculosis
ccgcggucgagaaggcggccaa

SEQ ID NO: 125048 - RNA, 22 nt, Mycobacterium avium subsp. paratuberculosis
ucagcagcgacggcccggugag

SEQ ID NO: 125049 - RNA, 22 nt, Mycobacterium avium subsp. paratuberculosis
uucgauguggugaccaucgcgg

SEQ ID NO: 125050 - RNA, 20 nt, Mycobacterium avium subsp. paratuberculosis
cggcgggacagguacggcug

SEQ ID NO: 125051 - RNA, 22 nt, Mycobacterium avium subsp. paratuberculosis
aagcugcgccgcgcgaagguga

SEQ ID NO: 125052 - RNA, 22 nt, Mycobacterium avium subsp. paratuberculosis
ucaccgacugcggcccggccug

SEQ ID NO: 125053 - RNA, 22 nt, Mycobacterium avium subsp. paratuberculosis
cgacgggcuggaggccauguau

SEQ ID NO: 125054 - RNA, 22 nt, Mycobacterium avium subsp. paratuberculosis
cagccgcuuauuguccagcgag

SEQ ID NO: 125055 - RNA, 22 nt, Mycobacterium avium subsp. paratuberculosis
cggcaccgcgcucggcuggcug

SEQ ID NO: 125056 - RNA, 23 nt, Mycobacterium avium subsp. paratuberculosis
ugccgaugacguggucgggcggg

SEQ ID NO: 125057 - RNA, 23 nt, Mycobacterium avium subsp. paratuberculosis
cgacgucgacgccgaccaccugg

SEQ ID NO: 125058 - RNA, 22 nt, Mycobacterium avium subsp. paratuberculosis
uggcguagagcuugcgcagcga

SEQ ID NO: 125059 - RNA, 22 nt, Mycobacterium avium subsp. paratuberculosis
gccguagaacgacgccgugucg

SEQ ID NO: 125060 - RNA, 22 nt, Mycobacterium avium subsp. paratuberculosis
ugggcgcagaucuucgccaacg

SEQ ID NO: 125061 - RNA, 22 nt, Mycobacterium avium subsp. paratuberculosis
gauugggcgacgacgagugaau

SEQ ID NO: 125062 - RNA, 22 nt, Mycobacterium avium subsp. paratuberculosis
ucucgcggugggugcacguucg

SEQ ID NO: 125063 - RNA, 22 nt, Mycobacterium avium subsp. paratuberculosis
uuuucgcaaccacugcacgcuc

SEQ ID NO: 125064 - RNA, 22 nt, Mycobacterium avium subsp. paratuberculosis
gucgucgagcacuucggugaag

SEQ ID NO: 125065 - RNA, 19 nt, Mycobacterium avium subsp. paratuberculosis
gcugggccuggucgcgucc

SEQ ID NO: 125066 - RNA, 22 nt, Mycobacterium avium subsp. paratuberculosis
cucgagccagggcgcaacgguu

SEQ ID NO: 125067 - RNA, 22 nt, Mycobacterium avium subsp. paratuberculosis
ccacaccgugaccgcggcggga

SEQ ID NO: 125068 - RNA, 22 nt, Mycobacterium avium subsp. paratuberculosis
ugaccacgaugcucuaccccga

SEQ ID NO: 125069 - RNA, 22 nt, Mycobacterium avium subsp. paratuberculosis
cgucaccggugaggacgucacc

SEQ ID NO: 125070 - RNA, 22 nt, Mycobacterium avium subsp. paratuberculosis
ggaagucggcgcucgacgucau

SEQ ID NO: 125071 - RNA, 22 nt, Mycobacterium avium subsp. paratuberculosis
ccgcuguuggacaggcuggccg

SEQ ID NO: 125072 - RNA, 22 nt, Mycobacterium avium subsp. paratuberculosis
agcgugaaguuagcuucacgcu

SEQ ID NO: 125073 - RNA, 22 nt, Mycobacterium avium subsp. paratuberculosis
gggucuggucgucgacaucgug

SEQ ID NO: 125074 - RNA, 22 nt, Mycobacterium avium subsp. paratuberculosis
cgagcgugaaguuaguuucacg

SEQ ID NO: 125075 - RNA, 22 nt, Mycobacterium avium subsp. paratuberculosis
gguguguuuggaggucaccgcc

SEQ ID NO: 125076 - RNA, 22 nt, Mycobacterium avium subsp. paratuberculosis
cagcaugcccucggccgacccg

SEQ ID NO: 125077 - RNA, 21 nt, Mycobacterium avium subsp. paratuberculosis
gccacgaagggcaggaucgcg

SEQ ID NO: 125078 - RNA, 22 nt, Mycobacterium avium subsp. paratuberculosis
uggcgauucgguugcucgacgc

SEQ ID NO: 125079 - RNA, 22 nt, Mycobacterium avium subsp. paratuberculosis
ugacgccgaguucgacggcgcg

SEQ ID NO: 125080 - RNA, 22 nt, Mycobacterium avium subsp. paratuberculosis
gcgccaaggugccggcauagcg

SEQ ID NO: 125081 - RNA, 21 nt, Mycobacterium avium subsp. paratuberculosis
gguuaucggguaccgccggug

SEQ ID NO: 125082 - RNA, 22 nt, Mycobacterium avium subsp. paratuberculosis
cacaucgaaaucggacugccca

SEQ ID NO: 125083 - RNA, 18 nt, Mycobacterium avium subsp. paratuberculosis
acgacggcggcgccgugc

SEQ ID NO: 125084 - RNA, 22 nt, Mycobacterium avium subsp. paratuberculosis
ucacgccagcgugacgcucggg

SEQ ID NO: 125085 - RNA, 22 nt, Mycobacterium avium subsp. paratuberculosis
cgucaccgaccggucgcaggua

SEQ ID NO: 125086 - RNA, 22 nt, Mycobacterium avium subsp. paratuberculosis
gcgcccuggacgccgcggacga

SEQ ID NO: 125087 - RNA, 22 nt, Mycobacterium avium subsp. paratuberculosis
gcgcggccuaugucaccgucuu

SEQ ID NO: 125088 - RNA, 21 nt, Mycobacterium avium subsp. paratuberculosis
cagcccagcgagauggccggc

SEQ ID NO: 125089 - RNA, 22 nt, Mycobacterium avium subsp. paratuberculosis
ucgaucgaacgccggguggcgc

SEQ ID NO: 125090 - RNA, 20 nt, Mycobacterium avium subsp. paratuberculosis
cguagcguuacgagagcggc

SEQ ID NO: 125091 - RNA, 22 nt, Mycobacterium avium subsp. paratuberculosis
ucggaggagccaugagaagaac

SEQ ID NO: 125092 - RNA, 22 nt, Mycobacterium avium subsp. paratuberculosis
cagcgucgacuuguugcgccga

SEQ ID NO: 125093 - RNA, 22 nt, Mycobacterium avium subsp. paratuberculosis
ucgacgaucgcguccaggucgg

SEQ ID NO: 125094 - RNA, 22 nt, Mycobacterium avium subsp. paratuberculosis
ucgagcacggcuaucccgccgc

SEQ ID NO: 125095 - RNA, 22 nt, Mycobacterium avium subsp. paratuberculosis
cguucgccuaucugcggcccgg

SEQ ID NO: 125096 - RNA, 22 nt, Mycobacterium avium subsp. paratuberculosis
gcugccgguaggugaugccggc

SEQ ID NO: 125097 - RNA, 22 nt, Mycobacterium avium subsp. paratuberculosis
ggcccugugcacagccucgggu

SEQ ID NO: 125098 - RNA, 22 nt, Mycobacterium avium subsp. paratuberculosis
cggggcacaaccucccugucac

SEQ ID NO: 125099 - RNA, 22 nt, Mycobacterium avium subsp. paratuberculosis
uuuucgccucguacgacgccgg

SEQ ID NO: 125100 - RNA, 22 nt, Mycobacterium avium subsp. paratuberculosis
aggugcgcaccgucagcgagga

SEQ ID NO: 125101 - RNA, 22 nt, Mycobacterium avium subsp. paratuberculosis
gacggcuggugcccguuucccg

SEQ ID NO: 125102 - RNA, 22 nt, Mycobacterium avium subsp. paratuberculosis
uggcgccgugcaugaccgccug

SEQ ID NO: 125103 - RNA, 22 nt, Mycobacterium avium subsp. paratuberculosis
agcgugaaguuaaguucacgcu

SEQ ID NO: 125104 - RNA, 22 nt, Mycobacterium avium subsp. paratuberculosis
gucucggcggccucgcgcagcu

SEQ ID NO: 125105 - RNA, 22 nt, Mycobacterium avium subsp. paratuberculosis
ccagccaacggguuuggcgcga

SEQ ID NO: 125106 - RNA, 19 nt, Mycobacterium avium subsp. paratuberculosis
gcggccgggugcucggcgu

SEQ ID NO: 125107 - RNA, 22 nt, Mycobacterium avium subsp. paratuberculosis
guggacgagccgaccgccgggc

SEQ ID NO: 125108 - RNA, 22 nt, Mycobacterium avium subsp. paratuberculosis
cgucgggcgcuucauggugacc

SEQ ID NO: 125109 - RNA, 22 nt, Mycobacterium avium subsp. paratuberculosis
gcgcucagcggcgccuggucgg

SEQ ID NO: 125110 - RNA, 22 nt, Mycobacterium avium subsp. paratuberculosis
gcccggaggguauucgugugcu

SEQ ID NO: 125111 - RNA, 22 nt, Mycobacterium avium subsp. paratuberculosis
ccgagcgugacgguaguuucac

SEQ ID NO: 125112 - RNA, 20 nt, Mycobacterium avium subsp. paratuberculosis
ggccggcgguguggucgccu

SEQ ID NO: 125113 - RNA, 22 nt, Mycobacterium avium subsp. paratuberculosis
cggccgaggacgggaccgucgu

SEQ ID NO: 125114 - RNA, 22 nt, Mycobacterium avium subsp. paratuberculosis
aacucgcccgcaaccacgacgc

SEQ ID NO: 125115 - RNA, 19 nt, Mycobacterium avium subsp. paratuberculosis
gccgaucagcaaccgggca

SEQ ID NO: 125116 - RNA, 22 nt, Mycobacterium avium subsp. paratuberculosis
cguugucgaucagcucggcgaa

SEQ ID NO: 125117 - RNA, 22 nt, Mycobacterium avium subsp. paratuberculosis
cgacggcugccguagcggcggu

SEQ ID NO: 125118 - RNA, 22 nt, Mycobacterium avium subsp. paratuberculosis
ccgaccacccgcacgagcgggc

SEQ ID NO: 125119 - RNA, 22 nt, Mycobacterium avium subsp. paratuberculosis
ugcucgacgacggcaccgugcu

SEQ ID NO: 125120 - RNA, 22 nt, Mycobacterium avium subsp. paratuberculosis
ggaucggagacguccucggcga

SEQ ID NO: 125121 - RNA, 22 nt, Mycobacterium avium subsp. paratuberculosis
ugucgggcaucgcccgcauccu

SEQ ID NO: 125122 - RNA, 22 nt, Mycobacterium avium subsp. paratuberculosis
gcggucacaaugacuuccggag

SEQ ID NO: 125123 - RNA, 22 nt, Mycobacterium avium subsp. paratuberculosis
gccuaccucacuugucugacug

SEQ ID NO: 125124 - RNA, 22 nt, Mycobacterium avium subsp. paratuberculosis
ccgcgcguucgucaaccggccg

SEQ ID NO: 125125 - RNA, 22 nt, Mycobacterium avium subsp. paratuberculosis
cgaagaagccuggggccgguac

SEQ ID NO: 125126 - RNA, 22 nt, Mycobacterium avium subsp. paratuberculosis
ugaccgucuucgacccggccgc

SEQ ID NO: 125127 - RNA, 22 nt, Mycobacterium avium subsp. paratuberculosis
uugcucagccagcucgcgguga

SEQ ID NO: 125128 - RNA, 22 nt, Mycobacterium avium subsp. paratuberculosis
gcugggcgaccagcgccuccau

SEQ ID NO: 125129 - RNA, 22 nt, Mycobacterium avium subsp. paratuberculosis
ccacgacggcgucguuuuggcu

SEQ ID NO: 125130 - RNA, 22 nt, Mycobacterium avium subsp. paratuberculosis
ccggcgucacggaucugucggu

SEQ ID NO: 125131 - RNA, 22 nt, Mycobacterium avium subsp. paratuberculosis
acgaugugcuugcgguccgcgc

SEQ ID NO: 125132 - RNA, 22 nt, Mycobacterium avium subsp. paratuberculosis
gggugcuuucgcgucugcucgc

SEQ ID NO: 125133 - RNA, 22 nt, Mycobacterium avium subsp. paratuberculosis
gcgggcgcuacuucgagaaccc

SEQ ID NO: 125134 - RNA, 21 nt, Mycobacterium avium subsp. paratuberculosis
ccaucguguugagccgcccgc

SEQ ID NO: 125135 - RNA, 22 nt, Mycobacterium avium subsp. paratuberculosis
accggcgucacgaucgggacga

SEQ ID NO: 125136 - RNA, 22 nt, Mycobacterium avium subsp. paratuberculosis
ccagggugucggcgagccgguc

SEQ ID NO: 125137 - RNA, 22 nt, Mycobacterium avium subsp. paratuberculosis
uuggucguugucggccagggca

SEQ ID NO: 125138 - RNA, 22 nt, Mycobacterium avium subsp. paratuberculosis
accguugccucuuuccugguga

SEQ ID NO: 125139 - RNA, 22 nt, Mycobacterium avium subsp. paratuberculosis
uacggcggcaacgcgaugaccg

SEQ ID NO: 125140 - RNA, 22 nt, Mycobacterium avium subsp. paratuberculosis
gugaccaggccgccgcugccgc

SEQ ID NO: 125141 - RNA, 22 nt, Mycobacterium avium subsp. paratuberculosis
ggugcuggcgcuggacgccgau

SEQ ID NO: 125142 - RNA, 22 nt, Mycobacterium avium subsp. paratuberculosis
caaggcgucggcggcgaugacc

SEQ ID NO: 125143 - RNA, 22 nt, Mycobacterium avium subsp. paratuberculosis
cacaccgcgucaccggcggggu

SEQ ID NO: 125144 - RNA, 22 nt, Mycobacterium avium subsp. paratuberculosis
cgcuguacuucgcugcugccgc

SEQ ID NO: 125145 - RNA, 22 nt, Mycobacterium avium subsp. paratuberculosis
ugaugaucgggcaccgggccgc

SEQ ID NO: 125146 - RNA, 22 nt, Mycobacterium avium subsp. paratuberculosis
agaugcggccguugaucuucag

SEQ ID NO: 125147 - RNA, 22 nt, Mycobacterium avium subsp. paratuberculosis
uccggugugggcgcggaccacg

SEQ ID NO: 125148 - RNA, 22 nt, Mycobacterium avium subsp. paratuberculosis
gagggccaucgcgugagucucu

SEQ ID NO: 125149 - RNA, 22 nt, Mycobacterium avium subsp. paratuberculosis
aacgcuucugauuccuugccgu

SEQ ID NO: 125150 - RNA, 22 nt, Mycobacterium avium subsp. paratuberculosis
uuggcgcgggugaucucggcga

SEQ ID NO: 125151 - RNA, 22 nt, Mycobacterium avium subsp. paratuberculosis
caccgccgcggagaugucgucg

SEQ ID NO: 125152 - RNA, 22 nt, Mycobacterium avium subsp. paratuberculosis
ugcuggucgagcggaugcaguc

SEQ ID NO: 125153 - RNA, 22 nt, Mycobacterium avium subsp. paratuberculosis
uggucgagcuccgcgcggcagg

SEQ ID NO: 125154 - RNA, 20 nt, Mycobacterium avium subsp. paratuberculosis
gggcaugcaucgggcgacac

SEQ ID NO: 125155 - RNA, 22 nt, Mycobacterium avium subsp. paratuberculosis
cgggccaaccggcuggcccggc

SEQ ID NO: 125156 - RNA, 22 nt, Mycobacterium avium subsp. paratuberculosis
cggcgugucagccgggcccgug

SEQ ID NO: 125157 - RNA, 22 nt, Mycobacterium avium subsp. paratuberculosis
ggaccucggcguggacgcugau

SEQ ID NO: 125158 - RNA, 22 nt, Mycobacterium avium subsp. paratuberculosis
gcaugcggaaguugcgggcgug

SEQ ID NO: 125159 - RNA, 22 nt, Mycobacterium avium subsp. paratuberculosis
gcacccgcaccacggccuccuu

SEQ ID NO: 125160 - RNA, 22 nt, Mycobacterium avium subsp. paratuberculosis
uggcucgaaauccgcagugugg

SEQ ID NO: 125161 - RNA, 22 nt, Mycobacterium avium subsp. paratuberculosis
gaucaucggcagcggcgggcuc

SEQ ID NO: 125162 - RNA, 21 nt, Mycobacterium avium subsp. paratuberculosis
gagccgguagaccuggcuggc

SEQ ID NO: 125163 - RNA, 22 nt, Mycobacterium avium subsp. paratuberculosis
ccaaccgcaucggcagcgccac

SEQ ID NO: 125164 - RNA, 22 nt, Mycobacterium avium subsp. paratuberculosis
aucuggaccagcgcgaugucgg

SEQ ID NO: 125165 - RNA, 22 nt, Mycobacterium avium subsp. paratuberculosis
acgcggccccgccgucggggaa

SEQ ID NO: 125166 - RNA, 22 nt, Mycobacterium avium subsp. paratuberculosis
ugggucagcugagucacgaucg

SEQ ID NO: 125167 - RNA, 22 nt, Mycobacterium avium subsp. paratuberculosis
ggcgagcucaaggucgaacugg

SEQ ID NO: 125168 - RNA, 22 nt, Mycobacterium avium subsp. paratuberculosis
gcugaccgacgcgggccgguug

SEQ ID NO: 125169 - RNA, 21 nt, Mycobacterium avium subsp. paratuberculosis
gcugcucggcgaucuccuuga

SEQ ID NO: 125170 - RNA, 22 nt, Mycobacterium avium subsp. paratuberculosis
ucagcgagugcaauucgguccg

SEQ ID NO: 125171 - RNA, 22 nt, Mycobacterium avium subsp. paratuberculosis
ucccgguuggggcccgcgagcg

SEQ ID NO: 125172 - RNA, 22 nt, Mycobacterium avium subsp. paratuberculosis
gucggugucggugaaccgcacc

SEQ ID NO: 125173 - RNA, 19 nt, Mycobacterium avium subsp. paratuberculosis
cgcaacaacuccacguucg

SEQ ID NO: 125174 - RNA, 22 nt, Mycobacterium avium subsp. paratuberculosis
ggcgcggugaccaggcugauca

SEQ ID NO: 125175 - RNA, 22 nt, Mycobacterium avium subsp. paratuberculosis
cgggccgucgccgaggcauucg

SEQ ID NO: 125176 - RNA, 22 nt, Mycobacterium avium subsp. paratuberculosis
uggucgaaaugccgguccgcgg

SEQ ID NO: 125177 - RNA, 22 nt, Mycobacterium avium subsp. paratuberculosis
gcgcggcaacccggugucgccg

SEQ ID NO: 125178 - RNA, 22 nt, Mycobacterium avium subsp. paratuberculosis
uccggcgcgcgucagcugcagu

SEQ ID NO: 125179 - RNA, 22 nt, Mycobacterium avium subsp. paratuberculosis
agggccgcaucucggcgggcgu

SEQ ID NO: 125180 - RNA, 22 nt, Mycobacterium avium subsp. paratuberculosis
cgguggccgaccugggcauggc

SEQ ID NO: 125181 - RNA, 22 nt, Mycobacterium avium subsp. paratuberculosis
auggcgaucggcgggcacggcc

SEQ ID NO: 125182 - RNA, 22 nt, Mycobacterium avium subsp. paratuberculosis
gccgaacguguacucgcggcga

SEQ ID NO: 125183 - RNA, 22 nt, Mycobacterium avium subsp. paratuberculosis
gcugucggagucggugucggug

SEQ ID NO: 125184 - RNA, 22 nt, Mycobacterium avium subsp. paratuberculosis
cgcagcauuucuucgaucgcgg

SEQ ID NO: 125185 - RNA, 22 nt, Mycobacterium avium subsp. paratuberculosis
gagaagccgaucaccaggauca

SEQ ID NO: 125186 - RNA, 19 nt, Mycobacterium avium subsp. paratuberculosis
ucgagguugacggcgccga

SEQ ID NO: 125187 - RNA, 22 nt, Mycobacterium avium subsp. paratuberculosis
ggugcaguuccccgacacccuc

SEQ ID NO: 125188 - RNA, 22 nt, Mycobacterium avium subsp. paratuberculosis
gcgcggccucgauccacucguc

SEQ ID NO: 125189 - RNA, 22 nt, Mycobacterium avium subsp. paratuberculosis
ucuucggcagcacccgcggcca

SEQ ID NO: 125190 - RNA, 22 nt, Mycobacterium avium subsp. paratuberculosis
uggccgccgcucggcaaaccau

SEQ ID NO: 125191 - RNA, 22 nt, Mycobacterium avium subsp. paratuberculosis
agcgcugugcggcaacgcguuu

SEQ ID NO: 125192 - RNA, 22 nt, Mycobacterium avium subsp. paratuberculosis
gcgguggauggccaccaccaau

SEQ ID NO: 125193 - RNA, 22 nt, Mycobacterium avium subsp. paratuberculosis
gagcucuuguccgacgcgucgc

SEQ ID NO: 125194 - RNA, 22 nt, Mycobacterium avium subsp. paratuberculosis
ucgauuucaaggccggggugcu

SEQ ID NO: 125195 - RNA, 22 nt, Mycobacterium avium subsp. paratuberculosis
agcgugaagcuagcuucacgcu

SEQ ID NO: 125196 - RNA, 22 nt, Mycobacterium avium subsp. paratuberculosis
gaguuguccaccacgguguuga

SEQ ID NO: 125197 - RNA, 22 nt, Mycobacterium avium subsp. paratuberculosis
cuacgucaucaacgggucgaag

SEQ ID NO: 125198 - RNA, 22 nt, Mycobacterium avium subsp. paratuberculosis
caccaugaucagacccagcgug

SEQ ID NO: 125199 - RNA, 22 nt, Mycobacterium avium subsp. paratuberculosis
cgucgccgugcaucacggugug

SEQ ID NO: 125200 - RNA, 20 nt, Mycobacterium avium subsp. paratuberculosis
cgaccuguuggugaucgugg

SEQ ID NO: 125201 - RNA, 22 nt, Mycobacterium avium subsp. paratuberculosis
agcgggcggcgaaacccgcugg

SEQ ID NO: 125202 - RNA, 22 nt, Mycobacterium avium subsp. paratuberculosis
ggcuggugcccgagcgcggcua

SEQ ID NO: 125203 - RNA, 22 nt, Mycobacterium avium subsp. paratuberculosis
uccgaccugcgcgggaaggcga

SEQ ID NO: 125204 - RNA, 22 nt, Mycobacterium avium subsp. paratuberculosis
gcaccacgucgcugcaccggau

SEQ ID NO: 125205 - RNA, 23 nt, Mycobacterium avium subsp. paratuberculosis
ucgcaaccagcgcacguucggcg

SEQ ID NO: 125206 - RNA, 22 nt, Mycobacterium avium subsp. paratuberculosis
acgccgacgagaacuagcgcgc

SEQ ID NO: 125207 - RNA, 19 nt, Mycobacterium avium subsp. paratuberculosis
ugcuggcggccucgcccgc

SEQ ID NO: 125208 - RNA, 22 nt, Mycobacterium avium subsp. paratuberculosis
gauuccggcggcgacgcauucg

SEQ ID NO: 125209 - RNA, 18 nt, Mycobacterium avium subsp. paratuberculosis
ucgccaucaccagcgggc

SEQ ID NO: 125210 - RNA, 22 nt, Mycobacterium avium subsp. paratuberculosis
gacgcgugccguacgccguagc

SEQ ID NO: 125211 - RNA, 22 nt, Mycobacterium avium subsp. paratuberculosis
cgccgcgucgauguucacuucg

SEQ ID NO: 125212 - RNA, 22 nt, Mycobacterium avium subsp. paratuberculosis
cgcagcgucgccccgguggugu

SEQ ID NO: 125213 - RNA, 22 nt, Mycobacterium avium subsp. paratuberculosis
agcucgccguagaucaacaggu

SEQ ID NO: 125214 - RNA, 22 nt, Mycobacterium avium subsp. paratuberculosis
agccaaccugucagccugggca

SEQ ID NO: 125215 - RNA, 20 nt, Mycobacterium avium subsp. paratuberculosis
ucugccacagcccgaagauc

SEQ ID NO: 125216 - RNA, 22 nt, Mycobacterium avium subsp. paratuberculosis
gaucaccguggaccgcgcccgc

SEQ ID NO: 125217 - RNA, 22 nt, Mycobacterium avium subsp. paratuberculosis
gaccguaccguuuccauugccg

SEQ ID NO: 125218 - RNA, 22 nt, Mycobacterium avium subsp. paratuberculosis
uucggcuucggcgucaucuucg

SEQ ID NO: 125219 - RNA, 22 nt, Mycobacterium avium subsp. paratuberculosis
gcggcggguguucgucaucgcc

SEQ ID NO: 125220 - RNA, 20 nt, Mycobacterium avium subsp. paratuberculosis
ucgacuugcccgagccggac

SEQ ID NO: 125221 - RNA, 22 nt, Mycobacterium avium subsp. paratuberculosis
uacgaggacauccgggcgcuga

SEQ ID NO: 125222 - RNA, 22 nt, Mycobacterium avium subsp. paratuberculosis
ccaucgacgcggugcugccgau

SEQ ID NO: 125223 - RNA, 22 nt, Mycobacterium avium subsp. paratuberculosis
cccggcgucacgcuggcgugac

SEQ ID NO: 125224 - RNA, 22 nt, Mycobacterium avium subsp. paratuberculosis
cugggcaccgugccgugaugcu

SEQ ID NO: 125225 - RNA, 22 nt, Mycobacterium avium subsp. paratuberculosis
gagcguaaccccacggcgauaa

SEQ ID NO: 125226 - RNA, 22 nt, Mycobacterium avium subsp. paratuberculosis
gguggugucggcggccucguug

SEQ ID NO: 125227 - RNA, 22 nt, Mycobacterium avium subsp. paratuberculosis
gggugagcaggauguuggccgg

SEQ ID NO: 125228 - RNA, 22 nt, Mycobacterium avium subsp. paratuberculosis
cucgucgacgaccaccaccaag

SEQ ID NO: 125229 - RNA, 22 nt, Mycobacterium avium subsp. paratuberculosis
ugggcccggcgaucgcggaguu

SEQ ID NO: 125230 - RNA, 22 nt, Mycobacterium avium subsp. paratuberculosis
accggaaucgcugcgugaccgg

SEQ ID NO: 125231 - RNA, 22 nt, Mycobacterium avium subsp. paratuberculosis
guggccgucgugguggcguugc

SEQ ID NO: 125232 - RNA, 22 nt, Mycobacterium avium subsp. paratuberculosis
ucgccguccacgccgugcagcg

SEQ ID NO: 125233 - RNA, 22 nt, Mycobacterium avium subsp. paratuberculosis
cagcgcgcgggcggccagguag

SEQ ID NO: 125234 - RNA, 22 nt, Mycobacterium avium subsp. paratuberculosis
cgccucgacgucggcaccuccg

SEQ ID NO: 125235 - RNA, 22 nt, Mycobacterium avium subsp. paratuberculosis
ucaucgccaccgaugagcgccg

SEQ ID NO: 125236 - RNA, 22 nt, Mycobacterium avium subsp. paratuberculosis
gucggcgacgaguucguggugc

SEQ ID NO: 125237 - RNA, 21 nt, Mycobacterium avium subsp. paratuberculosis
cgccggccucggagccgucgg

SEQ ID NO: 125238 - RNA, 22 nt, Mycobacterium avium subsp. paratuberculosis
uggcguccagcagcgccgagac

SEQ ID NO: 125239 - RNA, 19 nt, Mycobacterium avium subsp. paratuberculosis
ucugcaggguggcccaguu

SEQ ID NO: 125240 - RNA, 22 nt, Mycobacterium avium subsp. paratuberculosis
gcaguacaccaacuucacgccc

SEQ ID NO: 125241 - RNA, 22 nt, Mycobacterium avium subsp. paratuberculosis
cgacgaauccgacgcucaacuc

SEQ ID NO: 125242 - RNA, 19 nt, Mycobacterium avium subsp. paratuberculosis
cgacgcccaucguggcgac

SEQ ID NO: 125243 - RNA, 22 nt, Mycobacterium avium subsp. paratuberculosis
ucggcgcccgcaccaugugggc

SEQ ID NO: 125244 - RNA, 22 nt, Mycobacterium avium subsp. paratuberculosis
cggcggcagcacaucgguggcg

SEQ ID NO: 125245 - RNA, 22 nt, Mycobacterium avium subsp. paratuberculosis
gccggcaugcggaucggcuuca

SEQ ID NO: 125246 - RNA, 22 nt, Mycobacterium avium subsp. paratuberculosis
cguggcggccgagcccaugcug

SEQ ID NO: 125247 - RNA, 22 nt, Mycobacterium avium subsp. paratuberculosis
acccggcuggcgaccugggugg

SEQ ID NO: 125248 - RNA, 22 nt, Mycobacterium avium subsp. paratuberculosis
gacccccggugucugaccucgc

SEQ ID NO: 125249 - RNA, 22 nt, Mycobacterium avium subsp. paratuberculosis
uggcugcgaacagcaccuuggu

SEQ ID NO: 125250 - RNA, 22 nt, Mycobacterium avium subsp. paratuberculosis
gacguucgacggagagcugcug

SEQ ID NO: 125251 - RNA, 22 nt, Mycobacterium avium subsp. paratuberculosis
aucuggugaagaaccucgauca

SEQ ID NO: 125252 - RNA, 22 nt, Mycobacterium avium subsp. paratuberculosis
acgaaccgcgucugcgguaugg

SEQ ID NO: 125253 - RNA, 22 nt, Mycobacterium avium subsp. paratuberculosis
gacacgguguugauagcguggu

SEQ ID NO: 125254 - RNA, 22 nt, Mycobacterium avium subsp. paratuberculosis
caguuccucgucgcagucggcg

SEQ ID NO: 125255 - RNA, 22 nt, Mycobacterium avium subsp. paratuberculosis
gguccggcgcgguggacugcaa

SEQ ID NO: 125256 - RNA, 22 nt, Mycobacterium avium subsp. paratuberculosis
acguggcccgggccgccggcau

SEQ ID NO: 125257 - RNA, 22 nt, Mycobacterium avium subsp. paratuberculosis
ccacgcuggcgugacgccgggu

SEQ ID NO: 125258 - RNA, 22 nt, Mycobacterium avium subsp. paratuberculosis
cagcguguugaccgaggagcga

SEQ ID NO: 125259 - RNA, 22 nt, Mycobacterium avium subsp. paratuberculosis
ggucaucgggcaggugggcacc

SEQ ID NO: 125260 - RNA, 22 nt, Mycobacterium avium subsp. paratuberculosis
gcgucaccggucgucuugguga

SEQ ID NO: 125261 - RNA, 22 nt, Mycobacterium avium subsp. paratuberculosis
caccgcgagcagacgcaaaagc

SEQ ID NO: 125262 - RNA, 22 nt, Mycobacterium avium subsp. paratuberculosis
agucgggcaccucgcgguccag

SEQ ID NO: 125263 - RNA, 22 nt, Mycobacterium avium subsp. paratuberculosis
gggaccaucgccggccuggucg

SEQ ID NO: 125264 - RNA, 18 nt, Mycobacterium avium subsp. paratuberculosis
ucgacgcagccuucgauc

SEQ ID NO: 125265 - RNA, 22 nt, Mycobacterium avium subsp. paratuberculosis
cggugcuggccacgcuggcgcu

SEQ ID NO: 125266 - RNA, 22 nt, Mycobacterium avium subsp. paratuberculosis
ggcaugugucggcggccagcgc

SEQ ID NO: 125267 - RNA, 22 nt, Mycobacterium avium subsp. paratuberculosis
ugcguucgaucucggcggcguc

SEQ ID NO: 125268 - RNA, 22 nt, Mycobacterium avium subsp. paratuberculosis
agcugcgccggacgggcuaccu

SEQ ID NO: 125269 - RNA, 22 nt, Mycobacterium avium subsp. paratuberculosis
ugagcaccaccgccgcggccac

SEQ ID NO: 125270 - RNA, 22 nt, Mycobacterium avium subsp. paratuberculosis
gcgaccugcuguucgcccggcu

SEQ ID NO: 125271 - RNA, 22 nt, Mycobacterium avium subsp. paratuberculosis
ccacgacuggucggcgaccgag

SEQ ID NO: 125272 - RNA, 22 nt, Mycobacterium avium subsp. paratuberculosis
agucgcggacggcgccggccac

SEQ ID NO: 125273 - RNA, 22 nt, Mycobacterium avium subsp. paratuberculosis
uuucgggcuggucaccggcgcg

SEQ ID NO: 125274 - RNA, 22 nt, Mycobacterium avium subsp. paratuberculosis
ggcgcgggcgucccgguggugc

SEQ ID NO: 125275 - RNA, 22 nt, Mycobacterium avium subsp. paratuberculosis
ccgcgccgacgagcagcccgug

SEQ ID NO: 125276 - RNA, 22 nt, Mycobacterium avium subsp. paratuberculosis
cgggauccccccgcagacgcug

SEQ ID NO: 125277 - RNA, 22 nt, Mycobacterium avium subsp. paratuberculosis
gaggggucggccugggugauga

SEQ ID NO: 125278 - RNA, 22 nt, Mycobacterium avium subsp. paratuberculosis
cggcgucgaugcgggccagcgu

SEQ ID NO: 125279 - RNA, 22 nt, Mycobacterium avium subsp. paratuberculosis
gaggcguucuacaugcgggucg

SEQ ID NO: 125280 - RNA, 22 nt, Mycobacterium avium subsp. paratuberculosis
cggccagaccguugaugucggu

SEQ ID NO: 125281 - RNA, 22 nt, Mycobacterium avium subsp. paratuberculosis
gucccgaucccggacaccgcgc

SEQ ID NO: 125282 - RNA, 22 nt, Mycobacterium avium subsp. paratuberculosis
agauggcgccgccggauccguc

SEQ ID NO: 125283 - RNA, 22 nt, Mycobacterium avium subsp. paratuberculosis
cuugccgaccgcgucgggaucg

SEQ ID NO: 125284 - RNA, 22 nt, Mycobacterium avium subsp. paratuberculosis
cucggugcacuucgcgcccggg

SEQ ID NO: 125285 - RNA, 22 nt, Mycobacterium avium subsp. paratuberculosis
gcgugccgggucugccgguagu

SEQ ID NO: 125286 - RNA, 22 nt, Mycobacterium avium subsp. paratuberculosis
gcgcggauuuauucggguccgg

SEQ ID NO: 125287 - RNA, 22 nt, Mycobacterium avium subsp. paratuberculosis
cgcgaaccgaugcugacgcucg

SEQ ID NO: 125288 - RNA, 22 nt, Mycobacterium avium subsp. paratuberculosis
agucgaccgggguggauucgcu

SEQ ID NO: 125289 - RNA, 22 nt, Mycobacterium avium subsp. paratuberculosis
ugaucgagcgggucgacgacuu

SEQ ID NO: 125290 - RNA, 22 nt, Mycobacterium avium subsp. paratuberculosis
cgaacgugggguuguugcgcgg

SEQ ID NO: 125291 - RNA, 22 nt, Mycobacterium avium subsp. paratuberculosis
gcugcgcgagcucgacgugcug

SEQ ID NO: 125292 - RNA, 22 nt, Mycobacterium avium subsp. paratuberculosis
acaccagggcgaucagccagga

SEQ ID NO: 125293 - RNA, 22 nt, Mycobacterium avium subsp. paratuberculosis
cucgacacgcuguaugucacgc

SEQ ID NO: 125294 - RNA, 22 nt, Mycobacterium avium subsp. paratuberculosis
cugcgcggcggaguguugcugc

SEQ ID NO: 125295 - RNA, 22 nt, Mycobacterium avium subsp. paratuberculosis
accggcguugccgcccauauca

SEQ ID NO: 125296 - RNA, 20 nt, Mycobacterium avium subsp. paratuberculosis
ucggcgauggucuccggucc

SEQ ID NO: 125297 - RNA, 22 nt, Mycobacterium avium subsp. paratuberculosis
augucgguggucacgccgucca

SEQ ID NO: 125298 - RNA, 18 nt, Mycobacterium avium subsp. paratuberculosis
accggucugcuggucggc

SEQ ID NO: 125299 - RNA, 22 nt, Mycobacterium avium subsp. paratuberculosis
ucucaccaccagcgauggcacg

SEQ ID NO: 125300 - RNA, 21 nt, Mycobacterium avium subsp. paratuberculosis
ugacgccgacgaguuucuuca

SEQ ID NO: 125301 - RNA, 22 nt, Mycobacterium avium subsp. paratuberculosis
uggccgguggcgcugucgacgg

SEQ ID NO: 125302 - RNA, 22 nt, Mycobacterium avium subsp. paratuberculosis
gguggacaaggaccucgccgcg

SEQ ID NO: 125303 - RNA, 19 nt, Mycobacterium avium subsp. paratuberculosis
gggugggcuaacagcggug

SEQ ID NO: 125304 - RNA, 22 nt, Mycobacterium avium subsp. paratuberculosis
acccccgacgaguugauccugu

SEQ ID NO: 125305 - RNA, 22 nt, Mycobacterium avium subsp. paratuberculosis
ccaguucgacggcgucgacgcc

SEQ ID NO: 125306 - RNA, 22 nt, Mycobacterium avium subsp. paratuberculosis
uccgccggcucugagucgccgu

SEQ ID NO: 125307 - RNA, 22 nt, Mycobacterium avium subsp. paratuberculosis
ucggcaugguggugguggucgc

SEQ ID NO: 125308 - RNA, 22 nt, Mycobacterium avium subsp. paratuberculosis
uggucagcguggucggccuggu

SEQ ID NO: 125309 - RNA, 22 nt, Mycobacterium avium subsp. paratuberculosis
gaggccgccguggacgugguga

SEQ ID NO: 125310 - RNA, 22 nt, Mycobacterium avium subsp. paratuberculosis
acgcgcuccuucucguaggcgg

SEQ ID NO: 125311 - RNA, 22 nt, Mycobacterium avium subsp. paratuberculosis
gcgcugcuggugcuguucagcg

SEQ ID NO: 125312 - RNA, 22 nt, Mycobacterium avium subsp. paratuberculosis
ucgaggccgcaccguuuugcgu

SEQ ID NO: 125313 - RNA, 22 nt, Mycobacterium avium subsp. paratuberculosis
ugacgucgccgaccgccucacc

SEQ ID NO: 125314 - RNA, 22 nt, Mycobacterium avium subsp. paratuberculosis
cugggcuucugggacaucacgg

SEQ ID NO: 125315 - RNA, 22 nt, Mycobacterium avium subsp. paratuberculosis
cgcgcggugugggugaccgcgg

SEQ ID NO: 125316 - RNA, 22 nt, Mycobacterium avium subsp. paratuberculosis
ugguggagacggcgacgaaaug

SEQ ID NO: 125317 - RNA, 20 nt, Mycobacterium avium subsp. paratuberculosis
gcccgcucggcuggcugccg

SEQ ID NO: 125318 - RNA, 22 nt, Mycobacterium avium subsp. paratuberculosis
guggggucaguucccggcgacg

SEQ ID NO: 125319 - RNA, 22 nt, Mycobacterium avium subsp. paratuberculosis
agguucggggguggaccacagg

SEQ ID NO: 125320 - RNA, 22 nt, Mycobacterium avium subsp. paratuberculosis
ucucccggauuugcgccgaucu

SEQ ID NO: 125321 - RNA, 22 nt, Mycobacterium avium subsp. paratuberculosis
ugcucggccaccucggcgaugu

SEQ ID NO: 125322 - RNA, 22 nt, Mycobacterium avium subsp. paratuberculosis
cugacgcucguuucgcauggca

SEQ ID NO: 125323 - RNA, 22 nt, Mycobacterium avium subsp. paratuberculosis
augguucgcgacgccagguauu

SEQ ID NO: 125324 - RNA, 22 nt, Mycobacterium avium subsp. paratuberculosis
caugaaccgcccgucggguuca

SEQ ID NO: 125325 - RNA, 23 nt, Mycobacterium avium subsp. paratuberculosis
cgguggccauccacgacggccug

SEQ ID NO: 125326 - RNA, 22 nt, Mycobacterium avium subsp. paratuberculosis
augacggcgucgcugcguagua

SEQ ID NO: 125327 - RNA, 22 nt, Mycobacterium avium subsp. paratuberculosis
acccggucggccgguucggguc

SEQ ID NO: 125328 - RNA, 22 nt, Mycobacterium avium subsp. paratuberculosis
ucggccugcgagaugugcacgu

SEQ ID NO: 125329 - RNA, 22 nt, Mycobacterium avium subsp. paratuberculosis
cgccgagcgucacgccagcgug

SEQ ID NO: 125330 - RNA, 22 nt, Mycobacterium avium subsp. paratuberculosis
augacgucgugcagccccuucu

SEQ ID NO: 125331 - RNA, 22 nt, Mycobacterium avium subsp. paratuberculosis
cgcaccguucacccggccgacg

SEQ ID NO: 125332 - RNA, 22 nt, Mycobacterium avium subsp. paratuberculosis
cgaggccggggugcuggcgucg

SEQ ID NO: 125333 - RNA, 22 nt, Mycobacterium avium subsp. paratuberculosis
caggucgucgcggcagcaggcc

SEQ ID NO: 125334 - RNA, 22 nt, Mycobacterium avium subsp. paratuberculosis
gcugaaccugauccucaagggc

SEQ ID NO: 125335 - RNA, 22 nt, Mycobacterium avium subsp. paratuberculosis
cugcaccgacgcggacggcgag

SEQ ID NO: 125336 - RNA, 22 nt, Mycobacterium avium subsp. paratuberculosis
ucgaugacggugucggcgccgg

SEQ ID NO: 125337 - RNA, 22 nt, Mycobacterium avium subsp. paratuberculosis
accggggccaagaccgucaguc

SEQ ID NO: 125338 - RNA, 23 nt, Mycobacterium avium subsp. paratuberculosis
caaggucuguacugagcggaugc

SEQ ID NO: 125339 - RNA, 22 nt, Mycobacterium avium subsp. paratuberculosis
cagcggcuucugggcgaucccc

SEQ ID NO: 125340 - RNA, 22 nt, Mycobacterium avium subsp. paratuberculosis
cugaccaggaagaugccgauca

SEQ ID NO: 125341 - RNA, 22 nt, Mycobacterium avium subsp. paratuberculosis
gaucccgaugcgcaagaugcac

SEQ ID NO: 125342 - RNA, 22 nt, Mycobacterium avium subsp. paratuberculosis
accggggugaucgccgagaugg

SEQ ID NO: 125343 - RNA, 22 nt, Mycobacterium avium subsp. paratuberculosis
ugccgccuccgaccgguguguu

SEQ ID NO: 125344 - RNA, 20 nt, Mycobacterium avium subsp. paratuberculosis
cgauacgucaccgagcgcga

SEQ ID NO: 125345 - RNA, 23 nt, Mycobacterium avium subsp. paratuberculosis
acgacgcgauggucggugcggcg

SEQ ID NO: 125346 - RNA, 22 nt, Mycobacterium avium subsp. paratuberculosis
gcgguggagcugccgggaaucg

SEQ ID NO: 125347 - RNA, 22 nt, Mycobacterium avium subsp. paratuberculosis
uucguugugcgcgcggaagguu

SEQ ID NO: 125348 - RNA, 22 nt, Mycobacterium avium subsp. paratuberculosis
aucgugcugauccugcuggugc

SEQ ID NO: 125349 - RNA, 22 nt, Mycobacterium avium subsp. paratuberculosis
agaaggggcugcacgacgucau

SEQ ID NO: 125350 - RNA, 22 nt, Mycobacterium avium subsp. paratuberculosis
gggcggcucaacacgaugguuu

SEQ ID NO: 125351 - RNA, 22 nt, Mycobacterium avium subsp. paratuberculosis
cgcacgugcagccacgccccgc

SEQ ID NO: 125352 - RNA, 22 nt, Mycobacterium avium subsp. paratuberculosis
uucgggcaguagugcgcggccg

SEQ ID NO: 125353 - RNA, 20 nt, Mycobacterium avium subsp. paratuberculosis
ccaacaagucgacguucggc

SEQ ID NO: 125354 - RNA, 22 nt, Mycobacterium avium subsp. paratuberculosis
cgaucgggcucugguuggcgca

SEQ ID NO: 125355 - RNA, 22 nt, Mycobacterium avium subsp. paratuberculosis
cgucgcggcccucgaccggcag

SEQ ID NO: 125356 - RNA, 22 nt, Mycobacterium avium subsp. paratuberculosis
accgaacgugcacucacgguga

SEQ ID NO: 125357 - RNA, 22 nt, Mycobacterium avium subsp. paratuberculosis
gggugugaccgagaccgagguc

SEQ ID NO: 125358 - RNA, 18 nt, Mycobacterium avium subsp. paratuberculosis
uucugcgagguggcccgc

SEQ ID NO: 125359 - RNA, 22 nt, Mycobacterium avium subsp. paratuberculosis
ucgcggggcuuuugcgucugcu

SEQ ID NO: 125360 - RNA, 18 nt, Mycobacterium avium subsp. paratuberculosis
ucgcgcugcugucccggu

SEQ ID NO: 125361 - RNA, 22 nt, Mycobacterium avium subsp. paratuberculosis
acaccgccacgucgaugccggc

SEQ ID NO: 125362 - RNA, 22 nt, Mycobacterium avium subsp. paratuberculosis
uccgucgacgcggugcugggcg

SEQ ID NO: 125363 - RNA, 22 nt, Mycobacterium avium subsp. paratuberculosis
agccacggcagcacguagugca

SEQ ID NO: 125364 - RNA, 22 nt, Mycobacterium avium subsp. paratuberculosis
uccacccgcagagaucccaagg

SEQ ID NO: 125365 - RNA, 22 nt, Mycobacterium avium subsp. paratuberculosis
gcgggacagccgcgaccagucg

SEQ ID NO: 125366 - RNA, 22 nt, Mycobacterium avium subsp. paratuberculosis
uacuuccuguuccuggcggugc

SEQ ID NO: 125367 - RNA, 22 nt, Mycobacterium avium subsp. paratuberculosis
ggcaccgugggucagggcgcgg

SEQ ID NO: 125368 - RNA, 22 nt, Mycobacterium avium subsp. paratuberculosis
aggucgugaucggucucgauca

SEQ ID NO: 125369 - RNA, 22 nt, Mycobacterium avium subsp. paratuberculosis
aggucggccggcaccaguucgg

SEQ ID NO: 125370 - RNA, 22 nt, Mycobacterium avium subsp. paratuberculosis
cugaucugaacccggcgcacca

SEQ ID NO: 125371 - RNA, 22 nt, Mycobacterium avium subsp. paratuberculosis
acccggcgucacgccagcgugg

SEQ ID NO: 125372 - RNA, 22 nt, Mycobacterium avium subsp. paratuberculosis
gccgcgucgaugccgcugggga

SEQ ID NO: 125373 - RNA, 22 nt, Mycobacterium avium subsp. paratuberculosis
gcggagcacuccugguaugaac

SEQ ID NO: 125374 - RNA, 20 nt, Mycobacterium avium subsp. paratuberculosis
gcccggaucgccgaacgcgg

SEQ ID NO: 125375 - RNA, 22 nt, Mycobacterium avium subsp. paratuberculosis
cgggcuggccguauuggccggg

SEQ ID NO: 125376 - RNA, 22 nt, Mycobacterium avium subsp. paratuberculosis
ugcuggccgacauggcgagaau

SEQ ID NO: 125377 - RNA, 18 nt, Mycobacterium avium subsp. paratuberculosis
caugcgcugcacggccac

SEQ ID NO: 125378 - RNA, 22 nt, Mycobacterium avium subsp. paratuberculosis
cgccggcuucgugauccugauu

SEQ ID NO: 125379 - RNA, 22 nt, Mycobacterium avium subsp. paratuberculosis
uaacggcacccccagcgauuug

SEQ ID NO: 125380 - RNA, 21 nt, Mycobacterium avium subsp. paratuberculosis
ggcagcgagcuagccgccggc

SEQ ID NO: 125381 - RNA, 22 nt, Mycobacterium avium subsp. paratuberculosis
gggcgacgacgucagcacgcug

SEQ ID NO: 125382 - RNA, 22 nt, Mycobacterium avium subsp. paratuberculosis
acccggcugggcgccuacgcgc

SEQ ID NO: 125383 - RNA, 23 nt, Mycobacterium avium subsp. paratuberculosis
ugugcuuccgggugucgucggac

SEQ ID NO: 125384 - RNA, 22 nt, Mycobacterium avium subsp. paratuberculosis
gagcagacgcaaaagccccuga

SEQ ID NO: 125385 - RNA, 22 nt, Mycobacterium avium subsp. paratuberculosis
ugggcgaucggaaucgcgaucg

SEQ ID NO: 125386 - RNA, 22 nt, Mycobacterium avium subsp. paratuberculosis
ucaccgagaugucggcgaacgg

SEQ ID NO: 125387 - RNA, 22 nt, Mycobacterium avium subsp. paratuberculosis
aggucguccucgccgaccucga

SEQ ID NO: 125388 - RNA, 20 nt, Mycobacterium avium subsp. paratuberculosis
ccgaaucgucguugugcggc

SEQ ID NO: 125389 - RNA, 22 nt, Mycobacterium avium subsp. paratuberculosis
cgcgcucugggauaucgccaau

SEQ ID NO: 125390 - RNA, 22 nt, Mycobacterium avium subsp. paratuberculosis
cguggccgagaucgcgccgcug

SEQ ID NO: 125391 - RNA, 22 nt, Mycobacterium avium subsp. paratuberculosis
gcuggugcagccguccagcguc

SEQ ID NO: 125392 - RNA, 22 nt, Mycobacterium avium subsp. paratuberculosis
ucgcuaguugcacuuucgcggu

SEQ ID NO: 125393 - RNA, 22 nt, Mycobacterium avium subsp. paratuberculosis
acgggcaccacgcgguggugcg

SEQ ID NO: 125394 - RNA, 22 nt, Mycobacterium avium subsp. paratuberculosis
ggcugcugccgucgcugugcgg

SEQ ID NO: 125395 - RNA, 22 nt, Mycobacterium avium subsp. paratuberculosis
gugauugguugcggcgguggcg

SEQ ID NO: 125396 - RNA, 22 nt, Mycobacterium avium subsp. paratuberculosis
ggcguugguagaucggcacgcc

SEQ ID NO: 125397 - RNA, 22 nt, Mycobacterium avium subsp. paratuberculosis
uucgggaucccacggaucggug

SEQ ID NO: 125398 - RNA, 22 nt, Mycobacterium avium subsp. paratuberculosis
agccgcgcuggacggugugccg

SEQ ID NO: 125399 - RNA, 20 nt, Mycobacterium avium subsp. paratuberculosis
gacguucuccacgcugcggc

SEQ ID NO: 125400 - RNA, 22 nt, Mycobacterium avium subsp. paratuberculosis
gccgcggauccgcgucacggca

SEQ ID NO: 125401 - RNA, 22 nt, Mycobacterium avium subsp. paratuberculosis
cgacggcuccaagcggacgauc

SEQ ID NO: 125402 - RNA, 22 nt, Mycobacterium avium subsp. paratuberculosis
gccagcacccgcaacagcuguu

SEQ ID NO: 125403 - RNA, 22 nt, Mycobacterium avium subsp. paratuberculosis
ccgaggaucgcuaucugaugac

SEQ ID NO: 125404 - RNA, 21 nt, Mycobacterium avium subsp. paratuberculosis
agccgcccggcgccaguaacc

SEQ ID NO: 125405 - RNA, 22 nt, Mycobacterium avium subsp. paratuberculosis
cgcgccggugaucguguugucc

SEQ ID NO: 125406 - RNA, 22 nt, Mycobacterium avium subsp. paratuberculosis
cggcgcgcaccagcauccaguc

SEQ ID NO: 125407 - RNA, 19 nt, Mycobacterium avium subsp. paratuberculosis
gugggcgucgaauucgacg

SEQ ID NO: 125408 - RNA, 22 nt, Mycobacterium avium subsp. paratuberculosis
uagcugcguucgucgucgguga

SEQ ID NO: 125409 - RNA, 22 nt, Mycobacterium avium subsp. paratuberculosis
ccgccaacaagauucgccgcuc

SEQ ID NO: 125410 - RNA, 22 nt, Mycobacterium avium subsp. paratuberculosis
gaccugcagccggaugugcuga

SEQ ID NO: 125411 - RNA, 22 nt, Mycobacterium avium subsp. paratuberculosis
gcuggcaugcagcugccgcacg

SEQ ID NO: 125412 - RNA, 22 nt, Mycobacterium avium subsp. paratuberculosis
cgagcgucacgcuggcgugacg

SEQ ID NO: 125413 - RNA, 22 nt, Mycobacterium avium subsp. paratuberculosis
uggcgugaucgaguuggcccgu

SEQ ID NO: 125414 - RNA, 22 nt, Mycobacterium avium subsp. paratuberculosis
gagggugucggggaacugcacc

SEQ ID NO: 125415 - RNA, 22 nt, Mycobacterium avium subsp. paratuberculosis
uccuucgccgacuaucugaugu

SEQ ID NO: 125416 - RNA, 22 nt, Mycobacterium avium subsp. paratuberculosis
cggugacagccucgucgcgacc

SEQ ID NO: 125417 - RNA, 20 nt, Mycobacterium avium subsp. paratuberculosis
acaccguccgccuggccgag

SEQ ID NO: 125418 - RNA, 22 nt, Mycobacterium avium subsp. paratuberculosis
cagcgcgucgagcaggucgcug

SEQ ID NO: 125419 - RNA, 22 nt, Mycobacterium avium subsp. paratuberculosis
agcagguggugcgcugcagcga

SEQ ID NO: 125420 - RNA, 22 nt, Mycobacterium avium subsp. paratuberculosis
ucgaacuuuucgaggaucacca

SEQ ID NO: 125421 - RNA, 22 nt, Mycobacterium avium subsp. paratuberculosis
aaggagcucguccgggauccgg

SEQ ID NO: 125422 - RNA, 22 nt, Mycobacterium avium subsp. paratuberculosis
acgccgccgagccgcuguugua

SEQ ID NO: 125423 - RNA, 22 nt, Mycobacterium avium subsp. paratuberculosis
gucuuccaguuggcgucgaccu

SEQ ID NO: 125424 - RNA, 22 nt, Mycobacterium avium subsp. paratuberculosis
guggugcugcggccggacggua

SEQ ID NO: 125425 - RNA, 22 nt, Mycobacterium avium subsp. paratuberculosis
uucgcguguccaggaugcaucg

SEQ ID NO: 125426 - RNA, 22 nt, Mycobacterium avium subsp. paratuberculosis
gugcauccuggcgggcgucguc

SEQ ID NO: 125427 - RNA, 22 nt, Mycobacterium avium subsp. paratuberculosis
ucgcgcucagugcacgcucggc

SEQ ID NO: 125428 - RNA, 21 nt, Mycobacterium avium subsp. paratuberculosis
ucgauggaggcggugggcggc

SEQ ID NO: 125429 - RNA, 22 nt, Mycobacterium avium subsp. paratuberculosis
cuucuugcgauugcggcuggcg

SEQ ID NO: 125430 - RNA, 22 nt, Mycobacterium avium subsp. paratuberculosis
uucaucaccgcccacccggauu

SEQ ID NO: 125431 - RNA, 22 nt, Mycobacterium avium subsp. paratuberculosis
accgcuccgcucggccugcgcc

SEQ ID NO: 125432 - RNA, 22 nt, Mycobacterium avium subsp. paratuberculosis
gcgaagucaucaccggggauca

SEQ ID NO: 125433 - RNA, 22 nt, Mycobacterium avium subsp. paratuberculosis
gccgggcuggucggcagcgccc

SEQ ID NO: 125434 - RNA, 22 nt, Mycobacterium avium subsp. paratuberculosis
acauagauggugucgcgggcug

SEQ ID NO: 125435 - RNA, 22 nt, Mycobacterium avium subsp. paratuberculosis
ucgacacccgggccgccaccau

SEQ ID NO: 125436 - RNA, 22 nt, Mycobacterium avium subsp. paratuberculosis
gcgucacgcuggcgugacgcuc

SEQ ID NO: 125437 - RNA, 22 nt, Mycobacterium avium subsp. paratuberculosis
accgucucugucgccgguuccu

SEQ ID NO: 125438 - RNA, 22 nt, Mycobacterium avium subsp. paratuberculosis
gccgggugcugaacgccugaug

SEQ ID NO: 125439 - RNA, 22 nt, Mycobacterium avium subsp. paratuberculosis
aggcgucgacccggcuggccca

SEQ ID NO: 125440 - RNA, 20 nt, Mycobacterium avium subsp. paratuberculosis
accugaccuucuacgaccug

SEQ ID NO: 125441 - RNA, 22 nt, Mycobacterium avium subsp. paratuberculosis
aucaccugcaugagcugguggc

SEQ ID NO: 125442 - RNA, 22 nt, Mycobacterium avium subsp. paratuberculosis
ucgccguccgggcugacguuga

SEQ ID NO: 125443 - RNA, 22 nt, Mycobacterium avium subsp. paratuberculosis
agugcccgccuuugagcgacaa

SEQ ID NO: 125444 - RNA, 22 nt, Mycobacterium avium subsp. paratuberculosis
ggaguugacuucucgggcgucg

SEQ ID NO: 125445 - RNA, 22 nt, Mycobacterium avium subsp. paratuberculosis
acucgcccuggcugagcgucag

SEQ ID NO: 125446 - RNA, 22 nt, Mycobacterium avium subsp. paratuberculosis
cccgaugcgccguccuggccga

SEQ ID NO: 125447 - RNA, 22 nt, Mycobacterium avium subsp. paratuberculosis
cagcccaguguagacggccagc

SEQ ID NO: 125448 - RNA, 22 nt, Mycobacterium avium subsp. paratuberculosis
uugcuguuccugcucaccggca

SEQ ID NO: 125449 - RNA, 22 nt, Mycobacterium avium subsp. paratuberculosis
cggcugagauucgguacggucc

SEQ ID NO: 125450 - RNA, 22 nt, Mycobacterium avium subsp. paratuberculosis
ucgcgcugcccuuggcggcuuc

SEQ ID NO: 125451 - RNA, 22 nt, Mycobacterium avium subsp. paratuberculosis
gcgacgucacccugcuguggcc

SEQ ID NO: 125452 - RNA, 22 nt, Mycobacterium avium subsp. paratuberculosis
guccgcaacgucgacuccgagu

SEQ ID NO: 125453 - RNA, 20 nt, Mycobacterium avium subsp. paratuberculosis
gggcuuuugcgucugcucgc

SEQ ID NO: 125454 - RNA, 23 nt, Mycobacterium avium subsp. paratuberculosis
cacgccagcgugacgcucggugc

SEQ ID NO: 125455 - RNA, 23 nt, Mycobacterium avium subsp. paratuberculosis
gcgguggaggucucgccgccgcc

SEQ ID NO: 125456 - RNA, 22 nt, Mycobacterium avium subsp. paratuberculosis
cgcgaggugucgcuguuccgcg

SEQ ID NO: 125457 - RNA, 22 nt, Mycobacterium avium subsp. paratuberculosis
cugccgaucggcaccguggugc

SEQ ID NO: 125458 - RNA, 22 nt, Mycobacterium avium subsp. paratuberculosis
gaggugaucaucgccggcgccg

SEQ ID NO: 125459 - RNA, 22 nt, Mycobacterium avium subsp. paratuberculosis
gcaacgagaccacccgcaauuc

SEQ ID NO: 125460 - RNA, 22 nt, Mycobacterium avium subsp. paratuberculosis
gcccgcuguccgugugcucgag

SEQ ID NO: 125461 - RNA, 22 nt, Mycobacterium avium subsp. paratuberculosis
cgcccugggucuggaucagcgc

SEQ ID NO: 125462 - RNA, 22 nt, Mycobacterium avium subsp. paratuberculosis
acggcgcccgggccagcaguug

SEQ ID NO: 125463 - RNA, 22 nt, Mycobacterium avium subsp. paratuberculosis
uggugcccagcauuucgggugg

SEQ ID NO: 125464 - RNA, 22 nt, Mycobacterium avium subsp. paratuberculosis
ugguggugcccggcgucggcgc

SEQ ID NO: 125465 - RNA, 22 nt, Mycobacterium avium subsp. paratuberculosis
cuggugcacggcgucgaucugg

SEQ ID NO: 125466 - RNA, 22 nt, Mycobacterium avium subsp. paratuberculosis
uuggugcagcaccgcagccggu

SEQ ID NO: 125467 - RNA, 22 nt, Mycobacterium avium subsp. paratuberculosis
cgccggcgucagagguuggcga

SEQ ID NO: 125468 - RNA, 22 nt, Mycobacterium avium subsp. paratuberculosis
ccucaugagguggccgcgccca

SEQ ID NO: 125469 - RNA, 22 nt, Mycobacterium avium subsp. paratuberculosis
uugggcccacggugaccuaagc

SEQ ID NO: 125470 - RNA, 21 nt, Mycobacterium avium subsp. paratuberculosis
gcuuccugcaugcccucgauc

SEQ ID NO: 125471 - RNA, 22 nt, Mycobacterium avium subsp. paratuberculosis
agcucgccgggugccgucggug

SEQ ID NO: 125472 - RNA, 22 nt, Mycobacterium avium subsp. paratuberculosis
cccgguucgcgaauucggcggc

SEQ ID NO: 125473 - RNA, 22 nt, Mycobacterium avium subsp. paratuberculosis
cgcccguuuuccguugaugcgc

SEQ ID NO: 125474 - RNA, 22 nt, Mycobacterium avium subsp. paratuberculosis
gacgacagaccuuccucggccg

SEQ ID NO: 125475 - RNA, 22 nt, Mycobacterium avium subsp. paratuberculosis
gggguuggagucggugucgcug

SEQ ID NO: 125476 - RNA, 22 nt, Mycobacterium avium subsp. paratuberculosis
ugcgcgaucucgccgcauacac

SEQ ID NO: 125477 - RNA, 22 nt, Mycobacterium avium subsp. paratuberculosis
ugauggccgagcaggucgacug

SEQ ID NO: 125478 - RNA, 22 nt, Mycobacterium avium subsp. paratuberculosis
uucugcucgacgaccucgccga

SEQ ID NO: 125479 - RNA, 22 nt, Mycobacterium avium subsp. paratuberculosis
uggcugcuguacgccgugccgg

SEQ ID NO: 125480 - RNA, 21 nt, Mycobacterium avium subsp. paratuberculosis
ccggcgagcggacugccgcag

SEQ ID NO: 125481 - RNA, 22 nt, Mycobacterium avium subsp. paratuberculosis
ugcgcccgugugguguucggac

SEQ ID NO: 125482 - RNA, 22 nt, Mycobacterium avium subsp. paratuberculosis
cagcacccgcacuccggcggcc

SEQ ID NO: 125483 - RNA, 22 nt, Mycobacterium avium subsp. paratuberculosis
ccagcacgaucaggucggccag

SEQ ID NO: 125484 - RNA, 22 nt, Mycobacterium avium subsp. paratuberculosis
ccgauccacagcggccgccggc

SEQ ID NO: 125485 - RNA, 22 nt, Mycobacterium avium subsp. paratuberculosis
gcggcggguucggcauccacgu

SEQ ID NO: 125486 - RNA, 20 nt, Mycobacterium avium subsp. paratuberculosis
acgacgcguacaucagcgcg

SEQ ID NO: 125487 - RNA, 22 nt, Mycobacterium avium subsp. paratuberculosis
uggagcgguccuuggccuccag

SEQ ID NO: 125488 - RNA, 22 nt, Mycobacterium avium subsp. paratuberculosis
ucccgagcgucacgcuggcgcu

SEQ ID NO: 125489 - RNA, 23 nt, Mycobacterium avium subsp. paratuberculosis
gcuaccaccgguguacggcggga

SEQ ID NO: 125490 - RNA, 22 nt, Mycobacterium avium subsp. paratuberculosis
caccuguaccccgaucugccca

SEQ ID NO: 125491 - RNA, 22 nt, Mycobacterium avium subsp. paratuberculosis
ucggccagcgucgccgucagca

SEQ ID NO: 125492 - RNA, 22 nt, Mycobacterium avium subsp. paratuberculosis
uuggccgccuucucgaccgcgg

SEQ ID NO: 125493 - RNA, 22 nt, Mycobacterium avium subsp. paratuberculosis
gcucaggcuaugcaagcaggcc

SEQ ID NO: 125494 - RNA, 22 nt, Mycobacterium avium subsp. paratuberculosis
gaaggugaaguuggcguuguug

SEQ ID NO: 125495 - RNA, 22 nt, Mycobacterium avium subsp. paratuberculosis
gccgagcgugcacugagcgcga

SEQ ID NO: 125496 - RNA, 22 nt, Mycobacterium avium subsp. paratuberculosis
cacgugcgcgguggcggcgaga

SEQ ID NO: 125497 - RNA, 23 nt, Mycobacterium avium subsp. paratuberculosis
cugcccggcauggucgccucggc

SEQ ID NO: 125498 - RNA, 22 nt, Mycobacterium avium subsp. paratuberculosis
cgcggcugcuggucgaguacug

SEQ ID NO: 125499 - RNA, 22 nt, Mycobacterium avium subsp. paratuberculosis
gugaccgcgcgagagcaguacg

SEQ ID NO: 125500 - RNA, 22 nt, Mycobacterium avium subsp. paratuberculosis
cgccaugaagcugacguauugc

SEQ ID NO: 125501 - RNA, 22 nt, Mycobacterium avium subsp. paratuberculosis
cgcugcgggcgcugaucaugga

SEQ ID NO: 125502 - RNA, 22 nt, Mycobacterium avium subsp. paratuberculosis
ugccagcccaaucauguucgua

SEQ ID NO: 125503 - RNA, 18 nt, Mycobacterium avium subsp. paratuberculosis
cggagccggcugaugcuc

SEQ ID NO: 125504 - RNA, 22 nt, Mycobacterium avium subsp. paratuberculosis
uugucccggaacgccgacgucg

SEQ ID NO: 125505 - RNA, 22 nt, Mycobacterium avium subsp. paratuberculosis
gcgacgacggcucgaucgaggg

SEQ ID NO: 125506 - RNA, 22 nt, Mycobacterium avium subsp. paratuberculosis
agcggcaggucccaggccagga

SEQ ID NO: 125507 - RNA, 22 nt, Mycobacterium avium subsp. paratuberculosis
cuccaucggguuggccggaucg

SEQ ID NO: 125508 - RNA, 22 nt, Mycobacterium avium subsp. paratuberculosis
uuggugauccggaagcgcucga

SEQ ID NO: 125509 - RNA, 22 nt, Mycobacterium avium subsp. paratuberculosis
gaugucggcgcccaccugcugg

SEQ ID NO: 125510 - RNA, 22 nt, Mycobacterium avium subsp. paratuberculosis
gggcuggacgaacccgugggug

SEQ ID NO: 125511 - RNA, 22 nt, Mycobacterium avium subsp. paratuberculosis
ucggugaccacccgcucgcgcg

SEQ ID NO: 125512 - RNA, 20 nt, Mycobacterium avium subsp. paratuberculosis
ucggcacccggcugugcugg

SEQ ID NO: 125513 - RNA, 22 nt, Mycobacterium avium subsp. paratuberculosis
accgccguggacgugcucgacu

SEQ ID NO: 125514 - RNA, 22 nt, Mycobacterium avium subsp. paratuberculosis
accccccacgucauaggcggcg

SEQ ID NO: 125515 - RNA, 20 nt, Mycobacterium avium subsp. paratuberculosis
ggcgucguccaucacgucgc

SEQ ID NO: 125516 - RNA, 22 nt, Mycobacterium avium subsp. paratuberculosis
acgagcgagggccaggcgcgcu

SEQ ID NO: 125517 - RNA, 22 nt, Mycobacterium avium subsp. paratuberculosis
uaccggccggaggccacggcga

SEQ ID NO: 125518 - RNA, 21 nt, Mycobacterium avium subsp. paratuberculosis
cagugccgacgaucugcccca

SEQ ID NO: 125519 - RNA, 22 nt, Mycobacterium avium subsp. paratuberculosis
gcgauucugccagccggccgcg

SEQ ID NO: 125520 - RNA, 22 nt, Mycobacterium avium subsp. paratuberculosis
uauugcucagggacuuguguga

SEQ ID NO: 125521 - RNA, 19 nt, Mycobacterium avium subsp. paratuberculosis
uggccgucgaugauguuga

SEQ ID NO: 125522 - RNA, 22 nt, Mycobacterium avium subsp. paratuberculosis
ucgugguuggcgacgugcuuga

SEQ ID NO: 125523 - RNA, 22 nt, Mycobacterium avium subsp. paratuberculosis
cucgugguggacggucagcgcg

SEQ ID NO: 125524 - RNA, 22 nt, Mycobacterium avium subsp. paratuberculosis
acccgcuggcgaugcggccgca

SEQ ID NO: 125525 - RNA, 22 nt, Mycobacterium avium subsp. paratuberculosis
uggccgcgcuggcgcccuggaa

SEQ ID NO: 125526 - RNA, 22 nt, Mycobacterium avium subsp. paratuberculosis
gaucgcggugugcuucuugauc

SEQ ID NO: 125527 - RNA, 22 nt, Mycobacterium avium subsp. paratuberculosis
ggaucgaggacgucgccgacgc

SEQ ID NO: 125528 - RNA, 22 nt, Mycobacterium avium subsp. paratuberculosis
ucuggucgaggucgucggcgaa

SEQ ID NO: 125529 - RNA, 22 nt, Mycobacterium avium subsp. paratuberculosis
ugcggggcucgucgccgaacac

SEQ ID NO: 125530 - RNA, 22 nt, Mycobacterium avium subsp. paratuberculosis
aacaggauuccgacaccgccgc

SEQ ID NO: 125531 - RNA, 22 nt, Mycobacterium avium subsp. paratuberculosis
uuucgcccagcaagucgacguu

SEQ ID NO: 125532 - RNA, 22 nt, Mycobacterium avium subsp. paratuberculosis
gcguaguaccaccaccggcccu

SEQ ID NO: 125533 - RNA, 22 nt, Mycobacterium avium subsp. paratuberculosis
gaggcgcccaugcggguggugg

SEQ ID NO: 125534 - RNA, 22 nt, Mycobacterium avium subsp. paratuberculosis
gcucggcgaugguguuggccaa

SEQ ID NO: 125535 - RNA, 22 nt, Mycobacterium avium subsp. paratuberculosis
gcggcccgccucguaucagggc

SEQ ID NO: 125536 - RNA, 22 nt, Mycobacterium avium subsp. paratuberculosis
ggucaccgcggcggugcucgaa

SEQ ID NO: 125537 - RNA, 22 nt, Mycobacterium avium subsp. paratuberculosis
gggaaucggcccgcugccgucg

SEQ ID NO: 125538 - RNA, 22 nt, Mycobacterium avium subsp. paratuberculosis
gcgcugaaugcgcauggcccgc

SEQ ID NO: 125539 - RNA, 22 nt, Mycobacterium avium subsp. paratuberculosis
ugcuggguguuccgcaggagga

SEQ ID NO: 125540 - RNA, 22 nt, Mycobacterium avium subsp. paratuberculosis
aucauggcgaugacggugcgcg

SEQ ID NO: 125541 - RNA, 20 nt, Mycobacterium avium subsp. paratuberculosis
uccuggugaucggcuucucg

SEQ ID NO: 125542 - RNA, 22 nt, Mycobacterium avium subsp. paratuberculosis
ggcacauccugugcggcgucga

SEQ ID NO: 125543 - RNA, 22 nt, Mycobacterium avium subsp. paratuberculosis
uggacagcagcaccgccagggc

SEQ ID NO: 125544 - RNA, 22 nt, Mycobacterium avium subsp. paratuberculosis
cuggccgucggugaccacgucg

SEQ ID NO: 125545 - RNA, 22 nt, Mycobacterium avium subsp. paratuberculosis
accuggcggccgcgcgggccaa

SEQ ID NO: 125546 - RNA, 22 nt, Mycobacterium avium subsp. paratuberculosis
augaucgccuggccgccgcggc

SEQ ID NO: 125547 - RNA, 17 nt, Mycobacterium avium subsp. paratuberculosis
ugguggcguuguguuca

SEQ ID NO: 125548 - RNA, 22 nt, Mycobacterium avium subsp. paratuberculosis
gucgucgucgaaguccggcgcc

SEQ ID NO: 125549 - RNA, 22 nt, Mycobacterium avium subsp. paratuberculosis
acgccguguggcagcgcugguu

SEQ ID NO: 125550 - RNA, 17 nt, Mycobacterium avium subsp. paratuberculosis
uguuggcggcacugauc

SEQ ID NO: 125551 - RNA, 22 nt, Mycobacterium avium subsp. paratuberculosis
gcgagcagacgcgaaagcaccc

SEQ ID NO: 125552 - RNA, 22 nt, Mycobacterium avium subsp. paratuberculosis
uguccaggugguuggucggcuc

SEQ ID NO: 125553 - RNA, 22 nt, Mycobacterium avium subsp. paratuberculosis
ugcgcgaagccgaacugcgcug

SEQ ID NO: 125554 - RNA, 22 nt, Mycobacterium avium subsp. paratuberculosis
ccgauggcgcuggugcuggcgc

SEQ ID NO: 125555 - RNA, 22 nt, Mycobacterium avium subsp. paratuberculosis
cgacucuucguaauacggcuuc

SEQ ID NO: 125556 - RNA, 22 nt, Mycobacterium avium subsp. paratuberculosis
gcuggugcaaagcggcgccggc

SEQ ID NO: 125557 - RNA, 22 nt, Mycobacterium avium subsp. paratuberculosis
aucggcgcagcugaccugguuc

SEQ ID NO: 125558 - RNA, 22 nt, Mycobacterium avium subsp. paratuberculosis
gacccggucguggucgcauggc

SEQ ID NO: 125559 - RNA, 22 nt, Mycobacterium avium subsp. paratuberculosis
aacaugcaggucgagcugguga

SEQ ID NO: 125560 - RNA, 22 nt, Mycobacterium avium subsp. paratuberculosis
gcgcugaugcaggcgaccggca

SEQ ID NO: 125561 - RNA, 20 nt, Mycobacterium avium subsp. paratuberculosis
cgaacgcacgagcggucagc

SEQ ID NO: 125562 - RNA, 20 nt, Mycobacterium avium subsp. paratuberculosis
ucgucggucucggcgaugac

SEQ ID NO: 125563 - RNA, 22 nt, Mycobacterium avium subsp. paratuberculosis
guugguggaucgucgcgaaguc

SEQ ID NO: 125564 - RNA, 22 nt, Mycobacterium avium subsp. paratuberculosis
caggcuggcaucgucggcgccg

SEQ ID NO: 125565 - RNA, 22 nt, Mycobacterium avium subsp. paratuberculosis
ucguugaucagcccgccggugu

SEQ ID NO: 125566 - RNA, 19 nt, Mycobacterium avium subsp. paratuberculosis
uggcggucagcgggcugcc

SEQ ID NO: 125567 - RNA, 22 nt, Mycobacterium avium subsp. paratuberculosis
cgguuauccacaggucgcgguc

SEQ ID NO: 125568 - RNA, 22 nt, Mycobacterium avium subsp. paratuberculosis
cgacggucgccugggcgggaac

SEQ ID NO: 125569 - RNA, 22 nt, Mycobacterium avium subsp. paratuberculosis
cggguccaacgccaggguggcg

SEQ ID NO: 125570 - RNA, 22 nt, Mycobacterium avium subsp. paratuberculosis
cgaggugaucggccgccggcuc

SEQ ID NO: 125571 - RNA, 22 nt, Mycobacterium avium subsp. paratuberculosis
uuucggcgaggaccugguggcc

SEQ ID NO: 125572 - RNA, 22 nt, Mycobacterium avium subsp. paratuberculosis
cguucgaggaguucgaccgcga

SEQ ID NO: 125573 - RNA, 21 nt, Mycobacterium avium subsp. paratuberculosis
ucgaugccgucgaacagcugc

SEQ ID NO: 125574 - RNA, 22 nt, Mycobacterium avium subsp. paratuberculosis
acgacguaccgggcgcugggca

SEQ ID NO: 125575 - RNA, 22 nt, Mycobacterium avium subsp. paratuberculosis
ccggugagguuggacggcgccu

SEQ ID NO: 125576 - RNA, 22 nt, Mycobacterium avium subsp. paratuberculosis
ggcucaccauuuguuugcccgg

SEQ ID NO: 125577 - RNA, 22 nt, Mycobacterium avium subsp. paratuberculosis
gcgccgaccuggccggcgacgg

SEQ ID NO: 125578 - RNA, 22 nt, Mycobacterium avium subsp. paratuberculosis
cugcuggucgaucugguggacc

SEQ ID NO: 125579 - RNA, 23 nt, Mycobacterium avium subsp. paratuberculosis
ggggauuucacgucugcucggcg

SEQ ID NO: 125580 - RNA, 22 nt, Mycobacterium avium subsp. paratuberculosis
gugucacgcuggcgugacguuc

SEQ ID NO: 125581 - RNA, 22 nt, Mycobacterium avium subsp. paratuberculosis
cagcgggucggcgccgauccgc

SEQ ID NO: 125582 - RNA, 22 nt, Mycobacterium avium subsp. paratuberculosis
ucgcuggcggucuccgggucga

SEQ ID NO: 125583 - RNA, 22 nt, Mycobacterium avium subsp. paratuberculosis
cggucgaagccacgucgacgcg

SEQ ID NO: 125584 - RNA, 22 nt, Mycobacterium avium subsp. paratuberculosis
uggcgcugcaacugguagcgga

SEQ ID NO: 125585 - RNA, 20 nt, Mycobacterium avium subsp. paratuberculosis
ccagcgcgucgacgacguug

SEQ ID NO: 125586 - RNA, 22 nt, Mycobacterium avium subsp. paratuberculosis
ccgucgaacguggaguuguugc

SEQ ID NO: 125587 - RNA, 22 nt, Mycobacterium avium subsp. paratuberculosis
gcggucgucaccgccgccgccu

SEQ ID NO: 125588 - RNA, 22 nt, Mycobacterium avium subsp. paratuberculosis
ucggugucgcggaguugucgga

SEQ ID NO: 125589 - RNA, 22 nt, Mycobacterium avium subsp. paratuberculosis
uugagcgguuacacgcgggccg

SEQ ID NO: 125590 - RNA, 22 nt, Mycobacterium avium subsp. paratuberculosis
cggugaugacgacgacgcggcc

SEQ ID NO: 125591 - RNA, 22 nt, Mycobacterium avium subsp. paratuberculosis
acgcuggucgacgccugccccu

SEQ ID NO: 125592 - RNA, 22 nt, Mycobacterium avium subsp. paratuberculosis
cgaacacgccggucugcgaucc

SEQ ID NO: 125593 - RNA, 22 nt, Mycobacterium avium subsp. paratuberculosis
gggcuuuugcgucugcucgcga

SEQ ID NO: 125594 - RNA, 20 nt, Mycobacterium avium subsp. paratuberculosis
aggucgugaacucgccgauc

SEQ ID NO: 125595 - RNA, 22 nt, Mycobacterium avium subsp. paratuberculosis
ccgucgacgacgugcaccagca

SEQ ID NO: 125596 - RNA, 22 nt, Mycobacterium avium subsp. paratuberculosis
ugucguccgguuucaccugggg

SEQ ID NO: 125597 - RNA, 22 nt, Mycobacterium avium subsp. paratuberculosis
gccggcaugcuggucaccgggc

SEQ ID NO: 125598 - RNA, 22 nt, Mycobacterium avium subsp. paratuberculosis
gcaaggugcucaagcaucggau

SEQ ID NO: 125599 - RNA, 22 nt, Mycobacterium avium subsp. paratuberculosis
gcgcugcacgagcacauccugg

SEQ ID NO: 125600 - RNA, 22 nt, Mycobacterium avium subsp. paratuberculosis
gcgugcaggcccgccacgucuc

SEQ ID NO: 125601 - RNA, 22 nt, Mycobacterium avium subsp. paratuberculosis
aacgagcaugucgucggcaaag

SEQ ID NO: 125602 - RNA, 22 nt, Mycobacterium avium subsp. paratuberculosis
aucggguucacccgcgccggcg

SEQ ID NO: 125603 - RNA, 22 nt, Mycobacterium avium subsp. paratuberculosis
cgcgauggcgaugaucagguga

SEQ ID NO: 125604 - RNA, 22 nt, Mycobacterium avium subsp. paratuberculosis
cgauguccgacggcccggucca

SEQ ID NO: 125605 - RNA, 22 nt, Mycobacterium avium subsp. paratuberculosis
cugauuguguucgcggcggccu

SEQ ID NO: 125606 - RNA, 19 nt, Mycobacterium avium subsp. paratuberculosis
ccgaaucgcugcugugcga

SEQ ID NO: 125607 - RNA, 22 nt, Mycobacterium avium subsp. paratuberculosis
cgaucuggucgggcaaggugcu

SEQ ID NO: 125608 - RNA, 22 nt, Mycobacterium avium subsp. paratuberculosis
gaucgcccucgaugcccugcag

SEQ ID NO: 125609 - RNA, 22 nt, Mycobacterium avium subsp. paratuberculosis
cggcgcgcgguuccucgucgac

SEQ ID NO: 125610 - RNA, 22 nt, Mycobacterium avium subsp. paratuberculosis
ggacgcugauccugggcucguu

SEQ ID NO: 125611 - RNA, 22 nt, Mycobacterium avium subsp. paratuberculosis
accgugcagugccgggccgaga

SEQ ID NO: 125612 - RNA, 22 nt, Mycobacterium avium subsp. paratuberculosis
cgccgagcgugggccguaugga

SEQ ID NO: 125613 - RNA, 22 nt, Mycobacterium avium subsp. paratuberculosis
guggcacucuuggccgcgacga

SEQ ID NO: 125614 - RNA, 22 nt, Mycobacterium avium subsp. paratuberculosis
caccugcagggcuggacgcugg

SEQ ID NO: 125615 - RNA, 22 nt, Mycobacterium avium subsp. paratuberculosis
gcccggcuggguguugcggugc

SEQ ID NO: 125616 - RNA, 22 nt, Mycobacterium avium subsp. paratuberculosis
aaccaaggcgucuacgguuugc

SEQ ID NO: 125617 - RNA, 22 nt, Mycobacterium avium subsp. paratuberculosis
cggccaccgacaccucgaacaa

SEQ ID NO: 125618 - RNA, 22 nt, Mycobacterium avium subsp. paratuberculosis
gcgcgguaggacggguggcgac

SEQ ID NO: 125619 - RNA, 22 nt, Mycobacterium avium subsp. paratuberculosis
cagcagcugggaaucggcauga

SEQ ID NO: 125620 - RNA, 22 nt, Mycobacterium avium subsp. paratuberculosis
gcacgugugacgcuucgccacg

SEQ ID NO: 125621 - RNA, 22 nt, Mycobacterium avium subsp. paratuberculosis
gggcgcuggcgcuggacagcga

SEQ ID NO: 125622 - RNA, 22 nt, Mycobacterium avium subsp. paratuberculosis
ccgcggucgacgucaccggcgg

SEQ ID NO: 125623 - RNA, 22 nt, Mycobacterium avium subsp. paratuberculosis
gagcaugugcugucccuggucg

SEQ ID NO: 125624 - RNA, 22 nt, Mycobacterium avium subsp. paratuberculosis
gucggcaugggccgggcgcuga

SEQ ID NO: 125625 - RNA, 22 nt, Mycobacterium avium subsp. paratuberculosis
ccgagcaggucggcggcgucgu

SEQ ID NO: 125626 - RNA, 22 nt, Mycobacterium avium subsp. paratuberculosis
cuguccggacaggcggccgacc

SEQ ID NO: 125627 - RNA, 22 nt, Mycobacterium avium subsp. paratuberculosis
cgggcuguuccgcacccggcgg

SEQ ID NO: 125628 - RNA, 22 nt, Mycobacterium avium subsp. paratuberculosis
ggcgugggcgcugaucgccgcc

SEQ ID NO: 125629 - RNA, 22 nt, Mycobacterium avium subsp. paratuberculosis
agaccgggaaccguggcacugu

SEQ ID NO: 125630 - RNA, 22 nt, Mycobacterium avium subsp. paratuberculosis
ccuucgccuccggcauggccgc

SEQ ID NO: 125631 - RNA, 22 nt, Mycobacterium avium subsp. paratuberculosis
ccugguucugcagcgugcggau

SEQ ID NO: 125632 - RNA, 22 nt, Mycobacterium avium subsp. paratuberculosis
ggucaggcucacgaucgcggcg

SEQ ID NO: 125633 - RNA, 22 nt, Mycobacterium avium subsp. paratuberculosis
gucaccaucaguugccacgacg

SEQ ID NO: 125634 - RNA, 22 nt, Mycobacterium avium subsp. paratuberculosis
uucgucgacguggugcuggcgc

SEQ ID NO: 125635 - RNA, 22 nt, Mycobacterium avium subsp. paratuberculosis
uggucgcgacgucaugggcgag

SEQ ID NO: 125636 - RNA, 22 nt, Mycobacterium avium subsp. paratuberculosis
gucaucuuggccugaccggacu

SEQ ID NO: 125637 - RNA, 22 nt, Mycobacterium avium subsp. paratuberculosis
ggcucgucgaccagccgcugcc

SEQ ID NO: 125638 - RNA, 22 nt, Mycobacterium avium subsp. paratuberculosis
ggcgcauguugguuugcgcguu

SEQ ID NO: 125639 - RNA, 22 nt, Mycobacterium avium subsp. paratuberculosis
accacggcgguggucgcgcggu

SEQ ID NO: 125640 - RNA, 22 nt, Mycobacterium avium subsp. paratuberculosis
gccguccuugcgggccuguucg

SEQ ID NO: 125641 - RNA, 22 nt, Mycobacterium avium subsp. paratuberculosis
ucgugcaccucaacgacccggg

SEQ ID NO: 125642 - RNA, 22 nt, Mycobacterium avium subsp. paratuberculosis
gaugaucagggucagcgccgca

SEQ ID NO: 125643 - RNA, 22 nt, Mycobacterium avium subsp. paratuberculosis
guacuucagguagcccagggcg

SEQ ID NO: 125644 - RNA, 22 nt, Mycobacterium avium subsp. paratuberculosis
gccgagcgucacgccagugugg

SEQ ID NO: 125645 - RNA, 22 nt, Mycobacterium avium subsp. paratuberculosis
agcgccgagcaguacguggccg

SEQ ID NO: 125646 - RNA, 22 nt, Mycobacterium avium subsp. paratuberculosis
gcgggucguaaucggcgagcag

SEQ ID NO: 125647 - RNA, 22 nt, Mycobacterium avium subsp. paratuberculosis
accgggguguucugcggcggcg

SEQ ID NO: 125648 - RNA, 22 nt, Mycobacterium avium subsp. paratuberculosis
cagcgcgugccguuccagcugg

SEQ ID NO: 125649 - RNA, 22 nt, Mycobacterium avium subsp. paratuberculosis
gucgggcggguccuggaaggug

SEQ ID NO: 125650 - RNA, 22 nt, Mycobacterium avium subsp. paratuberculosis
aucgcgauguuccucucgguag

SEQ ID NO: 125651 - RNA, 22 nt, Mycobacterium avium subsp. paratuberculosis
uugggcggcaacgccgcucggc

SEQ ID NO: 125652 - RNA, 22 nt, Mycobacterium avium subsp. paratuberculosis
ccaccccgaugaucuggcggga

SEQ ID NO: 125653 - RNA, 22 nt, Mycobacterium avium subsp. paratuberculosis
uggcgcugaucgacgugcgcga

SEQ ID NO: 125654 - RNA, 22 nt, Mycobacterium avium subsp. paratuberculosis
gcuggcguggaucgaccgcuga

SEQ ID NO: 125655 - RNA, 22 nt, Mycobacterium avium subsp. paratuberculosis
aaagauggacccgaucgagauc

SEQ ID NO: 125656 - RNA, 22 nt, Mycobacterium avium subsp. paratuberculosis
aucgcggcgugcccgcugaccu

SEQ ID NO: 125657 - RNA, 22 nt, Mycobacterium avium subsp. paratuberculosis
uugucgcugcgaggcgggcaca

SEQ ID NO: 125658 - RNA, 22 nt, Mycobacterium avium subsp. paratuberculosis
agggccaucgcgugagucucug

SEQ ID NO: 125659 - RNA, 22 nt, Mycobacterium avium subsp. paratuberculosis
ugcgcaccgaguugcugcgcga

SEQ ID NO: 125660 - RNA, 22 nt, Mycobacterium avium subsp. paratuberculosis
ccgucgcccuuggugagaaugu

SEQ ID NO: 125661 - RNA, 22 nt, Mycobacterium avium subsp. paratuberculosis
cggcugguggauucggcucgag

SEQ ID NO: 125662 - RNA, 22 nt, Mycobacterium avium subsp. paratuberculosis
cggacgaaguccucggcguucu

SEQ ID NO: 125663 - RNA, 22 nt, Mycobacterium avium subsp. paratuberculosis
gcccgaccaggacaugcugagc

SEQ ID NO: 125664 - RNA, 22 nt, Mycobacterium avium subsp. paratuberculosis
ugggcucagccugcuggucgaa

SEQ ID NO: 125665 - RNA, 22 nt, Mycobacterium avium subsp. paratuberculosis
gccgucauccacgacgcgucgu

SEQ ID NO: 125666 - RNA, 22 nt, Mycobacterium avium subsp. paratuberculosis
gcgcucaucaucugcuuggccu

SEQ ID NO: 125667 - RNA, 22 nt, Mycobacterium avium subsp. paratuberculosis
gagcgugggggguaugcacgau

SEQ ID NO: 125668 - RNA, 20 nt, Mycobacterium avium subsp. paratuberculosis
uacaccgccgcgcagguggc

SEQ ID NO: 125669 - RNA, 22 nt, Mycobacterium avium subsp. paratuberculosis
ccgaugccguugguggugcgcu

SEQ ID NO: 125670 - RNA, 22 nt, Mycobacterium avium subsp. paratuberculosis
gccucgggcagcaggucgucga

SEQ ID NO: 125671 - RNA, 22 nt, Mycobacterium avium subsp. paratuberculosis
ucggugacgugccgcugaaccu

SEQ ID NO: 125672 - RNA, 22 nt, Mycobacterium avium subsp. paratuberculosis
ccuggacgcugaucccggcgcu

SEQ ID NO: 125673 - RNA, 20 nt, Mycobacterium avium subsp. paratuberculosis
cggugucgaccgagucgcgg

SEQ ID NO: 125674 - RNA, 22 nt, Mycobacterium avium subsp. paratuberculosis
gccgccuguaacgccaugacga

SEQ ID NO: 125675 - RNA, 22 nt, Mycobacterium avium subsp. paratuberculosis
ggcgcggacuggacggccgcca

SEQ ID NO: 125676 - RNA, 22 nt, Mycobacterium avium subsp. paratuberculosis
gucgacgaggacgacuuucggu

SEQ ID NO: 125677 - RNA, 22 nt, Mycobacterium avium subsp. paratuberculosis
cugcgcaucccaggugaaugac

SEQ ID NO: 125678 - RNA, 22 nt, Mycobacterium avium subsp. paratuberculosis
aaugggagccagcugucgaccg

SEQ ID NO: 125679 - RNA, 22 nt, Mycobacterium avium subsp. paratuberculosis
ggccgucguugaggauguacgg

SEQ ID NO: 125680 - RNA, 23 nt, Mycobacterium avium subsp. paratuberculosis
ccugaccgcccacgagaaccacg

SEQ ID NO: 125681 - RNA, 22 nt, Mycobacterium avium subsp. paratuberculosis
guaucgacuacccaccaaguuu

SEQ ID NO: 125682 - RNA, 22 nt, Mycobacterium avium subsp. paratuberculosis
guugccgagucguggucgguga

SEQ ID NO: 125683 - RNA, 22 nt, Mycobacterium avium subsp. paratuberculosis
ccacggcguuguggccggcguc

SEQ ID NO: 125684 - RNA, 22 nt, Mycobacterium avium subsp. paratuberculosis
gcccgggggaagcuccugcugc

SEQ ID NO: 125685 - RNA, 22 nt, Mycobacterium avium subsp. paratuberculosis
ucgaggaauugccgcagcgacu

SEQ ID NO: 125686 - RNA, 22 nt, Mycobacterium avium subsp. paratuberculosis
ucuaccuuccgccggaggcguu

SEQ ID NO: 125687 - RNA, 22 nt, Mycobacterium avium subsp. paratuberculosis
gccgccgguuacucggccacgc

SEQ ID NO: 125688 - RNA, 22 nt, Mycobacterium avium subsp. paratuberculosis
gacggcggcagggucgaucagg

SEQ ID NO: 125689 - RNA, 22 nt, Mycobacterium avium subsp. paratuberculosis
caucgaucguggcggcgacccg

SEQ ID NO: 125690 - RNA, 22 nt, Mycobacterium avium subsp. paratuberculosis
ugcucucaccgguguugagcag

SEQ ID NO: 125691 - RNA, 21 nt, Mycobacterium avium subsp. paratuberculosis
acgagccgacgaugucggccc

SEQ ID NO: 125692 - RNA, 21 nt, Mycobacterium avium subsp. paratuberculosis
acggaagcggugauggcgucg

SEQ ID NO: 125693 - RNA, 22 nt, Mycobacterium avium subsp. paratuberculosis
gaugcugcugaaagccggucug

SEQ ID NO: 125694 - RNA, 22 nt, Mycobacterium avium subsp. paratuberculosis
uggugugcgcccggcuguugcu

SEQ ID NO: 125695 - RNA, 19 nt, Mycobacterium avium subsp. paratuberculosis
cacgccggcgugacgcucg

SEQ ID NO: 125696 - RNA, 22 nt, Mycobacterium avium subsp. paratuberculosis
gccgagcgucacgccagcguga

SEQ ID NO: 125697 - RNA, 22 nt, Mycobacterium avium subsp. paratuberculosis
aguucgacguugucgcgcugca

SEQ ID NO: 125698 - RNA, 22 nt, Mycobacterium avium subsp. paratuberculosis
cuccagggugagcgugacgcug

SEQ ID NO: 125699 - RNA, 22 nt, Mycobacterium avium subsp. paratuberculosis
ccuggccgacaccaaccccgaa

SEQ ID NO: 125700 - RNA, 22 nt, Mycobacterium avium subsp. paratuberculosis
gaugcggcugccgucgguggac

SEQ ID NO: 125701 - RNA, 22 nt, Mycobacterium avium subsp. paratuberculosis
aacggcggcaucagcuucggcg

SEQ ID NO: 125702 - RNA, 22 nt, Mycobacterium avium subsp. paratuberculosis
ccaacaacucgacguucggcgg

SEQ ID NO: 125703 - RNA, 22 nt, Mycobacterium avium subsp. paratuberculosis
cggcccgguauccgcggucacg

SEQ ID NO: 125704 - RNA, 22 nt, Mycobacterium avium subsp. paratuberculosis
ggacaaggucgaagcgcuggac

SEQ ID NO: 125705 - RNA, 22 nt, Mycobacterium avium subsp. paratuberculosis
guggcggucuugaauucgauca

SEQ ID NO: 125706 - RNA, 22 nt, Mycobacterium avium subsp. paratuberculosis
cuugccggccauccggaugacg

SEQ ID NO: 125707 - RNA, 18 nt, Mycobacterium avium subsp. paratuberculosis
cgucgcccgcaucaccuc

SEQ ID NO: 125708 - RNA, 22 nt, Mycobacterium avium subsp. paratuberculosis
cgccgguggugcgcaccugcag

SEQ ID NO: 125709 - RNA, 22 nt, Mycobacterium avium subsp. paratuberculosis
cccggugaucaugcucaccacg

SEQ ID NO: 125710 - RNA, 22 nt, Mycobacterium avium subsp. paratuberculosis
accacgcuguagaugcccgcgc

SEQ ID NO: 125711 - RNA, 22 nt, Mycobacterium avium subsp. paratuberculosis
uuuccgccccggcgcugaacaa

SEQ ID NO: 125712 - RNA, 22 nt, Mycobacterium avium subsp. paratuberculosis
ccgagcgcgccaccguguucga

SEQ ID NO: 125713 - RNA, 22 nt, Mycobacterium avium subsp. paratuberculosis
agcaucgcgaagaugccgucga

SEQ ID NO: 125714 - RNA, 22 nt, Mycobacterium avium subsp. paratuberculosis
ggcggucaauguccgcgacgau

SEQ ID NO: 125715 - RNA, 22 nt, Mycobacterium avium subsp. paratuberculosis
ucggggugugcaggacgggauc

SEQ ID NO: 125716 - RNA, 22 nt, Mycobacterium avium subsp. paratuberculosis
agguucccgcgcucagcgcggu

SEQ ID NO: 125717 - RNA, 22 nt, Mycobacterium avium subsp. paratuberculosis
gcugcucgauuucccugcgguu

SEQ ID NO: 125718 - RNA, 22 nt, Mycobacterium avium subsp. paratuberculosis
ccgcccggcggaugcgggucga

SEQ ID NO: 125719 - RNA, 22 nt, Mycobacterium avium subsp. paratuberculosis
gaugcggcaccgcggcuucggc

SEQ ID NO: 125720 - RNA, 22 nt, Mycobacterium avium subsp. paratuberculosis
acaugcgugcgcgaggaggcgu

SEQ ID NO: 125721 - RNA, 22 nt, Mycobacterium avium subsp. paratuberculosis
gucgacgucgggcggcuguucu

SEQ ID NO: 125722 - RNA, 22 nt, Mycobacterium avium subsp. paratuberculosis
gacaaggucuacuccggggcgu

SEQ ID NO: 125723 - RNA, 22 nt, Mycobacterium avium subsp. paratuberculosis
ucacgucgcuggucgugcagcg

SEQ ID NO: 125724 - RNA, 22 nt, Mycobacterium avium subsp. paratuberculosis
cacgucgaggccgggccgcauc

SEQ ID NO: 125725 - RNA, 22 nt, Mycobacterium avium subsp. paratuberculosis
cgucgucgaccaucucguagua

SEQ ID NO: 125726 - RNA, 22 nt, Mycobacterium avium subsp. paratuberculosis
ucggugcgaugguggucgccgu

SEQ ID NO: 125727 - RNA, 22 nt, Mycobacterium avium subsp. paratuberculosis
gcgaggucaugcggacccgcac

SEQ ID NO: 125728 - RNA, 22 nt, Mycobacterium avium subsp. paratuberculosis
cgcguucgaaagugacgucgug

SEQ ID NO: 125729 - RNA, 22 nt, Mycobacterium avium subsp. paratuberculosis
uugcccgccgcgcugaccgauu

SEQ ID NO: 125730 - RNA, 22 nt, Mycobacterium avium subsp. paratuberculosis
aggccgcguccaugucggccgg

SEQ ID NO: 125731 - RNA, 22 nt, Mycobacterium avium subsp. paratuberculosis
uggccgccguccuugcccugug

SEQ ID NO: 125732 - RNA, 22 nt, Mycobacterium avium subsp. paratuberculosis
gagcugcucgaggcgcggucgc

SEQ ID NO: 125733 - RNA, 22 nt, Mycobacterium avium subsp. paratuberculosis
uacgggaugcucagcucgcgga

SEQ ID NO: 125734 - RNA, 22 nt, Mycobacterium avium subsp. paratuberculosis
uggugcuggccgccugcggcca

SEQ ID NO: 125735 - RNA, 22 nt, Mycobacterium avium subsp. paratuberculosis
ugcccggacugcguggccucgc

SEQ ID NO: 125736 - RNA, 22 nt, Mycobacterium avium subsp. paratuberculosis
cgagcgucacgcuggcgugacc

SEQ ID NO: 125737 - RNA, 22 nt, Mycobacterium avium subsp. paratuberculosis
caccagcaggauugggacgucg

SEQ ID NO: 125738 - RNA, 20 nt, Mycobacterium avium subsp. paratuberculosis
ucccgcagcuggucccacuc

SEQ ID NO: 125739 - RNA, 23 nt, Mycobacterium avium subsp. paratuberculosis
gcgaugcugaucaaccugcugcg

SEQ ID NO: 125740 - RNA, 22 nt, Mycobacterium avium subsp. paratuberculosis
gccgcgggugauggcggccgcc

SEQ ID NO: 125741 - RNA, 22 nt, Mycobacterium avium subsp. paratuberculosis
uucgaggucggcgcguugacca

SEQ ID NO: 125742 - RNA, 22 nt, Mycobacterium avium subsp. paratuberculosis
ggcuugacaucuauuccggacu

SEQ ID NO: 125743 - RNA, 22 nt, Mycobacterium avium subsp. paratuberculosis
gucgggguugucgaacgccucg

SEQ ID NO: 125744 - RNA, 22 nt, Mycobacterium avium subsp. paratuberculosis
ucggcguucgaucucgaagcag

SEQ ID NO: 125745 - RNA, 21 nt, Mycobacterium avium subsp. paratuberculosis
gcgccccgaacgcuggauccg

SEQ ID NO: 125746 - RNA, 22 nt, Mycobacterium avium subsp. paratuberculosis
ucaccugcugcaugggcgccga

SEQ ID NO: 125747 - RNA, 22 nt, Mycobacterium avium subsp. paratuberculosis
gggagcuuuugcgucugcucgc

SEQ ID NO: 125748 - RNA, 22 nt, Mycobacterium avium subsp. paratuberculosis
cggucacgcuggcgugacgcuc

SEQ ID NO: 125749 - RNA, 19 nt, Mycobacterium avium subsp. paratuberculosis
aggugugggacucgccgaa

SEQ ID NO: 125750 - RNA, 22 nt, Mycobacterium avium subsp. paratuberculosis
uucgugaucggagucgcuaccg

SEQ ID NO: 125751 - RNA, 22 nt, Mycobacterium avium subsp. paratuberculosis
gucggcuucgucucgguguuga

SEQ ID NO: 125752 - RNA, 22 nt, Mycobacterium avium subsp. paratuberculosis
cgccggugaucgcgguccgccg

SEQ ID NO: 125753 - RNA, 22 nt, Mycobacterium avium subsp. paratuberculosis
ucggugaucgcgcccugccggu

SEQ ID NO: 125754 - RNA, 22 nt, Mycobacterium avium subsp. paratuberculosis
caccagcgggcugccgacgccg

SEQ ID NO: 125755 - RNA, 22 nt, Mycobacterium avium subsp. paratuberculosis
uccuuggccucgccagucguca

SEQ ID NO: 125756 - RNA, 19 nt, Mycobacterium avium subsp. paratuberculosis
uucaucgagaugaacccgc

SEQ ID NO: 125757 - RNA, 22 nt, Mycobacterium avium subsp. paratuberculosis
acggugugcugggggugcgcga

SEQ ID NO: 125758 - RNA, 22 nt, Mycobacterium avium subsp. paratuberculosis
cgcggcaagcacgugcggaucg

SEQ ID NO: 125759 - RNA, 22 nt, Mycobacterium avium subsp. paratuberculosis
uuggucgagcgggucgaggucg

SEQ ID NO: 125760 - RNA, 22 nt, Mycobacterium avium subsp. paratuberculosis
caccaacagguccgcgggccgc

SEQ ID NO: 125761 - RNA, 22 nt, Mycobacterium avium subsp. paratuberculosis
ucgugcaccucgacggcgcgca

SEQ ID NO: 125762 - RNA, 22 nt, Mycobacterium avium subsp. paratuberculosis
acauaccgcacgaucggcguca

SEQ ID NO: 125763 - RNA, 22 nt, Mycobacterium avium subsp. paratuberculosis
ccgagcagaucccggcggugcu

SEQ ID NO: 125764 - RNA, 22 nt, Mycobacterium avium subsp. paratuberculosis
gugcgggccggcucguuaccgc

SEQ ID NO: 125765 - RNA, 22 nt, Mycobacterium avium subsp. paratuberculosis
uggccggucaccgccaccaugg

SEQ ID NO: 125766 - RNA, 22 nt, Mycobacterium avium subsp. paratuberculosis
augaccucgugguggaaaccgg

SEQ ID NO: 125767 - RNA, 22 nt, Mycobacterium avium subsp. paratuberculosis
cgggccgccuggcgaucgguga

SEQ ID NO: 125768 - RNA, 21 nt, Mycobacterium avium subsp. paratuberculosis
cggguugacccagcccggcgg

SEQ ID NO: 125769 - RNA, 19 nt, Mycobacterium avium subsp. paratuberculosis
ccgaggccgaacucgcggc

SEQ ID NO: 125770 - RNA, 22 nt, Mycobacterium avium subsp. paratuberculosis
cgcggcgucacgcuggcgugac

SEQ ID NO: 125771 - RNA, 22 nt, Mycobacterium avium subsp. paratuberculosis
caugcgcgccacuccggccgca

SEQ ID NO: 125772 - RNA, 22 nt, Mycobacterium avium subsp. paratuberculosis
ugcgcgccuacaucgcggccaa

SEQ ID NO: 125773 - RNA, 22 nt, Mycobacterium avium subsp. paratuberculosis
gcgccgaauccagguccucgag

SEQ ID NO: 125774 - RNA, 22 nt, Mycobacterium avium subsp. paratuberculosis
ccgcugugggagcgcauggauu

SEQ ID NO: 125775 - RNA, 21 nt, Mycobacterium avium subsp. paratuberculosis
ggugacggccugaccgcugga

SEQ ID NO: 125776 - RNA, 22 nt, Mycobacterium avium subsp. paratuberculosis
gggucaccggauggucgaugac

SEQ ID NO: 125777 - RNA, 22 nt, Mycobacterium avium subsp. paratuberculosis
cggcacggugcacacgccgagg

SEQ ID NO: 125778 - RNA, 22 nt, Mycobacterium avium subsp. paratuberculosis
aaucuguugcggcgcgggcaug

SEQ ID NO: 125779 - RNA, 22 nt, Mycobacterium avium subsp. paratuberculosis
aggucgguaccaccaucggucu

SEQ ID NO: 125780 - RNA, 22 nt, Mycobacterium avium subsp. paratuberculosis
gagcugggaacugugggccuac

SEQ ID NO: 125781 - RNA, 23 nt, Mycobacterium avium subsp. paratuberculosis
gucggcgugcgcggccagguugc

SEQ ID NO: 125782 - RNA, 22 nt, Mycobacterium avium subsp. paratuberculosis
cagggguaguugcgcgcgccgc

SEQ ID NO: 125783 - RNA, 22 nt, Mycobacterium avium subsp. paratuberculosis
ggugauugucgcucagaggcgg

SEQ ID NO: 125784 - RNA, 22 nt, Mycobacterium avium subsp. paratuberculosis
cguccggguggcuuuccaggua

SEQ ID NO: 125785 - RNA, 22 nt, Mycobacterium avium subsp. paratuberculosis
ggccgcuaaggaacucagcgcg

SEQ ID NO: 125786 - RNA, 22 nt, Mycobacterium avium subsp. paratuberculosis
gcgguugggagcgcgcgguucu

SEQ ID NO: 125787 - RNA, 22 nt, Mycobacterium avium subsp. paratuberculosis
augguguugggcggcaagguga

SEQ ID NO: 125788 - RNA, 22 nt, Mycobacterium avium subsp. paratuberculosis
gcugacgucggcggcgcuguag

SEQ ID NO: 125789 - RNA, 22 nt, Mycobacterium avium subsp. paratuberculosis
guugccgacguuguucaccacc

SEQ ID NO: 125790 - RNA, 22 nt, Mycobacterium avium subsp. paratuberculosis
agcgacaccgaaucggcgcugc

SEQ ID NO: 125791 - RNA, 22 nt, Mycobacterium avium subsp. paratuberculosis
acccggcugaucgcgucggugg

SEQ ID NO: 125792 - RNA, 22 nt, Mycobacterium avium subsp. paratuberculosis
acggggugaccacgguggugau

SEQ ID NO: 125793 - RNA, 22 nt, Mycobacterium avium subsp. paratuberculosis
uagacacgaauacccuucggcc

SEQ ID NO: 125794 - RNA, 22 nt, Mycobacterium avium subsp. paratuberculosis
gucggcgaugucgugcucggug

SEQ ID NO: 125795 - RNA, 22 nt, Mycobacterium avium subsp. paratuberculosis
guggggccgagcuggcgcagga

SEQ ID NO: 125796 - RNA, 22 nt, Mycobacterium avium subsp. paratuberculosis
ggugucggggccggccauggug

SEQ ID NO: 125797 - RNA, 22 nt, Mycobacterium avium subsp. paratuberculosis
cgucaaggcggucgccggcggc

SEQ ID NO: 125798 - RNA, 22 nt, Mycobacterium avium subsp. paratuberculosis
gccagggucgguucgggcagag

SEQ ID NO: 125799 - RNA, 22 nt, Mycobacterium avium subsp. paratuberculosis
gaucgcgaguuuggucauggag

SEQ ID NO: 125800 - RNA, 22 nt, Mycobacterium avium subsp. paratuberculosis
gcugcgucaugccguaaguggc

SEQ ID NO: 125801 - RNA, 22 nt, Mycobacterium avium subsp. paratuberculosis
gucgccagcuugccgggccgcg

SEQ ID NO: 125802 - RNA, 22 nt, Mycobacterium avium subsp. paratuberculosis
gccguggcguuacacgcgcgag

SEQ ID NO: 125803 - RNA, 22 nt, Mycobacterium avium subsp. paratuberculosis
aacgccggcacgcugggcgccu

SEQ ID NO: 125804 - RNA, 22 nt, Mycobacterium avium subsp. paratuberculosis
ccgcgacggcgccgaccagcac

SEQ ID NO: 125805 - RNA, 22 nt, Mycobacterium avium subsp. paratuberculosis
accgugaagcuaacuucacgcu

SEQ ID NO: 125806 - RNA, 22 nt, Mycobacterium avium subsp. paratuberculosis
aggaggcggugcugcccuucca

SEQ ID NO: 125807 - RNA, 21 nt, Mycobacterium avium subsp. paratuberculosis
aggccgccgaugaugccgccg

SEQ ID NO: 125808 - RNA, 22 nt, Mycobacterium avium subsp. paratuberculosis
cgugaaauuaguuucacgcucg

SEQ ID NO: 125809 - RNA, 22 nt, Mycobacterium avium subsp. paratuberculosis
ucggcaccacguccaccauggc

SEQ ID NO: 125810 - RNA, 20 nt, Mycobacterium avium subsp. paratuberculosis
ggugaguugccuggcgaccu

SEQ ID NO: 125811 - RNA, 22 nt, Mycobacterium avium subsp. paratuberculosis
ucaucacguugucggccaucga

SEQ ID NO: 125812 - RNA, 17 nt, Mycobacterium avium subsp. paratuberculosis
cugcggcagcgccucga

SEQ ID NO: 125813 - RNA, 22 nt, Mycobacterium avium subsp. paratuberculosis
gacgaacagucgcuggacgcgg

SEQ ID NO: 125814 - RNA, 22 nt, Mycobacterium avium subsp. paratuberculosis
cagucuggacgagaucgcggag

SEQ ID NO: 125815 - RNA, 22 nt, Mycobacterium avium subsp. paratuberculosis
ggccggcgaccugucgaucugg

SEQ ID NO: 125816 - RNA, 22 nt, Mycobacterium avium subsp. paratuberculosis
ggucgccguuggagugcgugau

SEQ ID NO: 125817 - RNA, 22 nt, Mycobacterium avium subsp. paratuberculosis
aucgucgaugugcgcgacgagg

SEQ ID NO: 125818 - RNA, 22 nt, Mycobacterium avium subsp. paratuberculosis
gugacacgcugauuucucguac

SEQ ID NO: 125819 - RNA, 23 nt, Mycobacterium avium subsp. paratuberculosis
gaugcggcccagcgcggcgaucc

SEQ ID NO: 125820 - RNA, 22 nt, Mycobacterium avium subsp. paratuberculosis
gcggcgggcugaccaccaacgc

SEQ ID NO: 125821 - RNA, 22 nt, Mycobacterium avium subsp. paratuberculosis
caacgucgacuugugggcgcca

SEQ ID NO: 125822 - RNA, 20 nt, Mycobacterium avium subsp. paratuberculosis
augccgagccgggcaaaccc

SEQ ID NO: 125823 - RNA, 22 nt, Mycobacterium avium subsp. paratuberculosis
ugccgcgugcuuucagcacggc

SEQ ID NO: 125824 - RNA, 22 nt, Mycobacterium avium subsp. paratuberculosis
gcggcgagaagggcaccgccaa

SEQ ID NO: 125825 - RNA, 22 nt, Mycobacterium avium subsp. paratuberculosis
aucgccugguggaugccgucca

SEQ ID NO: 125826 - RNA, 22 nt, Mycobacterium avium subsp. paratuberculosis
cugcgcgaccuggcggugacgu

SEQ ID NO: 125827 - RNA, 22 nt, Mycobacterium avium subsp. paratuberculosis
cuggucggggaaugcgcgcagg

SEQ ID NO: 125828 - RNA, 22 nt, Mycobacterium avium subsp. paratuberculosis
ggugauccgcagcggccgcaug

SEQ ID NO: 125829 - RNA, 22 nt, Mycobacterium avium subsp. paratuberculosis
cgcgaaagugcuacugccgacg

SEQ ID NO: 125830 - RNA, 22 nt, Mycobacterium avium subsp. paratuberculosis
cccagcuccuuggcccggucgu

SEQ ID NO: 125831 - RNA, 22 nt, Mycobacterium avium subsp. paratuberculosis
gccgaugcguuccacgaugccc

SEQ ID NO: 125832 - RNA, 22 nt, Mycobacterium avium subsp. paratuberculosis
uugucgcucaaaggcgggcacu

SEQ ID NO: 125833 - RNA, 18 nt, Mycobacterium avium subsp. paratuberculosis
acguucgacccgccgauc

SEQ ID NO: 125834 - RNA, 22 nt, Mycobacterium avium subsp. paratuberculosis
ggcggugugcagcaccucggcg

SEQ ID NO: 125835 - RNA, 22 nt, Mycobacterium avium subsp. paratuberculosis
ggccuggucaucgagcuggcgg

SEQ ID NO: 125836 - RNA, 22 nt, Mycobacterium avium subsp. paratuberculosis
ucgcggucgcccugaaggucgc

SEQ ID NO: 125837 - RNA, 22 nt, Mycobacterium avium subsp. paratuberculosis
ugaugccguagucggucgcggu

SEQ ID NO: 125838 - RNA, 22 nt, Mycobacterium avium subsp. paratuberculosis
gugaucgguagcagguccgaca

SEQ ID NO: 125839 - RNA, 22 nt, Mycobacterium avium subsp. paratuberculosis
ccgccgaggugcacgucgaagc

SEQ ID NO: 125840 - RNA, 21 nt, Mycobacterium avium subsp. paratuberculosis
gccguggcguuacgagcgagc

SEQ ID NO: 125841 - RNA, 22 nt, Mycobacterium avium subsp. paratuberculosis
uccaccucgcugaagucgcugu

SEQ ID NO: 125842 - RNA, 22 nt, Mycobacterium avium subsp. paratuberculosis
augcccucgcgcagggcgauga

SEQ ID NO: 125843 - RNA, 22 nt, Mycobacterium avium subsp. paratuberculosis
ccgagacguagcccaccaacug

SEQ ID NO: 125844 - RNA, 22 nt, Mycobacterium avium subsp. paratuberculosis
ggaccggcagcccguccacgcu

SEQ ID NO: 125845 - RNA, 22 nt, Mycobacterium avium subsp. paratuberculosis
ccacccuggccagcgccggguu

SEQ ID NO: 125846 - RNA, 22 nt, Mycobacterium avium subsp. paratuberculosis
cucgggggugcccgaacggcag

SEQ ID NO: 125847 - RNA, 22 nt, Mycobacterium avium subsp. paratuberculosis
guuggagguggccgccagcacg

SEQ ID NO: 125848 - RNA, 22 nt, Mycobacterium avium subsp. paratuberculosis
aagccggugaagcagcccagca

SEQ ID NO: 125849 - RNA, 22 nt, Mycobacterium avium subsp. paratuberculosis
aagugguccgacgaccuggugu

SEQ ID NO: 125850 - RNA, 22 nt, Mycobacterium avium subsp. paratuberculosis
gcggguggaccccgacgcgcug

SEQ ID NO: 125851 - RNA, 22 nt, Mycobacterium avium subsp. paratuberculosis
ccgcgagcagacacaaaagccc

SEQ ID NO: 125852 - RNA, 22 nt, Mycobacterium avium subsp. paratuberculosis
gcugucgcuggaggagaaaccc

SEQ ID NO: 125853 - RNA, 22 nt, Mycobacterium avium subsp. paratuberculosis
ugaugccggcgauagguggcga

SEQ ID NO: 125854 - RNA, 22 nt, Mycobacterium avium subsp. paratuberculosis
guggcuucgcccgccgagcguc

SEQ ID NO: 125855 - RNA, 22 nt, Mycobacterium avium subsp. paratuberculosis
gacggcaccaccagcgaggugc

SEQ ID NO: 125856 - RNA, 22 nt, Mycobacterium avium subsp. paratuberculosis
cggcggcgaucaggagaaacgc

SEQ ID NO: 125857 - RNA, 22 nt, Mycobacterium avium subsp. paratuberculosis
cacuggcuuucgcgaucgcggc

SEQ ID NO: 125858 - RNA, 22 nt, Mycobacterium avium subsp. paratuberculosis
ucgucgacgguccgcugcgcuu

SEQ ID NO: 125859 - RNA, 22 nt, Mycobacterium avium subsp. paratuberculosis
acgaccggcggcgguuauggcu

SEQ ID NO: 125860 - RNA, 22 nt, Mycobacterium avium subsp. paratuberculosis
accgcggcgccuugaccaccac

SEQ ID NO: 125861 - RNA, 22 nt, Mycobacterium avium subsp. paratuberculosis
gcggccagcccauugacgucgc

SEQ ID NO: 125862 - RNA, 22 nt, Mycobacterium avium subsp. paratuberculosis
ugggggcuuuugcgucugcucg

SEQ ID NO: 125863 - RNA, 22 nt, Mycobacterium avium subsp. paratuberculosis
ccugcugagcgaccuugagguu

SEQ ID NO: 125864 - RNA, 22 nt, Mycobacterium avium subsp. paratuberculosis
auugggugccguugccggugca

SEQ ID NO: 125865 - RNA, 22 nt, Mycobacterium avium subsp. paratuberculosis
agucgccguaccggucaccgug

SEQ ID NO: 125866 - RNA, 22 nt, Mycobacterium avium subsp. paratuberculosis
accgcgcauguagccgcugccg

SEQ ID NO: 125867 - RNA, 22 nt, Mycobacterium avium subsp. paratuberculosis
gcgcguaggcgauggcggccug

SEQ ID NO: 125868 - RNA, 22 nt, Mycobacterium avium subsp. paratuberculosis
ccaccgcuucaucugcaggaag

SEQ ID NO: 125869 - RNA, 22 nt, Mycobacterium avium subsp. paratuberculosis
gugcuuuugcgucugcucgcca

SEQ ID NO: 125870 - RNA, 22 nt, Mycobacterium avium subsp. paratuberculosis
cggcggcugcagccggauuggu

SEQ ID NO: 125871 - RNA, 22 nt, Mycobacterium avium subsp. paratuberculosis
caccggcacccugguggccggg

SEQ ID NO: 125872 - RNA, 22 nt, Mycobacterium avium subsp. paratuberculosis
cccagcacguccacggcggcau

SEQ ID NO: 125873 - RNA, 22 nt, Mycobacterium avium subsp. paratuberculosis
gcagucgggaauuagcacggcg

SEQ ID NO: 125874 - RNA, 22 nt, Mycobacterium avium subsp. paratuberculosis
acgaacuccgggccggccugca

SEQ ID NO: 125875 - RNA, 22 nt, Mycobacterium avium subsp. paratuberculosis
gcaguccagcgccucggcgaug

SEQ ID NO: 125876 - RNA, 22 nt, Mycobacterium avium subsp. paratuberculosis
aacucggugcggucgccgagcc

SEQ ID NO: 125877 - RNA, 22 nt, Mycobacterium avium subsp. paratuberculosis
cggccccggccagcacacgccg

SEQ ID NO: 125878 - RNA, 22 nt, Mycobacterium avium subsp. paratuberculosis
gugcggauugcgauacaugucg

SEQ ID NO: 125879 - RNA, 22 nt, Mycobacterium avium subsp. paratuberculosis
gugccccagcagcucggugagc

SEQ ID NO: 125880 - RNA, 21 nt, Mycobacterium avium subsp. paratuberculosis
ggccacgucgucaugugagcg

SEQ ID NO: 125881 - RNA, 22 nt, Mycobacterium avium subsp. paratuberculosis
uccgcgccaggucggcccgcga

SEQ ID NO: 125882 - RNA, 22 nt, Mycobacterium avium subsp. paratuberculosis
uccggcaguacgguggaaagcc

SEQ ID NO: 125883 - RNA, 22 nt, Mycobacterium avium subsp. paratuberculosis
aucccgcaugucgcucuucgac

SEQ ID NO: 125884 - RNA, 21 nt, Mycobacterium avium subsp. paratuberculosis
acggugagccguucgugcugc

SEQ ID NO: 125885 - RNA, 22 nt, Mycobacterium avium subsp. paratuberculosis
ggcgcggugccguauacccgcc

SEQ ID NO: 125886 - RNA, 22 nt, Mycobacterium avium subsp. paratuberculosis
cgcaccccgcgcaucgccaggc

SEQ ID NO: 125887 - RNA, 22 nt, Mycobacterium avium subsp. paratuberculosis
ccugaccaccgguuugccgagu

SEQ ID NO: 125888 - RNA, 22 nt, Mycobacterium avium subsp. paratuberculosis
agcaccgagaagcccagcgugu

SEQ ID NO: 125889 - RNA, 22 nt, Mycobacterium avium subsp. paratuberculosis
aacuucgucggcauccacuucu

SEQ ID NO: 125890 - RNA, 22 nt, Mycobacterium avium subsp. paratuberculosis
guggacagcccgaccagcgugc

SEQ ID NO: 125891 - RNA, 22 nt, Mycobacterium avium subsp. paratuberculosis
auuucggccuugaucgaggugc

SEQ ID NO: 125892 - RNA, 22 nt, Mycobacterium avium subsp. paratuberculosis
ucgucgaggaugccgccgaaga

SEQ ID NO: 125893 - RNA, 18 nt, Mycobacterium avium subsp. paratuberculosis
uggguccaaguauccuga

SEQ ID NO: 125894 - RNA, 20 nt, Mycobacterium avium subsp. paratuberculosis
cgacgcgucgaagcucugac

SEQ ID NO: 125895 - RNA, 22 nt, Mycobacterium avium subsp. paratuberculosis
gugcgggucgacucgucgcugc

SEQ ID NO: 125896 - RNA, 22 nt, Mycobacterium avium subsp. paratuberculosis
ccgggagacggcggaguuauuu

SEQ ID NO: 125897 - RNA, 19 nt, Mycobacterium avium subsp. paratuberculosis
cgacgcccuggugaccuuu

SEQ ID NO: 125898 - RNA, 22 nt, Mycobacterium avium subsp. paratuberculosis
uucgagugcggcacgcacccag

SEQ ID NO: 125899 - RNA, 22 nt, Mycobacterium avium subsp. paratuberculosis
aggccguucggacggcgcagcc

SEQ ID NO: 125900 - RNA, 22 nt, Mycobacterium avium subsp. paratuberculosis
cgaucgggaugaucgcgcucac

SEQ ID NO: 125901 - RNA, 21 nt, Mycobacterium avium subsp. paratuberculosis
aggugagugaacgagaucuug

SEQ ID NO: 125902 - RNA, 21 nt, Mycobacterium avium subsp. paratuberculosis
ucgcggugaguacacgcucgg

SEQ ID NO: 125903 - RNA, 22 nt, Mycobacterium avium subsp. paratuberculosis
cgcuacgugacggggguggcca

SEQ ID NO: 125904 - RNA, 22 nt, Mycobacterium avium subsp. paratuberculosis
ggcgcaggcggucgagcugcag

SEQ ID NO: 125905 - RNA, 22 nt, Mycobacterium avium subsp. paratuberculosis
gcagcgacggcccgguugccgg

SEQ ID NO: 125906 - RNA, 21 nt, Mycobacterium avium subsp. paratuberculosis
cgcaccagcacaccggcgugc

SEQ ID NO: 125907 - RNA, 21 nt, Mycobacterium avium subsp. paratuberculosis
cuggauguacgccggcggcgc

SEQ ID NO: 125908 - RNA, 22 nt, Mycobacterium avium subsp. paratuberculosis
gcagcagcuccucgacggcguc

SEQ ID NO: 125909 - RNA, 22 nt, Mycobacterium avium subsp. paratuberculosis
gcguguucucgucggugugaua

SEQ ID NO: 125910 - RNA, 22 nt, Mycobacterium avium subsp. paratuberculosis
uguccgauccggagcaguugga

SEQ ID NO: 125911 - RNA, 22 nt, Mycobacterium avium subsp. paratuberculosis
acgccgccgaagaucgugcuga

SEQ ID NO: 125912 - RNA, 22 nt, Mycobacterium avium subsp. paratuberculosis
ucgccuuggugaacagcgaguc

SEQ ID NO: 125913 - RNA, 22 nt, Mycobacterium avium subsp. paratuberculosis
guggugaccuacgugcgggugg

SEQ ID NO: 125914 - RNA, 22 nt, Mycobacterium avium subsp. paratuberculosis
ccaucgacgaaaggccgacgau

SEQ ID NO: 125915 - RNA, 23 nt, Mycobacterium avium subsp. paratuberculosis
aaggcggcaccgaucaccgcggc

SEQ ID NO: 125916 - RNA, 22 nt, Mycobacterium avium subsp. paratuberculosis
aggucgauguugccgaugguga

SEQ ID NO: 125917 - RNA, 22 nt, Mycobacterium avium subsp. paratuberculosis
accgggcguucaagcacgucgc

SEQ ID NO: 125918 - RNA, 22 nt, Mycobacterium avium subsp. paratuberculosis
ucgcggcccaccggcgcggugu

SEQ ID NO: 125919 - RNA, 22 nt, Mycobacterium avium subsp. paratuberculosis
gcccuguucgucgacgcccucg

SEQ ID NO: 125920 - RNA, 22 nt, Mycobacterium avium subsp. paratuberculosis
cucgucgagcugcacccacugc

SEQ ID NO: 125921 - RNA, 22 nt, Mycobacterium avium subsp. paratuberculosis
caucuggccaccgggaugcgga

SEQ ID NO: 125922 - RNA, 22 nt, Mycobacterium avium subsp. paratuberculosis
ggaccacggucuacgagaucga

SEQ ID NO: 125923 - RNA, 22 nt, Mycobacterium avium subsp. paratuberculosis
uucggcggcuggaugcucgccg

SEQ ID NO: 125924 - RNA, 22 nt, Mycobacterium avium subsp. paratuberculosis
cggugccgaucuacgagccggc

SEQ ID NO: 125925 - RNA, 22 nt, Mycobacterium avium subsp. paratuberculosis
gcacuugaagcugaagcggccc

SEQ ID NO: 125926 - RNA, 22 nt, Mycobacterium avium subsp. paratuberculosis
gcuggaugacguggucgugcag

SEQ ID NO: 125927 - RNA, 20 nt, Mycobacterium avium subsp. paratuberculosis
agccggucagcaccgccgcc

SEQ ID NO: 125928 - RNA, 22 nt, Mycobacterium avium subsp. paratuberculosis
cuugccgacgugcguugccggu

SEQ ID NO: 125929 - RNA, 22 nt, Mycobacterium avium subsp. paratuberculosis
auucccggguagcucuccggag

SEQ ID NO: 125930 - RNA, 22 nt, Mycobacterium avium subsp. paratuberculosis
gccacccugcugggcaugcugg

SEQ ID NO: 125931 - RNA, 22 nt, Mycobacterium avium subsp. paratuberculosis
ugucggcgacgaggcccuugau

SEQ ID NO: 125932 - RNA, 22 nt, Mycobacterium avium subsp. paratuberculosis
uucgucauggcguuacaggcgg

SEQ ID NO: 125933 - RNA, 22 nt, Mycobacterium avium subsp. paratuberculosis
caguguguacucacggcgggau

SEQ ID NO: 125934 - RNA, 22 nt, Mycobacterium avium subsp. paratuberculosis
ugggugcucaccgacggcgacc

SEQ ID NO: 125935 - RNA, 23 nt, Mycobacterium avium subsp. paratuberculosis
cgugcccaccagucgcggucggc

SEQ ID NO: 125936 - RNA, 22 nt, Mycobacterium avium subsp. paratuberculosis
gcggcacuggaggcguugccgc

SEQ ID NO: 125937 - RNA, 22 nt, Mycobacterium avium subsp. paratuberculosis
cuggguggugcuggccgacccc

SEQ ID NO: 125938 - RNA, 22 nt, Mycobacterium avium subsp. paratuberculosis
ugcgccgucaacuggaguccuu

SEQ ID NO: 125939 - RNA, 22 nt, Mycobacterium avium subsp. paratuberculosis
ccagcagacgcaaaagcccccg

SEQ ID NO: 125940 - RNA, 22 nt, Mycobacterium avium subsp. paratuberculosis
guuugcccgccgcgccgguuag

SEQ ID NO: 125941 - RNA, 22 nt, Mycobacterium avium subsp. paratuberculosis
gggcucgugcaggcugcgcagc

SEQ ID NO: 125942 - RNA, 22 nt, Mycobacterium avium subsp. paratuberculosis
gagccggcuucggcggccggcu

SEQ ID NO: 125943 - RNA, 22 nt, Mycobacterium avium subsp. paratuberculosis
auccgcucugccgucgaccccg

SEQ ID NO: 125944 - RNA, 22 nt, Mycobacterium avium subsp. paratuberculosis
cgucacgcuggcgugacgcucg

SEQ ID NO: 125945 - RNA, 22 nt, Mycobacterium avium subsp. paratuberculosis
caggaucagcaggucggcguag

SEQ ID NO: 125946 - RNA, 22 nt, Mycobacterium avium subsp. paratuberculosis
cgugaagcuaguuucacgcucg

SEQ ID NO: 125947 - RNA, 22 nt, Mycobacterium avium subsp. paratuberculosis
cagccgccucgacgacgaagcc

SEQ ID NO: 125948 - RNA, 22 nt, Mycobacterium avium subsp. paratuberculosis
ggccgucucguagccgaugccg

SEQ ID NO: 125949 - RNA, 20 nt, Mycobacterium avium subsp. paratuberculosis
cacucaccucggagguccuc

SEQ ID NO: 125950 - RNA, 22 nt, Mycobacterium avium subsp. paratuberculosis
cccggcgcuggccagggugguc

SEQ ID NO: 125951 - RNA, 22 nt, Mycobacterium avium subsp. paratuberculosis
gccuggcauagaucuccggauu

SEQ ID NO: 125952 - RNA, 22 nt, Mycobacterium avium subsp. paratuberculosis
acgucgccgaacugaucuccgu

SEQ ID NO: 125953 - RNA, 22 nt, Mycobacterium avium subsp. paratuberculosis
accgaacgugcauucagugcga

SEQ ID NO: 125954 - RNA, 22 nt, Mycobacterium avium subsp. paratuberculosis
gguucggugucgccguaugucu

SEQ ID NO: 125955 - RNA, 22 nt, Mycobacterium avium subsp. paratuberculosis
cgcuggaagucgugcggccggu

SEQ ID NO: 125956 - RNA, 22 nt, Mycobacterium avium subsp. paratuberculosis
ggcgucgaguacgacagcccgu

SEQ ID NO: 125957 - RNA, 22 nt, Mycobacterium avium subsp. paratuberculosis
gccacgcuggcgugacgcucgg

SEQ ID NO: 125958 - RNA, 22 nt, Mycobacterium avium subsp. paratuberculosis
uccguaccggccgcgcuggugc

SEQ ID NO: 125959 - RNA, 22 nt, Mycobacterium avium subsp. paratuberculosis
cgagagugcaucuaccgacgcu

SEQ ID NO: 125960 - RNA, 22 nt, Mycobacterium avium subsp. paratuberculosis
cggccuggugacggaagugguu

SEQ ID NO: 125961 - RNA, 22 nt, Mycobacterium avium subsp. paratuberculosis
gaaccccgccgauuuccuggug

SEQ ID NO: 125962 - RNA, 22 nt, Mycobacterium avium subsp. paratuberculosis
augcgccucgacggcgucgggg

SEQ ID NO: 125963 - RNA, 22 nt, Mycobacterium avium subsp. paratuberculosis
ccgccgucagguccggcuggug

SEQ ID NO: 125964 - RNA, 22 nt, Mycobacterium avium subsp. paratuberculosis
ccaucgccguggugaugccggu

SEQ ID NO: 125965 - RNA, 22 nt, Mycobacterium avium subsp. paratuberculosis
cgcgcugggcgaugucgugggu

SEQ ID NO: 125966 - RNA, 22 nt, Mycobacterium avium subsp. paratuberculosis
cggcgggcuggacugggccguc

SEQ ID NO: 125967 - RNA, 22 nt, Mycobacterium avium subsp. paratuberculosis
gagcagacacaaaagcacccga

SEQ ID NO: 125968 - RNA, 22 nt, Mycobacterium avium subsp. paratuberculosis
uugcuguuggagaaccgcgggu

SEQ ID NO: 125969 - RNA, 22 nt, Mycobacterium avium subsp. paratuberculosis
ggugacgccgcaucugcuggug

SEQ ID NO: 125970 - RNA, 22 nt, Mycobacterium avium subsp. paratuberculosis
ucaacgucaucgccgcggccac

SEQ ID NO: 125971 - RNA, 22 nt, Mycobacterium avium subsp. paratuberculosis
gagcuggaucucgcgggugccc

SEQ ID NO: 125972 - RNA, 22 nt, Mycobacterium avium subsp. paratuberculosis
aacaggcggugggggccauucg

SEQ ID NO: 125973 - RNA, 22 nt, Mycobacterium avium subsp. paratuberculosis
gucgucguccggcaccgcgaac

SEQ ID NO: 125974 - RNA, 22 nt, Mycobacterium avium subsp. paratuberculosis
gggcagaugcagauacggcucg

SEQ ID NO: 125975 - RNA, 22 nt, Mycobacterium avium subsp. paratuberculosis
gcuggcgguggucuuggccggg

SEQ ID NO: 125976 - RNA, 21 nt, Mycobacterium avium subsp. paratuberculosis
ggcgucggugucgagcaccuc

SEQ ID NO: 125977 - RNA, 22 nt, Mycobacterium avium subsp. paratuberculosis
accugcccggcagugucgacga

SEQ ID NO: 125978 - RNA, 22 nt, Mycobacterium avium subsp. paratuberculosis
ccagcucuuggucaccgcgauc

SEQ ID NO: 125979 - RNA, 22 nt, Mycobacterium avium subsp. paratuberculosis
ggcuaucucacuuugaucaucu

SEQ ID NO: 125980 - RNA, 22 nt, Mycobacterium avium subsp. paratuberculosis
gaucaccaugaacccguuggag

SEQ ID NO: 125981 - RNA, 22 nt, Mycobacterium avium subsp. paratuberculosis
cccgggguguacgcccgcuuuc

SEQ ID NO: 125982 - RNA, 22 nt, Mycobacterium avium subsp. paratuberculosis
gucgucggcgcccaagccggug

SEQ ID NO: 125983 - RNA, 22 nt, Mycobacterium avium subsp. paratuberculosis
ggggcguugguugcggccccgc

SEQ ID NO: 125984 - RNA, 22 nt, Mycobacterium avium subsp. paratuberculosis
aucccccgccgaucgugguguc

SEQ ID NO: 125985 - RNA, 20 nt, Mycobacterium avium subsp. paratuberculosis
acuucggcaugcgcacccgc

SEQ ID NO: 125986 - RNA, 22 nt, Mycobacterium avium subsp. paratuberculosis
cggaccuggugguggucgugcc

SEQ ID NO: 125987 - RNA, 22 nt, Mycobacterium avium subsp. paratuberculosis
uagugcugggucugcagccggc

SEQ ID NO: 125988 - RNA, 22 nt, Mycobacterium avium subsp. paratuberculosis
cauccgaccaucccggccgcuc

SEQ ID NO: 125989 - RNA, 22 nt, Mycobacterium avium subsp. paratuberculosis
aacacagcgucgucgccgaccc

SEQ ID NO: 125990 - RNA, 22 nt, Mycobacterium avium subsp. paratuberculosis
gcaccgucgagaucagcgugug

SEQ ID NO: 125991 - RNA, 22 nt, Mycobacterium avium subsp. paratuberculosis
ccagguggccguaauggauggg

SEQ ID NO: 125992 - RNA, 21 nt, Mycobacterium avium subsp. paratuberculosis
acgucgacccggccgaucggc

SEQ ID NO: 125993 - RNA, 22 nt, Mycobacterium avium subsp. paratuberculosis
cuggccgaccugaucgugcugg

SEQ ID NO: 125994 - RNA, 22 nt, Mycobacterium avium subsp. paratuberculosis
gcugacuguugcgccggccugg

SEQ ID NO: 125995 - RNA, 22 nt, Mycobacterium avium subsp. paratuberculosis
cgccacgcuggcgugacgcuga

SEQ ID NO: 125996 - RNA, 22 nt, Mycobacterium avium subsp. paratuberculosis
ucgacucgguucuugauccgca

SEQ ID NO: 125997 - RNA, 22 nt, Mycobacterium avium subsp. paratuberculosis
uguucgacaccaccgcgagcag

SEQ ID NO: 125998 - RNA, 19 nt, Mycobacterium avium subsp. paratuberculosis
gcuggccgagcugucccgc

SEQ ID NO: 125999 - RNA, 22 nt, Mycobacterium avium subsp. paratuberculosis
cgccggaccguggagccgcggc

SEQ ID NO: 126000 - RNA, 22 nt, Mycobacterium avium subsp. paratuberculosis
gcgagaccuucgauggccggca

SEQ ID NO: 126001 - RNA, 22 nt, Mycobacterium avium subsp. paratuberculosis
uugaucgccgacgacgucacca

SEQ ID NO: 126002 - RNA, 22 nt, Mycobacterium avium subsp. paratuberculosis
ucgugcugucggucgccacccc

SEQ ID NO: 126003 - RNA, 21 nt, Mycobacterium avium subsp. paratuberculosis
cgacuacguguugccgggcgg

SEQ ID NO: 126004 - RNA, 22 nt, Mycobacterium avium subsp. paratuberculosis
ggucgacgggugcgccagcuca

SEQ ID NO: 126005 - RNA, 22 nt, Mycobacterium avium subsp. paratuberculosis
ggcgucgaucaacaugugcugg

SEQ ID NO: 126006 - RNA, 22 nt, Mycobacterium avium subsp. paratuberculosis
gguguucgccgccacgauggcc

SEQ ID NO: 126007 - RNA, 22 nt, Mycobacterium avium subsp. paratuberculosis
uacgccgaauucgcggucucgu

SEQ ID NO: 126008 - RNA, 22 nt, Mycobacterium avium subsp. paratuberculosis
aacuggcgaugagccucggagc

SEQ ID NO: 126009 - RNA, 22 nt, Mycobacterium avium subsp. paratuberculosis
cucacgccgucggugcugggcc

SEQ ID NO: 126010 - RNA, 22 nt, Mycobacterium avium subsp. paratuberculosis
gaucgcggcguucgugcugauc

SEQ ID NO: 126011 - RNA, 22 nt, Mycobacterium avium subsp. paratuberculosis
ucgaccagccggccgggccguc

SEQ ID NO: 126012 - RNA, 22 nt, Mycobacterium avium subsp. paratuberculosis
uguccgacgaggcgucguggau

SEQ ID NO: 126013 - RNA, 22 nt, Mycobacterium avium subsp. paratuberculosis
gcgaugaugucggcagguucgc

SEQ ID NO: 126014 - RNA, 22 nt, Mycobacterium avium subsp. paratuberculosis
cgccaggucggccucgucgcgg

SEQ ID NO: 126015 - RNA, 21 nt, Mycobacterium avium subsp. paratuberculosis
uuguccgcggugccgcgcagc

SEQ ID NO: 126016 - RNA, 22 nt, Mycobacterium avium subsp. paratuberculosis
uggccggccugcaucaugauca

SEQ ID NO: 126017 - RNA, 22 nt, Mycobacterium avium subsp. paratuberculosis
uuggccggcugcaguucgacgg

SEQ ID NO: 126018 - RNA, 22 nt, Mycobacterium avium subsp. paratuberculosis
aacggcucugggaccgggccca

SEQ ID NO: 126019 - RNA, 22 nt, Mycobacterium avium subsp. paratuberculosis
cgucgcgcuggaagugcugucg

SEQ ID NO: 126020 - RNA, 20 nt, Mycobacterium avium subsp. paratuberculosis
ucgaucgcggucuggggugg

SEQ ID NO: 126021 - RNA, 19 nt, Mycobacterium avium subsp. paratuberculosis
cgauuccaucgggcugggu

SEQ ID NO: 126022 - RNA, 22 nt, Mycobacterium avium subsp. paratuberculosis
ggcgggaugcgcugggaauuga

SEQ ID NO: 126023 - RNA, 22 nt, Mycobacterium avium subsp. paratuberculosis
ggcaggccgcgcuccacgaucu

SEQ ID NO: 126024 - RNA, 22 nt, Mycobacterium avium subsp. paratuberculosis
aucaggucgucgccgggccgcu

SEQ ID NO: 126025 - RNA, 22 nt, Mycobacterium avium subsp. paratuberculosis
agcgucgaguuguuggcgccga

SEQ ID NO: 126026 - RNA, 22 nt, Mycobacterium avium subsp. paratuberculosis
ccggugccggugccgcugggcg

SEQ ID NO: 126027 - RNA, 22 nt, Mycobacterium avium subsp. paratuberculosis
ugaccugcgaccaggaccgguc

SEQ ID NO: 126028 - RNA, 22 nt, Mycobacterium avium subsp. paratuberculosis
cgacgucgcgauggaggugacc

SEQ ID NO: 126029 - RNA, 22 nt, Mycobacterium avium subsp. paratuberculosis
gcgcuuguccuccuggcgcugg

SEQ ID NO: 126030 - RNA, 22 nt, Mycobacterium avium subsp. paratuberculosis
cugcccgucgcucgucggguug

SEQ ID NO: 126031 - RNA, 22 nt, Mycobacterium avium subsp. paratuberculosis
aggggccgaagcgcaucgcccg

SEQ ID NO: 126032 - RNA, 22 nt, Mycobacterium avium subsp. paratuberculosis
aaccugaucccggaguggaaug

SEQ ID NO: 126033 - RNA, 22 nt, Mycobacterium avium subsp. paratuberculosis
acgguggugaagcccuugauga

SEQ ID NO: 126034 - RNA, 22 nt, Mycobacterium avium subsp. paratuberculosis
gccggccgggugagcugaucga

SEQ ID NO: 126035 - RNA, 22 nt, Mycobacterium avium subsp. paratuberculosis
cgcgugucgcgccauucucgag

SEQ ID NO: 126036 - RNA, 22 nt, Mycobacterium avium subsp. paratuberculosis
gccugcaccagcaacaccgagc

SEQ ID NO: 126037 - RNA, 22 nt, Mycobacterium avium subsp. paratuberculosis
accgucacaugggcccggcuuc

SEQ ID NO: 126038 - RNA, 22 nt, Mycobacterium avium subsp. paratuberculosis
cgucacgccagcgugacgccgc

SEQ ID NO: 126039 - RNA, 22 nt, Mycobacterium avium subsp. paratuberculosis
agcagcccgcaauucucccgca

SEQ ID NO: 126040 - RNA, 22 nt, Mycobacterium avium subsp. paratuberculosis
gugggcgccgucaaugguguag

SEQ ID NO: 126041 - RNA, 22 nt, Mycobacterium avium subsp. paratuberculosis
gcuggucucgagcugcacccgc

SEQ ID NO: 126042 - RNA, 22 nt, Mycobacterium avium subsp. paratuberculosis
ggcggucggcucguccaccacc

SEQ ID NO: 126043 - RNA, 21 nt, Mycobacterium avium subsp. paratuberculosis
ccuugcgauucggcggacucg

SEQ ID NO: 126044 - RNA, 22 nt, Mycobacterium avium subsp. paratuberculosis
cgcgagagugcaacuaccgacg

SEQ ID NO: 126045 - RNA, 22 nt, Mycobacterium avium subsp. paratuberculosis
ucggccuuguccgucgugcuga

SEQ ID NO: 126046 - RNA, 22 nt, Mycobacterium avium subsp. paratuberculosis
gacgaggguggucaugacuguu

SEQ ID NO: 126047 - RNA, 22 nt, Mycobacterium avium subsp. paratuberculosis
aagcgcaaucaaaaaccccgcu

SEQ ID NO: 126048 - RNA, 22 nt, Mycobacterium avium subsp. paratuberculosis
aucguguacgcggcggcccggg

SEQ ID NO: 126049 - RNA, 22 nt, Mycobacterium avium subsp. paratuberculosis
cgcgccggugcugguggucggc

SEQ ID NO: 126050 - RNA, 22 nt, Mycobacterium avium subsp. paratuberculosis
cgucgggauuggguugcauguu

SEQ ID NO: 126051 - RNA, 22 nt, Mycobacterium avium subsp. paratuberculosis
gcggucggguagugacgaaucu

SEQ ID NO: 126052 - RNA, 22 nt, Mycobacterium avium subsp. paratuberculosis
uucggggugaagaaccgggacc

SEQ ID NO: 126053 - RNA, 22 nt, Mycobacterium avium subsp. paratuberculosis
cgccgggcugagcugccgcccg

SEQ ID NO: 126054 - RNA, 22 nt, Mycobacterium avium subsp. paratuberculosis
aucuuggcguacugcgccucuu

SEQ ID NO: 126055 - RNA, 22 nt, Mycobacterium avium subsp. paratuberculosis
gcacccagauacccggcacggu

SEQ ID NO: 126056 - RNA, 22 nt, Mycobacterium avium subsp. paratuberculosis
gccaccagggugggcaggcuca

SEQ ID NO: 126057 - RNA, 22 nt, Mycobacterium avium subsp. paratuberculosis
gguccggcggugucgguaccgc

SEQ ID NO: 126058 - RNA, 22 nt, Mycobacterium avium subsp. paratuberculosis
cugccguggauuugcgcgccgc

SEQ ID NO: 126059 - RNA, 22 nt, Mycobacterium avium subsp. paratuberculosis
uguccgcagaucgagcagccgu

SEQ ID NO: 126060 - RNA, 22 nt, Mycobacterium avium subsp. paratuberculosis
cgggugaucguguugcaucgga

SEQ ID NO: 126061 - RNA, 22 nt, Mycobacterium avium subsp. paratuberculosis
gccgugguggcgcugaaaucga

SEQ ID NO: 126062 - RNA, 22 nt, Mycobacterium avium subsp. paratuberculosis
uggaggaguucgacagucagcu

SEQ ID NO: 126063 - RNA, 22 nt, Mycobacterium avium subsp. paratuberculosis
ggcaugcaguuuggacacgucc

SEQ ID NO: 126064 - RNA, 22 nt, Mycobacterium avium subsp. paratuberculosis
acggugacgcugauggucgcgu

SEQ ID NO: 126065 - RNA, 22 nt, Mycobacterium avium subsp. paratuberculosis
ucggcucgauucgguugccggg

SEQ ID NO: 126066 - RNA, 19 nt, Mycobacterium avium subsp. paratuberculosis
agcgugcgcgacgaacgcc

SEQ ID NO: 126067 - RNA, 22 nt, Mycobacterium avium subsp. paratuberculosis
ccgccaggugagcgccgagcac

SEQ ID NO: 126068 - RNA, 22 nt, Mycobacterium avium subsp. paratuberculosis
gugugaucgagguugccggcca

SEQ ID NO: 126069 - RNA, 22 nt, Mycobacterium avium subsp. paratuberculosis
gcugaucggcgggucgaacguc

SEQ ID NO: 126070 - RNA, 19 nt, Mycobacterium avium subsp. paratuberculosis
gugccggcgggacguggcg

SEQ ID NO: 126071 - RNA, 22 nt, Mycobacterium avium subsp. paratuberculosis
guugacccgcucgugcguucgg

SEQ ID NO: 126072 - RNA, 20 nt, Mycobacterium avium subsp. paratuberculosis
uggugcacacguugacgccc

SEQ ID NO: 126073 - RNA, 22 nt, Mycobacterium avium subsp. paratuberculosis
acccgaacagauucuggcccgg

SEQ ID NO: 126074 - RNA, 22 nt, Mycobacterium avium subsp. paratuberculosis
acgucggcggguucagcggucg

SEQ ID NO: 126075 - RNA, 22 nt, Mycobacterium avium subsp. paratuberculosis
ggguggagugguugaccgacga

SEQ ID NO: 126076 - RNA, 22 nt, Mycobacterium avium subsp. paratuberculosis
gccggucggcgacgacccggcg

SEQ ID NO: 126077 - RNA, 22 nt, Mycobacterium avium subsp. paratuberculosis
cagacgcaaaggcaccgcuuuu

SEQ ID NO: 126078 - RNA, 22 nt, Mycobacterium avium subsp. paratuberculosis
gccgugugccgugaacgccgcg

SEQ ID NO: 126079 - RNA, 22 nt, Mycobacterium avium subsp. paratuberculosis
ucgucgaacgcgauuucggugg

SEQ ID NO: 126080 - RNA, 22 nt, Mycobacterium avium subsp. paratuberculosis
gccacccgguggauccguuccc

SEQ ID NO: 126081 - RNA, 22 nt, Mycobacterium avium subsp. paratuberculosis
gucaccaaccaucaggcguuca

SEQ ID NO: 126082 - RNA, 22 nt, Mycobacterium avium subsp. paratuberculosis
ugcugucggcccgcagcucggu

SEQ ID NO: 126083 - RNA, 22 nt, Mycobacterium avium subsp. paratuberculosis
uggacgaggccgucggccgacu

SEQ ID NO: 126084 - RNA, 22 nt, Mycobacterium avium subsp. paratuberculosis
ccgcgagcagacacaaaagcgc

SEQ ID NO: 126085 - RNA, 22 nt, Mycobacterium avium subsp. paratuberculosis
cagcugaucgccucgggcuaca

SEQ ID NO: 126086 - RNA, 22 nt, Mycobacterium avium subsp. paratuberculosis
aucggucagcccuucguggacg

SEQ ID NO: 126087 - RNA, 22 nt, Mycobacterium avium subsp. paratuberculosis
cgcucguugcgaaggggcuggg

SEQ ID NO: 126088 - RNA, 22 nt, Mycobacterium avium subsp. paratuberculosis
cgccgcaggaggcgucgcccgu

SEQ ID NO: 126089 - RNA, 22 nt, Mycobacterium avium subsp. paratuberculosis
caacaacucgacguucggcguc

SEQ ID NO: 126090 - RNA, 22 nt, Mycobacterium avium subsp. paratuberculosis
cagccggucgaguucggugacg

SEQ ID NO: 126091 - RNA, 22 nt, Mycobacterium avium subsp. paratuberculosis
ucggugucgccgucgcccagcu

SEQ ID NO: 126092 - RNA, 22 nt, Mycobacterium avium subsp. paratuberculosis
guagguguugaaaucgcaguaa

SEQ ID NO: 126093 - RNA, 19 nt, Mycobacterium avium subsp. paratuberculosis
gcaguaccggcggaucgcc

SEQ ID NO: 126094 - RNA, 17 nt, Mycobacterium avium subsp. paratuberculosis
accgcuucgccgacgac

SEQ ID NO: 126095 - RNA, 22 nt, Mycobacterium avium subsp. paratuberculosis
cgcggcgaugacguugaucacc

SEQ ID NO: 126096 - RNA, 22 nt, Mycobacterium avium subsp. paratuberculosis
gucgcgcugcagcagucggugc

SEQ ID NO: 126097 - RNA, 22 nt, Mycobacterium avium subsp. paratuberculosis
uccggaccgcaggcccaggucu

SEQ ID NO: 126098 - RNA, 22 nt, Mycobacterium avium subsp. paratuberculosis
gcgcagcagaucaaaccgcaag

SEQ ID NO: 126099 - RNA, 22 nt, Mycobacterium avium subsp. paratuberculosis
ccccgcaagacccgcagcaugc

SEQ ID NO: 126100 - RNA, 22 nt, Mycobacterium avium subsp. paratuberculosis
cggaugcuccggaggcgcugug

SEQ ID NO: 126101 - RNA, 22 nt, Mycobacterium avium subsp. paratuberculosis
cgcaccguccgacugcuggguc

SEQ ID NO: 126102 - RNA, 22 nt, Mycobacterium avium subsp. paratuberculosis
uugcggugcguuggccgccgag

SEQ ID NO: 126103 - RNA, 19 nt, Mycobacterium avium subsp. paratuberculosis
guccaggcccgcguguucg

SEQ ID NO: 126104 - RNA, 22 nt, Mycobacterium avium subsp. paratuberculosis
uccgggugcccuaccgggcgcg

SEQ ID NO: 126105 - RNA, 22 nt, Mycobacterium avium subsp. paratuberculosis
guggcgguucgucgcguaucug

SEQ ID NO: 126106 - RNA, 22 nt, Mycobacterium avium subsp. paratuberculosis
cgucgccaguugcacuuucggc

SEQ ID NO: 126107 - RNA, 22 nt, Mycobacterium avium subsp. paratuberculosis
ggccggggucugggcguugagg

SEQ ID NO: 126108 - RNA, 22 nt, Mycobacterium avium subsp. paratuberculosis
gaguccgccccggccgacaccu

SEQ ID NO: 126109 - RNA, 22 nt, Mycobacterium avium subsp. paratuberculosis
gguugucgaaguaccggaagcc

SEQ ID NO: 126110 - RNA, 22 nt, Mycobacterium avium subsp. paratuberculosis
agcuggauguggugcacggucg

SEQ ID NO: 126111 - RNA, 23 nt, Mycobacterium avium subsp. paratuberculosis
ucgacgaugugacgcggccagcg

SEQ ID NO: 126112 - RNA, 22 nt, Mycobacterium avium subsp. paratuberculosis
cugcccgggcccgauggcggcc

SEQ ID NO: 126113 - RNA, 22 nt, Mycobacterium avium subsp. paratuberculosis
ugcguugcgccacuugggguuc

SEQ ID NO: 126114 - RNA, 17 nt, Mycobacterium avium subsp. paratuberculosis
ugcugguggugcuccug

SEQ ID NO: 126115 - RNA, 22 nt, Mycobacterium avium subsp. paratuberculosis
cugcuggugcggcuggccggcg

SEQ ID NO: 126116 - RNA, 22 nt, Mycobacterium avium subsp. paratuberculosis
cagcaggagcuucccccgggcg

SEQ ID NO: 126117 - RNA, 22 nt, Mycobacterium avium subsp. paratuberculosis
cgucgcgguugccgaaccggug

SEQ ID NO: 126118 - RNA, 22 nt, Mycobacterium avium subsp. paratuberculosis
gucgccgaccugcuggcguccg

SEQ ID NO: 126119 - RNA, 22 nt, Mycobacterium avium subsp. paratuberculosis
gccucggcgccgaauccguuga

SEQ ID NO: 126120 - RNA, 22 nt, Mycobacterium avium subsp. paratuberculosis
gugcgguguggggugacgacgu

SEQ ID NO: 126121 - RNA, 22 nt, Mycobacterium avium subsp. paratuberculosis
gcggcgcagaagggaucgguga

SEQ ID NO: 126122 - RNA, 22 nt, Mycobacterium avium subsp. paratuberculosis
cugcagauccgagaggguguuc

SEQ ID NO: 126123 - RNA, 22 nt, Mycobacterium avium subsp. paratuberculosis
cguucggaacgcacaccgugcu

SEQ ID NO: 126124 - RNA, 22 nt, Mycobacterium avium subsp. paratuberculosis
ugucggugucgugggcggccgc

SEQ ID NO: 126125 - RNA, 22 nt, Mycobacterium avium subsp. paratuberculosis
cgccgaccugcugauccugccg

SEQ ID NO: 126126 - RNA, 22 nt, Mycobacterium avium subsp. paratuberculosis
gacacccacgacggcacggccc

SEQ ID NO: 126127 - RNA, 22 nt, Mycobacterium avium subsp. paratuberculosis
ccccgacgccgugcuggccacc

SEQ ID NO: 126128 - RNA, 20 nt, Mycobacterium avium subsp. paratuberculosis
gccggaccgcacgaucgccg

SEQ ID NO: 126129 - RNA, 18 nt, Mycobacterium avium subsp. paratuberculosis
ccgcggcggggucgaacc

SEQ ID NO: 126130 - RNA, 22 nt, Mycobacterium avium subsp. paratuberculosis
ccacgccggcgugacgcuggag

SEQ ID NO: 126131 - RNA, 22 nt, Mycobacterium avium subsp. paratuberculosis
cggcggcccaaaagguuugggc

SEQ ID NO: 126132 - RNA, 22 nt, Mycobacterium avium subsp. paratuberculosis
ugcgugacauacagcgugucga

SEQ ID NO: 126133 - RNA, 22 nt, Mycobacterium avium subsp. paratuberculosis
cgcgaucuucuucgucggccgu

SEQ ID NO: 126134 - RNA, 22 nt, Mycobacterium avium subsp. paratuberculosis
gcgaggucagacaccggggguc

SEQ ID NO: 126135 - RNA, 22 nt, Mycobacterium avium subsp. paratuberculosis
gcaccgccggcuaucuggccau

SEQ ID NO: 126136 - RNA, 22 nt, Mycobacterium avium subsp. paratuberculosis
cggccgccuucaccugaugcuc

SEQ ID NO: 126137 - RNA, 22 nt, Mycobacterium avium subsp. paratuberculosis
gucggagaucugcgaggccgac

SEQ ID NO: 126138 - RNA, 22 nt, Mycobacterium avium subsp. paratuberculosis
gugaaguuaauuucacgcucgg

SEQ ID NO: 126139 - RNA, 22 nt, Mycobacterium avium subsp. paratuberculosis
ugugggcgggcacguggcuuug

SEQ ID NO: 126140 - RNA, 22 nt, Mycobacterium avium subsp. paratuberculosis
gagcgggcccuggaucggguca

SEQ ID NO: 126141 - RNA, 23 nt, Mycobacterium avium subsp. paratuberculosis
cuccgguucgggaugcgagcuga

SEQ ID NO: 126142 - RNA, 22 nt, Mycobacterium avium subsp. paratuberculosis
gaucgacgacuuucagcuggag

SEQ ID NO: 126143 - RNA, 22 nt, Mycobacterium avium subsp. paratuberculosis
auccaugucccccacguucggc

SEQ ID NO: 126144 - RNA, 22 nt, Mycobacterium avium subsp. paratuberculosis
gucggccggcccgaucggcgau

SEQ ID NO: 126145 - RNA, 17 nt, Mycobacterium avium subsp. paratuberculosis
uccaggucggccgcggu

SEQ ID NO: 126146 - RNA, 22 nt, Mycobacterium avium subsp. paratuberculosis
cgugaucgcguccgagcaggcc

SEQ ID NO: 126147 - RNA, 22 nt, Mycobacterium avium subsp. paratuberculosis
ugcggcccccguucgucgcggu

SEQ ID NO: 126148 - RNA, 21 nt, Mycobacterium avium subsp. paratuberculosis
ccgaucgcgauggcguugagc

SEQ ID NO: 126149 - RNA, 23 nt, Mycobacterium avium subsp. paratuberculosis
ccaguucgaccuugagcucgccc

SEQ ID NO: 126150 - RNA, 22 nt, Mycobacterium avium subsp. paratuberculosis
gugcgggaaguuccacggcgug

SEQ ID NO: 126151 - RNA, 22 nt, Mycobacterium avium subsp. paratuberculosis
gacccgcagcaucggcugcugc

SEQ ID NO: 126152 - RNA, 22 nt, Mycobacterium avium subsp. paratuberculosis
cggccagcagcgcgugggaguu

SEQ ID NO: 126153 - RNA, 22 nt, Mycobacterium avium subsp. paratuberculosis
gaaacgacccgacacccuggcc

SEQ ID NO: 126154 - RNA, 22 nt, Mycobacterium avium subsp. paratuberculosis
gcggcgcagcggcgaggucaac

SEQ ID NO: 126155 - RNA, 20 nt, Mycobacterium avium subsp. paratuberculosis
gccugcauggccgccugggc

SEQ ID NO: 126156 - RNA, 22 nt, Mycobacterium avium subsp. paratuberculosis
aacggugcgucgccccggcggg

SEQ ID NO: 126157 - RNA, 22 nt, Mycobacterium avium subsp. paratuberculosis
cgccgccagcaggucggcgacc

SEQ ID NO: 126158 - RNA, 19 nt, Mycobacterium avium subsp. paratuberculosis
cgucgaccugaucaacgug

SEQ ID NO: 126159 - RNA, 22 nt, Mycobacterium avium subsp. paratuberculosis
cugaccucggcccgacugauca

SEQ ID NO: 126160 - RNA, 22 nt, Mycobacterium avium subsp. paratuberculosis
uggcggcgcuggccgugcuggu

SEQ ID NO: 126161 - RNA, 22 nt, Mycobacterium avium subsp. paratuberculosis
ucaucggcgugaccuggaacga

SEQ ID NO: 126162 - RNA, 22 nt, Mycobacterium avium subsp. paratuberculosis
ggccccgcgaguacggcggcca

SEQ ID NO: 126163 - RNA, 22 nt, Mycobacterium avium subsp. paratuberculosis
guggcgcuggauccuggcgccc

SEQ ID NO: 126164 - RNA, 22 nt, Mycobacterium avium subsp. paratuberculosis
cgauccgguugcacaccaucgc

SEQ ID NO: 126165 - RNA, 22 nt, Mycobacterium avium subsp. paratuberculosis
uugauccgaucgagcacguguu

SEQ ID NO: 126166 - RNA, 22 nt, Mycobacterium avium subsp. paratuberculosis
gcgucgugauccgcgggcagac

SEQ ID NO: 126167 - RNA, 22 nt, Mycobacterium avium subsp. paratuberculosis
gaugcuggcggccucgccgcgg

SEQ ID NO: 126168 - RNA, 19 nt, Mycobacterium avium subsp. paratuberculosis
uggguaucacguccaguuc

SEQ ID NO: 126169 - RNA, 22 nt, Mycobacterium avium subsp. paratuberculosis
uucggugaccuggucgccccgc

SEQ ID NO: 126170 - RNA, 22 nt, Mycobacterium avium subsp. paratuberculosis
uuccuggugcgcaccgucaccg

SEQ ID NO: 126171 - RNA, 21 nt, Mycobacterium avium subsp. paratuberculosis
cggcaggacauggcgaacggc

SEQ ID NO: 126172 - RNA, 22 nt, Mycobacterium avium subsp. paratuberculosis
gcugccgacggggccgucauga

SEQ ID NO: 126173 - RNA, 22 nt, Mycobacterium avium subsp. paratuberculosis
cgucacgaccaccgccgcgauc

SEQ ID NO: 126174 - RNA, 21 nt, Mycobacterium avium subsp. paratuberculosis
ucgaccacggggugugccugc

SEQ ID NO: 126175 - RNA, 22 nt, Mycobacterium avium subsp. paratuberculosis
uuuucggugccgucgacgaacc

SEQ ID NO: 126176 - RNA, 22 nt, Mycobacterium avium subsp. paratuberculosis
cucggcggccugggcgugcuca

SEQ ID NO: 126177 - RNA, 20 nt, Mycobacterium avium subsp. paratuberculosis
gcuuuugcgucugcucgcgc

SEQ ID NO: 126178 - RNA, 22 nt, Mycobacterium avium subsp. paratuberculosis
uguucggucaacgcggcguggc

SEQ ID NO: 126179 - RNA, 20 nt, Mycobacterium avium subsp. paratuberculosis
cgccacgaagacggugccgc

SEQ ID NO: 126180 - RNA, 22 nt, Mycobacterium avium subsp. paratuberculosis
ucgugguguggaacaucgucgg

SEQ ID NO: 126181 - RNA, 22 nt, Mycobacterium avium subsp. paratuberculosis
cgcgaucgggagccggacuggg

SEQ ID NO: 126182 - RNA, 22 nt, Mycobacterium avium subsp. paratuberculosis
aaguccgggcuguaguacugau

SEQ ID NO: 126183 - RNA, 22 nt, Mycobacterium avium subsp. paratuberculosis
ugcccugauugaccgugaacug

SEQ ID NO: 126184 - RNA, 23 nt, Mycobacterium avium subsp. paratuberculosis
cggugcuguaccaggccgugguc

SEQ ID NO: 126185 - RNA, 22 nt, Mycobacterium avium subsp. paratuberculosis
gcgcguuggugccugaguugcc

SEQ ID NO: 126186 - RNA, 22 nt, Mycobacterium avium subsp. paratuberculosis
guggcggccgacgucaugcugg

SEQ ID NO: 126187 - RNA, 22 nt, Mycobacterium avium subsp. paratuberculosis
gacuccagcguggcggccacca

SEQ ID NO: 126188 - RNA, 21 nt, Mycobacterium avium subsp. paratuberculosis
ucggcggcaccaucgggacgc

SEQ ID NO: 126189 - RNA, 22 nt, Mycobacterium avium subsp. paratuberculosis
ucgcgguucucgauguccuugc

SEQ ID NO: 126190 - RNA, 22 nt, Mycobacterium avium subsp. paratuberculosis
cgccgcaagcucggucucgucg

SEQ ID NO: 126191 - RNA, 22 nt, Mycobacterium avium subsp. paratuberculosis
cucggcggcgagaucgguggcc

SEQ ID NO: 126192 - RNA, 22 nt, Mycobacterium avium subsp. paratuberculosis
ggcggggagaaggugacgcugc

SEQ ID NO: 126193 - RNA, 22 nt, Mycobacterium avium subsp. paratuberculosis
accguguccuuggccgagcgca

SEQ ID NO: 126194 - RNA, 22 nt, Mycobacterium avium subsp. paratuberculosis
ucgcagucguauccggcggcgg

SEQ ID NO: 126195 - RNA, 22 nt, Mycobacterium avium subsp. paratuberculosis
ggugcggcagggcgacugaccg

SEQ ID NO: 126196 - RNA, 22 nt, Mycobacterium avium subsp. paratuberculosis
augcucaccggccguaccgugu

SEQ ID NO: 126197 - RNA, 22 nt, Mycobacterium avium subsp. paratuberculosis
guccgaggucgcugcgccgacg

SEQ ID NO: 126198 - RNA, 22 nt, Mycobacterium avium subsp. paratuberculosis
cccucaucuggugcacgcgaug

SEQ ID NO: 126199 - RNA, 22 nt, Mycobacterium avium subsp. paratuberculosis
uucguccgccagcacgguuugc

SEQ ID NO: 126200 - RNA, 22 nt, Mycobacterium avium subsp. paratuberculosis
agcgugaagcuaacuucacgcu

SEQ ID NO: 126201 - RNA, 22 nt, Mycobacterium avium subsp. paratuberculosis
ucaccggagccgcugacccggc

SEQ ID NO: 126202 - RNA, 22 nt, Mycobacterium avium subsp. paratuberculosis
ccccggcguccacgccguguug

SEQ ID NO: 126203 - RNA, 22 nt, Mycobacterium avium subsp. paratuberculosis
acucgaugucaucgucguccaa

SEQ ID NO: 126204 - RNA, 22 nt, Mycobacterium avium subsp. paratuberculosis
ccgcucguaacgccagggcgga

SEQ ID NO: 126205 - RNA, 22 nt, Mycobacterium avium subsp. paratuberculosis
gacaccuucaucggcucgccgc

SEQ ID NO: 126206 - RNA, 22 nt, Mycobacterium avium subsp. paratuberculosis
cggggcauucggugacgguauc

SEQ ID NO: 126207 - RNA, 22 nt, Mycobacterium avium subsp. paratuberculosis
augccggcuucccagccgggca

SEQ ID NO: 126208 - RNA, 22 nt, Mycobacterium avium subsp. paratuberculosis
cggacgccucggccagguugag

SEQ ID NO: 126209 - RNA, 22 nt, Mycobacterium avium subsp. paratuberculosis
ucggucaacgugcccgucuugu

SEQ ID NO: 126210 - RNA, 22 nt, Mycobacterium avium subsp. paratuberculosis
ggugggcgcuggcggucaucgu

SEQ ID NO: 126211 - RNA, 22 nt, Mycobacterium avium subsp. paratuberculosis
uguucgccggcgucgaucagcg

SEQ ID NO: 126212 - RNA, 22 nt, Mycobacterium avium subsp. paratuberculosis
cacaccgacggcuucccgcgcg

SEQ ID NO: 126213 - RNA, 22 nt, Mycobacterium avium subsp. paratuberculosis
cucgaucguccgggacgcgauc

SEQ ID NO: 126214 - RNA, 22 nt, Mycobacterium avium subsp. paratuberculosis
cugcaccgacaggccgcuggaa

SEQ ID NO: 126215 - RNA, 22 nt, Mycobacterium avium subsp. paratuberculosis
gugggcugucggugaccuggcu

SEQ ID NO: 126216 - RNA, 22 nt, Mycobacterium avium subsp. paratuberculosis
uggagggcgccggcaucgacuc

SEQ ID NO: 126217 - RNA, 22 nt, Mycobacterium avium subsp. paratuberculosis
uggucggccgacgacguguucu

SEQ ID NO: 126218 - RNA, 22 nt, Mycobacterium avium subsp. paratuberculosis
gaucggcgacggccucggcauu

SEQ ID NO: 126219 - RNA, 20 nt, Mycobacterium avium subsp. paratuberculosis
uugucugcuuuggguugucg

SEQ ID NO: 126220 - RNA, 22 nt, Mycobacterium avium subsp. paratuberculosis
cuggcugacgucagcgacuucg

SEQ ID NO: 126221 - RNA, 22 nt, Mycobacterium avium subsp. paratuberculosis
ugauccccggugaugacuucgc

SEQ ID NO: 126222 - RNA, 21 nt, Mycobacterium avium subsp. paratuberculosis
gccugggcaccaggucgacga

SEQ ID NO: 126223 - RNA, 22 nt, Mycobacterium avium subsp. paratuberculosis
ccgggugagcaaguacgcguug

SEQ ID NO: 126224 - RNA, 22 nt, Mycobacterium avium subsp. paratuberculosis
cuccugguggucgucgccgugg

SEQ ID NO: 126225 - RNA, 22 nt, Mycobacterium avium subsp. paratuberculosis
gggcgucugcuugccgccggug

SEQ ID NO: 126226 - RNA, 22 nt, Mycobacterium avium subsp. paratuberculosis
caggcgcugaaccugcgcagcg

SEQ ID NO: 126227 - RNA, 22 nt, Mycobacterium avium subsp. paratuberculosis
acuacggguaccgccggcugcg

SEQ ID NO: 126228 - RNA, 22 nt, Mycobacterium avium subsp. paratuberculosis
gacggcgccgcgucgguggugg

SEQ ID NO: 126229 - RNA, 21 nt, Mycobacterium avium subsp. paratuberculosis
uggcaggucgucgacgccacc

SEQ ID NO: 126230 - RNA, 22 nt, Mycobacterium avium subsp. paratuberculosis
ucggcggacauggcggucgccc

SEQ ID NO: 126231 - RNA, 22 nt, Mycobacterium avium subsp. paratuberculosis
ccggucgaggugagcgaugagc

SEQ ID NO: 126232 - RNA, 22 nt, Mycobacterium avium subsp. paratuberculosis
cgguggucgggugaccucaccg

SEQ ID NO: 126233 - RNA, 23 nt, Mycobacterium avium subsp. paratuberculosis
ucggcgagcacgccaucgccucg

SEQ ID NO: 126234 - RNA, 22 nt, Mycobacterium avium subsp. paratuberculosis
gucgcugaggcugcgggugggg

SEQ ID NO: 126235 - RNA, 22 nt, Mycobacterium avium subsp. paratuberculosis
cuggccggccucgacccggucg

SEQ ID NO: 126236 - RNA, 22 nt, Mycobacterium avium subsp. paratuberculosis
ucuccccagcgggcccggcggu

SEQ ID NO: 126237 - RNA, 22 nt, Mycobacterium avium subsp. paratuberculosis
cgucgacggcgaacuugggcuu

SEQ ID NO: 126238 - RNA, 22 nt, Mycobacterium avium subsp. paratuberculosis
uggacgagaucuucgcgacccg

SEQ ID NO: 126239 - RNA, 22 nt, Mycobacterium avium subsp. paratuberculosis
ggguggccuucggugucgaccg

SEQ ID NO: 126240 - RNA, 20 nt, Mycobacterium avium subsp. paratuberculosis
gguugcggacgaucgccagc

SEQ ID NO: 126241 - RNA, 22 nt, Mycobacterium avium subsp. paratuberculosis
ucggcaggcuggcguaguugcc

SEQ ID NO: 126242 - RNA, 22 nt, Mycobacterium avium subsp. paratuberculosis
ugugcggugcgaugccgggcag

SEQ ID NO: 126243 - RNA, 22 nt, Mycobacterium avium subsp. paratuberculosis
gccgcucguaacggcagggcgc

SEQ ID NO: 126244 - RNA, 22 nt, Mycobacterium avium subsp. paratuberculosis
ucgggccguagcgggucagcgc

SEQ ID NO: 126245 - RNA, 22 nt, Mycobacterium avium subsp. paratuberculosis
guccgucagcucuucgcggccg

SEQ ID NO: 126246 - RNA, 22 nt, Mycobacterium avium subsp. paratuberculosis
ugcuggugaagucgaggaagcc

SEQ ID NO: 126247 - RNA, 22 nt, Mycobacterium avium subsp. paratuberculosis
gucggcggaugcugccaggugc

SEQ ID NO: 126248 - RNA, 22 nt, Mycobacterium avium subsp. paratuberculosis
aaggccuacaacgacuggcaca

SEQ ID NO: 126249 - RNA, 22 nt, Mycobacterium avium subsp. paratuberculosis
ccggccgcagcauguauccgac

SEQ ID NO: 126250 - RNA, 22 nt, Mycobacterium avium subsp. paratuberculosis
ugggcgacuugauggcggucgg

SEQ ID NO: 126251 - RNA, 22 nt, Mycobacterium avium subsp. paratuberculosis
uguccgaaggcacgaaccuggc

SEQ ID NO: 126252 - RNA, 22 nt, Mycobacterium avium subsp. paratuberculosis
uggucggagguggccggcaucu

SEQ ID NO: 126253 - RNA, 22 nt, Mycobacterium avium subsp. paratuberculosis
gcuguuuuugugcaucuggauc

SEQ ID NO: 126254 - RNA, 22 nt, Mycobacterium avium subsp. paratuberculosis
ccgccgaaggugauugggcggc

SEQ ID NO: 126255 - RNA, 22 nt, Mycobacterium avium subsp. paratuberculosis
guggguguagccgcgccugcca

SEQ ID NO: 126256 - RNA, 22 nt, Mycobacterium avium subsp. paratuberculosis
aaucgugcucggugagccacga

SEQ ID NO: 126257 - RNA, 22 nt, Mycobacterium avium subsp. paratuberculosis
ucggccagauccuggagaccca

SEQ ID NO: 126258 - RNA, 22 nt, Mycobacterium avium subsp. paratuberculosis
ugggcagaucccgccaggcggu

SEQ ID NO: 126259 - RNA, 22 nt, Mycobacterium avium subsp. paratuberculosis
cuaccgcuacugcaccuacguc

SEQ ID NO: 126260 - RNA, 22 nt, Mycobacterium avium subsp. paratuberculosis
gcaauguggcagaucgccgaau

SEQ ID NO: 126261 - RNA, 22 nt, Mycobacterium avium subsp. paratuberculosis
caccugcuggccacucucgccg

SEQ ID NO: 126262 - RNA, 22 nt, Mycobacterium avium subsp. paratuberculosis
uacaccguuucggcggacuggg

SEQ ID NO: 126263 - RNA, 22 nt, Mycobacterium avium subsp. paratuberculosis
gaucgacgcugugcagaucgac

SEQ ID NO: 126264 - RNA, 22 nt, Mycobacterium avium subsp. paratuberculosis
ggugauugguggcgguggcguc

SEQ ID NO: 126265 - RNA, 22 nt, Mycobacterium avium subsp. paratuberculosis
gcccggccaccuggucggguuc

SEQ ID NO: 126266 - RNA, 22 nt, Mycobacterium avium subsp. paratuberculosis
ucgaucgcgaccuccuugauga

SEQ ID NO: 126267 - RNA, 22 nt, Mycobacterium avium subsp. paratuberculosis
gauugacggccucccgggcguc

SEQ ID NO: 126268 - RNA, 22 nt, Mycobacterium avium subsp. paratuberculosis
ccuuggugaccagcggcuggcc

SEQ ID NO: 126269 - RNA, 22 nt, Mycobacterium avium subsp. paratuberculosis
ggacgucggcgcgcucggugcu

SEQ ID NO: 126270 - RNA, 23 nt, Mycobacterium avium subsp. paratuberculosis
agcuggaugaucucggugaugag

SEQ ID NO: 126271 - RNA, 22 nt, Mycobacterium avium subsp. paratuberculosis
ugaucggccggcacgccgacgu

SEQ ID NO: 126272 - RNA, 22 nt, Mycobacterium avium subsp. paratuberculosis
accgggcacgggucgccgccac

SEQ ID NO: 126273 - RNA, 22 nt, Mycobacterium avium subsp. paratuberculosis
ccgguaccaacuggugggccuu

SEQ ID NO: 126274 - RNA, 22 nt, Mycobacterium avium subsp. paratuberculosis
uggcugcgagacgggcuggucg

SEQ ID NO: 126275 - RNA, 22 nt, Mycobacterium avium subsp. paratuberculosis
ggcgaugcuggccuucacguuc

SEQ ID NO: 126276 - RNA, 23 nt, Mycobacterium avium subsp. paratuberculosis
cgucgccuucuacucgugcugcg

SEQ ID NO: 126277 - RNA, 22 nt, Mycobacterium avium subsp. paratuberculosis
gaacgugcacccaccgcgagaa

SEQ ID NO: 126278 - RNA, 22 nt, Mycobacterium avium subsp. paratuberculosis
cucacucugcaggaacucgggg

SEQ ID NO: 126279 - RNA, 22 nt, Mycobacterium avium subsp. paratuberculosis
gcacgcgguggucggggagugg

SEQ ID NO: 126280 - RNA, 22 nt, Mycobacterium avium subsp. paratuberculosis
acggcccggucuugguccauug

SEQ ID NO: 126281 - RNA, 22 nt, Mycobacterium avium subsp. paratuberculosis
uggaucaucggcucgcggccgg

SEQ ID NO: 126282 - RNA, 22 nt, Mycobacterium avium subsp. paratuberculosis
aucgucgaggacgccgagcacu

SEQ ID NO: 126283 - RNA, 22 nt, Mycobacterium avium subsp. paratuberculosis
ccaccgacgcacgcuugcgcug

SEQ ID NO: 126284 - RNA, 22 nt, Mycobacterium avium subsp. paratuberculosis
ugccggugguguucgucgugca

SEQ ID NO: 126285 - RNA, 22 nt, Mycobacterium avium subsp. paratuberculosis
aggauggugcgggccugcaguu

SEQ ID NO: 126286 - RNA, 22 nt, Mycobacterium avium subsp. paratuberculosis
ugcuggucccggucgacgacgu

SEQ ID NO: 126287 - RNA, 22 nt, Mycobacterium avium subsp. paratuberculosis
accagcuugggcagcagcgcgc

SEQ ID NO: 126288 - RNA, 23 nt, Mycobacterium avium subsp. paratuberculosis
ccgccucgucgauaucgcugacg

SEQ ID NO: 126289 - RNA, 22 nt, Mycobacterium avium subsp. paratuberculosis
cacgaugcuggagaucaccagg

SEQ ID NO: 126290 - RNA, 22 nt, Mycobacterium avium subsp. paratuberculosis
cgaacucggcaucaccugccag

SEQ ID NO: 126291 - RNA, 22 nt, Mycobacterium avium subsp. paratuberculosis
acagccggugaccccgguggug

SEQ ID NO: 126292 - RNA, 22 nt, Mycobacterium avium subsp. paratuberculosis
caccgccgucgaccugcggcgc

SEQ ID NO: 126293 - RNA, 22 nt, Mycobacterium avium subsp. paratuberculosis
ggcuguugcgcggcagcggccu

SEQ ID NO: 126294 - RNA, 22 nt, Mycobacterium avium subsp. paratuberculosis
gcaccacguauaccgacgcgcc

SEQ ID NO: 126295 - RNA, 22 nt, Mycobacterium avium subsp. paratuberculosis
uccagcggccgaucccggugug

SEQ ID NO: 126296 - RNA, 22 nt, Mycobacterium avium subsp. paratuberculosis
gccgcgcugaccgagcucgucg

SEQ ID NO: 126297 - RNA, 22 nt, Mycobacterium avium subsp. paratuberculosis
ugcccggcggugcgccuaccgg

SEQ ID NO: 126298 - RNA, 22 nt, Mycobacterium avium subsp. paratuberculosis
ucgagcuggucgagcuccgggg

SEQ ID NO: 126299 - RNA, 22 nt, Mycobacterium avium subsp. paratuberculosis
cggucuuguugucgucggcccg

SEQ ID NO: 126300 - RNA, 22 nt, Mycobacterium avium subsp. paratuberculosis
gaagacgcaaaagcccccgcac

SEQ ID NO: 126301 - RNA, 22 nt, Mycobacterium avium subsp. paratuberculosis
gagaaccuccgagugaagugcg

SEQ ID NO: 126302 - RNA, 22 nt, Mycobacterium avium subsp. paratuberculosis
acgccgugguacuccggcgcga

SEQ ID NO: 126303 - RNA, 22 nt, Mycobacterium avium subsp. paratuberculosis
cgccuuggacaaaugacccgag

SEQ ID NO: 126304 - RNA, 23 nt, Mycobacterium avium subsp. paratuberculosis
cgcgggucuccgagcuggacggc

SEQ ID NO: 126305 - RNA, 22 nt, Mycobacterium avium subsp. paratuberculosis
uuggccggcagcucaccgcgcu

SEQ ID NO: 126306 - RNA, 22 nt, Mycobacterium avium subsp. paratuberculosis
agcacgacguccgucgcgccgg

SEQ ID NO: 126307 - RNA, 22 nt, Mycobacterium avium subsp. paratuberculosis
gucgagcagcacgaugucggcg

SEQ ID NO: 126308 - RNA, 22 nt, Mycobacterium avium subsp. paratuberculosis
agagcuccagcgagaacgggcc

SEQ ID NO: 126309 - RNA, 22 nt, Mycobacterium avium subsp. paratuberculosis
auguucaucaccgggcccgacg

SEQ ID NO: 126310 - RNA, 22 nt, Mycobacterium avium subsp. paratuberculosis
ugaccgcgucgaccggcucgaa

SEQ ID NO: 126311 - RNA, 19 nt, Mycobacterium avium subsp. paratuberculosis
ucgacgacgucgaucaccu

SEQ ID NO: 126312 - RNA, 22 nt, Mycobacterium avium subsp. paratuberculosis
aaccgcgcgaccaccgccgugg

SEQ ID NO: 126313 - RNA, 22 nt, Mycobacterium avium subsp. paratuberculosis
cccucccgcgaggagcaggcgc

SEQ ID NO: 126314 - RNA, 22 nt, Mycobacterium avium subsp. paratuberculosis
gcacgccgaucagcgggcggcu

SEQ ID NO: 126315 - RNA, 22 nt, Mycobacterium avium subsp. paratuberculosis
ccgaacgugcacuggcagcgaa

SEQ ID NO: 126316 - RNA, 22 nt, Mycobacterium avium subsp. paratuberculosis
gcgucgacguccucgucggugg

SEQ ID NO: 126317 - RNA, 22 nt, Mycobacterium avium subsp. paratuberculosis
ccggcgcggucagcucgccggg

SEQ ID NO: 126318 - RNA, 22 nt, Mycobacterium avium subsp. paratuberculosis
gcaccggcaucccgccgcugua

SEQ ID NO: 126319 - RNA, 22 nt, Mycobacterium avium subsp. paratuberculosis
ccgcuacuacgugagcaugaac

SEQ ID NO: 126320 - RNA, 22 nt, Mycobacterium avium subsp. paratuberculosis
cagccugguagcgaucgccgag

SEQ ID NO: 126321 - RNA, 22 nt, Mycobacterium avium subsp. paratuberculosis
uucgaucaggaucggguguucg

SEQ ID NO: 126322 - RNA, 22 nt, Mycobacterium avium subsp. paratuberculosis
uccauucccaucgcccgcagca

SEQ ID NO: 126323 - RNA, 20 nt, Mycobacterium avium subsp. paratuberculosis
gcugauggcguugcugaugc

SEQ ID NO: 126324 - RNA, 22 nt, Mycobacterium avium subsp. paratuberculosis
caucggcaucgcggugcuggug

SEQ ID NO: 126325 - RNA, 22 nt, Mycobacterium avium subsp. paratuberculosis
acgauggcgaucacccagcgcc

SEQ ID NO: 126326 - RNA, 21 nt, Mycobacterium avium subsp. paratuberculosis
accaggucggucagcgagcuc

SEQ ID NO: 126327 - RNA, 22 nt, Mycobacterium avium subsp. paratuberculosis
ggggauccacgcggcgccgugc

SEQ ID NO: 126328 - RNA, 22 nt, Mycobacterium avium subsp. paratuberculosis
aguccuugaccaggaacuucag

SEQ ID NO: 126329 - RNA, 22 nt, Mycobacterium avium subsp. paratuberculosis
uaggcgccggucagcgacgcca

SEQ ID NO: 126330 - RNA, 22 nt, Mycobacterium avium subsp. paratuberculosis
uccgggaaccucgaccucgugg

SEQ ID NO: 126331 - RNA, 22 nt, Mycobacterium avium subsp. paratuberculosis
guggccacgaucgccgcggugg

SEQ ID NO: 126332 - RNA, 22 nt, Mycobacterium avium subsp. paratuberculosis
cggugugcagcgggugcaggcg

SEQ ID NO: 126333 - RNA, 22 nt, Mycobacterium avium subsp. paratuberculosis
cggcgugugcuggccggggccg

SEQ ID NO: 126334 - RNA, 21 nt, Mycobacterium avium subsp. paratuberculosis
gucggcaguugcacuuucgcg

SEQ ID NO: 126335 - RNA, 23 nt, Mycobacterium avium subsp. paratuberculosis
ggcucgguggcgaguuggcggac

SEQ ID NO: 126336 - RNA, 22 nt, Mycobacterium avium subsp. paratuberculosis
ucgacgaaauggccgagcagcg

SEQ ID NO: 126337 - RNA, 22 nt, Mycobacterium avium subsp. paratuberculosis
uaacuggugauguugcgggcga

SEQ ID NO: 126338 - RNA, 22 nt, Mycobacterium avium subsp. paratuberculosis
gccgcuuacgcccagcugucgg

SEQ ID NO: 126339 - RNA, 22 nt, Mycobacterium avium subsp. paratuberculosis
ucgaacagcgccugcugggugg

SEQ ID NO: 126340 - RNA, 22 nt, Mycobacterium avium subsp. paratuberculosis
ggcaucgacaaccggcucgccg

SEQ ID NO: 126341 - RNA, 22 nt, Mycobacterium avium subsp. paratuberculosis
gcugacgcuguucgggggucag

SEQ ID NO: 126342 - RNA, 22 nt, Mycobacterium avium subsp. paratuberculosis
ucucccggaauccgucgauguu

SEQ ID NO: 126343 - RNA, 20 nt, Mycobacterium avium subsp. paratuberculosis
guucgucgcugaccgggguc

SEQ ID NO: 126344 - RNA, 20 nt, Mycobacterium avium subsp. paratuberculosis
ggcggcacauucgaagucac

SEQ ID NO: 126345 - RNA, 22 nt, Mycobacterium avium subsp. paratuberculosis
gccguggacgugcaccgagaug

SEQ ID NO: 126346 - RNA, 22 nt, Mycobacterium avium subsp. paratuberculosis
ucgcggccagugcacgcucggc

SEQ ID NO: 126347 - RNA, 22 nt, Mycobacterium avium subsp. paratuberculosis
cugauucggcaaguucucgagg

SEQ ID NO: 126348 - RNA, 22 nt, Mycobacterium avium subsp. paratuberculosis
cgagccuggccggacgcgcggu

SEQ ID NO: 126349 - RNA, 22 nt, Mycobacterium avium subsp. paratuberculosis
gcguugcugauccugucagcgg

SEQ ID NO: 126350 - RNA, 22 nt, Mycobacterium avium subsp. paratuberculosis
acguacaagaacaccggcgaac

SEQ ID NO: 126351 - RNA, 22 nt, Mycobacterium avium subsp. paratuberculosis
ccgcguucaccgaucccggcua

SEQ ID NO: 126352 - RNA, 22 nt, Mycobacterium avium subsp. paratuberculosis
gcccggugccgguggcucgggc

SEQ ID NO: 126353 - RNA, 22 nt, Mycobacterium avium subsp. paratuberculosis
cucgguggugauccgcgcgacc

SEQ ID NO: 126354 - RNA, 21 nt, Mycobacterium avium subsp. paratuberculosis
cucgggcaguguucugaccgc

SEQ ID NO: 126355 - RNA, 20 nt, Mycobacterium avium subsp. paratuberculosis
cggccgagguuccggcgcug

SEQ ID NO: 126356 - RNA, 22 nt, Mycobacterium avium subsp. paratuberculosis
aggcgugugcgccgccgucgac

SEQ ID NO: 126357 - RNA, 22 nt, Mycobacterium avium subsp. paratuberculosis
cugcuggacagccugcuguccg

SEQ ID NO: 126358 - RNA, 22 nt, Mycobacterium avium subsp. paratuberculosis
ugucggcacgcuagucugcugc

SEQ ID NO: 126359 - RNA, 22 nt, Mycobacterium avium subsp. paratuberculosis
ucgugcgguggucugcggucgu

SEQ ID NO: 126360 - RNA, 22 nt, Mycobacterium avium subsp. paratuberculosis
aggacggugacguguucgcgaa

SEQ ID NO: 126361 - RNA, 22 nt, Mycobacterium avium subsp. paratuberculosis
gaccagguuggucaccggcacc

SEQ ID NO: 126362 - RNA, 22 nt, Mycobacterium avium subsp. paratuberculosis
guucgcggacgggcuggccggc

SEQ ID NO: 126363 - RNA, 22 nt, Mycobacterium avium subsp. paratuberculosis
ggcgcgguucuagacugucugc

SEQ ID NO: 126364 - RNA, 22 nt, Mycobacterium avium subsp. paratuberculosis
acaucgucaagaacaccgcgug

SEQ ID NO: 126365 - RNA, 22 nt, Mycobacterium avium subsp. paratuberculosis
uggcgguggaccugccggcccu

SEQ ID NO: 126366 - RNA, 22 nt, Mycobacterium avium subsp. paratuberculosis
ccccgguggaaugcggucgcag

SEQ ID NO: 126367 - RNA, 22 nt, Mycobacterium avium subsp. paratuberculosis
gcgagcccguccaggucgugcu

SEQ ID NO: 126368 - RNA, 22 nt, Mycobacterium avium subsp. paratuberculosis
cugugcgagcccggcgguagcg

SEQ ID NO: 126369 - RNA, 22 nt, Mycobacterium avium subsp. paratuberculosis
ucgaugcccauggcgccgccca

SEQ ID NO: 126370 - RNA, 22 nt, Mycobacterium avium subsp. paratuberculosis
gucggcgcugauggccgcgugg

SEQ ID NO: 126371 - RNA, 22 nt, Mycobacterium avium subsp. paratuberculosis
ugggcaccgcgcccggcggcac

SEQ ID NO: 126372 - RNA, 22 nt, Mycobacterium avium subsp. paratuberculosis
auggcgugcgcgaugggguguu

SEQ ID NO: 126373 - RNA, 22 nt, Mycobacterium avium subsp. paratuberculosis
ugcacgacccgaugaccuucau

SEQ ID NO: 126374 - RNA, 22 nt, Mycobacterium avium subsp. paratuberculosis
cgcggcugaccacgcugucuug

SEQ ID NO: 126375 - RNA, 22 nt, Mycobacterium avium subsp. paratuberculosis
cggucggcgggucaggcgagca

SEQ ID NO: 126376 - RNA, 22 nt, Mycobacterium avium subsp. paratuberculosis
aagaaguggaugccgacgaagu

SEQ ID NO: 126377 - RNA, 22 nt, Mycobacterium avium subsp. paratuberculosis
gccacgcuggcgugacgcucgc

SEQ ID NO: 126378 - RNA, 22 nt, Mycobacterium avium subsp. paratuberculosis
ucguggugcugucgcagcugcc

SEQ ID NO: 126379 - RNA, 22 nt, Mycobacterium avium subsp. paratuberculosis
ucggcgacguagugguggccgu

SEQ ID NO: 126380 - RNA, 22 nt, Mycobacterium avium subsp. paratuberculosis
gccggugccguggucugcgccg

SEQ ID NO: 126381 - RNA, 22 nt, Mycobacterium avium subsp. paratuberculosis
ggcucgacggcuggccggaagc

SEQ ID NO: 126382 - RNA, 22 nt, Mycobacterium avium subsp. paratuberculosis
cuggucagguacaguguuuaga

SEQ ID NO: 126383 - RNA, 22 nt, Mycobacterium avium subsp. paratuberculosis
acgugcacgccaugugcguggg

SEQ ID NO: 126384 - RNA, 22 nt, Mycobacterium avium subsp. paratuberculosis
guccucgaccacgauggugcgu

SEQ ID NO: 126385 - RNA, 22 nt, Mycobacterium avium subsp. paratuberculosis
cagcgcgacuucgcguauccgg

SEQ ID NO: 126386 - RNA, 22 nt, Mycobacterium avium subsp. paratuberculosis
cgcaguucaucuaucugcuuuc

SEQ ID NO: 126387 - RNA, 22 nt, Mycobacterium avium subsp. paratuberculosis
ucacugcuggucgcgcggcuga

SEQ ID NO: 126388 - RNA, 22 nt, Mycobacterium avium subsp. paratuberculosis
cgcccagccgaaccuguugcug

SEQ ID NO: 126389 - RNA, 22 nt, Mycobacterium avium subsp. paratuberculosis
gccugcagcccuggacgucucg

SEQ ID NO: 126390 - RNA, 22 nt, Mycobacterium avium subsp. paratuberculosis
ucggucuugcgucccucggcgg

SEQ ID NO: 126391 - RNA, 22 nt, Mycobacterium avium subsp. paratuberculosis
ccggcgucgacgccgucgaacu

SEQ ID NO: 126392 - RNA, 22 nt, Mycobacterium avium subsp. paratuberculosis
acggcugguucccgacgcgcga

SEQ ID NO: 126393 - RNA, 22 nt, Mycobacterium avium subsp. paratuberculosis
ucuacgacgcgcacauggaccu

SEQ ID NO: 126394 - RNA, 22 nt, Mycobacterium avium subsp. paratuberculosis
ccgcucugaugagaucagcggc

SEQ ID NO: 126395 - RNA, 22 nt, Mycobacterium avium subsp. paratuberculosis
ccacccggacaccgcgauccug

SEQ ID NO: 126396 - RNA, 21 nt, Mycobacterium avium subsp. paratuberculosis
ccgaaggguauucgugucuag

SEQ ID NO: 126397 - RNA, 22 nt, Mycobacterium avium subsp. paratuberculosis
acgugcuggucgcauucggccg

SEQ ID NO: 126398 - RNA, 22 nt, Mycobacterium avium subsp. paratuberculosis
ucggcggucgccaaugccgcug

SEQ ID NO: 126399 - RNA, 22 nt, Mycobacterium avium subsp. paratuberculosis
ucgagcagccgaccagcgucac

SEQ ID NO: 126400 - RNA, 22 nt, Mycobacterium avium subsp. paratuberculosis
aggucgucguaggcgucguuga

SEQ ID NO: 126401 - RNA, 22 nt, Mycobacterium avium subsp. paratuberculosis
ccgggaaugcuuuccggccagc

SEQ ID NO: 126402 - RNA, 22 nt, Mycobacterium avium subsp. paratuberculosis
uugccgaggcuguuggaucgcg

SEQ ID NO: 126403 - RNA, 22 nt, Mycobacterium avium subsp. paratuberculosis
agcuggugaccaccuaucgcgg

SEQ ID NO: 126404 - RNA, 22 nt, Mycobacterium avium subsp. paratuberculosis
ucgccgaugucgucgguguggu

SEQ ID NO: 126405 - RNA, 22 nt, Mycobacterium avium subsp. paratuberculosis
cgucgaggguuccagcgggcgc

SEQ ID NO: 126406 - RNA, 22 nt, Mycobacterium avium subsp. paratuberculosis
cgagcgugcagcuaccgcgaga

SEQ ID NO: 126407 - RNA, 22 nt, Mycobacterium avium subsp. paratuberculosis
ucaacgacgagcagggccacga

SEQ ID NO: 126408 - RNA, 22 nt, Mycobacterium avium subsp. paratuberculosis
ucgcccaacgacgcggccagcg

SEQ ID NO: 126409 - RNA, 22 nt, Mycobacterium avium subsp. paratuberculosis
gccaugucggugacguugucga

SEQ ID NO: 126410 - RNA, 22 nt, Mycobacterium avium subsp. paratuberculosis
gaccugcucgacgggugggugg

SEQ ID NO: 126411 - RNA, 21 nt, Mycobacterium avium subsp. paratuberculosis
ugcucgccugacccgccgacc

SEQ ID NO: 126412 - RNA, 22 nt, Mycobacterium avium subsp. paratuberculosis
gggugucgcccucgggguacuc

SEQ ID NO: 126413 - RNA, 22 nt, Mycobacterium avium subsp. paratuberculosis
ucggcaccaaucggcugcuggc

SEQ ID NO: 126414 - RNA, 22 nt, Mycobacterium avium subsp. paratuberculosis
gcauggccgcggcgauccgcag

SEQ ID NO: 126415 - RNA, 22 nt, Mycobacterium avium subsp. paratuberculosis
gcauggucggcuuccugaccau

SEQ ID NO: 126416 - RNA, 22 nt, Mycobacterium avium subsp. paratuberculosis
cagcgcggucaccuggcggugu

SEQ ID NO: 126417 - RNA, 22 nt, Mycobacterium avium subsp. paratuberculosis
acgugauggacgagugguuccg

SEQ ID NO: 126418 - RNA, 22 nt, Mycobacterium avium subsp. paratuberculosis
gcggccagcacccgaucgcgcu

SEQ ID NO: 126419 - RNA, 22 nt, Mycobacterium avium subsp. paratuberculosis
cgcacgccgccccgaccagaga

SEQ ID NO: 126420 - RNA, 22 nt, Mycobacterium avium subsp. paratuberculosis
agcgugaccucgucaccaagau

SEQ ID NO: 126421 - RNA, 22 nt, Mycobacterium avium subsp. paratuberculosis
ccgagcgugggggccauguacg

SEQ ID NO: 126422 - RNA, 22 nt, Mycobacterium avium subsp. paratuberculosis
gcucgacgguaaccgugacggc

SEQ ID NO: 126423 - RNA, 22 nt, Mycobacterium avium subsp. paratuberculosis
ucggggaucgacgaauaccgcc

SEQ ID NO: 126424 - RNA, 22 nt, Mycobacterium avium subsp. paratuberculosis
agccgguggaucgggucgaugc

SEQ ID NO: 126425 - RNA, 22 nt, Mycobacterium avium subsp. paratuberculosis
accgccgacuccuacggcccgu

SEQ ID NO: 126426 - RNA, 22 nt, Mycobacterium avium subsp. paratuberculosis
ccggcggucccguucucggcgc

SEQ ID NO: 126427 - RNA, 20 nt, Mycobacterium avium subsp. paratuberculosis
cugccccggcgggauggcga

SEQ ID NO: 126428 - RNA, 22 nt, Mycobacterium avium subsp. paratuberculosis
cguuggcgugggcgacgcccga

SEQ ID NO: 126429 - RNA, 22 nt, Mycobacterium avium subsp. paratuberculosis
cgcaccacgucgaucuccuugc

SEQ ID NO: 126430 - RNA, 22 nt, Mycobacterium avium subsp. paratuberculosis
gccggcgucgccgaguugaccc

SEQ ID NO: 126431 - RNA, 22 nt, Mycobacterium avium subsp. paratuberculosis
guugccgucgggccggcgccgg

SEQ ID NO: 126432 - RNA, 22 nt, Mycobacterium avium subsp. paratuberculosis
ucgaagcuggcgcuggucaggc

SEQ ID NO: 126433 - RNA, 22 nt, Mycobacterium avium subsp. paratuberculosis
ggucuggcugacgccgacgaac

SEQ ID NO: 126434 - RNA, 22 nt, Mycobacterium avium subsp. paratuberculosis
gucgcggugcgcaggaaugccg

SEQ ID NO: 126435 - RNA, 22 nt, Mycobacterium avium subsp. paratuberculosis
gggccgagucguuguccuugag

SEQ ID NO: 126436 - RNA, 22 nt, Mycobacterium avium subsp. paratuberculosis
cgagcgucacgccagcguggcg

SEQ ID NO: 126437 - RNA, 21 nt, Mycobacterium avium subsp. paratuberculosis
uggccugcagguggucgcggg

SEQ ID NO: 126438 - RNA, 22 nt, Mycobacterium avium subsp. paratuberculosis
gccagcaccgcgcugugcgugg

SEQ ID NO: 126439 - RNA, 23 nt, Mycobacterium avium subsp. paratuberculosis
ucuggccucggagccgccgagcc

SEQ ID NO: 126440 - RNA, 22 nt, Mycobacterium avium subsp. paratuberculosis
caucaucugcggauuggagccc

SEQ ID NO: 126441 - RNA, 22 nt, Mycobacterium avium subsp. paratuberculosis
cgagggcugcucguucaucaac

SEQ ID NO: 126442 - RNA, 22 nt, Mycobacterium avium subsp. paratuberculosis
cugccguugucgguggcgacga

SEQ ID NO: 126443 - RNA, 22 nt, Mycobacterium avium subsp. paratuberculosis
ucgagacuuaaaccacgcacac

SEQ ID NO: 126444 - RNA, 22 nt, Mycobacterium avium subsp. paratuberculosis
ugacgcgcgaggucgacuguca

SEQ ID NO: 126445 - RNA, 22 nt, Mycobacterium avium subsp. paratuberculosis
ggcgcguucggcgaucacgucg

SEQ ID NO: 126446 - RNA, 22 nt, Mycobacterium avium subsp. paratuberculosis
ugugccugaccgucggcgcggg

SEQ ID NO: 126447 - RNA, 22 nt, Mycobacterium avium subsp. paratuberculosis
gcgccggggcgaucgugguguc

SEQ ID NO: 126448 - RNA, 22 nt, Mycobacterium avium subsp. paratuberculosis
cccaucacgaucgggucgggcg

SEQ ID NO: 126449 - RNA, 22 nt, Mycobacterium avium subsp. paratuberculosis
gccagguuguuguuggugcggc

SEQ ID NO: 126450 - RNA, 22 nt, Mycobacterium avium subsp. paratuberculosis
gucggucaccgucgucggaccg

SEQ ID NO: 126451 - RNA, 21 nt, Mycobacterium avium subsp. paratuberculosis
uggcugaugucgcucugcguc

SEQ ID NO: 126452 - RNA, 22 nt, Mycobacterium avium subsp. paratuberculosis
ucacgcaacaagucgacguugg

SEQ ID NO: 126453 - RNA, 22 nt, Mycobacterium avium subsp. paratuberculosis
gcgcugaaguuacucaccgaca

SEQ ID NO: 126454 - RNA, 23 nt, Mycobacterium avium subsp. paratuberculosis
cggccgaaccgcuuucggcgguc

SEQ ID NO: 126455 - RNA, 22 nt, Mycobacterium avium subsp. paratuberculosis
caggaucgggugggucaccgug

SEQ ID NO: 126456 - RNA, 22 nt, Mycobacterium avium subsp. paratuberculosis
gacccacugaccaggaggacag

SEQ ID NO: 126457 - RNA, 22 nt, Mycobacterium avium subsp. paratuberculosis
cuacaucgcgacgcugauggug

SEQ ID NO: 126458 - RNA, 22 nt, Mycobacterium avium subsp. paratuberculosis
cuggucauggccugguuggucu

SEQ ID NO: 126459 - RNA, 22 nt, Mycobacterium avium subsp. paratuberculosis
gguggggucccaggcgccgucc

SEQ ID NO: 126460 - RNA, 22 nt, Mycobacterium avium subsp. paratuberculosis
gcaucauguacaccgucaccug

SEQ ID NO: 126461 - RNA, 22 nt, Mycobacterium avium subsp. paratuberculosis
gcccggccuggucacgcuggcg

SEQ ID NO: 126462 - RNA, 22 nt, Mycobacterium avium subsp. paratuberculosis
ccgacgaguucggccuguucga

SEQ ID NO: 126463 - RNA, 22 nt, Mycobacterium avium subsp. paratuberculosis
agcgcgaucgggugcuggccgc

SEQ ID NO: 126464 - RNA, 22 nt, Mycobacterium avium subsp. paratuberculosis
aggccggugucggugaggaugu

SEQ ID NO: 126465 - RNA, 22 nt, Mycobacterium avium subsp. paratuberculosis
cagucgaucuccucguagcugc

SEQ ID NO: 126466 - RNA, 22 nt, Mycobacterium avium subsp. paratuberculosis
ccacgucguggaugucgggcac

SEQ ID NO: 126467 - RNA, 19 nt, Mycobacterium avium subsp. paratuberculosis
auuucgggacuguugcggg

SEQ ID NO: 126468 - RNA, 22 nt, Mycobacterium avium subsp. paratuberculosis
gugugcuccgccgggacaccgg

SEQ ID NO: 126469 - RNA, 22 nt, Mycobacterium avium subsp. paratuberculosis
uuucagcgccgccucgguguag

SEQ ID NO: 126470 - RNA, 22 nt, Mycobacterium avium subsp. paratuberculosis
cgacgacaccccgguggccucg

SEQ ID NO: 126471 - RNA, 22 nt, Mycobacterium avium subsp. paratuberculosis
cucgcucacccgcacgaacaga

SEQ ID NO: 126472 - RNA, 22 nt, Mycobacterium avium subsp. paratuberculosis
acaucaccgucgccgggcggau

SEQ ID NO: 126473 - RNA, 22 nt, Mycobacterium avium subsp. paratuberculosis
uccgccggcgacaucgaugguc

SEQ ID NO: 126474 - RNA, 21 nt, Mycobacterium avium subsp. paratuberculosis
gccguugcggaaauucuuguu

SEQ ID NO: 126475 - RNA, 22 nt, Mycobacterium avium subsp. paratuberculosis
ucccagccggccaucgcccggu

SEQ ID NO: 126476 - RNA, 22 nt, Mycobacterium avium subsp. paratuberculosis
gugacggacuguucgguggacu

SEQ ID NO: 126477 - RNA, 22 nt, Mycobacterium avium subsp. paratuberculosis
ugcgggccuccucguuggcgac

SEQ ID NO: 126478 - RNA, 22 nt, Mycobacterium avium subsp. paratuberculosis
ucgggggcuuuugcgucugcuc

SEQ ID NO: 126479 - RNA, 22 nt, Mycobacterium avium subsp. paratuberculosis
cggccaucuggucgcucagcag

SEQ ID NO: 126480 - RNA, 22 nt, Mycobacterium avium subsp. paratuberculosis
guggccgaggugcuuggggucg

SEQ ID NO: 126481 - RNA, 22 nt, Mycobacterium avium subsp. paratuberculosis
ugggcugguucggccggugacc

SEQ ID NO: 126482 - RNA, 22 nt, Mycobacterium avium subsp. paratuberculosis
cguugccaguugcacuuucgcg

SEQ ID NO: 126483 - RNA, 22 nt, Mycobacterium avium subsp. paratuberculosis
gcggucgaggccgccuugccga

SEQ ID NO: 126484 - RNA, 22 nt, Mycobacterium avium subsp. paratuberculosis
ugcgggugacaggcugaugcgg

SEQ ID NO: 126485 - RNA, 22 nt, Mycobacterium avium subsp. paratuberculosis
gcgcgagcagacacaauagcgc

SEQ ID NO: 126486 - RNA, 20 nt, Mycobacterium avium subsp. paratuberculosis
cacguggugcaccugcccga

SEQ ID NO: 126487 - RNA, 22 nt, Mycobacterium avium subsp. paratuberculosis
ucaugcucgacaccgcgcuggg

SEQ ID NO: 126488 - RNA, 22 nt, Mycobacterium avium subsp. paratuberculosis
gcuuuugugucugcucgcggua

SEQ ID NO: 126489 - RNA, 22 nt, Mycobacterium avium subsp. paratuberculosis
acgcugggcgccaccgcgcugg

SEQ ID NO: 126490 - RNA, 20 nt, Mycobacterium avium subsp. paratuberculosis
ucucgguguggguccacggc

SEQ ID NO: 126491 - RNA, 22 nt, Mycobacterium avium subsp. paratuberculosis
ucggguuccgaguaggcguugc

SEQ ID NO: 126492 - RNA, 22 nt, Mycobacterium avium subsp. paratuberculosis
uacguggggcccacgcucgggc

SEQ ID NO: 126493 - RNA, 22 nt, Mycobacterium avium subsp. paratuberculosis
ucgcgccagucgaccguggugc

SEQ ID NO: 126494 - RNA, 22 nt, Mycobacterium avium subsp. paratuberculosis
gcccgcgacgacggugucggcg

SEQ ID NO: 126495 - RNA, 22 nt, Mycobacterium avium subsp. paratuberculosis
accgcgacgccgagcccacgug

SEQ ID NO: 126496 - RNA, 22 nt, Mycobacterium avium subsp. paratuberculosis
gggucgauggacgccaccacgu

SEQ ID NO: 126497 - RNA, 22 nt, Mycobacterium avium subsp. paratuberculosis
uggucgaaguuguugcucgcac

SEQ ID NO: 126498 - RNA, 21 nt, Mycobacterium avium subsp. paratuberculosis
ggcugcgcgggagucgcccgc

SEQ ID NO: 126499 - RNA, 22 nt, Mycobacterium avium subsp. paratuberculosis
guccggcucguacaagcgguuc

SEQ ID NO: 126500 - RNA, 22 nt, Mycobacterium avium subsp. paratuberculosis
gugccgaacucgacgcggccgu

SEQ ID NO: 126501 - RNA, 22 nt, Mycobacterium avium subsp. paratuberculosis
ugcugcuguccguggggcuggc

SEQ ID NO: 126502 - RNA, 22 nt, Mycobacterium avium subsp. paratuberculosis
gucauguccgggugcgcguggc

SEQ ID NO: 126503 - RNA, 22 nt, Mycobacterium avium subsp. paratuberculosis
gcgccgucgggcaacgggugca

SEQ ID NO: 126504 - RNA, 22 nt, Mycobacterium avium subsp. paratuberculosis
cggccgcgacuggucggcggug

SEQ ID NO: 126505 - RNA, 22 nt, Mycobacterium avium subsp. paratuberculosis
augcggauguaucguucugcuc

SEQ ID NO: 126506 - RNA, 22 nt, Mycobacterium avium subsp. paratuberculosis
uucucgggccucaugguuccgc

SEQ ID NO: 126507 - RNA, 22 nt, Mycobacterium avium subsp. paratuberculosis
ccgacgauguuccacaccacga

SEQ ID NO: 126508 - RNA, 22 nt, Mycobacterium avium subsp. paratuberculosis
gagcuggccaaggaagugcccg

SEQ ID NO: 126509 - RNA, 22 nt, Mycobacterium avium subsp. paratuberculosis
cacaggugaucaucgaugcggc

SEQ ID NO: 126510 - RNA, 22 nt, Mycobacterium avium subsp. paratuberculosis
ucacgcuggcgugacgcucggc

SEQ ID NO: 126511 - RNA, 22 nt, Mycobacterium avium subsp. paratuberculosis
uccgcaggauucgcagcacgga

SEQ ID NO: 126512 - RNA, 22 nt, Mycobacterium avium subsp. paratuberculosis
cacaccgucgcagccgacguga

SEQ ID NO: 126513 - RNA, 22 nt, Mycobacterium avium subsp. paratuberculosis
cgagucagcgucggcgagucgg

SEQ ID NO: 126514 - RNA, 22 nt, Mycobacterium avium subsp. paratuberculosis
cgucagcgauuucgugggcggc

SEQ ID NO: 126515 - RNA, 22 nt, Mycobacterium avium subsp. paratuberculosis
gcuguacgaccugcccaucguc

SEQ ID NO: 126516 - RNA, 22 nt, Mycobacterium avium subsp. paratuberculosis
ggccaccagcgccgagagccgg

SEQ ID NO: 126517 - RNA, 22 nt, Mycobacterium avium subsp. paratuberculosis
gaccacccacgacgggcugcuc

SEQ ID NO: 126518 - RNA, 22 nt, Mycobacterium avium subsp. paratuberculosis
ugugccuguccaugcuggugcc

SEQ ID NO: 126519 - RNA, 22 nt, Mycobacterium avium subsp. paratuberculosis
uggccaggucgccgacgaccug

SEQ ID NO: 126520 - RNA, 22 nt, Mycobacterium avium subsp. paratuberculosis
cucgacaugcggcagcuguucg

SEQ ID NO: 126521 - RNA, 22 nt, Mycobacterium avium subsp. paratuberculosis
uuucgccgugggguuacgcgcg

SEQ ID NO: 126522 - RNA, 22 nt, Mycobacterium avium subsp. paratuberculosis
cucgcgguugccggccuggugg

SEQ ID NO: 126523 - RNA, 22 nt, Mycobacterium avium subsp. paratuberculosis
gcgucgcugaucgccgucgaug

SEQ ID NO: 126524 - RNA, 22 nt, Mycobacterium avium subsp. paratuberculosis
cgccuacccgccgccgagcuuc

SEQ ID NO: 126525 - RNA, 22 nt, Mycobacterium avium subsp. paratuberculosis
ggcgucgagcauguauucgggu

SEQ ID NO: 126526 - RNA, 22 nt, Mycobacterium avium subsp. paratuberculosis
ucgguucccgcggcgaucgcca

SEQ ID NO: 126527 - RNA, 22 nt, Mycobacterium avium subsp. paratuberculosis
cuggccggcgccucgaucgccg

SEQ ID NO: 126528 - RNA, 22 nt, Mycobacterium avium subsp. paratuberculosis
ggccgcgagccgaugauccaca

SEQ ID NO: 126529 - RNA, 22 nt, Mycobacterium avium subsp. paratuberculosis
cgcggccagccgcugaucgggg

SEQ ID NO: 126530 - RNA, 22 nt, Mycobacterium avium subsp. paratuberculosis
cgggugggcggauucaggacac

SEQ ID NO: 126531 - RNA, 22 nt, Mycobacterium avium subsp. paratuberculosis
cgugaagcuaauuucacgcucg

SEQ ID NO: 126532 - RNA, 22 nt, Mycobacterium avium subsp. paratuberculosis
ccgcuguacgcggcaugccugg

SEQ ID NO: 126533 - RNA, 22 nt, Mycobacterium avium subsp. paratuberculosis
gaccgucacgcuggcgugacac

SEQ ID NO: 126534 - RNA, 22 nt, Mycobacterium avium subsp. paratuberculosis
ggcugcugaccgaauccgacgu

SEQ ID NO: 126535 - RNA, 22 nt, Mycobacterium avium subsp. paratuberculosis
gacgcccuugccagcuuuccgg

SEQ ID NO: 126536 - RNA, 22 nt, Mycobacterium avium subsp. paratuberculosis
uguucgugaggucccgguggca

SEQ ID NO: 126537 - RNA, 22 nt, Mycobacterium avium subsp. paratuberculosis
uugcgccggaucgucggcuggu

SEQ ID NO: 126538 - RNA, 22 nt, Mycobacterium avium subsp. paratuberculosis
cucgggucaaccaucggguggu

SEQ ID NO: 126539 - RNA, 22 nt, Mycobacterium avium subsp. paratuberculosis
cuggccagcuugcgggccgacu

SEQ ID NO: 126540 - RNA, 22 nt, Mycobacterium avium subsp. paratuberculosis
cggcuccgcgaucaccgccgac

SEQ ID NO: 126541 - RNA, 22 nt, Mycobacterium avium subsp. paratuberculosis
ucgacgacggcgaugucggcgc

SEQ ID NO: 126542 - RNA, 22 nt, Mycobacterium avium subsp. paratuberculosis
gugucgguagaugcacuuucgu

SEQ ID NO: 126543 - RNA, 22 nt, Mycobacterium avium subsp. paratuberculosis
guaccggucaguccguccgcgg

SEQ ID NO: 126544 - RNA, 22 nt, Mycobacterium avium subsp. paratuberculosis
gacggugcugaucgucgcgcac

SEQ ID NO: 126545 - RNA, 22 nt, Mycobacterium avium subsp. paratuberculosis
gcgccgagcgugggggcugugc

SEQ ID NO: 126546 - RNA, 18 nt, Mycobacterium avium subsp. paratuberculosis
ugaucgacgagccgcucg

SEQ ID NO: 126547 - RNA, 21 nt, Mycobacterium avium subsp. paratuberculosis
cguagcccccacgcucggcgc

SEQ ID NO: 126548 - RNA, 21 nt, Mycobacterium avium subsp. paratuberculosis
ucggcgacauccucggcaucc

SEQ ID NO: 126549 - RNA, 22 nt, Mycobacterium avium subsp. paratuberculosis
ggcuugaggucgucgcggucac

SEQ ID NO: 126550 - RNA, 22 nt, Mycobacterium avium subsp. paratuberculosis
accacgaggaccagcgucgcga

SEQ ID NO: 126551 - RNA, 22 nt, Mycobacterium avium subsp. paratuberculosis
caccagcgcgcgcuggcacguc

SEQ ID NO: 126552 - RNA, 21 nt, Mycobacterium avium subsp. paratuberculosis
ucgaugacggcggugccggcc

SEQ ID NO: 126553 - RNA, 22 nt, Mycobacterium avium subsp. paratuberculosis
ccgacguguaaaucacauaggc

SEQ ID NO: 126554 - RNA, 22 nt, Mycobacterium avium subsp. paratuberculosis
aucucgcugcagaaccgaggcg

SEQ ID NO: 126555 - RNA, 22 nt, Mycobacterium avium subsp. paratuberculosis
ggccgaguuccgcgugaucgac

SEQ ID NO: 126556 - RNA, 22 nt, Mycobacterium avium subsp. paratuberculosis
gcgggacagcucggccagcgcg

SEQ ID NO: 126557 - RNA, 22 nt, Mycobacterium avium subsp. paratuberculosis
ugcuugcgggucuugagguagu

SEQ ID NO: 126558 - RNA, 22 nt, Mycobacterium avium subsp. paratuberculosis
gucgucgaucgcggcggccagc

SEQ ID NO: 126559 - RNA, 22 nt, Mycobacterium avium subsp. paratuberculosis
caccuccugcaucaggucgaac

SEQ ID NO: 126560 - RNA, 22 nt, Mycobacterium avium subsp. paratuberculosis
accgggcgguugaccggcagcu

SEQ ID NO: 126561 - RNA, 22 nt, Mycobacterium avium subsp. paratuberculosis
cuccgccgagggcaucgaccag

SEQ ID NO: 126562 - RNA, 22 nt, Mycobacterium avium subsp. paratuberculosis
cugccgguuguuggugcgggcg

SEQ ID NO: 126563 - RNA, 22 nt, Mycobacterium avium subsp. paratuberculosis
gucggcgagcuuggcgguguuc

SEQ ID NO: 126564 - RNA, 23 nt, Mycobacterium avium subsp. paratuberculosis
cgccucgagaucgcgcccgaacg

SEQ ID NO: 126565 - RNA, 22 nt, Mycobacterium avium subsp. paratuberculosis
uuggcccgcgcccaggcgaugg

SEQ ID NO: 126566 - RNA, 22 nt, Mycobacterium avium subsp. paratuberculosis
acgucgaccagcagcgcggugg

SEQ ID NO: 126567 - RNA, 22 nt, Mycobacterium avium subsp. paratuberculosis
gcgggugccaguaguugggcug

SEQ ID NO: 126568 - RNA, 22 nt, Mycobacterium avium subsp. paratuberculosis
gcgucgagugugcgggugcugc

SEQ ID NO: 126569 - RNA, 22 nt, Mycobacterium avium subsp. paratuberculosis
gacacgucgacguugaggucgu

SEQ ID NO: 126570 - RNA, 22 nt, Mycobacterium avium subsp. paratuberculosis
ucaacggcccggccaccaccuc

SEQ ID NO: 126571 - RNA, 22 nt, Mycobacterium avium subsp. paratuberculosis
gucgugaauuuguucaccaucg

SEQ ID NO: 126572 - RNA, 22 nt, Mycobacterium avium subsp. paratuberculosis
uguggugcacgaacggcacguu

SEQ ID NO: 126573 - RNA, 22 nt, Mycobacterium avium subsp. paratuberculosis
ccgacaugccaguugccggugc

SEQ ID NO: 126574 - RNA, 22 nt, Mycobacterium avium subsp. paratuberculosis
gcgucgaugucgaccacguugg

SEQ ID NO: 126575 - RNA, 22 nt, Mycobacterium avium subsp. paratuberculosis
gacggcgacgccgaucgcugcu

SEQ ID NO: 126576 - RNA, 22 nt, Mycobacterium avium subsp. paratuberculosis
cuugggugccucggccuugggu

SEQ ID NO: 126577 - RNA, 22 nt, Mycobacterium avium subsp. paratuberculosis
ugacccgauccagggcccgcuc

SEQ ID NO: 126578 - RNA, 22 nt, Mycobacterium avium subsp. paratuberculosis
ugggacgagcuggugcgccagc

SEQ ID NO: 126579 - RNA, 22 nt, Mycobacterium avium subsp. paratuberculosis
gcacgcugucggccacccggcg

SEQ ID NO: 126580 - RNA, 22 nt, Mycobacterium avium subsp. paratuberculosis
agcgugaaacuagcuucacgcu

SEQ ID NO: 126581 - RNA, 22 nt, Mycobacterium avium subsp. paratuberculosis
gccacgcuggccgcgguggagg

SEQ ID NO: 126582 - RNA, 22 nt, Mycobacterium avium subsp. paratuberculosis
ugguggcggccgaucgugcgcc

SEQ ID NO: 126583 - RNA, 19 nt, Mycobacterium avium subsp. paratuberculosis
ucagucgcgcgcuucgauc

SEQ ID NO: 126584 - RNA, 22 nt, Mycobacterium avium subsp. paratuberculosis
ucgacccaggugcccgacaccg

SEQ ID NO: 126585 - RNA, 22 nt, Mycobacterium avium subsp. paratuberculosis
gccggggcaucgccggaauggc

SEQ ID NO: 126586 - RNA, 22 nt, Mycobacterium avium subsp. paratuberculosis
uccgguucgucugggucuggcu

SEQ ID NO: 126587 - RNA, 22 nt, Mycobacterium avium subsp. paratuberculosis
caggucguagaaggucaggucg

SEQ ID NO: 126588 - RNA, 22 nt, Mycobacterium avium subsp. paratuberculosis
ugguggagcagguccgcgcgca

SEQ ID NO: 126589 - RNA, 22 nt, Mycobacterium avium subsp. paratuberculosis
ucgaccaucuccgcguugagau

SEQ ID NO: 126590 - RNA, 22 nt, Mycobacterium avium subsp. paratuberculosis
aucgaucagcagggcggugggc

SEQ ID NO: 126591 - RNA, 22 nt, Mycobacterium avium subsp. paratuberculosis
cagcggcaggaugucggcgaug

SEQ ID NO: 126592 - RNA, 22 nt, Mycobacterium avium subsp. paratuberculosis
ucgggaucaugaacuucgcgaa

SEQ ID NO: 126593 - RNA, 22 nt, Mycobacterium avium subsp. paratuberculosis
cccgcagggcauugggcagguc

SEQ ID NO: 126594 - RNA, 22 nt, Mycobacterium avium subsp. paratuberculosis
gaccgaggcgggguugacgccc

SEQ ID NO: 126595 - RNA, 22 nt, Mycobacterium avium subsp. paratuberculosis
cgggugucggcgugcucgguca

SEQ ID NO: 126596 - RNA, 22 nt, Mycobacterium avium subsp. paratuberculosis
ggugccgcacgaccagcccggu

SEQ ID NO: 126597 - RNA, 22 nt, Mycobacterium avium subsp. paratuberculosis
cccguaguggccggcgacgucg

SEQ ID NO: 126598 - RNA, 22 nt, Mycobacterium avium subsp. paratuberculosis
cgaaccugaucgagcuggugga

SEQ ID NO: 126599 - RNA, 22 nt, Mycobacterium avium subsp. paratuberculosis
cgcuuuccaccgucaccucggg

SEQ ID NO: 126600 - RNA, 22 nt, Mycobacterium avium subsp. paratuberculosis
gacgggccaguauuacgccaac

SEQ ID NO: 126601 - RNA, 22 nt, Mycobacterium avium subsp. paratuberculosis
uuccgggcggcuggucugcggg

SEQ ID NO: 126602 - RNA, 22 nt, Mycobacterium avium subsp. paratuberculosis
gcgcgcccuggucaagcaccuc

SEQ ID NO: 126603 - RNA, 22 nt, Mycobacterium avium subsp. paratuberculosis
cgcugcuggugcccuaccugcu

SEQ ID NO: 126604 - RNA, 20 nt, Mycobacterium avium subsp. paratuberculosis
uggugcgggcguucgcccgg

SEQ ID NO: 126605 - RNA, 22 nt, Mycobacterium avium subsp. paratuberculosis
cgucaggugaccaagcagaucg

SEQ ID NO: 126606 - RNA, 22 nt, Mycobacterium avium subsp. paratuberculosis
gagcgugcagugguugcgaaaa

SEQ ID NO: 126607 - RNA, 22 nt, Mycobacterium avium subsp. paratuberculosis
gcugacagcgcgggcaccacag

SEQ ID NO: 126608 - RNA, 22 nt, Mycobacterium avium subsp. paratuberculosis
accuggaacggcuugcgggcgc

SEQ ID NO: 126609 - RNA, 22 nt, Mycobacterium avium subsp. paratuberculosis
gccgcgagagugcaacuaccga

SEQ ID NO: 126610 - RNA, 22 nt, Mycobacterium avium subsp. paratuberculosis
agaccgccaucgccaucagcgc

SEQ ID NO: 126611 - RNA, 22 nt, Mycobacterium avium subsp. paratuberculosis
uccacgaucgcgcggugccagu

SEQ ID NO: 126612 - RNA, 22 nt, Mycobacterium avium subsp. paratuberculosis
cguccucgccgaccggccgcug

SEQ ID NO: 126613 - RNA, 22 nt, Mycobacterium avium subsp. paratuberculosis
aggugaccgcggucgacgucgg

SEQ ID NO: 126614 - RNA, 20 nt, Mycobacterium avium subsp. paratuberculosis
augccgaggcgggcaaaccc

SEQ ID NO: 126615 - RNA, 22 nt, Mycobacterium avium subsp. paratuberculosis
gucgaccacacgccggggcaca

SEQ ID NO: 126616 - RNA, 22 nt, Mycobacterium avium subsp. paratuberculosis
gaguggggacccgccgucgccg

SEQ ID NO: 126617 - RNA, 22 nt, Mycobacterium avium subsp. paratuberculosis
uucgugagcgauuucugcgcga

SEQ ID NO: 126618 - RNA, 20 nt, Mycobacterium avium subsp. paratuberculosis
ggccaccacuacgucgccga

SEQ ID NO: 126619 - RNA, 22 nt, Mycobacterium avium subsp. paratuberculosis
acaucgaccccacgucggccga

SEQ ID NO: 126620 - RNA, 22 nt, Mycobacterium avium subsp. paratuberculosis
cgucaagaaguuccugcgcuac

SEQ ID NO: 126621 - RNA, 22 nt, Mycobacterium avium subsp. paratuberculosis
ggcaguaguuggauuccgcggc

SEQ ID NO: 126622 - RNA, 22 nt, Mycobacterium avium subsp. paratuberculosis
gauguugaccacccgcagcgag

SEQ ID NO: 126623 - RNA, 22 nt, Mycobacterium avium subsp. paratuberculosis
ugugggaccaaacacaauucgu

SEQ ID NO: 126624 - RNA, 22 nt, Mycobacterium avium subsp. paratuberculosis
caaccgggucgaggucuacgcg

SEQ ID NO: 126625 - RNA, 22 nt, Mycobacterium avium subsp. paratuberculosis
gggccgacggugagaauuugcg

SEQ ID NO: 126626 - RNA, 22 nt, Mycobacterium avium subsp. paratuberculosis
ucgacgccgaugacgccggcgg

SEQ ID NO: 126627 - RNA, 22 nt, Mycobacterium avium subsp. paratuberculosis
ugacgcucgaggucgaccguca

SEQ ID NO: 126628 - RNA, 22 nt, Mycobacterium avium subsp. paratuberculosis
cgcccuguguacacacucgacg

SEQ ID NO: 126629 - RNA, 22 nt, Mycobacterium avium subsp. paratuberculosis
ucgccgucgucggugccggucu

SEQ ID NO: 126630 - RNA, 22 nt, Mycobacterium avium subsp. paratuberculosis
ggucggcgaggcagacgugcaa

SEQ ID NO: 126631 - RNA, 22 nt, Mycobacterium avium subsp. paratuberculosis
gaaccggcggcccgacccgcag

SEQ ID NO: 126632 - RNA, 23 nt, Mycobacterium avium subsp. paratuberculosis
uggucggcuucuuguucgccguc

SEQ ID NO: 126633 - RNA, 22 nt, Mycobacterium avium subsp. paratuberculosis
aguggguggccagauccguuug

SEQ ID NO: 126634 - RNA, 22 nt, Mycobacterium avium subsp. paratuberculosis
gcgcaucuggaccgccucguag

SEQ ID NO: 126635 - RNA, 22 nt, Mycobacterium avium subsp. paratuberculosis
ucgccgcccgcacgucgucggg

SEQ ID NO: 126636 - RNA, 23 nt, Mycobacterium avium subsp. paratuberculosis
aucgccagcaucaggcccgccac

SEQ ID NO: 126637 - RNA, 22 nt, Mycobacterium avium subsp. paratuberculosis
cggcgaggccugcccgcccgag

SEQ ID NO: 126638 - RNA, 22 nt, Mycobacterium avium subsp. paratuberculosis
ugcucgaacuggggcuuguuca

SEQ ID NO: 126639 - RNA, 22 nt, Mycobacterium avium subsp. paratuberculosis
uccaccgcccaggucgaugcgc

SEQ ID NO: 126640 - RNA, 22 nt, Mycobacterium avium subsp. paratuberculosis
gugcaggucguguucccaggug

SEQ ID NO: 126641 - RNA, 22 nt, Mycobacterium avium subsp. paratuberculosis
gaucggccgggucgacgucgcc

SEQ ID NO: 126642 - RNA, 22 nt, Mycobacterium avium subsp. paratuberculosis
ucggccggcccggucggccgca

SEQ ID NO: 126643 - RNA, 22 nt, Mycobacterium avium subsp. paratuberculosis
gcgccaggaacugccgguccgc

SEQ ID NO: 126644 - RNA, 22 nt, Mycobacterium avium subsp. paratuberculosis
cgaccugcggccgucggaugcg

SEQ ID NO: 126645 - RNA, 22 nt, Mycobacterium avium subsp. paratuberculosis
gaguucuuggaacgggucucgc

SEQ ID NO: 126646 - RNA, 22 nt, Mycobacterium avium subsp. paratuberculosis
acgugcgggguauccucggugg

SEQ ID NO: 126647 - RNA, 22 nt, Mycobacterium avium subsp. paratuberculosis
cagccgguaggugacgcugcug

SEQ ID NO: 126648 - RNA, 22 nt, Mycobacterium avium subsp. paratuberculosis
cggcggcgagcugucccgggug

SEQ ID NO: 126649 - RNA, 22 nt, Mycobacterium avium subsp. paratuberculosis
ggaugggugccgcgcugguggc

SEQ ID NO: 126650 - RNA, 22 nt, Mycobacterium avium subsp. paratuberculosis
aggucguagccgccaacucgaa

SEQ ID NO: 126651 - RNA, 22 nt, Mycobacterium avium subsp. paratuberculosis
gacggcgacaccggguugccgc

SEQ ID NO: 126652 - RNA, 22 nt, Mycobacterium avium subsp. paratuberculosis
gccggugacgugcgucgucucg

SEQ ID NO: 126653 - RNA, 22 nt, Mycobacterium avium subsp. paratuberculosis
caccggcgccgauucgaacagc

SEQ ID NO: 126654 - RNA, 22 nt, Mycobacterium avium subsp. paratuberculosis
accugcccggaucugggguuca

SEQ ID NO: 126655 - RNA, 22 nt, Mycobacterium avium subsp. paratuberculosis
cacucgggaucggucacggaga

SEQ ID NO: 126656 - RNA, 22 nt, Mycobacterium avium subsp. paratuberculosis
cauguugucgguguugaugccg

SEQ ID NO: 126657 - RNA, 22 nt, Mycobacterium avium subsp. paratuberculosis
uccgcaccgcggugaagccggc

SEQ ID NO: 126658 - RNA, 22 nt, Mycobacterium avium subsp. paratuberculosis
cuccuggaagccggccgcgacg

SEQ ID NO: 126659 - RNA, 22 nt, Mycobacterium avium subsp. paratuberculosis
gugcaucacgauccggcgggcc

SEQ ID NO: 126660 - RNA, 22 nt, Mycobacterium avium subsp. paratuberculosis
cugggcgcggugguggccgcca

SEQ ID NO: 126661 - RNA, 22 nt, Mycobacterium avium subsp. paratuberculosis
ggcggcggagucgaugcgggug

SEQ ID NO: 126662 - RNA, 19 nt, Mycobacterium avium subsp. paratuberculosis
cgcguugauggucucggug

SEQ ID NO: 126663 - RNA, 18 nt, Mycobacterium avium subsp. paratuberculosis
gccggcucgacaugguug

SEQ ID NO: 126664 - RNA, 18 nt, Mycobacterium avium subsp. paratuberculosis
caccuccagcccggcgau

SEQ ID NO: 126665 - RNA, 22 nt, Mycobacterium avium subsp. paratuberculosis
gacgcgaugaaggacauggacg

SEQ ID NO: 126666 - RNA, 22 nt, Mycobacterium avium subsp. paratuberculosis
gcaguacuacuucgacgccgac

SEQ ID NO: 126667 - RNA, 22 nt, Mycobacterium avium subsp. paratuberculosis
caggucgccgaugcgguagccg

SEQ ID NO: 126668 - RNA, 21 nt, Mycobacterium avium subsp. paratuberculosis
agcaugaagccggugcucagc

SEQ ID NO: 126669 - RNA, 22 nt, Mycobacterium avium subsp. paratuberculosis
gacguugagcgcgaugugggcg

SEQ ID NO: 126670 - RNA, 22 nt, Mycobacterium avium subsp. paratuberculosis
acccggcaaacgauggugcgcc

SEQ ID NO: 126671 - RNA, 19 nt, Mycobacterium avium subsp. paratuberculosis
gcaccgcgucgaucccgcc

SEQ ID NO: 126672 - RNA, 22 nt, Mycobacterium avium subsp. paratuberculosis
gucgggcaccuccaguugcgac

SEQ ID NO: 126673 - RNA, 22 nt, Mycobacterium avium subsp. paratuberculosis
ucgcgccgugaggucgggugcg

SEQ ID NO: 126674 - RNA, 22 nt, Mycobacterium avium subsp. paratuberculosis
gggugcuggacuucgcggcguu

SEQ ID NO: 126675 - RNA, 22 nt, Mycobacterium avium subsp. paratuberculosis
gcgccgucacgucgguuaccgu

SEQ ID NO: 126676 - RNA, 22 nt, Mycobacterium avium subsp. paratuberculosis
ggcggccucgaucucggugcgc

SEQ ID NO: 126677 - RNA, 22 nt, Mycobacterium avium subsp. paratuberculosis
accgacggcgacgacggugccu

SEQ ID NO: 126678 - RNA, 20 nt, Mycobacterium avium subsp. paratuberculosis
uucgccgacaucgaccggca

SEQ ID NO: 126679 - RNA, 22 nt, Mycobacterium avium subsp. paratuberculosis
ucgggcgccuucaccgucgucc

SEQ ID NO: 126680 - RNA, 22 nt, Mycobacterium avium subsp. paratuberculosis
auggcggugcucgcgggcgugc

SEQ ID NO: 126681 - RNA, 22 nt, Mycobacterium avium subsp. paratuberculosis
gcggugaauccgaauucacgga

SEQ ID NO: 126682 - RNA, 22 nt, Mycobacterium avium subsp. paratuberculosis
gcgcggugaucaugcuggucau

SEQ ID NO: 126683 - RNA, 22 nt, Mycobacterium avium subsp. paratuberculosis
ggcugcagguggugccgggcga

SEQ ID NO: 126684 - RNA, 22 nt, Mycobacterium avium subsp. paratuberculosis
gagcgucacgcuagcgugaccg

SEQ ID NO: 126685 - RNA, 22 nt, Mycobacterium avium subsp. paratuberculosis
ggugucugguacuccgcggaug

SEQ ID NO: 126686 - RNA, 22 nt, Mycobacterium avium subsp. paratuberculosis
aucgagguggccgucagcgcgu

SEQ ID NO: 126687 - RNA, 22 nt, Mycobacterium avium subsp. paratuberculosis
ucgagcugggcccgcgcauccc

SEQ ID NO: 126688 - RNA, 22 nt, Mycobacterium avium subsp. paratuberculosis
ggcuggcgaccgacugguccac

SEQ ID NO: 126689 - RNA, 22 nt, Mycobacterium avium subsp. paratuberculosis
ucggcgcugacguugggccggg

SEQ ID NO: 126690 - RNA, 22 nt, Mycobacterium avium subsp. paratuberculosis
acgugcugggcuggccgucgau

SEQ ID NO: 126691 - RNA, 22 nt, Mycobacterium avium subsp. paratuberculosis
accggcgacgagcagcccggca

SEQ ID NO: 126692 - RNA, 22 nt, Mycobacterium avium subsp. paratuberculosis
ggccaccaccaggucggcgucg

SEQ ID NO: 126693 - RNA, 23 nt, Mycobacterium avium subsp. paratuberculosis
gcuaccuguaccgcaccaugauc

SEQ ID NO: 126694 - RNA, 22 nt, Mycobacterium avium subsp. paratuberculosis
cagcgucuuggcccccugcucg

SEQ ID NO: 126695 - RNA, 22 nt, Mycobacterium avium subsp. paratuberculosis
acccgcgggcaggccgacgccg

SEQ ID NO: 126696 - RNA, 22 nt, Mycobacterium avium subsp. paratuberculosis
gaccgcgggcguaacgccgugg

SEQ ID NO: 126697 - RNA, 22 nt, Mycobacterium avium subsp. paratuberculosis
ccgaugucgacgaguuccucga

SEQ ID NO: 126698 - RNA, 22 nt, Mycobacterium avium subsp. paratuberculosis
cucuucgaucuguuugccguag

SEQ ID NO: 126699 - RNA, 22 nt, Mycobacterium avium subsp. paratuberculosis
acgggcugaucgugucgaugcg

SEQ ID NO: 126700 - RNA, 22 nt, Mycobacterium avium subsp. paratuberculosis
ccgccgcgaugggggugacgcu

SEQ ID NO: 126701 - RNA, 22 nt, Mycobacterium avium subsp. paratuberculosis
gcacgcaagagugcggccccga

SEQ ID NO: 126702 - RNA, 22 nt, Mycobacterium avium subsp. paratuberculosis
cgccuuggugagcaggaaggug

SEQ ID NO: 126703 - RNA, 22 nt, Mycobacterium avium subsp. paratuberculosis
acguggacagaauagucgguac

SEQ ID NO: 126704 - RNA, 22 nt, Mycobacterium avium subsp. paratuberculosis
aaggaguugcggcgcaagcuga

SEQ ID NO: 126705 - RNA, 22 nt, Mycobacterium avium subsp. paratuberculosis
ggcgaugcgcgggagccgcuug

SEQ ID NO: 126706 - RNA, 22 nt, Mycobacterium avium subsp. paratuberculosis
ggucgucgcgaucggcaucacc

SEQ ID NO: 126707 - RNA, 23 nt, Mycobacterium avium subsp. paratuberculosis
ucgacgugacguuccccugcccg

SEQ ID NO: 126708 - RNA, 22 nt, Mycobacterium avium subsp. paratuberculosis
guugccgaagugaaaggaugcc

SEQ ID NO: 126709 - RNA, 22 nt, Mycobacterium avium subsp. paratuberculosis
ugaucggcuucuccggcgugcg

SEQ ID NO: 126710 - RNA, 22 nt, Mycobacterium avium subsp. paratuberculosis
ugcacgagaucucggugcgggu

SEQ ID NO: 126711 - RNA, 19 nt, Mycobacterium avium subsp. paratuberculosis
gguggucggccuggucgcc

SEQ ID NO: 126712 - RNA, 23 nt, Mycobacterium avium subsp. paratuberculosis
cgggggcuuuugcgucugcucgc

SEQ ID NO: 126713 - RNA, 22 nt, Mycobacterium avium subsp. paratuberculosis
ggcacgucgaucuccacgucgg

SEQ ID NO: 126714 - RNA, 22 nt, Mycobacterium avium subsp. paratuberculosis
gcugcugagcgccgccgagacg

SEQ ID NO: 126715 - RNA, 22 nt, Mycobacterium avium subsp. paratuberculosis
ucgagcgucacgcuggcguggc

SEQ ID NO: 126716 - RNA, 22 nt, Mycobacterium avium subsp. paratuberculosis
gcagcggucgacgacgcgcugg

SEQ ID NO: 126717 - RNA, 22 nt, Mycobacterium avium subsp. paratuberculosis
cgggauuggucgcuggccgacc

SEQ ID NO: 126718 - RNA, 22 nt, Mycobacterium avium subsp. paratuberculosis
augggugcggcggucaccggcu

SEQ ID NO: 126719 - RNA, 22 nt, Mycobacterium avium subsp. paratuberculosis
cuggccggcuucgcgggcgugg

SEQ ID NO: 126720 - RNA, 22 nt, Mycobacterium avium subsp. paratuberculosis
gcaccgcccuguggcuggaaag

SEQ ID NO: 126721 - RNA, 22 nt, Mycobacterium avium subsp. paratuberculosis
agcccggccgcagccuggagcg

SEQ ID NO: 126722 - RNA, 22 nt, Mycobacterium avium subsp. paratuberculosis
ugaucgccaaaaacgguacggc

SEQ ID NO: 126723 - RNA, 22 nt, Mycobacterium avium subsp. paratuberculosis
gcgcgguguccgggaucgggac

SEQ ID NO: 126724 - RNA, 22 nt, Mycobacterium avium subsp. paratuberculosis
cgcggugaugcccagcucggcg

SEQ ID NO: 126725 - RNA, 22 nt, Mycobacterium avium subsp. paratuberculosis
cgagcagacgugaaaucccccg

SEQ ID NO: 126726 - RNA, 22 nt, Mycobacterium avium subsp. paratuberculosis
ccacgcaguccuucgccgacau

SEQ ID NO: 126727 - RNA, 22 nt, Mycobacterium avium subsp. paratuberculosis
gcggcgcagcgucugauacacg

SEQ ID NO: 126728 - RNA, 22 nt, Mycobacterium avium subsp. paratuberculosis
cgggauggugaccgcggagaug

SEQ ID NO: 126729 - RNA, 22 nt, Mycobacterium avium subsp. paratuberculosis
guggcgucgaaguggucgaugu

SEQ ID NO: 126730 - RNA, 22 nt, Mycobacterium avium subsp. paratuberculosis
uguggaccgggccgucggacau

SEQ ID NO: 126731 - RNA, 22 nt, Mycobacterium avium subsp. paratuberculosis
auuggccgaucgcacugccacg

SEQ ID NO: 126732 - RNA, 22 nt, Mycobacterium avium subsp. paratuberculosis
ggcgaccagcucgaucgugaug

SEQ ID NO: 126733 - RNA, 22 nt, Mycobacterium avium subsp. paratuberculosis
gcgcacuggcuggcgucggccg

SEQ ID NO: 126734 - RNA, 22 nt, Mycobacterium avium subsp. paratuberculosis
ccgucgcugauggccugggcca

SEQ ID NO: 126735 - RNA, 22 nt, Mycobacterium avium subsp. paratuberculosis
augucggcgucgcccacguagg

SEQ ID NO: 126736 - RNA, 22 nt, Mycobacterium avium subsp. paratuberculosis
ugcacguggaauucacccgcua

SEQ ID NO: 126737 - RNA, 22 nt, Mycobacterium avium subsp. paratuberculosis
guggccgaggucgucacgaucu

SEQ ID NO: 126738 - RNA, 22 nt, Mycobacterium avium subsp. paratuberculosis
ccaugguggcguccaggaugcg

SEQ ID NO: 126739 - RNA, 22 nt, Mycobacterium avium subsp. paratuberculosis
auguccgacggauucauccacg

SEQ ID NO: 126740 - RNA, 22 nt, Mycobacterium avium subsp. paratuberculosis
acucccgacgaccuggucggca

SEQ ID NO: 126741 - RNA, 22 nt, Mycobacterium avium subsp. paratuberculosis
ugcugcgcgacacgucggugcu

SEQ ID NO: 126742 - RNA, 22 nt, Mycobacterium avium subsp. paratuberculosis
ccugccuggccacguggucgcu

SEQ ID NO: 126743 - RNA, 21 nt, Mycobacterium avium subsp. paratuberculosis
acgucucggagaagaccguuc

SEQ ID NO: 126744 - RNA, 22 nt, Mycobacterium avium subsp. paratuberculosis
cugcggcugcugucgaacauca

SEQ ID NO: 126745 - RNA, 22 nt, Mycobacterium avium subsp. paratuberculosis
ggucaucucguccgacggguug

SEQ ID NO: 126746 - RNA, 22 nt, Mycobacterium avium subsp. paratuberculosis
accggaacgaggguggggcaga

SEQ ID NO: 126747 - RNA, 19 nt, Mycobacterium avium subsp. paratuberculosis
uccgggucgcucauccgcg

SEQ ID NO: 126748 - RNA, 22 nt, Mycobacterium avium subsp. paratuberculosis
gccgucugcagcgugcccgagu

SEQ ID NO: 126749 - RNA, 22 nt, Mycobacterium avium subsp. paratuberculosis
gucggcaguagcacuuucgcgg

SEQ ID NO: 126750 - RNA, 22 nt, Mycobacterium avium subsp. paratuberculosis
gccaccgacgggaucgucgucg

SEQ ID NO: 126751 - RNA, 22 nt, Mycobacterium avium subsp. paratuberculosis
augccgagcgaucuggugcccg

SEQ ID NO: 126752 - RNA, 22 nt, Mycobacterium avium subsp. paratuberculosis
uccagcgcgggucggugccguc

SEQ ID NO: 126753 - RNA, 22 nt, Mycobacterium avium subsp. paratuberculosis
aaggcguacucggccggcgcca

SEQ ID NO: 126754 - RNA, 22 nt, Mycobacterium avium subsp. paratuberculosis
cgccggugcuggugcucaccug

SEQ ID NO: 126755 - RNA, 22 nt, Mycobacterium avium subsp. paratuberculosis
gccgcggccugcccgucuagau

SEQ ID NO: 126756 - RNA, 22 nt, Mycobacterium avium subsp. paratuberculosis
cugucgggcauguagagccggu

SEQ ID NO: 126757 - RNA, 22 nt, Mycobacterium avium subsp. paratuberculosis
ucacgccagcgugacggccggc

SEQ ID NO: 126758 - RNA, 22 nt, Mycobacterium avium subsp. paratuberculosis
cugcgcuucgcggugaccggcg

SEQ ID NO: 126759 - RNA, 22 nt, Mycobacterium avium subsp. paratuberculosis
ucgcgggcgccgaucugcucga

SEQ ID NO: 126760 - RNA, 20 nt, Mycobacterium avium subsp. paratuberculosis
cggcgcugaauucguguccc

SEQ ID NO: 126761 - RNA, 22 nt, Mycobacterium avium subsp. paratuberculosis
ccgacgacguucaccaggaauu

SEQ ID NO: 126762 - RNA, 22 nt, Mycobacterium avium subsp. paratuberculosis
ucuucgucacagcacgaucgcc

SEQ ID NO: 126763 - RNA, 22 nt, Mycobacterium avium subsp. paratuberculosis
ccgccgcgccaaagagccguuc

SEQ ID NO: 126764 - RNA, 22 nt, Mycobacterium avium subsp. paratuberculosis
gccgaacgugcaccuacugcga

SEQ ID NO: 126765 - RNA, 22 nt, Mycobacterium avium subsp. paratuberculosis
gcugcgcggcuugcugcgguag

SEQ ID NO: 126766 - RNA, 22 nt, Mycobacterium avium subsp. paratuberculosis
ggugccggugucggcggcgucg

SEQ ID NO: 126767 - RNA, 22 nt, Mycobacterium avium subsp. paratuberculosis
guaguuggucuggccgcgguug

SEQ ID NO: 126768 - RNA, 22 nt, Mycobacterium avium subsp. paratuberculosis
cgagaauccgaccgccuggacc

SEQ ID NO: 126769 - RNA, 22 nt, Mycobacterium avium subsp. paratuberculosis
cggauccaccggguggcgcacu

SEQ ID NO: 126770 - RNA, 22 nt, Mycobacterium avium subsp. paratuberculosis
cgcugguugucgacgcugcagg

SEQ ID NO: 126771 - RNA, 22 nt, Mycobacterium avium subsp. paratuberculosis
gcgccgagcgugggggcuacgu

SEQ ID NO: 126772 - RNA, 22 nt, Mycobacterium avium subsp. paratuberculosis
gcccggcugucggcggcggccc

SEQ ID NO: 126773 - RNA, 18 nt, Mycobacterium avium subsp. paratuberculosis
gugacgagcucgaucgcc

SEQ ID NO: 126774 - RNA, 22 nt, Mycobacterium avium subsp. paratuberculosis
accuugacguccucaucguggg

SEQ ID NO: 126775 - RNA, 22 nt, Mycobacterium avium subsp. paratuberculosis
aucgcggccgacuuggagucga

SEQ ID NO: 126776 - RNA, 22 nt, Mycobacterium avium subsp. paratuberculosis
auccgcgacuucgguggugugc

SEQ ID NO: 126777 - RNA, 22 nt, Mycobacterium avium subsp. paratuberculosis
ucggcccaauccaggguccgcu

SEQ ID NO: 126778 - RNA, 22 nt, Mycobacterium avium subsp. paratuberculosis
cgcgaucaggccggccaccagg

SEQ ID NO: 126779 - RNA, 22 nt, Mycobacterium avium subsp. paratuberculosis
gaccaguuguuggacgagcuac

SEQ ID NO: 126780 - RNA, 22 nt, Mycobacterium avium subsp. paratuberculosis
cggagcuguucgccggggucac

SEQ ID NO: 126781 - RNA, 22 nt, Mycobacterium avium subsp. paratuberculosis
aggagggcaaccugggccugau

SEQ ID NO: 126782 - RNA, 22 nt, Mycobacterium avium subsp. paratuberculosis
gucgcccuugccgacgccgacg

SEQ ID NO: 126783 - RNA, 22 nt, Mycobacterium avium subsp. paratuberculosis
gcgcgcacacacugcugaccac

SEQ ID NO: 126784 - RNA, 22 nt, Mycobacterium avium subsp. paratuberculosis
ucggcgccggaccgcuugugcg

SEQ ID NO: 126785 - RNA, 22 nt, Mycobacterium avium subsp. paratuberculosis
uugccgccgaucgcgccggggu

SEQ ID NO: 126786 - RNA, 22 nt, Mycobacterium avium subsp. paratuberculosis
acccgcuugccggucaggucga

SEQ ID NO: 126787 - RNA, 22 nt, Mycobacterium avium subsp. paratuberculosis
gagcgucacgcuggcguggcgc

SEQ ID NO: 126788 - RNA, 22 nt, Mycobacterium avium subsp. paratuberculosis
gggccgcacucccgagauggcg

SEQ ID NO: 126789 - RNA, 22 nt, Mycobacterium avium subsp. paratuberculosis
agggucacgguuacuccguacg

SEQ ID NO: 126790 - RNA, 21 nt, Mycobacterium avium subsp. paratuberculosis
acgcggccaagagugaucgac

SEQ ID NO: 126791 - RNA, 22 nt, Mycobacterium avium subsp. paratuberculosis
cuuucgguguugcaccagggcg

SEQ ID NO: 126792 - RNA, 22 nt, Mycobacterium avium subsp. paratuberculosis
cgcggccaggcucagcagccag

SEQ ID NO: 126793 - RNA, 22 nt, Mycobacterium avium subsp. paratuberculosis
acagcuggcccuugugcagcuc

SEQ ID NO: 126794 - RNA, 22 nt, Mycobacterium avium subsp. paratuberculosis
gcuucuucgcgcaugcgcugcc

SEQ ID NO: 126795 - RNA, 22 nt, Mycobacterium avium subsp. paratuberculosis
cgccgcgaacacgacauccugg

SEQ ID NO: 126796 - RNA, 22 nt, Mycobacterium avium subsp. paratuberculosis
uggugcuuggcuguuacggcgc

SEQ ID NO: 126797 - RNA, 22 nt, Mycobacterium avium subsp. paratuberculosis
acggcggugcugacggcgacgc

SEQ ID NO: 126798 - RNA, 22 nt, Mycobacterium avium subsp. paratuberculosis
gcggcguugacccgcuccacgu

SEQ ID NO: 126799 - RNA, 22 nt, Mycobacterium avium subsp. paratuberculosis
guugggguugacccugcugguc

SEQ ID NO: 126800 - RNA, 22 nt, Mycobacterium avium subsp. paratuberculosis
uuuucucggcgaccaugcggca

SEQ ID NO: 126801 - RNA, 22 nt, Mycobacterium avium subsp. paratuberculosis
cggccgucgccguagagcaguc

SEQ ID NO: 126802 - RNA, 22 nt, Mycobacterium avium subsp. paratuberculosis
uggccucggagaauccgcucga

SEQ ID NO: 126803 - RNA, 22 nt, Mycobacterium avium subsp. paratuberculosis
cgagccgaauccaccagccgcg

SEQ ID NO: 126804 - RNA, 22 nt, Mycobacterium avium subsp. paratuberculosis
ucgggaaggcuggucggcucgu

SEQ ID NO: 126805 - RNA, 22 nt, Mycobacterium avium subsp. paratuberculosis
augguggugacaaggccucgac

SEQ ID NO: 126806 - RNA, 22 nt, Mycobacterium avium subsp. paratuberculosis
ggccuggggauggucggcgucg

SEQ ID NO: 126807 - RNA, 22 nt, Mycobacterium avium subsp. paratuberculosis
ucccggugcggucgggcgcguc

SEQ ID NO: 126808 - RNA, 22 nt, Mycobacterium avium subsp. paratuberculosis
cugggugcgugccgcacucgaa

SEQ ID NO: 126809 - RNA, 22 nt, Mycobacterium avium subsp. paratuberculosis
gccuugggcugcaccuuggcca

SEQ ID NO: 126810 - RNA, 22 nt, Mycobacterium avium subsp. paratuberculosis
cgaucgacgguguugacgagau

SEQ ID NO: 126811 - RNA, 22 nt, Mycobacterium avium subsp. paratuberculosis
cggcgcuggcgcgucccauucc

SEQ ID NO: 126812 - RNA, 22 nt, Mycobacterium avium subsp. paratuberculosis
aucggcgaccagaucacgucga

SEQ ID NO: 126813 - RNA, 22 nt, Mycobacterium avium subsp. paratuberculosis
cugcuggugacccgggacuggu

SEQ ID NO: 126814 - RNA, 19 nt, Mycobacterium avium subsp. paratuberculosis
accagauggaucggaugcg

SEQ ID NO: 126815 - RNA, 22 nt, Mycobacterium avium subsp. paratuberculosis
ggccauguucgggguggccuac

SEQ ID NO: 126816 - RNA, 22 nt, Mycobacterium avium subsp. paratuberculosis
gccugcagauaguccagcgugu

SEQ ID NO: 126817 - RNA, 22 nt, Mycobacterium avium subsp. paratuberculosis
ugcgaacggugucgccgcggcc

SEQ ID NO: 126818 - RNA, 22 nt, Mycobacterium avium subsp. paratuberculosis
ugcgccugcucggcggcgaugg

SEQ ID NO: 126819 - RNA, 22 nt, Mycobacterium avium subsp. paratuberculosis
agccaaaacgacgccgucgugg

SEQ ID NO: 126820 - RNA, 22 nt, Mycobacterium avium subsp. paratuberculosis
cgcaccgagcgucgcgacaaga

SEQ ID NO: 126821 - RNA, 22 nt, Mycobacterium avium subsp. paratuberculosis
ugcggugcugcucggcgcugau

SEQ ID NO: 126822 - RNA, 22 nt, Mycobacterium avium subsp. paratuberculosis
aacgucgacucguggugcggau

SEQ ID NO: 126823 - RNA, 22 nt, Mycobacterium avium subsp. paratuberculosis
ccgccaguucggcgacaccgug

SEQ ID NO: 126824 - RNA, 22 nt, Mycobacterium avium subsp. paratuberculosis
ggugaucucccggugcaguuug

SEQ ID NO: 126825 - RNA, 22 nt, Mycobacterium avium subsp. paratuberculosis
uggggugcggcgcugacccuga

SEQ ID NO: 126826 - RNA, 22 nt, Mycobacterium avium subsp. paratuberculosis
gcggguugccgaucacggcggg

SEQ ID NO: 126827 - RNA, 22 nt, Mycobacterium avium subsp. paratuberculosis
uuucgggugauccaugucguuc

SEQ ID NO: 126828 - RNA, 22 nt, Mycobacterium avium subsp. paratuberculosis
gcagcgucuccagcagcucgcg

SEQ ID NO: 126829 - RNA, 22 nt, Mycobacterium avium subsp. paratuberculosis
ucagcacgucggugaggugggc

SEQ ID NO: 126830 - RNA, 22 nt, Mycobacterium avium subsp. paratuberculosis
ccgaccgcaucgauccggcguu

SEQ ID NO: 126831 - RNA, 22 nt, Mycobacterium avium subsp. paratuberculosis
ggcucaccaagaacuucggugc

SEQ ID NO: 126832 - RNA, 22 nt, Mycobacterium avium subsp. paratuberculosis
ugcggcgcagcgcguggaucag

SEQ ID NO: 126833 - RNA, 22 nt, Mycobacterium avium subsp. paratuberculosis
caccuaccugcgguucgucugg

SEQ ID NO: 126834 - RNA, 22 nt, Mycobacterium avium subsp. paratuberculosis
ggccgcggcccgggucgagccu

SEQ ID NO: 126835 - RNA, 22 nt, Mycobacterium avium subsp. paratuberculosis
gaacgucacgccagcgugacac

SEQ ID NO: 126836 - RNA, 22 nt, Mycobacterium avium subsp. paratuberculosis
gcgccgcaucgagauugcgcug

SEQ ID NO: 126837 - RNA, 22 nt, Mycobacterium avium subsp. paratuberculosis
gauggcgacggauucgcggguc

SEQ ID NO: 126838 - RNA, 22 nt, Mycobacterium avium subsp. paratuberculosis
aucggcgcccggccgcuggauu

SEQ ID NO: 126839 - RNA, 22 nt, Mycobacterium avium subsp. paratuberculosis
uccggggugaucgucgggccga

SEQ ID NO: 126840 - RNA, 22 nt, Mycobacterium avium subsp. paratuberculosis
auccgggcgucgaggcgcggau

SEQ ID NO: 126841 - RNA, 21 nt, Mycobacterium avium subsp. paratuberculosis
uugucaccgccguccggcgac

SEQ ID NO: 126842 - RNA, 22 nt, Mycobacterium avium subsp. paratuberculosis
gcgauggucggcgagaucguau

SEQ ID NO: 126843 - RNA, 19 nt, Mycobacterium avium subsp. paratuberculosis
acgucggccgaccguucgg

SEQ ID NO: 126844 - RNA, 20 nt, Mycobacterium avium subsp. paratuberculosis
accgccuucuggaagaccug

SEQ ID NO: 126845 - RNA, 22 nt, Mycobacterium avium subsp. paratuberculosis
cgggagagcugaaggccggaau

SEQ ID NO: 126846 - RNA, 21 nt, Mycobacterium avium subsp. paratuberculosis
guguccugucucaaggcguug

SEQ ID NO: 126847 - RNA, 22 nt, Mycobacterium avium subsp. paratuberculosis
cgccgcugcccggucuggauga

SEQ ID NO: 126848 - RNA, 22 nt, Mycobacterium avium subsp. paratuberculosis
uguucgaucaugaugacgucga

SEQ ID NO: 126849 - RNA, 22 nt, Mycobacterium avium subsp. paratuberculosis
ucgcgcagguagcccucggccg

SEQ ID NO: 126850 - RNA, 22 nt, Mycobacterium avium subsp. paratuberculosis
ccgaccagaucacgucgaacca

SEQ ID NO: 126851 - RNA, 22 nt, Mycobacterium avium subsp. paratuberculosis
gugcugauggcgauggcggucg

SEQ ID NO: 126852 - RNA, 22 nt, Mycobacterium avium subsp. paratuberculosis
ccagcggguuucgccgcccgcu

SEQ ID NO: 126853 - RNA, 22 nt, Mycobacterium avium subsp. paratuberculosis
gugcgggggcuuuugcgucuuc

SEQ ID NO: 126854 - RNA, 22 nt, Mycobacterium avium subsp. paratuberculosis
cgaugaccggugccaguugauc

SEQ ID NO: 126855 - RNA, 22 nt, Mycobacterium avium subsp. paratuberculosis
uugcaccgugggggcgcguuug

SEQ ID NO: 126856 - RNA, 22 nt, Mycobacterium avium subsp. paratuberculosis
acucggagucgagcgucguggg

SEQ ID NO: 126857 - RNA, 22 nt, Mycobacterium avium subsp. paratuberculosis
ggccagcugcauggcgaccucg

SEQ ID NO: 126858 - RNA, 22 nt, Mycobacterium avium subsp. paratuberculosis
ucccaaccugguucgggugcaa

SEQ ID NO: 126859 - RNA, 22 nt, Mycobacterium avium subsp. paratuberculosis
uggacggcggugaagccggcgu

SEQ ID NO: 126860 - RNA, 22 nt, Mycobacterium avium subsp. paratuberculosis
ucagguugguggcucccaguau

SEQ ID NO: 126861 - RNA, 22 nt, Mycobacterium avium subsp. paratuberculosis
cgccgccgugguggucacgaug

SEQ ID NO: 126862 - RNA, 20 nt, Mycobacterium avium subsp. paratuberculosis
gcgagggcuucuucuacggc

SEQ ID NO: 126863 - RNA, 22 nt, Mycobacterium avium subsp. paratuberculosis
ccggucaugaucugguccaugg

SEQ ID NO: 126864 - RNA, 22 nt, Mycobacterium avium subsp. paratuberculosis
acggcgaccauccacucgggcc

SEQ ID NO: 126865 - RNA, 22 nt, Mycobacterium avium subsp. paratuberculosis
gcgcuuccuuuccuguccugua

SEQ ID NO: 126866 - RNA, 23 nt, Mycobacterium avium subsp. paratuberculosis
ugucggauacaugcugcggccgg

SEQ ID NO: 126867 - RNA, 22 nt, Mycobacterium avium subsp. paratuberculosis
guucccgguguggcugucggug

SEQ ID NO: 126868 - RNA, 22 nt, Mycobacterium avium subsp. paratuberculosis
gcggcggucgaggagcuggugg

SEQ ID NO: 126869 - RNA, 22 nt, Mycobacterium avium subsp. paratuberculosis
cgcggcugaaguuccuggucaa

SEQ ID NO: 126870 - RNA, 22 nt, Mycobacterium avium subsp. paratuberculosis
ccgcgcugguggccgugcacgu

SEQ ID NO: 126871 - RNA, 22 nt, Mycobacterium avium subsp. paratuberculosis
accgagcgucacgcuggcgugg

SEQ ID NO: 126872 - RNA, 22 nt, Mycobacterium avium subsp. paratuberculosis
uuguccaccggcagcgacuccc

SEQ ID NO: 126873 - RNA, 19 nt, Mycobacterium avium subsp. paratuberculosis
gcaccgcagucuuguugac

SEQ ID NO: 126874 - RNA, 22 nt, Mycobacterium avium subsp. paratuberculosis
ucgauguuguggucaacuucca

SEQ ID NO: 126875 - RNA, 22 nt, Mycobacterium avium subsp. paratuberculosis
uaccugcgcuucgugcgaaugu

SEQ ID NO: 126876 - RNA, 22 nt, Mycobacterium avium subsp. paratuberculosis
gagauugcaaccacgcacaucc

SEQ ID NO: 126877 - RNA, 22 nt, Mycobacterium avium subsp. paratuberculosis
cgaggguucggcguccgcggcc

SEQ ID NO: 126878 - RNA, 22 nt, Mycobacterium avium subsp. paratuberculosis
gagcuuggccugggucagcugg

SEQ ID NO: 126879 - RNA, 22 nt, Mycobacterium avium subsp. paratuberculosis
agcgcgacggcgaugguguuca

SEQ ID NO: 126880 - RNA, 22 nt, Mycobacterium avium subsp. paratuberculosis
gcgauuucgacugaccgcgaac

SEQ ID NO: 126881 - RNA, 22 nt, Mycobacterium avium subsp. paratuberculosis
gaccaugucgcggcgcagccgc

SEQ ID NO: 126882 - RNA, 22 nt, Mycobacterium avium subsp. paratuberculosis
gagcucacccggcucgccgugc

SEQ ID NO: 126883 - RNA, 20 nt, Mycobacterium avium subsp. paratuberculosis
uccgacagcagcaucucgug

SEQ ID NO: 126884 - RNA, 22 nt, Mycobacterium avium subsp. paratuberculosis
caggagaagcugauaccgccga

SEQ ID NO: 126885 - RNA, 22 nt, Mycobacterium avium subsp. paratuberculosis
gcggaauccaacuacugccccu

SEQ ID NO: 126886 - RNA, 22 nt, Mycobacterium avium subsp. paratuberculosis
cgccgaucaccugcccggcgcu

SEQ ID NO: 126887 - RNA, 22 nt, Mycobacterium avium subsp. paratuberculosis
gcgcgcucggucgugguggacg

SEQ ID NO: 126888 - RNA, 22 nt, Mycobacterium avium subsp. paratuberculosis
gaggugcucggcgaguucguca

SEQ ID NO: 126889 - RNA, 22 nt, Mycobacterium avium subsp. paratuberculosis
ggguggggcuggucgccgccac

SEQ ID NO: 126890 - RNA, 22 nt, Mycobacterium avium subsp. paratuberculosis
gcggugagcgauccggcgucuc

SEQ ID NO: 126891 - RNA, 22 nt, Mycobacterium avium subsp. paratuberculosis
ucgcggaucgaggaggagaucg

SEQ ID NO: 126892 - RNA, 22 nt, Mycobacterium avium subsp. paratuberculosis
ucacgucguaggccgcgaucac

SEQ ID NO: 126893 - RNA, 22 nt, Mycobacterium avium subsp. paratuberculosis
gaaggucggcaccgugucggac

SEQ ID NO: 126894 - RNA, 22 nt, Mycobacterium avium subsp. paratuberculosis
cgguugccucguuuacgaaccg

SEQ ID NO: 126895 - RNA, 22 nt, Mycobacterium avium subsp. paratuberculosis
ucgacgacgagggcuaccuguu

SEQ ID NO: 126896 - RNA, 22 nt, Mycobacterium avium subsp. paratuberculosis
gcugaucagcagccgugacccg

SEQ ID NO: 126897 - RNA, 22 nt, Mycobacterium avium subsp. paratuberculosis
cgucgagugugcacugguggcg

SEQ ID NO: 126898 - RNA, 22 nt, Mycobacterium avium subsp. paratuberculosis
gccggccgcguucugggcgauc

SEQ ID NO: 126899 - RNA, 22 nt, Mycobacterium avium subsp. paratuberculosis
gaacuugcgacaacggguuggu

SEQ ID NO: 126900 - RNA, 22 nt, Mycobacterium avium subsp. paratuberculosis
ucaccgugagugcacguucggu

SEQ ID NO: 126901 - RNA, 22 nt, Mycobacterium avium subsp. paratuberculosis
aucggcccgcucgaugcgucgg

SEQ ID NO: 126902 - RNA, 22 nt, Mycobacterium avium subsp. paratuberculosis
gccuccagcgccaucaccagcu

SEQ ID NO: 126903 - RNA, 22 nt, Mycobacterium avium subsp. paratuberculosis
cgggccgacgaucacgaugucg

SEQ ID NO: 126904 - RNA, 22 nt, Mycobacterium avium subsp. paratuberculosis
gccgucgaacugcagccggcca

SEQ ID NO: 126905 - RNA, 22 nt, Mycobacterium avium subsp. paratuberculosis
gucgcggcggugccgguagugg

SEQ ID NO: 126906 - RNA, 22 nt, Mycobacterium avium subsp. paratuberculosis
gcagcauguccugccggcgggu

SEQ ID NO: 126907 - RNA, 21 nt, Mycobacterium avium subsp. paratuberculosis
ucggcguuuccggccuggugg

SEQ ID NO: 126908 - RNA, 22 nt, Mycobacterium avium subsp. paratuberculosis
gguaggcgacgugcugcucgcc

SEQ ID NO: 126909 - RNA, 22 nt, Mycobacterium avium subsp. paratuberculosis
ggcgcucaucgguggcgaugaa

SEQ ID NO: 126910 - RNA, 22 nt, Mycobacterium avium subsp. paratuberculosis
ucgcucauggcuguucggcggu

SEQ ID NO: 126911 - RNA, 22 nt, Mycobacterium avium subsp. paratuberculosis
ucggcgugccgcuucuugaacu

SEQ ID NO: 126912 - RNA, 22 nt, Mycobacterium avium subsp. paratuberculosis
ccgaccagauacaucagggcga

SEQ ID NO: 126913 - RNA, 22 nt, Mycobacterium avium subsp. paratuberculosis
uacgccggccggucgaugaccu

SEQ ID NO: 126914 - RNA, 22 nt, Mycobacterium avium subsp. paratuberculosis
cgugcacaucucgcaggccgag

SEQ ID NO: 126915 - RNA, 22 nt, Mycobacterium avium subsp. paratuberculosis
cuguggcuggacgaacgccgcg

SEQ ID NO: 126916 - RNA, 22 nt, Mycobacterium avium subsp. paratuberculosis
ggucgcccuuggccgggucgcg

SEQ ID NO: 126917 - RNA, 22 nt, Mycobacterium avium subsp. paratuberculosis
ugucgcggcuguccggcaucgc

SEQ ID NO: 126918 - RNA, 22 nt, Mycobacterium avium subsp. paratuberculosis
ccgcuucaugucgggcgagaac

SEQ ID NO: 126919 - RNA, 22 nt, Mycobacterium avium subsp. paratuberculosis
ucgacgaguucuacgagugguu

SEQ ID NO: 126920 - RNA, 22 nt, Mycobacterium avium subsp. paratuberculosis
ggggcuuuugcgucugcucgcg

SEQ ID NO: 126921 - RNA, 22 nt, Mycobacterium avium subsp. paratuberculosis
gaugguguggcacaucgcgcgg

SEQ ID NO: 126922 - RNA, 22 nt, Mycobacterium avium subsp. paratuberculosis
uccacgacagcaccgcgccgcu

SEQ ID NO: 126923 - RNA, 22 nt, Mycobacterium avium subsp. paratuberculosis
ggcaccgguuuccgagcugcgc

SEQ ID NO: 126924 - RNA, 22 nt, Mycobacterium avium subsp. paratuberculosis
ccgggcuucgacguggccaagg

SEQ ID NO: 126925 - RNA, 22 nt, Mycobacterium avium subsp. paratuberculosis
gcgcaucaucuuccuggguucg

SEQ ID NO: 126926 - RNA, 22 nt, Mycobacterium avium subsp. paratuberculosis
cagggccagcacgucacgcgcg

SEQ ID NO: 126927 - RNA, 22 nt, Mycobacterium avium subsp. paratuberculosis
cucgcugguggccgcggugcug

SEQ ID NO: 126928 - RNA, 22 nt, Mycobacterium avium subsp. paratuberculosis
cugccgaaagugcaacuggcga

SEQ ID NO: 126929 - RNA, 22 nt, Mycobacterium avium subsp. paratuberculosis
aacgccgcccgauguugccggu

SEQ ID NO: 126930 - RNA, 22 nt, Mycobacterium avium subsp. paratuberculosis
cuggcgccgaaguccgcggcga

SEQ ID NO: 126931 - RNA, 22 nt, Mycobacterium avium subsp. paratuberculosis
ugguccggcuggccgaaaacgc

SEQ ID NO: 126932 - RNA, 22 nt, Mycobacterium avium subsp. paratuberculosis
acgggcuugguucucgaucuga

SEQ ID NO: 126933 - RNA, 22 nt, Mycobacterium avium subsp. paratuberculosis
uggucgguucuauguaaguugg

SEQ ID NO: 126934 - RNA, 22 nt, Mycobacterium avium subsp. paratuberculosis
ggcgcgauuccccagcgcgcca

SEQ ID NO: 126935 - RNA, 22 nt, Mycobacterium avium subsp. paratuberculosis
gguucgagcucgaucgugguga

SEQ ID NO: 126936 - RNA, 22 nt, Mycobacterium avium subsp. paratuberculosis
ccgagcgugggggcuguguagg

SEQ ID NO: 126937 - RNA, 20 nt, Mycobacterium avium subsp. paratuberculosis
ucuccggugaccaccacggc

SEQ ID NO: 126938 - RNA, 22 nt, Mycobacterium avium subsp. paratuberculosis
cgccuucgugucggggucgcug

SEQ ID NO: 126939 - RNA, 22 nt, Mycobacterium avium subsp. paratuberculosis
cgcggugcuggccuuguguucg

SEQ ID NO: 126940 - RNA, 22 nt, Mycobacterium avium subsp. paratuberculosis
guggcggugcacaggucccagc

SEQ ID NO: 126941 - RNA, 18 nt, Mycobacterium avium subsp. paratuberculosis
uggucgcggcugucccgc

SEQ ID NO: 126942 - RNA, 22 nt, Mycobacterium avium subsp. paratuberculosis
cgggugagugccgggcuggcgg

SEQ ID NO: 126943 - RNA, 23 nt, Mycobacterium avium subsp. paratuberculosis
ucacgcuggcgugacgcucggcg

SEQ ID NO: 126944 - RNA, 20 nt, Mycobacterium avium subsp. paratuberculosis
accccgcgcgaacgcaucgc

SEQ ID NO: 126945 - RNA, 23 nt, Mycobacterium avium subsp. paratuberculosis
gcagcgugccgaucacguugguc

SEQ ID NO: 126946 - RNA, 20 nt, Mycobacterium avium subsp. paratuberculosis
accagccggcggucgccggc

SEQ ID NO: 126947 - RNA, 22 nt, Mycobacterium avium subsp. paratuberculosis
ggcgaucagcaucgcgggccgg

SEQ ID NO: 126948 - RNA, 22 nt, Mycobacterium avium subsp. paratuberculosis
gccgggaugcgugcgguggcgg

SEQ ID NO: 126949 - RNA, 22 nt, Mycobacterium avium subsp. paratuberculosis
aucgccgacgaccuucaugccc

SEQ ID NO: 126950 - RNA, 22 nt, Mycobacterium avium subsp. paratuberculosis
cguugcugccgucaaugagccg

SEQ ID NO: 126951 - RNA, 22 nt, Mycobacterium avium subsp. paratuberculosis
ccugcgacaaaugcgcggaauu

SEQ ID NO: 126952 - RNA, 22 nt, Mycobacterium avium subsp. paratuberculosis
gccggcgccaagucgccggugu

SEQ ID NO: 126953 - RNA, 21 nt, Mycobacterium avium subsp. paratuberculosis
acgcugcuggccggcgauccg

SEQ ID NO: 126954 - RNA, 22 nt, Mycobacterium avium subsp. paratuberculosis
guccgguggcgagcagcagcgg

SEQ ID NO: 126955 - RNA, 22 nt, Mycobacterium avium subsp. paratuberculosis
cuccagcgucacgccggcgugg

SEQ ID NO: 126956 - RNA, 22 nt, Mycobacterium avium subsp. paratuberculosis
gccaccacggcaguagcaucgg

SEQ ID NO: 126957 - RNA, 22 nt, Mycobacterium avium subsp. paratuberculosis
cgagcgugcacucaccgcgaua

SEQ ID NO: 126958 - RNA, 22 nt, Mycobacterium avium subsp. paratuberculosis
uucgcugccagugcacguucgg

SEQ ID NO: 126959 - RNA, 22 nt, Mycobacterium avium subsp. paratuberculosis
guuguccggccgcaccccgaag

SEQ ID NO: 126960 - RNA, 22 nt, Mycobacterium avium subsp. paratuberculosis
agcggacccuggauugggccga

SEQ ID NO: 126961 - RNA, 22 nt, Mycobacterium avium subsp. paratuberculosis
acuggucuuguagcccggcagg

SEQ ID NO: 126962 - RNA, 22 nt, Mycobacterium avium subsp. paratuberculosis
ugaacacguuccaggacaccac

SEQ ID NO: 126963 - RNA, 23 nt, Mycobacterium avium subsp. paratuberculosis
uggucgcgacgcagaauuucgcc

SEQ ID NO: 126964 - RNA, 22 nt, Mycobacterium avium subsp. paratuberculosis
gccgaacgugcacuggcggcga

SEQ ID NO: 126965 - RNA, 22 nt, Mycobacterium avium subsp. paratuberculosis
cuucggugaguagaucgcggua

SEQ ID NO: 126966 - RNA, 22 nt, Mycobacterium avium subsp. paratuberculosis
gcgggugcguuguugacguucc

SEQ ID NO: 126967 - RNA, 22 nt, Mycobacterium avium subsp. paratuberculosis
aacgugaaacuagcuucacguu

SEQ ID NO: 126968 - RNA, 22 nt, Mycobacterium avium subsp. paratuberculosis
gcgaucgcgcauuucaggucgc

SEQ ID NO: 126969 - RNA, 23 nt, Mycobacterium avium subsp. paratuberculosis
cgaugccgccggccaauucggcg

SEQ ID NO: 126970 - RNA, 22 nt, Mycobacterium avium subsp. paratuberculosis
gacgacgccgggugacagcgcc

SEQ ID NO: 126971 - RNA, 22 nt, Mycobacterium avium subsp. paratuberculosis
gccgaccaggucgucgggaguu

SEQ ID NO: 126972 - RNA, 22 nt, Mycobacterium avium subsp. paratuberculosis
ccccgcgagcagacgcaaaagc

SEQ ID NO: 126973 - RNA, 22 nt, Mycobacterium avium subsp. paratuberculosis
ggcgcgacugaccgaccggccc

SEQ ID NO: 126974 - RNA, 22 nt, Mycobacterium avium subsp. paratuberculosis
cuucgaugguggucagcgaccu

SEQ ID NO: 126975 - RNA, 22 nt, Mycobacterium avium subsp. paratuberculosis
gaggugcugcgcggccugggcg

SEQ ID NO: 126976 - RNA, 22 nt, Mycobacterium avium subsp. paratuberculosis
gacggccgcgagccgcacggug

SEQ ID NO: 126977 - RNA, 22 nt, Mycobacterium avium subsp. paratuberculosis
caucgccguguacagcggcgca

SEQ ID NO: 126978 - RNA, 22 nt, Mycobacterium avium subsp. paratuberculosis
ccucgcaggagagcaccgacgu

SEQ ID NO: 126979 - RNA, 22 nt, Mycobacterium avium subsp. paratuberculosis
cguucccgcugcaggaugguga

SEQ ID NO: 126980 - RNA, 22 nt, Mycobacterium avium subsp. paratuberculosis
acgauggcguccccaccggccc

SEQ ID NO: 126981 - RNA, 22 nt, Mycobacterium avium subsp. paratuberculosis
acccggaugcccaucuuccaga

SEQ ID NO: 126982 - RNA, 22 nt, Mycobacterium avium subsp. paratuberculosis
gcggcaguguggucgcauccgg

SEQ ID NO: 126983 - RNA, 22 nt, Mycobacterium avium subsp. paratuberculosis
cgagcagacgcaaaaccacccg

SEQ ID NO: 126984 - RNA, 22 nt, Mycobacterium avium subsp. paratuberculosis
aggggugccaccgugcgcagcg

SEQ ID NO: 126985 - RNA, 22 nt, Mycobacterium avium subsp. paratuberculosis
aggucgucacggucgucgacga

SEQ ID NO: 126986 - RNA, 22 nt, Mycobacterium avium subsp. paratuberculosis
gcggcguugccgcgguucaccg

SEQ ID NO: 126987 - RNA, 22 nt, Mycobacterium avium subsp. paratuberculosis
aaucgccagaaggccguucugc

SEQ ID NO: 126988 - RNA, 22 nt, Mycobacterium avium subsp. paratuberculosis
cacaacgugucagucaaccggg

SEQ ID NO: 126989 - RNA, 22 nt, Mycobacterium avium subsp. paratuberculosis
ggugagccuggccaacaccggc

SEQ ID NO: 126990 - RNA, 22 nt, Mycobacterium avium subsp. paratuberculosis
gguuuugcgucugcucggcggc

SEQ ID NO: 126991 - RNA, 22 nt, Mycobacterium avium subsp. paratuberculosis
acguccaucaccaugucggcgu

SEQ ID NO: 126992 - RNA, 22 nt, Mycobacterium avium subsp. paratuberculosis
uccgcgacacugcaacuacgca

SEQ ID NO: 126993 - RNA, 21 nt, Mycobacterium avium subsp. paratuberculosis
caucgccggcgcgauguugug

SEQ ID NO: 126994 - RNA, 22 nt, Mycobacterium avium subsp. paratuberculosis
cgcgaugagggaggccaccgcg

SEQ ID NO: 126995 - RNA, 22 nt, Mycobacterium avium subsp. paratuberculosis
uucguggugucggcggccgcgc

SEQ ID NO: 126996 - RNA, 22 nt, Mycobacterium avium subsp. paratuberculosis
cgccguggguggugaccuccca

SEQ ID NO: 126997 - RNA, 22 nt, Mycobacterium avium subsp. paratuberculosis
uggacggcauccaccaggcgau

SEQ ID NO: 126998 - RNA, 22 nt, Mycobacterium avium subsp. paratuberculosis
ccgggugaugcgcgaccagcug

SEQ ID NO: 126999 - RNA, 22 nt, Mycobacterium avium subsp. paratuberculosis
gugauucggauucgccgcgcag

SEQ ID NO: 127000 - RNA, 22 nt, Mycobacterium avium subsp. paratuberculosis
aggucggucucuuuggugcgcg

SEQ ID NO: 127001 - RNA, 22 nt, Mycobacterium avium subsp. paratuberculosis
uggguggccaaguccggcugga

SEQ ID NO: 127002 - RNA, 22 nt, Mycobacterium avium subsp. paratuberculosis
cgggugugcgggaccgccaucg

SEQ ID NO: 127003 - RNA, 22 nt, Mycobacterium avium subsp. paratuberculosis
gucacgccagcgugacgcucgg

SEQ ID NO: 127004 - RNA, 22 nt, Mycobacterium avium subsp. paratuberculosis
gcgcgcuugcccagcuugucgc

SEQ ID NO: 127005 - RNA, 22 nt, Mycobacterium avium subsp. paratuberculosis
agcgugaaguuagcuucacggu

SEQ ID NO: 127006 - RNA, 22 nt, Mycobacterium avium subsp. paratuberculosis
cuacacagcccccacgcucggc

SEQ ID NO: 127007 - RNA, 22 nt, Mycobacterium avium subsp. paratuberculosis
gcguuucagugugcauccuggg

SEQ ID NO: 127008 - RNA, 22 nt, Mycobacterium avium subsp. paratuberculosis
cucggcguggccgaccggcguu

SEQ ID NO: 127009 - RNA, 22 nt, Mycobacterium avium subsp. paratuberculosis
gcgaaaggucguggcgggcgaa

SEQ ID NO: 127010 - RNA, 22 nt, Mycobacterium avium subsp. paratuberculosis
ugugggaugaggugcaggugca

SEQ ID NO: 127011 - RNA, 22 nt, Mycobacterium avium subsp. paratuberculosis
caccaccgugauguuggugaaa

SEQ ID NO: 127012 - RNA, 22 nt, Mycobacterium avium subsp. paratuberculosis
ccgggcacuggccgcgguggcc

SEQ ID NO: 127013 - RNA, 22 nt, Mycobacterium avium subsp. paratuberculosis
cagggcgaggcguucaccgcgg

SEQ ID NO: 127014 - RNA, 22 nt, Mycobacterium avium subsp. paratuberculosis
gaccgcgucgcugcugggcagc

SEQ ID NO: 127015 - RNA, 22 nt, Mycobacterium avium subsp. paratuberculosis
cgacgccgagacgcuggcacaa

SEQ ID NO: 127016 - RNA, 22 nt, Mycobacterium avium subsp. paratuberculosis
aucgcggaucuggcgcucgacc

SEQ ID NO: 127017 - RNA, 22 nt, Mycobacterium avium subsp. paratuberculosis
guggguuucgcgggucaccggg

SEQ ID NO: 127018 - RNA, 22 nt, Mycobacterium avium subsp. paratuberculosis
cggcaucgagaagccguccggg

SEQ ID NO: 127019 - RNA, 22 nt, Mycobacterium avium subsp. paratuberculosis
auggucagcuggcugcccugcu

SEQ ID NO: 127020 - RNA, 22 nt, Mycobacterium avium subsp. paratuberculosis
uggucgaucucgaacaccgucg

SEQ ID NO: 127021 - RNA, 22 nt, Mycobacterium avium subsp. paratuberculosis
gccuucucacgcgccagcuuga

SEQ ID NO: 127022 - RNA, 22 nt, Mycobacterium avium subsp. paratuberculosis
gauccacgacgccucgucggac

SEQ ID NO: 127023 - RNA, 22 nt, Mycobacterium avium subsp. paratuberculosis
cagcugguguugcuggacgccc

SEQ ID NO: 127024 - RNA, 22 nt, Mycobacterium avium subsp. paratuberculosis
cgaugcucacgaaggcauucuu

SEQ ID NO: 127025 - RNA, 22 nt, Mycobacterium avium subsp. paratuberculosis
gccgccggccuggugcugggug

SEQ ID NO: 127026 - RNA, 23 nt, Mycobacterium avium subsp. paratuberculosis
ucgagcuggccguugauggaagc

SEQ ID NO: 127027 - RNA, 22 nt, Mycobacterium avium subsp. paratuberculosis
cggacgcgacgcugucggcaug

SEQ ID NO: 127028 - RNA, 21 nt, Mycobacterium avium subsp. paratuberculosis
ucccgccgggguggucagacu

SEQ ID NO: 127029 - RNA, 22 nt, Mycobacterium avium subsp. paratuberculosis
uacgggccguaggagucggcgg

SEQ ID NO: 127030 - RNA, 22 nt, Mycobacterium avium subsp. paratuberculosis
ugccgcagcgacagccggccgg

SEQ ID NO: 127031 - RNA, 22 nt, Mycobacterium avium subsp. paratuberculosis
ugggcgaccugggcaccgacac

SEQ ID NO: 127032 - RNA, 22 nt, Mycobacterium avium subsp. paratuberculosis
cggccgcaccggcgaugacggc

SEQ ID NO: 127033 - RNA, 22 nt, Mycobacterium avium subsp. paratuberculosis
acgagguugucgcugugaggcg

SEQ ID NO: 127034 - RNA, 22 nt, Mycobacterium avium subsp. paratuberculosis
acuggcgugcggcggcgaccgg

SEQ ID NO: 127035 - RNA, 22 nt, Mycobacterium avium subsp. paratuberculosis
gcgaaagugcaacuggcgacgc

SEQ ID NO: 127036 - RNA, 22 nt, Mycobacterium avium subsp. paratuberculosis
gcucaucgagagcgaccggggu

SEQ ID NO: 127037 - RNA, 22 nt, Mycobacterium avium subsp. paratuberculosis
agcguggacuaguugcgcgauc

SEQ ID NO: 127038 - RNA, 22 nt, Mycobacterium avium subsp. paratuberculosis
ccagcugguccagcacgucggg

SEQ ID NO: 127039 - RNA, 22 nt, Mycobacterium avium subsp. paratuberculosis
accgacgccgcgaucggcgaca

SEQ ID NO: 127040 - RNA, 22 nt, Mycobacterium avium subsp. paratuberculosis
uugauggcugaggccuacucgg

SEQ ID NO: 127041 - RNA, 22 nt, Mycobacterium avium subsp. paratuberculosis
cgggggguaggagguuaugcca

SEQ ID NO: 127042 - RNA, 22 nt, Mycobacterium avium subsp. paratuberculosis
gggccccgcggucaucucggug

SEQ ID NO: 127043 - RNA, 22 nt, Mycobacterium avium subsp. paratuberculosis
gcugcaucgcgaaccggucgcc

SEQ ID NO: 127044 - RNA, 22 nt, Mycobacterium avium subsp. paratuberculosis
ggccggccgccgggccggucau

SEQ ID NO: 127045 - RNA, 22 nt, Mycobacterium avium subsp. paratuberculosis
cagcagcaugcggcaccacuug

SEQ ID NO: 127046 - RNA, 22 nt, Mycobacterium avium subsp. paratuberculosis
agcuggucggccgcggcggugu

SEQ ID NO: 127047 - RNA, 21 nt, Mycobacterium avium subsp. paratuberculosis
ggugcuggugucgcaugcgcu

SEQ ID NO: 127048 - RNA, 20 nt, Mycobacterium avium subsp. paratuberculosis
aguagucgaugcucgacguc

SEQ ID NO: 127049 - RNA, 22 nt, Mycobacterium avium subsp. paratuberculosis
acgcgcguaaccccacggcgaa

SEQ ID NO: 127050 - RNA, 22 nt, Mycobacterium avium subsp. paratuberculosis
accaggcguuguagaucugcag

SEQ ID NO: 127051 - RNA, 22 nt, Mycobacterium avium subsp. paratuberculosis
guggugugcccggugcaucugg

SEQ ID NO: 127052 - RNA, 22 nt, Mycobacterium avium subsp. paratuberculosis
uggcggcauacagcggcccgau

SEQ ID NO: 127053 - RNA, 22 nt, Mycobacterium avium subsp. paratuberculosis
cggccgaagccgagcaccgccc

SEQ ID NO: 127054 - RNA, 22 nt, Mycobacterium avium subsp. paratuberculosis
auuccguugcuggcguuggccg

SEQ ID NO: 127055 - RNA, 22 nt, Mycobacterium avium subsp. paratuberculosis
cagugguggaaguucgccggug

SEQ ID NO: 127056 - RNA, 22 nt, Mycobacterium avium subsp. paratuberculosis
gcggcgucggcuucgccccgug

SEQ ID NO: 127057 - RNA, 23 nt, Mycobacterium avium subsp. paratuberculosis
uccggccggucaucaggccccuc

SEQ ID NO: 127058 - RNA, 22 nt, Mycobacterium avium subsp. paratuberculosis
ucgcugcugaucccggcgcugc

SEQ ID NO: 127059 - RNA, 22 nt, Mycobacterium avium subsp. paratuberculosis
agcggguccagggugaucgagc

SEQ ID NO: 127060 - RNA, 22 nt, Mycobacterium avium subsp. paratuberculosis
gccucgcugauggacaucgaca

SEQ ID NO: 127061 - RNA, 22 nt, Mycobacterium avium subsp. paratuberculosis
cgcccgcaccgacgucgcgauc

SEQ ID NO: 127062 - RNA, 22 nt, Mycobacterium avium subsp. paratuberculosis
cggguugcuguccgggaugccg

SEQ ID NO: 127063 - RNA, 22 nt, Mycobacterium avium subsp. paratuberculosis
ugugccgcguacccgggccggu

SEQ ID NO: 127064 - RNA, 22 nt, Mycobacterium avium subsp. paratuberculosis
ucgucgaucaccgugcgcaggu

SEQ ID NO: 127065 - RNA, 22 nt, Mycobacterium avium subsp. paratuberculosis
cgucggugcugguggcccacgg

SEQ ID NO: 127066 - RNA, 22 nt, Mycobacterium avium subsp. paratuberculosis
gcgaugccggacagccgcgaca

SEQ ID NO: 127067 - RNA, 20 nt, Mycobacterium avium subsp. paratuberculosis
caagggaguauucgggguuc

SEQ ID NO: 127068 - RNA, 22 nt, Mycobacterium avium subsp. paratuberculosis
ugcgguccugcccgcgagagca

SEQ ID NO: 127069 - RNA, 22 nt, Mycobacterium avium subsp. paratuberculosis
cggggguugagcccggccgagg

SEQ ID NO: 127070 - RNA, 22 nt, Mycobacterium avium subsp. paratuberculosis
gucgguggugcaggccauggug

SEQ ID NO: 127071 - RNA, 22 nt, Mycobacterium avium subsp. paratuberculosis
cgcggucaacggcccgacggcg

SEQ ID NO: 127072 - RNA, 22 nt, Mycobacterium avium subsp. paratuberculosis
uggucgcgauggccgucgcauc

SEQ ID NO: 127073 - RNA, 22 nt, Mycobacterium avium subsp. paratuberculosis
gcugggucagcggcugccggcc

SEQ ID NO: 127074 - RNA, 22 nt, Mycobacterium avium subsp. paratuberculosis
gcgacgacggccgguaucgcgg

SEQ ID NO: 127075 - RNA, 22 nt, Mycobacterium avium subsp. paratuberculosis
gcgccgcugcaggcugcacucg

SEQ ID NO: 127076 - RNA, 22 nt, Mycobacterium avium subsp. paratuberculosis
gcccggaaucaaccggcgcgcc

SEQ ID NO: 127077 - RNA, 22 nt, Mycobacterium avium subsp. paratuberculosis
gacggugucggcguuggcgguc

SEQ ID NO: 127078 - RNA, 22 nt, Mycobacterium avium subsp. paratuberculosis
gcgccauguguucggcgacggc

SEQ ID NO: 127079 - RNA, 18 nt, Mycobacterium avium subsp. paratuberculosis
agcccccacgcucggcgc

SEQ ID NO: 127080 - RNA, 22 nt, Mycobacterium avium subsp. paratuberculosis
ucgcugucgccaagucgucgau

SEQ ID NO: 127081 - RNA, 22 nt, Mycobacterium avium subsp. paratuberculosis
cgacccggucgaggucggcgag

SEQ ID NO: 127082 - RNA, 22 nt, Mycobacterium avium subsp. paratuberculosis
ucacggugaugacggcgacgac

SEQ ID NO: 127083 - RNA, 22 nt, Mycobacterium avium subsp. paratuberculosis
ccggcggugaccgcgccggcca

SEQ ID NO: 127084 - RNA, 22 nt, Mycobacterium avium subsp. paratuberculosis
ugugcccgggcgcggcggaacu

SEQ ID NO: 127085 - RNA, 22 nt, Mycobacterium avium subsp. paratuberculosis
caccagaucgacgccgcgccgg

SEQ ID NO: 127086 - RNA, 22 nt, Mycobacterium avium subsp. paratuberculosis
uggcugaccagaaagucgacca

SEQ ID NO: 127087 - RNA, 22 nt, Mycobacterium avium subsp. paratuberculosis
ucgucgagcaccacggucuugc

SEQ ID NO: 127088 - RNA, 22 nt, Mycobacterium avium subsp. paratuberculosis
gaggauggcgacgucggcgccg

SEQ ID NO: 127089 - RNA, 22 nt, Mycobacterium avium subsp. paratuberculosis
agguaggcgccuuucgggaccg

SEQ ID NO: 127090 - RNA, 23 nt, Mycobacterium avium subsp. paratuberculosis
cgaucgacaaugcgucgccguca

SEQ ID NO: 127091 - RNA, 22 nt, Mycobacterium avium subsp. paratuberculosis
cuggcgccguugggucuggugu

SEQ ID NO: 127092 - RNA, 22 nt, Mycobacterium avium subsp. paratuberculosis
gggcuuggcgcagcgccgcaua

SEQ ID NO: 127093 - RNA, 22 nt, Mycobacterium avium subsp. paratuberculosis
gcccgagcugggcaccacgauc

SEQ ID NO: 127094 - RNA, 20 nt, Mycobacterium avium subsp. paratuberculosis
acgucccaauccugcuggug

SEQ ID NO: 127095 - RNA, 22 nt, Mycobacterium avium subsp. paratuberculosis
cgggcuggguuaagcgcaucag

SEQ ID NO: 127096 - RNA, 22 nt, Mycobacterium avium subsp. paratuberculosis
agcgccgcggucucggcgaugg

SEQ ID NO: 127097 - RNA, 22 nt, Mycobacterium avium subsp. paratuberculosis
acgggccagcaggucggcggug

SEQ ID NO: 127098 - RNA, 22 nt, Mycobacterium avium subsp. paratuberculosis
gugccgcaugucgccgacgaug

SEQ ID NO: 127099 - RNA, 22 nt, Mycobacterium avium subsp. paratuberculosis
ccugcgccggguguucggcacu

SEQ ID NO: 127100 - RNA, 22 nt, Mycobacterium avium subsp. paratuberculosis
aaccggugccgccgccgacgag

SEQ ID NO: 127101 - RNA, 22 nt, Mycobacterium avium subsp. paratuberculosis
ccguggcguuacgcccgcggau

SEQ ID NO: 127102 - RNA, 22 nt, Mycobacterium avium subsp. paratuberculosis
ugcccgacgacgacgaacgugc

SEQ ID NO: 127103 - RNA, 23 nt, Mycobacterium avium subsp. paratuberculosis
gcgggccggagcucagcgccccg

SEQ ID NO: 127104 - RNA, 22 nt, Mycobacterium avium subsp. paratuberculosis
ucggcugcaagcgaauccugaa

SEQ ID NO: 127105 - RNA, 22 nt, Mycobacterium avium subsp. paratuberculosis
ucaccgcggcgaccugguggcc

SEQ ID NO: 127106 - RNA, 22 nt, Mycobacterium avium subsp. paratuberculosis
cggugcgcagcgcaugcgacac

SEQ ID NO: 127107 - RNA, 22 nt, Mycobacterium avium subsp. paratuberculosis
gucacgcuagcgugacgcucgc

SEQ ID NO: 127108 - RNA, 22 nt, Mycobacterium avium subsp. paratuberculosis
gcgggcaacgucgggcacgccg

SEQ ID NO: 127109 - RNA, 22 nt, Mycobacterium avium subsp. paratuberculosis
gccgaacgucgaguuguugggc

SEQ ID NO: 127110 - RNA, 22 nt, Mycobacterium avium subsp. paratuberculosis
ggcgcccgcggcuucguggugu

SEQ ID NO: 127111 - RNA, 22 nt, Mycobacterium avium subsp. paratuberculosis
gcgugccgacuauguggugacc

SEQ ID NO: 127112 - RNA, 22 nt, Mycobacterium avium subsp. paratuberculosis
ggcuacucgcugaucgucgacg

SEQ ID NO: 127113 - RNA, 22 nt, Mycobacterium avium subsp. paratuberculosis
ccgcgcggccgaugaucagccg

SEQ ID NO: 127114 - RNA, 22 nt, Mycobacterium avium subsp. paratuberculosis
uucgaguagcccugcugcccgu

SEQ ID NO: 127115 - RNA, 22 nt, Mycobacterium avium subsp. paratuberculosis
guuguguugcagugcggcgcug

SEQ ID NO: 127116 - RNA, 22 nt, Mycobacterium avium subsp. paratuberculosis
cugcgugcucuacgccugcgag

SEQ ID NO: 127117 - RNA, 21 nt, Mycobacterium avium subsp. paratuberculosis
cugcuggcccaccaggccguc

SEQ ID NO: 127118 - RNA, 22 nt, Mycobacterium avium subsp. paratuberculosis
gucguggucaccgucaccgacg

SEQ ID NO: 127119 - RNA, 22 nt, Mycobacterium avium subsp. paratuberculosis
ggguccuuguagaccucggugg

SEQ ID NO: 127120 - RNA, 22 nt, Mycobacterium avium subsp. paratuberculosis
uggcgcggcgagauccggaucu

SEQ ID NO: 127121 - RNA, 18 nt, Mycobacterium avium subsp. paratuberculosis
cgauguggccgacguggu

SEQ ID NO: 127122 - RNA, 22 nt, Mycobacterium avium subsp. paratuberculosis
gucggugcccgacaucccgggg

SEQ ID NO: 127123 - RNA, 22 nt, Mycobacterium avium subsp. paratuberculosis
gcggugcugguggccgacgagu

SEQ ID NO: 127124 - RNA, 22 nt, Mycobacterium avium subsp. paratuberculosis
cgagccgaugaagguguccugg

SEQ ID NO: 127125 - RNA, 22 nt, Mycobacterium avium subsp. paratuberculosis
guggccucgggaugcaugccga

SEQ ID NO: 127126 - RNA, 22 nt, Mycobacterium avium subsp. paratuberculosis
gaccuggugguggccgaggcgg

SEQ ID NO: 127127 - RNA, 22 nt, Mycobacterium avium subsp. paratuberculosis
ggcagcagcgagaagugcaggu

SEQ ID NO: 127128 - RNA, 22 nt, Mycobacterium avium subsp. paratuberculosis
ugacgcugucgcaguuguugug

SEQ ID NO: 127129 - RNA, 22 nt, Mycobacterium avium subsp. paratuberculosis
cugccgcgcacggucgacgaga

SEQ ID NO: 127130 - RNA, 22 nt, Mycobacterium avium subsp. paratuberculosis
uaucgccgugggguuacgcucg

SEQ ID NO: 127131 - RNA, 22 nt, Mycobacterium avium subsp. paratuberculosis
uccccggugggccuggcgacac

SEQ ID NO: 127132 - RNA, 21 nt, Mycobacterium avium subsp. paratuberculosis
ggcgaccgccauguccgccga

SEQ ID NO: 127133 - RNA, 22 nt, Mycobacterium avium subsp. paratuberculosis
gucggcaagcuuuuugcggcgc

SEQ ID NO: 127134 - RNA, 22 nt, Mycobacterium avium subsp. paratuberculosis
ccugaucaucagcgccggcggg

SEQ ID NO: 127135 - RNA, 22 nt, Mycobacterium avium subsp. paratuberculosis
ggcagcgacuacgacccgaugc

SEQ ID NO: 127136 - RNA, 22 nt, Mycobacterium avium subsp. paratuberculosis
cgcagcagauuacggcggucca

SEQ ID NO: 127137 - RNA, 22 nt, Mycobacterium avium subsp. paratuberculosis
cgggccgacgacgugguguuca

SEQ ID NO: 127138 - RNA, 18 nt, Mycobacterium avium subsp. paratuberculosis
uccguccagguagcgccg

SEQ ID NO: 127139 - RNA, 22 nt, Mycobacterium avium subsp. paratuberculosis
gauggugagcuggccguagcgu

SEQ ID NO: 127140 - RNA, 22 nt, Mycobacterium avium subsp. paratuberculosis
gggcggcacggugacggccagg

SEQ ID NO: 127141 - RNA, 22 nt, Mycobacterium avium subsp. paratuberculosis
aucgacacgaucacccgcacgu

SEQ ID NO: 127142 - RNA, 22 nt, Mycobacterium avium subsp. paratuberculosis
cugugguugcuggcgcucaugc

SEQ ID NO: 127143 - RNA, 22 nt, Mycobacterium avium subsp. paratuberculosis
acggggccggugucgaccugcu

SEQ ID NO: 127144 - RNA, 22 nt, Mycobacterium avium subsp. paratuberculosis
gugucgggggcuuuugcgucug

SEQ ID NO: 127145 - RNA, 22 nt, Mycobacterium avium subsp. paratuberculosis
cggcgguugugauaggcgaugg

SEQ ID NO: 127146 - RNA, 22 nt, Mycobacterium avium subsp. paratuberculosis
gucgccgugccgguggcugauc

SEQ ID NO: 127147 - RNA, 19 nt, Mycobacterium avium subsp. paratuberculosis
cuucuuggacacccggcgc

SEQ ID NO: 127148 - RNA, 22 nt, Mycobacterium avium subsp. paratuberculosis
ccgacgccagccagugcgcggc

SEQ ID NO: 127149 - RNA, 22 nt, Mycobacterium avium subsp. paratuberculosis
agucgacuacuccggucaggac

SEQ ID NO: 127150 - RNA, 22 nt, Mycobacterium avium subsp. paratuberculosis
uggcaacugacgguuuugcgcc

SEQ ID NO: 127151 - RNA, 22 nt, Mycobacterium avium subsp. paratuberculosis
cgacuggaccgacggcgucggc

SEQ ID NO: 127152 - RNA, 22 nt, Mycobacterium avium subsp. paratuberculosis
ucaggcuggaagugcucggcuu

SEQ ID NO: 127153 - RNA, 22 nt, Mycobacterium avium subsp. paratuberculosis
ugucggcgucggucagcgccau

SEQ ID NO: 127154 - RNA, 22 nt, Mycobacterium avium subsp. paratuberculosis
gccgcagcugaacaucggcgcg

SEQ ID NO: 127155 - RNA, 22 nt, Mycobacterium avium subsp. paratuberculosis
ucgagcuugucaacgguguaua

SEQ ID NO: 127156 - RNA, 22 nt, Mycobacterium avium subsp. paratuberculosis
ggguacgcgcgcugcuguucau

SEQ ID NO: 127157 - RNA, 22 nt, Mycobacterium avium subsp. paratuberculosis
ccggccagcgucgaguuguugg

SEQ ID NO: 127158 - RNA, 22 nt, Mycobacterium avium subsp. paratuberculosis
ccgaacuucugcagcgucgcgc

SEQ ID NO: 127159 - RNA, 22 nt, Mycobacterium avium subsp. paratuberculosis
gcgugcuugaugacguaguuga

SEQ ID NO: 127160 - RNA, 22 nt, Mycobacterium avium subsp. paratuberculosis
gcgucacgccagcgugacgcuc

SEQ ID NO: 127161 - RNA, 22 nt, Mycobacterium avium subsp. paratuberculosis
cgucgacgaccaggagcucgga

SEQ ID NO: 127162 - RNA, 19 nt, Mycobacterium avium subsp. paratuberculosis
cgccucgcccaccaccggc

SEQ ID NO: 127163 - RNA, 22 nt, Mycobacterium avium subsp. paratuberculosis
acgcccuugauccgccugagau

SEQ ID NO: 127164 - RNA, 22 nt, Mycobacterium avium subsp. paratuberculosis
augucgaucuugccgccggugc

SEQ ID NO: 127165 - RNA, 22 nt, Mycobacterium avium subsp. paratuberculosis
cucguuggacggcgcgcagucc

SEQ ID NO: 127166 - RNA, 22 nt, Mycobacterium avium subsp. paratuberculosis
ugcggccgaccgaccggcccaa

SEQ ID NO: 127167 - RNA, 20 nt, Mycobacterium avium subsp. paratuberculosis
ugcccugcugcgcgccgggg

SEQ ID NO: 127168 - RNA, 22 nt, Mycobacterium avium subsp. paratuberculosis
uaccgguugccgaucaggucga

SEQ ID NO: 127169 - RNA, 22 nt, Mycobacterium avium subsp. paratuberculosis
uucgcggaaccacguugcggga

SEQ ID NO: 127170 - RNA, 22 nt, Mycobacterium avium subsp. paratuberculosis
uagcccgcgagcgucgaguugu

SEQ ID NO: 127171 - RNA, 22 nt, Mycobacterium avium subsp. paratuberculosis
gcgcggcaucgagcugguggug

SEQ ID NO: 127172 - RNA, 22 nt, Mycobacterium avium subsp. paratuberculosis
ccguuugauguuucggacuugg

SEQ ID NO: 127173 - RNA, 22 nt, Mycobacterium avium subsp. paratuberculosis
caccaucgugccgauguaucug

SEQ ID NO: 127174 - RNA, 22 nt, Mycobacterium avium subsp. paratuberculosis
gcgccuccggguugccgcugcu

SEQ ID NO: 127175 - RNA, 23 nt, Mycobacterium avium subsp. paratuberculosis
ucacgcuggcgugacgcucgccg

SEQ ID NO: 127176 - RNA, 22 nt, Mycobacterium avium subsp. paratuberculosis
ugggcgccgggcuggccuccca

SEQ ID NO: 127177 - RNA, 22 nt, Mycobacterium avium subsp. paratuberculosis
gugugcgugauuuaagugucgc

SEQ ID NO: 127178 - RNA, 22 nt, Mycobacterium avium subsp. paratuberculosis
uccgcccuggcguuacgagcgg

SEQ ID NO: 127179 - RNA, 22 nt, Mycobacterium avium subsp. paratuberculosis
ccucacggucggcguccagcgc

SEQ ID NO: 127180 - RNA, 22 nt, Mycobacterium avium subsp. paratuberculosis
cggcgucagcuucgcguucgug

SEQ ID NO: 127181 - RNA, 22 nt, Mycobacterium avium subsp. paratuberculosis
gagcgggcguccucggcgguca

SEQ ID NO: 127182 - RNA, 22 nt, Mycobacterium avium subsp. paratuberculosis
gcagcaggacgagcucaccucg

SEQ ID NO: 127183 - RNA, 22 nt, Mycobacterium avium subsp. paratuberculosis
ggcagucgacgaugccccaggc

SEQ ID NO: 127184 - RNA, 22 nt, Mycobacterium avium subsp. paratuberculosis
ucucgguguccagcgcgcuggu

SEQ ID NO: 127185 - RNA, 22 nt, Mycobacterium avium subsp. paratuberculosis
ggcgcugcaacgcgacgucguc

SEQ ID NO: 127186 - RNA, 22 nt, Mycobacterium avium subsp. paratuberculosis
cgguggugggcucggugcucga

SEQ ID NO: 127187 - RNA, 22 nt, Mycobacterium avium subsp. paratuberculosis
aucgccucggcggcgacgguca

SEQ ID NO: 127188 - RNA, 22 nt, Mycobacterium avium subsp. paratuberculosis
cacucgccggaucagcauccgg

SEQ ID NO: 127189 - RNA, 22 nt, Mycobacterium avium subsp. paratuberculosis
agccgcggcgaauggucgguca

SEQ ID NO: 127190 - RNA, 23 nt, Mycobacterium avium subsp. paratuberculosis
gcgugguccggugacgcggccgc

SEQ ID NO: 127191 - RNA, 22 nt, Mycobacterium avium subsp. paratuberculosis
gguggugaucccggccgagcgg

SEQ ID NO: 127192 - RNA, 22 nt, Mycobacterium avium subsp. paratuberculosis
agcacgaaggccgccggguccu

SEQ ID NO: 127193 - RNA, 22 nt, Mycobacterium avium subsp. paratuberculosis
uggucggcgccgugggcgagcu

SEQ ID NO: 127194 - RNA, 22 nt, Mycobacterium avium subsp. paratuberculosis
gggugguaguagccgccggcgg

SEQ ID NO: 127195 - RNA, 22 nt, Mycobacterium avium subsp. paratuberculosis
cacgcuguucagcgcggccggc

SEQ ID NO: 127196 - RNA, 22 nt, Mycobacterium avium subsp. paratuberculosis
uuugggggacuuucgcgucugc

SEQ ID NO: 127197 - RNA, 22 nt, Mycobacterium avium subsp. paratuberculosis
gugguguccgggcgcaguacag

SEQ ID NO: 127198 - RNA, 22 nt, Mycobacterium avium subsp. paratuberculosis
cugcgccggcuucggcugagcc

SEQ ID NO: 127199 - RNA, 22 nt, Mycobacterium avium subsp. paratuberculosis
ccggcuggcaggucgcgccgga

SEQ ID NO: 127200 - RNA, 19 nt, Mycobacterium avium subsp. paratuberculosis
ccgcgccauccugcgggug

SEQ ID NO: 127201 - RNA, 22 nt, Mycobacterium avium subsp. paratuberculosis
augucggccagcaggauccgaa

SEQ ID NO: 127202 - RNA, 22 nt, Mycobacterium avium subsp. paratuberculosis
gccgguguugccgguggcgcga

SEQ ID NO: 127203 - RNA, 22 nt, Mycobacterium avium subsp. paratuberculosis
agguugccgugcaggucgaccg

SEQ ID NO: 127204 - RNA, 22 nt, Mycobacterium avium subsp. paratuberculosis
ucggugcgcgggaagcugucgu

SEQ ID NO: 127205 - RNA, 22 nt, Mycobacterium avium subsp. paratuberculosis
agccgcuggcugcgcaccguca

SEQ ID NO: 127206 - RNA, 22 nt, Mycobacterium avium subsp. paratuberculosis
gacgaggugauggagcggcugg

SEQ ID NO: 127207 - RNA, 22 nt, Mycobacterium avium subsp. paratuberculosis
ccuggcugcacacugaacgccg

SEQ ID NO: 127208 - RNA, 19 nt, Mycobacterium avium subsp. paratuberculosis
ggcggcugaccgucgagug

SEQ ID NO: 127209 - RNA, 22 nt, Mycobacterium avium subsp. paratuberculosis
ccggcccgauccagcaccgcgc

SEQ ID NO: 127210 - RNA, 22 nt, Mycobacterium avium subsp. paratuberculosis
ccgguggugacggcgcccuguu

SEQ ID NO: 127211 - RNA, 22 nt, Mycobacterium avium subsp. paratuberculosis
cgacgaugcgguuccggccguu

SEQ ID NO: 127212 - RNA, 22 nt, Mycobacterium avium subsp. paratuberculosis
cgcgcuggugcggccgucguug

SEQ ID NO: 127213 - RNA, 22 nt, Mycobacterium avium subsp. paratuberculosis
gcgcucgggcugcuuggcggag

SEQ ID NO: 127214 - RNA, 22 nt, Mycobacterium avium subsp. paratuberculosis
acgcgaaagugcaacugccgac

SEQ ID NO: 127215 - RNA, 22 nt, Mycobacterium avium subsp. paratuberculosis
gagcgcgauccacugcgcaccg

SEQ ID NO: 127216 - RNA, 22 nt, Mycobacterium avium subsp. paratuberculosis
ccgccucacagcgacaacgcgu

SEQ ID NO: 127217 - RNA, 22 nt, Mycobacterium avium subsp. paratuberculosis
gcagcgcgucgaaccgccaguc

SEQ ID NO: 127218 - RNA, 17 nt, Mycobacterium avium subsp. paratuberculosis
gugcucggcucgcccgc

SEQ ID NO: 127219 - RNA, 22 nt, Mycobacterium avium subsp. paratuberculosis
cacgacuugagcgcagcgacgu

SEQ ID NO: 127220 - RNA, 22 nt, Mycobacterium avium subsp. paratuberculosis
gccgcgccgagcccgcucagua

SEQ ID NO: 127221 - RNA, 22 nt, Mycobacterium avium subsp. paratuberculosis
gcugccggugcugggcaccgcg

SEQ ID NO: 127222 - RNA, 22 nt, Mycobacterium avium subsp. paratuberculosis
ucgauguccgcgacguauuccu

SEQ ID NO: 127223 - RNA, 22 nt, Mycobacterium avium subsp. paratuberculosis
aggcgcugggcgcggugcucga

SEQ ID NO: 127224 - RNA, 22 nt, Mycobacterium avium subsp. paratuberculosis
ugucgcugccgcggguggagau

SEQ ID NO: 127225 - RNA, 22 nt, Mycobacterium avium subsp. paratuberculosis
caggcguagugauaccggaccu

SEQ ID NO: 127226 - RNA, 21 nt, Mycobacterium avium subsp. paratuberculosis
ucggucucggcguacuggccc

SEQ ID NO: 127227 - RNA, 22 nt, Mycobacterium avium subsp. paratuberculosis
accggugcugcccgacgacuag

SEQ ID NO: 127228 - RNA, 22 nt, Mycobacterium avium subsp. paratuberculosis
gccggcugcucggaggcugcga

SEQ ID NO: 127229 - RNA, 22 nt, Mycobacterium avium subsp. paratuberculosis
ugcagcacuucgucuuuggacc

SEQ ID NO: 127230 - RNA, 22 nt, Mycobacterium avium subsp. paratuberculosis
caccggcgaugaacucagcgca

SEQ ID NO: 127231 - RNA, 22 nt, Mycobacterium avium subsp. paratuberculosis
cgacuugcguuccgagggcgca

SEQ ID NO: 127232 - RNA, 22 nt, Mycobacterium avium subsp. paratuberculosis
ggugcugagccuggacgccgcc

SEQ ID NO: 127233 - RNA, 22 nt, Mycobacterium avium subsp. paratuberculosis
ugcgggccgaucugaccgaccg

SEQ ID NO: 127234 - RNA, 22 nt, Mycobacterium avium subsp. paratuberculosis
ggucgcgaugaucucccgccgc

SEQ ID NO: 127235 - RNA, 22 nt, Mycobacterium avium subsp. paratuberculosis
ugcugaccagcaccucggccgc

SEQ ID NO: 127236 - RNA, 22 nt, Mycobacterium avium subsp. paratuberculosis
gugacucgcggggugcgcgagu

SEQ ID NO: 127237 - RNA, 22 nt, Mycobacterium avium subsp. paratuberculosis
gcgacgagauccccgaggacgg

SEQ ID NO: 127238 - RNA, 22 nt, Mycobacterium avium subsp. paratuberculosis
ugugcggacguucggcggugaa

SEQ ID NO: 127239 - RNA, 22 nt, Mycobacterium avium subsp. paratuberculosis
cagcaugucgaucgaccagguc

SEQ ID NO: 127240 - RNA, 22 nt, Mycobacterium avium subsp. paratuberculosis
cgggcguguucggcgagcugac

SEQ ID NO: 127241 - RNA, 22 nt, Mycobacterium avium subsp. paratuberculosis
ggcgggguugagcagcggaugc

SEQ ID NO: 127242 - RNA, 22 nt, Mycobacterium avium subsp. paratuberculosis
ccucggugucaccgcuagcacc

SEQ ID NO: 127243 - RNA, 22 nt, Mycobacterium avium subsp. paratuberculosis
cggccgaaauagaugauguuca

SEQ ID NO: 127244 - RNA, 23 nt, Mycobacterium avium subsp. paratuberculosis
gcuggcgaugcaccuggccgccg

SEQ ID NO: 127245 - RNA, 22 nt, Mycobacterium avium subsp. paratuberculosis
ucgauguugcggcgggucucgg

SEQ ID NO: 127246 - RNA, 22 nt, Mycobacterium avium subsp. paratuberculosis
gucagcccgccggccgauucuc

SEQ ID NO: 127247 - RNA, 22 nt, Mycobacterium avium subsp. paratuberculosis
cgccgcagauacacacgcaagg

SEQ ID NO: 127248 - RNA, 22 nt, Mycobacterium avium subsp. paratuberculosis
gccguggugguuagcggcauga

SEQ ID NO: 127249 - RNA, 22 nt, Mycobacterium avium subsp. paratuberculosis
ugugcccgccucgcagcgacaa

SEQ ID NO: 127250 - RNA, 22 nt, Mycobacterium avium subsp. paratuberculosis
ggcuucgcccgccgagcgucac

SEQ ID NO: 127251 - RNA, 22 nt, Mycobacterium avium subsp. paratuberculosis
uggacgauuuguucguugcugg

SEQ ID NO: 127252 - RNA, 22 nt, Mycobacterium avium subsp. paratuberculosis
gcccgccucugagcgacaauca

SEQ ID NO: 127253 - RNA, 22 nt, Mycobacterium avium subsp. paratuberculosis
ggcgaggauuccggugugucgu

SEQ ID NO: 127254 - RNA, 22 nt, Mycobacterium avium subsp. paratuberculosis
uccgccguggcguuacgagcgc

SEQ ID NO: 127255 - RNA, 22 nt, Mycobacterium avium subsp. paratuberculosis
gucgacgcgcucucggcguuca

SEQ ID NO: 127256 - RNA, 22 nt, Mycobacterium avium subsp. paratuberculosis
aggccgauuggcugaucgucgg

SEQ ID NO: 127257 - RNA, 22 nt, Mycobacterium avium subsp. paratuberculosis
ucgcugcuggaccgcggcaugg

SEQ ID NO: 127258 - RNA, 22 nt, Mycobacterium avium subsp. paratuberculosis
ucucgcgguagcugcacgcucg

SEQ ID NO: 127259 - RNA, 22 nt, Mycobacterium avium subsp. paratuberculosis
uugcgggcgaucaccuggcuuu

SEQ ID NO: 127260 - RNA, 22 nt, Mycobacterium avium subsp. paratuberculosis
ugcgccguggugccgcagcccg

SEQ ID NO: 127261 - RNA, 19 nt, Mycobacterium avium subsp. paratuberculosis
ugcuggggucgguguucga

SEQ ID NO: 127262 - RNA, 22 nt, Mycobacterium avium subsp. paratuberculosis
gucagcgucaagccggccggcu

SEQ ID NO: 127263 - RNA, 22 nt, Mycobacterium avium subsp. paratuberculosis
gcuuggugaacucggccagcug

SEQ ID NO: 127264 - RNA, 22 nt, Mycobacterium avium subsp. paratuberculosis
ucgacgcggcguuuccaggcuu

SEQ ID NO: 127265 - RNA, 23 nt, Mycobacterium avium subsp. paratuberculosis
uggugcagucgacgccggcgauc

SEQ ID NO: 127266 - RNA, 22 nt, Mycobacterium avium subsp. paratuberculosis
caucugcacgcaggccugcacg

SEQ ID NO: 127267 - RNA, 23 nt, Mycobacterium avium subsp. paratuberculosis
uaccgcgcaccguggcgcucacc

SEQ ID NO: 127268 - RNA, 22 nt, Mycobacterium avium subsp. paratuberculosis
ugcagcgaaccgucggcgucgc

SEQ ID NO: 127269 - RNA, 22 nt, Mycobacterium avium subsp. paratuberculosis
gccggggucaggcaugcgggua

SEQ ID NO: 127270 - RNA, 22 nt, Mycobacterium avium subsp. paratuberculosis
cguggugcuggccgaggcgcgu

SEQ ID NO: 127271 - RNA, 22 nt, Mycobacterium avium subsp. paratuberculosis
ucgcguggugccagcuguucag

SEQ ID NO: 127272 - RNA, 22 nt, Mycobacterium avium subsp. paratuberculosis
gcgcgcaggaugcggucgucgu

SEQ ID NO: 127273 - RNA, 22 nt, Mycobacterium avium subsp. paratuberculosis
accgacgccgcggugugcgcca

SEQ ID NO: 127274 - RNA, 22 nt, Mycobacterium avium subsp. paratuberculosis
gucgcgcugcucgguggggugg

SEQ ID NO: 127275 - RNA, 22 nt, Mycobacterium avium subsp. paratuberculosis
ucgcccugacguuacggacgcg

SEQ ID NO: 127276 - RNA, 22 nt, Mycobacterium avium subsp. paratuberculosis
ccaaccuugaccaggaucauug

SEQ ID NO: 127277 - RNA, 22 nt, Mycobacterium avium subsp. paratuberculosis
augccgauugacgccagugcga

SEQ ID NO: 127278 - RNA, 22 nt, Mycobacterium avium subsp. paratuberculosis
ggcgagcagacgcaaaagcccc

SEQ ID NO: 127279 - RNA, 22 nt, Mycobacterium avium subsp. paratuberculosis
agggccaucgcgauguuccucu

SEQ ID NO: 127280 - RNA, 22 nt, Mycobacterium avium subsp. paratuberculosis
gacggcuacccgagccgcggcu

SEQ ID NO: 127281 - RNA, 22 nt, Mycobacterium avium subsp. paratuberculosis
ggcggccgugcuguggcaggau

SEQ ID NO: 127282 - RNA, 22 nt, Mycobacterium avium subsp. paratuberculosis
gacaucgcggccguucgccgug

SEQ ID NO: 127283 - RNA, 22 nt, Mycobacterium avium subsp. paratuberculosis
ucgaccgccgccuucugcagga

SEQ ID NO: 127284 - RNA, 22 nt, Mycobacterium avium subsp. paratuberculosis
gcugccgacgucgaugccgauu

SEQ ID NO: 127285 - RNA, 22 nt, Mycobacterium avium subsp. paratuberculosis
gcagggccucaucgcggucgcc

SEQ ID NO: 127286 - RNA, 22 nt, Mycobacterium avium subsp. paratuberculosis
ugucgcuggucgaggcgcugcg

SEQ ID NO: 127287 - RNA, 22 nt, Mycobacterium avium subsp. paratuberculosis
ccgagcgucacgcuggcgugac

SEQ ID NO: 127288 - RNA, 22 nt, Mycobacterium avium subsp. paratuberculosis
ggggcugaugcccucggccgcg

SEQ ID NO: 127289 - RNA, 23 nt, Mycobacterium avium subsp. paratuberculosis
ugguccaggcggucggauucucg

SEQ ID NO: 127290 - RNA, 22 nt, Mycobacterium avium subsp. paratuberculosis
ucgcuaguugcacucucgcggc

SEQ ID NO: 127291 - RNA, 22 nt, Mycobacterium avium subsp. paratuberculosis
ucggcgacggugaaggcgaucu

SEQ ID NO: 127292 - RNA, 22 nt, Mycobacterium avium subsp. paratuberculosis
uugacaccguugaugcgcaugg

SEQ ID NO: 127293 - RNA, 22 nt, Mycobacterium avium subsp. paratuberculosis
uucgguggcgaucagguggucg

SEQ ID NO: 127294 - RNA, 22 nt, Mycobacterium avium subsp. paratuberculosis
ucucagugccgagcggcaguuc

SEQ ID NO: 127295 - RNA, 22 nt, Mycobacterium avium subsp. paratuberculosis
ucggucgggccuccggcaggag

SEQ ID NO: 127296 - RNA, 22 nt, Mycobacterium avium subsp. paratuberculosis
acgaucacccaccugggugccg

SEQ ID NO: 127297 - RNA, 22 nt, Mycobacterium avium subsp. paratuberculosis
cuccuggucguccugcggaucc

SEQ ID NO: 127298 - RNA, 20 nt, Mycobacterium avium subsp. paratuberculosis
ugcugucgaccaccguggcg

SEQ ID NO: 127299 - RNA, 22 nt, Mycobacterium avium subsp. paratuberculosis
ucgggcuguccagccacgaccg

SEQ ID NO: 127300 - RNA, 22 nt, Mycobacterium avium subsp. paratuberculosis
gcccggaaucgagcggccacga

SEQ ID NO: 127301 - RNA, 22 nt, Mycobacterium avium subsp. paratuberculosis
agcgugcaccuaauuucacgcu

SEQ ID NO: 127302 - RNA, 22 nt, Mycobacterium avium subsp. paratuberculosis
uccgggcgaucgauuccacccu

SEQ ID NO: 127303 - RNA, 21 nt, Mycobacterium avium subsp. paratuberculosis
agcagcucgccgagaugggcg

SEQ ID NO: 127304 - RNA, 22 nt, Mycobacterium avium subsp. paratuberculosis
agcgccccggcguagcgcaaca

SEQ ID NO: 127305 - RNA, 22 nt, Mycobacterium avium subsp. paratuberculosis
cuggcgauuccgcguggcgccg

SEQ ID NO: 127306 - RNA, 22 nt, Mycobacterium avium subsp. paratuberculosis
gcgaccgaugccagcguguggc

SEQ ID NO: 127307 - RNA, 22 nt, Mycobacterium avium subsp. paratuberculosis
gccgucuugcuccucgagccgc

SEQ ID NO: 127308 - RNA, 22 nt, Mycobacterium avium subsp. paratuberculosis
ugucggugaggaucugcauccg

SEQ ID NO: 127309 - RNA, 22 nt, Mycobacterium avium subsp. paratuberculosis
ucucggcgguguaggcguucag

SEQ ID NO: 127310 - RNA, 22 nt, Mycobacterium avium subsp. paratuberculosis
ucgcgcugggcgacuucgucga

SEQ ID NO: 127311 - RNA, 22 nt, Mycobacterium avium subsp. paratuberculosis
cggcucgcgaucgcuggccgug

SEQ ID NO: 127312 - RNA, 22 nt, Mycobacterium avium subsp. paratuberculosis
auggccgacgucugguggcggu

SEQ ID NO: 127313 - RNA, 22 nt, Mycobacterium avium subsp. paratuberculosis
cccgccucugagcgacaacgac

SEQ ID NO: 127314 - RNA, 22 nt, Mycobacterium avium subsp. paratuberculosis
cgcggucggucagaucggcccg

SEQ ID NO: 127315 - RNA, 22 nt, Mycobacterium avium subsp. paratuberculosis
cgggcggagcagcuucgccggg

SEQ ID NO: 127316 - RNA, 22 nt, Mycobacterium avium subsp. paratuberculosis
ucgacaccgacaccguggugau

SEQ ID NO: 127317 - RNA, 22 nt, Mycobacterium avium subsp. paratuberculosis
cgucggcugcacuugcacgacu

SEQ ID NO: 127318 - RNA, 22 nt, Mycobacterium avium subsp. paratuberculosis
gcagcgacagcagcucggcgua

SEQ ID NO: 127319 - RNA, 22 nt, Mycobacterium avium subsp. paratuberculosis
aucgcuguucaggacgucgcug

SEQ ID NO: 127320 - RNA, 22 nt, Mycobacterium avium subsp. paratuberculosis
gcgcguuggugcuggauugcuu

SEQ ID NO: 127321 - RNA, 22 nt, Mycobacterium avium subsp. paratuberculosis
gcccccucgaaacgguuguccc

SEQ ID NO: 127322 - RNA, 22 nt, Mycobacterium avium subsp. paratuberculosis
gccggugacaccuucccgacug

SEQ ID NO: 127323 - RNA, 22 nt, Mycobacterium avium subsp. paratuberculosis
ucagccucggccuggacagucg

SEQ ID NO: 127324 - RNA, 20 nt, Mycobacterium avium subsp. paratuberculosis
ccguggcguuacacgcgcgg

SEQ ID NO: 127325 - RNA, 22 nt, Mycobacterium avium subsp. paratuberculosis
gcgagcagacgcaaaagccccc

SEQ ID NO: 127326 - RNA, 22 nt, Mycobacterium avium subsp. paratuberculosis
cacccgcaguggggacgcgccg

SEQ ID NO: 127327 - RNA, 22 nt, Mycobacterium avium subsp. paratuberculosis
caggcgguggcccaggcggucg

SEQ ID NO: 127328 - RNA, 22 nt, Mycobacterium avium subsp. paratuberculosis
gaucucgaucucgccgaugccg

SEQ ID NO: 127329 - RNA, 22 nt, Mycobacterium avium subsp. paratuberculosis
cggccggcccguggccggccag

SEQ ID NO: 127330 - RNA, 22 nt, Mycobacterium avium subsp. paratuberculosis
ugcggcgucauugggcugcaug

SEQ ID NO: 127331 - RNA, 22 nt, Mycobacterium avium subsp. paratuberculosis
ugcaggacuggacacuugacac

SEQ ID NO: 127332 - RNA, 22 nt, Mycobacterium avium subsp. paratuberculosis
uggaggccaucgagggacugca

SEQ ID NO: 127333 - RNA, 22 nt, Mycobacterium avium subsp. paratuberculosis
ugcccgcgucgucgacgggacg

SEQ ID NO: 127334 - RNA, 22 nt, Mycobacterium avium subsp. paratuberculosis
cgcucagcgcgccggugagguc

SEQ ID NO: 127335 - RNA, 22 nt, Mycobacterium avium subsp. paratuberculosis
ugccauggcggacgggcguuuu

SEQ ID NO: 127336 - RNA, 22 nt, Mycobacterium avium subsp. paratuberculosis
uccuggucgugacgggcaucga

SEQ ID NO: 127337 - RNA, 22 nt, Mycobacterium avium subsp. paratuberculosis
gaucuccggcugggcggacuga

SEQ ID NO: 127338 - RNA, 20 nt, Mycobacterium avium subsp. paratuberculosis
cggucuggcggaccugggug

SEQ ID NO: 127339 - RNA, 22 nt, Mycobacterium avium subsp. paratuberculosis
cucgagcagacgcaaaagcccc

SEQ ID NO: 127340 - RNA, 22 nt, Mycobacterium avium subsp. paratuberculosis
ucgugguagcuugcgcggcagc

SEQ ID NO: 127341 - RNA, 22 nt, Mycobacterium avium subsp. paratuberculosis
caccggggccacaacgcggaca

SEQ ID NO: 127342 - RNA, 22 nt, Mycobacterium avium subsp. paratuberculosis
ugcacgcggccgacgacaugau

SEQ ID NO: 127343 - RNA, 22 nt, Mycobacterium avium subsp. paratuberculosis
auggcggugucguaggcgucga

SEQ ID NO: 127344 - RNA, 22 nt, Mycobacterium avium subsp. paratuberculosis
ccguacauggcccccacgcucg

SEQ ID NO: 127345 - RNA, 22 nt, Mycobacterium avium subsp. paratuberculosis
uggcuggccgucaucaccggcg

SEQ ID NO: 127346 - RNA, 22 nt, Mycobacterium avium subsp. paratuberculosis
gccggucauggcgcuggccuga

SEQ ID NO: 127347 - RNA, 22 nt, Mycobacterium avium subsp. paratuberculosis
cggcggaccgcgaucaccggcg

SEQ ID NO: 127348 - RNA, 22 nt, Mycobacterium avium subsp. paratuberculosis
agccgcauuucguggucauggg

SEQ ID NO: 127349 - RNA, 22 nt, Mycobacterium avium subsp. paratuberculosis
gcggccugguugagcgcguugu

SEQ ID NO: 127350 - RNA, 22 nt, Mycobacterium avium subsp. paratuberculosis
gacgucggcguccuggcggcga

SEQ ID NO: 127351 - RNA, 22 nt, Mycobacterium avium subsp. paratuberculosis
gcggccggguucucggugaagg

SEQ ID NO: 127352 - RNA, 22 nt, Mycobacterium avium subsp. paratuberculosis
ucaccgugcuucucgagcugug

SEQ ID NO: 127353 - RNA, 22 nt, Mycobacterium avium subsp. paratuberculosis
ccgacggguuggggcugccggu

SEQ ID NO: 127354 - RNA, 21 nt, Mycobacterium avium subsp. paratuberculosis
ugcgccgucgucgacugguac

SEQ ID NO: 127355 - RNA, 22 nt, Mycobacterium avium subsp. paratuberculosis
cgacaucgaaagcgagggccug

SEQ ID NO: 127356 - RNA, 22 nt, Mycobacterium avium subsp. paratuberculosis
aucggcagcaccgcgucgaugg

SEQ ID NO: 127357 - RNA, 22 nt, Mycobacterium avium subsp. paratuberculosis
aacugcggaaccgcggcgcggu

SEQ ID NO: 127358 - RNA, 22 nt, Mycobacterium avium subsp. paratuberculosis
aucucgcugugcacgguguugc

SEQ ID NO: 127359 - RNA, 22 nt, Mycobacterium avium subsp. paratuberculosis
ucgaugaucaccgcggccaggc

SEQ ID NO: 127360 - RNA, 22 nt, Mycobacterium avium subsp. paratuberculosis
agcaugucgcugaucuugucga

SEQ ID NO: 127361 - RNA, 22 nt, Mycobacterium avium subsp. paratuberculosis
uucggcgaucugcucuacuucg

SEQ ID NO: 127362 - RNA, 22 nt, Mycobacterium avium subsp. paratuberculosis
cgucaucuucuccagcgagucc

SEQ ID NO: 127363 - RNA, 22 nt, Mycobacterium avium subsp. paratuberculosis
gucguagaugaucugccccuug

SEQ ID NO: 127364 - RNA, 22 nt, Mycobacterium avium subsp. paratuberculosis
cugcacgugcugcucaucccgg

SEQ ID NO: 127365 - RNA, 22 nt, Mycobacterium avium subsp. paratuberculosis
acgggcuugccgaggguggugc

SEQ ID NO: 127366 - RNA, 22 nt, Mycobacterium avium subsp. paratuberculosis
gccgagcgucacgcuggcguga

SEQ ID NO: 127367 - RNA, 22 nt, Mycobacterium avium subsp. paratuberculosis
agcuguccggcucgcugcugcc

SEQ ID NO: 127368 - RNA, 22 nt, Mycobacterium avium subsp. paratuberculosis
ggugagggucucgaucggguug

SEQ ID NO: 127369 - RNA, 22 nt, Mycobacterium avium subsp. paratuberculosis
ucgucacgcccgcgcugcaacg

SEQ ID NO: 127370 - RNA, 22 nt, Mycobacterium avium subsp. paratuberculosis
cgggaacuucuugaucgccugc

SEQ ID NO: 127371 - RNA, 22 nt, Mycobacterium avium subsp. paratuberculosis
ccgaacaguuugcucauaguua

SEQ ID NO: 127372 - RNA, 22 nt, Mycobacterium avium subsp. paratuberculosis
caggugcacauccuggccggca

SEQ ID NO: 127373 - RNA, 22 nt, Mycobacterium avium subsp. paratuberculosis
cgcuaccuggugcuacaccgaa

SEQ ID NO: 127374 - RNA, 22 nt, Mycobacterium avium subsp. paratuberculosis
uguuucugggcauccgcgccgu

SEQ ID NO: 127375 - RNA, 22 nt, Mycobacterium avium subsp. paratuberculosis
cguguugccgacgaucgugccg

SEQ ID NO: 127376 - RNA, 22 nt, Mycobacterium avium subsp. paratuberculosis
gccucgcagcugaucaggacgc

SEQ ID NO: 127377 - RNA, 22 nt, Mycobacterium avium subsp. paratuberculosis
auuucgggucgagagcggcggc

SEQ ID NO: 127378 - RNA, 22 nt, Mycobacterium avium subsp. paratuberculosis
aacgacgaaaacacgaugccgg

SEQ ID NO: 127379 - RNA, 22 nt, Mycobacterium avium subsp. paratuberculosis
ugucggcgcggaagguggugau

SEQ ID NO: 127380 - RNA, 22 nt, Mycobacterium avium subsp. paratuberculosis
ugcguaguugcagucucgugcu

SEQ ID NO: 127381 - RNA, 22 nt, Mycobacterium avium subsp. paratuberculosis
uugacgaucgugcccucgacga

SEQ ID NO: 127382 - RNA, 22 nt, Mycobacterium avium subsp. paratuberculosis
caggccgccaucgggcccgggc

SEQ ID NO: 127383 - RNA, 22 nt, Mycobacterium avium subsp. paratuberculosis
gccgucgucaccggugucggag

SEQ ID NO: 127384 - RNA, 22 nt, Mycobacterium avium subsp. paratuberculosis
acgucgcugguugcacuuucgc

SEQ ID NO: 127385 - RNA, 22 nt, Mycobacterium avium subsp. paratuberculosis
augccgaccacguaccggccca

SEQ ID NO: 127386 - RNA, 22 nt, Mycobacterium avium subsp. paratuberculosis
acgggcgcgccgguugauuccg

SEQ ID NO: 127387 - RNA, 22 nt, Mycobacterium avium subsp. paratuberculosis
auggucgugcucggcggcuucg

SEQ ID NO: 127388 - RNA, 22 nt, Mycobacterium avium subsp. paratuberculosis
ugauucccgacgacgggcacgc

SEQ ID NO: 127389 - RNA, 22 nt, Mycobacterium avium subsp. paratuberculosis
ggguggcgaugcguucggcgac

SEQ ID NO: 127390 - RNA, 22 nt, Mycobacterium avium subsp. paratuberculosis
ucgugguucgcggccgaguccg

SEQ ID NO: 127391 - RNA, 22 nt, Mycobacterium avium subsp. paratuberculosis
gacgggcggaccgucggcaaug

SEQ ID NO: 127392 - RNA, 22 nt, Mycobacterium avium subsp. paratuberculosis
ucgcugcccgacaucgaggggc

SEQ ID NO: 127393 - RNA, 19 nt, Mycobacterium avium subsp. paratuberculosis
gguuccuccgucgguggug

SEQ ID NO: 127394 - RNA, 22 nt, Mycobacterium avium subsp. paratuberculosis
ucgacggccugguugugcggca

SEQ ID NO: 127395 - RNA, 22 nt, Mycobacterium avium subsp. paratuberculosis
gcguccaauccccgguucucgg

SEQ ID NO: 127396 - RNA, 20 nt, Mycobacterium avium subsp. paratuberculosis
cgacgacugcguggcggcga

SEQ ID NO: 127397 - RNA, 22 nt, Mycobacterium avium subsp. paratuberculosis
uagcgcaccacggcguugucca

SEQ ID NO: 127398 - RNA, 22 nt, Mycobacterium avium subsp. paratuberculosis
aaucgcgcaauagagucgacgu

SEQ ID NO: 127399 - RNA, 22 nt, Mycobacterium avium subsp. paratuberculosis
cgguggucugcucggccugacg

SEQ ID NO: 127400 - RNA, 22 nt, Mycobacterium avium subsp. paratuberculosis
aagcugaucggcaugggcgacg

SEQ ID NO: 127401 - RNA, 22 nt, Mycobacterium avium subsp. paratuberculosis
uucgaguuggcggcuacgaccu

SEQ ID NO: 127402 - RNA, 22 nt, Mycobacterium avium subsp. paratuberculosis
cacucgcgaccagugagugcua

SEQ ID NO: 127403 - RNA, 22 nt, Mycobacterium avium subsp. paratuberculosis
ggguucgucccuggccgccgcg

SEQ ID NO: 127404 - RNA, 21 nt, Mycobacterium avium subsp. paratuberculosis
gcgaccucggucgcgugcggc

SEQ ID NO: 127405 - RNA, 22 nt, Mycobacterium avium subsp. paratuberculosis
gcugcgcgcgcacuucgacacc

SEQ ID NO: 127406 - RNA, 22 nt, Mycobacterium avium subsp. paratuberculosis
accggccgggccaucggguugg

SEQ ID NO: 127407 - RNA, 22 nt, Mycobacterium avium subsp. paratuberculosis
ggucgagcaugcguccggucug

SEQ ID NO: 127408 - RNA, 22 nt, Mycobacterium avium subsp. paratuberculosis
ggucuucaccgagggcgugauc

SEQ ID NO: 127409 - RNA, 17 nt, Mycobacterium avium subsp. paratuberculosis
uuuugcgucugcucgcg

SEQ ID NO: 127410 - RNA, 22 nt, Mycobacterium avium subsp. paratuberculosis
ccgacgucggcgacgauggcca

SEQ ID NO: 127411 - RNA, 22 nt, Mycobacterium avium subsp. paratuberculosis
accgccgagcguggaguuguug

SEQ ID NO: 127412 - RNA, 22 nt, Mycobacterium avium subsp. paratuberculosis
uggcggcguccacgucgacguu

SEQ ID NO: 127413 - RNA, 22 nt, Mycobacterium avium subsp. paratuberculosis
gcagcuuguccaagagccggcc

SEQ ID NO: 127414 - RNA, 20 nt, Mycobacterium avium subsp. paratuberculosis
accugcacgcuguccgcgug

SEQ ID NO: 127415 - RNA, 22 nt, Mycobacterium avium subsp. paratuberculosis
aaggcccaccaguugguaccgg

SEQ ID NO: 127416 - RNA, 22 nt, Mycobacterium avium subsp. paratuberculosis
ugcuggaugcgcuggccgccca

SEQ ID NO: 127417 - RNA, 22 nt, Mycobacterium avium subsp. paratuberculosis
agccggucaggagacuuucguc

SEQ ID NO: 127418 - RNA, 22 nt, Mycobacterium avium subsp. paratuberculosis
cggugcucgccaaggaggugau

SEQ ID NO: 127419 - RNA, 22 nt, Mycobacterium avium subsp. paratuberculosis
cgacggcgaacucggucucggu

SEQ ID NO: 127420 - RNA, 22 nt, Mycobacterium avium subsp. paratuberculosis
cggguggagaaguggcugguca

SEQ ID NO: 127421 - RNA, 22 nt, Mycobacterium avium subsp. paratuberculosis
gcagcgcgacgcccaggccaaa

SEQ ID NO: 127422 - RNA, 22 nt, Mycobacterium avium subsp. paratuberculosis
gcugauuccgguggccgccaag

SEQ ID NO: 127423 - RNA, 22 nt, Mycobacterium avium subsp. paratuberculosis
ggguuugcccgccucggcaucg

SEQ ID NO: 127424 - RNA, 22 nt, Mycobacterium avium subsp. paratuberculosis
ccgaggugauaucgcacggcuu

SEQ ID NO: 127425 - RNA, 21 nt, Mycobacterium avium subsp. paratuberculosis
cggugcucagccggugcccgc

SEQ ID NO: 127426 - RNA, 22 nt, Mycobacterium avium subsp. paratuberculosis
cgcucgggugugccugcagcga

SEQ ID NO: 127427 - RNA, 22 nt, Mycobacterium avium subsp. paratuberculosis
uagcggcucagcgcguagaagu

SEQ ID NO: 127428 - RNA, 22 nt, Mycobacterium avium subsp. paratuberculosis
ucguugucgcucagaggcgggc

SEQ ID NO: 127429 - RNA, 22 nt, Mycobacterium avium subsp. paratuberculosis
gccgauguaguucuugcggucg

SEQ ID NO: 127430 - RNA, 18 nt, Mycobacterium avium subsp. paratuberculosis
ccgguccgcgcgcugucc

SEQ ID NO: 127431 - RNA, 22 nt, Mycobacterium avium subsp. paratuberculosis
uugccgccggccuccucgacca

SEQ ID NO: 127432 - RNA, 22 nt, Mycobacterium avium subsp. paratuberculosis
gaaagugcaaccagcgacgugu

SEQ ID NO: 127433 - RNA, 22 nt, Mycobacterium avium subsp. paratuberculosis
ggugcgguucaccgacaccgac

SEQ ID NO: 127434 - RNA, 22 nt, Mycobacterium avium subsp. paratuberculosis
cggcgagguugcgcaggaacgc

SEQ ID NO: 127435 - RNA, 22 nt, Mycobacterium avium subsp. paratuberculosis
gcugucgcuguucggggugcau

SEQ ID NO: 127436 - RNA, 22 nt, Mycobacterium avium subsp. paratuberculosis
uugcgcucccaccaggucgucu

SEQ ID NO: 127437 - RNA, 22 nt, Mycobacterium avium subsp. paratuberculosis
cccagcucguugccggcggcca

SEQ ID NO: 127438 - RNA, 22 nt, Mycobacterium avium subsp. paratuberculosis
uacgacgccgaguggaucgucg

SEQ ID NO: 127439 - RNA, 22 nt, Mycobacterium avium subsp. paratuberculosis
ucgccguggcguuacgcuggcg

SEQ ID NO: 127440 - RNA, 22 nt, Mycobacterium avium subsp. paratuberculosis
ggccacgucgaagcccggguau

SEQ ID NO: 127441 - RNA, 22 nt, Mycobacterium avium subsp. paratuberculosis
ucagcaggucgaugcgguugcg

SEQ ID NO: 127442 - RNA, 22 nt, Mycobacterium avium subsp. paratuberculosis
acugccacaacgacucccgcgu

SEQ ID NO: 127443 - RNA, 21 nt, Mycobacterium avium subsp. paratuberculosis
cggcgcucgccgauguggugc

SEQ ID NO: 127444 - RNA, 22 nt, Mycobacterium avium subsp. paratuberculosis
gccuucggauccugcuggccga

SEQ ID NO: 127445 - RNA, 22 nt, Mycobacterium avium subsp. paratuberculosis
cagcggccggucggcgaggacg

SEQ ID NO: 127446 - RNA, 22 nt, Mycobacterium avium subsp. paratuberculosis
accgccuggcgggaucugccca

SEQ ID NO: 127447 - RNA, 22 nt, Mycobacterium avium subsp. paratuberculosis
agcgugaagcuaguuucacgcu

SEQ ID NO: 127448 - RNA, 22 nt, Mycobacterium avium subsp. paratuberculosis
cacggugccgucgucgagcagu

SEQ ID NO: 127449 - RNA, 19 nt, Mycobacterium avium subsp. paratuberculosis
ucgcgcuggggugcucgau

SEQ ID NO: 127450 - RNA, 22 nt, Mycobacterium avium subsp. paratuberculosis
ggcgguguuccagacccgcucg

SEQ ID NO: 127451 - RNA, 22 nt, Mycobacterium avium subsp. paratuberculosis
gaucccguucguggcguucgcg

SEQ ID NO: 127452 - RNA, 22 nt, Mycobacterium avium subsp. paratuberculosis
ugggugggcuugaccuguuuga

SEQ ID NO: 127453 - RNA, 22 nt, Mycobacterium avium subsp. paratuberculosis
uggccgaaccggguucggacga

SEQ ID NO: 127454 - RNA, 22 nt, Mycobacterium avium subsp. paratuberculosis
ccgccggguggucgagccgguc

SEQ ID NO: 127455 - RNA, 22 nt, Mycobacterium avium subsp. paratuberculosis
ucgccguggcgaucaucgugac

SEQ ID NO: 127456 - RNA, 20 nt, Mycobacterium avium subsp. paratuberculosis
cucgacgucggccggcgcgg

SEQ ID NO: 127457 - RNA, 22 nt, Mycobacterium avium subsp. paratuberculosis
accgcgcugcgcgccauggaca

SEQ ID NO: 127458 - RNA, 22 nt, Mycobacterium avium subsp. paratuberculosis
agaggaacaucgcgauggcccu

SEQ ID NO: 127459 - RNA, 22 nt, Mycobacterium avium subsp. paratuberculosis
cuggcuggagccgcaggcccgg

SEQ ID NO: 127460 - RNA, 22 nt, Mycobacterium avium subsp. paratuberculosis
uggcgcagucggcgugcuugcc

SEQ ID NO: 127461 - RNA, 22 nt, Mycobacterium avium subsp. paratuberculosis
ugaccaccaaggguggucccaa

SEQ ID NO: 127462 - RNA, 22 nt, Mycobacterium avium subsp. paratuberculosis
ggugcguaguugcagugucgcg

SEQ ID NO: 127463 - RNA, 22 nt, Mycobacterium avium subsp. paratuberculosis
cggcccaacaacucgacguugg

SEQ ID NO: 127464 - RNA, 22 nt, Mycobacterium avium subsp. paratuberculosis
gcugugggggcucgagcuggac

SEQ ID NO: 127465 - RNA, 21 nt, Mycobacterium avium subsp. paratuberculosis
ggccgcaccgucaacaucgcc

SEQ ID NO: 127466 - RNA, 22 nt, Mycobacterium avium subsp. paratuberculosis
uuggugacggcgggauaggcga

SEQ ID NO: 127467 - RNA, 22 nt, Mycobacterium avium subsp. paratuberculosis
guucgguauucgacaacgucgu

SEQ ID NO: 127468 - RNA, 22 nt, Mycobacterium avium subsp. paratuberculosis
ccgguugccccaccguugcagc

SEQ ID NO: 127469 - RNA, 22 nt, Mycobacterium avium subsp. paratuberculosis
caucccggccuggcgggcggcc

SEQ ID NO: 127470 - RNA, 22 nt, Mycobacterium avium subsp. paratuberculosis
gccgggcugccggucugcgccg

SEQ ID NO: 127471 - RNA, 23 nt, Mycobacterium avium subsp. paratuberculosis
cgccgagucgacggguguggccc

SEQ ID NO: 127472 - RNA, 22 nt, Mycobacterium avium subsp. paratuberculosis
ucggugguggaaggcgagcucg

SEQ ID NO: 127473 - RNA, 22 nt, Mycobacterium avium subsp. paratuberculosis
uucggugucggugcgggucggc

SEQ ID NO: 127474 - RNA, 21 nt, Mycobacterium avium subsp. paratuberculosis
ucaucgccuggcuggcguggc

SEQ ID NO: 127475 - RNA, 22 nt, Mycobacterium avium subsp. paratuberculosis
aucgcauucuggugcacgcgga

SEQ ID NO: 127476 - RNA, 22 nt, Mycobacterium avium subsp. paratuberculosis
aacgucgacuuguugggcgaaa

SEQ ID NO: 127477 - RNA, 22 nt, Mycobacterium avium subsp. paratuberculosis
cccgcguuguugaccaggacgu

SEQ ID NO: 127478 - RNA, 22 nt, Mycobacterium avium subsp. paratuberculosis
gcgguggccaucggcacgcuga

SEQ ID NO: 127479 - RNA, 22 nt, Mycobacterium avium subsp. paratuberculosis
gagcccaucgacgagaucucgg

SEQ ID NO: 127480 - RNA, 22 nt, Mycobacterium avium subsp. paratuberculosis
cgccgcggccgagguguucgcc

SEQ ID NO: 127481 - RNA, 22 nt, Mycobacterium avium subsp. paratuberculosis
gggcggugcucggcuucggccg

SEQ ID NO: 127482 - RNA, 20 nt, Mycobacterium avium subsp. paratuberculosis
gcgucccggacgagcgugcg

SEQ ID NO: 127483 - RNA, 22 nt, Mycobacterium avium subsp. paratuberculosis
cgaguugcccaccgcccugcug

SEQ ID NO: 127484 - RNA, 22 nt, Mycobacterium avium subsp. paratuberculosis
cguguugcccccggugagccgc

SEQ ID NO: 127485 - RNA, 22 nt, Mycobacterium avium subsp. paratuberculosis
gacgacaucgagcggcuagugg

SEQ ID NO: 127486 - RNA, 22 nt, Mycobacterium avium subsp. paratuberculosis
cagcggccgaucauggucggcg

SEQ ID NO: 127487 - RNA, 22 nt, Mycobacterium avium subsp. paratuberculosis
cgcccgcacccuggacaccugg

SEQ ID NO: 127488 - RNA, 22 nt, Mycobacterium avium subsp. paratuberculosis
ccggcgucgucgugacgcgaca

SEQ ID NO: 127489 - RNA, 22 nt, Mycobacterium avium subsp. paratuberculosis
ucggcggcaucguggcccuggc

SEQ ID NO: 127490 - RNA, 22 nt, Mycobacterium avium subsp. paratuberculosis
gucggcgcaacaagucgacgcu

SEQ ID NO: 127491 - RNA, 22 nt, Mycobacterium avium subsp. paratuberculosis
gcaccccguacucgcgcggcgu

SEQ ID NO: 127492 - RNA, 22 nt, Mycobacterium avium subsp. paratuberculosis
cugucgccggcgguguccaucg

SEQ ID NO: 127493 - RNA, 22 nt, Mycobacterium avium subsp. paratuberculosis
uacuccggcucaccgguguggg

SEQ ID NO: 127494 - RNA, 22 nt, Mycobacterium avium subsp. paratuberculosis
auggccgcgguguggcugagcg

SEQ ID NO: 127495 - RNA, 22 nt, Mycobacterium avium subsp. paratuberculosis
accgccgaagcugguggaggcg

SEQ ID NO: 127496 - RNA, 22 nt, Mycobacterium avium subsp. paratuberculosis
ugcugggugcccgcggcggugc

SEQ ID NO: 127497 - RNA, 22 nt, Mycobacterium avium subsp. paratuberculosis
gcgaggcgggcgucagccggga

SEQ ID NO: 127498 - RNA, 22 nt, Mycobacterium avium subsp. paratuberculosis
ucacgccgcggguggcgccgua

SEQ ID NO: 127499 - RNA, 22 nt, Mycobacterium avium subsp. paratuberculosis
uccgggaucuggaauacgugcg

SEQ ID NO: 127500 - RNA, 22 nt, Mycobacterium avium subsp. paratuberculosis
cagaccuaccuugcccgcgcgg

SEQ ID NO: 127501 - RNA, 22 nt, Mycobacterium avium subsp. paratuberculosis
ccggaucagaaaccacgcgucg

SEQ ID NO: 127502 - RNA, 22 nt, Mycobacterium avium subsp. paratuberculosis
ggccgucguccuguguuaucca

SEQ ID NO: 127503 - RNA, 22 nt, Mycobacterium avium subsp. paratuberculosis
cccgcuggucggcgucuucgag

SEQ ID NO: 127504 - RNA, 22 nt, Mycobacterium avium subsp. paratuberculosis
acgccgagcugcugucgcugcu

SEQ ID NO: 127505 - RNA, 22 nt, Mycobacterium avium subsp. paratuberculosis
ugugcuggcgguaugcgugguc

SEQ ID NO: 127506 - RNA, 22 nt, Mycobacterium avium subsp. paratuberculosis
gcgguggcguugcuguccuacc

SEQ ID NO: 127507 - RNA, 20 nt, Mycobacterium avium subsp. paratuberculosis
ugggcgccuccgaacgcggc

SEQ ID NO: 127508 - RNA, 22 nt, Mycobacterium avium subsp. paratuberculosis
ugguccacgaucaggcagcccg

SEQ ID NO: 127509 - RNA, 22 nt, Mycobacterium avium subsp. paratuberculosis
cgccgacgugucuugguccgac

SEQ ID NO: 127510 - RNA, 22 nt, Mycobacterium avium subsp. paratuberculosis
ugauucccgcguugauggcggg

SEQ ID NO: 127511 - RNA, 22 nt, Mycobacterium avium subsp. paratuberculosis
cgugcugcgcgagcugcagcag

SEQ ID NO: 127512 - RNA, 22 nt, Mycobacterium avium subsp. paratuberculosis
augccgugcuuggccagcucgc

SEQ ID NO: 127513 - RNA, 22 nt, Mycobacterium avium subsp. paratuberculosis
guucgugccgaccgucaucgcg

SEQ ID NO: 127514 - RNA, 22 nt, Mycobacterium avium subsp. paratuberculosis
gugcugggauugauggcggcga

SEQ ID NO: 127515 - RNA, 22 nt, Mycobacterium avium subsp. paratuberculosis
aauuggugacgacggcgcucaa

SEQ ID NO: 127516 - RNA, 22 nt, Mycobacterium avium subsp. paratuberculosis
ggcggcucguacuagagggccu

SEQ ID NO: 127517 - RNA, 22 nt, Mycobacterium avium subsp. paratuberculosis
uucggguucuucgucauccugc

SEQ ID NO: 127518 - RNA, 22 nt, Mycobacterium avium subsp. paratuberculosis
gcggccacgagaccgaccggcu

SEQ ID NO: 127519 - RNA, 22 nt, Mycobacterium avium subsp. paratuberculosis
gcgccguacuugugcaccucga

SEQ ID NO: 127520 - RNA, 22 nt, Mycobacterium avium subsp. paratuberculosis
uuggugguggucgucgacgagc

SEQ ID NO: 127521 - RNA, 22 nt, Mycobacterium avium subsp. paratuberculosis
uggcggcccugcuguccgccgc

SEQ ID NO: 127522 - RNA, 22 nt, Mycobacterium avium subsp. paratuberculosis
uaaguggagcgcguuccgauua

SEQ ID NO: 127523 - RNA, 22 nt, Mycobacterium avium subsp. paratuberculosis
ggacaguugcguggcgccggcg

SEQ ID NO: 127524 - RNA, 22 nt, Mycobacterium avium subsp. paratuberculosis
gcugcgcggcacgguccgguug

SEQ ID NO: 127525 - RNA, 22 nt, Mycobacterium avium subsp. paratuberculosis
gaccggcagccgggcgagccga

SEQ ID NO: 127526 - RNA, 22 nt, Mycobacterium avium subsp. paratuberculosis
aggccggugaccagugggugcu

SEQ ID NO: 127527 - RNA, 22 nt, Mycobacterium avium subsp. paratuberculosis
gugucgaccuggauccugccgg

SEQ ID NO: 127528 - RNA, 22 nt, Mycobacterium avium subsp. paratuberculosis
cgcggugggcucggcucggcug

SEQ ID NO: 127529 - RNA, 22 nt, Mycobacterium avium subsp. paratuberculosis
ucggccaucgguucgguggugc

SEQ ID NO: 127530 - RNA, 22 nt, Mycobacterium avium subsp. paratuberculosis
gccagccacccggugacgucga

SEQ ID NO: 127531 - RNA, 22 nt, Mycobacterium avium subsp. paratuberculosis
cgcgccggugguggcgguggcc

SEQ ID NO: 127532 - RNA, 22 nt, Mycobacterium avium subsp. paratuberculosis
cggggcgaagauccgcaaggcg

SEQ ID NO: 127533 - RNA, 22 nt, Mycobacterium avium subsp. paratuberculosis
gagggcguguggcaccacacgg

SEQ ID NO: 127534 - RNA, 22 nt, Mycobacterium avium subsp. paratuberculosis
gugcucgcugaccuaccccggc

SEQ ID NO: 127535 - RNA, 22 nt, Mycobacterium avium subsp. paratuberculosis
gccagcauccgcagucuggucg

SEQ ID NO: 127536 - RNA, 22 nt, Mycobacterium avium subsp. paratuberculosis
caccgcgaucgcggggucaccg

SEQ ID NO: 127537 - RNA, 22 nt, Mycobacterium avium subsp. paratuberculosis
uacaccgacgaggcguccagcg

SEQ ID NO: 127538 - RNA, 22 nt, Mycobacterium avium subsp. paratuberculosis
gccgccguggaaguacauguug

SEQ ID NO: 127539 - RNA, 22 nt, Mycobacterium avium subsp. paratuberculosis
ugcugcgucauguggcgggcga

SEQ ID NO: 127540 - RNA, 22 nt, Mycobacterium avium subsp. paratuberculosis
cugcgggcgcgguccacgguga

SEQ ID NO: 127541 - RNA, 22 nt, Mycobacterium avium subsp. paratuberculosis
cucggggcuauggcgcagcugg

SEQ ID NO: 127542 - RNA, 22 nt, Mycobacterium avium subsp. paratuberculosis
augggcuucggcuaucaccgcg

SEQ ID NO: 127543 - RNA, 22 nt, Mycobacterium avium subsp. paratuberculosis
ucgcucgacgaccucgacgcgg

SEQ ID NO: 127544 - RNA, 23 nt, Mycobacterium avium subsp. paratuberculosis
ugcacgucugccucgccgacccc

SEQ ID NO: 127545 - RNA, 22 nt, Mycobacterium avium subsp. paratuberculosis
ugggccaacggaauguagucgg

SEQ ID NO: 127546 - RNA, 22 nt, Mycobacterium avium subsp. paratuberculosis
uaccggugguguagcuucgaug

SEQ ID NO: 127547 - RNA, 22 nt, Mycobacterium avium subsp. paratuberculosis
ucagcgguccugcugcaugguc

SEQ ID NO: 127548 - RNA, 21 nt, Mycobacterium avium subsp. paratuberculosis
cggguccggcaccgcgugcgg

SEQ ID NO: 127549 - RNA, 22 nt, Mycobacterium avium subsp. paratuberculosis
uucgucggcgaacggccagucc

SEQ ID NO: 127550 - RNA, 22 nt, Mycobacterium avium subsp. paratuberculosis
ucgugcuggacgucuacggcgc

SEQ ID NO: 127551 - RNA, 22 nt, Mycobacterium avium subsp. paratuberculosis
cggggucggccagcaccaccca

SEQ ID NO: 127552 - RNA, 22 nt, Mycobacterium avium subsp. paratuberculosis
ucgcugggcggcagcucggcau

SEQ ID NO: 127553 - RNA, 22 nt, Mycobacterium avium subsp. paratuberculosis
acagaugucaauagugugaguu

SEQ ID NO: 127554 - RNA, 22 nt, Mycobacterium avium subsp. paratuberculosis
gucccggaugcgggugggcacc

SEQ ID NO: 127555 - RNA, 22 nt, Mycobacterium avium subsp. paratuberculosis
uguccggaauaucagucaugcc

SEQ ID NO: 127556 - RNA, 22 nt, Mycobacterium avium subsp. paratuberculosis
guuggccguacuggcccggcug

SEQ ID NO: 127557 - RNA, 22 nt, Mycobacterium avium subsp. paratuberculosis
auggcagcagcaucgugguggc

SEQ ID NO: 127558 - RNA, 22 nt, Mycobacterium avium subsp. paratuberculosis
ggaggucggucacggcgccagu

SEQ ID NO: 127559 - RNA, 22 nt, Mycobacterium avium subsp. paratuberculosis
guucuccaccauggacgcgcgg

SEQ ID NO: 127560 - RNA, 22 nt, Mycobacterium avium subsp. paratuberculosis
ggguuugcccggcucggcaucg

SEQ ID NO: 127561 - RNA, 22 nt, Mycobacterium avium subsp. paratuberculosis
gcuggugaccgaggcgauggug

SEQ ID NO: 127562 - RNA, 22 nt, Mycobacterium avium subsp. paratuberculosis
cuguucguggccgguuucuacg

SEQ ID NO: 127563 - RNA, 23 nt, Mycobacterium avium subsp. paratuberculosis
ccgcuaccgacgguucgucguua

SEQ ID NO: 127564 - RNA, 16 nt, Mycobacterium avium subsp. paratuberculosis
ucggugggcaugcuca

SEQ ID NO: 127565 - RNA, 22 nt, Mycobacterium avium subsp. paratuberculosis
ggucggccgccaaugccgaggc

SEQ ID NO: 127566 - RNA, 22 nt, Mycobacterium avium subsp. paratuberculosis
cgauggucggcagcuuggccag

SEQ ID NO: 127567 - RNA, 22 nt, Mycobacterium avium subsp. paratuberculosis
ccgcgcaaucaaaaaccccgcu

SEQ ID NO: 127568 - RNA, 19 nt, Mycobacterium avium subsp. paratuberculosis
acgggccguggcgccaucu

SEQ ID NO: 127569 - RNA, 22 nt, Mycobacterium avium subsp. paratuberculosis
accgcguccguaacgucagggc

SEQ ID NO: 127570 - RNA, 22 nt, Mycobacterium avium subsp. paratuberculosis
ggcgcugguggucggcgcguuc

SEQ ID NO: 127571 - RNA, 22 nt, Mycobacterium avium subsp. paratuberculosis
agcgcaccaccaacggcaucgg

SEQ ID NO: 127572 - RNA, 22 nt, Mycobacterium avium subsp. paratuberculosis
ccacguguucgucgagaauccc

SEQ ID NO: 127573 - RNA, 22 nt, Mycobacterium avium subsp. paratuberculosis
cuaccccggcuggauuuugcga

SEQ ID NO: 127574 - RNA, 22 nt, Mycobacterium avium subsp. paratuberculosis
gaugcggugacuuucgaucugc

SEQ ID NO: 127575 - RNA, 22 nt, Mycobacterium avium subsp. paratuberculosis
ccgccgagcaaaacgccgccaa

SEQ ID NO: 127576 - RNA, 22 nt, Mycobacterium avium subsp. paratuberculosis
aacgugcugcagcaugcgacgg

SEQ ID NO: 127577 - RNA, 22 nt, Mycobacterium avium subsp. paratuberculosis
cuccgaucuggccgaccggcug

SEQ ID NO: 127578 - RNA, 23 nt, Mycobacterium avium subsp. paratuberculosis
caucaugaaggccggugccgguu

SEQ ID NO: 127579 - RNA, 22 nt, Mycobacterium avium subsp. paratuberculosis
caccgcgcacgaggccggcugg

SEQ ID NO: 127580 - RNA, 22 nt, Mycobacterium avium subsp. paratuberculosis
cgucgcgaccaguggcggcguu

SEQ ID NO: 127581 - RNA, 22 nt, Mycobacterium avium subsp. paratuberculosis
cgccugcucgcugggcaugcug

SEQ ID NO: 127582 - RNA, 22 nt, Mycobacterium avium subsp. paratuberculosis
agccgcaacguuugauuuugug

SEQ ID NO: 127583 - RNA, 22 nt, Mycobacterium avium subsp. paratuberculosis
ugccgguggaucugcgccacga

SEQ ID NO: 127584 - RNA, 22 nt, Mycobacterium avium subsp. paratuberculosis
ggccgaccuggguuguuucggc

SEQ ID NO: 127585 - RNA, 22 nt, Mycobacterium avium subsp. paratuberculosis
accgggaugacguuguggcccg

SEQ ID NO: 127586 - RNA, 21 nt, Mycobacterium avium subsp. paratuberculosis
cgguggucaugagccgcuugu

SEQ ID NO: 127587 - RNA, 22 nt, Mycobacterium avium subsp. paratuberculosis
ucggcggaauggaaagcgggac

SEQ ID NO: 127588 - RNA, 22 nt, Mycobacterium avium subsp. paratuberculosis
ugggcgaccaccugagcccggu

SEQ ID NO: 127589 - RNA, 22 nt, Mycobacterium avium subsp. paratuberculosis
gcguggucgcggugaacagcug

SEQ ID NO: 127590 - RNA, 22 nt, Mycobacterium avium subsp. paratuberculosis
gacggugcagcgcucaucuacu

SEQ ID NO: 127591 - RNA, 22 nt, Mycobacterium avium subsp. paratuberculosis
uggaggaagagcaggugugcac

SEQ ID NO: 127592 - RNA, 22 nt, Mycobacterium avium subsp. paratuberculosis
cgaccauuggucggcgggugug

SEQ ID NO: 127593 - RNA, 22 nt, Mycobacterium avium subsp. paratuberculosis
ccaccgggcgcggagcgaucgg

SEQ ID NO: 127594 - RNA, 22 nt, Mycobacterium avium subsp. paratuberculosis
gggguucaucuccgcggcgucg

SEQ ID NO: 127595 - RNA, 22 nt, Mycobacterium avium subsp. paratuberculosis
cgagcgccuccucgaccagaug

SEQ ID NO: 127596 - RNA, 22 nt, Mycobacterium avium subsp. paratuberculosis
accccggugaccguggcguagc

SEQ ID NO: 127597 - RNA, 22 nt, Mycobacterium avium subsp. paratuberculosis
cgcgagagugcaacuagcgacg

SEQ ID NO: 127598 - RNA, 22 nt, Mycobacterium avium subsp. paratuberculosis
ucgaugaugccccgcacgauuu

SEQ ID NO: 127599 - RNA, 22 nt, Mycobacterium avium subsp. paratuberculosis
accugcacuucucgcugcugcc

SEQ ID NO: 127600 - RNA, 22 nt, Mycobacterium avium subsp. paratuberculosis
gugacgaucacgucgccggggc

SEQ ID NO: 127601 - RNA, 22 nt, Mycobacterium avium subsp. paratuberculosis
augucggcaacccgaaauggau

SEQ ID NO: 127602 - RNA, 22 nt, Mycobacterium avium subsp. paratuberculosis
ucgcgcaucagcaccuugcacg

SEQ ID NO: 127603 - RNA, 22 nt, Mycobacterium avium subsp. paratuberculosis
ggucggcgaugccgucggcgag

SEQ ID NO: 127604 - RNA, 19 nt, Mycobacterium avium subsp. paratuberculosis
cucgucgagucguacccgc

SEQ ID NO: 127605 - RNA, 22 nt, Mycobacterium avium subsp. paratuberculosis
guagccggugagccgcggugcg

SEQ ID NO: 127606 - RNA, 22 nt, Mycobacterium avium subsp. paratuberculosis
agccgggcgugcucguuggcgu

SEQ ID NO: 127607 - RNA, 22 nt, Mycobacterium avium subsp. paratuberculosis
uguugugcgagaugggcagcgg

SEQ ID NO: 127608 - RNA, 22 nt, Mycobacterium avium subsp. paratuberculosis
ccacgcuggcgugacgcucggc

SEQ ID NO: 127609 - RNA, 22 nt, Mycobacterium avium subsp. paratuberculosis
gcgccguucauggucaucgaca

SEQ ID NO: 127610 - RNA, 22 nt, Mycobacterium avium subsp. paratuberculosis
ugucgaucgacuaccggcuggc

SEQ ID NO: 127611 - RNA, 22 nt, Mycobacterium avium subsp. paratuberculosis
gcgcucguaacgccacggcgga

SEQ ID NO: 127612 - RNA, 22 nt, Mycobacterium avium subsp. paratuberculosis
gagacggucggggugggccagu

SEQ ID NO: 127613 - RNA, 22 nt, Mycobacterium avium subsp. paratuberculosis
gccgaacguguagcuguugcga

SEQ ID NO: 127614 - RNA, 22 nt, Mycobacterium avium subsp. paratuberculosis
cgugcggcgugaucuugucgau

SEQ ID NO: 127615 - RNA, 22 nt, Mycobacterium avium subsp. paratuberculosis
guccugguuggugaucggcugc

SEQ ID NO: 127616 - RNA, 22 nt, Mycobacterium avium subsp. paratuberculosis
ggccgcgucgucacccaguggc

SEQ ID NO: 127617 - RNA, 22 nt, Mycobacterium avium subsp. paratuberculosis
gcucgagcauguucgccauggu

SEQ ID NO: 127618 - RNA, 22 nt, Mycobacterium avium subsp. paratuberculosis
ccgcgggauggaucggcugccg

SEQ ID NO: 127619 - RNA, 22 nt, Mycobacterium avium subsp. paratuberculosis
accggccaccggguccggcggu

SEQ ID NO: 127620 - RNA, 22 nt, Mycobacterium avium subsp. paratuberculosis
gcgcgucguccucguuguggua

SEQ ID NO: 127621 - RNA, 22 nt, Mycobacterium avium subsp. paratuberculosis
gucgccggagguggcgaagccg

SEQ ID NO: 127622 - RNA, 22 nt, Mycobacterium avium subsp. paratuberculosis
accggugagccgggaauggcga

SEQ ID NO: 127623 - RNA, 22 nt, Mycobacterium avium subsp. paratuberculosis
gagcgugcaaccacugcgaaaa

SEQ ID NO: 127624 - RNA, 22 nt, Mycobacterium avium subsp. paratuberculosis
gcgggccgucgaacucggggug

SEQ ID NO: 127625 - RNA, 22 nt, Mycobacterium avium subsp. paratuberculosis
ugcgugcacaucccgaccgcgc

SEQ ID NO: 127626 - RNA, 18 nt, Mycobacterium avium subsp. paratuberculosis
uggugccggccgaccucg

SEQ ID NO: 127627 - RNA, 22 nt, Mycobacterium avium subsp. paratuberculosis
ccgucgucgacgccgcgcaguu

SEQ ID NO: 127628 - RNA, 22 nt, Mycobacterium avium subsp. paratuberculosis
cccggugggccggaccguuggu

SEQ ID NO: 127629 - RNA, 22 nt, Mycobacterium avium subsp. paratuberculosis
gaacgggugcacauggucggca

SEQ ID NO: 127630 - RNA, 22 nt, Mycobacterium avium subsp. paratuberculosis
cgaccggccgcacgacuuccag

SEQ ID NO: 127631 - RNA, 22 nt, Mycobacterium avium subsp. paratuberculosis
cagccgauuggugccgaccacc

SEQ ID NO: 127632 - RNA, 22 nt, Mycobacterium avium subsp. paratuberculosis
cgcgcggguaggucgccgccuc

SEQ ID NO: 127633 - RNA, 22 nt, Mycobacterium avium subsp. paratuberculosis
acagguucgacgugcccgcggc

SEQ ID NO: 127634 - RNA, 22 nt, Mycobacterium avium subsp. paratuberculosis
ucaacgccaugagcgacgccga

SEQ ID NO: 127635 - RNA, 22 nt, Mycobacterium avium subsp. paratuberculosis
gaccgcguugugccgaccgacg

SEQ ID NO: 127636 - RNA, 22 nt, Mycobacterium avium subsp. paratuberculosis
uggcccgcaccgucgucgcgcu

SEQ ID NO: 127637 - RNA, 22 nt, Mycobacterium avium subsp. paratuberculosis
gcgccacggccagcaugcugga

SEQ ID NO: 127638 - RNA, 19 nt, Mycobacterium avium subsp. paratuberculosis
gucgucgaauuucccggcc

SEQ ID NO: 127639 - RNA, 22 nt, Mycobacterium avium subsp. paratuberculosis
ccgcugauccgcugcugcacga

SEQ ID NO: 127640 - RNA, 22 nt, Mycobacterium avium subsp. paratuberculosis
ccagcgcgguggcgcccagcgu

SEQ ID NO: 127641 - RNA, 22 nt, Mycobacterium avium subsp. paratuberculosis
uugcccgggaucaccgcguugu

SEQ ID NO: 127642 - RNA, 22 nt, Mycobacterium avium subsp. paratuberculosis
cucucccgcgagcacgcggugg

SEQ ID NO: 127643 - RNA, 22 nt, Mycobacterium avium subsp. paratuberculosis
guggugggccagccgcggcgcu

SEQ ID NO: 127644 - RNA, 22 nt, Mycobacterium avium subsp. paratuberculosis
gccgagcgucacgccagcgugg

SEQ ID NO: 127645 - RNA, 22 nt, Mycobacterium avium subsp. paratuberculosis
aucgggauggcgccgucgccgg

SEQ ID NO: 127646 - RNA, 22 nt, Mycobacterium avium subsp. paratuberculosis
ccggccauguucagcaugcaca

SEQ ID NO: 127647 - RNA, 22 nt, Mycobacterium avium subsp. paratuberculosis
uccguccaggguggcgagcacg

SEQ ID NO: 127648 - RNA, 22 nt, Mycobacterium avium subsp. paratuberculosis
cguggccgggcugcuugggcuu

SEQ ID NO: 127649 - RNA, 22 nt, Mycobacterium avium subsp. paratuberculosis
ugggcgacuucauggcggccac

SEQ ID NO: 127650 - RNA, 18 nt, Mycobacterium avium subsp. paratuberculosis
ggcacggcuucgggacag

SEQ ID NO: 127651 - RNA, 22 nt, Mycobacterium avium subsp. paratuberculosis
acgucgaccgcaguggugauga

SEQ ID NO: 127652 - RNA, 22 nt, Mycobacterium avium subsp. paratuberculosis
gggucgucgaugacggcgcgca

SEQ ID NO: 127653 - RNA, 22 nt, Mycobacterium avium subsp. paratuberculosis
ccggcggugaucgguagggccg

SEQ ID NO: 127654 - RNA, 22 nt, Mycobacterium avium subsp. paratuberculosis
gaacaccgccgugccggccagc

SEQ ID NO: 127655 - RNA, 22 nt, Mycobacterium avium subsp. paratuberculosis
ccgcgggccaggucgucaccgc

SEQ ID NO: 127656 - RNA, 22 nt, Mycobacterium avium subsp. paratuberculosis
gcuggccuaccggcuuuccggc

SEQ ID NO: 127657 - RNA, 22 nt, Mycobacterium avium subsp. paratuberculosis
ucggcggguucgucgucguugc

SEQ ID NO: 127658 - RNA, 22 nt, Mycobacterium avium subsp. paratuberculosis
ucgaacaucguuguggcacagc

SEQ ID NO: 127659 - RNA, 22 nt, Mycobacterium avium subsp. paratuberculosis
agcgggguuuuugauugcgcgg

SEQ ID NO: 127660 - RNA, 22 nt, Mycobacterium avium subsp. paratuberculosis
gauccugguguugcugcgggcc

SEQ ID NO: 127661 - RNA, 22 nt, Mycobacterium avium subsp. paratuberculosis
agcagacgcaaaagccccucga

SEQ ID NO: 127662 - RNA, 22 nt, Mycobacterium avium subsp. paratuberculosis
agccgcaccgccacgguguggc

SEQ ID NO: 127663 - RNA, 22 nt, Mycobacterium avium subsp. paratuberculosis
cgcgagcagacgcaaaagcucc

SEQ ID NO: 127664 - RNA, 22 nt, Mycobacterium avium subsp. paratuberculosis
ugggccgggcccaucgcuuuuc

SEQ ID NO: 127665 - RNA, 22 nt, Mycobacterium avium subsp. paratuberculosis
ugcucugcgggcagacucgaua

SEQ ID NO: 127666 - RNA, 22 nt, Mycobacterium avium subsp. paratuberculosis
aaggacuaugccaccuacggau

SEQ ID NO: 127667 - RNA, 22 nt, Mycobacterium avium subsp. paratuberculosis
gcugcaccgcggugaucggcag

SEQ ID NO: 127668 - RNA, 22 nt, Mycobacterium avium subsp. paratuberculosis
acguagcuggggaucugcucgc

SEQ ID NO: 127669 - RNA, 22 nt, Mycobacterium avium subsp. paratuberculosis
gucccggugaugaacgcgccgu

SEQ ID NO: 127670 - RNA, 22 nt, Mycobacterium avium subsp. paratuberculosis
cggcgcacgucggucacuuugg

SEQ ID NO: 127671 - RNA, 22 nt, Mycobacterium avium subsp. paratuberculosis
gcccgccgagggcgacgauguu

SEQ ID NO: 127672 - RNA, 22 nt, Mycobacterium avium subsp. paratuberculosis
uggcgaugaugcuggucggguu

SEQ ID NO: 127673 - RNA, 22 nt, Mycobacterium avium subsp. paratuberculosis
gucgccgggguccgccccgaau

SEQ ID NO: 127674 - RNA, 22 nt, Mycobacterium avium subsp. paratuberculosis
cggcggucacgcuggcgugacg

SEQ ID NO: 127675 - RNA, 22 nt, Mycobacterium avium subsp. paratuberculosis
ucgcggugguugcacgcucggc

SEQ ID NO: 127676 - RNA, 22 nt, Mycobacterium avium subsp. paratuberculosis
gucgaucucguguugcaggucg

SEQ ID NO: 127677 - RNA, 22 nt, Mycobacterium avium subsp. paratuberculosis
uggaugaauccgucggacauca

SEQ ID NO: 127678 - RNA, 22 nt, Mycobacterium avium subsp. paratuberculosis
agcggcgcgaucucggccacgg

SEQ ID NO: 127679 - RNA, 22 nt, Mycobacterium avium subsp. paratuberculosis
ggcucggugcugcccgccauca

SEQ ID NO: 127680 - RNA, 22 nt, Mycobacterium avium subsp. paratuberculosis
cgaugccgaccgggaccgcgcc

SEQ ID NO: 127681 - RNA, 22 nt, Mycobacterium avium subsp. paratuberculosis
agcgccuacgcccguggcgacg

SEQ ID NO: 127682 - RNA, 22 nt, Mycobacterium avium subsp. paratuberculosis
gagaaccaguccucgggcguca

SEQ ID NO: 127683 - RNA, 22 nt, Mycobacterium avium subsp. paratuberculosis
ccuuggccuugcucaucacgac

SEQ ID NO: 127684 - RNA, 22 nt, Mycobacterium avium subsp. paratuberculosis
aggcgggugacgcuccagccgg

SEQ ID NO: 127685 - RNA, 22 nt, Mycobacterium avium subsp. paratuberculosis
ucaggaucagcucggccgucgg

SEQ ID NO: 127686 - RNA, 22 nt, Mycobacterium avium subsp. paratuberculosis
cacaccgagcgagcgcaccaga

SEQ ID NO: 127687 - RNA, 22 nt, Mycobacterium avium subsp. paratuberculosis
cgcuguccaucaucaccgggcu

SEQ ID NO: 127688 - RNA, 22 nt, Mycobacterium avium subsp. paratuberculosis
gccucgaggaccuggauucggc

SEQ ID NO: 127689 - RNA, 22 nt, Mycobacterium avium subsp. paratuberculosis
gccgacuggaggccgcccggca

SEQ ID NO: 127690 - RNA, 22 nt, Mycobacterium avium subsp. paratuberculosis
acaacguggugguggugcugca

SEQ ID NO: 127691 - RNA, 21 nt, Mycobacterium avium subsp. paratuberculosis
uggaucccaaguccucgagcg

SEQ ID NO: 127692 - RNA, 22 nt, Mycobacterium avium subsp. paratuberculosis
ucugggcgauccugugcaccgu

SEQ ID NO: 127693 - RNA, 22 nt, Mycobacterium avium subsp. paratuberculosis
uaucgcggugagugcacgcucg

SEQ ID NO: 127694 - RNA, 22 nt, Mycobacterium avium subsp. paratuberculosis
cgacacagcucgcugauccgca

SEQ ID NO: 127695 - RNA, 21 nt, Mycobacterium avium subsp. paratuberculosis
cgggugcuuuugugucugcuc

SEQ ID NO: 127696 - RNA, 22 nt, Mycobacterium avium subsp. paratuberculosis
ccgaggagaucggcgcgccgcc

SEQ ID NO: 127697 - RNA, 22 nt, Mycobacterium avium subsp. paratuberculosis
gagcgucacgccagcgugacgc

SEQ ID NO: 127698 - RNA, 22 nt, Mycobacterium avium subsp. paratuberculosis
gggcgagaugagucccggcgau

SEQ ID NO: 127699 - RNA, 22 nt, Mycobacterium avium subsp. paratuberculosis
aacucgggacucggcggaucgg

SEQ ID NO: 127700 - RNA, 22 nt, Mycobacterium avium subsp. paratuberculosis
ugcugcaggagaccacccggga

SEQ ID NO: 127701 - RNA, 22 nt, Mycobacterium avium subsp. paratuberculosis
acccgcagcggacggguggugc

SEQ ID NO: 127702 - RNA, 22 nt, Mycobacterium avium subsp. paratuberculosis
gccgccggugcugaccaccggc

SEQ ID NO: 127703 - RNA, 22 nt, Mycobacterium avium subsp. paratuberculosis
gcccaacaacucgacgcuggcc

SEQ ID NO: 127704 - RNA, 22 nt, Mycobacterium avium subsp. paratuberculosis
aaguaucuagaugaauucagug

SEQ ID NO: 127705 - RNA, 22 nt, Mycobacterium avium subsp. paratuberculosis
acagaugucaauagugugaguu

SEQ ID NO: 127706 - RNA, 19 nt, Mycobacterium avium subsp. paratuberculosis
acugcgacgaucaaccggc

SEQ ID NO: 127707 - RNA, 22 nt, Mycobacterium avium subsp. paratuberculosis
accagcaguaugggcgccgguu

SEQ ID NO: 127708 - RNA, 22 nt, Mycobacterium avium subsp. paratuberculosis
acugccacaacgacucccgcgu

SEQ ID NO: 127709 - RNA, 22 nt, Mycobacterium avium subsp. paratuberculosis
accacgaggaccagcgucgcga

SEQ ID NO: 127710 - RNA, 18 nt, Mycobacterium avium subsp. paratuberculosis
accacccaggagaucguc

SEQ ID NO: 127711 - RNA, 22 nt, Mycobacterium avium subsp. paratuberculosis
agggucuaguugaacgagucgc

SEQ ID NO: 127712 - RNA, 22 nt, Mycobacterium avium subsp. paratuberculosis
agggccgcaucucggcgggcgu

SEQ ID NO: 127713 - RNA, 22 nt, Mycobacterium avium subsp. paratuberculosis
aguccuugaccaggaacuucag

SEQ ID NO: 127714 - RNA, 22 nt, Mycobacterium avium subsp. paratuberculosis
aucaccugcaugagcugguggc

SEQ ID NO: 127715 - RNA, 22 nt, Mycobacterium avium subsp. paratuberculosis
auggcagcagcaucgugguggc

SEQ ID NO: 127716 - RNA, 22 nt, Mycobacterium avium subsp. paratuberculosis
auggcagcggauccucgacauc

SEQ ID NO: 127717 - RNA, 22 nt, Mycobacterium avium subsp. paratuberculosis
augugcagcgcgucggcgaguu

SEQ ID NO: 127718 - RNA, 22 nt, Mycobacterium avium subsp. paratuberculosis
auggcgaucggcgggcacggcc

SEQ ID NO: 127719 - RNA, 22 nt, Mycobacterium avium subsp. paratuberculosis
auggucaggaugucgaccucga

SEQ ID NO: 127720 - RNA, 22 nt, Mycobacterium avium subsp. paratuberculosis
cagccgccucgacgacgaagcc

SEQ ID NO: 127721 - RNA, 21 nt, Mycobacterium avium subsp. paratuberculosis
cagcccagcgagauggccggc

SEQ ID NO: 127722 - RNA, 22 nt, Mycobacterium avium subsp. paratuberculosis
cagcccaguguagacggccagc

SEQ ID NO: 127723 - RNA, 22 nt, Mycobacterium avium subsp. paratuberculosis
cagcaugucgaucgaccagguc

SEQ ID NO: 127724 - RNA, 22 nt, Mycobacterium avium subsp. paratuberculosis
cagcgucuuggcccccugcucg

SEQ ID NO: 127725 - RNA, 22 nt, Mycobacterium avium subsp. paratuberculosis
cagcggccggucggcgaggacg

SEQ ID NO: 127726 - RNA, 20 nt, Mycobacterium avium subsp. paratuberculosis
caagggaguauucgggguuc

SEQ ID NO: 127727 - RNA, 22 nt, Mycobacterium avium subsp. paratuberculosis
cacgaugcuggagaucaccagg

SEQ ID NO: 127728 - RNA, 22 nt, Mycobacterium avium subsp. paratuberculosis
cacgcacugaccgggcugcagg

SEQ ID NO: 127729 - RNA, 23 nt, Mycobacterium avium subsp. paratuberculosis
cacgccagcgugacgcucggugc

SEQ ID NO: 127730 - RNA, 22 nt, Mycobacterium avium subsp. paratuberculosis
caauuucuacgugaugcgcaac

SEQ ID NO: 127731 - RNA, 22 nt, Mycobacterium avium subsp. paratuberculosis
cacaggugaucaucgaugcggc

SEQ ID NO: 127732 - RNA, 22 nt, Mycobacterium avium subsp. paratuberculosis
caccagcaggauugggacgucg

SEQ ID NO: 127733 - RNA, 22 nt, Mycobacterium avium subsp. paratuberculosis
uguccaggugguuggucggcuc

SEQ ID NO: 127734 - RNA, 22 nt, Mycobacterium avium subsp. paratuberculosis
uguccgcagaucgagcagccgu

SEQ ID NO: 127735 - RNA, 22 nt, Mycobacterium avium subsp. paratuberculosis
uggcuggccgucaucaccggcg

SEQ ID NO: 127736 - RNA, 22 nt, Mycobacterium avium subsp. paratuberculosis
uggcugaccagaaagucgacca

SEQ ID NO: 127737 - RNA, 23 nt, Mycobacterium avium subsp. paratuberculosis
ugcacgucugccucgccgacccc

SEQ ID NO: 127738 - RNA, 22 nt, Mycobacterium avium subsp. paratuberculosis
uccauucucggccgggugcaca

SEQ ID NO: 127739 - RNA, 22 nt, Mycobacterium avium subsp. paratuberculosis
uccacccgcagagaucccaagg

SEQ ID NO: 127740 - RNA, 22 nt, Mycobacterium avium subsp. paratuberculosis
uccaccgcccaggucgaugcgc

SEQ ID NO: 127741 - RNA, 22 nt, Mycobacterium avium subsp. paratuberculosis
ucagguugguggcucccaguau

SEQ ID NO: 127742 - RNA, 22 nt, Mycobacterium avium subsp. paratuberculosis
uccuggucgugacgggcaucga

SEQ ID NO: 127743 - RNA, 19 nt, Mycobacterium avium subsp. paratuberculosis
ucugcaggguggcccaguu

SEQ ID NO: 127744 - RNA, 22 nt, Mycobacterium avium subsp. paratuberculosis
ucucauuccugagacuuucuug

SEQ ID NO: 127745 - RNA, 23 nt, Mycobacterium avium subsp. paratuberculosis
ucuggccucggagccgccgagcc

SEQ ID NO: 127746 - RNA, 22 nt, Mycobacterium avium subsp. paratuberculosis
ucugcauucgaaaguacuauuu

SEQ ID NO: 127747 - RNA, 22 nt, Mycobacterium avium subsp. paratuberculosis
ucugccaacauaagagccgacg

SEQ ID NO: 127748 - RNA, 22 nt, Mycobacterium avium subsp. paratuberculosis
ugaccugcgaccaggaccgguc

SEQ ID NO: 127749 - RNA, 22 nt, Mycobacterium avium subsp. paratuberculosis
ugacgccaguucuccgcgccga

SEQ ID NO: 127750 - RNA, 22 nt, Mycobacterium avium subsp. paratuberculosis
ucaggcuggaagugcucggcuu

SEQ ID NO: 127751 - RNA, 22 nt, Mycobacterium avium subsp. paratuberculosis
gggucaccggauggucgaugac

SEQ ID NO: 127752 - RNA, 22 nt, Mycobacterium avium subsp. paratuberculosis
gggguucaucuccgcggcgucg

SEQ ID NO: 127753 - RNA, 22 nt, Mycobacterium avium subsp. paratuberculosis
gggugcuuucgcgucugcucgc

SEQ ID NO: 127754 - RNA, 22 nt, Mycobacterium avium subsp. paratuberculosis
ggguggagugguugaccgacga

SEQ ID NO: 127755 - RNA, 20 nt, Mycobacterium avium subsp. paratuberculosis
gugcacaucgacccggcgga

SEQ ID NO: 127756 - RNA, 22 nt, Mycobacterium avium subsp. paratuberculosis
guggccacgaucgccgcggugg

SEQ ID NO: 127757 - RNA, 22 nt, Mycobacterium avium subsp. paratuberculosis
gugggcagcgugcgcaucgggg

SEQ ID NO: 127758 - RNA, 22 nt, Mycobacterium avium subsp. paratuberculosis
gugggcugucggugaccuggcu

SEQ ID NO: 127759 - RNA, 22 nt, Mycobacterium avium subsp. paratuberculosis
gugccccagcagcucggugagc

SEQ ID NO: 127760 - RNA, 22 nt, Mycobacterium avium subsp. paratuberculosis
gugcuuuugcgucugcucgcca

SEQ ID NO: 127761 - RNA, 22 nt, Mycobacterium avium subsp. paratuberculosis
gugcucacgcugcugcuggccg

SEQ ID NO: 127762 - RNA, 22 nt, Mycobacterium avium subsp. paratuberculosis
ggcugauuuugcgggccgcccg

SEQ ID NO: 127763 - RNA, 22 nt, Mycobacterium avium subsp. paratuberculosis
ggcuugacaucuauuccggacu

SEQ ID NO: 127764 - RNA, 22 nt, Mycobacterium avium subsp. paratuberculosis
ggcuugaggucgucgcggucac

SEQ ID NO: 127765 - RNA, 22 nt, Mycobacterium avium subsp. paratuberculosis
gggcuuggcgcagcgccgcaua

SEQ ID NO: 127766 - RNA, 22 nt, Mycobacterium avium subsp. paratuberculosis
gggcgcuggcgcuggacagcga

SEQ ID NO: 127767 - RNA, 22 nt, Mycobacterium avium subsp. paratuberculosis
gggcggcacggugacggccagg

SEQ ID NO: 127768 - RNA, 22 nt, Mycobacterium avium subsp. paratuberculosis
gggaugugcugcagguugaucc

SEQ ID NO: 127769 - RNA, 22 nt, Mycobacterium avium subsp. paratuberculosis
gggcagaugcagauacggcucg

SEQ ID NO: 127770 - RNA, 22 nt, Mycobacterium avium subsp. paratuberculosis
gccagguuguuguuggugcggc

SEQ ID NO: 127771 - RNA, 22 nt, Mycobacterium avium subsp. paratuberculosis
gccauuuucccgagucccggca

SEQ ID NO: 127772 - RNA, 22 nt, Mycobacterium avium subsp. paratuberculosis
gcccgccucugagcgacaauca

SEQ ID NO: 127773 - RNA, 22 nt, Mycobacterium avium subsp. paratuberculosis
gcauggcccugcccgucgucag

SEQ ID NO: 127774 - RNA, 22 nt, Mycobacterium avium subsp. paratuberculosis
gccagcacccgcaacagcuguu

SEQ ID NO: 127775 - RNA, 22 nt, Mycobacterium avium subsp. paratuberculosis
gccagcaccgcgcugugcgugg

SEQ ID NO: 127776 - RNA, 22 nt, Mycobacterium avium subsp. paratuberculosis
gccacccugcugggcaugcugg

SEQ ID NO: 127777 - RNA, 22 nt, Mycobacterium avium subsp. paratuberculosis
gaccagguuggucaccggcacc

SEQ ID NO: 127778 - RNA, 22 nt, Mycobacterium avium subsp. paratuberculosis
gaccugcagccggaugugcuga

SEQ ID NO: 127779 - RNA, 22 nt, Mycobacterium avium subsp. paratuberculosis
gaccugcucgacgggugggugg

SEQ ID NO: 127780 - RNA, 22 nt, Mycobacterium avium subsp. paratuberculosis
gacgaggguggucaugacuguu

SEQ ID NO: 127781 - RNA, 20 nt, Mycobacterium avium subsp. paratuberculosis
gacguucuccacgcugcggc

SEQ ID NO: 127782 - RNA, 22 nt, Mycobacterium avium subsp. paratuberculosis
gcagcaggacgagcucaccucg

SEQ ID NO: 127783 - RNA, 22 nt, Mycobacterium avium subsp. paratuberculosis
gcagcauguccugccggcgggu

SEQ ID NO: 127784 - RNA, 22 nt, Mycobacterium avium subsp. paratuberculosis
gcagcgucgguagaugcacucu

SEQ ID NO: 127785 - RNA, 22 nt, Mycobacterium avium subsp. paratuberculosis
gcagcgucuccagcagcucgcg

SEQ ID NO: 127786 - RNA, 22 nt, Mycobacterium avium subsp. paratuberculosis
gcagcuuguccaagagccggcc

SEQ ID NO: 127787 - RNA, 22 nt, Mycobacterium avium subsp. paratuberculosis
gcugaaccugauccucaagggc

SEQ ID NO: 127788 - RNA, 22 nt, Mycobacterium avium subsp. paratuberculosis
gcugcaccgcggugaucggcag

SEQ ID NO: 127789 - RNA, 22 nt, Mycobacterium avium subsp. paratuberculosis
gcugcaucgcgaaccggucgcc

SEQ ID NO: 127790 - RNA, 19 nt, Mycobacterium avium subsp. paratuberculosis
gcugggccuggucgcgucc

SEQ ID NO: 127791 - RNA, 22 nt, Mycobacterium avium subsp. paratuberculosis
gcugcugagcgccgccgagacg

SEQ ID NO: 127792 - RNA, 22 nt, Mycobacterium avium subsp. paratuberculosis
ggcagcagcgagaagugcaggu

SEQ ID NO: 127793 - RNA, 22 nt, Mycobacterium avium subsp. paratuberculosis
ggccgcugcuggccggggagag

SEQ ID NO: 127794 - RNA, 22 nt, Mycobacterium avium subsp. paratuberculosis
ggccuggucaucgagcuggcgg

SEQ ID NO: 127795 - RNA, 22 nt, Mycobacterium avium subsp. paratuberculosis
ggcgagcucaaggucgaacugg

SEQ ID NO: 127796 - RNA, 22 nt, Mycobacterium avium subsp. paratuberculosis
ggcgagcagacgcaaaagcccc

SEQ ID NO: 127797 - RNA, 22 nt, Mycobacterium avium subsp. paratuberculosis
ggcgccacgcggaaucgccagc

SEQ ID NO: 127798 - RNA, 22 nt, Mycobacterium avium subsp. paratuberculosis
ggcgcgggcgucccgguggugc

SEQ ID NO: 127799 - RNA, 22 nt, Mycobacterium avium subsp. paratuberculosis
cucgcugguggccgcggugcug

SEQ ID NO: 127800 - RNA, 22 nt, Mycobacterium avium subsp. paratuberculosis
cugaucugaacccggcgcacca

SEQ ID NO: 127801 - RNA, 20 nt, Mycobacterium avium subsp. paratuberculosis
cugccccggcgggauggcga

SEQ ID NO: 127802 - RNA, 22 nt, Mycobacterium avium subsp. paratuberculosis
cugcccgggcccgauggcggcc

SEQ ID NO: 127803 - RNA, 22 nt, Mycobacterium avium subsp. paratuberculosis
cucacgccgucggugcugggcc

SEQ ID NO: 127804 - RNA, 22 nt, Mycobacterium avium subsp. paratuberculosis
cuccuggaagccggccgcgacg

SEQ ID NO: 127805 - RNA, 22 nt, Mycobacterium avium subsp. paratuberculosis
cuucuugcgauugcggcuggcg

SEQ ID NO: 127806 - RNA, 22 nt, Mycobacterium avium subsp. paratuberculosis
cuuugaaauaggcgugcaggcg

SEQ ID NO: 127807 - RNA, 22 nt, Mycobacterium avium subsp. paratuberculosis
gaaagugcaaccagcgacgugu

SEQ ID NO: 127808 - RNA, 22 nt, Mycobacterium avium subsp. paratuberculosis
cgcagcauuucuucgaucgcgg

SEQ ID NO: 127809 - RNA, 22 nt, Mycobacterium avium subsp. paratuberculosis
caggucuuccagaaggcggucg

SEQ ID NO: 127810 - RNA, 22 nt, Mycobacterium avium subsp. paratuberculosis
caguuccucgucgcagucggcg

SEQ ID NO: 127811 - RNA, 22 nt, Mycobacterium avium subsp. paratuberculosis
caggcuggcaucgucggcgccg

SEQ ID NO: 127812 - RNA, 22 nt, Mycobacterium avium subsp. paratuberculosis
cgaccugcggccgucggaugcg

SEQ ID NO: 127813 - RNA, 22 nt, Mycobacterium avium subsp. paratuberculosis
uuacuuaucgguaagucaguua

SEQ ID NO: 127814 - RNA, 23 nt, Mycobacterium avium subsp. paratuberculosis
ugugcuuccgggugucgucggac

SEQ ID NO: 127815 - RNA, 22 nt, Mycobacterium avium subsp. paratuberculosis
ugugggaugaggugcaggugca

SEQ ID NO: 127816 - RNA, 22 nt, Mycobacterium avium subsp. paratuberculosis
aacgugaagcuaguuucacguu

SEQ ID NO: 127817 - RNA, 22 nt, Mycobacterium avium subsp. paratuberculosis
aacgugcugcagcaugcgacgg

SEQ ID NO: 127818 - RNA, 22 nt, Mycobacterium avium subsp. paratuberculosis
aagcaguacgcgaugucggauc

SEQ ID NO: 127819 - RNA, 22 nt, Mycobacterium avium subsp. paratuberculosis
acgagcuguggguuuccaggua

SEQ ID NO: 127820 - RNA, 22 nt, Mycobacterium avium subsp. paratuberculosis
acgccgugguacuccggcgcga

SEQ ID NO: 127821 - RNA, 22 nt, Mycobacterium avium subsp. paratuberculosis
acccggcugggcgccuacgcgc

SEQ ID NO: 127822 - RNA, 22 nt, Mycobacterium avium subsp. paratuberculosis
accggcaucaccacggcgaugg

SEQ ID NO: 127823 - RNA, 22 nt, Mycobacterium avium subsp. paratuberculosis
accuugacguccucaucguggg

SEQ ID NO: 127824 - RNA, 22 nt, Mycobacterium avium subsp. paratuberculosis
aauccacaucgccgacggcgug

SEQ ID NO: 127825 - RNA, 22 nt, Mycobacterium avium subsp. paratuberculosis
agagucucaugggcaucaucgg

SEQ ID NO: 127826 - RNA, 22 nt, Mycobacterium avium subsp. paratuberculosis
agagcuccagcgagaacgggcc

SEQ ID NO: 127827 - RNA, 22 nt, Mycobacterium avium subsp. paratuberculosis
agaggaacaucgcgauggcccu

SEQ ID NO: 127828 - RNA, 20 nt, Mycobacterium avium subsp. paratuberculosis
acgucccaauccugcuggug

SEQ ID NO: 127829 - RNA, 22 nt, Mycobacterium avium subsp. paratuberculosis
agcguggacuaguugcgcgauc

SEQ ID NO: 127830 - RNA, 22 nt, Mycobacterium avium subsp. paratuberculosis
agcggcagcaccagauggcggc

SEQ ID NO: 127831 - RNA, 22 nt, Mycobacterium avium subsp. paratuberculosis
agcugcgccggacgggcuaccu

SEQ ID NO: 127832 - RNA, 22 nt, Mycobacterium avium subsp. paratuberculosis
agcuguccggcucgcugcugcc

SEQ ID NO: 127833 - RNA, 22 nt, Mycobacterium avium subsp. paratuberculosis
agcagguggugcgcugcagcga

SEQ ID NO: 127834 - RNA, 22 nt, Mycobacterium avium subsp. paratuberculosis
agcagcaugccgucgcggcgaa

SEQ ID NO: 127835 - RNA, 21 nt, Mycobacterium avium subsp. paratuberculosis
agcaugaagccggugcucagc

SEQ ID NO: 127836 - RNA, 22 nt, Mycobacterium avium subsp. paratuberculosis
agcccggccgcagccuggagcg

SEQ ID NO: 127837 - RNA, 22 nt, Mycobacterium avium subsp. paratuberculosis
agcccggcgaucugcuggcugc

SEQ ID NO: 127838 - RNA, 21 nt, Mycobacterium avium subsp. paratuberculosis
agcagcucgccgagaugggcg

SEQ ID NO: 127839 - RNA, 22 nt, Mycobacterium avium subsp. paratuberculosis
agccgggcgugcucguuggcgu

SEQ ID NO: 127840 - RNA, 22 nt, Mycobacterium avium subsp. paratuberculosis
uuguaugaccucgguugaugcu

SEQ ID NO: 127841 - RNA, 21 nt, Mycobacterium avium subsp. paratuberculosis
uugucaccgccguccggcgac

SEQ ID NO: 127842 - RNA, 22 nt, Mycobacterium avium subsp. paratuberculosis
uuggugguggucgucgacgagc

SEQ ID NO: 127843 - RNA, 22 nt, Mycobacterium avium subsp. paratuberculosis
uuguuuuuggccggauggccgu

SEQ ID NO: 127844 - RNA, 22 nt, Mycobacterium avium subsp. paratuberculosis
uugaucaccgcgguuuccagcu

SEQ ID NO: 127845 - RNA, 22 nt, Mycobacterium avium subsp. paratuberculosis
uugagguugaacuugccggugc

SEQ ID NO: 127846 - RNA, 22 nt, Mycobacterium avium subsp. paratuberculosis
uugaggaucagguucagcuggc

SEQ ID NO: 127847 - RNA, 22 nt, Mycobacterium avium subsp. paratuberculosis
uucagggucucgccgaucaccc

SEQ ID NO: 127848 - RNA, 22 nt, Mycobacterium avium subsp. paratuberculosis
uucugguccuucauccggugcg

SEQ ID NO: 127849 - RNA, 22 nt, Mycobacterium avium subsp. paratuberculosis
uucggcuucggcgucaucuucg

SEQ ID NO: 127850 - RNA, 22 nt, Mycobacterium avium subsp. paratuberculosis
uucggggagcgcgacaccguuu

SEQ ID NO: 127851 - RNA, 18 nt, Mycobacterium avium subsp. paratuberculosis
uggguccaaguauccuga

SEQ ID NO: 127852 - RNA, 22 nt, Mycobacterium avium subsp. paratuberculosis
ugguaacacacgguggugagca

SEQ ID NO: 127853 - RNA, 22 nt, Mycobacterium avium subsp. paratuberculosis
ugggcucagccugcuggucgaa

SEQ ID NO: 127854 - RNA, 22 nt, Mycobacterium avium subsp. paratuberculosis
ugggccaacggaauguagucgg

SEQ ID NO: 127855 - RNA, 22 nt, Mycobacterium avium subsp. paratuberculosis
uggaggaagagcaggugugcac

SEQ ID NO: 127856 - RNA, 22 nt, Mycobacterium avium subsp. paratuberculosis
uggaggaguucgacagucagcu

SEQ ID NO: 127857 - RNA, 22 nt, Mycobacterium avium subsp. paratuberculosis
ugguggugcccggcgucggcgc

SEQ ID NO: 127858 - RNA, 22 nt, Mycobacterium avium subsp. paratuberculosis
ugguggagacggcgacgaaaug

SEQ ID NO: 127859 - RNA, 22 nt, Mycobacterium avium subsp. paratuberculosis
ugguggagcagguccgcgcgca

SEQ ID NO: 127860 - RNA, 22 nt, Mycobacterium avium subsp. paratuberculosis
uuugcaggguggucagguugga

SEQ ID NO: 127861 - RNA, 22 nt, Mycobacterium avium subsp. paratuberculosis
ucaauuccgguggugugcugaa

SEQ ID NO: 127862 - RNA, 22 nt, Mycobacterium avium subsp. paratuberculosis
ucagcucuucgaccgcgguggc

SEQ ID NO: 127863 - RNA, 22 nt, Mycobacterium avium subsp. paratuberculosis
ucagcaggucgaugcgguugcg

SEQ ID NO: 127864 - RNA, 22 nt, Mycobacterium avium subsp. paratuberculosis
ucagccucggccuggacagucg

SEQ ID NO: 127865 - RNA, 22 nt, Mycobacterium avium subsp. paratuberculosis
ucacuauucgcgucucucgacc

SEQ ID NO: 127866 - RNA, 22 nt, Mycobacterium avium subsp. paratuberculosis
ucgcugggcggcagcucggcau

SEQ ID NO: 127867 - RNA, 22 nt, Mycobacterium avium subsp. paratuberculosis
ucgagcagccgaccagcgucac

SEQ ID NO: 127868 - RNA, 22 nt, Mycobacterium avium subsp. paratuberculosis
ucgauguuguggucaacuucca

SEQ ID NO: 127869 - RNA, 22 nt, Mycobacterium avium subsp. paratuberculosis
uggaaaagauggguccgguccg

SEQ ID NO: 127870 - RNA, 22 nt, Mycobacterium avium subsp. paratuberculosis
ugcuggucgagcggaugcaguc

SEQ ID NO: 127871 - RNA, 22 nt, Mycobacterium avium subsp. paratuberculosis
ugcuggccgacauggcgagaau

SEQ ID NO: 127872 - RNA, 22 nt, Mycobacterium avium subsp. paratuberculosis
ugcccggcggugcgccuaccgg

SEQ ID NO: 127873 - RNA, 22 nt, Mycobacterium avium subsp. paratuberculosis
uacauggugcgcagcaccaucg

SEQ ID NO: 127874 - RNA, 22 nt, Mycobacterium avium subsp. paratuberculosis
guugguggaucgucgcgaaguc

SEQ ID NO: 127875 - RNA, 22 nt, Mycobacterium avium subsp. paratuberculosis
guuggagguggccgccagcacg

SEQ ID NO: 127876 - RNA, 22 nt, Mycobacterium avium subsp. paratuberculosis
gucaccaucaguugccacgacg

SEQ ID NO: 127877 - RNA, 22 nt, Mycobacterium avium subsp. paratuberculosis
gucacgccagcgugacgcucgg

SEQ ID NO: 127878 - RNA, 22 nt, Mycobacterium avium subsp. paratuberculosis
gucacgcuagcgugacgcucgc

SEQ ID NO: 127879 - RNA, 22 nt, Mycobacterium avium subsp. paratuberculosis
ggugacgccgcaucugcuggug

SEQ ID NO: 127880 - RNA, 22 nt, Mycobacterium avium subsp. paratuberculosis
gcuucuucgcgcaugcgcugcc

SEQ ID NO: 127881 - RNA, 22 nt, Mycobacterium avium subsp. paratuberculosis
gcguggugaucguguuccccgg

SEQ ID NO: 127882 - RNA, 22 nt, Mycobacterium avium subsp. paratuberculosis
ccugccuggccacguggucgcu

SEQ ID NO: 127883 - RNA, 22 nt, Mycobacterium avium subsp. paratuberculosis
ccuggccgacaccaaccccgaa

SEQ ID NO: 127884 - RNA, 22 nt, Mycobacterium avium subsp. paratuberculosis
cccaggcuggccaggaugccca

SEQ ID NO: 127885 - RNA, 22 nt, Mycobacterium avium subsp. paratuberculosis
ccgacgaguucggccuguucga

SEQ ID NO: 127886 - RNA, 22 nt, Mycobacterium avium subsp. paratuberculosis
ccuugugaccgcgcuguacguc

SEQ ID NO: 127887 - RNA, 22 nt, Mycobacterium avium subsp. paratuberculosis
cgggauggugaccgcggagaug

SEQ ID NO: 127888 - RNA, 22 nt, Mycobacterium avium subsp. paratuberculosis
ccaguucgacggcgucgacgcc

SEQ ID NO: 127889 - RNA, 22 nt, Mycobacterium avium subsp. paratuberculosis
ccaugguggcguccaggaugcg

SEQ ID NO: 127890 - RNA, 22 nt, Mycobacterium avium subsp. paratuberculosis
ccagcucuuggucaccgcgauc

SEQ ID NO: 127891 - RNA, 22 nt, Mycobacterium avium subsp. paratuberculosis
ccagcugguccagcacgucggg

SEQ ID NO: 127892 - RNA, 22 nt, Mycobacterium avium subsp. paratuberculosis
caucugcacgcaggccugcacg

SEQ ID NO: 127893 - RNA, 22 nt, Mycobacterium avium subsp. paratuberculosis
caugaggugacguucgaauccg

SEQ ID NO: 127894 - RNA, 22 nt, Mycobacterium avium subsp. paratuberculosis
ccaacaacucgacguucggcgg

SEQ ID NO: 127895 - RNA, 22 nt, Mycobacterium avium subsp. paratuberculosis
ccaaccgcaucggcagcgccac

SEQ ID NO: 127896 - RNA, 22 nt, Mycobacterium avium subsp. paratuberculosis
ccacagagacucacgcgauggc

SEQ ID NO: 127897 - RNA, 22 nt, Mycobacterium avium subsp. paratuberculosis
gagggccaucgcgugagucucu

SEQ ID NO: 127898 - RNA, 22 nt, Mycobacterium avium subsp. paratuberculosis
gagcucacccggcucgccgugc

SEQ ID NO: 127899 - RNA, 22 nt, Mycobacterium avium subsp. paratuberculosis
gagaaccaguccucgggcguca

SEQ ID NO: 127900 - RNA, 22 nt, Mycobacterium avium subsp. paratuberculosis
gagacgagcgccuguaugaccg

SEQ ID NO: 127901 - RNA, 22 nt, Mycobacterium avium subsp. paratuberculosis
cugggcgcggugguggccgcca

SEQ ID NO: 127902 - RNA, 22 nt, Mycobacterium avium subsp. paratuberculosis
cuggcugacgucagcgacuucg

SEQ ID NO: 127903 - RNA, 22 nt, Mycobacterium avium subsp. paratuberculosis
cuggccagcuugcgggccgacu

SEQ ID NO: 127904 - RNA, 22 nt, Mycobacterium avium subsp. paratuberculosis
cgggccaaccggcuggcccggc

SEQ ID NO: 127905 - RNA, 22 nt, Mycobacterium avium subsp. paratuberculosis
gccugcagauaguccagcgugu

SEQ ID NO: 127906 - RNA, 22 nt, Mycobacterium avium subsp. paratuberculosis
gccugcagcccuggacgucucg

SEQ ID NO: 127907 - RNA, 21 nt, Mycobacterium avium subsp. paratuberculosis
gccugggcaccaggucgacga

SEQ ID NO: 127908 - RNA, 22 nt, Mycobacterium avium subsp. paratuberculosis
gccuccagcgccaucaccagcu

SEQ ID NO: 127909 - RNA, 22 nt, Mycobacterium avium subsp. paratuberculosis
gcgccgcugcaggcugcacucg

SEQ ID NO: 127910 - RNA, 22 nt, Mycobacterium avium subsp. paratuberculosis
gcgguggagcugccgggaaucg

SEQ ID NO: 127911 - RNA, 22 nt, Mycobacterium avium subsp. paratuberculosis
gcaacaaccccacguucggcgu

SEQ ID NO: 127912 - RNA, 22 nt, Mycobacterium avium subsp. paratuberculosis
gaugccuucgacaaggcgaaga

SEQ ID NO: 127913 - RNA, 22 nt, Mycobacterium avium subsp. paratuberculosis
gauggcgacggauucgcggguc

SEQ ID NO: 127914 - RNA, 22 nt, Mycobacterium avium subsp. paratuberculosis
gcaacugcucagccacuccuug

SEQ ID NO: 127915 - RNA, 22 nt, Mycobacterium avium subsp. paratuberculosis
gcacgcugucggccacccggcg

SEQ ID NO: 127916 - RNA, 21 nt, Mycobacterium avium subsp. paratuberculosis
gccguggcguuacgagcgagc

SEQ ID NO: 127917 - RNA, 22 nt, Mycobacterium avium subsp. paratuberculosis
gccguggugguuagcggcauga

SEQ ID NO: 127918 - RNA, 22 nt, Mycobacterium avium subsp. paratuberculosis
gcagcagcuccucgacggcguc

SEQ ID NO: 127919 - RNA, 20 nt, Human
aaaaacaguaaugcugaaga

SEQ ID NO: 127920 - RNA, 22 nt, Human
aaacagcugcaguacacggccu

SEQ ID NO: 127921 - RNA, 22 nt, Human
aaacccaggguuuugucuuccc

SEQ ID NO: 127922 - RNA, 22 nt, Human
aaaagcucucuucuucggcuuu

SEQ ID NO: 127923 - RNA, 22 nt, Human
aaagacagccuguuggcuuucu

SEQ ID NO: 127924 - RNA, 22 nt, Human
aaagaacguuucugggaaucag

SEQ ID NO: 127925 - RNA, 23 nt, Human
aaacuacauuuauaguuuuucuc

SEQ ID NO: 127926 - RNA, 22 nt, Human
aagccucaugccagauccaggu

SEQ ID NO: 127927 - RNA, 22 nt, Human
aagccuguugacagcugucagu

SEQ ID NO: 127928 - RNA, 22 nt, Human
aagcagacugggccauaaggaa

SEQ ID NO: 127929 - RNA, 22 nt, Human
aagcagugacucucagaggcag

SEQ ID NO: 127930 - RNA, 22 nt, Human
aaggagcuuucauuacagccuu

SEQ ID NO: 127931 - RNA, 20 nt, Human
aaggaggcuuaaaguuagaa

SEQ ID NO: 127932 - RNA, 22 nt, Human
aaggaucuuucuuuuuaccauu

SEQ ID NO: 127933 - RNA, 22 nt, Human
aaggcgguuccgguucgcggcg

SEQ ID NO: 127934 - RNA, 22 nt, Human
aaggcgccacagugauugcaaa

SEQ ID NO: 127935 - RNA, 22 nt, Human
aaggcggcggcggcggcugcgg

SEQ ID NO: 127936 - RNA, 22 nt, Human
aaggcgaggggcacagcugaga

SEQ ID NO: 127937 - RNA, 22 nt, Human
aaggcacuugcccagagcugca

SEQ ID NO: 127938 - RNA, 22 nt, Human
aagggaaacagccaggcccugu

SEQ ID NO: 127939 - RNA, 22 nt, Human
aagggggacaagcauuggcuua

SEQ ID NO: 127940 - RNA, 23 nt, Human
aagggcgauuaacauucgcucga

SEQ ID NO: 127941 - RNA, 22 nt, Human
aaggugcauuaguuuggagggg

SEQ ID NO: 127942 - RNA, 21 nt, Human
aaguacccuuuugcuacucag

SEQ ID NO: 127943 - RNA, 17 nt, Human
aagugggcaaagugaga

SEQ ID NO: 127944 - RNA, 23 nt, Human
aaguggucaucuaucccaugguu

SEQ ID NO: 127945 - RNA, 22 nt, Human
aaguggugagacccugcugaaa

SEQ ID NO: 127946 - RNA, 22 nt, Human
aagucgccuaaacaaaguaucu

SEQ ID NO: 127947 - RNA, 22 nt, Human
aaguggcccuaauugggccaaa

SEQ ID NO: 127948 - RNA, 22 nt, Human
aaguugaaugucuugcugaaug

SEQ ID NO: 127949 - RNA, 23 nt, Human
aaguugucauguaaaaugggcua

SEQ ID NO: 127950 - RNA, 22 nt, Human
aauagcacauguugguugagua

SEQ ID NO: 127951 - RNA, 22 nt, Human
aaucugacaaaauauuuccagu

SEQ ID NO: 127952 - RNA, 22 nt, Human
aaucugaccguggagaucucca

SEQ ID NO: 127953 - RNA, 22 nt, Human
aaucuugggacagggacacuau

SEQ ID NO: 127954 - RNA, 22 nt, Human
aaucucguuaugaagaugguug

SEQ ID NO: 127955 - RNA, 22 nt, Human
aaucgacuguagagacuuggcg

SEQ ID NO: 127956 - RNA, 23 nt, Human
aaugaguugggcagcauacaggc

SEQ ID NO: 127957 - RNA, 22 nt, Human
aaugccuucauuggcgaagugc

SEQ ID NO: 127958 - RNA, 22 nt, Human
aaugacaguggcacagucacuu

SEQ ID NO: 127959 - RNA, 22 nt, Human
aauguugaaccuuuuuggccug

SEQ ID NO: 127960 - RNA, 22 nt, Human
aauguugacguuggccagggcc

SEQ ID NO: 127961 - RNA, 21 nt, Human
aauucccagaaacagcacaag

SEQ ID NO: 127962 - RNA, 22 nt, Human
aauucaacagucaguuaucuca

SEQ ID NO: 127963 - RNA, 22 nt, Human
aauggcaauagugcauuaugua

SEQ ID NO: 127964 - RNA, 22 nt, Human
aauggcaagccacaugcuuuuc

SEQ ID NO: 127965 - RNA, 22 nt, Human
aauggaugauuaaauggaugaa

SEQ ID NO: 127966 - RNA, 22 nt, Human
aaugguggaugucuguucugac

SEQ ID NO: 127967 - RNA, 22 nt, Human
aacugggugauucaggcuguuu

SEQ ID NO: 127968 - RNA, 22 nt, Human
aacuggguuuaucuaaugugua

SEQ ID NO: 127969 - RNA, 19 nt, Human
aacucugccgaggcaagcc

SEQ ID NO: 127970 - RNA, 22 nt, Human
aacucgaugcaauucacuuugu

SEQ ID NO: 127971 - RNA, 22 nt, Human
aacuuaacucugcaauccagcu

SEQ ID NO: 127972 - RNA, 20 nt, Human
aacuuugagugcaugacuuu

SEQ ID NO: 127973 - RNA, 22 nt, Human
aagaaggcggaccagaagggag

SEQ ID NO: 127974 - RNA, 22 nt, Human
aagaagguugaaugacuacuuu

SEQ ID NO: 127975 - RNA, 22 nt, Human
aagaacaugggugugggcauuc

SEQ ID NO: 127976 - RNA, 21 nt, Human
aagagcgccgggcagggcuga

SEQ ID NO: 127977 - RNA, 22 nt, Human
aagaggcuacagcccugugucu

SEQ ID NO: 127978 - RNA, 22 nt, Human
aagacccuaccccuggagagga

SEQ ID NO: 127979 - RNA, 22 nt, Human
aagaggcagcuugguaggcauc

SEQ ID NO: 127980 - RNA, 22 nt, Human
aagaugcuucaugagaguuggg

SEQ ID NO: 127981 - RNA, 22 nt, Human
aagagcuuguuaugcugcucuu

SEQ ID NO: 127982 - RNA, 22 nt, Human
aagaggaauaauaaaaauugca

SEQ ID NO: 127983 - RNA, 22 nt, Human
aagcacagggacucaggaccgg

SEQ ID NO: 127984 - RNA, 22 nt, Human
aagcagcauaugacagcaucca

SEQ ID NO: 127985 - RNA, 22 nt, Human
aagcaaaagguuacacuucugg

SEQ ID NO: 127986 - RNA, 22 nt, Human
aagcaguuuagucaucgggauu

SEQ ID NO: 127987 - RNA, 22 nt, Human
aaccaggcgagagagcggucag

SEQ ID NO: 127988 - RNA, 22 nt, Human
aaccagaagucaucagagcuga

SEQ ID NO: 127989 - RNA, 22 nt, Human
aaccuaagaacagcaggcuccu

SEQ ID NO: 127990 - RNA, 22 nt, Human
aaccucgggcugcacuuggcac

SEQ ID NO: 127991 - RNA, 22 nt, Human
aaccauggauuucaguucaccu

SEQ ID NO: 127992 - RNA, 22 nt, Human
aacccuguuguguacaugcaua

SEQ ID NO: 127993 - RNA, 22 nt, Human
aacagggcaguuccuuauagug

SEQ ID NO: 127994 - RNA, 22 nt, Human
aacgauuugaguuaguuuuuag

SEQ ID NO: 127995 - RNA, 22 nt, Human
aacccaagacaagcacuggcca

SEQ ID NO: 127996 - RNA, 22 nt, Human
aaccugagggcaggaccccaua

SEQ ID NO: 127997 - RNA, 22 nt, Human
aacgcugugcacuggguccagg

SEQ ID NO: 127998 - RNA, 22 nt, Human
aacgccgggacucgcagggagc

SEQ ID NO: 127999 - RNA, 22 nt, Human
aacgcagagaguaaugcugaac

SEQ ID NO: 128000 - RNA, 22 nt, Human
aacgcaacaacuggagcuguag

SEQ ID NO: 128001 - RNA, 22 nt, Human
aaccggauugauccuucuuuga

SEQ ID NO: 128002 - RNA, 22 nt, Human
aacgugcuuuacaaaugaccuu

SEQ ID NO: 128003 - RNA, 22 nt, Human
aaccugaggguagacaaguuca

SEQ ID NO: 128004 - RNA, 22 nt, Human
aacgagcugggggggccggggg

SEQ ID NO: 128005 - RNA, 22 nt, Human
aacgaugauaaauuguucucug

SEQ ID NO: 128006 - RNA, 22 nt, Human
aacucaggagagaguaacaggg

SEQ ID NO: 128007 - RNA, 22 nt, Human
aacuacucugggguggcagguu

SEQ ID NO: 128008 - RNA, 22 nt, Human
aacagguucaucuuggaagcag

SEQ ID NO: 128009 - RNA, 22 nt, Human
aacaucaaaggaagaaugauau

SEQ ID NO: 128010 - RNA, 22 nt, Human
aaagaucaguuaacgccaucaa

SEQ ID NO: 128011 - RNA, 23 nt, Human
aaagaggugaauccaggacaagc

SEQ ID NO: 128012 - RNA, 22 nt, Human
agguggucccaauggcugggca

SEQ ID NO: 128013 - RNA, 22 nt, Human
agguggugacgaugcuccguac

SEQ ID NO: 128014 - RNA, 22 nt, Human
aggugggcuuagaaaucuguau

SEQ ID NO: 128015 - RNA, 22 nt, Human
aggugcccucucuggcuccucc

SEQ ID NO: 128016 - RNA, 22 nt, Human
aggugcuugcauacugcuugac

SEQ ID NO: 128017 - RNA, 22 nt, Human
agguuuuagagagccaggaugu

SEQ ID NO: 128018 - RNA, 22 nt, Human
agguuuuugucauuuucuggua

SEQ ID NO: 128019 - RNA, 21 nt, Human
aguagucgauucaggagaagu

SEQ ID NO: 128020 - RNA, 22 nt, Human
aguaucgcuuuguaucaugagg

SEQ ID NO: 128021 - RNA, 22 nt, Human
aguaucugccagaaucucaguu

SEQ ID NO: 128022 - RNA, 19 nt, Human
aguauuggcagguccugua

SEQ ID NO: 128023 - RNA, 22 nt, Human
agucaacauuugagaugcaaug

SEQ ID NO: 128024 - RNA, 22 nt, Human
agucaagguggaccagaaaaau

SEQ ID NO: 128025 - RNA, 21 nt, Human
agucaagcugccugcuuggca

SEQ ID NO: 128026 - RNA, 22 nt, Human
agucacuguucugucaugucaa

SEQ ID NO: 128027 - RNA, 22 nt, Human
agucagaaggugucagaucuug

SEQ ID NO: 128028 - RNA, 22 nt, Human
agucagcuugucucuaggguug

SEQ ID NO: 128029 - RNA, 22 nt, Human
agucaggggaucuagacuugaa

SEQ ID NO: 128030 - RNA, 22 nt, Human
agucaccuacagcucaugcuuc

SEQ ID NO: 128031 - RNA, 22 nt, Human
agucggguugcagacacauccu

SEQ ID NO: 128032 - RNA, 22 nt, Human
agucuagagcuuuuaucaggcc

SEQ ID NO: 128033 - RNA, 22 nt, Human
agucccugauggacuggaugag

SEQ ID NO: 128034 - RNA, 22 nt, Human
aguccucagauauggagaucug

SEQ ID NO: 128035 - RNA, 22 nt, Human
agucagcuuggaacuuuuuucc

SEQ ID NO: 128036 - RNA, 22 nt, Human
aguccagggcuuagucagcggg

SEQ ID NO: 128037 - RNA, 22 nt, Human
agucugaguaucucugagccag

SEQ ID NO: 128038 - RNA, 22 nt, Human
agucggggagcgugaccagaga

SEQ ID NO: 128039 - RNA, 22 nt, Human
agucugaaccagauggcaaggu

SEQ ID NO: 128040 - RNA, 22 nt, Human
agucucccauaggcuaaguauu

SEQ ID NO: 128041 - RNA, 22 nt, Human
aggugcacugguacaggcuuca

SEQ ID NO: 128042 - RNA, 22 nt, Human
aggugcagcugguggagucugg

SEQ ID NO: 128043 - RNA, 22 nt, Human
agguccugucuuaucucuguaa

SEQ ID NO: 128044 - RNA, 22 nt, Human
agguagcuggugcugggcuccu

SEQ ID NO: 128045 - RNA, 22 nt, Human
aggguuucucuccaguguggac

SEQ ID NO: 128046 - RNA, 22 nt, Human
agggggccuauucuuggacugc

SEQ ID NO: 128047 - RNA, 22 nt, Human
aggggguugcgcaggggcuccc

SEQ ID NO: 128048 - RNA, 22 nt, Human
agggggcuccugcaggccccca

SEQ ID NO: 128049 - RNA, 22 nt, Human
aggggauggagcuggaaggcag

SEQ ID NO: 128050 - RNA, 22 nt, Human
aggggaguuauuagacagggag

SEQ ID NO: 128051 - RNA, 22 nt, Human
aggguggcuggaguggucuggu

SEQ ID NO: 128052 - RNA, 20 nt, Human
agggucucuccuggcucugc

SEQ ID NO: 128053 - RNA, 22 nt, Human
aggguuaggguggcauggggaa

SEQ ID NO: 128054 - RNA, 22 nt, Human
aggguuaggaaggagaagagag

SEQ ID NO: 128055 - RNA, 22 nt, Human
agggggcaugaaauaaaggaaa

SEQ ID NO: 128056 - RNA, 22 nt, Human
aggggcugagaguuugaugugg

SEQ ID NO: 128057 - RNA, 20 nt, Human
aggggcuguaguuagaugac

SEQ ID NO: 128058 - RNA, 22 nt, Human
agggcugcugcuccgggcccag

SEQ ID NO: 128059 - RNA, 22 nt, Human
agggcucacuacaacccuggga

SEQ ID NO: 128060 - RNA, 22 nt, Human
agggcucagccuccuccucagc

SEQ ID NO: 128061 - RNA, 22 nt, Human
agggcugggcuuggcaggcugg

SEQ ID NO: 128062 - RNA, 22 nt, Human
agggcgugguggugcuggagca

SEQ ID NO: 128063 - RNA, 22 nt, Human
agggcggucccugagacucucc

SEQ ID NO: 128064 - RNA, 22 nt, Human
agggccggggagggcugugggg

SEQ ID NO: 128065 - RNA, 22 nt, Human
agggaccgugagcuccuugggg

SEQ ID NO: 128066 - RNA, 22 nt, Human
agggacccucagcuuggauguc

SEQ ID NO: 128067 - RNA, 22 nt, Human
agggagucuggccgucggcugg

SEQ ID NO: 128068 - RNA, 22 nt, Human
agggagcagcuagagggggucc

SEQ ID NO: 128069 - RNA, 19 nt, Human
aggcugccucacccucccu

SEQ ID NO: 128070 - RNA, 22 nt, Human
aggcugaagcacacucaugcag

SEQ ID NO: 128071 - RNA, 23 nt, Human
aggcugccacucagggugaggcu

SEQ ID NO: 128072 - RNA, 22 nt, Human
aggccgguggaggagguggagg

SEQ ID NO: 128073 - RNA, 18 nt, Human
aggcuggggaucacaggg

SEQ ID NO: 128074 - RNA, 22 nt, Human
aggcuucauuacagugguucaa

SEQ ID NO: 128075 - RNA, 19 nt, Human
agggaggcaagagaaaugu

SEQ ID NO: 128076 - RNA, 22 nt, Human
agggagcugcucugcuuccgug

SEQ ID NO: 128077 - RNA, 22 nt, Human
agggaugcaguaaaaacuguag

SEQ ID NO: 128078 - RNA, 22 nt, Human
agggacuugugucuguguuuuu

SEQ ID NO: 128079 - RNA, 22 nt, Human
agggaccacauccccucugugg

SEQ ID NO: 128080 - RNA, 22 nt, Human
aggcgagcgcggccggugcccc

SEQ ID NO: 128081 - RNA, 22 nt, Human
aggcgaagggaccagacgguag

SEQ ID NO: 128082 - RNA, 22 nt, Human
aggccugcccuuggggagccuu

SEQ ID NO: 128083 - RNA, 22 nt, Human
aggccugcuccucuucucaucc

SEQ ID NO: 128084 - RNA, 22 nt, Human
aggccugaggaccagauaaaug

SEQ ID NO: 128085 - RNA, 22 nt, Human
aggccgcgguggcgaaggcguu

SEQ ID NO: 128086 - RNA, 22 nt, Human
aggcccucucggucccccgccg

SEQ ID NO: 128087 - RNA, 22 nt, Human
aggccgcuggggcagcgcccga

SEQ ID NO: 128088 - RNA, 23 nt, Human
aggcugcagaagaauagggucau

SEQ ID NO: 128089 - RNA, 22 nt, Human
aggcugccuaugaaggcagaag

SEQ ID NO: 128090 - RNA, 22 nt, Human
aggcggguuuaggacaaugcuu

SEQ ID NO: 128091 - RNA, 22 nt, Human
aggcgguuggcuuugucugggu

SEQ ID NO: 128092 - RNA, 22 nt, Human
aggccagggacaaugaggcaga

SEQ ID NO: 128093 - RNA, 22 nt, Human
aggcuaagugauuagugacaua

SEQ ID NO: 128094 - RNA, 22 nt, Human
aggagcccggucgucaugguaa

SEQ ID NO: 128095 - RNA, 16 nt, Human
aggagcagaaagcagu

SEQ ID NO: 128096 - RNA, 22 nt, Human
aggauggaaguaacuggauaau

SEQ ID NO: 128097 - RNA, 20 nt, Human
aggccgcccgcugccgcuuc

SEQ ID NO: 128098 - RNA, 22 nt, Human
aggcccugcugaggccucccuc

SEQ ID NO: 128099 - RNA, 22 nt, Human
aggcccagcaccagcggucuuc

SEQ ID NO: 128100 - RNA, 22 nt, Human
aggccccacaaacucgccuuug

SEQ ID NO: 128101 - RNA, 22 nt, Human
aggaggcucucagguccucccc

SEQ ID NO: 128102 - RNA, 22 nt, Human
aggaggcaaaugagagggcuca

SEQ ID NO: 128103 - RNA, 22 nt, Human
aggagguagggugugaaacagc

SEQ ID NO: 128104 - RNA, 22 nt, Human
agcaguugcuuuguauauuaaa

SEQ ID NO: 128105 - RNA, 19 nt, Human
agcagugaaaucuggugag

SEQ ID NO: 128106 - RNA, 18 nt, Human
agcagugcggaucauuuu

SEQ ID NO: 128107 - RNA, 22 nt, Human
agcaggguggcaagucuuucug

SEQ ID NO: 128108 - RNA, 22 nt, Human
agcaggaggguuuuguagaguc

SEQ ID NO: 128109 - RNA, 22 nt, Human
agcagggagacagugcagcauu

SEQ ID NO: 128110 - RNA, 22 nt, Human
agcaggacuugcugagcccucc

SEQ ID NO: 128111 - RNA, 22 nt, Human
agcaggaaggcuagaagcagga

SEQ ID NO: 128112 - RNA, 22 nt, Human
agcaggagaaagaguaugggcu

SEQ ID NO: 128113 - RNA, 22 nt, Human
agcagccgccgccgccgcgcac

SEQ ID NO: 128114 - RNA, 22 nt, Human
agcagcaggugaccucgaugcc

SEQ ID NO: 128115 - RNA, 22 nt, Human
agauaggcuuagccaagcuuuc

SEQ ID NO: 128116 - RNA, 19 nt, Human
agcaucuccacagaaaaag

SEQ ID NO: 128117 - RNA, 22 nt, Human
agcaggaggagagccuggcggu

SEQ ID NO: 128118 - RNA, 22 nt, Human
agcauucccuuugcagugucau

SEQ ID NO: 128119 - RNA, 22 nt, Human
agcagggugugggugugagugu

SEQ ID NO: 128120 - RNA, 22 nt, Human
agcaggucagugguaaucaaaa

SEQ ID NO: 128121 - RNA, 21 nt, Human
agcagucugcggccggugcgg

SEQ ID NO: 128122 - RNA, 22 nt, Human
agccacagucuguagccagcuu

SEQ ID NO: 128123 - RNA, 19 nt, Human
agcaguggagccaugccug

SEQ ID NO: 128124 - RNA, 22 nt, Human
agcaguucucugucuagcuaga

SEQ ID NO: 128125 - RNA, 18 nt, Human
agcaguugucucucucca

SEQ ID NO: 128126 - RNA, 22 nt, Human
agcaucggacggagcaccugcu

SEQ ID NO: 128127 - RNA, 22 nt, Human
agcgcccguugagucgcgcggu

SEQ ID NO: 128128 - RNA, 22 nt, Human
agcgacuugacagacauguccu

SEQ ID NO: 128129 - RNA, 22 nt, Human
agccuugcaugauuucauucau

SEQ ID NO: 128130 - RNA, 22 nt, Human
agcggcaggaagcgcgcaagcg

SEQ ID NO: 128131 - RNA, 22 nt, Human
agcggccucgcugccugcucag

SEQ ID NO: 128132 - RNA, 22 nt, Human
agcggcucaggccccgugggcu

SEQ ID NO: 128133 - RNA, 19 nt, Human
agcgccucuacugcaugga

SEQ ID NO: 128134 - RNA, 22 nt, Human
agcgcaguuaccgcgcggggcu

SEQ ID NO: 128135 - RNA, 22 nt, Human
agcgagccugugcacuucuaac

SEQ ID NO: 128136 - RNA, 22 nt, Human
agcggaggaggcggagcaggga

SEQ ID NO: 128137 - RNA, 22 nt, Human
agcgacuguaagagggccccgg

SEQ ID NO: 128138 - RNA, 22 nt, Human
agcgcgcggggcugcggcaggg

SEQ ID NO: 128139 - RNA, 22 nt, Human
agcgcggccuuacacccagggg

SEQ ID NO: 128140 - RNA, 22 nt, Human
agcgcucauuuuccuccugcuc

SEQ ID NO: 128141 - RNA, 22 nt, Human
agcggugacauccuucugugcu

SEQ ID NO: 128142 - RNA, 22 nt, Human
agcguacuugaggcuuggggcc

SEQ ID NO: 128143 - RNA, 22 nt, Human
agcgggucaugucggccgccca

SEQ ID NO: 128144 - RNA, 22 nt, Human
agcggcgcgucuccgagcugga

SEQ ID NO: 128145 - RNA, 22 nt, Human
agcguucuguuccaugcuaaca

SEQ ID NO: 128146 - RNA, 22 nt, Human
agcgucaugugaccagcgcgcc

SEQ ID NO: 128147 - RNA, 19 nt, Human
agcucaggcccaucguccc

SEQ ID NO: 128148 - RNA, 19 nt, Human
agcuccucaccucucgcgg

SEQ ID NO: 128149 - RNA, 22 nt, Human
agcucugugcaggcagaggcau

SEQ ID NO: 128150 - RNA, 22 nt, Human
agcucuccuacucucuuucuag

SEQ ID NO: 128151 - RNA, 22 nt, Human
agcucggcuguccugugccccu

SEQ ID NO: 128152 - RNA, 22 nt, Human
agcucugcuucuugggaagaug

SEQ ID NO: 128153 - RNA, 22 nt, Human
agcuccugcgcacggugcacac

SEQ ID NO: 128154 - RNA, 22 nt, Human
agcugcuggcggauguuggacu

SEQ ID NO: 128155 - RNA, 19 nt, Human
agcugcugauugguggagg

SEQ ID NO: 128156 - RNA, 22 nt, Human
agcugaccugauugcuuuucag

SEQ ID NO: 128157 - RNA, 22 nt, Human
agcugagccagacagguaagca

SEQ ID NO: 128158 - RNA, 22 nt, Human
agcugcauucguaucauauugu

SEQ ID NO: 128159 - RNA, 22 nt, Human
agcucuucugacucuaggcuca

SEQ ID NO: 128160 - RNA, 22 nt, Human
agcugacagugcauggagggac

SEQ ID NO: 128161 - RNA, 22 nt, Human
agcucuguugcggucacaggag

SEQ ID NO: 128162 - RNA, 22 nt, Human
agcucuuccuccauucuggcca

SEQ ID NO: 128163 - RNA, 22 nt, Human
agcugaggccccgcagcagggu

SEQ ID NO: 128164 - RNA, 22 nt, Human
agcuguugaccuucccuuucag

SEQ ID NO: 128165 - RNA, 22 nt, Human
agcuuccaaagaccaggauuga

SEQ ID NO: 128166 - RNA, 22 nt, Human
agcuucuucugccuugucccug

SEQ ID NO: 128167 - RNA, 22 nt, Human
agcuugauggauugcugaggca

SEQ ID NO: 128168 - RNA, 20 nt, Human
agcuggcccccgguggccug

SEQ ID NO: 128169 - RNA, 22 nt, Human
agcugugccuauucguggcaag

SEQ ID NO: 128170 - RNA, 22 nt, Human
agcugcuaagcugcauaacuua

SEQ ID NO: 128171 - RNA, 22 nt, Human
agcugcuuuacuggucggcugg

SEQ ID NO: 128172 - RNA, 22 nt, Human
agcugcugcaaguggugcuaac

SEQ ID NO: 128173 - RNA, 22 nt, Human
agcugcauguauauucuuaaca

SEQ ID NO: 128174 - RNA, 22 nt, Human
agcuuggcaagcacuguuugag

SEQ ID NO: 128175 - RNA, 20 nt, Human
agcuuucaccaguacuucca

SEQ ID NO: 128176 - RNA, 22 nt, Human
agcuuugucccaagugcucugg

SEQ ID NO: 128177 - RNA, 22 nt, Human
aggagcacugggcaugucaccc

SEQ ID NO: 128178 - RNA, 22 nt, Human
aggacagagggaccagagccca

SEQ ID NO: 128179 - RNA, 22 nt, Human
aggacacuuccugaguggacaa

SEQ ID NO: 128180 - RNA, 22 nt, Human
aggacuggucucuuuucuccaa

SEQ ID NO: 128181 - RNA, 22 nt, Human
aggacuguauacucuaggugaa

SEQ ID NO: 128182 - RNA, 22 nt, Human
aggagacaguuuggacguguag

SEQ ID NO: 128183 - RNA, 22 nt, Human
aggacucagcgucugucucccg

SEQ ID NO: 128184 - RNA, 22 nt, Human
aggaagagcuggaccagaggac

SEQ ID NO: 128185 - RNA, 23 nt, Human
aggaagucugacacuacagcguu

SEQ ID NO: 128186 - RNA, 22 nt, Human
aggaagccuggaguccugccca

SEQ ID NO: 128187 - RNA, 22 nt, Human
agcuggauuaaucacagugacu

SEQ ID NO: 128188 - RNA, 22 nt, Human
agcuggaaucucggcaaagcgu

SEQ ID NO: 128189 - RNA, 22 nt, Human
aggaaauaguuuagucccaaaa

SEQ ID NO: 128190 - RNA, 22 nt, Human
aggaacaguuucaaagagugaa

SEQ ID NO: 128191 - RNA, 22 nt, Human
aggaaauaagggcacuucagau

SEQ ID NO: 128192 - RNA, 22 nt, Human
agcuucccaggagaucuccgcc

SEQ ID NO: 128193 - RNA, 22 nt, Human
agcuugcccuuguaccagccag

SEQ ID NO: 128194 - RNA, 22 nt, Human
agcuugaugaaagugggugcuc

SEQ ID NO: 128195 - RNA, 22 nt, Human
acgugugugugcacguguguau

SEQ ID NO: 128196 - RNA, 20 nt, Human
acuaccaugcaauuccgcuu

SEQ ID NO: 128197 - RNA, 20 nt, Human
acugcaagagacagaugaaa

SEQ ID NO: 128198 - RNA, 22 nt, Human
acugauuccaagcuuguggagg

SEQ ID NO: 128199 - RNA, 22 nt, Human
acugaggaagccugucaucauc

SEQ ID NO: 128200 - RNA, 18 nt, Human
acugagcccaggacacac

SEQ ID NO: 128201 - RNA, 22 nt, Human
acuggagcccguggaggcgcag

SEQ ID NO: 128202 - RNA, 22 nt, Human
acuggauucucuuacacagaug

SEQ ID NO: 128203 - RNA, 22 nt, Human
acugcaggucccaucaccugcg

SEQ ID NO: 128204 - RNA, 22 nt, Human
acugcacuccagcccgagcaac

SEQ ID NO: 128205 - RNA, 22 nt, Human
acugcguuucuaaaguagcaua

SEQ ID NO: 128206 - RNA, 22 nt, Human
acugggacuguaugugcuggac

SEQ ID NO: 128207 - RNA, 22 nt, Human
acuggggaggucuggauggauc

SEQ ID NO: 128208 - RNA, 19 nt, Human
acugggaugggcagugcca

SEQ ID NO: 128209 - RNA, 22 nt, Human
acuguggcugcuacccuggcuc

SEQ ID NO: 128210 - RNA, 18 nt, Human
acuguggcucagaguugc

SEQ ID NO: 128211 - RNA, 22 nt, Human
acugucauuaaugaauguaaua

SEQ ID NO: 128212 - RNA, 22 nt, Human
acuggugcucuggccaccgcug

SEQ ID NO: 128213 - RNA, 22 nt, Human
acuggggcaggaaaguaugcug

SEQ ID NO: 128214 - RNA, 22 nt, Human
acuggggauugguucuucaaca

SEQ ID NO: 128215 - RNA, 19 nt, Human
acuggggcaggcugggcuu

SEQ ID NO: 128216 - RNA, 22 nt, Human
acuggcgucugucuccccugcc

SEQ ID NO: 128217 - RNA, 22 nt, Human
acuggcauuccuaggggagggg

SEQ ID NO: 128218 - RNA, 22 nt, Human
acugggcaaggauaugaugggu

SEQ ID NO: 128219 - RNA, 21 nt, Human
acugggcuagccugacuucug

SEQ ID NO: 128220 - RNA, 22 nt, Human
acuggguuguuugucucaugag

SEQ ID NO: 128221 - RNA, 22 nt, Human
acuguccucgaaguaccugugc

SEQ ID NO: 128222 - RNA, 22 nt, Human
acuguugugaauaaugaaaugc

SEQ ID NO: 128223 - RNA, 22 nt, Human
acuuugucuugaucaaaggugu

SEQ ID NO: 128224 - RNA, 22 nt, Human
acuucugcccuggcgagggcgu

SEQ ID NO: 128225 - RNA, 22 nt, Human
acuugagcuugaaagguaugcu

SEQ ID NO: 128226 - RNA, 21 nt, Human
agaagcggucgaaucgcagac

SEQ ID NO: 128227 - RNA, 22 nt, Human
agaagcauaagggcuuugccag

SEQ ID NO: 128228 - RNA, 22 nt, Human
agaagaucccugugguuacgac

SEQ ID NO: 128229 - RNA, 22 nt, Human
acuuugccuucuuacuguguug

SEQ ID NO: 128230 - RNA, 22 nt, Human
agaacaggaggaagccagcucc

SEQ ID NO: 128231 - RNA, 20 nt, Human
agaaggagagaugaggcaaa

SEQ ID NO: 128232 - RNA, 22 nt, Human
agaaggcagaaaagcuuuacaa

SEQ ID NO: 128233 - RNA, 22 nt, Human
agaauccucuagggauggcagg

SEQ ID NO: 128234 - RNA, 22 nt, Human
agacagcggugcaauaaauggu

SEQ ID NO: 128235 - RNA, 22 nt, Human
agaccauagugauguuuacguc

SEQ ID NO: 128236 - RNA, 20 nt, Human
agacauugaggagagagcau

SEQ ID NO: 128237 - RNA, 21 nt, Human
agacugaugggaagacucugu

SEQ ID NO: 128238 - RNA, 22 nt, Human
agacucuggcaugcuaacuagu

SEQ ID NO: 128239 - RNA, 22 nt, Human
agaccccuguggugaugguggu

SEQ ID NO: 128240 - RNA, 22 nt, Human
agaccccugcuggggcugcugu

SEQ ID NO: 128241 - RNA, 19 nt, Human
agacccaguuuucuagugu

SEQ ID NO: 128242 - RNA, 22 nt, Human
agacugugagaagauggcugcg

SEQ ID NO: 128243 - RNA, 22 nt, Human
agacuugguaacuagugaagaa

SEQ ID NO: 128244 - RNA, 22 nt, Human
agacuucucuuggcuauauuau

SEQ ID NO: 128245 - RNA, 22 nt, Human
agagaacaggcagcuggugccg

SEQ ID NO: 128246 - RNA, 22 nt, Human
agacuguuccgucagacucagu

SEQ ID NO: 128247 - RNA, 22 nt, Human
agacucacuucuuucucguauu

SEQ ID NO: 128248 - RNA, 21 nt, Human
agacuucuacuaucuuaugac

SEQ ID NO: 128249 - RNA, 22 nt, Human
agacuucucuaacuugaggacc

SEQ ID NO: 128250 - RNA, 22 nt, Human
agagccauuuaaauaguuguca

SEQ ID NO: 128251 - RNA, 22 nt, Human
agagcagcaaucuuugaaauua

SEQ ID NO: 128252 - RNA, 22 nt, Human
agagcccagaucccacccugga

SEQ ID NO: 128253 - RNA, 22 nt, Human
agagaaccauggcauccaggua

SEQ ID NO: 128254 - RNA, 22 nt, Human
agagacaggguuuugucguguu

SEQ ID NO: 128255 - RNA, 22 nt, Human
agaggugcuuaugcucaugguu

SEQ ID NO: 128256 - RNA, 22 nt, Human
agagggcugugcuaaauuucag

SEQ ID NO: 128257 - RNA, 22 nt, Human
agagggagagaccuccgugccu

SEQ ID NO: 128258 - RNA, 23 nt, Human
agaggccaacuucuugccccucc

SEQ ID NO: 128259 - RNA, 22 nt, Human
agagcugggacuuggacucaau

SEQ ID NO: 128260 - RNA, 22 nt, Human
agagcagcuuuucggaaccacu

SEQ ID NO: 128261 - RNA, 22 nt, Human
agagcuccaggguuuuguagug

SEQ ID NO: 128262 - RNA, 22 nt, Human
agagcucguggcucauugagga

SEQ ID NO: 128263 - RNA, 22 nt, Human
agaggaguagcugagcucugca

SEQ ID NO: 128264 - RNA, 22 nt, Human
agaggagaauguaaauuuguca

SEQ ID NO: 128265 - RNA, 21 nt, Human
agaggacuuuuuugauguuuu

SEQ ID NO: 128266 - RNA, 22 nt, Human
agaggcacccaguuaagcugca

SEQ ID NO: 128267 - RNA, 22 nt, Human
agaggaauuauugaguuagauu

SEQ ID NO: 128268 - RNA, 22 nt, Human
acccugacggugggcagcuuga

SEQ ID NO: 128269 - RNA, 22 nt, Human
accgugcccauucauuuacaaa

SEQ ID NO: 128270 - RNA, 21 nt, Human
accgucaguacuaguauugac

SEQ ID NO: 128271 - RNA, 22 nt, Human
accuauuguccagagccaggcc

SEQ ID NO: 128272 - RNA, 22 nt, Human
accucagauuguggcuccgcug

SEQ ID NO: 128273 - RNA, 22 nt, Human
acccauggcucucugggaugcu

SEQ ID NO: 128274 - RNA, 22 nt, Human
accccagcucugagccacacca

SEQ ID NO: 128275 - RNA, 22 nt, Human
accccgugucccugaggguccu

SEQ ID NO: 128276 - RNA, 22 nt, Human
acccccaggacacugccucuga

SEQ ID NO: 128277 - RNA, 22 nt, Human
acccccuuucuugaccucaugu

SEQ ID NO: 128278 - RNA, 22 nt, Human
accggucucaccaaacgcccca

SEQ ID NO: 128279 - RNA, 22 nt, Human
accgucagguuagaaugagcac

SEQ ID NO: 128280 - RNA, 22 nt, Human
acccuacggacuugacugggcg

SEQ ID NO: 128281 - RNA, 22 nt, Human
accaugacugucacauuauuau

SEQ ID NO: 128282 - RNA, 22 nt, Human
accauccaggugagggagaccu

SEQ ID NO: 128283 - RNA, 22 nt, Human
accaguuuuuugaccaugggug

SEQ ID NO: 128284 - RNA, 20 nt, Human
acccagaguccuccccgcgc

SEQ ID NO: 128285 - RNA, 22 nt, Human
accgcuggcacuggggacgggg

SEQ ID NO: 128286 - RNA, 21 nt, Human
acccagaauggagccaagccu

SEQ ID NO: 128287 - RNA, 22 nt, Human
accgagcaggguguuugcgcac

SEQ ID NO: 128288 - RNA, 22 nt, Human
accgauguggaaaauuucauuu

SEQ ID NO: 128289 - RNA, 22 nt, Human
accugaucugagaaguggaggg

SEQ ID NO: 128290 - RNA, 23 nt, Human
accuccuuguugaguggggguga

SEQ ID NO: 128291 - RNA, 22 nt, Human
accgauuucaaauggugcuaga

SEQ ID NO: 128292 - RNA, 22 nt, Human
accgggcagcucugccccugcc

SEQ ID NO: 128293 - RNA, 22 nt, Human
accgguucccaucuggagaguu

SEQ ID NO: 128294 - RNA, 22 nt, Human
accugauuuuauggauuuugag

SEQ ID NO: 128295 - RNA, 23 nt, Human
accgccgcugccgccgcccccgc

SEQ ID NO: 128296 - RNA, 22 nt, Human
accugcucucccucucgcaguc

SEQ ID NO: 128297 - RNA, 23 nt, Human
accuggucccaugggugggccug

SEQ ID NO: 128298 - RNA, 21 nt, Human
accuggugaugaaugggaggc

SEQ ID NO: 128299 - RNA, 21 nt, Human
accugguuuacugaucccagg

SEQ ID NO: 128300 - RNA, 22 nt, Human
accugaccagguggcuucccaa

SEQ ID NO: 128301 - RNA, 22 nt, Human
accucccgacggcgcgggagaa

SEQ ID NO: 128302 - RNA, 22 nt, Human
accugguuucuuacccaagaga

SEQ ID NO: 128303 - RNA, 22 nt, Human
acgauaacaauaguagcaugua

SEQ ID NO: 128304 - RNA, 22 nt, Human
acgaggauuuccuuagaugaaa

SEQ ID NO: 128305 - RNA, 22 nt, Human
accuggauauuuucaguugcau

SEQ ID NO: 128306 - RNA, 22 nt, Human
accugguaaccugccugacuaa

SEQ ID NO: 128307 - RNA, 22 nt, Human
accuggcccugggucuccugac

SEQ ID NO: 128308 - RNA, 22 nt, Human
accuggacucugaucacuuuug

SEQ ID NO: 128309 - RNA, 22 nt, Human
accuggaccugccaccuaugag

SEQ ID NO: 128310 - RNA, 22 nt, Human
accugcagguguuuccacacuu

SEQ ID NO: 128311 - RNA, 22 nt, Human
accuugauggagugaugaauga

SEQ ID NO: 128312 - RNA, 22 nt, Human
accuucugaccucucggacuuc

SEQ ID NO: 128313 - RNA, 19 nt, Human
accuguucaaccucgugcu

SEQ ID NO: 128314 - RNA, 22 nt, Human
acggccgaugacuccagcaugg

SEQ ID NO: 128315 - RNA, 22 nt, Human
acggcggguuccgggccagccc

SEQ ID NO: 128316 - RNA, 22 nt, Human
acggagggagagagggaggaga

SEQ ID NO: 128317 - RNA, 22 nt, Human
accuugggcccagaccggcacg

SEQ ID NO: 128318 - RNA, 20 nt, Human
acgaacauauugcaggguuu

SEQ ID NO: 128319 - RNA, 23 nt, Human
acgaccuugcccucauuccaaag

SEQ ID NO: 128320 - RNA, 22 nt, Human
acgggugugauuccuuuugugu

SEQ ID NO: 128321 - RNA, 22 nt, Human
acgggggagucuuuuacaucau

SEQ ID NO: 128322 - RNA, 22 nt, Human
acggggagcgucggccucuccc

SEQ ID NO: 128323 - RNA, 22 nt, Human
acguagggauuccucgucucau

SEQ ID NO: 128324 - RNA, 22 nt, Human
acgucaucguugucaucgucau

SEQ ID NO: 128325 - RNA, 22 nt, Human
acgguuuugugagguaguacuu

SEQ ID NO: 128326 - RNA, 22 nt, Human
acgguuuggggaggaggauccc

SEQ ID NO: 128327 - RNA, 22 nt, Human
acaugguguggcacuaggggcu

SEQ ID NO: 128328 - RNA, 22 nt, Human
acaugggggugggacggcagag

SEQ ID NO: 128329 - RNA, 20 nt, Human
acauggagaagcgagguagg

SEQ ID NO: 128330 - RNA, 22 nt, Human
acaugcacagcaagggugagag

SEQ ID NO: 128331 - RNA, 22 nt, Human
acauggaaacacgcagccccaa

SEQ ID NO: 128332 - RNA, 22 nt, Human
acauccagcagauuguccagag

SEQ ID NO: 128333 - RNA, 21 nt, Human
acauccaggguccucacugcc

SEQ ID NO: 128334 - RNA, 22 nt, Human
acaucccccuacuuguguccug

SEQ ID NO: 128335 - RNA, 22 nt, Human
acauccaguaucagaagcauca

SEQ ID NO: 128336 - RNA, 22 nt, Human
acaugaguuacuuccgauuccc

SEQ ID NO: 128337 - RNA, 22 nt, Human
acauggaccucagauccuggcc

SEQ ID NO: 128338 - RNA, 22 nt, Human
acaugcuuucuagguccuucug

SEQ ID NO: 128339 - RNA, 22 nt, Human
acaugaggaacucaggagucac

SEQ ID NO: 128340 - RNA, 22 nt, Human
acauuuccaaagaugccaguca

SEQ ID NO: 128341 - RNA, 22 nt, Human
accacguccugguggcuguugg

SEQ ID NO: 128342 - RNA, 22 nt, Human
accaccacugacaccagcucgg

SEQ ID NO: 128343 - RNA, 22 nt, Human
accagccacacacauuagucac

SEQ ID NO: 128344 - RNA, 22 nt, Human
accagccacccugccgcguccg

SEQ ID NO: 128345 - RNA, 22 nt, Human
accagguugagacuucggcuuu

SEQ ID NO: 128346 - RNA, 22 nt, Human
accagcgcguuuucaguuucau

SEQ ID NO: 128347 - RNA, 17 nt, Human
accaggggcagcacugc

SEQ ID NO: 128348 - RNA, 22 nt, Human
acccggccuacucagugcccag

SEQ ID NO: 128349 - RNA, 22 nt, Human
accccuacugaaauuuccuggu

SEQ ID NO: 128350 - RNA, 22 nt, Human
accccuuaaauuuguuguuuaa

SEQ ID NO: 128351 - RNA, 22 nt, Human
accaccacauaguaggcacuua

SEQ ID NO: 128352 - RNA, 22 nt, Human
acccgguuuucccagcaccucc

SEQ ID NO: 128353 - RNA, 19 nt, Human
acccaugcucuguggacuu

SEQ ID NO: 128354 - RNA, 22 nt, Human
acccagauauccaggccucugc

SEQ ID NO: 128355 - RNA, 22 nt, Human
acccaucauuagucuuucagga

SEQ ID NO: 128356 - RNA, 20 nt, Human
acccaaagcucagcgugucc

SEQ ID NO: 128357 - RNA, 22 nt, Human
acauuuuguuuauggaaaagau

SEQ ID NO: 128358 - RNA, 22 nt, Human
accaguucuauguagauaauga

SEQ ID NO: 128359 - RNA, 22 nt, Human
accaggguacuucuaggugggg

SEQ ID NO: 128360 - RNA, 22 nt, Human
accaauguucaaccuugacugc

SEQ ID NO: 128361 - RNA, 22 nt, Human
accaacuuuccaaagugccugg

SEQ ID NO: 128362 - RNA, 19 nt, Human
accaaacaguggacggagc

SEQ ID NO: 128363 - RNA, 22 nt, Human
accaacacgucugaguauuucc

SEQ ID NO: 128364 - RNA, 22 nt, Human
acauguggaggaggcgagggua

SEQ ID NO: 128365 - RNA, 21 nt, Human
acauguacacauguaugcaca

SEQ ID NO: 128366 - RNA, 22 nt, Human
acauggguuaaagaagauggaa

SEQ ID NO: 128367 - RNA, 22 nt, Human
acauggggaaaaaggccugcuc

SEQ ID NO: 128368 - RNA, 22 nt, Human
acauguuuacaaaccucaagcc

SEQ ID NO: 128369 - RNA, 22 nt, Human
accaagaguccaagugagguug

SEQ ID NO: 128370 - RNA, 22 nt, Human
accaggaguuuugaccaggggc

SEQ ID NO: 128371 - RNA, 22 nt, Human
accaauguuuuauagaaaugcc

SEQ ID NO: 128372 - RNA, 22 nt, Human
acauugguauuaguguggcuga

SEQ ID NO: 128373 - RNA, 22 nt, Human
acauuuugggagaaaguuguua

SEQ ID NO: 128374 - RNA, 22 nt, Human
accaggcagcaccaaagccggu

SEQ ID NO: 128375 - RNA, 22 nt, Human
cccagccuuugcuuccugguuc

SEQ ID NO: 128376 - RNA, 22 nt, Human
cccagcugaacuugcauuccaa

SEQ ID NO: 128377 - RNA, 22 nt, Human
cccaggcuggggcuccuccagc

SEQ ID NO: 128378 - RNA, 22 nt, Human
cccaggucgucagcaguguggu

SEQ ID NO: 128379 - RNA, 22 nt, Human
cauuagggucuuuagacagcuc

SEQ ID NO: 128380 - RNA, 22 nt, Human
cccagcuuugcggacccgggag

SEQ ID NO: 128381 - RNA, 22 nt, Human
cccaggccguguaaucagcagc

SEQ ID NO: 128382 - RNA, 22 nt, Human
ccagcaucagcucuuggcuggc

SEQ ID NO: 128383 - RNA, 22 nt, Human
ccagcaggagacuagcaacaua

SEQ ID NO: 128384 - RNA, 22 nt, Human
cccauuuuuuggauguguggau

SEQ ID NO: 128385 - RNA, 22 nt, Human
cccaugacucucauucacaguc

SEQ ID NO: 128386 - RNA, 22 nt, Human
cccaucugugaaauggggcugc

SEQ ID NO: 128387 - RNA, 22 nt, Human
ccagcaaguaagucagugucag

SEQ ID NO: 128388 - RNA, 22 nt, Human
cccagccgaaugcucccuuccc

SEQ ID NO: 128389 - RNA, 20 nt, Human
caucaacaccuugucagccu

SEQ ID NO: 128390 - RNA, 23 nt, Human
cccgggaagugcugcuuaucugg

SEQ ID NO: 128391 - RNA, 22 nt, Human
ccaggcccugcuccucacacca

SEQ ID NO: 128392 - RNA, 22 nt, Human
ccaggcuccccaggaggcccuu

SEQ ID NO: 128393 - RNA, 22 nt, Human
ccaggcucaccuggagccccug

SEQ ID NO: 128394 - RNA, 22 nt, Human
ccaggcuaggaccgauuucccu

SEQ ID NO: 128395 - RNA, 22 nt, Human
ccagggagggccacagggccau

SEQ ID NO: 128396 - RNA, 22 nt, Human
ccagggcggacaaggucuuuga

SEQ ID NO: 128397 - RNA, 22 nt, Human
cccgcuaaaucaguucugaguc

SEQ ID NO: 128398 - RNA, 22 nt, Human
cccgacuccuccugguaccuaa

SEQ ID NO: 128399 - RNA, 22 nt, Human
ccaggcagaggggucuggagca

SEQ ID NO: 128400 - RNA, 22 nt, Human
cccgaaaauuguuguacugcag

SEQ ID NO: 128401 - RNA, 22 nt, Human
ccaggcccugccugugguuccu

SEQ ID NO: 128402 - RNA, 22 nt, Human
ccagccugccaagcccagcccu

SEQ ID NO: 128403 - RNA, 22 nt, Human
ccagccuucugaugggacccuc

SEQ ID NO: 128404 - RNA, 22 nt, Human
ccagccacugacugauuuaaaa

SEQ ID NO: 128405 - RNA, 22 nt, Human
ccccauggaaaacccaccuagg

SEQ ID NO: 128406 - RNA, 22 nt, Human
cccccauccccugaaggagcug

SEQ ID NO: 128407 - RNA, 22 nt, Human
ccccaguuccugucaaggguaa

SEQ ID NO: 128408 - RNA, 22 nt, Human
ccccguggcugggggacagagc

SEQ ID NO: 128409 - RNA, 23 nt, Human
ccccugcauggcaccacauuccc

SEQ ID NO: 128410 - RNA, 22 nt, Human
ccagcucgaggcaggggcugca

SEQ ID NO: 128411 - RNA, 22 nt, Human
ccagcugcugcaccgugcaugg

SEQ ID NO: 128412 - RNA, 22 nt, Human
ccagcuuuucagaaucugccug

SEQ ID NO: 128413 - RNA, 17 nt, Human
ccagcugcucccucaga

SEQ ID NO: 128414 - RNA, 22 nt, Human
ccaugggugucuggagcacccu

SEQ ID NO: 128415 - RNA, 22 nt, Human
ccgccccaggcccugagccaag

SEQ ID NO: 128416 - RNA, 22 nt, Human
ccauuuuccuguauggacucga

SEQ ID NO: 128417 - RNA, 22 nt, Human
cccacccuacugcuacccagga

SEQ ID NO: 128418 - RNA, 22 nt, Human
ccgaggaguagggugucuacgg

SEQ ID NO: 128419 - RNA, 22 nt, Human
ccgagguccugaagcaagggcc

SEQ ID NO: 128420 - RNA, 22 nt, Human
ccgagaucagaguaggauuugg

SEQ ID NO: 128421 - RNA, 22 nt, Human
ccaucccugagucacaggaggg

SEQ ID NO: 128422 - RNA, 22 nt, Human
cccuuugucaguagucuuagug

SEQ ID NO: 128423 - RNA, 21 nt, Human
ccgacggcgcagaugccggcc

SEQ ID NO: 128424 - RNA, 23 nt, Human
cccucgcuccucgguuccccugu

SEQ ID NO: 128425 - RNA, 17 nt, Human
cccugcacccuacucuc

SEQ ID NO: 128426 - RNA, 22 nt, Human
ccaggggagagucugagucguu

SEQ ID NO: 128427 - RNA, 22 nt, Human
ccaguccacgucaagaagaggu

SEQ ID NO: 128428 - RNA, 23 nt, Human
ccagucgagucccaaccuucacc

SEQ ID NO: 128429 - RNA, 22 nt, Human
ccagguuggccaccuucacggg

SEQ ID NO: 128430 - RNA, 22 nt, Human
cccgguggagaugugggacagg

SEQ ID NO: 128431 - RNA, 22 nt, Human
cccgggucugugugaaauucca

SEQ ID NO: 128432 - RNA, 22 nt, Human
cccuccagugucccagugggga

SEQ ID NO: 128433 - RNA, 22 nt, Human
ccagggcugcugccugggcugg

SEQ ID NO: 128434 - RNA, 22 nt, Human
cccuggcucaggcagcuuuguu

SEQ ID NO: 128435 - RNA, 22 nt, Human
cccuggacuccauuuucccgua

SEQ ID NO: 128436 - RNA, 20 nt, Human
cccuggcuggcaucuggacu

SEQ ID NO: 128437 - RNA, 22 nt, Human
cccugggccccgaacugcugag

SEQ ID NO: 128438 - RNA, 22 nt, Human
ccagugacaaagucggaagucc

SEQ ID NO: 128439 - RNA, 17 nt, Human
cccugcauugauccuca

SEQ ID NO: 128440 - RNA, 22 nt, Human
cccugcuuccucuucuguuugu

SEQ ID NO: 128441 - RNA, 22 nt, Human
ccagucugccggcccggccccu

SEQ ID NO: 128442 - RNA, 22 nt, Human
cccuguccugcuaggcccuggu

SEQ ID NO: 128443 - RNA, 22 nt, Human
cccuggucucugacuugauccu

SEQ ID NO: 128444 - RNA, 22 nt, Human
cccugggucagagcgacuucuc

SEQ ID NO: 128445 - RNA, 22 nt, Human
ccagugcuuccaggaauacggu

SEQ ID NO: 128446 - RNA, 22 nt, Human
ccagugcagacgcggaacuggc

SEQ ID NO: 128447 - RNA, 22 nt, Human
ccagugcaguacaaaccuuagu

SEQ ID NO: 128448 - RNA, 22 nt, Human
cccaguuguuccuauucuucuu

SEQ ID NO: 128449 - RNA, 22 nt, Human
ccgugccuuuaguuucuucugu

SEQ ID NO: 128450 - RNA, 22 nt, Human
ccgugcaguuucucacacacau

SEQ ID NO: 128451 - RNA, 22 nt, Human
ccguccgcuccuccagccgcug

SEQ ID NO: 128452 - RNA, 22 nt, Human
ccccagugguugcaacagcaga

SEQ ID NO: 128453 - RNA, 22 nt, Human
ccccaggcagcccuccaggagc

SEQ ID NO: 128454 - RNA, 22 nt, Human
ccccacaugaauacaguguagu

SEQ ID NO: 128455 - RNA, 22 nt, Human
cccagggguugaggccguaggg

SEQ ID NO: 128456 - RNA, 20 nt, Human
ccccagcauccuuuucaucu

SEQ ID NO: 128457 - RNA, 22 nt, Human
ccccaguuucaccuaccccgcc

SEQ ID NO: 128458 - RNA, 22 nt, Human
ccccugggcccugagccgcgau

SEQ ID NO: 128459 - RNA, 22 nt, Human
ccccugcucagggaggagaccg

SEQ ID NO: 128460 - RNA, 21 nt, Human
ccccuguggagcacauguggc

SEQ ID NO: 128461 - RNA, 22 nt, Human
ccgugggugggguacgggcugg

SEQ ID NO: 128462 - RNA, 22 nt, Human
ccuacccucaagggccuggggg

SEQ ID NO: 128463 - RNA, 22 nt, Human
ccuacccaccccuccucaucac

SEQ ID NO: 128464 - RNA, 20 nt, Human
ccucauucucgcguguguuu

SEQ ID NO: 128465 - RNA, 22 nt, Human
ccgcggcuguaguggaggugga

SEQ ID NO: 128466 - RNA, 22 nt, Human
ccgccucucgcucccagcuugc

SEQ ID NO: 128467 - RNA, 22 nt, Human
ccgcgcccccggcugugccccc

SEQ ID NO: 128468 - RNA, 22 nt, Human
ccgcucuuugagacucucccga

SEQ ID NO: 128469 - RNA, 22 nt, Human
cccacgccuucuuucuucaaau

SEQ ID NO: 128470 - RNA, 22 nt, Human
cccagaaugauucagcgacagu

SEQ ID NO: 128471 - RNA, 18 nt, Human
cccagaggaaugccugga

SEQ ID NO: 128472 - RNA, 22 nt, Human
cccagagggcugaggauaugaa

SEQ ID NO: 128473 - RNA, 19 nt, Human
cccagaggaaugccuggaa

SEQ ID NO: 128474 - RNA, 22 nt, Human
ccgcuggccgacuuccgagagc

SEQ ID NO: 128475 - RNA, 22 nt, Human
ccggaggaaauugcauugguug

SEQ ID NO: 128476 - RNA, 22 nt, Human
cccagcccaucauuccugcaaa

SEQ ID NO: 128477 - RNA, 22 nt, Human
cccagcaccauaacucaggccu

SEQ ID NO: 128478 - RNA, 22 nt, Human
cccagccugaucucggccagcu

SEQ ID NO: 128479 - RNA, 22 nt, Human
cccagcucuggaagguggggga

SEQ ID NO: 128480 - RNA, 22 nt, Human
cccagccgcuguggucuagggu

SEQ ID NO: 128481 - RNA, 22 nt, Human
ccggcugagccucgccgcggcc

SEQ ID NO: 128482 - RNA, 22 nt, Human
ccggcggguggagcaugcgcgg

SEQ ID NO: 128483 - RNA, 19 nt, Human
ccggucaugcauuccuuug

SEQ ID NO: 128484 - RNA, 22 nt, Human
ccggguucuuguucuaggaugu

SEQ ID NO: 128485 - RNA, 22 nt, Human
cccagcuggcaaaggcguccuu

SEQ ID NO: 128486 - RNA, 22 nt, Human
cccagcgccugcccuccgccgc

SEQ ID NO: 128487 - RNA, 22 nt, Human
ccucgcucauggauucugccug

SEQ ID NO: 128488 - RNA, 22 nt, Human
ccucgugcgauaguuaugucag

SEQ ID NO: 128489 - RNA, 22 nt, Human
ccuccugggccuugcucuguga

SEQ ID NO: 128490 - RNA, 22 nt, Human
cccggcucggcuucuuccccac

SEQ ID NO: 128491 - RNA, 19 nt, Human
ccuccgcauccucaucugu

SEQ ID NO: 128492 - RNA, 19 nt, Human
ccuccguguuaccuguccu

SEQ ID NO: 128493 - RNA, 22 nt, Human
cccgcucaccccacuccaccag

SEQ ID NO: 128494 - RNA, 22 nt, Human
cccggagcagucgggcuccggg

SEQ ID NO: 128495 - RNA, 22 nt, Human
cccggcgccucguuuccuaguc

SEQ ID NO: 128496 - RNA, 22 nt, Human
cccgaggagagguccaggcccu

SEQ ID NO: 128497 - RNA, 22 nt, Human
cccgccggccacaccggccgcc

SEQ ID NO: 128498 - RNA, 19 nt, Human
cccgauggagacuuagcag

SEQ ID NO: 128499 - RNA, 22 nt, Human
ccucccaccguaucucaguggc

SEQ ID NO: 128500 - RNA, 21 nt, Human
ccuccagccagagggucugga

SEQ ID NO: 128501 - RNA, 19 nt, Human
cccucggcuucugguuacu

SEQ ID NO: 128502 - RNA, 22 nt, Human
cccuccgccagugcccgccccg

SEQ ID NO: 128503 - RNA, 22 nt, Human
cccguggugggaugacaccaug

SEQ ID NO: 128504 - RNA, 22 nt, Human
cccgggccgagucuuccagcga

SEQ ID NO: 128505 - RNA, 22 nt, Human
cccgggcucuggcagaggcggu

SEQ ID NO: 128506 - RNA, 22 nt, Human
cccgguugggguuccagggcgc

SEQ ID NO: 128507 - RNA, 22 nt, Human
ccucuggacuugggacagugag

SEQ ID NO: 128508 - RNA, 22 nt, Human
ccugacagcgugucccuggccc

SEQ ID NO: 128509 - RNA, 22 nt, Human
cccugauaaaucagcaccucag

SEQ ID NO: 128510 - RNA, 22 nt, Human
cccugaggcccacaagucccag

SEQ ID NO: 128511 - RNA, 22 nt, Human
ccugaccauuugccacaugggu

SEQ ID NO: 128512 - RNA, 22 nt, Human
cccugcacuguguggacucugg

SEQ ID NO: 128513 - RNA, 22 nt, Human
ccugacucugauuucgcugcau

SEQ ID NO: 128514 - RNA, 21 nt, Human
ccugagccuguuuauccagaa

SEQ ID NO: 128515 - RNA, 22 nt, Human
ccugagacucuccugugcagcc

SEQ ID NO: 128516 - RNA, 22 nt, Human
ccugaggcccuggcugugcuga

SEQ ID NO: 128517 - RNA, 21 nt, Human
ccugagucccccagacccugg

SEQ ID NO: 128518 - RNA, 22 nt, Human
ccugcacuaccuggggcugcug

SEQ ID NO: 128519 - RNA, 22 nt, Human
ccugccugggcucacuugccag

SEQ ID NO: 128520 - RNA, 18 nt, Human
ccugcguggauguccucu

SEQ ID NO: 128521 - RNA, 22 nt, Human
ccugcucccccugcaagccuug

SEQ ID NO: 128522 - RNA, 21 nt, Human
cccuugccugcacuccucggc

SEQ ID NO: 128523 - RNA, 22 nt, Human
cgcacuugugagcgacagggcu

SEQ ID NO: 128524 - RNA, 22 nt, Human
cgcauugcaauucaggggauaa

SEQ ID NO: 128525 - RNA, 22 nt, Human
cgccaaccaggcuguccuccca

SEQ ID NO: 128526 - RNA, 22 nt, Human
cgagcccacacuccuguccucu

SEQ ID NO: 128527 - RNA, 22 nt, Human
cgcacuggagcuggaacgaguc

SEQ ID NO: 128528 - RNA, 22 nt, Human
cgcagcuucagggccaggaggg

SEQ ID NO: 128529 - RNA, 23 nt, Human
cgagagccugcaggaccuucgga

SEQ ID NO: 128530 - RNA, 22 nt, Human
cgagcccaacccucccguccuc

SEQ ID NO: 128531 - RNA, 19 nt, Human
ccucggggucugaagucag

SEQ ID NO: 128532 - RNA, 22 nt, Human
ccucaucagaaagcagaaagca

SEQ ID NO: 128533 - RNA, 22 nt, Human
cgaccccugaaaauggcagcca

SEQ ID NO: 128534 - RNA, 22 nt, Human
ccucucccugcagggcccaggg

SEQ ID NO: 128535 - RNA, 22 nt, Human
ccgccacggggcaugggaggca

SEQ ID NO: 128536 - RNA, 22 nt, Human
cgacagauuauuuugugacugc

SEQ ID NO: 128537 - RNA, 22 nt, Human
ccgcagggcccggcgggcucag

SEQ ID NO: 128538 - RNA, 22 nt, Human
ccgcagucugcaaucucccugg

SEQ ID NO: 128539 - RNA, 22 nt, Human
ccgcaccgucugccauacacgc

SEQ ID NO: 128540 - RNA, 21 nt, Human
ccgaggagugcggggagcccc

SEQ ID NO: 128541 - RNA, 22 nt, Human
ccugcuggagucuaguuggucu

SEQ ID NO: 128542 - RNA, 22 nt, Human
ccugcugcugaugcuguuucac

SEQ ID NO: 128543 - RNA, 22 nt, Human
cgcgggcuugggcaccugcgga

SEQ ID NO: 128544 - RNA, 22 nt, Human
cgcucggcuuucccuccgccgg

SEQ ID NO: 128545 - RNA, 22 nt, Human
cgcucggugagccaguggcgga

SEQ ID NO: 128546 - RNA, 22 nt, Human
ccugcaguagagguugguaggg

SEQ ID NO: 128547 - RNA, 22 nt, Human
cgcgcgguguuccgcauucugc

SEQ ID NO: 128548 - RNA, 22 nt, Human
ccugaagaugguugauccccuu

SEQ ID NO: 128549 - RNA, 22 nt, Human
ccugccagccugccaucccaca

SEQ ID NO: 128550 - RNA, 22 nt, Human
ccugccagaaaagagggaguuc

SEQ ID NO: 128551 - RNA, 22 nt, Human
ccugcccaucccaccccagcau

SEQ ID NO: 128552 - RNA, 22 nt, Human
ccugcaguuuuuccaugauaca

SEQ ID NO: 128553 - RNA, 21 nt, Human
ccugcacuucccuccucaagu

SEQ ID NO: 128554 - RNA, 22 nt, Human
ccugcaugacuuugucagaccu

SEQ ID NO: 128555 - RNA, 22 nt, Human
cggcgcugguacaguggaagag

SEQ ID NO: 128556 - RNA, 22 nt, Human
cggccuuugcccgucauucugg

SEQ ID NO: 128557 - RNA, 22 nt, Human
ccugcugagccuggugggcagc

SEQ ID NO: 128558 - RNA, 19 nt, Human
ccugcugaagugaugcagc

SEQ ID NO: 128559 - RNA, 22 nt, Human
ccugggcauuuguuucacaggu

SEQ ID NO: 128560 - RNA, 20 nt, Human
ccugggcuccaggagccccg

SEQ ID NO: 128561 - RNA, 22 nt, Human
ccuggguccucacaaucccagg

SEQ ID NO: 128562 - RNA, 22 nt, Human
ccugggcucgcgcacuucaccc

SEQ ID NO: 128563 - RNA, 22 nt, Human
ccuggggcucugcacagagcag

SEQ ID NO: 128564 - RNA, 22 nt, Human
cggggcggcgagcgggccgggc

SEQ ID NO: 128565 - RNA, 22 nt, Human
cggggcaaggggggcuggugga

SEQ ID NO: 128566 - RNA, 22 nt, Human
ccugugcuucacucaacaagcc

SEQ ID NO: 128567 - RNA, 22 nt, Human
cggggaggagccagcggaggau

SEQ ID NO: 128568 - RNA, 22 nt, Human
cgggcuccaagcuuucacccca

SEQ ID NO: 128569 - RNA, 22 nt, Human
cggggucuggaguuguggugug

SEQ ID NO: 128570 - RNA, 20 nt, Human
ccuguucacugcgcaguuuc

SEQ ID NO: 128571 - RNA, 22 nt, Human
cggggcgggcgugggaggugga

SEQ ID NO: 128572 - RNA, 22 nt, Human
cggggcucugcacaggccagga

SEQ ID NO: 128573 - RNA, 22 nt, Human
cggggccccccagugaaccucu

SEQ ID NO: 128574 - RNA, 19 nt, Human
cggggcuugguggguucuc

SEQ ID NO: 128575 - RNA, 22 nt, Human
cggggggguuggaaaagggaga

SEQ ID NO: 128576 - RNA, 22 nt, Human
cggggugugacggugcgggccu

SEQ ID NO: 128577 - RNA, 18 nt, Human
ccuucaucucugcuucuu

SEQ ID NO: 128578 - RNA, 22 nt, Human
cgggucgcacaggagaaaggcg

SEQ ID NO: 128579 - RNA, 22 nt, Human
ccuucccagacggcucagcugu

SEQ ID NO: 128580 - RNA, 22 nt, Human
cggugcuuuccauaucagcagc

SEQ ID NO: 128581 - RNA, 22 nt, Human
cgucagccacagcugccccggg

SEQ ID NO: 128582 - RNA, 20 nt, Human
cguugccagcccggcccggg

SEQ ID NO: 128583 - RNA, 20 nt, Human
ccuuuuguugcuguuuggau

SEQ ID NO: 128584 - RNA, 22 nt, Human
ccuuuuguuucccuuuauguuc

SEQ ID NO: 128585 - RNA, 19 nt, Human
cgacauggguaaugggaga

SEQ ID NO: 128586 - RNA, 22 nt, Human
cgaacggcagagagcccguccc

SEQ ID NO: 128587 - RNA, 22 nt, Human
cgacgacaggcgcccgaggagg

SEQ ID NO: 128588 - RNA, 22 nt, Human
cgacuacuaacuacuguagaaa

SEQ ID NO: 128589 - RNA, 22 nt, Human
cgccugucugcauggccacugg

SEQ ID NO: 128590 - RNA, 22 nt, Human
cgccuggccccgcagcgcuugu

SEQ ID NO: 128591 - RNA, 19 nt, Human
cgcugcucccgcuguggcu

SEQ ID NO: 128592 - RNA, 22 nt, Human
cucagaugcacacaggugaggg

SEQ ID NO: 128593 - RNA, 22 nt, Human
cuauugguaucacacugauuuc

SEQ ID NO: 128594 - RNA, 22 nt, Human
cucccaucacaauucagggccu

SEQ ID NO: 128595 - RNA, 22 nt, Human
cuccagggcuaccagguuuuag

SEQ ID NO: 128596 - RNA, 22 nt, Human
cuccuggagcagcaggcgcagg

SEQ ID NO: 128597 - RNA, 22 nt, Human
cuccugcuuuuucuucuuccga

SEQ ID NO: 128598 - RNA, 22 nt, Human
cucagcugauuaauuucauguu

SEQ ID NO: 128599 - RNA, 22 nt, Human
cgcuuugacuuuagaaggccaa

SEQ ID NO: 128600 - RNA, 22 nt, Human
cgcuuugguaauagggcagccu

SEQ ID NO: 128601 - RNA, 22 nt, Human
cggaagcacuagacacugacac

SEQ ID NO: 128602 - RNA, 22 nt, Human
cggagcauacugccuggagaug

SEQ ID NO: 128603 - RNA, 22 nt, Human
cggacugaccugcucggggaga

SEQ ID NO: 128604 - RNA, 22 nt, Human
cggcgccccgcgcgggcggcuc

SEQ ID NO: 128605 - RNA, 22 nt, Human
cucguccugguuuaaguguccu

SEQ ID NO: 128606 - RNA, 22 nt, Human
cucggagggcaaguacuggcug

SEQ ID NO: 128607 - RNA, 22 nt, Human
cucgccugacucggaugggcug

SEQ ID NO: 128608 - RNA, 22 nt, Human
cuccuuuuugggaccgugcagc

SEQ ID NO: 128609 - RNA, 19 nt, Human
cucuggcuccugggcugcc

SEQ ID NO: 128610 - RNA, 22 nt, Human
cucuggagggaggcugagcugg

SEQ ID NO: 128611 - RNA, 22 nt, Human
cucuggacaucugcggugcuuc

SEQ ID NO: 128612 - RNA, 17 nt, Human
cucugggucuccugcuu

SEQ ID NO: 128613 - RNA, 22 nt, Human
cucuguggucugaagccuguga

SEQ ID NO: 128614 - RNA, 22 nt, Human
cucuguugucaguggaagcagc

SEQ ID NO: 128615 - RNA, 22 nt, Human
cggcugcgguucaccuagggca

SEQ ID NO: 128616 - RNA, 22 nt, Human
cggcugcagcggagcaggcugg

SEQ ID NO: 128617 - RNA, 22 nt, Human
cggcuacccaugucauauucgu

SEQ ID NO: 128618 - RNA, 22 nt, Human
cggcggcgaaccgaccugggug

SEQ ID NO: 128619 - RNA, 22 nt, Human
cgggaggcggagcuccgcgggg

SEQ ID NO: 128620 - RNA, 22 nt, Human
cgggagagacagaggaggcgcc

SEQ ID NO: 128621 - RNA, 22 nt, Human
cgggagaugaggagagcuucgg

SEQ ID NO: 128622 - RNA, 22 nt, Human
cggggcuggcguuagggaggca

SEQ ID NO: 128623 - RNA, 22 nt, Human
cggggcuccgaagagcucgguu

SEQ ID NO: 128624 - RNA, 22 nt, Human
cggucggagagaaugaccugga

SEQ ID NO: 128625 - RNA, 22 nt, Human
cgguccugcucuuccucccguu

SEQ ID NO: 128626 - RNA, 22 nt, Human
cggguccuucugucuucucugg

SEQ ID NO: 128627 - RNA, 19 nt, Human
cggugcugauuggugcagu

SEQ ID NO: 128628 - RNA, 22 nt, Human
cggugccccuagcgcgccgccc

SEQ ID NO: 128629 - RNA, 19 nt, Human
cggugaagagaguuuagau

SEQ ID NO: 128630 - RNA, 22 nt, Human
cgggucgagugcuguaguucga

SEQ ID NO: 128631 - RNA, 22 nt, Human
cgggguguggggcgguagugug

SEQ ID NO: 128632 - RNA, 20 nt, Human
cugaccagcagccugucucc

SEQ ID NO: 128633 - RNA, 22 nt, Human
cugaccgugccgcgguacugcu

SEQ ID NO: 128634 - RNA, 22 nt, Human
cugaaggcuuugaauggaauga

SEQ ID NO: 128635 - RNA, 22 nt, Human
cuggcaguguccagcucgugau

SEQ ID NO: 128636 - RNA, 22 nt, Human
cuggcagcucugagucccuucu

SEQ ID NO: 128637 - RNA, 22 nt, Human
cuggcccugucagcacagaauc

SEQ ID NO: 128638 - RNA, 22 nt, Human
cugugccagucagggggcaagu

SEQ ID NO: 128639 - RNA, 22 nt, Human
cugugcuguuagcgauuuuuaa

SEQ ID NO: 128640 - RNA, 22 nt, Human
cugugcuguuaagaaauuuagu

SEQ ID NO: 128641 - RNA, 22 nt, Human
cugugcuugcugugcuggggcc

SEQ ID NO: 128642 - RNA, 22 nt, Human
cuguggcuaggaagcuguggga

SEQ ID NO: 128643 - RNA, 22 nt, Human
gaaauagagacaguaagugucu

SEQ ID NO: 128644 - RNA, 22 nt, Human
cuguguugggauggugcgcgca

SEQ ID NO: 128645 - RNA, 22 nt, Human
cugugugugcacacguguaugg

SEQ ID NO: 128646 - RNA, 22 nt, Human
cugugugcagggcacaauggaa

SEQ ID NO: 128647 - RNA, 22 nt, Human
cuguuucuuugcugucagagag

SEQ ID NO: 128648 - RNA, 22 nt, Human
gaacaugaguuuuaugguauuu

SEQ ID NO: 128649 - RNA, 22 nt, Human
cuguucagugcauauguauuga

SEQ ID NO: 128650 - RNA, 22 nt, Human
gaacaaaagauagcccaaacau

SEQ ID NO: 128651 - RNA, 22 nt, Human
gaagccaacacgugggagggag

SEQ ID NO: 128652 - RNA, 22 nt, Human
gaaggcagucuggggagcagcc

SEQ ID NO: 128653 - RNA, 22 nt, Human
gaaggcaguaaauggcuguuuu

SEQ ID NO: 128654 - RNA, 22 nt, Human
cuucucuugugauguuagcgga

SEQ ID NO: 128655 - RNA, 22 nt, Human
cuucuguggaauagguuugaca

SEQ ID NO: 128656 - RNA, 22 nt, Human
cuucauccguaccacggccaca

SEQ ID NO: 128657 - RNA, 22 nt, Human
gaagcuucucaacugguggaau

SEQ ID NO: 128658 - RNA, 21 nt, Human
gaagcugcuaugaagggggac

SEQ ID NO: 128659 - RNA, 19 nt, Human
cuucaguguucaccuggcc

SEQ ID NO: 128660 - RNA, 22 nt, Human
gaaucucuuugucccugaguuu

SEQ ID NO: 128661 - RNA, 22 nt, Human
cuucuuugacucacugguacgc

SEQ ID NO: 128662 - RNA, 22 nt, Human
cuugcuguccgaugggucugua

SEQ ID NO: 128663 - RNA, 21 nt, Human
cuuggagacucuuggccacau

SEQ ID NO: 128664 - RNA, 22 nt, Human
gaaugcacacgugugugcaugc

SEQ ID NO: 128665 - RNA, 22 nt, Human
cuugggguuugggggcuugacc

SEQ ID NO: 128666 - RNA, 22 nt, Human
cuuggugagcuccuggcgcagc

SEQ ID NO: 128667 - RNA, 22 nt, Human
gaaugccugggguucuucgauc

SEQ ID NO: 128668 - RNA, 22 nt, Human
gaauggagaacccuggacacug

SEQ ID NO: 128669 - RNA, 22 nt, Human
gacgacgggccccguggccacc

SEQ ID NO: 128670 - RNA, 22 nt, Human
gacggggcagccagcugguggc

SEQ ID NO: 128671 - RNA, 20 nt, Human
gacgaacuagaacaguggua

SEQ ID NO: 128672 - RNA, 19 nt, Human
cuuugugguuuucagaacu

SEQ ID NO: 128673 - RNA, 22 nt, Human
gaccacugaaugcacuucuaau

SEQ ID NO: 128674 - RNA, 22 nt, Human
gacccggauguuguacucgagg

SEQ ID NO: 128675 - RNA, 22 nt, Human
gacccgacaaguaaucagguga

SEQ ID NO: 128676 - RNA, 22 nt, Human
gacauugaauugaauccagauu

SEQ ID NO: 128677 - RNA, 22 nt, Human
gacuggggcauuagaguagcuu

SEQ ID NO: 128678 - RNA, 22 nt, Human
gacuggucuuuugugauggaug

SEQ ID NO: 128679 - RNA, 22 nt, Human
gacuggguaaagcuuauccaaa

SEQ ID NO: 128680 - RNA, 22 nt, Human
gacuucuuaaagaggugaggaa

SEQ ID NO: 128681 - RNA, 20 nt, Human
gacuucaauuucuaucuuuu

SEQ ID NO: 128682 - RNA, 22 nt, Human
gagaagguggaccugaaggagc

SEQ ID NO: 128683 - RNA, 22 nt, Human
gagaagugaauaacgaagcagg

SEQ ID NO: 128684 - RNA, 22 nt, Human
gaaagcauucuggaggggcaga

SEQ ID NO: 128685 - RNA, 22 nt, Human
gagaggcagcucaggaggucag

SEQ ID NO: 128686 - RNA, 22 nt, Human
gagaggacaggauccggagggc

SEQ ID NO: 128687 - RNA, 18 nt, Human
gagaggcauuuagcugau

SEQ ID NO: 128688 - RNA, 22 nt, Human
gagagcaaaccuguguuuggag

SEQ ID NO: 128689 - RNA, 22 nt, Human
gagagcugucagcguagcaccg

SEQ ID NO: 128690 - RNA, 22 nt, Human
gagaucuguguuugcugaagcu

SEQ ID NO: 128691 - RNA, 22 nt, Human
gagauggauuuuuuugccaguc

SEQ ID NO: 128692 - RNA, 22 nt, Human
gagauuguggcagcagcuguuu

SEQ ID NO: 128693 - RNA, 22 nt, Human
gaacaaggauucccaaagaaga

SEQ ID NO: 128694 - RNA, 22 nt, Human
gaacagauucaucuaguggcua

SEQ ID NO: 128695 - RNA, 22 nt, Human
gagcagccugaggauucugcuc

SEQ ID NO: 128696 - RNA, 22 nt, Human
gagcagcaggccagguugcagg

SEQ ID NO: 128697 - RNA, 22 nt, Human
gaaccuggcagcccuauaucug

SEQ ID NO: 128698 - RNA, 22 nt, Human
gagcacauguggagagucuggg

SEQ ID NO: 128699 - RNA, 22 nt, Human
gagcaacacauugaaugaggau

SEQ ID NO: 128700 - RNA, 22 nt, Human
gagcagacugcacaguucuugc

SEQ ID NO: 128701 - RNA, 22 nt, Human
gagcaggucuuugguaaugcuu

SEQ ID NO: 128702 - RNA, 22 nt, Human
gagcagucuuugaaaggcacca

SEQ ID NO: 128703 - RNA, 22 nt, Human
gagcagguuauuagaaauggaa

SEQ ID NO: 128704 - RNA, 22 nt, Human
gaagaaggaagaucaugcuuga

SEQ ID NO: 128705 - RNA, 22 nt, Human
gaagaggaagaggagccagagc

SEQ ID NO: 128706 - RNA, 22 nt, Human
gagcagcugagcuggaaugaga

SEQ ID NO: 128707 - RNA, 22 nt, Human
gagcagggagaggcagagaggc

SEQ ID NO: 128708 - RNA, 22 nt, Human
gagcaggucucaguucugccuc

SEQ ID NO: 128709 - RNA, 22 nt, Human
gaacugggguagggguagcuuu

SEQ ID NO: 128710 - RNA, 22 nt, Human
cugauuucaaauggugcuagau

SEQ ID NO: 128711 - RNA, 22 nt, Human
cuucccugucuacaacccugcc

SEQ ID NO: 128712 - RNA, 20 nt, Human
cugauguucgugcuuccugg

SEQ ID NO: 128713 - RNA, 22 nt, Human
cugauggagagugugauuuggg

SEQ ID NO: 128714 - RNA, 22 nt, Human
cuucaguuaguuucaugugagc

SEQ ID NO: 128715 - RNA, 21 nt, Human
cuucgcuguuccagcucuugg

SEQ ID NO: 128716 - RNA, 22 nt, Human
cuucuaauucuuauguaagcuu

SEQ ID NO: 128717 - RNA, 23 nt, Human
cuucggcgcucgcugggcggagg

SEQ ID NO: 128718 - RNA, 22 nt, Human
cugcaguguccgcuugcucagc

SEQ ID NO: 128719 - RNA, 22 nt, Human
cugccacuaccaugcuggauga

SEQ ID NO: 128720 - RNA, 22 nt, Human
cugcagauguagcugcuuuccu

SEQ ID NO: 128721 - RNA, 22 nt, Human
cuuccugcaacaccuguguugc

SEQ ID NO: 128722 - RNA, 22 nt, Human
cuucuguguggauacagucccu

SEQ ID NO: 128723 - RNA, 22 nt, Human
cuucuucaucuuuuggaggaac

SEQ ID NO: 128724 - RNA, 22 nt, Human
cuucucuuugacaguugggugu

SEQ ID NO: 128725 - RNA, 22 nt, Human
cuucuucuagaagauggggaag

SEQ ID NO: 128726 - RNA, 22 nt, Human
cuucuugggaggggcggagcuc

SEQ ID NO: 128727 - RNA, 22 nt, Human
cuugccaguguugcagaagcuc

SEQ ID NO: 128728 - RNA, 22 nt, Human
cuugccagggacucagucaggg

SEQ ID NO: 128729 - RNA, 22 nt, Human
cuugauucauuuaagguuggag

SEQ ID NO: 128730 - RNA, 20 nt, Human
cuugaguucagagcugucau

SEQ ID NO: 128731 - RNA, 22 nt, Human
cugccuggggaaugugaggauu

SEQ ID NO: 128732 - RNA, 22 nt, Human
cugccccucgcucaccagcucu

SEQ ID NO: 128733 - RNA, 22 nt, Human
cugccggcugcugcagagaggu

SEQ ID NO: 128734 - RNA, 22 nt, Human
cugcccauggcuccuggcugug

SEQ ID NO: 128735 - RNA, 22 nt, Human
cuggaaagauuuacacggggaa

SEQ ID NO: 128736 - RNA, 22 nt, Human
cugcuuguguugcucagaguca

SEQ ID NO: 128737 - RNA, 22 nt, Human
cugcuuuggaucucucucugcc

SEQ ID NO: 128738 - RNA, 22 nt, Human
cuggaagcgucggaggaagggc

SEQ ID NO: 128739 - RNA, 22 nt, Human
cuggacucuuuguuuaguucug

SEQ ID NO: 128740 - RNA, 22 nt, Human
cuggagaagagguaguauguag

SEQ ID NO: 128741 - RNA, 22 nt, Human
cuuucauuuuugggcaucugag

SEQ ID NO: 128742 - RNA, 22 nt, Human
cugcugugcagacagacucucu

SEQ ID NO: 128743 - RNA, 22 nt, Human
cugcuggugcugcccacacggu

SEQ ID NO: 128744 - RNA, 22 nt, Human
cugcuguugagguuccaggcca

SEQ ID NO: 128745 - RNA, 22 nt, Human
cuuggcuccuucacagggagau

SEQ ID NO: 128746 - RNA, 22 nt, Human
cuuggugcgaagagucagggga

SEQ ID NO: 128747 - RNA, 22 nt, Human
cugcuguuuuccccaccaucuc

SEQ ID NO: 128748 - RNA, 22 nt, Human
cuuggggucuuacuuguacccu

SEQ ID NO: 128749 - RNA, 22 nt, Human
cugcgguucuguuuaguggcga

SEQ ID NO: 128750 - RNA, 22 nt, Human
cugcgcgagcacugccggcggg

SEQ ID NO: 128751 - RNA, 22 nt, Human
cugcguugaccagacuccuggg

SEQ ID NO: 128752 - RNA, 22 nt, Human
cugcucugagaggcucuuccua

SEQ ID NO: 128753 - RNA, 22 nt, Human
cuugcugggagagcuuuagaga

SEQ ID NO: 128754 - RNA, 22 nt, Human
cugccuucaaaguaauauuuua

SEQ ID NO: 128755 - RNA, 22 nt, Human
cuugcuuuaucugguuucucau

SEQ ID NO: 128756 - RNA, 22 nt, Human
cuuggcacauuuuguucuucug

SEQ ID NO: 128757 - RNA, 22 nt, Human
cuuggcacccaucuuuccaccu

SEQ ID NO: 128758 - RNA, 22 nt, Human
cuuggcaaaguggcaaaauuag

SEQ ID NO: 128759 - RNA, 22 nt, Human
cuuggcauguucaucugcuugg

SEQ ID NO: 128760 - RNA, 21 nt, Human
cugcugaaggaaccccaugga

SEQ ID NO: 128761 - RNA, 22 nt, Human
cucuggggaagugcacucgcug

SEQ ID NO: 128762 - RNA, 18 nt, Human
cucuggacagcaggcauc

SEQ ID NO: 128763 - RNA, 22 nt, Human
cucugcuuguaucacauuugcu

SEQ ID NO: 128764 - RNA, 20 nt, Human
cuggugccuucugcgauuua

SEQ ID NO: 128765 - RNA, 22 nt, Human
cucggcccuggucuuacgggac

SEQ ID NO: 128766 - RNA, 22 nt, Human
cucugcccacaguccccgagga

SEQ ID NO: 128767 - RNA, 22 nt, Human
cucugcguggcugggcccaggg

SEQ ID NO: 128768 - RNA, 22 nt, Human
cuguggcugcgcccugggggag

SEQ ID NO: 128769 - RNA, 22 nt, Human
cuguggaguccuggggaaugga

SEQ ID NO: 128770 - RNA, 22 nt, Human
cugugcuucgagggcuccccgc

SEQ ID NO: 128771 - RNA, 22 nt, Human
cuguggaaugcaguugcgagca

SEQ ID NO: 128772 - RNA, 22 nt, Human
cugugguuuuauuuauuugaag

SEQ ID NO: 128773 - RNA, 22 nt, Human
cugucucugauaagcucgaggg

SEQ ID NO: 128774 - RNA, 22 nt, Human
cugugcauaugucuugaggucu

SEQ ID NO: 128775 - RNA, 22 nt, Human
cucuugacagcuuuaguaucau

SEQ ID NO: 128776 - RNA, 22 nt, Human
cuguguggccuaaguggagaca

SEQ ID NO: 128777 - RNA, 22 nt, Human
cugugucucccaaggaggguca

SEQ ID NO: 128778 - RNA, 22 nt, Human
cuguguguauaauguuugauaa

SEQ ID NO: 128779 - RNA, 22 nt, Human
cugaaggacacgugaggagcca

SEQ ID NO: 128780 - RNA, 22 nt, Human
cugaccucuaaguaacagagaa

SEQ ID NO: 128781 - RNA, 22 nt, Human
cucggggcguggcaguagcaug

SEQ ID NO: 128782 - RNA, 22 nt, Human
cugaauucuuguugucggagca

SEQ ID NO: 128783 - RNA, 22 nt, Human
cuguuuggaugccauggucaag

SEQ ID NO: 128784 - RNA, 20 nt, Human
cugaauaccacagagccauc

SEQ ID NO: 128785 - RNA, 22 nt, Human
cugagcggugagggcauacagc

SEQ ID NO: 128786 - RNA, 22 nt, Human
cugagcuuuucucugcuucuua

SEQ ID NO: 128787 - RNA, 22 nt, Human
cuucacuaccuacacugccgcu

SEQ ID NO: 128788 - RNA, 22 nt, Human
cuucaacuucuguuuuaaggaa

SEQ ID NO: 128789 - RNA, 22 nt, Human
cuucacuccuggagugaguuuc

SEQ ID NO: 128790 - RNA, 22 nt, Human
cuggcgagcugggccuggggga

SEQ ID NO: 128791 - RNA, 21 nt, Human
cucauuccccgucccggcccc

SEQ ID NO: 128792 - RNA, 22 nt, Human
cuccaggacugaggacagagcu

SEQ ID NO: 128793 - RNA, 22 nt, Human
cuccaggcccagggccaagagc

SEQ ID NO: 128794 - RNA, 22 nt, Human
cuccagucccuccuugcccagc

SEQ ID NO: 128795 - RNA, 22 nt, Human
cuccccacucaacucccagacc

SEQ ID NO: 128796 - RNA, 22 nt, Human
cugggaaucuagagggcucauu

SEQ ID NO: 128797 - RNA, 22 nt, Human
cucccgagccuuacucuguucc

SEQ ID NO: 128798 - RNA, 22 nt, Human
cuccggccuucugacuccccug

SEQ ID NO: 128799 - RNA, 22 nt, Human
cugggagaggaaccucgagggu

SEQ ID NO: 128800 - RNA, 20 nt, Human
cuccuccccucggccccacc

SEQ ID NO: 128801 - RNA, 22 nt, Human
cuccuuccuccgcccuuccucg

SEQ ID NO: 128802 - RNA, 22 nt, Human
cuccuugguuccggcguuggag

SEQ ID NO: 128803 - RNA, 22 nt, Human
cuggagucagcaaggacgaggc

SEQ ID NO: 128804 - RNA, 22 nt, Human
cuggagcuucaggguucucggg

SEQ ID NO: 128805 - RNA, 22 nt, Human
cuggauagaggaugguaggcac

SEQ ID NO: 128806 - RNA, 22 nt, Human
cuggaugagcuucgugcgcacg

SEQ ID NO: 128807 - RNA, 22 nt, Human
cuggccugugggcugucuccgg

SEQ ID NO: 128808 - RNA, 22 nt, Human
cuggccagccucccagguaccc

SEQ ID NO: 128809 - RNA, 22 nt, Human
cuggccaggugggggguagugg

SEQ ID NO: 128810 - RNA, 22 nt, Human
cugaccugugagcuaugccggc

SEQ ID NO: 128811 - RNA, 22 nt, Human
cugacugaggaucaguucauca

SEQ ID NO: 128812 - RNA, 19 nt, Human
cugagcagggaaaaacccu

SEQ ID NO: 128813 - RNA, 22 nt, Human
cugagaucaugggucagguggu

SEQ ID NO: 128814 - RNA, 22 nt, Human
cuggaaaaauggauccugucuu

SEQ ID NO: 128815 - RNA, 22 nt, Human
cuggagaucaguuggacaacag

SEQ ID NO: 128816 - RNA, 23 nt, Human
cuggacauucgcaaaguucaucu

SEQ ID NO: 128817 - RNA, 22 nt, Human
cacgggcgacgugaucuaggac

SEQ ID NO: 128818 - RNA, 22 nt, Human
cagagccagcuguccuuggcau

SEQ ID NO: 128819 - RNA, 22 nt, Human
cagagcugagucuucaagguug

SEQ ID NO: 128820 - RNA, 22 nt, Human
cagagcucacaaacugaaaacc

SEQ ID NO: 128821 - RNA, 22 nt, Human
cagagcugucauuugccaguga

SEQ ID NO: 128822 - RNA, 22 nt, Human
caauugcuuccuucuguaagua

SEQ ID NO: 128823 - RNA, 22 nt, Human
cacaacaaaaaauaaguaugag

SEQ ID NO: 128824 - RNA, 22 nt, Human
cagaucacauccauccgucacc

SEQ ID NO: 128825 - RNA, 22 nt, Human
cagauguuugaaugcuuaccac

SEQ ID NO: 128826 - RNA, 21 nt, Human
cagagcuuuggagacggagga

SEQ ID NO: 128827 - RNA, 22 nt, Human
cagaggagcgaguuggacgcca

SEQ ID NO: 128828 - RNA, 22 nt, Human
cagaguccugcaccagcuccag

SEQ ID NO: 128829 - RNA, 22 nt, Human
cagcuccagcccaggcagcucc

SEQ ID NO: 128830 - RNA, 22 nt, Human
cagcugcgcagcgccgggccug

SEQ ID NO: 128831 - RNA, 22 nt, Human
cagcccaucaaggggauccuga

SEQ ID NO: 128832 - RNA, 22 nt, Human
cagauacaacagcaggaaugaa

SEQ ID NO: 128833 - RNA, 22 nt, Human
cagaguccuguaguauugcugg

SEQ ID NO: 128834 - RNA, 22 nt, Human
cagcaugguggagcugcucuuu

SEQ ID NO: 128835 - RNA, 22 nt, Human
cagacagagucuucccaucagu

SEQ ID NO: 128836 - RNA, 22 nt, Human
cagaccagaaggaagccgacaa

SEQ ID NO: 128837 - RNA, 22 nt, Human
cagacacgucccuguugaccug

SEQ ID NO: 128838 - RNA, 22 nt, Human
cagcuguauuucucugguuaga

SEQ ID NO: 128839 - RNA, 20 nt, Human
cagcagucagcucuccaaug

SEQ ID NO: 128840 - RNA, 22 nt, Human
cagcagaugacuauuggagcug

SEQ ID NO: 128841 - RNA, 21 nt, Human
cagcagaugccagggucucug

SEQ ID NO: 128842 - RNA, 22 nt, Human
cagcagaggagguggcagcacc

SEQ ID NO: 128843 - RNA, 22 nt, Human
cagaucacucugggcggcggga

SEQ ID NO: 128844 - RNA, 22 nt, Human
cagcuugcccugauguggaaga

SEQ ID NO: 128845 - RNA, 22 nt, Human
cagccccagcacuuagcugagu

SEQ ID NO: 128846 - RNA, 22 nt, Human
cagcccaggcucagauguuggg

SEQ ID NO: 128847 - RNA, 22 nt, Human
cagcuguggagauggggugcau

SEQ ID NO: 128848 - RNA, 22 nt, Human
cagcuuaccucccacagcucuc

SEQ ID NO: 128849 - RNA, 22 nt, Human
cagccuggccucuggauauuug

SEQ ID NO: 128850 - RNA, 22 nt, Human
cagccgcucaugggcccggagc

SEQ ID NO: 128851 - RNA, 22 nt, Human
cagcuuguucugaccugugauu

SEQ ID NO: 128852 - RNA, 22 nt, Human
cagggccaggccucaggggcgc

SEQ ID NO: 128853 - RNA, 22 nt, Human
cagggcacaguuauggaggugg

SEQ ID NO: 128854 - RNA, 22 nt, Human
cagggcuuuuuccuccucuuug

SEQ ID NO: 128855 - RNA, 22 nt, Human
caggggcuccaggugagccugg

SEQ ID NO: 128856 - RNA, 22 nt, Human
caggggcuuuccuguuuaugga

SEQ ID NO: 128857 - RNA, 22 nt, Human
caggggucccccggcucccugg

SEQ ID NO: 128858 - RNA, 22 nt, Human
caggguaccaagcuucgcccuc

SEQ ID NO: 128859 - RNA, 22 nt, Human
cagggugaagaugcgccuccug

SEQ ID NO: 128860 - RNA, 22 nt, Human
caggcacagcuaagacuggcca

SEQ ID NO: 128861 - RNA, 22 nt, Human
caggcagggagcuggaaaggau

SEQ ID NO: 128862 - RNA, 22 nt, Human
cagcucgaauaauggagaacug

SEQ ID NO: 128863 - RNA, 22 nt, Human
cagcucugcugggaggaugcag

SEQ ID NO: 128864 - RNA, 22 nt, Human
cagcucuccacccuccugguuc

SEQ ID NO: 128865 - RNA, 22 nt, Human
cagcucuggcuauugaggacca

SEQ ID NO: 128866 - RNA, 22 nt, Human
cagugccggccaggaccuccug

SEQ ID NO: 128867 - RNA, 22 nt, Human
caucucagguuuguucugagac

SEQ ID NO: 128868 - RNA, 22 nt, Human
caucuuuguuuuggauauaauc

SEQ ID NO: 128869 - RNA, 22 nt, Human
caucugcagccucugcauuccc

SEQ ID NO: 128870 - RNA, 22 nt, Human
cagugcuggaggggugcuugca

SEQ ID NO: 128871 - RNA, 22 nt, Human
cagugcucauagcuguuccucc

SEQ ID NO: 128872 - RNA, 22 nt, Human
cagugcuccugccccugcccuu

SEQ ID NO: 128873 - RNA, 22 nt, Human
caguggaugucucauaguguga

SEQ ID NO: 128874 - RNA, 22 nt, Human
caguucacggcugguaugaauu

SEQ ID NO: 128875 - RNA, 22 nt, Human
caguucaagauuguugcuuucu

SEQ ID NO: 128876 - RNA, 22 nt, Human
caguggggcuuccagacgcuga

SEQ ID NO: 128877 - RNA, 22 nt, Human
caguguuuagcacagugcuugg

SEQ ID NO: 128878 - RNA, 22 nt, Human
caugauucccacauugcgauca

SEQ ID NO: 128879 - RNA, 22 nt, Human
caugcagcagaauaaugacuau

SEQ ID NO: 128880 - RNA, 22 nt, Human
caugccugaucagcggccagca

SEQ ID NO: 128881 - RNA, 22 nt, Human
caugcgucugcauuggguggug

SEQ ID NO: 128882 - RNA, 22 nt, Human
caugcuggcacugaccagccua

SEQ ID NO: 128883 - RNA, 22 nt, Human
cauggcggcgcucucccugccu

SEQ ID NO: 128884 - RNA, 22 nt, Human
cauggcaggugcagauucugug

SEQ ID NO: 128885 - RNA, 19 nt, Human
cauggcgguaaagaggcug

SEQ ID NO: 128886 - RNA, 22 nt, Human
caugggcucuucuggacugcac

SEQ ID NO: 128887 - RNA, 19 nt, Human
caggucuucuuggaggacu

SEQ ID NO: 128888 - RNA, 22 nt, Human
cagguuguucugggcauggagg

SEQ ID NO: 128889 - RNA, 22 nt, Human
cagguaguuagaaugaccagga

SEQ ID NO: 128890 - RNA, 22 nt, Human
cauacauguuagcaguagccuu

SEQ ID NO: 128891 - RNA, 22 nt, Human
caggucauaacuaugcaugaac

SEQ ID NO: 128892 - RNA, 19 nt, Human
caggggcuuaugcgaccuc

SEQ ID NO: 128893 - RNA, 22 nt, Human
cagggggcccagcugggagggg

SEQ ID NO: 128894 - RNA, 22 nt, Human
caguacugucuuccugauggca

SEQ ID NO: 128895 - RNA, 22 nt, Human
caucccaacaggugaucuggua

SEQ ID NO: 128896 - RNA, 22 nt, Human
cauccagggguacccuggagcc

SEQ ID NO: 128897 - RNA, 22 nt, Human
cauccagagcugccugaccccg

SEQ ID NO: 128898 - RNA, 22 nt, Human
caggcgcugacgggaccgggcu

SEQ ID NO: 128899 - RNA, 22 nt, Human
cagggagcggggagaucucggg

SEQ ID NO: 128900 - RNA, 20 nt, Human
caggccuucaggauggcugg

SEQ ID NO: 128901 - RNA, 22 nt, Human
caggccgcccucuccuguuagc

SEQ ID NO: 128902 - RNA, 22 nt, Human
cagggcagaguuaagaugcugg

SEQ ID NO: 128903 - RNA, 22 nt, Human
cagggcaucucugaaucuucac

SEQ ID NO: 128904 - RNA, 22 nt, Human
caggggaagccagcugccaugu

SEQ ID NO: 128905 - RNA, 22 nt, Human
cagggcuugaaucaaggaaguc

SEQ ID NO: 128906 - RNA, 22 nt, Human
cagggccagggcuauggugaag

SEQ ID NO: 128907 - RNA, 22 nt, Human
caggucagcacuuggaggugca

SEQ ID NO: 128908 - RNA, 22 nt, Human
caggcagggcugccuucugcuu

SEQ ID NO: 128909 - RNA, 22 nt, Human
caggcaggagaaaaggcgcggg

SEQ ID NO: 128910 - RNA, 22 nt, Human
caggccacagcuaaagaggauu

SEQ ID NO: 128911 - RNA, 22 nt, Human
caggccagcuggaggggcagcu

SEQ ID NO: 128912 - RNA, 23 nt, Human
cagucgacugugcccucccgagc

SEQ ID NO: 128913 - RNA, 22 nt, Human
caggcagagagggcagugugga

SEQ ID NO: 128914 - RNA, 19 nt, Human
auuuccuggcauauaucac

SEQ ID NO: 128915 - RNA, 22 nt, Human
auuucagcagcccauguuugga

SEQ ID NO: 128916 - RNA, 22 nt, Human
auuuggaaacaugcugaccaug

SEQ ID NO: 128917 - RNA, 22 nt, Human
auuuggaaggcguuucucugua

SEQ ID NO: 128918 - RNA, 22 nt, Human
auuagguaguauaaucuuuguu

SEQ ID NO: 128919 - RNA, 22 nt, Human
auugacuuucccuucuccucau

SEQ ID NO: 128920 - RNA, 18 nt, Human
auuuguggggguuauaga

SEQ ID NO: 128921 - RNA, 22 nt, Human
auuugcaucagugagcgaugug

SEQ ID NO: 128922 - RNA, 23 nt, Human
auuugcugaucguagaugacuag

SEQ ID NO: 128923 - RNA, 21 nt, Human
auuuguggugcaauuguggua

SEQ ID NO: 128924 - RNA, 22 nt, Human
caaaacauucagagagcucacu

SEQ ID NO: 128925 - RNA, 22 nt, Human
caacguggauucuuccaggggc

SEQ ID NO: 128926 - RNA, 17 nt, Human
caaccaggaaaggaggg

SEQ ID NO: 128927 - RNA, 22 nt, Human
caacuucuauucagucugcagu

SEQ ID NO: 128928 - RNA, 19 nt, Human
caagagcaaagucuuauga

SEQ ID NO: 128929 - RNA, 22 nt, Human
caagagcgugugcagggcaagu

SEQ ID NO: 128930 - RNA, 22 nt, Human
cacagauaaggcuuugucccca

SEQ ID NO: 128931 - RNA, 22 nt, Human
cacacagguaagccucuuucaa

SEQ ID NO: 128932 - RNA, 22 nt, Human
cacaucucagggcuacaggcag

SEQ ID NO: 128933 - RNA, 22 nt, Human
caagagguaugagccgggauga

SEQ ID NO: 128934 - RNA, 22 nt, Human
cacagcuggggaagcugaggcc

SEQ ID NO: 128935 - RNA, 22 nt, Human
caagcgcgccgcuuccuuccgc

SEQ ID NO: 128936 - RNA, 22 nt, Human
caaggaaaacagaugaucaaca

SEQ ID NO: 128937 - RNA, 22 nt, Human
cacauguguaccugccucucug

SEQ ID NO: 128938 - RNA, 22 nt, Human
cacaugugggcacagggcugca

SEQ ID NO: 128939 - RNA, 22 nt, Human
cacauuucagcacucagggcau

SEQ ID NO: 128940 - RNA, 22 nt, Human
caagggcagaggcagggccccg

SEQ ID NO: 128941 - RNA, 22 nt, Human
caccagcgacugugaccagcaa

SEQ ID NO: 128942 - RNA, 22 nt, Human
caccacuuggcccugagguccu

SEQ ID NO: 128943 - RNA, 22 nt, Human
caccaucugaauauucuccaag

SEQ ID NO: 128944 - RNA, 22 nt, Human
caagguugugacccaaugacca

SEQ ID NO: 128945 - RNA, 22 nt, Human
caccacauguccgaaauucagc

SEQ ID NO: 128946 - RNA, 22 nt, Human
caccuggaggcagcaccgggcu

SEQ ID NO: 128947 - RNA, 22 nt, Human
cacccgacugaggacgccgccc

SEQ ID NO: 128948 - RNA, 22 nt, Human
caccccauccccucccaauucc

SEQ ID NO: 128949 - RNA, 22 nt, Human
cacccccaggcuccccuucugg

SEQ ID NO: 128950 - RNA, 20 nt, Human
caauguuggcaguauagagc

SEQ ID NO: 128951 - RNA, 22 nt, Human
caaaugcaguggucgugcugga

SEQ ID NO: 128952 - RNA, 22 nt, Human
caaugccaggaaccugggggaa

SEQ ID NO: 128953 - RNA, 22 nt, Human
caauagcuauguaaccugaaga

SEQ ID NO: 128954 - RNA, 22 nt, Human
caaauacguuuggcuggagcac

SEQ ID NO: 128955 - RNA, 22 nt, Human
caaaguauuuagcugacucgcu

SEQ ID NO: 128956 - RNA, 22 nt, Human
cacacaccagaaagccugggac

SEQ ID NO: 128957 - RNA, 22 nt, Human
caacaagcgcucagagcaaagc

SEQ ID NO: 128958 - RNA, 22 nt, Human
caacaaguugauuucacgcugc

SEQ ID NO: 128959 - RNA, 22 nt, Human
cacacagcuagugacaggagaa

SEQ ID NO: 128960 - RNA, 22 nt, Human
caagaugcaagaccagucaggc

SEQ ID NO: 128961 - RNA, 22 nt, Human
caaagaagagauuuacagagcu

SEQ ID NO: 128962 - RNA, 22 nt, Human
caaggaaaugucagaaaggcaa

SEQ ID NO: 128963 - RNA, 22 nt, Human
caagaaguugacagccagguga

SEQ ID NO: 128964 - RNA, 22 nt, Human
caagagcucccagaccugggca

SEQ ID NO: 128965 - RNA, 22 nt, Human
caaggucagacagccaggacag

SEQ ID NO: 128966 - RNA, 22 nt, Human
caagguuucgaguucccaacca

SEQ ID NO: 128967 - RNA, 22 nt, Human
caaguaugagaaagcuauuacc

SEQ ID NO: 128968 - RNA, 22 nt, Human
caaggaagguugguugaaggua

SEQ ID NO: 128969 - RNA, 22 nt, Human
caaagccuggggagaguaagga

SEQ ID NO: 128970 - RNA, 22 nt, Human
auggugaaaugauuugauguca

SEQ ID NO: 128971 - RNA, 22 nt, Human
augguugggggaugucagcagg

SEQ ID NO: 128972 - RNA, 22 nt, Human
auggcuucugucuuggaaauuu

SEQ ID NO: 128973 - RNA, 22 nt, Human
augguugccugagauaagacug

SEQ ID NO: 128974 - RNA, 22 nt, Human
augcuuucucuucuauuucuca

SEQ ID NO: 128975 - RNA, 22 nt, Human
auggcuguguuguuccucugaa

SEQ ID NO: 128976 - RNA, 22 nt, Human
auggccuuucucaguggugcuu

SEQ ID NO: 128977 - RNA, 22 nt, Human
auggccugaagcuaaccccccu

SEQ ID NO: 128978 - RNA, 22 nt, Human
augugaaauuugggcucuggga

SEQ ID NO: 128979 - RNA, 22 nt, Human
auguucucagguuguauuuauu

SEQ ID NO: 128980 - RNA, 22 nt, Human
auguuccuuaaugugcuuguag

SEQ ID NO: 128981 - RNA, 22 nt, Human
auguguguaugugugcauguau

SEQ ID NO: 128982 - RNA, 22 nt, Human
augugugugcgagcgugugugu

SEQ ID NO: 128983 - RNA, 21 nt, Human
auguguucugauagugcuugc

SEQ ID NO: 128984 - RNA, 22 nt, Human
augugauacuccuucuagugga

SEQ ID NO: 128985 - RNA, 22 nt, Human
augugcacuggugugugcguuc

SEQ ID NO: 128986 - RNA, 22 nt, Human
auguucccaaaaucccuguaga

SEQ ID NO: 128987 - RNA, 22 nt, Human
auucaagauaagggucugggag

SEQ ID NO: 128988 - RNA, 22 nt, Human
auuccagggaaauggggaugga

SEQ ID NO: 128989 - RNA, 22 nt, Human
auucauuuuuacaucaccaaua

SEQ ID NO: 128990 - RNA, 19 nt, Human
auguucugaauuacuguaa

SEQ ID NO: 128991 - RNA, 22 nt, Human
augcggcugugggggaauggga

SEQ ID NO: 128992 - RNA, 22 nt, Human
augccugggcuuuaggguucuc

SEQ ID NO: 128993 - RNA, 22 nt, Human
augcgcugugcacacucuuaac

SEQ ID NO: 128994 - RNA, 22 nt, Human
augcugacaacaaagaaggaag

SEQ ID NO: 128995 - RNA, 22 nt, Human
augcucggcuuucuuucuuucu

SEQ ID NO: 128996 - RNA, 22 nt, Human
augccgggguggcuccagcacc

SEQ ID NO: 128997 - RNA, 22 nt, Human
augcccugggagugcuguacca

SEQ ID NO: 128998 - RNA, 17 nt, Human
augcccagggcucccug

SEQ ID NO: 128999 - RNA, 22 nt, Human
augcaccugucuuuuaaggaua

SEQ ID NO: 129000 - RNA, 22 nt, Human
augcagcggucagaggaacuca

SEQ ID NO: 129001 - RNA, 22 nt, Human
augcagauguagauucugaaau

SEQ ID NO: 129002 - RNA, 22 nt, Human
augaugaugguuuaacuucagg

SEQ ID NO: 129003 - RNA, 22 nt, Human
augaucacagugucagucauua

SEQ ID NO: 129004 - RNA, 22 nt, Human
augauggagaacaaagaaaauc

SEQ ID NO: 129005 - RNA, 21 nt, Human
augcgcgguggagugagcgaa

SEQ ID NO: 129006 - RNA, 22 nt, Human
augccugcugucaggaacucuu

SEQ ID NO: 129007 - RNA, 22 nt, Human
augcuugaaaguuauuucauuu

SEQ ID NO: 129008 - RNA, 22 nt, Human
augcugugccuggaaagcggcu

SEQ ID NO: 129009 - RNA, 22 nt, Human
augcugcuuguccauuuauuug

SEQ ID NO: 129010 - RNA, 22 nt, Human
auggccuguuuccucugaaaga

SEQ ID NO: 129011 - RNA, 22 nt, Human
augcuugcccauguuucugaag

SEQ ID NO: 129012 - RNA, 18 nt, Human
augcugacacaaugugga

SEQ ID NO: 129013 - RNA, 22 nt, Human
augcugccuaaagcuacuuaca

SEQ ID NO: 129014 - RNA, 22 nt, Human
auggagugggaggacaugaagg

SEQ ID NO: 129015 - RNA, 22 nt, Human
aucugcugccuaggguuugucu

SEQ ID NO: 129016 - RNA, 22 nt, Human
aucuagguuuggaagauagagu

SEQ ID NO: 129017 - RNA, 22 nt, Human
augaaacucuagcuuucagcac

SEQ ID NO: 129018 - RNA, 22 nt, Human
aucugucagaccuuggucacag

SEQ ID NO: 129019 - RNA, 20 nt, Human
aucugguggggaauaacuuc

SEQ ID NO: 129020 - RNA, 22 nt, Human
augauucuaccaaugccaucuu

SEQ ID NO: 129021 - RNA, 22 nt, Human
augagcucuaaguacaugccca

SEQ ID NO: 129022 - RNA, 22 nt, Human
augacagcuaaggaauguguag

SEQ ID NO: 129023 - RNA, 22 nt, Human
augaccauccagaaguccagcu

SEQ ID NO: 129024 - RNA, 22 nt, Human
augaaugccggucucgggggaa

SEQ ID NO: 129025 - RNA, 22 nt, Human
augaggagucaaggagucggag

SEQ ID NO: 129026 - RNA, 22 nt, Human
aucaaguuauuaaguagcuuuc

SEQ ID NO: 129027 - RNA, 22 nt, Human
auauuugcccccaugcccuggc

SEQ ID NO: 129028 - RNA, 22 nt, Human
aucacuagaguuacauugccag

SEQ ID NO: 129029 - RNA, 20 nt, Human
aucaagugucuugccaggca

SEQ ID NO: 129030 - RNA, 22 nt, Human
aucauaccaguuuccaucagga

SEQ ID NO: 129031 - RNA, 22 nt, Human
aucagcucuugaugccuuucuu

SEQ ID NO: 129032 - RNA, 20 nt, Human
aucaggagucgcggggagag

SEQ ID NO: 129033 - RNA, 21 nt, Human
aucagaggacaucucagggcc

SEQ ID NO: 129034 - RNA, 22 nt, Human
aucagagcuaguacuugcaggu

SEQ ID NO: 129035 - RNA, 22 nt, Human
aucaacacuguuggcggggacc

SEQ ID NO: 129036 - RNA, 22 nt, Human
aucaacucacagugugcuggca

SEQ ID NO: 129037 - RNA, 22 nt, Human
aucaagacaaaggaaaggcuaa

SEQ ID NO: 129038 - RNA, 22 nt, Human
aucaugggauagugggacgagc

SEQ ID NO: 129039 - RNA, 22 nt, Human
aucaugcgguuaaggagugugu

SEQ ID NO: 129040 - RNA, 22 nt, Human
aucaucuaaaauuggcucagau

SEQ ID NO: 129041 - RNA, 17 nt, Human
aucagaggauaggacaa

SEQ ID NO: 129042 - RNA, 19 nt, Human
aucagcaguuuugccugga

SEQ ID NO: 129043 - RNA, 22 nt, Human
auccugugggguauugcugcau

SEQ ID NO: 129044 - RNA, 22 nt, Human
auccuggcuuuccugauuuacu

SEQ ID NO: 129045 - RNA, 20 nt, Human
auccuggucuuuggaagcuu

SEQ ID NO: 129046 - RNA, 22 nt, Human
auccacccugcaggccaacucu

SEQ ID NO: 129047 - RNA, 22 nt, Human
auccaggggucugaauggauau

SEQ ID NO: 129048 - RNA, 22 nt, Human
auccagaaguauuuuggguacu

SEQ ID NO: 129049 - RNA, 22 nt, Human
auccaggguuggggucacgagu

SEQ ID NO: 129050 - RNA, 23 nt, Human
aucgcccggguccagucccggcu

SEQ ID NO: 129051 - RNA, 22 nt, Human
aucggggaaugaccuuuucauu

SEQ ID NO: 129052 - RNA, 22 nt, Human
aucguggcacgucgccgcagcg

SEQ ID NO: 129053 - RNA, 22 nt, Human
aucguuaugauagagaaagaga

SEQ ID NO: 129054 - RNA, 22 nt, Human
aucccuggccacgaagcugccc

SEQ ID NO: 129055 - RNA, 22 nt, Human
auccgugagcgagcgagcaccc

SEQ ID NO: 129056 - RNA, 18 nt, Human
auccccagucccuggaau

SEQ ID NO: 129057 - RNA, 22 nt, Human
aucuacuuugggaguuucucuu

SEQ ID NO: 129058 - RNA, 20 nt, Human
aucaugugcacugcugacag

SEQ ID NO: 129059 - RNA, 22 nt, Human
aucaugugacuagguuuggcca

SEQ ID NO: 129060 - RNA, 22 nt, Human
auccuaagacgugugguuugag

SEQ ID NO: 129061 - RNA, 22 nt, Human
auccucaaggaauuaaauaggg

SEQ ID NO: 129062 - RNA, 22 nt, Human
aucauugcuaguaaggaucuug

SEQ ID NO: 129063 - RNA, 22 nt, Human
aucaucccuuucucccagugaa

SEQ ID NO: 129064 - RNA, 22 nt, Human
aucauccuagaaggaagcuagg

SEQ ID NO: 129065 - RNA, 22 nt, Human
auccacggucaauuccccaucc

SEQ ID NO: 129066 - RNA, 22 nt, Human
agugacauuauuuuguguacua

SEQ ID NO: 129067 - RNA, 22 nt, Human
agugaauuagccuauuuguaaa

SEQ ID NO: 129068 - RNA, 20 nt, Human
auagaguggugugucacauu

SEQ ID NO: 129069 - RNA, 22 nt, Human
auaccaaugaaucccugagaau

SEQ ID NO: 129070 - RNA, 22 nt, Human
auagaagguaaugccccaaggg

SEQ ID NO: 129071 - RNA, 22 nt, Human
auagacacagcuaugauuugag

SEQ ID NO: 129072 - RNA, 22 nt, Human
auagaguguguguuauguguga

SEQ ID NO: 129073 - RNA, 22 nt, Human
auacuacaucacagccaagaag

SEQ ID NO: 129074 - RNA, 22 nt, Human
auauccugguucuaucaaaagg

SEQ ID NO: 129075 - RNA, 22 nt, Human
auauggugauuuuaugcaggaa

SEQ ID NO: 129076 - RNA, 22 nt, Human
auaggcauaacacugauguccu

SEQ ID NO: 129077 - RNA, 22 nt, Human
uuuuuggacccaucuucuuuuu

SEQ ID NO: 129078 - RNA, 22 nt, Human
uuuuuugguuuggggauuauuu

SEQ ID NO: 129079 - RNA, 22 nt, Human
uuuuaggauuugaguugcugga

SEQ ID NO: 129080 - RNA, 22 nt, Human
uuuguuaggguuucagcuagcc

SEQ ID NO: 129081 - RNA, 23 nt, Human
uuuguugguuuaagaguagcaga

SEQ ID NO: 129082 - RNA, 22 nt, Human
uuuucucacugagagccuugau

SEQ ID NO: 129083 - RNA, 22 nt, Human
uuuucggggcgacuuagguucu

SEQ ID NO: 129084 - RNA, 22 nt, Human
uuuuccuugagucggggcacag

SEQ ID NO: 129085 - RNA, 22 nt, Human
uuuucuguuuaugaaauugugu

SEQ ID NO: 129086 - RNA, 22 nt, Human
uuuucuucggugcuggguugau

SEQ ID NO: 129087 - RNA, 20 nt, Human
uuuuguccaccugcaggaag

SEQ ID NO: 129088 - RNA, 22 nt, Human
uuuuguggacugugagggugca

SEQ ID NO: 129089 - RNA, 22 nt, Human
uuuuguggacugauccgaggac

SEQ ID NO: 129090 - RNA, 22 nt, Human
uuuuggauugcuaacucagggu

SEQ ID NO: 129091 - RNA, 22 nt, Human
uucugcuagugguauauguuga

SEQ ID NO: 129092 - RNA, 22 nt, Human
uucugaugccuggguugcuucu

SEQ ID NO: 129093 - RNA, 20 nt, Human
uucugcagcagguguugaag

SEQ ID NO: 129094 - RNA, 22 nt, Human
uucucugcgcuccggcccaguu

SEQ ID NO: 129095 - RNA, 22 nt, Human
uucuggucucucugaccuagga

SEQ ID NO: 129096 - RNA, 22 nt, Human
uucuggugauuugccucuuuag

SEQ ID NO: 129097 - RNA, 21 nt, Human
uucugcuguucaccaccaccc

SEQ ID NO: 129098 - RNA, 22 nt, Human
uucuggccagggaagagggguc

SEQ ID NO: 129099 - RNA, 22 nt, Human
uuuugaugaccauucuucuuuu

SEQ ID NO: 129100 - RNA, 22 nt, Human
uucguucagcgcuugcgcaugc

SEQ ID NO: 129101 - RNA, 22 nt, Human
uuuguugaauggcaggauuuua

SEQ ID NO: 129102 - RNA, 22 nt, Human
uuuuacgucuuugcugccucgu

SEQ ID NO: 129103 - RNA, 22 nt, Human
uucucgaacaaccuacagggug

SEQ ID NO: 129104 - RNA, 22 nt, Human
uucuccucuuugucacugcuuu

SEQ ID NO: 129105 - RNA, 22 nt, Human
uucuaggagucugguuccugcc

SEQ ID NO: 129106 - RNA, 19 nt, Human
uugaauguuugauagucuc

SEQ ID NO: 129107 - RNA, 22 nt, Human
uugaauggaauuggaaucuuau

SEQ ID NO: 129108 - RNA, 22 nt, Human
uugucuguacuggcugcaucga

SEQ ID NO: 129109 - RNA, 22 nt, Human
uuguaugcugggaagcgggagg

SEQ ID NO: 129110 - RNA, 22 nt, Human
uuggucagaugugucuccuccu

SEQ ID NO: 129111 - RNA, 22 nt, Human
uuggugaugcccaccuuuucau

SEQ ID NO: 129112 - RNA, 22 nt, Human
uuggcagagaacagaaugauuu

SEQ ID NO: 129113 - RNA, 22 nt, Human
uuggcacagagcugcagccugg

SEQ ID NO: 129114 - RNA, 22 nt, Human
uuggcaaaagauuggguacuua

SEQ ID NO: 129115 - RNA, 22 nt, Human
uugggucaugggaucccagcau

SEQ ID NO: 129116 - RNA, 22 nt, Human
uugggugcugcacccuucaaca

SEQ ID NO: 129117 - RNA, 22 nt, Human
uuguuugcacuuuagagacugu

SEQ ID NO: 129118 - RNA, 22 nt, Human
uugcucuuaccauuauguguga

SEQ ID NO: 129119 - RNA, 22 nt, Human
uugcugagcugaaccagccacc

SEQ ID NO: 129120 - RNA, 22 nt, Human
uugcugggauucauugaagggu

SEQ ID NO: 129121 - RNA, 21 nt, Human
uugcuggagcaauguaaauca

SEQ ID NO: 129122 - RNA, 22 nt, Human
uugcuugcggccuuugugccuu

SEQ ID NO: 129123 - RNA, 22 nt, Human
uugcuugaacccaggaagugga

SEQ ID NO: 129124 - RNA, 22 nt, Human
uugcugugucauuuguuuaauc

SEQ ID NO: 129125 - RNA, 22 nt, Human
uuggacugggauggccgaggcu

SEQ ID NO: 129126 - RNA, 22 nt, Human
uuggaaguggcaaaggcuaaag

SEQ ID NO: 129127 - RNA, 22 nt, Human
uuggaaauguagaaaagcagau

SEQ ID NO: 129128 - RNA, 23 nt, Human
uugcuugagcccaggaaguggag

SEQ ID NO: 129129 - RNA, 22 nt, Human
uugccgacuggccaaggaguaa

SEQ ID NO: 129130 - RNA, 22 nt, Human
uugccaggagacaucuggagcc

SEQ ID NO: 129131 - RNA, 22 nt, Human
uugccaggggacaucuggagcc

SEQ ID NO: 129132 - RNA, 22 nt, Human
uugcggaucuucauggccucag

SEQ ID NO: 129133 - RNA, 22 nt, Human
uugccuagugguagugacuguu

SEQ ID NO: 129134 - RNA, 20 nt, Human
uugcaugcagccggaugcug

SEQ ID NO: 129135 - RNA, 22 nt, Human
uugcagauuucuuguccccauu

SEQ ID NO: 129136 - RNA, 22 nt, Human
uugcagugucaucuagacgugg

SEQ ID NO: 129137 - RNA, 22 nt, Human
uugauuuggaauuuuuagagcu

SEQ ID NO: 129138 - RNA, 22 nt, Human
uugcaagcccugaagggcugga

SEQ ID NO: 129139 - RNA, 22 nt, Human
uuuguggaaaagagcccaggag

SEQ ID NO: 129140 - RNA, 22 nt, Human
uuugugguuuugagagaguugc

SEQ ID NO: 129141 - RNA, 22 nt, Human
uuuguggugagcagggaacguc

SEQ ID NO: 129142 - RNA, 22 nt, Human
uuccagucugggcucuucacug

SEQ ID NO: 129143 - RNA, 22 nt, Human
uuccccgagccuggggaagcug

SEQ ID NO: 129144 - RNA, 22 nt, Human
uucccugggggggccgcuuucc

SEQ ID NO: 129145 - RNA, 22 nt, Human
uuuguguuuugaggucuugcaa

SEQ ID NO: 129146 - RNA, 22 nt, Human
uuccaaaugacaaugggcugua

SEQ ID NO: 129147 - RNA, 20 nt, Human
uuugguuggcuaggggaagc

SEQ ID NO: 129148 - RNA, 22 nt, Human
uuugauuuuguuuauagugccg

SEQ ID NO: 129149 - RNA, 22 nt, Human
uucagaccucaaauccacaugc

SEQ ID NO: 129150 - RNA, 22 nt, Human
uucagguacuaagugcugauuc

SEQ ID NO: 129151 - RNA, 22 nt, Human
uucauccucuuuaucuaccugu

SEQ ID NO: 129152 - RNA, 22 nt, Human
uuugggguuuuuuggugaaauc

SEQ ID NO: 129153 - RNA, 19 nt, Human
uuugguaggcuugagggaa

SEQ ID NO: 129154 - RNA, 22 nt, Human
uuuggucaucaaagacaaguaa

SEQ ID NO: 129155 - RNA, 22 nt, Human
uucaguuccucuuuugggcucu

SEQ ID NO: 129156 - RNA, 22 nt, Human
uucauacucuucccugggcaaa

SEQ ID NO: 129157 - RNA, 22 nt, Human
uucaacacaaguugugcaguaa

SEQ ID NO: 129158 - RNA, 20 nt, Human
uuugauugccccucugacuu

SEQ ID NO: 129159 - RNA, 22 nt, Human
uuucugggggucgugcuggcug

SEQ ID NO: 129160 - RNA, 22 nt, Human
uuucuggacuaaagggagagau

SEQ ID NO: 129161 - RNA, 22 nt, Human
uuucuguuuguaacuccagcaa

SEQ ID NO: 129162 - RNA, 22 nt, Human
uuucuuugcugguuggcucucc

SEQ ID NO: 129163 - RNA, 22 nt, Human
uuucuuccuucuugaucauuug

SEQ ID NO: 129164 - RNA, 21 nt, Human
uguuugcuuuuggagcaacug

SEQ ID NO: 129165 - RNA, 22 nt, Human
uguuugagaauuugcugauguu

SEQ ID NO: 129166 - RNA, 20 nt, Human
uguuucccaacaccccaaag

SEQ ID NO: 129167 - RNA, 22 nt, Human
uuaccugcagagacguggaggc

SEQ ID NO: 129168 - RNA, 20 nt, Human
uuauccccauucuuguucuc

SEQ ID NO: 129169 - RNA, 21 nt, Human
uuuccagaggcagccggacuc

SEQ ID NO: 129170 - RNA, 22 nt, Human
uuucauguuggauacuguuuca

SEQ ID NO: 129171 - RNA, 22 nt, Human
uuucgggauuucaaagagcaaa

SEQ ID NO: 129172 - RNA, 22 nt, Human
uuucguugcacucauaugguug

SEQ ID NO: 129173 - RNA, 22 nt, Human
uuauuggcagcuccugcacaug

SEQ ID NO: 129174 - RNA, 22 nt, Human
uugcugguggcucugauuucau

SEQ ID NO: 129175 - RNA, 22 nt, Human
ugugggaggaugggccccuaga

SEQ ID NO: 129176 - RNA, 22 nt, Human
uguggccaccagagcugcuauu

SEQ ID NO: 129177 - RNA, 22 nt, Human
uguggcucugaugucauaaagg

SEQ ID NO: 129178 - RNA, 22 nt, Human
uugcugaggcuggggagaggug

SEQ ID NO: 129179 - RNA, 22 nt, Human
uugcugccagcgcccugcaggg

SEQ ID NO: 129180 - RNA, 22 nt, Human
uugcugcgcugaccuccaguga

SEQ ID NO: 129181 - RNA, 22 nt, Human
uugcuggaguagaaaacuuaac

SEQ ID NO: 129182 - RNA, 22 nt, Human
ugugcuugucuguuuugauugu

SEQ ID NO: 129183 - RNA, 22 nt, Human
ugugcugcagcgagagcuacga

SEQ ID NO: 129184 - RNA, 22 nt, Human
ugugcgucuguguacagaugug

SEQ ID NO: 129185 - RNA, 22 nt, Human
ugugcgcgugugcuuugugugu

SEQ ID NO: 129186 - RNA, 18 nt, Human
uugcucucucugggggca

SEQ ID NO: 129187 - RNA, 20 nt, Human
uugcucucuuguguugaugu

SEQ ID NO: 129188 - RNA, 22 nt, Human
ugugcagugcguggguguugaa

SEQ ID NO: 129189 - RNA, 22 nt, Human
ugugcaucuggaggcaauguuu

SEQ ID NO: 129190 - RNA, 22 nt, Human
ugugguuggggucagauaggga

SEQ ID NO: 129191 - RNA, 22 nt, Human
uguggugcagcgggaacagcuu

SEQ ID NO: 129192 - RNA, 20 nt, Human
uuggagaucacguguccagg

SEQ ID NO: 129193 - RNA, 22 nt, Human
ugugugguaaugagagauccaa

SEQ ID NO: 129194 - RNA, 22 nt, Human
ugugggcugcuguuuccuugua

SEQ ID NO: 129195 - RNA, 22 nt, Human
uuggaaaugcauuuguuauuau

SEQ ID NO: 129196 - RNA, 22 nt, Human
uguggugacuugagcuuccuaa

SEQ ID NO: 129197 - RNA, 22 nt, Human
uuggaaaagaaauacucauaua

SEQ ID NO: 129198 - RNA, 22 nt, Human
uuggcuguguugaaaacgugga

SEQ ID NO: 129199 - RNA, 22 nt, Human
uuggcuuuucaguuuuaaguua

SEQ ID NO: 129200 - RNA, 22 nt, Human
uguuacugaaugucucugcuuu

SEQ ID NO: 129201 - RNA, 22 nt, Human
uuggccguuucacugggcaguu

SEQ ID NO: 129202 - RNA, 22 nt, Human
uuggcgcuauuauuaccacauu

SEQ ID NO: 129203 - RNA, 22 nt, Human
uuggccugcuccagaacaaggg

SEQ ID NO: 129204 - RNA, 22 nt, Human
uuggggaauuuggggccguccg

SEQ ID NO: 129205 - RNA, 22 nt, Human
uugggauuggugggguggguuu

SEQ ID NO: 129206 - RNA, 22 nt, Human
uugggagagaaaccuaaugccu

SEQ ID NO: 129207 - RNA, 22 nt, Human
uguugaucucuuuccaaauucu

SEQ ID NO: 129208 - RNA, 22 nt, Human
uguugguuucaagcaggagccu

SEQ ID NO: 129209 - RNA, 22 nt, Human
uugguuaccuucagaaaugagu

SEQ ID NO: 129210 - RNA, 22 nt, Human
uugguguuucacuuccuugucg

SEQ ID NO: 129211 - RNA, 22 nt, Human
uuguacaaauaggaaccucuga

SEQ ID NO: 129212 - RNA, 23 nt, Human
uguuguccaacugaucuccaggc

SEQ ID NO: 129213 - RNA, 22 nt, Human
uuguagccaugucacaagcaca

SEQ ID NO: 129214 - RNA, 19 nt, Human
uuggugaagguucacugac

SEQ ID NO: 129215 - RNA, 22 nt, Human
uguuggauuuugugaaauauga

SEQ ID NO: 129216 - RNA, 19 nt, Human
uguugcagcuugaucggua

SEQ ID NO: 129217 - RNA, 22 nt, Human
uguugcauguggcuguuugcca

SEQ ID NO: 129218 - RNA, 21 nt, Human
uguugcuugucugagacuaug

SEQ ID NO: 129219 - RNA, 22 nt, Human
uuggugaugaaagugcugcgcu

SEQ ID NO: 129220 - RNA, 22 nt, Human
uguuggcagugcuacagucagu

SEQ ID NO: 129221 - RNA, 21 nt, Human
uguuggccuucauucucuguc

SEQ ID NO: 129222 - RNA, 22 nt, Human
ugucacggccggguggcaccga

SEQ ID NO: 129223 - RNA, 21 nt, Human
ugucagaaagccugugacuuu

SEQ ID NO: 129224 - RNA, 22 nt, Human
ugucacagggauaccauggggc

SEQ ID NO: 129225 - RNA, 22 nt, Human
ugucacuuaagguuggugucuc

SEQ ID NO: 129226 - RNA, 22 nt, Human
ugucagacagggcugcagucag

SEQ ID NO: 129227 - RNA, 22 nt, Human
uugauuugcagaagguguagag

SEQ ID NO: 129228 - RNA, 22 nt, Human
uugauuuccauuguccagcauu

SEQ ID NO: 129229 - RNA, 22 nt, Human
ugucauuggugaucugaugccu

SEQ ID NO: 129230 - RNA, 22 nt, Human
ugucauggacuggauuucugcu

SEQ ID NO: 129231 - RNA, 22 nt, Human
uguagaccuuugaaugggaaau

SEQ ID NO: 129232 - RNA, 22 nt, Human
ugucaccucauacaguaccuca

SEQ ID NO: 129233 - RNA, 22 nt, Human
ugugagcugccacuucuaaucu

SEQ ID NO: 129234 - RNA, 22 nt, Human
ugugauuucaaagggugucuuu

SEQ ID NO: 129235 - RNA, 22 nt, Human
uugccucuaauuagcucuguga

SEQ ID NO: 129236 - RNA, 22 nt, Human
ugugacaugauggcgucaugua

SEQ ID NO: 129237 - RNA, 18 nt, Human
ugguuggugggggugaag

SEQ ID NO: 129238 - RNA, 22 nt, Human
uucuuugcccauguuuccuaag

SEQ ID NO: 129239 - RNA, 22 nt, Human
ugguugugcuucuuugccucag

SEQ ID NO: 129240 - RNA, 22 nt, Human
ugguugguuaaugugcccauuu

SEQ ID NO: 129241 - RNA, 22 nt, Human
uugaacucagcuacugguuggu

SEQ ID NO: 129242 - RNA, 22 nt, Human
uguagcaauauaucagugcaca

SEQ ID NO: 129243 - RNA, 21 nt, Human
ugguguacauuuccauaguuu

SEQ ID NO: 129244 - RNA, 22 nt, Human
ugguggagucugggggaggcuu

SEQ ID NO: 129245 - RNA, 22 nt, Human
ugguggcaauuuuuggggucaa

SEQ ID NO: 129246 - RNA, 22 nt, Human
uucuuccagugaaacgugcauc

SEQ ID NO: 129247 - RNA, 23 nt, Human
uggugcagcgcaggccggguggc

SEQ ID NO: 129248 - RNA, 22 nt, Human
uggugcagacaggagccccgcu

SEQ ID NO: 129249 - RNA, 22 nt, Human
ugcucagaagacuuacugguua

SEQ ID NO: 129250 - RNA, 20 nt, Human
ugcuccaggaacacuggccg

SEQ ID NO: 129251 - RNA, 22 nt, Human
uggaggagaacugauuuggcuu

SEQ ID NO: 129252 - RNA, 22 nt, Human
uggaggaggagaacuuggcacu

SEQ ID NO: 129253 - RNA, 22 nt, Human
uggaggaggaugcauuuguugu

SEQ ID NO: 129254 - RNA, 22 nt, Human
uggaggcccagcugggggccgg

SEQ ID NO: 129255 - RNA, 19 nt, Human
uggaggcacuaacaaacuc

SEQ ID NO: 129256 - RNA, 22 nt, Human
uggagucagaaugcgacaggcc

SEQ ID NO: 129257 - RNA, 22 nt, Human
uucaaacacugugcaauugggu

SEQ ID NO: 129258 - RNA, 21 nt, Human
uucaaccagcaauuggcagaa

SEQ ID NO: 129259 - RNA, 22 nt, Human
uucaaccuucagcuugaguugg

SEQ ID NO: 129260 - RNA, 22 nt, Human
uucaacaacuugguucaaaugg

SEQ ID NO: 129261 - RNA, 22 nt, Human
uggauauagcugaggugucuug

SEQ ID NO: 129262 - RNA, 20 nt, Human
uggaucaccauccuguugcu

SEQ ID NO: 129263 - RNA, 20 nt, Human
uggaucgaccucacuuccau

SEQ ID NO: 129264 - RNA, 22 nt, Human
uggaugacaaccauuggaagag

SEQ ID NO: 129265 - RNA, 20 nt, Human
uucacagaucucuaacugag

SEQ ID NO: 129266 - RNA, 22 nt, Human
uucacagugguaaggguuguga

SEQ ID NO: 129267 - RNA, 22 nt, Human
uggaugcuccaaguagaccuua

SEQ ID NO: 129268 - RNA, 22 nt, Human
uggcaagcuguuggcagauagc

SEQ ID NO: 129269 - RNA, 22 nt, Human
uucacccuucucuggcuuucag

SEQ ID NO: 129270 - RNA, 22 nt, Human
uggcacagcuugucauaaacuc

SEQ ID NO: 129271 - RNA, 22 nt, Human
uucacccaaaucaagcuggccu

SEQ ID NO: 129272 - RNA, 22 nt, Human
uggcacugcccugucucggugg

SEQ ID NO: 129273 - RNA, 22 nt, Human
uggcacaguuaaaguuguagaa

SEQ ID NO: 129274 - RNA, 22 nt, Human
uggcagccucugguccuuaguu

SEQ ID NO: 129275 - RNA, 22 nt, Human
uggcagccugcgugaaggagcu

SEQ ID NO: 129276 - RNA, 22 nt, Human
uucacucagagcaggacagccc

SEQ ID NO: 129277 - RNA, 22 nt, Human
uggcacaggcagaaggugccgc

SEQ ID NO: 129278 - RNA, 22 nt, Human
uucagcauggcuguuuucccuu

SEQ ID NO: 129279 - RNA, 22 nt, Human
uucaggaaacaaauuugcaguu

SEQ ID NO: 129280 - RNA, 18 nt, Human
uucaggcucuugcaugaa

SEQ ID NO: 129281 - RNA, 22 nt, Human
uucaggugguuuaagaauugga

SEQ ID NO: 129282 - RNA, 20 nt, Human
uggcaugcucucuuuuuagg

SEQ ID NO: 129283 - RNA, 20 nt, Human
uggcaugaaauuuuccaagc

SEQ ID NO: 129284 - RNA, 18 nt, Human
uggcaugcuuugauacau

SEQ ID NO: 129285 - RNA, 22 nt, Human
uggcauuugagcuggaaggaug

SEQ ID NO: 129286 - RNA, 22 nt, Human
uggcaguugcaguaacuuguau

SEQ ID NO: 129287 - RNA, 22 nt, Human
uggcaucucggugcugguucuu

SEQ ID NO: 129288 - RNA, 22 nt, Human
uggcaucuggugauauggacua

SEQ ID NO: 129289 - RNA, 22 nt, Human
uggcagugagauuucucuucug

SEQ ID NO: 129290 - RNA, 22 nt, Human
uucagcaagugucucuacuguc

SEQ ID NO: 129291 - RNA, 21 nt, Human
uggcaggcagcuggaagcuug

SEQ ID NO: 129292 - RNA, 22 nt, Human
uggcagcucauuuggaaaugga

SEQ ID NO: 129293 - RNA, 22 nt, Human
uggcggagacauggacuucaga

SEQ ID NO: 129294 - RNA, 22 nt, Human
uggccuucagcucuggggugca

SEQ ID NO: 129295 - RNA, 22 nt, Human
uggcgacuggaauuaaucuuuu

SEQ ID NO: 129296 - RNA, 22 nt, Human
uggcgcgcagccugcuggugcu

SEQ ID NO: 129297 - RNA, 22 nt, Human
uggcgcgcucgcucucgcugag

SEQ ID NO: 129298 - RNA, 22 nt, Human
uggcucagcgcggccuggucuu

SEQ ID NO: 129299 - RNA, 22 nt, Human
uggcucacuuccguggagaggu

SEQ ID NO: 129300 - RNA, 23 nt, Human
uggcucugagcuuccugguggcc

SEQ ID NO: 129301 - RNA, 22 nt, Human
uggcucuucucaagcauuggcu

SEQ ID NO: 129302 - RNA, 22 nt, Human
uuccagguggcuuuccuggggg

SEQ ID NO: 129303 - RNA, 22 nt, Human
uuccagaacaauguggacguau

SEQ ID NO: 129304 - RNA, 22 nt, Human
uggcuucugguuuauccuuaua

SEQ ID NO: 129305 - RNA, 16 nt, Human
uggcuuccaguucucu

SEQ ID NO: 129306 - RNA, 22 nt, Human
uggcccugaaucaaggccagca

SEQ ID NO: 129307 - RNA, 20 nt, Human
uggccgacccugaggaguug

SEQ ID NO: 129308 - RNA, 23 nt, Human
uggccguccccugacucucuggc

SEQ ID NO: 129309 - RNA, 22 nt, Human
uggccccauuuuucuggagccu

SEQ ID NO: 129310 - RNA, 21 nt, Human
uggcccgagccgggguuggcu

SEQ ID NO: 129311 - RNA, 22 nt, Human
uucauagggagcaucuaccuau

SEQ ID NO: 129312 - RNA, 22 nt, Human
uucaugcgcuuuucaggagugu

SEQ ID NO: 129313 - RNA, 20 nt, Human
uucaugcagugguugcugug

SEQ ID NO: 129314 - RNA, 22 nt, Human
uucaucuucaaaccccagugcc

SEQ ID NO: 129315 - RNA, 22 nt, Human
uggccugauuuugcuaagagaa

SEQ ID NO: 129316 - RNA, 22 nt, Human
uucaucauuuuccauuccucuu

SEQ ID NO: 129317 - RNA, 22 nt, Human
uggccaugagaaucuuugcugu

SEQ ID NO: 129318 - RNA, 22 nt, Human
uggcauuuuguagcuguguauc

SEQ ID NO: 129319 - RNA, 22 nt, Human
uggcccauccggcuccuccuug

SEQ ID NO: 129320 - RNA, 22 nt, Human
uucaggucauuuuuagcccuag

SEQ ID NO: 129321 - RNA, 20 nt, Human
uggcccagcacgacgaggac

SEQ ID NO: 129322 - RNA, 22 nt, Human
uucaguguuagaauuccaagaa

SEQ ID NO: 129323 - RNA, 22 nt, Human
ugggcccaucauugcugugggc

SEQ ID NO: 129324 - RNA, 22 nt, Human
ugggcagggauuuggggaaacu

SEQ ID NO: 129325 - RNA, 22 nt, Human
ugggauucucagaaacacagag

SEQ ID NO: 129326 - RNA, 22 nt, Human
ugggccucuguuuccucaucug

SEQ ID NO: 129327 - RNA, 22 nt, Human
uggggagcucagcaccaucagu

SEQ ID NO: 129328 - RNA, 23 nt, Human
ugggccucuccacccuuuucugu

SEQ ID NO: 129329 - RNA, 22 nt, Human
uuccccaccagagacagagcug

SEQ ID NO: 129330 - RNA, 20 nt, Human
uuccccauaaaaauguucca

SEQ ID NO: 129331 - RNA, 22 nt, Human
uuccauuccauaucagguacag

SEQ ID NO: 129332 - RNA, 22 nt, Human
ugggagccuuccacugggggaa

SEQ ID NO: 129333 - RNA, 22 nt, Human
uggcuugagcugggcccaccug

SEQ ID NO: 129334 - RNA, 22 nt, Human
ugggugaagaggcuaugcuacu

SEQ ID NO: 129335 - RNA, 20 nt, Human
uucucugcagcaggcggccc

SEQ ID NO: 129336 - RNA, 22 nt, Human
ugggucaguagccuugcagaac

SEQ ID NO: 129337 - RNA, 22 nt, Human
ugggucagauugagccccuggu

SEQ ID NO: 129338 - RNA, 22 nt, Human
ugggucagauacaguguuuggu

SEQ ID NO: 129339 - RNA, 22 nt, Human
uucguugaagcaacgacuuugg

SEQ ID NO: 129340 - RNA, 20 nt, Human
ugggggugcccaucuccccu

SEQ ID NO: 129341 - RNA, 22 nt, Human
uggggucuggcauaugguagau

SEQ ID NO: 129342 - RNA, 22 nt, Human
ugggggguuuagaaucugcccu

SEQ ID NO: 129343 - RNA, 22 nt, Human
ugggggauucaucucagagcgu

SEQ ID NO: 129344 - RNA, 21 nt, Human
uguggccauuugaaaacaggg

SEQ ID NO: 129345 - RNA, 22 nt, Human
ugcaggucuggacccccacuuu

SEQ ID NO: 129346 - RNA, 22 nt, Human
ugcaggguuucaauacacagga

SEQ ID NO: 129347 - RNA, 22 nt, Human
ugcagggucuccuguacuuggg

SEQ ID NO: 129348 - RNA, 22 nt, Human
ugugcagaaggagguucuccgg

SEQ ID NO: 129349 - RNA, 22 nt, Human
ugcaggagaaaguacggagcgu

SEQ ID NO: 129350 - RNA, 22 nt, Human
ugcaggagcaccagcucacccu

SEQ ID NO: 129351 - RNA, 22 nt, Human
ugucuucauuccccaugaaguc

SEQ ID NO: 129352 - RNA, 19 nt, Human
ugcacucauggagggucug

SEQ ID NO: 129353 - RNA, 20 nt, Human
ugcacggcugugugugugca

SEQ ID NO: 129354 - RNA, 22 nt, Human
ugcacugccuuucuuggcauga

SEQ ID NO: 129355 - RNA, 22 nt, Human
uguggguggucagcgugugaug

SEQ ID NO: 129356 - RNA, 22 nt, Human
ugugguuuguaagcaaagcaaa

SEQ ID NO: 129357 - RNA, 22 nt, Human
uguggugcucagggaggauggg

SEQ ID NO: 129358 - RNA, 22 nt, Human
ugugugggcgaagacagccuuu

SEQ ID NO: 129359 - RNA, 22 nt, Human
ugccucucuggaucugcuguga

SEQ ID NO: 129360 - RNA, 22 nt, Human
ugcccagagccucuuaccucca

SEQ ID NO: 129361 - RNA, 22 nt, Human
ugugggcguggguuggggaggg

SEQ ID NO: 129362 - RNA, 22 nt, Human
ugugggaucauggaucagggcc

SEQ ID NO: 129363 - RNA, 22 nt, Human
ugccaucaugucagauuuggga

SEQ ID NO: 129364 - RNA, 22 nt, Human
ugccaugguuguacaguagcag

SEQ ID NO: 129365 - RNA, 22 nt, Human
ugccauagaaguccaacccaau

SEQ ID NO: 129366 - RNA, 22 nt, Human
ugccaacaggcuugccugaugu

SEQ ID NO: 129367 - RNA, 22 nt, Human
uguucccgaugacaggaccagg

SEQ ID NO: 129368 - RNA, 22 nt, Human
uguuccggucuaucgugucaau

SEQ ID NO: 129369 - RNA, 22 nt, Human
uguguuucucugaggggucccu

SEQ ID NO: 129370 - RNA, 19 nt, Human
ugccuggcaccagcuccac

SEQ ID NO: 129371 - RNA, 20 nt, Human
ugccugagcgcagcuccagg

SEQ ID NO: 129372 - RNA, 22 nt, Human
uguguguguguguguguuugug

SEQ ID NO: 129373 - RNA, 22 nt, Human
uguguguucauccccucaacau

SEQ ID NO: 129374 - RNA, 19 nt, Human
uguguuccauccaccaccc

SEQ ID NO: 129375 - RNA, 22 nt, Human
uguguuguuggggauguuuuca

SEQ ID NO: 129376 - RNA, 17 nt, Human
ugccuucgucuucaguu

SEQ ID NO: 129377 - RNA, 22 nt, Human
ugccuucugccaaggacggugc

SEQ ID NO: 129378 - RNA, 22 nt, Human
uguugauuaauuuucccaaaca

SEQ ID NO: 129379 - RNA, 22 nt, Human
uguuggaauaagugcuugaagg

SEQ ID NO: 129380 - RNA, 22 nt, Human
uguugaagcaccucugucuuuc

SEQ ID NO: 129381 - RNA, 21 nt, Human
ugcuaagugucacaugucugc

SEQ ID NO: 129382 - RNA, 22 nt, Human
ugcuaaguacauuccaggacuu

SEQ ID NO: 129383 - RNA, 22 nt, Human
ugcggugcagcccugcccucuc

SEQ ID NO: 129384 - RNA, 22 nt, Human
ugcggugcgcccgggcgagugc

SEQ ID NO: 129385 - RNA, 19 nt, Human
uguucuacuugcuaguauu

SEQ ID NO: 129386 - RNA, 22 nt, Human
uguucuucaaacucaguuccac

SEQ ID NO: 129387 - RNA, 22 nt, Human
ugcggcucaaagggaaggccuu

SEQ ID NO: 129388 - RNA, 22 nt, Human
ugcgccucugucacucagcauc

SEQ ID NO: 129389 - RNA, 23 nt, Human
uguuccugaugccucguccuguc

SEQ ID NO: 129390 - RNA, 22 nt, Human
ugggggcacccagccgaugagg

SEQ ID NO: 129391 - RNA, 22 nt, Human
ugacaucagacugugagaagag

SEQ ID NO: 129392 - RNA, 23 nt, Human
uggggucaaggcugccuuggggu

SEQ ID NO: 129393 - RNA, 22 nt, Human
uggggugccccccucgguuugc

SEQ ID NO: 129394 - RNA, 22 nt, Human
ugggguuuuagagcaggcagag

SEQ ID NO: 129395 - RNA, 22 nt, Human
ugagccugaguguguauugaac

SEQ ID NO: 129396 - RNA, 22 nt, Human
ugacauccuacaccccuggguc

SEQ ID NO: 129397 - RNA, 20 nt, Human
ugggguucccuuuagggcuu

SEQ ID NO: 129398 - RNA, 22 nt, Human
ugaggccaagccuccucugcca

SEQ ID NO: 129399 - RNA, 22 nt, Human
ugaggcaguucuuacuuguauu

SEQ ID NO: 129400 - RNA, 22 nt, Human
ugguggaggugggggguauuuu

SEQ ID NO: 129401 - RNA, 22 nt, Human
uggugcaggauuuauuuaacua

SEQ ID NO: 129402 - RNA, 22 nt, Human
uggugcacgugggcagucggcc

SEQ ID NO: 129403 - RNA, 22 nt, Human
ugaggaacaugggagaaauguc

SEQ ID NO: 129404 - RNA, 17 nt, Human
ugguucuuuuccugacc

SEQ ID NO: 129405 - RNA, 22 nt, Human
ugagggucgcaagcaccaggcc

SEQ ID NO: 129406 - RNA, 22 nt, Human
ugagguguuugugcaccaucug

SEQ ID NO: 129407 - RNA, 23 nt, Human
ugaggucuuggaaguucuguuug

SEQ ID NO: 129408 - RNA, 22 nt, Human
ugaguucugacugagcaugggg

SEQ ID NO: 129409 - RNA, 22 nt, Human
ugaucauguucuccaaaagcgu

SEQ ID NO: 129410 - RNA, 22 nt, Human
ugaguugucacaacgucacaag

SEQ ID NO: 129411 - RNA, 22 nt, Human
ugaguuucuuacucaggagcug

SEQ ID NO: 129412 - RNA, 22 nt, Human
ugaugaugaagaaauauuauca

SEQ ID NO: 129413 - RNA, 22 nt, Human
ugauggaucuguuggcggguuu

SEQ ID NO: 129414 - RNA, 22 nt, Human
ugauggugagaugucccguguu

SEQ ID NO: 129415 - RNA, 22 nt, Human
uguaucucugacacagucucac

SEQ ID NO: 129416 - RNA, 22 nt, Human
ugauucacagacuucacaaggc

SEQ ID NO: 129417 - RNA, 22 nt, Human
ugauguggaucuauaacuguaa

SEQ ID NO: 129418 - RNA, 22 nt, Human
ugauuuguuuaaauugcucguu

SEQ ID NO: 129419 - RNA, 21 nt, Human
ugucagcaacaauacuuucuc

SEQ ID NO: 129420 - RNA, 22 nt, Human
ugauugauaaugaagacaguca

SEQ ID NO: 129421 - RNA, 18 nt, Human
ugcacccuaagggcccca

SEQ ID NO: 129422 - RNA, 16 nt, Human
ugcaccgggaacacug

SEQ ID NO: 129423 - RNA, 23 nt, Human
ugucugccuaucaugugaaggac

SEQ ID NO: 129424 - RNA, 22 nt, Human
uguccccugcccagggauggga

SEQ ID NO: 129425 - RNA, 22 nt, Human
uguccagcuauauguguaugug

SEQ ID NO: 129426 - RNA, 22 nt, Human
uggcuuuugaaaaggugaugua

SEQ ID NO: 129427 - RNA, 22 nt, Human
uggcuucagacuucugcuacgu

SEQ ID NO: 129428 - RNA, 22 nt, Human
uggcuucuggccaggcacagga

SEQ ID NO: 129429 - RNA, 22 nt, Human
uggccucuuucuucccuuugac

SEQ ID NO: 129430 - RNA, 22 nt, Human
uggcuguuggagcuggaagaug

SEQ ID NO: 129431 - RNA, 22 nt, Human
uggcugaugucuguucuguuau

SEQ ID NO: 129432 - RNA, 22 nt, Human
uggcugagugaacauguccauu

SEQ ID NO: 129433 - RNA, 22 nt, Human
uggcggcuggacuggggggcca

SEQ ID NO: 129434 - RNA, 22 nt, Human
ugaacuggauuugugagcuccu

SEQ ID NO: 129435 - RNA, 22 nt, Human
ugggaagcugagccucgaugug

SEQ ID NO: 129436 - RNA, 22 nt, Human
ugaaccugagggcaaagggaca

SEQ ID NO: 129437 - RNA, 22 nt, Human
ugaaccgcuucauggugccugu

SEQ ID NO: 129438 - RNA, 22 nt, Human
ugaaccgacaggggaagauugu

SEQ ID NO: 129439 - RNA, 22 nt, Human
ugggaaacucuaaacuugagua

SEQ ID NO: 129440 - RNA, 22 nt, Human
ugggaagccaguaucagacuaa

SEQ ID NO: 129441 - RNA, 18 nt, Human
ugggacucugacuugguu

SEQ ID NO: 129442 - RNA, 21 nt, Human
ugaagcccugugaggugcuua

SEQ ID NO: 129443 - RNA, 22 nt, Human
ugggauauagaauuggcagagu

SEQ ID NO: 129444 - RNA, 22 nt, Human
ugggccgugagacgucucuggg

SEQ ID NO: 129445 - RNA, 22 nt, Human
ugaauagcaccuugaguaauga

SEQ ID NO: 129446 - RNA, 22 nt, Human
ugggcuguuucuuaaggauaug

SEQ ID NO: 129447 - RNA, 22 nt, Human
uggggacucacugacuaucuug

SEQ ID NO: 129448 - RNA, 22 nt, Human
uggggagucccaacgguggaag

SEQ ID NO: 129449 - RNA, 21 nt, Human
uggggaugcauugcagaggca

SEQ ID NO: 129450 - RNA, 22 nt, Human
ugggcagggagcuggaaccaca

SEQ ID NO: 129451 - RNA, 22 nt, Human
ugggccacguggagucuguagg

SEQ ID NO: 129452 - RNA, 22 nt, Human
ugggcaguccagcuggaaacgg

SEQ ID NO: 129453 - RNA, 22 nt, Human
ugaagguggcuugcagcuaguc

SEQ ID NO: 129454 - RNA, 20 nt, Human
ugggauggaaucaccugcac

SEQ ID NO: 129455 - RNA, 22 nt, Human
ugggauggacuuuagagaaucg

SEQ ID NO: 129456 - RNA, 22 nt, Human
ugggaggcugugggaauggguc

SEQ ID NO: 129457 - RNA, 21 nt, Human
ugaagccuagagaauugggga

SEQ ID NO: 129458 - RNA, 22 nt, Human
uggggcuuucgcggagcgucgg

SEQ ID NO: 129459 - RNA, 22 nt, Human
uggggcuuggcucacagaagcu

SEQ ID NO: 129460 - RNA, 18 nt, Human
ugggggacgcuuuuuuuc

SEQ ID NO: 129461 - RNA, 22 nt, Human
uggggcugguaccguaauauau

SEQ ID NO: 129462 - RNA, 22 nt, Human
uggggcuccaguagagaaggca

SEQ ID NO: 129463 - RNA, 22 nt, Human
uggggcgccuggcugaggcugc

SEQ ID NO: 129464 - RNA, 22 nt, Human
uggggcuccuccuggcaggagg

SEQ ID NO: 129465 - RNA, 22 nt, Human
uggggcgcaggcccagcgggcu

SEQ ID NO: 129466 - RNA, 22 nt, Human
uggggcuauggcccgaccacgu

SEQ ID NO: 129467 - RNA, 22 nt, Human
ugaaucugagccugcgcaaagu

SEQ ID NO: 129468 - RNA, 22 nt, Human
ugaaugaguucaccgcucaguu

SEQ ID NO: 129469 - RNA, 22 nt, Human
ugggggagggagaguugauggg

SEQ ID NO: 129470 - RNA, 22 nt, Human
ugggggaggaggagacagacug

SEQ ID NO: 129471 - RNA, 22 nt, Human
ugacagucacagcagaaacucg

SEQ ID NO: 129472 - RNA, 17 nt, Human
ugacagcuaaggggcuu

SEQ ID NO: 129473 - RNA, 22 nt, Human
ugacagugugcccggagguuag

SEQ ID NO: 129474 - RNA, 22 nt, Human
ugacaguuugacugcaaccuuu

SEQ ID NO: 129475 - RNA, 22 nt, Human
ugaauuuguaggaauucuccau

SEQ ID NO: 129476 - RNA, 22 nt, Human
ugaauguggucaggaaauuguu

SEQ ID NO: 129477 - RNA, 22 nt, Human
ugaauguguacacgauuguuug

SEQ ID NO: 129478 - RNA, 19 nt, Human
ucuguugcuuuguguccuc

SEQ ID NO: 129479 - RNA, 22 nt, Human
ucuguucucuuguucugacggu

SEQ ID NO: 129480 - RNA, 22 nt, Human
uggaguguuggucccacugagg

SEQ ID NO: 129481 - RNA, 22 nt, Human
uggagguagcugacuccagccc

SEQ ID NO: 129482 - RNA, 21 nt, Human
uggaggcguaaucacuguuga

SEQ ID NO: 129483 - RNA, 19 nt, Human
uggaggcggguggcccaga

SEQ ID NO: 129484 - RNA, 22 nt, Human
uggaugccauuugauuaaggcu

SEQ ID NO: 129485 - RNA, 22 nt, Human
uggaugccuugggggaggagga

SEQ ID NO: 129486 - RNA, 22 nt, Human
uggauaugaaacaaaacaagag

SEQ ID NO: 129487 - RNA, 22 nt, Human
uggcagcauuuuuuccagaaca

SEQ ID NO: 129488 - RNA, 22 nt, Human
uggcacguuggauugggaguuc

SEQ ID NO: 129489 - RNA, 22 nt, Human
uggcacugaagcuggaaagccu

SEQ ID NO: 129490 - RNA, 22 nt, Human
uggauuguuuacaucaugucug

SEQ ID NO: 129491 - RNA, 22 nt, Human
ucuuauucuuuuaaacaacgca

SEQ ID NO: 129492 - RNA, 22 nt, Human
uggauucucuguagccugguuc

SEQ ID NO: 129493 - RNA, 18 nt, Human
uggcaaugccaaaggcuu

SEQ ID NO: 129494 - RNA, 22 nt, Human
uggcaggggaaaagggguggga

SEQ ID NO: 129495 - RNA, 22 nt, Human
uggccagucuuagcugugccug

SEQ ID NO: 129496 - RNA, 22 nt, Human
uggccaaucagcugugaccugc

SEQ ID NO: 129497 - RNA, 22 nt, Human
uggcccaagggaggcuuggccu

SEQ ID NO: 129498 - RNA, 22 nt, Human
ucuugcuguggcagaucuggag

SEQ ID NO: 129499 - RNA, 22 nt, Human
ucuugccccugcuuuggaacaa

SEQ ID NO: 129500 - RNA, 22 nt, Human
uggcccaucagggcaccugaga

SEQ ID NO: 129501 - RNA, 22 nt, Human
uggccucauggccuuaucuggg

SEQ ID NO: 129502 - RNA, 20 nt, Human
ucuugucuggcagccuggag

SEQ ID NO: 129503 - RNA, 22 nt, Human
uggcccagaucucugaccuuga

SEQ ID NO: 129504 - RNA, 22 nt, Human
ucuugggcaguccucuacuggu

SEQ ID NO: 129505 - RNA, 22 nt, Human
ucugcaugccucaggaggccug

SEQ ID NO: 129506 - RNA, 22 nt, Human
ucugcccguucaaauccuuguu

SEQ ID NO: 129507 - RNA, 22 nt, Human
uggaacugguuugcuucagacu

SEQ ID NO: 129508 - RNA, 22 nt, Human
ucuggcacuugccaguuucuau

SEQ ID NO: 129509 - RNA, 22 nt, Human
ucuggaaauggaaguaacuaug

SEQ ID NO: 129510 - RNA, 22 nt, Human
ugcugccucugaauggagcagu

SEQ ID NO: 129511 - RNA, 22 nt, Human
ucuaccuucagaaugugggguu

SEQ ID NO: 129512 - RNA, 21 nt, Human
ucuagaccuugggcagucacu

SEQ ID NO: 129513 - RNA, 17 nt, Human
ucugcagaggcaaaccu

SEQ ID NO: 129514 - RNA, 21 nt, Human
ucugccaguuucucuuacuuu

SEQ ID NO: 129515 - RNA, 22 nt, Human
ucugcagggcccuuggcuccug

SEQ ID NO: 129516 - RNA, 22 nt, Human
uggacccaccccagggccugcu

SEQ ID NO: 129517 - RNA, 22 nt, Human
uggaaggggccaggcgcggagu

SEQ ID NO: 129518 - RNA, 22 nt, Human
ucugggguucuuaauuuggaag

SEQ ID NO: 129519 - RNA, 21 nt, Human
ucuggggacaagguccaggaa

SEQ ID NO: 129520 - RNA, 22 nt, Human
uggagccuugugagaccacaau

SEQ ID NO: 129521 - RNA, 21 nt, Human
uggagcagggaggauuugggg

SEQ ID NO: 129522 - RNA, 22 nt, Human
uggagcaagaagggaggcagaa

SEQ ID NO: 129523 - RNA, 22 nt, Human
uggagagcaaugaggggcaggc

SEQ ID NO: 129524 - RNA, 22 nt, Human
uggagcugguucuggggaagcu

SEQ ID NO: 129525 - RNA, 22 nt, Human
uggagcuggcuuguggaaguug

SEQ ID NO: 129526 - RNA, 22 nt, Human
uggaggaugacagagaugggcu

SEQ ID NO: 129527 - RNA, 21 nt, Human
ucgggcggcggcugaggcggc

SEQ ID NO: 129528 - RNA, 22 nt, Human
ugcucugcuaggagaagaauga

SEQ ID NO: 129529 - RNA, 22 nt, Human
ucgggaggaggcggagcucguu

SEQ ID NO: 129530 - RNA, 22 nt, Human
ucgggacccccgcccgggcccg

SEQ ID NO: 129531 - RNA, 22 nt, Human
ucggcuccucccuggaaagggg

SEQ ID NO: 129532 - RNA, 22 nt, Human
ucggccuuuucuuauacccaca

SEQ ID NO: 129533 - RNA, 22 nt, Human
ucgggcccggcucccgacgccc

SEQ ID NO: 129534 - RNA, 22 nt, Human
ucgggcgaauguuguuuuucuc

SEQ ID NO: 129535 - RNA, 23 nt, Human
ucgucgucagccacuaccucccc

SEQ ID NO: 129536 - RNA, 22 nt, Human
ucgucaaaguaaugucauagca

SEQ ID NO: 129537 - RNA, 22 nt, Human
ucggguguguguguuggguaug

SEQ ID NO: 129538 - RNA, 22 nt, Human
ugcugcacccuucauuuuccca

SEQ ID NO: 129539 - RNA, 22 nt, Human
ugcugcacucacaggaagaguu

SEQ ID NO: 129540 - RNA, 22 nt, Human
ugcugcacuuauggcucugagg

SEQ ID NO: 129541 - RNA, 22 nt, Human
ucgggggucgggcggcggucca

SEQ ID NO: 129542 - RNA, 22 nt, Human
ucgugagugcugucaccugcug

SEQ ID NO: 129543 - RNA, 22 nt, Human
ucguccaauaaccugccagcgc

SEQ ID NO: 129544 - RNA, 22 nt, Human
ucggauuggggaugggugggag

SEQ ID NO: 129545 - RNA, 22 nt, Human
ugcuccugaacacagcccuaug

SEQ ID NO: 129546 - RNA, 22 nt, Human
ucggccggagggggcgggcgca

SEQ ID NO: 129547 - RNA, 22 nt, Human
ugcuccucugcaugucugcggc

SEQ ID NO: 129548 - RNA, 22 nt, Human
ugcuagggcaggaggugaggag

SEQ ID NO: 129549 - RNA, 22 nt, Human
ugcuauccagacacauaugauc

SEQ ID NO: 129550 - RNA, 22 nt, Human
ucgccccccgccucacccucgg

SEQ ID NO: 129551 - RNA, 22 nt, Human
ucgccauguacaugaagggcgg

SEQ ID NO: 129552 - RNA, 22 nt, Human
ucgaggagagucgccagcugcu

SEQ ID NO: 129553 - RNA, 22 nt, Human
ugcgccaggacacccguggcgg

SEQ ID NO: 129554 - RNA, 22 nt, Human
ucgcccagguuggagugcagug

SEQ ID NO: 129555 - RNA, 22 nt, Human
ucgagcgcucccugugcucucg

SEQ ID NO: 129556 - RNA, 22 nt, Human
ucgagcucagcagggaggugcg

SEQ ID NO: 129557 - RNA, 22 nt, Human
ugccugucuaucuuugucaucu

SEQ ID NO: 129558 - RNA, 22 nt, Human
ucgaugcuggcgcagguuucac

SEQ ID NO: 129559 - RNA, 22 nt, Human
ugcguugaggaccgcgagggcg

SEQ ID NO: 129560 - RNA, 22 nt, Human
ugcguggauuuaggagugaggg

SEQ ID NO: 129561 - RNA, 19 nt, Human
ugcgggcugcggucagggc

SEQ ID NO: 129562 - RNA, 22 nt, Human
ugcgucccagcauguagggcag

SEQ ID NO: 129563 - RNA, 21 nt, Human
ugcguaugucuuguauuacuc

SEQ ID NO: 129564 - RNA, 23 nt, Human
ugccggaucuacuuuggguucuc

SEQ ID NO: 129565 - RNA, 22 nt, Human
ugccgcaggaggggcgauuucu

SEQ ID NO: 129566 - RNA, 19 nt, Human
ugccggccgcgggguuccu

SEQ ID NO: 129567 - RNA, 22 nt, Human
ugccgcuuucuggcccucaguc

SEQ ID NO: 129568 - RNA, 22 nt, Human
uccuucagaggacggcagccag

SEQ ID NO: 129569 - RNA, 22 nt, Human
ugccuggugcggagugaguggc

SEQ ID NO: 129570 - RNA, 22 nt, Human
ugccuguguauuuccggccugc

SEQ ID NO: 129571 - RNA, 22 nt, Human
uccuucuuuucgccggaguuga

SEQ ID NO: 129572 - RNA, 23 nt, Human
uccugcagauaagcugguugaca

SEQ ID NO: 129573 - RNA, 22 nt, Human
ugcccuuucuccagugaccauu

SEQ ID NO: 129574 - RNA, 22 nt, Human
uccucuucucuagagccggaau

SEQ ID NO: 129575 - RNA, 22 nt, Human
uccucuuguguguuccgguacc

SEQ ID NO: 129576 - RNA, 22 nt, Human
ugcaugacaauugccgucaagu

SEQ ID NO: 129577 - RNA, 22 nt, Human
uccguugaggcugccaggcgag

SEQ ID NO: 129578 - RNA, 17 nt, Human
uccuacaggugugcuga

SEQ ID NO: 129579 - RNA, 22 nt, Human
ucccuuuuuaauugugucccug

SEQ ID NO: 129580 - RNA, 22 nt, Human
ugcauugccucuauucauuaua

SEQ ID NO: 129581 - RNA, 22 nt, Human
ugcauugccauagcagggggau

SEQ ID NO: 129582 - RNA, 22 nt, Human
ugccaaugauuccacaauggaa

SEQ ID NO: 129583 - RNA, 16 nt, Human
ugccaagggguuaaug

SEQ ID NO: 129584 - RNA, 22 nt, Human
ugccagugugccuuccgcucac

SEQ ID NO: 129585 - RNA, 22 nt, Human
ugccagauuaugucuccagggc

SEQ ID NO: 129586 - RNA, 23 nt, Human
ugccaggaagaaugaccucugcu

SEQ ID NO: 129587 - RNA, 20 nt, Human
ugagaaacaagggcuggucu

SEQ ID NO: 129588 - RNA, 22 nt, Human
ugagggagggggagccguucua

SEQ ID NO: 129589 - RNA, 22 nt, Human
ugagguugggaggacugccuaa

SEQ ID NO: 129590 - RNA, 22 nt, Human
ugaguugcagucaauauugcaa

SEQ ID NO: 129591 - RNA, 22 nt, Human
ugagugugugucuuggguaccg

SEQ ID NO: 129592 - RNA, 22 nt, Human
ugagugacuguugucaagaugg

SEQ ID NO: 129593 - RNA, 22 nt, Human
ugaguccagaugggccagcagg

SEQ ID NO: 129594 - RNA, 22 nt, Human
ugagugggaggugggaagggua

SEQ ID NO: 129595 - RNA, 19 nt, Human
ugaucuccaguacagacau

SEQ ID NO: 129596 - RNA, 22 nt, Human
ucauuagaccucucugguucag

SEQ ID NO: 129597 - RNA, 20 nt, Human
ugauccacucucauugcucu

SEQ ID NO: 129598 - RNA, 23 nt, Human
ucauugcucaagauaaugguuga

SEQ ID NO: 129599 - RNA, 22 nt, Human
ugaugaucaugcagguugguuu

SEQ ID NO: 129600 - RNA, 22 nt, Human
ugaugcuagaacuuccaagaua

SEQ ID NO: 129601 - RNA, 22 nt, Human
uccaacuuaauugggaagauua

SEQ ID NO: 129602 - RNA, 22 nt, Human
uccaaugugccuuauuuugagc

SEQ ID NO: 129603 - RNA, 22 nt, Human
ugaugccauaguaaaauuugcu

SEQ ID NO: 129604 - RNA, 22 nt, Human
uccaaguuugagacugagagug

SEQ ID NO: 129605 - RNA, 22 nt, Human
uccagguccuacuggcccauag

SEQ ID NO: 129606 - RNA, 22 nt, Human
uccagguucaguucaucaucua

SEQ ID NO: 129607 - RNA, 22 nt, Human
uccagguuuggcuuuauaacuu

SEQ ID NO: 129608 - RNA, 22 nt, Human
uccaguggcaccuuggcccuca

SEQ ID NO: 129609 - RNA, 18 nt, Human
uccauccucugcucuuca

SEQ ID NO: 129610 - RNA, 22 nt, Human
uccaugauauauaugugcacau

SEQ ID NO: 129611 - RNA, 22 nt, Human
uccauacuggccucuuucccag

SEQ ID NO: 129612 - RNA, 22 nt, Human
ugcaaaaguuuuauacacagau

SEQ ID NO: 129613 - RNA, 22 nt, Human
uccagaaaucucuguugauugu

SEQ ID NO: 129614 - RNA, 22 nt, Human
uccaggcagcugcuugaugaua

SEQ ID NO: 129615 - RNA, 22 nt, Human
uccagagcuguccuacugugag

SEQ ID NO: 129616 - RNA, 22 nt, Human
uccacgggagcgucggucucgg

SEQ ID NO: 129617 - RNA, 22 nt, Human
uccaccugucccugcuuccugc

SEQ ID NO: 129618 - RNA, 22 nt, Human
uccaccaccaucacagucagac

SEQ ID NO: 129619 - RNA, 22 nt, Human
uccacagcagagcacgguaccu

SEQ ID NO: 129620 - RNA, 22 nt, Human
uccacagggaugccugcggcuu

SEQ ID NO: 129621 - RNA, 22 nt, Human
ugcaaggcacccacucugcuuu

SEQ ID NO: 129622 - RNA, 22 nt, Human
uccaugcgcgauggccuggcuu

SEQ ID NO: 129623 - RNA, 22 nt, Human
uccauggucgauggcugcuggg

SEQ ID NO: 129624 - RNA, 22 nt, Human
ugcacccacuuagcugaaguuc

SEQ ID NO: 129625 - RNA, 22 nt, Human
ucccaaaacuugaagcaagccu

SEQ ID NO: 129626 - RNA, 22 nt, Human
uccauucccugacagccucuuu

SEQ ID NO: 129627 - RNA, 20 nt, Human
ugcagcucccccgcaguuuc

SEQ ID NO: 129628 - RNA, 19 nt, Human
ugcagcuguaugagcuuaa

SEQ ID NO: 129629 - RNA, 22 nt, Human
ugcagccucacgcauccgcauu

SEQ ID NO: 129630 - RNA, 22 nt, Human
ugcagcagaauauggcugcagg

SEQ ID NO: 129631 - RNA, 22 nt, Human
ugcagcaucuccuugugccaug

SEQ ID NO: 129632 - RNA, 22 nt, Human
ugcacgcacuugcucuccagcg

SEQ ID NO: 129633 - RNA, 22 nt, Human
ugcacgcgcccuucgauggccc

SEQ ID NO: 129634 - RNA, 19 nt, Human
ugcagcacuaaaaacuuuc

SEQ ID NO: 129635 - RNA, 22 nt, Human
uagugcuuaaaacagaauuuuc

SEQ ID NO: 129636 - RNA, 22 nt, Human
ucuacuccaucugccagggcuu

SEQ ID NO: 129637 - RNA, 22 nt, Human
uagugggguccacuuccuucac

SEQ ID NO: 129638 - RNA, 22 nt, Human
ucuuccagauacuuccugacuu

SEQ ID NO: 129639 - RNA, 23 nt, Human
ucuagcccuaaaaagagagcaga

SEQ ID NO: 129640 - RNA, 22 nt, Human
ucuugcuguagcuguuucuucu

SEQ ID NO: 129641 - RNA, 22 nt, Human
ucuuggucccugagcucuuuca

SEQ ID NO: 129642 - RNA, 22 nt, Human
ugaaccuaacauuucuggcagu

SEQ ID NO: 129643 - RNA, 22 nt, Human
ugaacuucccauguacagacug

SEQ ID NO: 129644 - RNA, 21 nt, Human
ugaacaccaggagaaaucggu

SEQ ID NO: 129645 - RNA, 21 nt, Human
ucaaccagguguugaaggcac

SEQ ID NO: 129646 - RNA, 22 nt, Human
ugaagccacacuagcuuguccu

SEQ ID NO: 129647 - RNA, 22 nt, Human
ugaagacaguuuuacucaugag

SEQ ID NO: 129648 - RNA, 22 nt, Human
ucaaaggcuugugguucuggga

SEQ ID NO: 129649 - RNA, 22 nt, Human
ugaaauugaguaccucuuuaua

SEQ ID NO: 129650 - RNA, 22 nt, Human
ugaaagccuacagcucacuguu

SEQ ID NO: 129651 - RNA, 18 nt, Human
uauuugugugugugugug

SEQ ID NO: 129652 - RNA, 22 nt, Human
ucuuuugugauuuucugaagca

SEQ ID NO: 129653 - RNA, 22 nt, Human
ugaaggccagggauuugcagcc

SEQ ID NO: 129654 - RNA, 21 nt, Human
ucaagcggcagagcaguuauu

SEQ ID NO: 129655 - RNA, 22 nt, Human
ucaagcuggaaaugaagaaucu

SEQ ID NO: 129656 - RNA, 22 nt, Human
ugaagcuaguauuaacucagau

SEQ ID NO: 129657 - RNA, 22 nt, Human
ugaaggaggugaauccaugcau

SEQ ID NO: 129658 - RNA, 22 nt, Human
ucaagaagauaaugucuagggu

SEQ ID NO: 129659 - RNA, 21 nt, Human
ucaaguccuggcuuugcucuu

SEQ ID NO: 129660 - RNA, 22 nt, Human
ugaaucaaugaauugcacuuca

SEQ ID NO: 129661 - RNA, 22 nt, Human
ucacucgccuuuucguucgccg

SEQ ID NO: 129662 - RNA, 22 nt, Human
ucaccugccuggguggucaccu

SEQ ID NO: 129663 - RNA, 22 nt, Human
ucaccccagccuuaugacucag

SEQ ID NO: 129664 - RNA, 22 nt, Human
ucaccgucucaguacggaggga

SEQ ID NO: 129665 - RNA, 22 nt, Human
ucaccuggagagcuugcuaaua

SEQ ID NO: 129666 - RNA, 22 nt, Human
ucacugccuagggcuacugugc

SEQ ID NO: 129667 - RNA, 22 nt, Human
ucaccaggauugggcuguaggc

SEQ ID NO: 129668 - RNA, 22 nt, Human
ucaccauguacaugaagggcgg

SEQ ID NO: 129669 - RNA, 22 nt, Human
ucacaguucaacuaguucagau

SEQ ID NO: 129670 - RNA, 22 nt, Human
ugaaugaagcacuguaauucuc

SEQ ID NO: 129671 - RNA, 22 nt, Human
ugaaugcuacccugcuggcucu

SEQ ID NO: 129672 - RNA, 22 nt, Human
ugaauggugcccuagagggaug

SEQ ID NO: 129673 - RNA, 22 nt, Human
ucagaaggagagacagcgugga

SEQ ID NO: 129674 - RNA, 22 nt, Human
ucagaagguacugaagacaugg

SEQ ID NO: 129675 - RNA, 21 nt, Human
ucagaaucguuccagguagau

SEQ ID NO: 129676 - RNA, 18 nt, Human
ucagaggagauaccuaaa

SEQ ID NO: 129677 - RNA, 22 nt, Human
ucagagugagcuggggcugcuu

SEQ ID NO: 129678 - RNA, 21 nt, Human
ucagaccaacucuuguauccu

SEQ ID NO: 129679 - RNA, 22 nt, Human
ucagagccagacacacagcaga

SEQ ID NO: 129680 - RNA, 22 nt, Human
ucagacacacaacuucugcuua

SEQ ID NO: 129681 - RNA, 22 nt, Human
ugacaagagaccccuccgcagg

SEQ ID NO: 129682 - RNA, 22 nt, Human
ugacacacagggggauggaguu

SEQ ID NO: 129683 - RNA, 22 nt, Human
ugacugaggaaggugggguggg

SEQ ID NO: 129684 - RNA, 22 nt, Human
ucagcucucucuuggugaucuc

SEQ ID NO: 129685 - RNA, 22 nt, Human
ucagcucaggggauguggggga

SEQ ID NO: 129686 - RNA, 22 nt, Human
ucagcguuggccuccuccaggg

SEQ ID NO: 129687 - RNA, 22 nt, Human
ucagcgucuccaaaagagcccg

SEQ ID NO: 129688 - RNA, 22 nt, Human
ucagcacagcugcuuuuacuuc

SEQ ID NO: 129689 - RNA, 22 nt, Human
ucagauggucauucacuagggu

SEQ ID NO: 129690 - RNA, 22 nt, Human
ugaccgucagcugucuuccauu

SEQ ID NO: 129691 - RNA, 22 nt, Human
ugacguuugcgccgcgcacgac

SEQ ID NO: 129692 - RNA, 22 nt, Human
uaguugaauuuaucaguagcau

SEQ ID NO: 129693 - RNA, 22 nt, Human
gugcuaugugcugaacucaggu

SEQ ID NO: 129694 - RNA, 22 nt, Human
guguccaaagguaggaggaggg

SEQ ID NO: 129695 - RNA, 22 nt, Human
guguccaugugggugcucuccu

SEQ ID NO: 129696 - RNA, 22 nt, Human
guguccuguagaaacuguucca

SEQ ID NO: 129697 - RNA, 22 nt, Human
gugugucucaguugcuccgaag

SEQ ID NO: 129698 - RNA, 22 nt, Human
guguggcgacucagagcugccu

SEQ ID NO: 129699 - RNA, 22 nt, Human
uauaugcacucagguguaugug

SEQ ID NO: 129700 - RNA, 22 nt, Human
uaucugcuggagguaauuacuc

SEQ ID NO: 129701 - RNA, 22 nt, Human
guugauuuaaccucaccuuuga

SEQ ID NO: 129702 - RNA, 22 nt, Human
uauuuuggaugcauugagaugc

SEQ ID NO: 129703 - RNA, 22 nt, Human
guguguggacgucugagcccag

SEQ ID NO: 129704 - RNA, 22 nt, Human
guguucccauccacaccaagcc

SEQ ID NO: 129705 - RNA, 21 nt, Human
guuaccacugaugcaacagga

SEQ ID NO: 129706 - RNA, 22 nt, Human
uaugggcaagagauaggugguc

SEQ ID NO: 129707 - RNA, 22 nt, Human
guuccgcugcaaggccaggaaa

SEQ ID NO: 129708 - RNA, 21 nt, Human
guugugaccaugggaguugcu

SEQ ID NO: 129709 - RNA, 22 nt, Human
guuguugucauuagcuguuuaa

SEQ ID NO: 129710 - RNA, 22 nt, Human
guugucuggcucugaccauucu

SEQ ID NO: 129711 - RNA, 22 nt, Human
guugauuuaggguuuugguuuu

SEQ ID NO: 129712 - RNA, 22 nt, Human
uauuuuggcuccugagcucuga

SEQ ID NO: 129713 - RNA, 22 nt, Human
ucaaguccuuggcauaggauaa

SEQ ID NO: 129714 - RNA, 22 nt, Human
ucacagauguuauccugaggau

SEQ ID NO: 129715 - RNA, 22 nt, Human
ucacaugcucaccuaagccaca

SEQ ID NO: 129716 - RNA, 22 nt, Human
ucacccagacugucugacucuu

SEQ ID NO: 129717 - RNA, 22 nt, Human
ucacccuguggcuauaaggcaa

SEQ ID NO: 129718 - RNA, 22 nt, Human
ucaccaugcccuucucugcucu

SEQ ID NO: 129719 - RNA, 23 nt, Human
ucacugccaagaaaaguuacaga

SEQ ID NO: 129720 - RNA, 19 nt, Human
ucacggucaaccagagccu

SEQ ID NO: 129721 - RNA, 22 nt, Human
ucacuguuucaccgucugaagg

SEQ ID NO: 129722 - RNA, 22 nt, Human
ucacuguugccacggugauaau

SEQ ID NO: 129723 - RNA, 22 nt, Human
ucacuuccuugcagcuguagaa

SEQ ID NO: 129724 - RNA, 22 nt, Human
ucacuggaaaacaaauguuuua

SEQ ID NO: 129725 - RNA, 22 nt, Human
ucacuggauucauguuucuuua

SEQ ID NO: 129726 - RNA, 22 nt, Human
ucagaaacuaaauguggauuug

SEQ ID NO: 129727 - RNA, 22 nt, Human
ucagaacuaacuuugcugaacc

SEQ ID NO: 129728 - RNA, 22 nt, Human
ucagcaguuaagcuucccugcc

SEQ ID NO: 129729 - RNA, 22 nt, Human
ucagcaggugcuuuguuuacuc

SEQ ID NO: 129730 - RNA, 23 nt, Human
ucagccgcuggcgaguccacugg

SEQ ID NO: 129731 - RNA, 22 nt, Human
ucagcuucaucuugagcccaca

SEQ ID NO: 129732 - RNA, 22 nt, Human
uaaagaagaaaaggcuucaggc

SEQ ID NO: 129733 - RNA, 22 nt, Human
ucagcugggagaaaguuuuagg

SEQ ID NO: 129734 - RNA, 21 nt, Human
ucagccuguccaguguuaacc

SEQ ID NO: 129735 - RNA, 22 nt, Human
uaagaggucugaaacgguggga

SEQ ID NO: 129736 - RNA, 22 nt, Human
uaagagcagacacaaccugaga

SEQ ID NO: 129737 - RNA, 22 nt, Human
ucaucauccuuuuuugaagagu

SEQ ID NO: 129738 - RNA, 22 nt, Human
uaagaaaggggaaguuccucuu

SEQ ID NO: 129739 - RNA, 22 nt, Human
ucauccugaagaaccugcuucc

SEQ ID NO: 129740 - RNA, 22 nt, Human
ucauccucguccucuggugccc

SEQ ID NO: 129741 - RNA, 22 nt, Human
uaagggaagucuucaggagaca

SEQ ID NO: 129742 - RNA, 22 nt, Human
ucauccugucucuguucggaau

SEQ ID NO: 129743 - RNA, 19 nt, Human
uccaccgcgugcaccucua

SEQ ID NO: 129744 - RNA, 22 nt, Human
uccaccacgaaacugcagcugc

SEQ ID NO: 129745 - RNA, 20 nt, Human
uaccaucauuggcaaaccuc

SEQ ID NO: 129746 - RNA, 22 nt, Human
uccagcacacagguggcucuca

SEQ ID NO: 129747 - RNA, 19 nt, Human
uaccagguuggagaggccc

SEQ ID NO: 129748 - RNA, 22 nt, Human
uacauggauguuauccuuacug

SEQ ID NO: 129749 - RNA, 22 nt, Human
uacugguguauuucuucuuauu

SEQ ID NO: 129750 - RNA, 22 nt, Human
uacucuggaguugagaugcgag

SEQ ID NO: 129751 - RNA, 22 nt, Human
ucccaccugcuaagauguaucc

SEQ ID NO: 129752 - RNA, 22 nt, Human
ucccacagcuuccuagccacag

SEQ ID NO: 129753 - RNA, 22 nt, Human
ucccaagugcuccucuggcccc

SEQ ID NO: 129754 - RNA, 22 nt, Human
uccagguggcuuuccuggggga

SEQ ID NO: 129755 - RNA, 22 nt, Human
uccagugaacaucauggcucca

SEQ ID NO: 129756 - RNA, 22 nt, Human
uccaggucgggggugggccggc

SEQ ID NO: 129757 - RNA, 22 nt, Human
uaccgaagcugcuuuugcaugu

SEQ ID NO: 129758 - RNA, 19 nt, Human
uacccggauagccagguag

SEQ ID NO: 129759 - RNA, 22 nt, Human
ucgcggccgcuccacaugcaca

SEQ ID NO: 129760 - RNA, 22 nt, Human
ucgcuauuauuuuagguucuca

SEQ ID NO: 129761 - RNA, 22 nt, Human
ucgccuccucccagaucaacaa

SEQ ID NO: 129762 - RNA, 22 nt, Human
ucgagauguuuguuguggugau

SEQ ID NO: 129763 - RNA, 22 nt, Human
ucgagaccagcuagaaggaagu

SEQ ID NO: 129764 - RNA, 22 nt, Human
ucgacuccauuuuucuugguuc

SEQ ID NO: 129765 - RNA, 22 nt, Human
ucgaaugccaacaccgaaguuu

SEQ ID NO: 129766 - RNA, 22 nt, Human
uaggggcccgugggauggacag

SEQ ID NO: 129767 - RNA, 19 nt, Human
uaggcccugcgaauggcuu

SEQ ID NO: 129768 - RNA, 22 nt, Human
uaggcagggauuaggguugauu

SEQ ID NO: 129769 - RNA, 22 nt, Human
uaggcaguagcuuuggauguca

SEQ ID NO: 129770 - RNA, 22 nt, Human
ucggcgaccugucauggaccaa

SEQ ID NO: 129771 - RNA, 22 nt, Human
uaggggggugaaggaggucccu

SEQ ID NO: 129772 - RNA, 22 nt, Human
ucgcuguguccuuuucacuuau

SEQ ID NO: 129773 - RNA, 22 nt, Human
ucgggccacauccacacaucca

SEQ ID NO: 129774 - RNA, 22 nt, Human
ucgggggaaccggcccgggccu

SEQ ID NO: 129775 - RNA, 22 nt, Human
uaggucugaggcugcaucuugg

SEQ ID NO: 129776 - RNA, 22 nt, Human
uaggucuuggagguggggcugg

SEQ ID NO: 129777 - RNA, 22 nt, Human
uaggucaaggccacuucuugga

SEQ ID NO: 129778 - RNA, 22 nt, Human
uagucggcuaggagggccuucu

SEQ ID NO: 129779 - RNA, 22 nt, Human
ucguguuggaacugcuuuguaa

SEQ ID NO: 129780 - RNA, 22 nt, Human
ucguggaugaagaauagaggcc

SEQ ID NO: 129781 - RNA, 21 nt, Human
uccugccuggccuucugacua

SEQ ID NO: 129782 - RNA, 22 nt, Human
uccugcccuguccuugccucug

SEQ ID NO: 129783 - RNA, 22 nt, Human
uagccacuccgcagcaccgggu

SEQ ID NO: 129784 - RNA, 17 nt, Human
uagccagcuugugauuu

SEQ ID NO: 129785 - RNA, 22 nt, Human
uagccguugggguaacuggaca

SEQ ID NO: 129786 - RNA, 22 nt, Human
uagcccgugaggaggggcugug

SEQ ID NO: 129787 - RNA, 22 nt, Human
uagcgggucacccugcugugaa

SEQ ID NO: 129788 - RNA, 21 nt, Human
uccugcagggcagcagagugg

SEQ ID NO: 129789 - RNA, 22 nt, Human
uccugcaugcuagugagugcuu

SEQ ID NO: 129790 - RNA, 22 nt, Human
uagcaggagagaaguuuuaagu

SEQ ID NO: 129791 - RNA, 22 nt, Human
uagcaggaggcaguuccucgcu

SEQ ID NO: 129792 - RNA, 22 nt, Human
uagaccugugggggcagcgggc

SEQ ID NO: 129793 - RNA, 22 nt, Human
uagaggaccacagggugcagag

SEQ ID NO: 129794 - RNA, 22 nt, Human
uacuucauucaaguucgcuaua

SEQ ID NO: 129795 - RNA, 22 nt, Human
ucccagcaggcaccgcuucugc

SEQ ID NO: 129796 - RNA, 22 nt, Human
uagagcccucuggccacguugc

SEQ ID NO: 129797 - RNA, 22 nt, Human
uagagcucaagaagcaaaagcu

SEQ ID NO: 129798 - RNA, 22 nt, Human
uagacuggaagcuccuugaggc

SEQ ID NO: 129799 - RNA, 22 nt, Human
gugaguugugugaguaagcaga

SEQ ID NO: 129800 - RNA, 22 nt, Human
gugaugaaggccugcaccuggu

SEQ ID NO: 129801 - RNA, 22 nt, Human
gugaucagaagaaccugccgaa

SEQ ID NO: 129802 - RNA, 21 nt, Human
uagaccagcugugcuccucgg

SEQ ID NO: 129803 - RNA, 22 nt, Human
uagaaugggaggggaaucaucc

SEQ ID NO: 129804 - RNA, 22 nt, Human
uagaggccguagguggcugguu

SEQ ID NO: 129805 - RNA, 22 nt, Human
gugcaaugaguguggcaaagcc

SEQ ID NO: 129806 - RNA, 22 nt, Human
gugcagcugguggagucugggg

SEQ ID NO: 129807 - RNA, 22 nt, Human
gugcagcugggcgcugaccuuc

SEQ ID NO: 129808 - RNA, 22 nt, Human
uagaucucugccuuguucagag

SEQ ID NO: 129809 - RNA, 22 nt, Human
gugccaccagaugcuguugcua

SEQ ID NO: 129810 - RNA, 20 nt, Human
gugcggcucuaccacucggu

SEQ ID NO: 129811 - RNA, 22 nt, Human
gugccuggugcaggauaaucac

SEQ ID NO: 129812 - RNA, 22 nt, Human
gugcgaaagaagcgacuccagu

SEQ ID NO: 129813 - RNA, 22 nt, Human
uagcagcacuauuuguuguagu

SEQ ID NO: 129814 - RNA, 22 nt, Human
gugccuggaaucuuuucuucac

SEQ ID NO: 129815 - RNA, 22 nt, Human
uacugcaguuccugcugucucc

SEQ ID NO: 129816 - RNA, 22 nt, Human
gugaagcaagggucaccugugg

SEQ ID NO: 129817 - RNA, 22 nt, Human
uacucauuggagaauuacgagg

SEQ ID NO: 129818 - RNA, 23 nt, Human
uacagccaugucgcugauuuaac

SEQ ID NO: 129819 - RNA, 22 nt, Human
uacagcgaaaauuuagcuugau

SEQ ID NO: 129820 - RNA, 20 nt, Human
uacccgcagcugggucuggc

SEQ ID NO: 129821 - RNA, 22 nt, Human
uaccaugggucaguuggguuug

SEQ ID NO: 129822 - RNA, 22 nt, Human
gucugcccuuggccugggacuu

SEQ ID NO: 129823 - RNA, 22 nt, Human
uacaccuuaagccgcggcuccc

SEQ ID NO: 129824 - RNA, 21 nt, Human
uacaagaccggauucgggccc

SEQ ID NO: 129825 - RNA, 22 nt, Human
gucugccagauucugcuggauc

SEQ ID NO: 129826 - RNA, 22 nt, Human
uacacacacaugcauguacgug

SEQ ID NO: 129827 - RNA, 22 nt, Human
gucugcagcacugugcacgguc

SEQ ID NO: 129828 - RNA, 22 nt, Human
gucugcacgugccagggagggg

SEQ ID NO: 129829 - RNA, 20 nt, Human
uacaaggauguucaucagag

SEQ ID NO: 129830 - RNA, 22 nt, Human
gucuaccuucuuucucaacugg

SEQ ID NO: 129831 - RNA, 22 nt, Human
guugcuggggcugaguccccag

SEQ ID NO: 129832 - RNA, 22 nt, Human
ggugcuucgauagguguccaua

SEQ ID NO: 129833 - RNA, 22 nt, Human
gguggagacucagauuuguugc

SEQ ID NO: 129834 - RNA, 22 nt, Human
ggucaaucaugggucauugucu

SEQ ID NO: 129835 - RNA, 22 nt, Human
gguggcuucuguuugcaagagg

SEQ ID NO: 129836 - RNA, 22 nt, Human
gguggcagaggaggcgggagag

SEQ ID NO: 129837 - RNA, 22 nt, Human
gguggcauguaccucacagacu

SEQ ID NO: 129838 - RNA, 19 nt, Human
ggugggacaggugagauau

SEQ ID NO: 129839 - RNA, 22 nt, Human
ggugggccaaauuaaacauaua

SEQ ID NO: 129840 - RNA, 23 nt, Human
gguuggcuguacccaggcucccu

SEQ ID NO: 129841 - RNA, 21 nt, Human
gguuucugcaaaccuuguaca

SEQ ID NO: 129842 - RNA, 22 nt, Human
gguguuccgguucugcucuggg

SEQ ID NO: 129843 - RNA, 19 nt, Human
gguuaccagugugucuggc

SEQ ID NO: 129844 - RNA, 22 nt, Human
gguuaacaccacagcugggaca

SEQ ID NO: 129845 - RNA, 22 nt, Human
gguugccuguggcucccuguua

SEQ ID NO: 129846 - RNA, 22 nt, Human
gguugcggaccagcugggcugc

SEQ ID NO: 129847 - RNA, 22 nt, Human
gguugccuuugcaguuggauca

SEQ ID NO: 129848 - RNA, 22 nt, Human
gucaccgguuuuuagguaaaca

SEQ ID NO: 129849 - RNA, 22 nt, Human
gucacaaaugauuuagcaauca

SEQ ID NO: 129850 - RNA, 22 nt, Human
gucaaugcuuaguuugccugaa

SEQ ID NO: 129851 - RNA, 23 nt, Human
gucaccuccccuugccuucuccc

SEQ ID NO: 129852 - RNA, 22 nt, Human
guaugugguaccaugcaacggg

SEQ ID NO: 129853 - RNA, 22 nt, Human
guauccuccccgcuggccuuca

SEQ ID NO: 129854 - RNA, 22 nt, Human
guauuaugaaugccgaggcggc

SEQ ID NO: 129855 - RNA, 23 nt, Human
uaagccugugccugcuaccugcu

SEQ ID NO: 129856 - RNA, 18 nt, Human
uaacugguuucuucccau

SEQ ID NO: 129857 - RNA, 22 nt, Human
guagguggaggcaacacagcca

SEQ ID NO: 129858 - RNA, 22 nt, Human
guagccacugaaguaaggccac

SEQ ID NO: 129859 - RNA, 23 nt, Human
guguuguugauuuucgaaucuuu

SEQ ID NO: 129860 - RNA, 22 nt, Human
guguugaugugucuguauucua

SEQ ID NO: 129861 - RNA, 22 nt, Human
ggggaggaagcuggaacacggg

SEQ ID NO: 129862 - RNA, 22 nt, Human
ggggacaagggugucaguaggc

SEQ ID NO: 129863 - RNA, 21 nt, Human
ggggcccccacacaugccucc

SEQ ID NO: 129864 - RNA, 22 nt, Human
ggggccaaggcaaacuugaggg

SEQ ID NO: 129865 - RNA, 22 nt, Human
ggggcgaguguggaccgcagcc

SEQ ID NO: 129866 - RNA, 22 nt, Human
guuaaaaugauuugugauuuau

SEQ ID NO: 129867 - RNA, 22 nt, Human
ggggccgggccggcagacuggg

SEQ ID NO: 129868 - RNA, 22 nt, Human
ggggccuuugaguugggucccu

SEQ ID NO: 129869 - RNA, 23 nt, Human
guuaccgaccugauucggcagcc

SEQ ID NO: 129870 - RNA, 22 nt, Human
guuagaauggacaaagcugaaa

SEQ ID NO: 129871 - RNA, 22 nt, Human
ggggcggcgugggcgcggugau

SEQ ID NO: 129872 - RNA, 22 nt, Human
guuaaaugcagauucugacuca

SEQ ID NO: 129873 - RNA, 22 nt, Human
ggggugaggcagggcagggguc

SEQ ID NO: 129874 - RNA, 22 nt, Human
ggggugugcugggagaagggau

SEQ ID NO: 129875 - RNA, 23 nt, Human
guuauugcuggugcuggccagcc

SEQ ID NO: 129876 - RNA, 22 nt, Human
gggguuggaugccuuggaaauu

SEQ ID NO: 129877 - RNA, 22 nt, Human
ggguacaccaauggaugccagg

SEQ ID NO: 129878 - RNA, 22 nt, Human
gggucauugcgugacgcgagca

SEQ ID NO: 129879 - RNA, 22 nt, Human
ggggucccucucugugucaguu

SEQ ID NO: 129880 - RNA, 22 nt, Human
gggguacgaugguggggggcga

SEQ ID NO: 129881 - RNA, 22 nt, Human
guuaggcagugugguauagcag

SEQ ID NO: 129882 - RNA, 22 nt, Human
gggggggcagguuggaugucag

SEQ ID NO: 129883 - RNA, 22 nt, Human
gggggaggcucggcgccgcggu

SEQ ID NO: 129884 - RNA, 22 nt, Human
gggggcgccgccgcucaucuca

SEQ ID NO: 129885 - RNA, 22 nt, Human
ggggcguugccacggggacggg

SEQ ID NO: 129886 - RNA, 21 nt, Human
ggggccucaucagaaauguua

SEQ ID NO: 129887 - RNA, 22 nt, Human
gggggagcuacaggucccuugg

SEQ ID NO: 129888 - RNA, 22 nt, Human
gggugguggagguuugacagac

SEQ ID NO: 129889 - RNA, 22 nt, Human
gggugguuccuggaucugacug

SEQ ID NO: 129890 - RNA, 22 nt, Human
ggguguuaugccucugagucag

SEQ ID NO: 129891 - RNA, 22 nt, Human
ggguguggaggugacacauuug

SEQ ID NO: 129892 - RNA, 22 nt, Human
guucuggaggagagccuggugu

SEQ ID NO: 129893 - RNA, 22 nt, Human
guucugcccaggccuccccaac

SEQ ID NO: 129894 - RNA, 22 nt, Human
guucuguuguugaucuuuggag

SEQ ID NO: 129895 - RNA, 22 nt, Human
ggguggggcaugcucucuucug

SEQ ID NO: 129896 - RNA, 22 nt, Human
gggugcucauggauaaggcgaa

SEQ ID NO: 129897 - RNA, 22 nt, Human
guucggcuuccuaugucaugag

SEQ ID NO: 129898 - RNA, 22 nt, Human
guuccgcggccucgcgcugagc

SEQ ID NO: 129899 - RNA, 22 nt, Human
guucaccaguagcugggcuguu

SEQ ID NO: 129900 - RNA, 22 nt, Human
guuagggcaagggguuccucug

SEQ ID NO: 129901 - RNA, 22 nt, Human
gggugcucagugccaaggagug

SEQ ID NO: 129902 - RNA, 22 nt, Human
gggugcauggcagcccuucugg

SEQ ID NO: 129903 - RNA, 22 nt, Human
gggucuggagauccgggugaag

SEQ ID NO: 129904 - RNA, 20 nt, Human
gggucuggcaucucucucug

SEQ ID NO: 129905 - RNA, 22 nt, Human
guucgucuguggugugaggugc

SEQ ID NO: 129906 - RNA, 22 nt, Human
gggucggcacucuggcagcacc

SEQ ID NO: 129907 - RNA, 22 nt, Human
gguagaggaugaggagguugga

SEQ ID NO: 129908 - RNA, 22 nt, Human
gguagggaaggucucccacauu

SEQ ID NO: 129909 - RNA, 22 nt, Human
guugcaaaugggaagaugguua

SEQ ID NO: 129910 - RNA, 22 nt, Human
guugcggaguguagcgaugcuu

SEQ ID NO: 129911 - RNA, 22 nt, Human
ggguuccugaagugguucagga

SEQ ID NO: 129912 - RNA, 22 nt, Human
ggguuccuuggaacacuguuug

SEQ ID NO: 129913 - RNA, 22 nt, Human
ggguucauuugccggguaguuu

SEQ ID NO: 129914 - RNA, 22 nt, Human
guugagaagaccauuuuguuca

SEQ ID NO: 129915 - RNA, 22 nt, Human
guugaacagucacccugggagu

SEQ ID NO: 129916 - RNA, 22 nt, Human
guucuucucuuguaauggaauc

SEQ ID NO: 129917 - RNA, 22 nt, Human
guucuucagcccucagguccua

SEQ ID NO: 129918 - RNA, 22 nt, Human
ggguuuugugauugccucugaa

SEQ ID NO: 129919 - RNA, 22 nt, Human
gggcugcuccgcccgcugcgcc

SEQ ID NO: 129920 - RNA, 22 nt, Human
gggcugaugcuuauacauacug

SEQ ID NO: 129921 - RNA, 22 nt, Human
gggcugagagcuggaaucugag

SEQ ID NO: 129922 - RNA, 22 nt, Human
gugugaguggcuaagugugccu

SEQ ID NO: 129923 - RNA, 22 nt, Human
gugucacuuucaggagcucuaa

SEQ ID NO: 129924 - RNA, 22 nt, Human
gugugguguuaagcaaauuaau

SEQ ID NO: 129925 - RNA, 22 nt, Human
gugugcacaaucuggcaugugc

SEQ ID NO: 129926 - RNA, 22 nt, Human
gggcuguggggccugcagaagg

SEQ ID NO: 129927 - RNA, 20 nt, Human
gggcuuugagcucagggcuu

SEQ ID NO: 129928 - RNA, 22 nt, Human
gggcuuuuccauuccaggguuc

SEQ ID NO: 129929 - RNA, 22 nt, Human
gggcggggcucacggugcggca

SEQ ID NO: 129930 - RNA, 22 nt, Human
guggugaacauuugcaucugcu

SEQ ID NO: 129931 - RNA, 22 nt, Human
guggugauuugggucuagcuuu

SEQ ID NO: 129932 - RNA, 22 nt, Human
gugguccugguugucugagaga

SEQ ID NO: 129933 - RNA, 22 nt, Human
gugggugauacugccgugggag

SEQ ID NO: 129934 - RNA, 22 nt, Human
gggcgcuguguuaggugcugua

SEQ ID NO: 129935 - RNA, 22 nt, Human
guggguuggguuuuugaaggga

SEQ ID NO: 129936 - RNA, 22 nt, Human
gggcgcuuucugggucagggcu

SEQ ID NO: 129937 - RNA, 22 nt, Human
gugggugucaguaucuuuaacg

SEQ ID NO: 129938 - RNA, 22 nt, Human
gugguaccaguaggucagccau

SEQ ID NO: 129939 - RNA, 20 nt, Human
gggcucugcauccaucagcc

SEQ ID NO: 129940 - RNA, 22 nt, Human
gggcggcguccucagucgggug

SEQ ID NO: 129941 - RNA, 22 nt, Human
gggcuacugagcuggaacuggg

SEQ ID NO: 129942 - RNA, 22 nt, Human
gugguggggaguuggauggaag

SEQ ID NO: 129943 - RNA, 22 nt, Human
guggugggcgugguguaugccu

SEQ ID NO: 129944 - RNA, 22 nt, Human
gugguggugaggcaaggggugu

SEQ ID NO: 129945 - RNA, 22 nt, Human
guggugguguuggugacaaguu

SEQ ID NO: 129946 - RNA, 22 nt, Human
guguagugugcuguucaguguu

SEQ ID NO: 129947 - RNA, 22 nt, Human
gugguuugcugguguacguuua

SEQ ID NO: 129948 - RNA, 22 nt, Human
gugggugaguggggccgccuga

SEQ ID NO: 129949 - RNA, 22 nt, Human
gggccugcgcuggggggagccg

SEQ ID NO: 129950 - RNA, 22 nt, Human
gggccuguccccccaggagaac

SEQ ID NO: 129951 - RNA, 21 nt, Human
gggccugggccagggccgggu

SEQ ID NO: 129952 - RNA, 22 nt, Human
guggguccaaccugugugugug

SEQ ID NO: 129953 - RNA, 22 nt, Human
gugggggauggcgugugggucu

SEQ ID NO: 129954 - RNA, 22 nt, Human
gugggcuuuuuugaaaccugaa

SEQ ID NO: 129955 - RNA, 22 nt, Human
guggcagguguacagcucagcu

SEQ ID NO: 129956 - RNA, 22 nt, Human
guggcagagccuugcggcuuug

SEQ ID NO: 129957 - RNA, 22 nt, Human
guggcagagagcaagugucuga

SEQ ID NO: 129958 - RNA, 22 nt, Human
guggauuguaccacgaaaagug

SEQ ID NO: 129959 - RNA, 22 nt, Human
guggauggagcuggaagccauu

SEQ ID NO: 129960 - RNA, 22 nt, Human
guggcuggguggaacugagucu

SEQ ID NO: 129961 - RNA, 22 nt, Human
guggcgucgaugauggugucau

SEQ ID NO: 129962 - RNA, 22 nt, Human
guggccugacagaucggaacag

SEQ ID NO: 129963 - RNA, 22 nt, Human
guggccuuccuguuccuuugaa

SEQ ID NO: 129964 - RNA, 22 nt, Human
guggcauggggagcagcuagaa

SEQ ID NO: 129965 - RNA, 18 nt, Human
guggccauugaccagcuu

SEQ ID NO: 129966 - RNA, 22 nt, Human
guggacuuuggucugugccauc

SEQ ID NO: 129967 - RNA, 22 nt, Human
gggcaugcagcaauucuguggu

SEQ ID NO: 129968 - RNA, 22 nt, Human
gggcaugugauggacgugugcc

SEQ ID NO: 129969 - RNA, 22 nt, Human
guggagauauuugugauagggg

SEQ ID NO: 129970 - RNA, 22 nt, Human
gggccggcuggggcggggcggg

SEQ ID NO: 129971 - RNA, 19 nt, Human
gggccucacccacaccucc

SEQ ID NO: 129972 - RNA, 22 nt, Human
gggccgcagccucuccggccug

SEQ ID NO: 129973 - RNA, 22 nt, Human
gggcccaacuguuggcagccuc

SEQ ID NO: 129974 - RNA, 22 nt, Human
gggccaggaugugguucauuuu

SEQ ID NO: 129975 - RNA, 22 nt, Human
gggccaaggggagcuggaaggg

SEQ ID NO: 129976 - RNA, 22 nt, Human
gggcagucagauucgggggccu

SEQ ID NO: 129977 - RNA, 22 nt, Human
gggcaggacccguuagaguggc

SEQ ID NO: 129978 - RNA, 22 nt, Human
gggcaguuucaugugguucaac

SEQ ID NO: 129979 - RNA, 22 nt, Human
gggcaggggcagugguggcauu

SEQ ID NO: 129980 - RNA, 22 nt, Human
gggcaggcuggguggugguccc

SEQ ID NO: 129981 - RNA, 22 nt, Human
ggccuugauuccggucauugaa

SEQ ID NO: 129982 - RNA, 22 nt, Human
gugcuugcgcauaacuggggcc

SEQ ID NO: 129983 - RNA, 22 nt, Human
gugcuuugcuaggaccgauugu

SEQ ID NO: 129984 - RNA, 22 nt, Human
gcccagcucucuggccugucuu

SEQ ID NO: 129985 - RNA, 22 nt, Human
gcuggucuggcaauccucaugg

SEQ ID NO: 129986 - RNA, 22 nt, Human
gcccauggagaccucaggcugg

SEQ ID NO: 129987 - RNA, 22 nt, Human
ggaagcucaauacuuuccucuu

SEQ ID NO: 129988 - RNA, 19 nt, Human
gcugggauaggauguauuu

SEQ ID NO: 129989 - RNA, 22 nt, Human
gcugggagaggcagcuuucgga

SEQ ID NO: 129990 - RNA, 22 nt, Human
gcugggacacacagucuucuuu

SEQ ID NO: 129991 - RNA, 23 nt, Human
gcccagaggccccuggccugagc

SEQ ID NO: 129992 - RNA, 22 nt, Human
gcugggucucucccugguccug

SEQ ID NO: 129993 - RNA, 22 nt, Human
gcuggguuguucuccuggucca

SEQ ID NO: 129994 - RNA, 22 nt, Human
gcuggguaguucuuguuuggga

SEQ ID NO: 129995 - RNA, 22 nt, Human
gcugggccucuuacuucuuacg

SEQ ID NO: 129996 - RNA, 22 nt, Human
gcuggggaucgaaggcagagcc

SEQ ID NO: 129997 - RNA, 18 nt, Human
ggaaggugcuggagugca

SEQ ID NO: 129998 - RNA, 22 nt, Human
gccuggcagggagauuguaaga

SEQ ID NO: 129999 - RNA, 22 nt, Human
gccuggccaaucgccgucuagg

SEQ ID NO: 130000 - RNA, 22 nt, Human
gccugcuugaaagcacuuucug

SEQ ID NO: 130001 - RNA, 22 nt, Human
gccuggaaugcaaugugacgaa

SEQ ID NO: 130002 - RNA, 22 nt, Human
ggacggggagcuggaaagggga

SEQ ID NO: 130003 - RNA, 22 nt, Human
ggacuccuguguuuuggcugag

SEQ ID NO: 130004 - RNA, 20 nt, Human
ggacccuggguucuucugag

SEQ ID NO: 130005 - RNA, 21 nt, Human
ggacccucagauggcagugag

SEQ ID NO: 130006 - RNA, 22 nt, Human
ggacucucaggcugucggcuuc

SEQ ID NO: 130007 - RNA, 22 nt, Human
ggacugggagaauggaggcaag

SEQ ID NO: 130008 - RNA, 22 nt, Human
gcgcacaaccccguggcgguga

SEQ ID NO: 130009 - RNA, 22 nt, Human
ggacucuaccuggagcagccuc

SEQ ID NO: 130010 - RNA, 22 nt, Human
gccuucgauaugaggguuugcc

SEQ ID NO: 130011 - RNA, 22 nt, Human
gccuuggacuaccacucccaca

SEQ ID NO: 130012 - RNA, 22 nt, Human
gccuugagcucaugucccagcu

SEQ ID NO: 130013 - RNA, 22 nt, Human
ggacagacagcauggaaccaua

SEQ ID NO: 130014 - RNA, 22 nt, Human
gcgccgacccucccugccggac

SEQ ID NO: 130015 - RNA, 20 nt, Human
gcgcaguuccgggcgcgucu

SEQ ID NO: 130016 - RNA, 22 nt, Human
gcgcagugagguuaagaaugca

SEQ ID NO: 130017 - RNA, 22 nt, Human
ggagaucuuggacuggccggcc

SEQ ID NO: 130018 - RNA, 22 nt, Human
ggagaucugggcuguuucuggc

SEQ ID NO: 130019 - RNA, 22 nt, Human
ggagauggucacagguaaacau

SEQ ID NO: 130020 - RNA, 22 nt, Human
ggagaugacaucccagcccggc

SEQ ID NO: 130021 - RNA, 22 nt, Human
ggagcagaggaaagaguagcau

SEQ ID NO: 130022 - RNA, 22 nt, Human
ggagaugucugugccacgucuc

SEQ ID NO: 130023 - RNA, 22 nt, Human
gcggguggaggagggacgggca

SEQ ID NO: 130024 - RNA, 22 nt, Human
gcgguggcuacuaaaguucgaa

SEQ ID NO: 130025 - RNA, 22 nt, Human
gcgguuggacguucgccucggg

SEQ ID NO: 130026 - RNA, 22 nt, Human
gcggucuaggaccucagugugu

SEQ ID NO: 130027 - RNA, 22 nt, Human
gcuacaaaaccagggcaaagga

SEQ ID NO: 130028 - RNA, 22 nt, Human
gcgggcuuggcuccagggccca

SEQ ID NO: 130029 - RNA, 22 nt, Human
ggcagagguagcuggaaccagg

SEQ ID NO: 130030 - RNA, 22 nt, Human
ggcagaggaagcuggaaguggg

SEQ ID NO: 130031 - RNA, 22 nt, Human
ggcagagcugugcgcccaccca

SEQ ID NO: 130032 - RNA, 22 nt, Human
ggcagggagagcaugcugauaa

SEQ ID NO: 130033 - RNA, 18 nt, Human
ggcagggcucagcugcuc

SEQ ID NO: 130034 - RNA, 22 nt, Human
gcucagcuggagagggacgggu

SEQ ID NO: 130035 - RNA, 22 nt, Human
ggcagggagagcgccgccaugc

SEQ ID NO: 130036 - RNA, 22 nt, Human
gcuccagcuccauaaacauaag

SEQ ID NO: 130037 - RNA, 22 nt, Human
gcuccacugccccugggcaccg

SEQ ID NO: 130038 - RNA, 22 nt, Human
ggagcauggcuucuuggggcug

SEQ ID NO: 130039 - RNA, 22 nt, Human
ggaucaccagguuuguuguugg

SEQ ID NO: 130040 - RNA, 23 nt, Human
ggauccugacauauaccaucacc

SEQ ID NO: 130041 - RNA, 22 nt, Human
ggauggaugugaucugccuccu

SEQ ID NO: 130042 - RNA, 22 nt, Human
ggaugcugcuccacaucccaca

SEQ ID NO: 130043 - RNA, 22 nt, Human
ggauccuucagcacugaggugu

SEQ ID NO: 130044 - RNA, 22 nt, Human
ggaugaguuguauauaggauuc

SEQ ID NO: 130045 - RNA, 22 nt, Human
gcggcuggcuguccaaacuggg

SEQ ID NO: 130046 - RNA, 22 nt, Human
gcgggcgcuguggccccggccu

SEQ ID NO: 130047 - RNA, 19 nt, Human
gcgggcucuccaccccauc

SEQ ID NO: 130048 - RNA, 22 nt, Human
ggcaagauccagcacaaacaca

SEQ ID NO: 130049 - RNA, 22 nt, Human
ggcaagcacugggugucuuagc

SEQ ID NO: 130050 - RNA, 22 nt, Human
ggauggugauguacccagucau

SEQ ID NO: 130051 - RNA, 22 nt, Human
ggaugggcuuggggaggucuag

SEQ ID NO: 130052 - RNA, 22 nt, Human
gcggcccggguccccagcagca

SEQ ID NO: 130053 - RNA, 22 nt, Human
gcugcgccgggagccggggccg

SEQ ID NO: 130054 - RNA, 22 nt, Human
gcugcuacagagcuggaggggg

SEQ ID NO: 130055 - RNA, 22 nt, Human
gcugcuggcggagcuggcgcug

SEQ ID NO: 130056 - RNA, 22 nt, Human
ggcgaugaggucuuagaaucua

SEQ ID NO: 130057 - RNA, 22 nt, Human
ggcgauuggccgggaggaggca

SEQ ID NO: 130058 - RNA, 22 nt, Human
ggcgaggcgggccgcggggucu

SEQ ID NO: 130059 - RNA, 22 nt, Human
ggcgacuacugaaugcuugaaa

SEQ ID NO: 130060 - RNA, 22 nt, Human
gcugccuugaacuuggccuggg

SEQ ID NO: 130061 - RNA, 22 nt, Human
ggccuugggauguggcugcagc

SEQ ID NO: 130062 - RNA, 22 nt, Human
ggccuugguggcuuugcugaug

SEQ ID NO: 130063 - RNA, 23 nt, Human
ggccuuuuuaaccgcgagcgaca

SEQ ID NO: 130064 - RNA, 22 nt, Human
ggcgccugguauucuuccucuc

SEQ ID NO: 130065 - RNA, 22 nt, Human
ggcggaggucacgcacccgcca

SEQ ID NO: 130066 - RNA, 22 nt, Human
ggcggcaagggaauggagaaga

SEQ ID NO: 130067 - RNA, 22 nt, Human
ggcguccuccucgucugaggcg

SEQ ID NO: 130068 - RNA, 22 nt, Human
ggccugagaagcaaggacacaa

SEQ ID NO: 130069 - RNA, 18 nt, Human
ggccucagccuggccgga

SEQ ID NO: 130070 - RNA, 22 nt, Human
ggccuggccuccugcuuuucca

SEQ ID NO: 130071 - RNA, 22 nt, Human
ggcccgcgcugcuggcgcgcca

SEQ ID NO: 130072 - RNA, 22 nt, Human
ggccgccgcuuagcugagcccc

SEQ ID NO: 130073 - RNA, 22 nt, Human
gcugcaggaggugguagggucu

SEQ ID NO: 130074 - RNA, 22 nt, Human
gcugcacgguccuggcaccacg

SEQ ID NO: 130075 - RNA, 23 nt, Human
gcugcagugaauguuguuguugu

SEQ ID NO: 130076 - RNA, 22 nt, Human
gcugccgcugcggggcgcgggc

SEQ ID NO: 130077 - RNA, 22 nt, Human
gcugcccauugcucucccacuc

SEQ ID NO: 130078 - RNA, 22 nt, Human
gcugcccucccagggcaagcuu

SEQ ID NO: 130079 - RNA, 21 nt, Human
gcucccgaagugcucggcguu

SEQ ID NO: 130080 - RNA, 22 nt, Human
gcucugcuccaucuguuuccuc

SEQ ID NO: 130081 - RNA, 22 nt, Human
gcucuggcugccuuaguuuugu

SEQ ID NO: 130082 - RNA, 22 nt, Human
gcugacuauaaggcugcucugu

SEQ ID NO: 130083 - RNA, 22 nt, Human
gcuggccugcgagggcaggcug

SEQ ID NO: 130084 - RNA, 22 nt, Human
gcugggagucgcgucuguggcc

SEQ ID NO: 130085 - RNA, 22 nt, Human
ggcuggacuuucugcugggcuc

SEQ ID NO: 130086 - RNA, 21 nt, Human
gcuggcugucucuuacacggu

SEQ ID NO: 130087 - RNA, 22 nt, Human
ggcugcagggaacaggaugggu

SEQ ID NO: 130088 - RNA, 17 nt, Human
ggcugccaggcaacaua

SEQ ID NO: 130089 - RNA, 22 nt, Human
ggcugcuugggcuguuucuuuu

SEQ ID NO: 130090 - RNA, 22 nt, Human
ggcugaugacgccugagucuga

SEQ ID NO: 130091 - RNA, 22 nt, Human
ggcugcaagacguuauuagcgu

SEQ ID NO: 130092 - RNA, 22 nt, Human
ggcugaggccucuggggaggga

SEQ ID NO: 130093 - RNA, 22 nt, Human
ggcucuggcgagcuuuaguaca

SEQ ID NO: 130094 - RNA, 22 nt, Human
ggcucuccacuauggaugagaa

SEQ ID NO: 130095 - RNA, 22 nt, Human
gcuggaugucugugccaggcac

SEQ ID NO: 130096 - RNA, 22 nt, Human
ggcuccaggguaccccuggaug

SEQ ID NO: 130097 - RNA, 22 nt, Human
ggcuccugggcgucuucgaaca

SEQ ID NO: 130098 - RNA, 22 nt, Human
ggcucacuguaccugccgccgc

SEQ ID NO: 130099 - RNA, 22 nt, Human
ggcucagaggagcuggaacggu

SEQ ID NO: 130100 - RNA, 22 nt, Human
gcuggaagggccagcuuucagg

SEQ ID NO: 130101 - RNA, 22 nt, Human
ggcucguaaaggccucacaggu

SEQ ID NO: 130102 - RNA, 22 nt, Human
gcugcuggcuuccugcuguuuu

SEQ ID NO: 130103 - RNA, 22 nt, Human
gcugucaggaacaugccuuggu

SEQ ID NO: 130104 - RNA, 22 nt, Human
gcuguacugucugccaagccag

SEQ ID NO: 130105 - RNA, 22 nt, Human
gcugucccccaaagaugcuccu

SEQ ID NO: 130106 - RNA, 22 nt, Human
ggcuucucuuggccaugguccc

SEQ ID NO: 130107 - RNA, 22 nt, Human
gcuggugugagauucucgaggg

SEQ ID NO: 130108 - RNA, 22 nt, Human
ggcugggagguggcgaggaggc

SEQ ID NO: 130109 - RNA, 22 nt, Human
ggcugguggcgggcagcacaga

SEQ ID NO: 130110 - RNA, 18 nt, Human
ggcugggcugugccccuu

SEQ ID NO: 130111 - RNA, 21 nt, Human
gguagggaagguguuccucau

SEQ ID NO: 130112 - RNA, 22 nt, Human
gguaccuggcccuggggcugcu

SEQ ID NO: 130113 - RNA, 22 nt, Human
gggugugcuaaaccuacgcaca

SEQ ID NO: 130114 - RNA, 22 nt, Human
ggucucugggacguuggaucgc

SEQ ID NO: 130115 - RNA, 22 nt, Human
ggugaaggaucccucuuggccu

SEQ ID NO: 130116 - RNA, 22 nt, Human
ggucuucauaugccacagaguc

SEQ ID NO: 130117 - RNA, 22 nt, Human
ggucgaguuccuuguuuuuuau

SEQ ID NO: 130118 - RNA, 22 nt, Human
ggcaccuuucaucccaucuaga

SEQ ID NO: 130119 - RNA, 22 nt, Human
ggauuugaugagacuaucuacu

SEQ ID NO: 130120 - RNA, 22 nt, Human
ggugcguggcccauccuccacc

SEQ ID NO: 130121 - RNA, 22 nt, Human
ggcagcccuggacccuggagaa

SEQ ID NO: 130122 - RNA, 22 nt, Human
ggugcaauaaaguuguagaacc

SEQ ID NO: 130123 - RNA, 22 nt, Human
ggugacauuggagagacaggug

SEQ ID NO: 130124 - RNA, 19 nt, Human
ggugaucugucccuugcuc

SEQ ID NO: 130125 - RNA, 22 nt, Human
ggcagguccugaguccugaggc

SEQ ID NO: 130126 - RNA, 22 nt, Human
ggcagggaauucagagggaagg

SEQ ID NO: 130127 - RNA, 22 nt, Human
ggugguucagugguuagggcca

SEQ ID NO: 130128 - RNA, 22 nt, Human
gguggguccuuugacagagaug

SEQ ID NO: 130129 - RNA, 22 nt, Human
ggcaguguggauccuggagaag

SEQ ID NO: 130130 - RNA, 22 nt, Human
gguguacgaagaggcgggaguc

SEQ ID NO: 130131 - RNA, 22 nt, Human
gguguaaucacaagcuggaauu

SEQ ID NO: 130132 - RNA, 22 nt, Human
gguggcuugcugguaggugugc

SEQ ID NO: 130133 - RNA, 22 nt, Human
gguggggacuuggggucagcgg

SEQ ID NO: 130134 - RNA, 22 nt, Human
gguggucaggagcgcccguugg

SEQ ID NO: 130135 - RNA, 22 nt, Human
ggcagucuuucccuugagcucu

SEQ ID NO: 130136 - RNA, 22 nt, Human
ggugggaauccaggccuucauc

SEQ ID NO: 130137 - RNA, 22 nt, Human
ggccugcuaccagcugugaccu

SEQ ID NO: 130138 - RNA, 22 nt, Human
ggccugcucuggcuguggucag

SEQ ID NO: 130139 - RNA, 22 nt, Human
ggccuggcacauaguaggcagu

SEQ ID NO: 130140 - RNA, 22 nt, Human
ggccucucuccuuggcuugcag

SEQ ID NO: 130141 - RNA, 22 nt, Human
ggccgggugggaggcagcggag

SEQ ID NO: 130142 - RNA, 20 nt, Human
ggccugagcauggcuggcag

SEQ ID NO: 130143 - RNA, 22 nt, Human
ggccgcuuucuggggagugagg

SEQ ID NO: 130144 - RNA, 22 nt, Human
ggccgggcaugcgagcugagcg

SEQ ID NO: 130145 - RNA, 22 nt, Human
ggccgccacuuuccagugcugc

SEQ ID NO: 130146 - RNA, 22 nt, Human
guagggguggggagguggucug

SEQ ID NO: 130147 - RNA, 22 nt, Human
guaggaguguucgggaacuggg

SEQ ID NO: 130148 - RNA, 22 nt, Human
guaggugggcuuccaagguccu

SEQ ID NO: 130149 - RNA, 22 nt, Human
guacuugauucauuauugcauu

SEQ ID NO: 130150 - RNA, 22 nt, Human
gguugauuuuuaugaagccaug

SEQ ID NO: 130151 - RNA, 22 nt, Human
ggcccugcuuccccaguguaca

SEQ ID NO: 130152 - RNA, 22 nt, Human
ggccgccacacagauucccccg

SEQ ID NO: 130153 - RNA, 22 nt, Human
ggcccuggggcaggagcagagg

SEQ ID NO: 130154 - RNA, 22 nt, Human
ggccagcgugggggaguagcgg

SEQ ID NO: 130155 - RNA, 22 nt, Human
gguucuggaaaagaaagcaaag

SEQ ID NO: 130156 - RNA, 22 nt, Human
gguugaagcuacuuucuggaug

SEQ ID NO: 130157 - RNA, 22 nt, Human
ggugucaucugggcuggagaua

SEQ ID NO: 130158 - RNA, 22 nt, Human
ggugucagccacuuugucggag

SEQ ID NO: 130159 - RNA, 22 nt, Human
gcuguggacacagcucucuuca

SEQ ID NO: 130160 - RNA, 22 nt, Human
gggagcugagcuggaagagaau

SEQ ID NO: 130161 - RNA, 22 nt, Human
gcuuuguucauuuaguuuuuuu

SEQ ID NO: 130162 - RNA, 22 nt, Human
gcuuuggcuucuccuggcagga

SEQ ID NO: 130163 - RNA, 22 nt, Human
gggcaagaggguuugacaugag

SEQ ID NO: 130164 - RNA, 22 nt, Human
gggcagaaaggaaggcuggggg

SEQ ID NO: 130165 - RNA, 22 nt, Human
gggcacggaaggcgccaggggu

SEQ ID NO: 130166 - RNA, 22 nt, Human
gggcaagagaggaagagauggc

SEQ ID NO: 130167 - RNA, 22 nt, Human
gggcaagaagcuggaagcauuc

SEQ ID NO: 130168 - RNA, 22 nt, Human
gggaggucgaggcugggccgca

SEQ ID NO: 130169 - RNA, 22 nt, Human
gggagggcuuggacccagaugu

SEQ ID NO: 130170 - RNA, 22 nt, Human
gggaguggagagugaagcuaau

SEQ ID NO: 130171 - RNA, 22 nt, Human
gggaguauguccgggcucuaga

SEQ ID NO: 130172 - RNA, 22 nt, Human
gggauguauguuuguguggaga

SEQ ID NO: 130173 - RNA, 22 nt, Human
gggauggggagcuggaaagggg

SEQ ID NO: 130174 - RNA, 22 nt, Human
gggcgcgccaggagcugcgcgg

SEQ ID NO: 130175 - RNA, 22 nt, Human
gggcgagcgucucagccgggcg

SEQ ID NO: 130176 - RNA, 22 nt, Human
gggcgccgggagugagagugag

SEQ ID NO: 130177 - RNA, 22 nt, Human
ggaaguggauucagggcugcua

SEQ ID NO: 130178 - RNA, 22 nt, Human
gggccuuggaggagaaggacuu

SEQ ID NO: 130179 - RNA, 22 nt, Human
gggcgcaagcaugugucugggu

SEQ ID NO: 130180 - RNA, 22 nt, Human
ggaaggugagugcugugugauu

SEQ ID NO: 130181 - RNA, 20 nt, Human
ggaacccuagacuugcgcag

SEQ ID NO: 130182 - RNA, 22 nt, Human
ggaagcuguugugagugcagca

SEQ ID NO: 130183 - RNA, 22 nt, Human
gggcgcgcggagccucgccggg

SEQ ID NO: 130184 - RNA, 22 nt, Human
gggcggggcuuccguccuccac

SEQ ID NO: 130185 - RNA, 22 nt, Human
gggcggggggagcuggaaugaa

SEQ ID NO: 130186 - RNA, 22 nt, Human
gggcggugccugucuccgaagc

SEQ ID NO: 130187 - RNA, 22 nt, Human
gggcggccugcucuguggggag

SEQ ID NO: 130188 - RNA, 22 nt, Human
ggacagacuuuacagccccggg

SEQ ID NO: 130189 - RNA, 22 nt, Human
ggacagagcaacccuacgcagc

SEQ ID NO: 130190 - RNA, 22 nt, Human
gggcuacagaugggagggauga

SEQ ID NO: 130191 - RNA, 22 nt, Human
gggcuagggucagggggccacu

SEQ ID NO: 130192 - RNA, 22 nt, Human
gggcucaaccauagcacaaaga

SEQ ID NO: 130193 - RNA, 19 nt, Human
ggaguugccaggagaagga

SEQ ID NO: 130194 - RNA, 22 nt, Human
ggaguuucugucaucccguccc

SEQ ID NO: 130195 - RNA, 22 nt, Human
ggaguguuaggaaguuguguuu

SEQ ID NO: 130196 - RNA, 22 nt, Human
gggugucugcugaauuucccuu

SEQ ID NO: 130197 - RNA, 22 nt, Human
gggucucucuucuuucugugaa

SEQ ID NO: 130198 - RNA, 22 nt, Human
gggucagggaggccccaccaug

SEQ ID NO: 130199 - RNA, 22 nt, Human
ggguggugauacugcuucugcc

SEQ ID NO: 130200 - RNA, 22 nt, Human
gggguguuuugaagagguucag

SEQ ID NO: 130201 - RNA, 22 nt, Human
ggagggaggggugggagaugga

SEQ ID NO: 130202 - RNA, 22 nt, Human
ggagggagugcaggcaggcaga

SEQ ID NO: 130203 - RNA, 22 nt, Human
ggggucugaucccuucuggcuu

SEQ ID NO: 130204 - RNA, 22 nt, Human
gggguauuugguagacauuuug

SEQ ID NO: 130205 - RNA, 22 nt, Human
ggggugggcuggguguccaagg

SEQ ID NO: 130206 - RNA, 22 nt, Human
gggguguuagucuuacccagag

SEQ ID NO: 130207 - RNA, 22 nt, Human
ggggugagaguguuuuaaagca

SEQ ID NO: 130208 - RNA, 22 nt, Human
ggggcugggaggccggcgcgca

SEQ ID NO: 130209 - RNA, 17 nt, Human
ggggcguguauuugaug

SEQ ID NO: 130210 - RNA, 22 nt, Human
ggggcucauuugcaggggggag

SEQ ID NO: 130211 - RNA, 22 nt, Human
ggggcggggagcaugagcuggg

SEQ ID NO: 130212 - RNA, 22 nt, Human
ggggccaugauggacgagguga

SEQ ID NO: 130213 - RNA, 22 nt, Human
gggcuggcaguuuucugaguuc

SEQ ID NO: 130214 - RNA, 22 nt, Human
gggcuggggcucuggggcuagg

SEQ ID NO: 130215 - RNA, 22 nt, Human
gggcuguaggagcuggaauggg

SEQ ID NO: 130216 - RNA, 22 nt, Human
ggacauuguuguuggauccuug

SEQ ID NO: 130217 - RNA, 22 nt, Human
ggacauggccguaguccccacg

SEQ ID NO: 130218 - RNA, 22 nt, Human
ggacauggaaagugugugauuu

SEQ ID NO: 130219 - RNA, 22 nt, Human
ggggacggcuggccggggcccc

SEQ ID NO: 130220 - RNA, 22 nt, Human
ggggacuugguuuuaaugagcu

SEQ ID NO: 130221 - RNA, 22 nt, Human
ggggaggugugcaggacaccuc

SEQ ID NO: 130222 - RNA, 22 nt, Human
ggagagcuagugagcuggaggu

SEQ ID NO: 130223 - RNA, 22 nt, Human
ggggagggcugagcacgguuga

SEQ ID NO: 130224 - RNA, 22 nt, Human
ggggcaucguugauugcauggu

SEQ ID NO: 130225 - RNA, 22 nt, Human
gcagcgcugagaugauuuguug

SEQ ID NO: 130226 - RNA, 22 nt, Human
gcggcaguccuuccaguacagg

SEQ ID NO: 130227 - RNA, 22 nt, Human
gcggccucuuugcugccucagg

SEQ ID NO: 130228 - RNA, 22 nt, Human
gcagccugaguuuagcucgucg

SEQ ID NO: 130229 - RNA, 22 nt, Human
gcagccuccggccuggcccccu

SEQ ID NO: 130230 - RNA, 22 nt, Human
gcagccauggcuggccgggcau

SEQ ID NO: 130231 - RNA, 22 nt, Human
gcgauugguuuggggccagagu

SEQ ID NO: 130232 - RNA, 22 nt, Human
gcggagcuaaagauuggcuccu

SEQ ID NO: 130233 - RNA, 22 nt, Human
gccuuuugcaaugguguuggug

SEQ ID NO: 130234 - RNA, 22 nt, Human
gcggagaggcagagacuccgcg

SEQ ID NO: 130235 - RNA, 22 nt, Human
gcagccaauggcgagccccaca

SEQ ID NO: 130236 - RNA, 22 nt, Human
gcgguguuuuaacacucccucg

SEQ ID NO: 130237 - RNA, 22 nt, Human
gcgggugagauucgagagaugg

SEQ ID NO: 130238 - RNA, 22 nt, Human
gcggggggcucgggcagcucgg

SEQ ID NO: 130239 - RNA, 22 nt, Human
gcguagaagaaagcugcugcua

SEQ ID NO: 130240 - RNA, 22 nt, Human
gcagcguguggcuaauggcucu

SEQ ID NO: 130241 - RNA, 22 nt, Human
gcggcggcggaggcgggggcag

SEQ ID NO: 130242 - RNA, 22 nt, Human
gcggggcucuacuuggccugga

SEQ ID NO: 130243 - RNA, 22 nt, Human
gcagcucagcacgcacagguaa

SEQ ID NO: 130244 - RNA, 19 nt, Human
gcggcggugccggcuggga

SEQ ID NO: 130245 - RNA, 22 nt, Human
gcggcgucccagcuccgacggc

SEQ ID NO: 130246 - RNA, 22 nt, Human
gcgggccggcaggggaggaguu

SEQ ID NO: 130247 - RNA, 22 nt, Human
gcgugugugauaugccucugca

SEQ ID NO: 130248 - RNA, 22 nt, Human
gcuaagcuuugagucuggacag

SEQ ID NO: 130249 - RNA, 22 nt, Human
gcaggggguaaggggcagggcu

SEQ ID NO: 130250 - RNA, 22 nt, Human
gcuacaacugugucuguggggc

SEQ ID NO: 130251 - RNA, 19 nt, Human
gcaguuccucuuaagagaa

SEQ ID NO: 130252 - RNA, 22 nt, Human
gcuccggggguuccagaucauc

SEQ ID NO: 130253 - RNA, 22 nt, Human
gcuccccaggcccuccacucuc

SEQ ID NO: 130254 - RNA, 22 nt, Human
gcuaguucugccuccccuagug

SEQ ID NO: 130255 - RNA, 22 nt, Human
gcucaaggucacacagggguga

SEQ ID NO: 130256 - RNA, 22 nt, Human
gcucaacuucuaggacuucagg

SEQ ID NO: 130257 - RNA, 22 nt, Human
gcaucuccugagucagauuuug

SEQ ID NO: 130258 - RNA, 22 nt, Human
gcucgauugucaguguuaggga

SEQ ID NO: 130259 - RNA, 22 nt, Human
gcaucuguuagagugugcaugc

SEQ ID NO: 130260 - RNA, 22 nt, Human
gcucaagaccaagggagcgggg

SEQ ID NO: 130261 - RNA, 22 nt, Human
gcucaacucaacgucauuugaa

SEQ ID NO: 130262 - RNA, 22 nt, Human
gcuauuuagaaaggcuuggaga

SEQ ID NO: 130263 - RNA, 22 nt, Human
gcaguuugugauguggcaguca

SEQ ID NO: 130264 - RNA, 22 nt, Human
gcugcgcgcagccggcgccgag

SEQ ID NO: 130265 - RNA, 23 nt, Human
gcugccguuucccaucgugguga

SEQ ID NO: 130266 - RNA, 21 nt, Human
gccacugcugcucauucucug

SEQ ID NO: 130267 - RNA, 22 nt, Human
gccagcuuagaucccccagccc

SEQ ID NO: 130268 - RNA, 22 nt, Human
gcugcagggagcuggaaggcuc

SEQ ID NO: 130269 - RNA, 19 nt, Human
gccacguuggcuaguugcc

SEQ ID NO: 130270 - RNA, 22 nt, Human
gccaaccagucgguccaggaag

SEQ ID NO: 130271 - RNA, 22 nt, Human
gcucuggcuacuguggcuaccg

SEQ ID NO: 130272 - RNA, 22 nt, Human
gcucugaacugucaugaauugg

SEQ ID NO: 130273 - RNA, 23 nt, Human
gcugagcaccagccauaucuuuu

SEQ ID NO: 130274 - RNA, 22 nt, Human
gcugauucuucugcuuuuucuc

SEQ ID NO: 130275 - RNA, 22 nt, Human
gcugagcagcgaaggcacaugc

SEQ ID NO: 130276 - RNA, 22 nt, Human
gccagucgucuuuauuacagcu

SEQ ID NO: 130277 - RNA, 22 nt, Human
gccaggugauuucaaaguccuu

SEQ ID NO: 130278 - RNA, 22 nt, Human
gccaguuuguuuacugaugguu

SEQ ID NO: 130279 - RNA, 22 nt, Human
gcugcuucgcugcacacccgag

SEQ ID NO: 130280 - RNA, 22 nt, Human
gcuggaaauaacuuguguagaa

SEQ ID NO: 130281 - RNA, 22 nt, Human
gccaggagaaaaggcgaaugau

SEQ ID NO: 130282 - RNA, 22 nt, Human
gccaggcagcagcgaggauggu

SEQ ID NO: 130283 - RNA, 22 nt, Human
gccaggccuggguggagcgcuc

SEQ ID NO: 130284 - RNA, 22 nt, Human
gccaggcggcccaggagauggc

SEQ ID NO: 130285 - RNA, 22 nt, Human
gcugcgcugggacgccaccaac

SEQ ID NO: 130286 - RNA, 22 nt, Human
gcugcucaaaaaaacacuagcu

SEQ ID NO: 130287 - RNA, 22 nt, Human
gccaguggucagugggagggug

SEQ ID NO: 130288 - RNA, 22 nt, Human
gccauaggggcuuacauaguua

SEQ ID NO: 130289 - RNA, 22 nt, Human
gcuggcgauggccgagucuccg

SEQ ID NO: 130290 - RNA, 22 nt, Human
gcuggauuuaggguucccuccu

SEQ ID NO: 130291 - RNA, 22 nt, Human
gcuggauaaggaucaguuucuu

SEQ ID NO: 130292 - RNA, 22 nt, Human
gcuggcggguuggggaggcgga

SEQ ID NO: 130293 - RNA, 22 nt, Human
gccauguucuugaaucuggguc

SEQ ID NO: 130294 - RNA, 22 nt, Human
gccaugguggggccucccugac

SEQ ID NO: 130295 - RNA, 22 nt, Human
gccggguguuccugggaagaug

SEQ ID NO: 130296 - RNA, 22 nt, Human
gauugggagugugacauuguau

SEQ ID NO: 130297 - RNA, 22 nt, Human
gauuggucacacaauaguauau

SEQ ID NO: 130298 - RNA, 22 nt, Human
gccggagagccaacaccacgga

SEQ ID NO: 130299 - RNA, 22 nt, Human
gccgcguggcagucuuggugac

SEQ ID NO: 130300 - RNA, 22 nt, Human
gccggcugggggcggagggcag

SEQ ID NO: 130301 - RNA, 22 nt, Human
gccgggagugcagcgggcgcgc

SEQ ID NO: 130302 - RNA, 22 nt, Human
gauugcugccagcguguccgug

SEQ ID NO: 130303 - RNA, 22 nt, Human
gccgccgcucaccugggcgccg

SEQ ID NO: 130304 - RNA, 21 nt, Human
gccgaugugacucuacguagu

SEQ ID NO: 130305 - RNA, 22 nt, Human
gcccugaaggccuccaggacuc

SEQ ID NO: 130306 - RNA, 22 nt, Human
gaugguggggggcagcugggag

SEQ ID NO: 130307 - RNA, 22 nt, Human
gcccuagaguugagagcaccca

SEQ ID NO: 130308 - RNA, 22 nt, Human
gccugcaaagacuuccuucucu

SEQ ID NO: 130309 - RNA, 22 nt, Human
gcacacaaaaauauguguugaa

SEQ ID NO: 130310 - RNA, 22 nt, Human
gcacagcuaugagcugaauugu

SEQ ID NO: 130311 - RNA, 22 nt, Human
gccuucauuggaaucuagcuuc

SEQ ID NO: 130312 - RNA, 22 nt, Human
gccuucccuccucugcucucag

SEQ ID NO: 130313 - RNA, 22 nt, Human
gcacacuguaugcugguauuug

SEQ ID NO: 130314 - RNA, 22 nt, Human
gcaacguauauggguaaggaua

SEQ ID NO: 130315 - RNA, 22 nt, Human
gcaaaaacaguguagucuucug

SEQ ID NO: 130316 - RNA, 22 nt, Human
gccuccgccuuccugucucccc

SEQ ID NO: 130317 - RNA, 22 nt, Human
gccuagaagaaugagcgcaggg

SEQ ID NO: 130318 - RNA, 22 nt, Human
gagguuggggugucucucccca

SEQ ID NO: 130319 - RNA, 20 nt, Human
gagguugcucagaguggggu

SEQ ID NO: 130320 - RNA, 22 nt, Human
gaggugggaggcgggccugcau

SEQ ID NO: 130321 - RNA, 20 nt, Human
gcauggcuggcugcugucug

SEQ ID NO: 130322 - RNA, 22 nt, Human
gcaugcuguuuggaaacgauaa

SEQ ID NO: 130323 - RNA, 22 nt, Human
gcaugguuuccugcaacguucu

SEQ ID NO: 130324 - RNA, 22 nt, Human
gcccagacaucuguugggaccu

SEQ ID NO: 130325 - RNA, 22 nt, Human
gcccagccucagggcaucagcu

SEQ ID NO: 130326 - RNA, 20 nt, Human
gcccacccgcacucccgccg

SEQ ID NO: 130327 - RNA, 22 nt, Human
gcccguuuagcaaacgccuccu

SEQ ID NO: 130328 - RNA, 22 nt, Human
gaugcucuugauuggaccaggg

SEQ ID NO: 130329 - RNA, 22 nt, Human
gccauggugagccaccuggugg

SEQ ID NO: 130330 - RNA, 22 nt, Human
gaugaaguaguccacuggaagg

SEQ ID NO: 130331 - RNA, 22 nt, Human
gaggggcgaggacgcugaagua

SEQ ID NO: 130332 - RNA, 22 nt, Human
gcagauccaaauauaguucuug

SEQ ID NO: 130333 - RNA, 22 nt, Human
gcagaugagagugugaucuggg

SEQ ID NO: 130334 - RNA, 22 nt, Human
gcagcaaucuucacagugucau

SEQ ID NO: 130335 - RNA, 22 nt, Human
gagggugugguauggauguguu

SEQ ID NO: 130336 - RNA, 22 nt, Human
gagggugguggcggccggcacc

SEQ ID NO: 130337 - RNA, 22 nt, Human
gaggggcucuugggcaugaagg

SEQ ID NO: 130338 - RNA, 21 nt, Human
gcagcaugagaaagccccaaa

SEQ ID NO: 130339 - RNA, 22 nt, Human
gaggggcugggguugacuccaa

SEQ ID NO: 130340 - RNA, 22 nt, Human
gagggggcaggcucggcaccgg

SEQ ID NO: 130341 - RNA, 22 nt, Human
gcagaggcaaagucuggaugac

SEQ ID NO: 130342 - RNA, 22 nt, Human
gcagagaaugucagauuuuguu

SEQ ID NO: 130343 - RNA, 22 nt, Human
gaggggcacaguggggccuggg

SEQ ID NO: 130344 - RNA, 22 nt, Human
gaggggcaagaaguuggccucu

SEQ ID NO: 130345 - RNA, 22 nt, Human
gaggggacugucuggcuccgag

SEQ ID NO: 130346 - RNA, 22 nt, Human
gaggggaauguuccugagcugg

SEQ ID NO: 130347 - RNA, 22 nt, Human
gcagccagggaccuuugacuau

SEQ ID NO: 130348 - RNA, 22 nt, Human
gaggguuucagugggacggguu

SEQ ID NO: 130349 - RNA, 22 nt, Human
gaggucagcaagccaugcuugu

SEQ ID NO: 130350 - RNA, 22 nt, Human
gaggucacacugauagucuuga

SEQ ID NO: 130351 - RNA, 22 nt, Human
gaggucagugugggggcaaggg

SEQ ID NO: 130352 - RNA, 22 nt, Human
gaggucaugcagcucugaguuc

SEQ ID NO: 130353 - RNA, 22 nt, Human
gaggugaacccaggugcuucac

SEQ ID NO: 130354 - RNA, 22 nt, Human
gaggugauuccucccauguaau

SEQ ID NO: 130355 - RNA, 22 nt, Human
gcaggagggggccuggagccca

SEQ ID NO: 130356 - RNA, 22 nt, Human
gcaggcagauccagaagcacua

SEQ ID NO: 130357 - RNA, 22 nt, Human
gcaggaagauugcagaaggcug

SEQ ID NO: 130358 - RNA, 22 nt, Human
gcaggacugauggagcauaugu

SEQ ID NO: 130359 - RNA, 22 nt, Human
gcaggacuucuguuuaaccagu

SEQ ID NO: 130360 - RNA, 20 nt, Human
gcagcugacccuagugcuug

SEQ ID NO: 130361 - RNA, 22 nt, Human
gcagccucugcaguucaggagg

SEQ ID NO: 130362 - RNA, 22 nt, Human
gcacggucagggugggggagug

SEQ ID NO: 130363 - RNA, 22 nt, Human
gcaccgagaaggaagcaugccu

SEQ ID NO: 130364 - RNA, 22 nt, Human
gcaccauagagaagagacacaa

SEQ ID NO: 130365 - RNA, 22 nt, Human
gaggccuucauuucuccgucug

SEQ ID NO: 130366 - RNA, 22 nt, Human
gaggcccugagauugcugcccu

SEQ ID NO: 130367 - RNA, 22 nt, Human
gcacuaccaguaauuaaaucug

SEQ ID NO: 130368 - RNA, 22 nt, Human
gaggccagcacccagaugcaug

SEQ ID NO: 130369 - RNA, 22 nt, Human
gcacaggcugcacgaccccagc

SEQ ID NO: 130370 - RNA, 22 nt, Human
gaggcagaggaaacagcucauu

SEQ ID NO: 130371 - RNA, 22 nt, Human
gaggcagaggaugggacuguau

SEQ ID NO: 130372 - RNA, 22 nt, Human
gaggaugacaaagaaggcagac

SEQ ID NO: 130373 - RNA, 23 nt, Human
gcacuccgagggcacgugucucu

SEQ ID NO: 130374 - RNA, 22 nt, Human
gcacucugggucaucugcugcc

SEQ ID NO: 130375 - RNA, 22 nt, Human
gcacugagacuuuagauuggag

SEQ ID NO: 130376 - RNA, 22 nt, Human
gagggaaaggggccaugauugg

SEQ ID NO: 130377 - RNA, 22 nt, Human
gagggagagaugcuggaccggg

SEQ ID NO: 130378 - RNA, 22 nt, Human
gaggcaggaagggaggguugug

SEQ ID NO: 130379 - RNA, 21 nt, Human
gcagaacuaggacuugaacau

SEQ ID NO: 130380 - RNA, 23 nt, Human
gcacuguuugaggagcacugugc

SEQ ID NO: 130381 - RNA, 19 nt, Human
gcacacccugcaccaccau

SEQ ID NO: 130382 - RNA, 22 nt, Human
gcacagauaaucugccuuacca

SEQ ID NO: 130383 - RNA, 22 nt, Human
gaggaggucaccuggugagcaa

SEQ ID NO: 130384 - RNA, 22 nt, Human
gaggagggagcuggaagcucuu

SEQ ID NO: 130385 - RNA, 22 nt, Human
gaggagcugggucagggagaca

SEQ ID NO: 130386 - RNA, 22 nt, Human
gaggaggacauuggaaagaacu

SEQ ID NO: 130387 - RNA, 22 nt, Human
gaggagcuucagaggaaucuua

SEQ ID NO: 130388 - RNA, 22 nt, Human
gaggaggagacggaggccuggg

SEQ ID NO: 130389 - RNA, 21 nt, Human
gcacaacucucacauucuucu

SEQ ID NO: 130390 - RNA, 22 nt, Human
gcaaggacagaagcccacacag

SEQ ID NO: 130391 - RNA, 22 nt, Human
gaggacccuuaggucagacaga

SEQ ID NO: 130392 - RNA, 22 nt, Human
gaggacuucaggccuggccagg

SEQ ID NO: 130393 - RNA, 22 nt, Human
gaggagacaguggagccgcuac

SEQ ID NO: 130394 - RNA, 19 nt, Human
gagccgcucccgcagccgg

SEQ ID NO: 130395 - RNA, 22 nt, Human
gcaauuggaaugaauucuauuu

SEQ ID NO: 130396 - RNA, 22 nt, Human
gcaauagccuacaugcgucaga

SEQ ID NO: 130397 - RNA, 22 nt, Human
gagcaguuagggaccgcaggcu

SEQ ID NO: 130398 - RNA, 22 nt, Human
gagcaggcuggcagggccaggg

SEQ ID NO: 130399 - RNA, 22 nt, Human
gauguuggugcauucacuucug

SEQ ID NO: 130400 - RNA, 22 nt, Human
gauucugaaauuaacagacugg

SEQ ID NO: 130401 - RNA, 22 nt, Human
gauuccuuucgccugccgagcu

SEQ ID NO: 130402 - RNA, 22 nt, Human
gagcgcacagaaggaagcagcc

SEQ ID NO: 130403 - RNA, 22 nt, Human
gagccggggcucccugaggucc

SEQ ID NO: 130404 - RNA, 22 nt, Human
gagccuggagcuggaacgaagc

SEQ ID NO: 130405 - RNA, 21 nt, Human
gauuuuagggcagccaaacac

SEQ ID NO: 130406 - RNA, 21 nt, Human
gcaaccagaccacagggcagu

SEQ ID NO: 130407 - RNA, 22 nt, Human
gagcggcggugagaaguguggg

SEQ ID NO: 130408 - RNA, 22 nt, Human
gagcggcucaguggccauguga

SEQ ID NO: 130409 - RNA, 22 nt, Human
gagcuggacauacaggaaacca

SEQ ID NO: 130410 - RNA, 22 nt, Human
gagagugggagauuuccagcag

SEQ ID NO: 130411 - RNA, 22 nt, Human
gagauccccagugugucucggc

SEQ ID NO: 130412 - RNA, 22 nt, Human
gauggguugaguucauggagcc

SEQ ID NO: 130413 - RNA, 22 nt, Human
gaugggaggaugaauuggaccu

SEQ ID NO: 130414 - RNA, 22 nt, Human
gauggguuugagauguuugggu

SEQ ID NO: 130415 - RNA, 22 nt, Human
gagcagcacagaccaaacagaa

SEQ ID NO: 130416 - RNA, 22 nt, Human
gagcacugagcuggaauuggag

SEQ ID NO: 130417 - RNA, 22 nt, Human
gaugugugugcccugggccugc

SEQ ID NO: 130418 - RNA, 22 nt, Human
gagcagcucgagaaggaagcag

SEQ ID NO: 130419 - RNA, 22 nt, Human
gaugucauguuggcagacaguu

SEQ ID NO: 130420 - RNA, 22 nt, Human
gauguaucugagcugcuuaggu

SEQ ID NO: 130421 - RNA, 22 nt, Human
gagaggaagugccugcucccag

SEQ ID NO: 130422 - RNA, 22 nt, Human
gagaggcugagcaguccggguu

SEQ ID NO: 130423 - RNA, 22 nt, Human
gagaggguugggaggcagcaga

SEQ ID NO: 130424 - RNA, 22 nt, Human
gauggacgguuuuaccagacag

SEQ ID NO: 130425 - RNA, 22 nt, Human
gauggcaaugcuagaaauuuag

SEQ ID NO: 130426 - RNA, 22 nt, Human
gauggcauucacaaacuuaacu

SEQ ID NO: 130427 - RNA, 22 nt, Human
gagcccuguagcaagucauguc

SEQ ID NO: 130428 - RNA, 22 nt, Human
gagccauggaggaugugcagca

SEQ ID NO: 130429 - RNA, 19 nt, Human
gagcaugacuggccuugca

SEQ ID NO: 130430 - RNA, 22 nt, Human
gagccaugagauaagagcaccu

SEQ ID NO: 130431 - RNA, 22 nt, Human
gagacagugucagccauugaaa

SEQ ID NO: 130432 - RNA, 22 nt, Human
gagccgcagcugcguagggucc

SEQ ID NO: 130433 - RNA, 23 nt, Human
gaugauggcaacuacauccggug

SEQ ID NO: 130434 - RNA, 22 nt, Human
gagacugcguggcucugacaca

SEQ ID NO: 130435 - RNA, 18 nt, Human
aaacgguuucaugcugua

SEQ ID NO: 130436 - RNA, 22 nt, Human
aaaccgguacccuccugccugc

SEQ ID NO: 130437 - RNA, 22 nt, Human
aaacgcauucuuacaugcuucc

SEQ ID NO: 130438 - RNA, 22 nt, Human
aaacaccaagagcuagcuauua

SEQ ID NO: 130439 - RNA, 22 nt, Human
aaacacacaacauauuuuggaa

SEQ ID NO: 130440 - RNA, 22 nt, Human
aaagagugugcauguaccugug

SEQ ID NO: 130441 - RNA, 22 nt, Human
aaagggagauaaaguaauuuua

SEQ ID NO: 130442 - RNA, 22 nt, Human
aaaggucagaugugucgaggag

SEQ ID NO: 130443 - RNA, 22 nt, Human
aaaggaaacuaugaaucucugg

SEQ ID NO: 130444 - RNA, 22 nt, Human
aaagcgagccggcuuggaggga

SEQ ID NO: 130445 - RNA, 22 nt, Human
aaagcccuccaggguauacauu

SEQ ID NO: 130446 - RNA, 22 nt, Human
aaagccagggacagugugcaug

SEQ ID NO: 130447 - RNA, 22 nt, Human
aaagaugaaguucagcgaagaa

SEQ ID NO: 130448 - RNA, 22 nt, Human
aaagguggugguuagggaauau

SEQ ID NO: 130449 - RNA, 22 nt, Human
aaaggagugaaaugagaggaaa

SEQ ID NO: 130450 - RNA, 22 nt, Human
aaagcugaaacgaaaugacaac

SEQ ID NO: 130451 - RNA, 17 nt, Human
aaagccgaucagauguu

SEQ ID NO: 130452 - RNA, 22 nt, Human
aacagggcgugaauaaugaaga

SEQ ID NO: 130453 - RNA, 20 nt, Human
aacagcucucgacuuaucuu

SEQ ID NO: 130454 - RNA, 21 nt, Human
aacaaaagggaagaacagcug

SEQ ID NO: 130455 - RNA, 22 nt, Human
aacaaaacauuuuacgaauaua

SEQ ID NO: 130456 - RNA, 22 nt, Human
aaauggaaguuuguucucagcc

SEQ ID NO: 130457 - RNA, 22 nt, Human
aaugcgcagaguggugugugca

SEQ ID NO: 130458 - RNA, 22 nt, Human
aaucgguugaacccaggaagug

SEQ ID NO: 130459 - RNA, 22 nt, Human
aaucaugguacaaguaagcacg

SEQ ID NO: 130460 - RNA, 22 nt, Human
aaugcugugggauagggcuccu

SEQ ID NO: 130461 - RNA, 22 nt, Human
aauggaccuuaaauugcuucag

SEQ ID NO: 130462 - RNA, 22 nt, Human
aauggcaaaaguuucggaaauu

SEQ ID NO: 130463 - RNA, 20 nt, Human
acaaccacugcucacaguuu

SEQ ID NO: 130464 - RNA, 22 nt, Human
acaaaucccuguaaacacagcu

SEQ ID NO: 130465 - RNA, 22 nt, Human
acaacagaacuccugggauuuu

SEQ ID NO: 130466 - RNA, 22 nt, Human
acaaccaugucaguucaaacca

SEQ ID NO: 130467 - RNA, 22 nt, Human
aauuucuuucagcugcuuuaag

SEQ ID NO: 130468 - RNA, 22 nt, Human
aauuucuuuagagguacugauc

SEQ ID NO: 130469 - RNA, 22 nt, Human
aauuauucaugucugggcagcc

SEQ ID NO: 130470 - RNA, 22 nt, Human
aauucuguugguuagaguugga

SEQ ID NO: 130471 - RNA, 22 nt, Human
acaagaaaggucugggaacaau

SEQ ID NO: 130472 - RNA, 22 nt, Human
acaacccacacguuccgggugg

SEQ ID NO: 130473 - RNA, 22 nt, Human
acaaggccaagcauucuagcaa

SEQ ID NO: 130474 - RNA, 22 nt, Human
acaagaccagcagggagggugc

SEQ ID NO: 130475 - RNA, 22 nt, Human
acaaggccugagggugacagca

SEQ ID NO: 130476 - RNA, 21 nt, Human
acaaugaguuugaggcaucag

SEQ ID NO: 130477 - RNA, 19 nt, Human
acacaccagugccugugac

SEQ ID NO: 130478 - RNA, 20 nt, Human
acacagccuagaguuuggcu

SEQ ID NO: 130479 - RNA, 21 nt, Human
acacagcuggagcaucccggu

SEQ ID NO: 130480 - RNA, 22 nt, Human
acacacaugccuuuccuaagua

SEQ ID NO: 130481 - RNA, 22 nt, Human
acacgauguuuuaagccccuaa

SEQ ID NO: 130482 - RNA, 22 nt, Human
acacccuuuagcaauucuucaa

SEQ ID NO: 130483 - RNA, 22 nt, Human
acacgcacaccugugcacucgu

SEQ ID NO: 130484 - RNA, 22 nt, Human
acacccuugcagacgguuccuu

SEQ ID NO: 130485 - RNA, 20 nt, Human
acacaccugcucagacugag

SEQ ID NO: 130486 - RNA, 22 nt, Human
acacaagaaugugcacucagcc

SEQ ID NO: 130487 - RNA, 22 nt, Human
acacgguggccagcaguaggug

SEQ ID NO: 130488 - RNA, 23 nt, Human
acagcaagaggaccagaugugag

SEQ ID NO: 130489 - RNA, 22 nt, Human
acagagggagugacggccaacc

SEQ ID NO: 130490 - RNA, 22 nt, Human
acagcagguuauuguuauggca

SEQ ID NO: 130491 - RNA, 22 nt, Human
acagccacuaugacagauuuag

SEQ ID NO: 130492 - RNA, 22 nt, Human
acagccacccuggaacgguugu

SEQ ID NO: 130493 - RNA, 23 nt, Human
acagaggcaucagagcagcaggc

SEQ ID NO: 130494 - RNA, 22 nt, Human
acagaugccagcuacaccaccg

SEQ ID NO: 130495 - RNA, 22 nt, Human
acagcauagaggaaauguggaa

SEQ ID NO: 130496 - RNA, 22 nt, Human
acagcugagaugcuacuugugg

SEQ ID NO: 130497 - RNA, 22 nt, Human
acagcugguugaaggggaccaa

SEQ ID NO: 130498 - RNA, 19 nt, Human
acagccuguugguggggcu

SEQ ID NO: 130499 - RNA, 22 nt, Human
acagcucaggcccaucaacccc

SEQ ID NO: 130500 - RNA, 20 nt, Human
acagccguaaugguccuugg

SEQ ID NO: 130501 - RNA, 22 nt, Human
acaggacgugugugcgcaugug

SEQ ID NO: 130502 - RNA, 22 nt, Human
acagcuggaggucugugagcac

SEQ ID NO: 130503 - RNA, 21 nt, Human
acaguacuugagaucuuuuga

SEQ ID NO: 130504 - RNA, 22 nt, Human
acaggauuuucagggaagguga

SEQ ID NO: 130505 - RNA, 22 nt, Human
acagguuggagguguggaguca

SEQ ID NO: 130506 - RNA, 22 nt, Human
acaggcgucgccugcucuugcc

SEQ ID NO: 130507 - RNA, 22 nt, Human
acaggcugcccgcuccccaccu

SEQ ID NO: 130508 - RNA, 22 nt, Human
acagguaucccuuucuaccuga

SEQ ID NO: 130509 - RNA, 22 nt, Human
acaucacuugguuaaugugguc

SEQ ID NO: 130510 - RNA, 20 nt, Human
acauccacugagugggauga

SEQ ID NO: 130511 - RNA, 22 nt, Human
acagguauuaugaagccuauuu

SEQ ID NO: 130512 - RNA, 22 nt, Human
acagugugcaagaaauggggga

SEQ ID NO: 130513 - RNA, 22 nt, Human
aaggcuuguugucacgcucuug

SEQ ID NO: 130514 - RNA, 22 nt, Human
aaggucuuggcucuggccgcac

SEQ ID NO: 130515 - RNA, 22 nt, Human
aagguccuguagccacagagcc

SEQ ID NO: 130516 - RNA, 22 nt, Human
aaggucuucgaaccuuauguua

SEQ ID NO: 130517 - RNA, 22 nt, Human
aagggccuccuggggagccugg

SEQ ID NO: 130518 - RNA, 22 nt, Human
aagggcuucucgccugugugca

SEQ ID NO: 130519 - RNA, 22 nt, Human
aaggggggcaccugcaugcccg

SEQ ID NO: 130520 - RNA, 22 nt, Human
aaggugccacuucccucagacu

SEQ ID NO: 130521 - RNA, 22 nt, Human
aaggugggacugagaggggaca

SEQ ID NO: 130522 - RNA, 22 nt, Human
aaggugcugaggguccuggcuu

SEQ ID NO: 130523 - RNA, 23 nt, Human
aaggugaagccaccaggugagga

SEQ ID NO: 130524 - RNA, 22 nt, Human
aagucccaucugccuccaugua

SEQ ID NO: 130525 - RNA, 22 nt, Human
aagugaaaaaagucaguacuga

SEQ ID NO: 130526 - RNA, 22 nt, Human
aagucuuugagaucggacauag

SEQ ID NO: 130527 - RNA, 22 nt, Human
aagugcuggccuacucaaucga

SEQ ID NO: 130528 - RNA, 22 nt, Human
aaguggcaggggaaggguugga

SEQ ID NO: 130529 - RNA, 22 nt, Human
aaguucaccugcauuuacuaaa

SEQ ID NO: 130530 - RNA, 20 nt, Human
aaguugaaguuacuucaugg

SEQ ID NO: 130531 - RNA, 19 nt, Human
aaucacaagcaauaggggu

SEQ ID NO: 130532 - RNA, 22 nt, Human
aaucacuggcuccucacggcaa

SEQ ID NO: 130533 - RNA, 22 nt, Human
aaucaaauuucuugugguuguu

SEQ ID NO: 130534 - RNA, 22 nt, Human
aagcaaguucuaaaguaauucu

SEQ ID NO: 130535 - RNA, 22 nt, Human
aagcgcggccgccgcggucgcu

SEQ ID NO: 130536 - RNA, 23 nt, Human
aagcaacagacuucaucagauau

SEQ ID NO: 130537 - RNA, 22 nt, Human
aagccagccaguuccagcagcu

SEQ ID NO: 130538 - RNA, 22 nt, Human
aagccgagggaggugauggaga

SEQ ID NO: 130539 - RNA, 22 nt, Human
aagccugguuauuugaggaugu

SEQ ID NO: 130540 - RNA, 22 nt, Human
aagccuccgugcugcuggaucu

SEQ ID NO: 130541 - RNA, 22 nt, Human
aagcucugggacugaggcuccu

SEQ ID NO: 130542 - RNA, 22 nt, Human
aaggaacuucagggcgaaugga

SEQ ID NO: 130543 - RNA, 22 nt, Human
aagcgcaaggugucagcagguu

SEQ ID NO: 130544 - RNA, 22 nt, Human
aaggcgauuuaaagauguuagg

SEQ ID NO: 130545 - RNA, 22 nt, Human
aagcgggcagcggccugcgcca

SEQ ID NO: 130546 - RNA, 22 nt, Human
aagcucuauaggagauacagua

SEQ ID NO: 130547 - RNA, 22 nt, Human
aagcugccugggaggaagggcu

SEQ ID NO: 130548 - RNA, 22 nt, Human
aagcugcagacccccugucuca

SEQ ID NO: 130549 - RNA, 20 nt, Human
aagcuguguucaagauggga

SEQ ID NO: 130550 - RNA, 22 nt, Human
aaggaguggugaagucagaugu

SEQ ID NO: 130551 - RNA, 22 nt, Human
aaggccacacuugcuggccagc

SEQ ID NO: 130552 - RNA, 22 nt, Human
aaggcaguuaauuuggcuagaa

SEQ ID NO: 130553 - RNA, 22 nt, Human
aaggcagagggaaaacgggaau

SEQ ID NO: 130554 - RNA, 22 nt, Human
aagaaagaucugaaagaagcga

SEQ ID NO: 130555 - RNA, 22 nt, Human
aagaaaggcacaagaaagaaaa

SEQ ID NO: 130556 - RNA, 22 nt, Human
aagaaggaaggcaagagauggg

SEQ ID NO: 130557 - RNA, 22 nt, Human
aagaagcuacugucacuaucag

SEQ ID NO: 130558 - RNA, 22 nt, Human
aagaccacaggaaucaaacagg

SEQ ID NO: 130559 - RNA, 23 nt, Human
aagaaugcuucugaagagcugcc

SEQ ID NO: 130560 - RNA, 20 nt, Human
aagacacuguccccacugga

SEQ ID NO: 130561 - RNA, 22 nt, Human
aagaaguccuugaggcgcaccc

SEQ ID NO: 130562 - RNA, 21 nt, Human
aagcagcugcagaauuucagu

SEQ ID NO: 130563 - RNA, 22 nt, Human
aagaucugaccgugauggcggc

SEQ ID NO: 130564 - RNA, 22 nt, Human
aguucugggaggugcacgucca

SEQ ID NO: 130565 - RNA, 22 nt, Human
aguucccgcgggagggcgcagg

SEQ ID NO: 130566 - RNA, 22 nt, Human
aguuccucagaagggccuggga

SEQ ID NO: 130567 - RNA, 22 nt, Human
aguucggauuguaauagauaau

SEQ ID NO: 130568 - RNA, 22 nt, Human
aguugcugccagguccugggag

SEQ ID NO: 130569 - RNA, 22 nt, Human
aguugcagguucacguaucuug

SEQ ID NO: 130570 - RNA, 22 nt, Human
aguugguggaagcuaagcuucu

SEQ ID NO: 130571 - RNA, 22 nt, Human
aguuggcauuuuauuuaaguau

SEQ ID NO: 130572 - RNA, 22 nt, Human
aguuguucucagcagaagaacu

SEQ ID NO: 130573 - RNA, 22 nt, Human
aguuuccacuggagacacugug

SEQ ID NO: 130574 - RNA, 22 nt, Human
aguugguguuagaguuuuucag

SEQ ID NO: 130575 - RNA, 22 nt, Human
aguuucccucacaggucugcau

SEQ ID NO: 130576 - RNA, 22 nt, Human
aguugguucgucucgccuugag

SEQ ID NO: 130577 - RNA, 22 nt, Human
auaccaaugacaggaguuaggg

SEQ ID NO: 130578 - RNA, 22 nt, Human
aguggugccuaagcgcggaggc

SEQ ID NO: 130579 - RNA, 22 nt, Human
aguggugaucuguuacagucac

SEQ ID NO: 130580 - RNA, 22 nt, Human
aguguccaacucagcuugucaa

SEQ ID NO: 130581 - RNA, 22 nt, Human
aguguggccaaugaggaugggc

SEQ ID NO: 130582 - RNA, 22 nt, Human
aguggcuggcaggggagggucc

SEQ ID NO: 130583 - RNA, 22 nt, Human
agugggacccagauuuucuuga

SEQ ID NO: 130584 - RNA, 19 nt, Human
agugggcaaggaagaugac

SEQ ID NO: 130585 - RNA, 22 nt, Human
aguguucaucacaggcuagaga

SEQ ID NO: 130586 - RNA, 22 nt, Human
agugugacccauggcaagggca

SEQ ID NO: 130587 - RNA, 22 nt, Human
agugucuuuagucgcugagcaa

SEQ ID NO: 130588 - RNA, 22 nt, Human
agugucagcagcuucauugucu

SEQ ID NO: 130589 - RNA, 23 nt, Human
aguguucagcauguaguaaauac

SEQ ID NO: 130590 - RNA, 22 nt, Human
aguguucaauuugagcucaaag

SEQ ID NO: 130591 - RNA, 22 nt, Human
aguucauccucauuuacaagga

SEQ ID NO: 130592 - RNA, 22 nt, Human
aguucaugcuuagaucucauuu

SEQ ID NO: 130593 - RNA, 22 nt, Human
aguucaugugguuuaacuuaau

SEQ ID NO: 130594 - RNA, 20 nt, Human
aguguuggugcuuuucccag

SEQ ID NO: 130595 - RNA, 21 nt, Human
aguggcacuguuucuucccua

SEQ ID NO: 130596 - RNA, 22 nt, Human
aguggcugugaaauacauggga

SEQ ID NO: 130597 - RNA, 22 nt, Human
aguggagguuacagcuguacau

SEQ ID NO: 130598 - RNA, 22 nt, Human
aguggggcccaagaaucugcau

SEQ ID NO: 130599 - RNA, 22 nt, Human
aguggcuguuccaggugaggac

SEQ ID NO: 130600 - RNA, 22 nt, Human
aguggcuucucuggggucaaga

SEQ ID NO: 130601 - RNA, 22 nt, Human
agugccauggcugcuagauggc

SEQ ID NO: 130602 - RNA, 23 nt, Human
aguggccgaucaucucgggcuug

SEQ ID NO: 130603 - RNA, 23 nt, Human
aguggaggucgggguggggagac

SEQ ID NO: 130604 - RNA, 22 nt, Human
agugcuuuauguuguugugcaa

SEQ ID NO: 130605 - RNA, 22 nt, Human
agugccuggcugauggguccug

SEQ ID NO: 130606 - RNA, 22 nt, Human
agucuuuguuccugggaccuga

SEQ ID NO: 130607 - RNA, 22 nt, Human
agugaaauaugcccauugcugu

SEQ ID NO: 130608 - RNA, 21 nt, Human
agugagauuuaugccugguuc

SEQ ID NO: 130609 - RNA, 22 nt, Human
agugagcuuuuaaaauuuacca

SEQ ID NO: 130610 - RNA, 22 nt, Human
agugaugauccaaaugaauuga

SEQ ID NO: 130611 - RNA, 21 nt, Human
agugagugacagaagaagguu

SEQ ID NO: 130612 - RNA, 18 nt, Human
agucugagugaaauguag

SEQ ID NO: 130613 - RNA, 22 nt, Human
agggcccaccuuggugcugagg

SEQ ID NO: 130614 - RNA, 22 nt, Human
agggcccauagaucgucagcuu

SEQ ID NO: 130615 - RNA, 20 nt, Human
agggccuauauaaacugcug

SEQ ID NO: 130616 - RNA, 22 nt, Human
aggggcagaggaugauggaaga

SEQ ID NO: 130617 - RNA, 21 nt, Human
agggccagaucaccaaggagc

SEQ ID NO: 130618 - RNA, 22 nt, Human
agggcaugugaaguaaccuagg

SEQ ID NO: 130619 - RNA, 22 nt, Human
agggcaguuuuacugaaaggug

SEQ ID NO: 130620 - RNA, 22 nt, Human
agggaugugcagggcuugccau

SEQ ID NO: 130621 - RNA, 22 nt, Human
agggcuguuggugcccucgagg

SEQ ID NO: 130622 - RNA, 22 nt, Human
agggaggcccagcagacuggcg

SEQ ID NO: 130623 - RNA, 22 nt, Human
agggcaggguuggugcuggugc

SEQ ID NO: 130624 - RNA, 22 nt, Human
agggccagcagcuuggccaacc

SEQ ID NO: 130625 - RNA, 22 nt, Human
agggccaagaaagaguggcuuu

SEQ ID NO: 130626 - RNA, 21 nt, Human
aggcuuggaucuagacaggcc

SEQ ID NO: 130627 - RNA, 22 nt, Human
agggcacuuccucugggucccu

SEQ ID NO: 130628 - RNA, 22 nt, Human
agggcaguguggugggacugac

SEQ ID NO: 130629 - RNA, 22 nt, Human
agggcaguuaugaaugucucca

SEQ ID NO: 130630 - RNA, 22 nt, Human
aggcugucucaccucaggaggg

SEQ ID NO: 130631 - RNA, 22 nt, Human
aggcugucucagccugcuugca

SEQ ID NO: 130632 - RNA, 22 nt, Human
aggcuguagaucuagacaugua

SEQ ID NO: 130633 - RNA, 22 nt, Human
aggcuucaaggacagcagccac

SEQ ID NO: 130634 - RNA, 22 nt, Human
aggguggaggacaggccaguga

SEQ ID NO: 130635 - RNA, 22 nt, Human
aggguggcacucugggggcucc

SEQ ID NO: 130636 - RNA, 22 nt, Human
aggguguuugggagcagaggau

SEQ ID NO: 130637 - RNA, 22 nt, Human
aggguaccugauuuauggagca

SEQ ID NO: 130638 - RNA, 22 nt, Human
aggggcuuguggaguugcuggu

SEQ ID NO: 130639 - RNA, 22 nt, Human
aggggcugugucauuuguccua

SEQ ID NO: 130640 - RNA, 22 nt, Human
agggcuucugcugcagagaccu

SEQ ID NO: 130641 - RNA, 22 nt, Human
agggucgucuggguccgugggg

SEQ ID NO: 130642 - RNA, 22 nt, Human
aggguuccugaaaaguauguca

SEQ ID NO: 130643 - RNA, 22 nt, Human
aggucuacaugcuuaauauauc

SEQ ID NO: 130644 - RNA, 22 nt, Human
aggucugcccaggaugcugcuu

SEQ ID NO: 130645 - RNA, 22 nt, Human
aggucggcuuuuuuccuuucac

SEQ ID NO: 130646 - RNA, 22 nt, Human
aggucgugggugagagagagac

SEQ ID NO: 130647 - RNA, 22 nt, Human
agggggccggggcucaggagcc

SEQ ID NO: 130648 - RNA, 20 nt, Human
agggguucuguuaugaaaua

SEQ ID NO: 130649 - RNA, 22 nt, Human
agggggccucucccgcggcgcc

SEQ ID NO: 130650 - RNA, 21 nt, Human
aggugcccaggauuauuuuuu

SEQ ID NO: 130651 - RNA, 22 nt, Human
agguggggacuccaccgaugcu

SEQ ID NO: 130652 - RNA, 22 nt, Human
aggugggucgcaggcaucagug

SEQ ID NO: 130653 - RNA, 22 nt, Human
agguggucuuguggaugccgca

SEQ ID NO: 130654 - RNA, 22 nt, Human
agguguaauuacucuugcaguu

SEQ ID NO: 130655 - RNA, 22 nt, Human
aggugucauuauagaccagaua

SEQ ID NO: 130656 - RNA, 18 nt, Human
agguguguuucuaggagc

SEQ ID NO: 130657 - RNA, 22 nt, Human
aggugugcacccggucgcuucc

SEQ ID NO: 130658 - RNA, 22 nt, Human
aggucccauguccucccugacc

SEQ ID NO: 130659 - RNA, 16 nt, Human
aggugugugguagaua

SEQ ID NO: 130660 - RNA, 22 nt, Human
agguuaggaggggagugccaca

SEQ ID NO: 130661 - RNA, 22 nt, Human
agguuaggaaugggagguaaug

SEQ ID NO: 130662 - RNA, 19 nt, Human
aggugaugugacucuagaa

SEQ ID NO: 130663 - RNA, 22 nt, Human
aggucuugcggaagauauggcu

SEQ ID NO: 130664 - RNA, 22 nt, Human
aggucuugguaggccagagucu

SEQ ID NO: 130665 - RNA, 21 nt, Human
aggugaaggcgagggggacag

SEQ ID NO: 130666 - RNA, 22 nt, Human
aggugcccaaaucuucuguuuu

SEQ ID NO: 130667 - RNA, 22 nt, Human
aggugcucaguaauugauuguu

SEQ ID NO: 130668 - RNA, 22 nt, Human
aggugcauuuacuuggggcccu

SEQ ID NO: 130669 - RNA, 22 nt, Human
agguggcuaugaggaugcaguc

SEQ ID NO: 130670 - RNA, 22 nt, Human
aggugggaauaauaaucaaagc

SEQ ID NO: 130671 - RNA, 22 nt, Human
agguucaucaauaacucagaga

SEQ ID NO: 130672 - RNA, 22 nt, Human
agguuuaggaaaacugagaguc

SEQ ID NO: 130673 - RNA, 22 nt, Human
agguugggagaggucacccuga

SEQ ID NO: 130674 - RNA, 22 nt, Human
agguggcguauguguucguguu

SEQ ID NO: 130675 - RNA, 20 nt, Human
agguugguuuacuagucugu

SEQ ID NO: 130676 - RNA, 18 nt, Human
agguugcaucugugcaga

SEQ ID NO: 130677 - RNA, 22 nt, Human
agguuuggccuuggggggaguu

SEQ ID NO: 130678 - RNA, 22 nt, Human
agguuguugagaucaucuggcu

SEQ ID NO: 130679 - RNA, 21 nt, Human
aguaccugugugccugugugu

SEQ ID NO: 130680 - RNA, 22 nt, Human
agguuuggguucauugcuggcu

SEQ ID NO: 130681 - RNA, 22 nt, Human
agguuuggaaguggcgauccau

SEQ ID NO: 130682 - RNA, 22 nt, Human
agcggcaagguguauguggcag

SEQ ID NO: 130683 - RNA, 22 nt, Human
agcgcuguguucccgugggcau

SEQ ID NO: 130684 - RNA, 22 nt, Human
agcgcugugaaggcugggccac

SEQ ID NO: 130685 - RNA, 22 nt, Human
agcggcaggacgucuucuucga

SEQ ID NO: 130686 - RNA, 19 nt, Human
agcggccgccgcgggcgcc

SEQ ID NO: 130687 - RNA, 22 nt, Human
aggaauguugagacauggcuaa

SEQ ID NO: 130688 - RNA, 22 nt, Human
aggaauugucgucauguauaau

SEQ ID NO: 130689 - RNA, 22 nt, Human
aggaggcguuugcuaaacgggc

SEQ ID NO: 130690 - RNA, 22 nt, Human
aggaggaggacucgccaggcca

SEQ ID NO: 130691 - RNA, 22 nt, Human
aggagcugccggauggggcaug

SEQ ID NO: 130692 - RNA, 22 nt, Human
aggagcccaaagcacuuggcug

SEQ ID NO: 130693 - RNA, 22 nt, Human
aggagggcggggcuaaaaggga

SEQ ID NO: 130694 - RNA, 20 nt, Human
aggauuauguacauggaugc

SEQ ID NO: 130695 - RNA, 22 nt, Human
aggagguaucuggucuccuuuu

SEQ ID NO: 130696 - RNA, 22 nt, Human
aggauauguccuuuuuuucccc

SEQ ID NO: 130697 - RNA, 22 nt, Human
aggauugucuccugugaugugc

SEQ ID NO: 130698 - RNA, 22 nt, Human
aggcaacagacaggcuugguuc

SEQ ID NO: 130699 - RNA, 22 nt, Human
aggcacagaauccagucugcug

SEQ ID NO: 130700 - RNA, 22 nt, Human
aggcaauuuuuaggguuguugu

SEQ ID NO: 130701 - RNA, 22 nt, Human
aggcaucguguuuuucugcuuu

SEQ ID NO: 130702 - RNA, 22 nt, Human
aggcaguguggagggcuguugc

SEQ ID NO: 130703 - RNA, 22 nt, Human
aggcagugccuggaccccagcu

SEQ ID NO: 130704 - RNA, 22 nt, Human
aggcaguggagcuggaauaggc

SEQ ID NO: 130705 - RNA, 22 nt, Human
aggccaggcgccggcgcgagac

SEQ ID NO: 130706 - RNA, 22 nt, Human
aggcauuuucuuguuauuuuua

SEQ ID NO: 130707 - RNA, 22 nt, Human
aggcauuuaucaggaaauguuc

SEQ ID NO: 130708 - RNA, 22 nt, Human
aggcauuuaaagauguaagacu

SEQ ID NO: 130709 - RNA, 21 nt, Human
aggcauuuucuuggagauucu

SEQ ID NO: 130710 - RNA, 22 nt, Human
aggcugggaaguguguccugag

SEQ ID NO: 130711 - RNA, 22 nt, Human
aggcugcuggcaggcguggacg

SEQ ID NO: 130712 - RNA, 22 nt, Human
aggcguggcuucugcuggguug

SEQ ID NO: 130713 - RNA, 22 nt, Human
aggcuccucugggggccccgga

SEQ ID NO: 130714 - RNA, 22 nt, Human
aggcucagcaucugauucauau

SEQ ID NO: 130715 - RNA, 22 nt, Human
aggccgagaugacagagccacu

SEQ ID NO: 130716 - RNA, 22 nt, Human
aggcugcucucgccggcggugu

SEQ ID NO: 130717 - RNA, 21 nt, Human
aggccaaguuggauuucuuca

SEQ ID NO: 130718 - RNA, 22 nt, Human
aggccacucagggggccaagau

SEQ ID NO: 130719 - RNA, 22 nt, Human
aggcaggcucaaugcccagucu

SEQ ID NO: 130720 - RNA, 23 nt, Human
aggcagaguccuggggcacagcc

SEQ ID NO: 130721 - RNA, 22 nt, Human
aggcaguggcuuuuguuguguu

SEQ ID NO: 130722 - RNA, 22 nt, Human
aggcaguguguagcuggaagag

SEQ ID NO: 130723 - RNA, 22 nt, Human
aggcauguugcuucgggcuuug

SEQ ID NO: 130724 - RNA, 22 nt, Human
aggcagugguguuugcuggugg

SEQ ID NO: 130725 - RNA, 22 nt, Human
aggcaggggagcuggaagggua

SEQ ID NO: 130726 - RNA, 22 nt, Human
aggcaggagcugugguggugag

SEQ ID NO: 130727 - RNA, 22 nt, Human
aggcagaugggagcuggaaguu

SEQ ID NO: 130728 - RNA, 19 nt, Human
aggcagccccaacuugcau

SEQ ID NO: 130729 - RNA, 21 nt, Human
aggcagcgauuuucauauugc

SEQ ID NO: 130730 - RNA, 20 nt, Human
aggcagacaaggagucuguu

SEQ ID NO: 130731 - RNA, 22 nt, Human
aggcagagaggucuuccuggaa

SEQ ID NO: 130732 - RNA, 22 nt, Human
aggcaggauuugcgaugugguu

SEQ ID NO: 130733 - RNA, 22 nt, Human
aggcagagauggcugcagggcc

SEQ ID NO: 130734 - RNA, 22 nt, Human
aggcaagauuaggaccagaaga

SEQ ID NO: 130735 - RNA, 23 nt, Human
aggcaagaacggguuguucaccc

SEQ ID NO: 130736 - RNA, 23 nt, Human
aggcagcaugcaacaggccauuu

SEQ ID NO: 130737 - RNA, 22 nt, Human
aggcagcagggagggagaaaug

SEQ ID NO: 130738 - RNA, 19 nt, Human
agcagccaucgaccaugga

SEQ ID NO: 130739 - RNA, 22 nt, Human
agcagcaggcugggaugagucu

SEQ ID NO: 130740 - RNA, 19 nt, Human
agcaccuaucuggauaagg

SEQ ID NO: 130741 - RNA, 17 nt, Human
agcagcuggguugaucu

SEQ ID NO: 130742 - RNA, 22 nt, Human
agcagcugagccccagcuguga

SEQ ID NO: 130743 - RNA, 22 nt, Human
agcaggccuuucaccucugucc

SEQ ID NO: 130744 - RNA, 22 nt, Human
agcaggauggaguaacgugaaa

SEQ ID NO: 130745 - RNA, 22 nt, Human
agcacucacuagaguuagaacc

SEQ ID NO: 130746 - RNA, 22 nt, Human
agcagcaccuguccucgcugcu

SEQ ID NO: 130747 - RNA, 22 nt, Human
agcaaagguagcagcucccagg

SEQ ID NO: 130748 - RNA, 22 nt, Human
agcaauucagagcauggacuuu

SEQ ID NO: 130749 - RNA, 22 nt, Human
agcaauucugaaauuacuugac

SEQ ID NO: 130750 - RNA, 22 nt, Human
agcacgcccaccuccugcggcg

SEQ ID NO: 130751 - RNA, 22 nt, Human
agcacagugccugacauauaug

SEQ ID NO: 130752 - RNA, 22 nt, Human
agcacauguuucuuuugcaauu

SEQ ID NO: 130753 - RNA, 20 nt, Human
agcacaggcagucauucagu

SEQ ID NO: 130754 - RNA, 22 nt, Human
agcaagggucucucauggcuug

SEQ ID NO: 130755 - RNA, 22 nt, Human
agcaaggguugguuuucugaca

SEQ ID NO: 130756 - RNA, 22 nt, Human
agcacguucuucauuacuucac

SEQ ID NO: 130757 - RNA, 22 nt, Human
agcacggugguuaagagagugg

SEQ ID NO: 130758 - RNA, 22 nt, Human
agcacuaccggucacggccaug

SEQ ID NO: 130759 - RNA, 22 nt, Human
agcgccgcugugauuggugagg

SEQ ID NO: 130760 - RNA, 22 nt, Human
agccuguuacuguccugugcca

SEQ ID NO: 130761 - RNA, 22 nt, Human
agccuggacagcuacggagaac

SEQ ID NO: 130762 - RNA, 21 nt, Human
agcgcugcauccaccauggcu

SEQ ID NO: 130763 - RNA, 22 nt, Human
agccugggucgagagacgagaa

SEQ ID NO: 130764 - RNA, 22 nt, Human
agccugugcuguguuugcucca

SEQ ID NO: 130765 - RNA, 22 nt, Human
agccuggagcaggcucugcucu

SEQ ID NO: 130766 - RNA, 22 nt, Human
agccugaaccaauauagcagcc

SEQ ID NO: 130767 - RNA, 22 nt, Human
agccgcgcagccucauuaagga

SEQ ID NO: 130768 - RNA, 22 nt, Human
agccgcgcuguuccugcugcug

SEQ ID NO: 130769 - RNA, 22 nt, Human
agccggccucggacagagggag

SEQ ID NO: 130770 - RNA, 21 nt, Human
agccgggacaacguggacccc

SEQ ID NO: 130771 - RNA, 22 nt, Human
agccucuagcuccccaaagcca

SEQ ID NO: 130772 - RNA, 22 nt, Human
agccgcugaauuugaaacaagc

SEQ ID NO: 130773 - RNA, 22 nt, Human
agcgaaaagaauggaguggagu

SEQ ID NO: 130774 - RNA, 22 nt, Human
agccucucugaugugacagcua

SEQ ID NO: 130775 - RNA, 22 nt, Human
agcagggagaccaucucuuccu

SEQ ID NO: 130776 - RNA, 22 nt, Human
agccagugcagcuggaaauuca

SEQ ID NO: 130777 - RNA, 22 nt, Human
agccagugucgugugacaugag

SEQ ID NO: 130778 - RNA, 22 nt, Human
agccccggugagggaguccugu

SEQ ID NO: 130779 - RNA, 22 nt, Human
agccccaauuacagcugugcug

SEQ ID NO: 130780 - RNA, 22 nt, Human
agcauucagacaucugauggau

SEQ ID NO: 130781 - RNA, 22 nt, Human
agcccgggagggcugucuggga

SEQ ID NO: 130782 - RNA, 22 nt, Human
agcccugaccuguccuguucug

SEQ ID NO: 130783 - RNA, 22 nt, Human
agccaugcuguuuugccuggga

SEQ ID NO: 130784 - RNA, 22 nt, Human
agccacggcaaugauaggcugc

SEQ ID NO: 130785 - RNA, 21 nt, Human
agccagguuuccuuugaagag

SEQ ID NO: 130786 - RNA, 22 nt, Human
agccacacuuagucacaaagau

SEQ ID NO: 130787 - RNA, 22 nt, Human
agccagauuuuuugagaggcga

SEQ ID NO: 130788 - RNA, 22 nt, Human
agccagcauauauauaguugaa

SEQ ID NO: 130789 - RNA, 22 nt, Human
agccauggaggaugugcagcau

SEQ ID NO: 130790 - RNA, 23 nt, Human
agcccagcagagaaccuaggucc

SEQ ID NO: 130791 - RNA, 22 nt, Human
agccauggagauguggguuggg

SEQ ID NO: 130792 - RNA, 22 nt, Human
agccauggagaacagacuugaa

SEQ ID NO: 130793 - RNA, 22 nt, Human
agcccagguggagugugugggg

SEQ ID NO: 130794 - RNA, 22 nt, Human
agccgauaaauuguuuucuugg

SEQ ID NO: 130795 - RNA, 22 nt, Human
agcccuucccuuucacuggugc

SEQ ID NO: 130796 - RNA, 21 nt, Human
agaugcaguuugcaggugggu

SEQ ID NO: 130797 - RNA, 22 nt, Human
agaugaugugugucuucagcua

SEQ ID NO: 130798 - RNA, 23 nt, Human
agaugaugaauaaagagugagga

SEQ ID NO: 130799 - RNA, 22 nt, Human
agaugaguaaauggagucuucc

SEQ ID NO: 130800 - RNA, 22 nt, Human
agauguugucucuuacguuuga

SEQ ID NO: 130801 - RNA, 22 nt, Human
agaucauuaaccaccuguucug

SEQ ID NO: 130802 - RNA, 22 nt, Human
agauccuagaugugaauagcua

SEQ ID NO: 130803 - RNA, 22 nt, Human
agaugaccaguaagugguugaa

SEQ ID NO: 130804 - RNA, 22 nt, Human
agauucgucuuuaauucaccau

SEQ ID NO: 130805 - RNA, 22 nt, Human
agauggaguccugaagccagaa

SEQ ID NO: 130806 - RNA, 22 nt, Human
agauggcuccaguguccagagg

SEQ ID NO: 130807 - RNA, 22 nt, Human
agauggggccugaggacacugu

SEQ ID NO: 130808 - RNA, 22 nt, Human
agcaacauggaguuugugcgca

SEQ ID NO: 130809 - RNA, 22 nt, Human
agcaaaacuaaagacacagaca

SEQ ID NO: 130810 - RNA, 22 nt, Human
agacacagcaauaacuacuguu

SEQ ID NO: 130811 - RNA, 22 nt, Human
agaccguguguggguugcggug

SEQ ID NO: 130812 - RNA, 22 nt, Human
agacgcgcagaaggaagcggcc

SEQ ID NO: 130813 - RNA, 22 nt, Human
agacuacggggaggggagggaa

SEQ ID NO: 130814 - RNA, 22 nt, Human
agagcagaggcauggccguggg

SEQ ID NO: 130815 - RNA, 22 nt, Human
agagcagauggagcuggaagag

SEQ ID NO: 130816 - RNA, 22 nt, Human
agagccuaguauggacucuuag

SEQ ID NO: 130817 - RNA, 22 nt, Human
agaggcaggcagcagagaagau

SEQ ID NO: 130818 - RNA, 22 nt, Human
agaggcagagcugggguuugac

SEQ ID NO: 130819 - RNA, 22 nt, Human
agagggagcuccaagaucaagg

SEQ ID NO: 130820 - RNA, 22 nt, Human
agagccggagucuucuuguuug

SEQ ID NO: 130821 - RNA, 22 nt, Human
agaguggcaccuuaccugagac

SEQ ID NO: 130822 - RNA, 19 nt, Human
agaucaggauguauuuuug

SEQ ID NO: 130823 - RNA, 22 nt, Human
agauaaacaacucuuagcuguu

SEQ ID NO: 130824 - RNA, 21 nt, Human
agaguugaaggcaguaaagag

SEQ ID NO: 130825 - RNA, 22 nt, Human
acgcggagccagaggguguggg

SEQ ID NO: 130826 - RNA, 23 nt, Human
acgcagacacauguaugggccuc

SEQ ID NO: 130827 - RNA, 22 nt, Human
acggcuugaacgcgccuguggg

SEQ ID NO: 130828 - RNA, 22 nt, Human
acguccaccccguaccagauca

SEQ ID NO: 130829 - RNA, 22 nt, Human
acgcugagcucauggagaugca

SEQ ID NO: 130830 - RNA, 22 nt, Human
acgggugcuuguucccgcugcu

SEQ ID NO: 130831 - RNA, 22 nt, Human
acgccggguaaggucauucugc

SEQ ID NO: 130832 - RNA, 22 nt, Human
acgccugccuguacuugugggg

SEQ ID NO: 130833 - RNA, 22 nt, Human
acgcgcuccagcaggugcuuca

SEQ ID NO: 130834 - RNA, 22 nt, Human
acgccuugagccuugccugaau

SEQ ID NO: 130835 - RNA, 20 nt, Human
acgccgcgaggugagcuggu

SEQ ID NO: 130836 - RNA, 22 nt, Human
acgccaggagcuucuccguuca

SEQ ID NO: 130837 - RNA, 22 nt, Human
acaucuucuauggagguucgga

SEQ ID NO: 130838 - RNA, 22 nt, Human
acagugguggagggcuguccug

SEQ ID NO: 130839 - RNA, 22 nt, Human
acagucucucaagcauauccug

SEQ ID NO: 130840 - RNA, 22 nt, Human
acuaggaaguaaauaugucauc

SEQ ID NO: 130841 - RNA, 22 nt, Human
acucacuguuuugaaauugaac

SEQ ID NO: 130842 - RNA, 22 nt, Human
acucaaacuuuuuguggacauu

SEQ ID NO: 130843 - RNA, 22 nt, Human
acgguguuucucguucaggguu

SEQ ID NO: 130844 - RNA, 22 nt, Human
acggguuccuugagggcaggau

SEQ ID NO: 130845 - RNA, 22 nt, Human
acguccgcugauucuuuggaag

SEQ ID NO: 130846 - RNA, 22 nt, Human
acggugagacuggcgaaggaaa

SEQ ID NO: 130847 - RNA, 22 nt, Human
acgucuacaugcaauucuuaua

SEQ ID NO: 130848 - RNA, 22 nt, Human
acguugaaaugggcauuuuccg

SEQ ID NO: 130849 - RNA, 22 nt, Human
acgugaccuuauuugaaaaaug

SEQ ID NO: 130850 - RNA, 22 nt, Human
acucgggggccgcugcagggag

SEQ ID NO: 130851 - RNA, 22 nt, Human
acucggcggccucgagugcugg

SEQ ID NO: 130852 - RNA, 23 nt, Human
acucucuguuuggaggcacuggu

SEQ ID NO: 130853 - RNA, 21 nt, Human
acuccagccacugacugucuc

SEQ ID NO: 130854 - RNA, 22 nt, Human
acucggaggccaaggccaacgg

SEQ ID NO: 130855 - RNA, 22 nt, Human
acuccuuuuaugugugcuaaaa

SEQ ID NO: 130856 - RNA, 22 nt, Human
acucaucauuuuacggagcagc

SEQ ID NO: 130857 - RNA, 22 nt, Human
acugcucugugguuggaagccu

SEQ ID NO: 130858 - RNA, 22 nt, Human
acugcugauuauugaaguagag

SEQ ID NO: 130859 - RNA, 21 nt, Human
acugccaugcaggagccucca

SEQ ID NO: 130860 - RNA, 22 nt, Human
acugccauauuaggagcuucag

SEQ ID NO: 130861 - RNA, 22 nt, Human
acugcagauccucugagaaacc

SEQ ID NO: 130862 - RNA, 22 nt, Human
acugagcaaaacugauccuguu

SEQ ID NO: 130863 - RNA, 22 nt, Human
acugaaaguugaugagucacug

SEQ ID NO: 130864 - RNA, 22 nt, Human
acugacuacauguccugucauu

SEQ ID NO: 130865 - RNA, 22 nt, Human
agaagaagacccuaaggaaagg

SEQ ID NO: 130866 - RNA, 19 nt, Human
agaacccccuuccucugcu

SEQ ID NO: 130867 - RNA, 22 nt, Human
agaaggcaucugcucgcuucca

SEQ ID NO: 130868 - RNA, 22 nt, Human
agaacccaaggcccagggaugu

SEQ ID NO: 130869 - RNA, 22 nt, Human
agaaucaggaagacagccuggc

SEQ ID NO: 130870 - RNA, 22 nt, Human
agaaucucuagaaaugggucuc

SEQ ID NO: 130871 - RNA, 22 nt, Human
agaagggaagcaggagaggcau

SEQ ID NO: 130872 - RNA, 22 nt, Human
agaaucugcauuuuaacaagau

SEQ ID NO: 130873 - RNA, 22 nt, Human
agaagguggaguagaacaagcu

SEQ ID NO: 130874 - RNA, 22 nt, Human
agaccauguuauccuucauuuu

SEQ ID NO: 130875 - RNA, 22 nt, Human
agacccugauucugcuggcggu

SEQ ID NO: 130876 - RNA, 22 nt, Human
agaaugucaagucaagaacaau

SEQ ID NO: 130877 - RNA, 22 nt, Human
agacaaucaacuguugaugccu

SEQ ID NO: 130878 - RNA, 22 nt, Human
acuuugccagcucccugcuggc

SEQ ID NO: 130879 - RNA, 22 nt, Human
acuuggucguggugcagcaugg

SEQ ID NO: 130880 - RNA, 22 nt, Human
acuugguccacaguaagugcuu

SEQ ID NO: 130881 - RNA, 22 nt, Human
acuugggaaaugaaaauacaga

SEQ ID NO: 130882 - RNA, 19 nt, Human
acuugcuuucauuuaagau

SEQ ID NO: 130883 - RNA, 22 nt, Human
acuucaggagcagucucuggaa

SEQ ID NO: 130884 - RNA, 22 nt, Human
acuguugagggaagcagaugaa

SEQ ID NO: 130885 - RNA, 22 nt, Human
acuguugcuuguuuggaauguu

SEQ ID NO: 130886 - RNA, 23 nt, Human
acuggauuguucuugggcgcuga

SEQ ID NO: 130887 - RNA, 22 nt, Human
acuggauuuugugguguaucuu

SEQ ID NO: 130888 - RNA, 21 nt, Human
acuuccacaucacugaguaga

SEQ ID NO: 130889 - RNA, 22 nt, Human
gaagcaccuggacggugccugg

SEQ ID NO: 130890 - RNA, 22 nt, Human
gaagcagguucuucaggaugaa

SEQ ID NO: 130891 - RNA, 22 nt, Human
gaagcccuggaggggcuggagg

SEQ ID NO: 130892 - RNA, 22 nt, Human
gaagcggguucacuggauggcu

SEQ ID NO: 130893 - RNA, 22 nt, Human
gaagccaugauaaccagugugg

SEQ ID NO: 130894 - RNA, 22 nt, Human
gagcgcgcaaucucuccagcug

SEQ ID NO: 130895 - RNA, 22 nt, Human
gagcgacucuuuuaguccagag

SEQ ID NO: 130896 - RNA, 22 nt, Human
gagcgugaggcagcuuucuaag

SEQ ID NO: 130897 - RNA, 22 nt, Human
gagcucucgggcuggggcguug

SEQ ID NO: 130898 - RNA, 22 nt, Human
gagcuaagcccuggagaggucg

SEQ ID NO: 130899 - RNA, 22 nt, Human
gaagcuucgaaagagugauuuc

SEQ ID NO: 130900 - RNA, 22 nt, Human
gaagcuccaggaugccugcacu

SEQ ID NO: 130901 - RNA, 22 nt, Human
gaaggaagcugucuggaugugu

SEQ ID NO: 130902 - RNA, 22 nt, Human
gaaggagaggauugugaggcug

SEQ ID NO: 130903 - RNA, 22 nt, Human
gagcuggagaaacacauaagaa

SEQ ID NO: 130904 - RNA, 22 nt, Human
gaggacugguugggaaugugaa

SEQ ID NO: 130905 - RNA, 22 nt, Human
gaaggcuguggcuggucucagu

SEQ ID NO: 130906 - RNA, 22 nt, Human
gaagggccaggggcaggcugga

SEQ ID NO: 130907 - RNA, 22 nt, Human
gaggagcggugcaugugggggc

SEQ ID NO: 130908 - RNA, 22 nt, Human
gaggagcaggcaggaucugguc

SEQ ID NO: 130909 - RNA, 22 nt, Human
gaaggggccuggggcaaggcua

SEQ ID NO: 130910 - RNA, 22 nt, Human
gaggaggcuggagaggccagga

SEQ ID NO: 130911 - RNA, 22 nt, Human
gaggaggagaagcggcggcgga

SEQ ID NO: 130912 - RNA, 22 nt, Human
gaggccauguggcccgggcugc

SEQ ID NO: 130913 - RNA, 22 nt, Human
gaggcgcgcugcgagggcgcgg

SEQ ID NO: 130914 - RNA, 22 nt, Human
gaggcaggcggggcccaggugg

SEQ ID NO: 130915 - RNA, 20 nt, Human
gaaucuggucaaaugucuau

SEQ ID NO: 130916 - RNA, 22 nt, Human
gaggcggugguggcgagaguca

SEQ ID NO: 130917 - RNA, 22 nt, Human
gaggcggcgacgcgggcccggg

SEQ ID NO: 130918 - RNA, 22 nt, Human
gaggcugguucccuugaucuuu

SEQ ID NO: 130919 - RNA, 22 nt, Human
gaauacaagccugccaccugga

SEQ ID NO: 130920 - RNA, 22 nt, Human
gaauaagaauccacuucuggca

SEQ ID NO: 130921 - RNA, 22 nt, Human
gaagucugacucuuuguaagcu

SEQ ID NO: 130922 - RNA, 22 nt, Human
gaggcuugccacuguccauggc

SEQ ID NO: 130923 - RNA, 22 nt, Human
gagggauuuuagugcagcaacu

SEQ ID NO: 130924 - RNA, 22 nt, Human
gagggagugggcccgugggcac

SEQ ID NO: 130925 - RNA, 22 nt, Human
gaauggcagaaugaagcagugu

SEQ ID NO: 130926 - RNA, 22 nt, Human
gagggcugccacguugggcgag

SEQ ID NO: 130927 - RNA, 22 nt, Human
gagggcucaacuacuacuaggc

SEQ ID NO: 130928 - RNA, 22 nt, Human
gaggggcggggcgggaggagag

SEQ ID NO: 130929 - RNA, 22 nt, Human
gaggggaaggguguucaauggg

SEQ ID NO: 130930 - RNA, 22 nt, Human
gagggggaaaagggcagcagag

SEQ ID NO: 130931 - RNA, 19 nt, Human
gaauugcacgagcagaggc

SEQ ID NO: 130932 - RNA, 22 nt, Human
gaggucuugagugacuuagcag

SEQ ID NO: 130933 - RNA, 22 nt, Human
gacagcguguuuugcaugaaca

SEQ ID NO: 130934 - RNA, 22 nt, Human
gacagcaggaugugaggggaug

SEQ ID NO: 130935 - RNA, 22 nt, Human
gaggugcaggggcccgggcugg

SEQ ID NO: 130936 - RNA, 22 nt, Human
gagguuggagggcugcccugca

SEQ ID NO: 130937 - RNA, 22 nt, Human
gacaguggagccacguugggag

SEQ ID NO: 130938 - RNA, 22 nt, Human
gagguuggagggcuggccugca

SEQ ID NO: 130939 - RNA, 22 nt, Human
gagguagcgugcagggcccgaa

SEQ ID NO: 130940 - RNA, 22 nt, Human
gagguccaggguggggccugag

SEQ ID NO: 130941 - RNA, 22 nt, Human
gaggucggaagugaggguaacu

SEQ ID NO: 130942 - RNA, 22 nt, Human
gacacucuuaauccuaucccug

SEQ ID NO: 130943 - RNA, 22 nt, Human
gacacugccaagugccccgaga

SEQ ID NO: 130944 - RNA, 22 nt, Human
gaggguggggaauagacugcua

SEQ ID NO: 130945 - RNA, 22 nt, Human
gacaagaugacaucauggcuuc

SEQ ID NO: 130946 - RNA, 22 nt, Human
gagggggcggccccugugggca

SEQ ID NO: 130947 - RNA, 22 nt, Human
gaggguggagccuccuggaagu

SEQ ID NO: 130948 - RNA, 22 nt, Human
gacacaacuauccaguauggga

SEQ ID NO: 130949 - RNA, 22 nt, Human
gaccugcucagcccuguguguu

SEQ ID NO: 130950 - RNA, 22 nt, Human
gaccugguggccauugucccag

SEQ ID NO: 130951 - RNA, 22 nt, Human
gaccucauggaguaagugagug

SEQ ID NO: 130952 - RNA, 22 nt, Human
gagucaauucaccuuggugcuu

SEQ ID NO: 130953 - RNA, 22 nt, Human
gagucaucucuagaaugaugau

SEQ ID NO: 130954 - RNA, 22 nt, Human
gacggaggacaucagcaguguc

SEQ ID NO: 130955 - RNA, 22 nt, Human
gacggagugcgcuugcuguuca

SEQ ID NO: 130956 - RNA, 22 nt, Human
gaguggccugccccagccaggc

SEQ ID NO: 130957 - RNA, 22 nt, Human
gagugaucuguaggcagcaugg

SEQ ID NO: 130958 - RNA, 19 nt, Human
gagugaggagcaucguuua

SEQ ID NO: 130959 - RNA, 22 nt, Human
gaguccuggagagcccgagcgc

SEQ ID NO: 130960 - RNA, 22 nt, Human
gagucuacaugcaggcaauugu

SEQ ID NO: 130961 - RNA, 22 nt, Human
gaccaggagauuugagcuaggc

SEQ ID NO: 130962 - RNA, 22 nt, Human
gacugggacucaacccaccauu

SEQ ID NO: 130963 - RNA, 22 nt, Human
gacuggcucuaucaggauaaau

SEQ ID NO: 130964 - RNA, 22 nt, Human
gagugggugaaugugcucauaa

SEQ ID NO: 130965 - RNA, 22 nt, Human
gaguggugagaauacaacggaa

SEQ ID NO: 130966 - RNA, 22 nt, Human
gauacaugucacaaguugugca

SEQ ID NO: 130967 - RNA, 22 nt, Human
gauaccugccaagcugcacuca

SEQ ID NO: 130968 - RNA, 22 nt, Human
gauacuugaggagaucaccaca

SEQ ID NO: 130969 - RNA, 23 nt, Human
gacuucacacucucaaccacugc

SEQ ID NO: 130970 - RNA, 22 nt, Human
gacuugcucaaaucagauuuua

SEQ ID NO: 130971 - RNA, 22 nt, Human
gagaacaaggaagagucggcag

SEQ ID NO: 130972 - RNA, 22 nt, Human
gagaaauagauucaugguagau

SEQ ID NO: 130973 - RNA, 22 nt, Human
gaucccccaucuacuaucccca

SEQ ID NO: 130974 - RNA, 22 nt, Human
gagaaugagucagagcuggcug

SEQ ID NO: 130975 - RNA, 22 nt, Human
gauccagauauuugggcuggua

SEQ ID NO: 130976 - RNA, 22 nt, Human
gacaggcagagaggaagagaga

SEQ ID NO: 130977 - RNA, 22 nt, Human
gacagggacacagccagugagg

SEQ ID NO: 130978 - RNA, 22 nt, Human
gacagaccucugcugacuggag

SEQ ID NO: 130979 - RNA, 22 nt, Human
gaccugaccucauuagcaaguu

SEQ ID NO: 130980 - RNA, 23 nt, Human
gaccucuuccuccagccucugaa

SEQ ID NO: 130981 - RNA, 22 nt, Human
gaccuccauucugucaugacug

SEQ ID NO: 130982 - RNA, 22 nt, Human
gacccugaggauucccugcuga

SEQ ID NO: 130983 - RNA, 22 nt, Human
gacaucuguccauggcacugga

SEQ ID NO: 130984 - RNA, 22 nt, Human
gaccgggcucugcugacggucu

SEQ ID NO: 130985 - RNA, 21 nt, Human
cuuugccuccagcagccgcag

SEQ ID NO: 130986 - RNA, 22 nt, Human
gacagugucccucuggggugga

SEQ ID NO: 130987 - RNA, 22 nt, Human
gagaccuuaagagaugucagcu

SEQ ID NO: 130988 - RNA, 22 nt, Human
gaaaacccuguauguagcguuu

SEQ ID NO: 130989 - RNA, 22 nt, Human
cuugcagccuggagcucagccu

SEQ ID NO: 130990 - RNA, 22 nt, Human
cuugagcugaguuugcagcucu

SEQ ID NO: 130991 - RNA, 22 nt, Human
gaagaugcugcuuguucacggg

SEQ ID NO: 130992 - RNA, 22 nt, Human
cuugggacucccuguagcagug

SEQ ID NO: 130993 - RNA, 23 nt, Human
cuuggcuagccacuuccacgcuc

SEQ ID NO: 130994 - RNA, 20 nt, Human
gacaagccacagcucccaga

SEQ ID NO: 130995 - RNA, 22 nt, Human
gacacaacuucccucccacauu

SEQ ID NO: 130996 - RNA, 22 nt, Human
gacacccgccggcgccugccuc

SEQ ID NO: 130997 - RNA, 22 nt, Human
gacaccuucuacugacuaugga

SEQ ID NO: 130998 - RNA, 22 nt, Human
gacaacuucaguaaaguagauu

SEQ ID NO: 130999 - RNA, 22 nt, Human
cuugucuaguuccuggugaugu

SEQ ID NO: 131000 - RNA, 19 nt, Human
cuuguggcuaugcagauac

SEQ ID NO: 131001 - RNA, 22 nt, Human
cuggccuuaucacaaagcuaga

SEQ ID NO: 131002 - RNA, 22 nt, Human
cuggcuuucauggcgcaguuga

SEQ ID NO: 131003 - RNA, 21 nt, Human
cugggaacccgaccaaggccu

SEQ ID NO: 131004 - RNA, 22 nt, Human
cuggcuaaugugcugauagcca

SEQ ID NO: 131005 - RNA, 22 nt, Human
cuggcggcccgaggcagaggag

SEQ ID NO: 131006 - RNA, 23 nt, Human
cuucagaccucagaaggucuguu

SEQ ID NO: 131007 - RNA, 22 nt, Human
cuucacugcagucauggcucug

SEQ ID NO: 131008 - RNA, 22 nt, Human
cuucagcgucgucaguguugcu

SEQ ID NO: 131009 - RNA, 20 nt, Human
cuggaguguagcaguggcug

SEQ ID NO: 131010 - RNA, 22 nt, Human
cuggaucgccccgaugugcccc

SEQ ID NO: 131011 - RNA, 22 nt, Human
cugggaugagcuguuuccuggu

SEQ ID NO: 131012 - RNA, 22 nt, Human
cuuuugcaauagugacacugau

SEQ ID NO: 131013 - RNA, 22 nt, Human
cugggacacguugugcuuuaac

SEQ ID NO: 131014 - RNA, 22 nt, Human
cugggacccagcccaagucuuu

SEQ ID NO: 131015 - RNA, 22 nt, Human
cugggaccugugugccugggcc

SEQ ID NO: 131016 - RNA, 22 nt, Human
cuuuuggcaucagccucaggaa

SEQ ID NO: 131017 - RNA, 22 nt, Human
cuuuuugccuugaagugaccuc

SEQ ID NO: 131018 - RNA, 22 nt, Human
cugggcaugggaacuucaaggc

SEQ ID NO: 131019 - RNA, 22 nt, Human
cugggugggcacccagccuggg

SEQ ID NO: 131020 - RNA, 22 nt, Human
cuggguguggugggugcugccg

SEQ ID NO: 131021 - RNA, 22 nt, Human
cugggugagcuggccagagggu

SEQ ID NO: 131022 - RNA, 22 nt, Human
cugggguuggccagggcccuag

SEQ ID NO: 131023 - RNA, 22 nt, Human
cugggguggugcaggccucaug

SEQ ID NO: 131024 - RNA, 22 nt, Human
cugggcucccucucccgccucg

SEQ ID NO: 131025 - RNA, 22 nt, Human
cugggcuuucaggcccuaaggc

SEQ ID NO: 131026 - RNA, 22 nt, Human
cugggguaucugccacaacucu

SEQ ID NO: 131027 - RNA, 22 nt, Human
cugggguaucuggugucuuggu

SEQ ID NO: 131028 - RNA, 22 nt, Human
cuggggccccagcucggccccu

SEQ ID NO: 131029 - RNA, 22 nt, Human
gaaaugaaacacacaugcagcu

SEQ ID NO: 131030 - RNA, 22 nt, Human
cuguccugauggugccacuggu

SEQ ID NO: 131031 - RNA, 22 nt, Human
gaaaccauggcaaccagguccu

SEQ ID NO: 131032 - RNA, 22 nt, Human
cugugguuucuaugggccuuga

SEQ ID NO: 131033 - RNA, 22 nt, Human
cugugggcucucaugggaccug

SEQ ID NO: 131034 - RNA, 22 nt, Human
cuguccauuuucgugccuccuu

SEQ ID NO: 131035 - RNA, 22 nt, Human
cuguggguggcugugccccagg

SEQ ID NO: 131036 - RNA, 22 nt, Human
cuguuguucacuuugcugguga

SEQ ID NO: 131037 - RNA, 22 nt, Human
gaacggccucguuccucggugu

SEQ ID NO: 131038 - RNA, 22 nt, Human
cugguuacuucagaucaguagu

SEQ ID NO: 131039 - RNA, 22 nt, Human
cugguuuauuucauaguuuguu

SEQ ID NO: 131040 - RNA, 22 nt, Human
cuggugaagccuucggagaccc

SEQ ID NO: 131041 - RNA, 22 nt, Human
cuggguguuccuuucauuuuaa

SEQ ID NO: 131042 - RNA, 22 nt, Human
cuguccuguggccugcuccggu

SEQ ID NO: 131043 - RNA, 22 nt, Human
cuguauggaggaggugcuagcc

SEQ ID NO: 131044 - RNA, 22 nt, Human
gaaaaucaugaaaguguguugu

SEQ ID NO: 131045 - RNA, 22 nt, Human
cucagcacauuccuaagggaug

SEQ ID NO: 131046 - RNA, 22 nt, Human
cucagcaauuaccugugucucu

SEQ ID NO: 131047 - RNA, 22 nt, Human
cucagaagaacaaaggcucuac

SEQ ID NO: 131048 - RNA, 22 nt, Human
cugcuugguuuggagggcccac

SEQ ID NO: 131049 - RNA, 22 nt, Human
cucaggaaaauauugaagaagu

SEQ ID NO: 131050 - RNA, 22 nt, Human
cucaugagucugucagagucau

SEQ ID NO: 131051 - RNA, 22 nt, Human
cucaugcugcaaauggcuguuu

SEQ ID NO: 131052 - RNA, 22 nt, Human
cugcuugaugaggaaaggauug

SEQ ID NO: 131053 - RNA, 22 nt, Human
cucaagacacccuggccucuac

SEQ ID NO: 131054 - RNA, 22 nt, Human
cucacccaaacuauaucuuuaa

SEQ ID NO: 131055 - RNA, 22 nt, Human
cucacgguuugcaucaagagug

SEQ ID NO: 131056 - RNA, 22 nt, Human
cucacugucagcugcagggcuu

SEQ ID NO: 131057 - RNA, 22 nt, Human
cucaccugccuccccgcccucc

SEQ ID NO: 131058 - RNA, 22 nt, Human
cuccuuuuuauaucuuucucug

SEQ ID NO: 131059 - RNA, 22 nt, Human
cugggggacagagagaggcggu

SEQ ID NO: 131060 - RNA, 22 nt, Human
cugggaguugacgaggcuugua

SEQ ID NO: 131061 - RNA, 22 nt, Human
cugggugugugugaacagagau

SEQ ID NO: 131062 - RNA, 22 nt, Human
cuggguuuggcugugcuugaau

SEQ ID NO: 131063 - RNA, 22 nt, Human
cuggucaauaaucauguaguac

SEQ ID NO: 131064 - RNA, 22 nt, Human
cuggucuugguauucgcagaag

SEQ ID NO: 131065 - RNA, 22 nt, Human
cugggaggagacaggggauggg

SEQ ID NO: 131066 - RNA, 22 nt, Human
cugggagaugacucagagcagg

SEQ ID NO: 131067 - RNA, 22 nt, Human
cuggcuguguguuugugcaucu

SEQ ID NO: 131068 - RNA, 21 nt, Human
cuggcucgccaugguucuuuu

SEQ ID NO: 131069 - RNA, 22 nt, Human
cuccacccuagagggcccaugc

SEQ ID NO: 131070 - RNA, 22 nt, Human
cuccagagagaaaggaggccgc

SEQ ID NO: 131071 - RNA, 22 nt, Human
cuccagcagaaagggcgagugg

SEQ ID NO: 131072 - RNA, 22 nt, Human
cuggcggugaucccgauggugu

SEQ ID NO: 131073 - RNA, 22 nt, Human
cuggcgauugcgagagucgccu

SEQ ID NO: 131074 - RNA, 22 nt, Human
cuguccccauugcugucccugg

SEQ ID NO: 131075 - RNA, 19 nt, Human
cuguccacacacucgcuuc

SEQ ID NO: 131076 - RNA, 22 nt, Human
cuggugagaccgacuuccacuu

SEQ ID NO: 131077 - RNA, 22 nt, Human
cuggugggucacgugugggugg

SEQ ID NO: 131078 - RNA, 22 nt, Human
cuggugcuguagccugauugag

SEQ ID NO: 131079 - RNA, 21 nt, Human
cugugggaaggccugaggucu

SEQ ID NO: 131080 - RNA, 22 nt, Human
cuguguuguuugaguagcuuga

SEQ ID NO: 131081 - RNA, 22 nt, Human
cuguucuccacuccugacuucu

SEQ ID NO: 131082 - RNA, 22 nt, Human
cuguuccuccaccucaacaaac

SEQ ID NO: 131083 - RNA, 22 nt, Human
cugaaagcaaaguaauucuuaa

SEQ ID NO: 131084 - RNA, 22 nt, Human
cuguuguguuauuugcagugca

SEQ ID NO: 131085 - RNA, 20 nt, Human
cuguucucuugccacaugag

SEQ ID NO: 131086 - RNA, 22 nt, Human
cuguuucucugccugcacacau

SEQ ID NO: 131087 - RNA, 22 nt, Human
cugaagaaagaaaauggccauc

SEQ ID NO: 131088 - RNA, 22 nt, Human
cuuauuugcccauguuucuuua

SEQ ID NO: 131089 - RNA, 22 nt, Human
cuuaggaaauccuguacucccc

SEQ ID NO: 131090 - RNA, 22 nt, Human
cugagggagacagugcggacua

SEQ ID NO: 131091 - RNA, 22 nt, Human
cugagggagcugcuggccuugg

SEQ ID NO: 131092 - RNA, 20 nt, Human
cuguuugcuaucaugagcug

SEQ ID NO: 131093 - RNA, 22 nt, Human
cugccugugcgccaagugcacg

SEQ ID NO: 131094 - RNA, 22 nt, Human
cugccgaugcgcaguggcgccu

SEQ ID NO: 131095 - RNA, 22 nt, Human
cuacugaugccccgcugugccu

SEQ ID NO: 131096 - RNA, 22 nt, Human
cuagaucuggcaggcacaaggu

SEQ ID NO: 131097 - RNA, 22 nt, Human
cuagaggaacaguuucagguuu

SEQ ID NO: 131098 - RNA, 22 nt, Human
cugcggcaccaaccccuucaug

SEQ ID NO: 131099 - RNA, 22 nt, Human
cugccuuggcccuaguucaugg

SEQ ID NO: 131100 - RNA, 22 nt, Human
cugcgcagaucugcuguucucu

SEQ ID NO: 131101 - RNA, 22 nt, Human
cuaccagcacgccuuccucuac

SEQ ID NO: 131102 - RNA, 22 nt, Human
cugcccugcagcuccacggacu

SEQ ID NO: 131103 - RNA, 22 nt, Human
cugcccgcaugcaggaaugcug

SEQ ID NO: 131104 - RNA, 22 nt, Human
cugccaggagaggccagggccc

SEQ ID NO: 131105 - RNA, 22 nt, Human
cuaauugcuggcugcuggcaga

SEQ ID NO: 131106 - RNA, 22 nt, Human
cuaagaaggaggaaaagugcca

SEQ ID NO: 131107 - RNA, 18 nt, Human
cuaagaggucguuucuca

SEQ ID NO: 131108 - RNA, 22 nt, Human
cuaagguuggcaguggaauugg

SEQ ID NO: 131109 - RNA, 22 nt, Human
cugcuacgguguccgguggggc

SEQ ID NO: 131110 - RNA, 22 nt, Human
cuaggucagaggacacagcuua

SEQ ID NO: 131111 - RNA, 22 nt, Human
cuaggggucccaagggugcucu

SEQ ID NO: 131112 - RNA, 22 nt, Human
cuaggaugcuguaauggugucu

SEQ ID NO: 131113 - RNA, 22 nt, Human
cugcugccagcuuaauacucac

SEQ ID NO: 131114 - RNA, 18 nt, Human
cuaguuuguuuucuacau

SEQ ID NO: 131115 - RNA, 22 nt, Human
cugcugcuugauugcaggaagu

SEQ ID NO: 131116 - RNA, 22 nt, Human
cugcugucuuuauuucacugcu

SEQ ID NO: 131117 - RNA, 22 nt, Human
cugcuguuuucugggcuucuua

SEQ ID NO: 131118 - RNA, 22 nt, Human
cguugguggguguguggucgga

SEQ ID NO: 131119 - RNA, 22 nt, Human
cugaugugcauguggggggaug

SEQ ID NO: 131120 - RNA, 22 nt, Human
cguucccuccugccacgggagg

SEQ ID NO: 131121 - RNA, 20 nt, Human
cguguacauuuaugccccug

SEQ ID NO: 131122 - RNA, 22 nt, Human
cgugucauggcggcgcaggugg

SEQ ID NO: 131123 - RNA, 21 nt, Human
cugcacugugauuuaaaaugu

SEQ ID NO: 131124 - RNA, 22 nt, Human
cugcagagaccuaggucagguu

SEQ ID NO: 131125 - RNA, 22 nt, Human
cugcacagucauuuccucucaa

SEQ ID NO: 131126 - RNA, 22 nt, Human
cugcagauaaguguuuugaaaa

SEQ ID NO: 131127 - RNA, 22 nt, Human
cugcaucacagcaggaggcaca

SEQ ID NO: 131128 - RNA, 22 nt, Human
cuaaacacuauucuggaaauag

SEQ ID NO: 131129 - RNA, 22 nt, Human
cgguugcaggaugugcgggcag

SEQ ID NO: 131130 - RNA, 22 nt, Human
cgguggcccauuguacgcagcu

SEQ ID NO: 131131 - RNA, 22 nt, Human
cugagcaucaaaugggcaauua

SEQ ID NO: 131132 - RNA, 23 nt, Human
cugagggcuggucugaagucugc

SEQ ID NO: 131133 - RNA, 22 nt, Human
cgucauacagaugaacaaucuc

SEQ ID NO: 131134 - RNA, 22 nt, Human
cugagcugcucccgcugcagcg

SEQ ID NO: 131135 - RNA, 22 nt, Human
cgugccugguggagagcgaggg

SEQ ID NO: 131136 - RNA, 22 nt, Human
cgugcaggagcuggagguccga

SEQ ID NO: 131137 - RNA, 22 nt, Human
cguggcaguagagcuggaacuu

SEQ ID NO: 131138 - RNA, 22 nt, Human
cgugaaaugcagaaaguugugg

SEQ ID NO: 131139 - RNA, 22 nt, Human
cgugaagaaguaauagguggug

SEQ ID NO: 131140 - RNA, 22 nt, Human
cugaugcucuggauguagucaa

SEQ ID NO: 131141 - RNA, 22 nt, Human
cugaucccuuuucauuugcagg

SEQ ID NO: 131142 - RNA, 22 nt, Human
cugauagagcauuagugugaga

SEQ ID NO: 131143 - RNA, 22 nt, Human
cgccgccgccugcccgcgcccc

SEQ ID NO: 131144 - RNA, 22 nt, Human
cgcccccgaucggggccgccgc

SEQ ID NO: 131145 - RNA, 22 nt, Human
cgccaguggcagcuggaacagg

SEQ ID NO: 131146 - RNA, 22 nt, Human
cuagguggcagcacuccgaggu

SEQ ID NO: 131147 - RNA, 22 nt, Human
cuagcaggacucagcagauauu

SEQ ID NO: 131148 - RNA, 22 nt, Human
cuagcagaagcuccuugagggu

SEQ ID NO: 131149 - RNA, 22 nt, Human
cgcaucggguagaggagcugga

SEQ ID NO: 131150 - RNA, 22 nt, Human
cgcuagggagcacuuggcagug

SEQ ID NO: 131151 - RNA, 22 nt, Human
cucagcgggagucuggccgaac

SEQ ID NO: 131152 - RNA, 22 nt, Human
cucagcgagggaaagaggccgc

SEQ ID NO: 131153 - RNA, 22 nt, Human
cucagcaacccacacacggucu

SEQ ID NO: 131154 - RNA, 22 nt, Human
cucaagagaaaucggaaucaga

SEQ ID NO: 131155 - RNA, 22 nt, Human
cgccgugcagucagcccagaag

SEQ ID NO: 131156 - RNA, 22 nt, Human
cuccgccuguccugggcccacg

SEQ ID NO: 131157 - RNA, 22 nt, Human
cuccgcagcugggguuggcgcu

SEQ ID NO: 131158 - RNA, 22 nt, Human
cuccagcucgcgagcucugcuc

SEQ ID NO: 131159 - RNA, 22 nt, Human
cucagugacuuccugcucaauu

SEQ ID NO: 131160 - RNA, 22 nt, Human
cucaucagagcccuccucuggc

SEQ ID NO: 131161 - RNA, 22 nt, Human
cuccggggacgcagucgccgcc

SEQ ID NO: 131162 - RNA, 22 nt, Human
cuccucccagcccaggcgccac

SEQ ID NO: 131163 - RNA, 22 nt, Human
cggaggcugcuuucuguugcua

SEQ ID NO: 131164 - RNA, 22 nt, Human
cggcccggccucgcggcgcaug

SEQ ID NO: 131165 - RNA, 22 nt, Human
cggccgcgggauggcgggcagc

SEQ ID NO: 131166 - RNA, 22 nt, Human
cucugagcucgugcaguacuuc

SEQ ID NO: 131167 - RNA, 22 nt, Human
cgaggagguccaggagcaguag

SEQ ID NO: 131168 - RNA, 22 nt, Human
cuaccccaggccccucgaugcc

SEQ ID NO: 131169 - RNA, 22 nt, Human
cgaggcuugcaaggacgaggag

SEQ ID NO: 131170 - RNA, 22 nt, Human
cgugugugugcgugugcgugug

SEQ ID NO: 131171 - RNA, 22 nt, Human
cgugugcguauguguuuguaug

SEQ ID NO: 131172 - RNA, 22 nt, Human
cguggccacaguggagcugagc

SEQ ID NO: 131173 - RNA, 22 nt, Human
cgagggcuggaggggagacaga

SEQ ID NO: 131174 - RNA, 22 nt, Human
cgagguacuuacccuggucugu

SEQ ID NO: 131175 - RNA, 22 nt, Human
cgagugauuauucuggcugaga

SEQ ID NO: 131176 - RNA, 22 nt, Human
cgcacacaaaugcauacgccag

SEQ ID NO: 131177 - RNA, 22 nt, Human
cuagaucuuuaaaaaucuggaa

SEQ ID NO: 131178 - RNA, 22 nt, Human
cgcacaggcacagacacuggga

SEQ ID NO: 131179 - RNA, 21 nt, Human
ccuugcacucaucccaugccc

SEQ ID NO: 131180 - RNA, 22 nt, Human
ccuuggcuuaccuucugugugg

SEQ ID NO: 131181 - RNA, 22 nt, Human
cgucauguuauggcucauucua

SEQ ID NO: 131182 - RNA, 22 nt, Human
ccuugcgaggaugcugugagcu

SEQ ID NO: 131183 - RNA, 22 nt, Human
cgggagcagcucuggggcuggg

SEQ ID NO: 131184 - RNA, 22 nt, Human
cgggcacagguugagguagaug

SEQ ID NO: 131185 - RNA, 22 nt, Human
cgggcacucagggucgaggugg

SEQ ID NO: 131186 - RNA, 22 nt, Human
cgggcccaggcaggggcucccc

SEQ ID NO: 131187 - RNA, 22 nt, Human
ccuggccacagggcucugcauu

SEQ ID NO: 131188 - RNA, 21 nt, Human
cgucccggcgugagagagcug

SEQ ID NO: 131189 - RNA, 22 nt, Human
cguggaggucgcauauuccucu

SEQ ID NO: 131190 - RNA, 22 nt, Human
cgugcuaccugagcugacagcu

SEQ ID NO: 131191 - RNA, 17 nt, Human
cgugaggaccaggcagc

SEQ ID NO: 131192 - RNA, 22 nt, Human
cgucuaaggaacuccauucaca

SEQ ID NO: 131193 - RNA, 22 nt, Human
cgugaucuguuauauagugagc

SEQ ID NO: 131194 - RNA, 22 nt, Human
cgucauuuguaaaugaucaaga

SEQ ID NO: 131195 - RNA, 22 nt, Human
ccggguccagugggcacugggc

SEQ ID NO: 131196 - RNA, 22 nt, Human
ccgguguggguuucucgguagu

SEQ ID NO: 131197 - RNA, 22 nt, Human
cgaaaaagaagugcaccauguu

SEQ ID NO: 131198 - RNA, 22 nt, Human
ccuaggcccauuaauuccccuu

SEQ ID NO: 131199 - RNA, 20 nt, Human
ccuagacacagggagggccg

SEQ ID NO: 131200 - RNA, 22 nt, Human
ccucggacuugggugggcuccu

SEQ ID NO: 131201 - RNA, 22 nt, Human
ccuccgguucucagggcuccac

SEQ ID NO: 131202 - RNA, 22 nt, Human
ccuccacgaggggucuucucuu

SEQ ID NO: 131203 - RNA, 18 nt, Human
cgauguguaugugauuug

SEQ ID NO: 131204 - RNA, 22 nt, Human
cgcccggcugagacgcucgccc

SEQ ID NO: 131205 - RNA, 22 nt, Human
cgaggccgcuucauggcuggca

SEQ ID NO: 131206 - RNA, 20 nt, Human
ccucucugcaugcucccuga

SEQ ID NO: 131207 - RNA, 22 nt, Human
cgcccguacuuugccggcauga

SEQ ID NO: 131208 - RNA, 22 nt, Human
ccucuccucugugcagacugcc

SEQ ID NO: 131209 - RNA, 21 nt, Human
cgcccggccggaaaccccuuc

SEQ ID NO: 131210 - RNA, 22 nt, Human
ccugagccgagcgcucuuucuc

SEQ ID NO: 131211 - RNA, 22 nt, Human
cgcugcugucaucgucuacggu

SEQ ID NO: 131212 - RNA, 22 nt, Human
cgcugggugguugauguacagc

SEQ ID NO: 131213 - RNA, 22 nt, Human
cgccgugucuggucuguacguc

SEQ ID NO: 131214 - RNA, 22 nt, Human
cgcugcagcggcugagucccgc

SEQ ID NO: 131215 - RNA, 22 nt, Human
cggagggcccucaggacugggu

SEQ ID NO: 131216 - RNA, 22 nt, Human
cgggacaauagcagugcugaug

SEQ ID NO: 131217 - RNA, 22 nt, Human
cggagguccagucacaaguaac

SEQ ID NO: 131218 - RNA, 22 nt, Human
cggcuucucgggucggauuccg

SEQ ID NO: 131219 - RNA, 20 nt, Human
cgggacacucaagcucuggg

SEQ ID NO: 131220 - RNA, 22 nt, Human
cggaggagcugcgcggaggggg

SEQ ID NO: 131221 - RNA, 22 nt, Human
cggagcgagaaggggaaagccc

SEQ ID NO: 131222 - RNA, 22 nt, Human
cgcuuuccaggcacauccucuu

SEQ ID NO: 131223 - RNA, 22 nt, Human
cgcuggagagcaagugcgugca

SEQ ID NO: 131224 - RNA, 22 nt, Human
ccugugucaucagcuguggcua

SEQ ID NO: 131225 - RNA, 22 nt, Human
ccugggugaugugcugcccucg

SEQ ID NO: 131226 - RNA, 22 nt, Human
ccugugacucugucugaugguc

SEQ ID NO: 131227 - RNA, 22 nt, Human
ccuguuccaacccucccuggcu

SEQ ID NO: 131228 - RNA, 22 nt, Human
ccuguguucguccucaccuugc

SEQ ID NO: 131229 - RNA, 23 nt, Human
ccuggcugaccugaagguguagu

SEQ ID NO: 131230 - RNA, 22 nt, Human
ccugggcauaaaucacuccaag

SEQ ID NO: 131231 - RNA, 22 nt, Human
ccuggcccagcuggaagcggga

SEQ ID NO: 131232 - RNA, 22 nt, Human
ccuggcccugcugcuugccagc

SEQ ID NO: 131233 - RNA, 22 nt, Human
ccugggccuaaacaaacaagag

SEQ ID NO: 131234 - RNA, 22 nt, Human
ccgcggcugcgcggugccccuc

SEQ ID NO: 131235 - RNA, 22 nt, Human
ccgcggcagaggcgggggcgcc

SEQ ID NO: 131236 - RNA, 22 nt, Human
ccgcggauggggagucaccacc

SEQ ID NO: 131237 - RNA, 22 nt, Human
ccuggcauuagaaauuccguca

SEQ ID NO: 131238 - RNA, 19 nt, Human
ccgagcagauugauguuuc

SEQ ID NO: 131239 - RNA, 22 nt, Human
ccgagcagggcgcccugcccca

SEQ ID NO: 131240 - RNA, 22 nt, Human
ccuggaccgacacaggaaggga

SEQ ID NO: 131241 - RNA, 21 nt, Human
ccuggagacaaagacagggug

SEQ ID NO: 131242 - RNA, 22 nt, Human
ccagagcaccgaaacgagcuuu

SEQ ID NO: 131243 - RNA, 22 nt, Human
ccgaaccacacgacagugcuca

SEQ ID NO: 131244 - RNA, 19 nt, Human
ccuggccaacgucaacauu

SEQ ID NO: 131245 - RNA, 22 nt, Human
ccagacuggggauuuugccagg

SEQ ID NO: 131246 - RNA, 22 nt, Human
ccagagaugcagugggugcagu

SEQ ID NO: 131247 - RNA, 22 nt, Human
ccagacuggggcuccuugaggg

SEQ ID NO: 131248 - RNA, 22 nt, Human
cccagaggcugaguugggagca

SEQ ID NO: 131249 - RNA, 22 nt, Human
cccagagacuuuguccgacgac

SEQ ID NO: 131250 - RNA, 22 nt, Human
ccgcucgggugcagagggcaga

SEQ ID NO: 131251 - RNA, 22 nt, Human
ccggauuugggagccaccaggg

SEQ ID NO: 131252 - RNA, 22 nt, Human
ccgcuggaagcgaguggugggc

SEQ ID NO: 131253 - RNA, 22 nt, Human
ccuuucuggucucugagagacu

SEQ ID NO: 131254 - RNA, 22 nt, Human
ccggcggaaacauggcggcgcc

SEQ ID NO: 131255 - RNA, 22 nt, Human
ccggcugcugaggcggccccgg

SEQ ID NO: 131256 - RNA, 22 nt, Human
ccgggcuuccuuagagcaagau

SEQ ID NO: 131257 - RNA, 22 nt, Human
ccgggcggcauccagccguucc

SEQ ID NO: 131258 - RNA, 22 nt, Human
ccuuccaguucuugguuguaau

SEQ ID NO: 131259 - RNA, 22 nt, Human
ccuucgcuggcaucuccaggua

SEQ ID NO: 131260 - RNA, 22 nt, Human
ccuguuuguucauguacuguga

SEQ ID NO: 131261 - RNA, 22 nt, Human
ccuugagugcaucguggguguc

SEQ ID NO: 131262 - RNA, 22 nt, Human
ccuucugcuggucaucccagug

SEQ ID NO: 131263 - RNA, 22 nt, Human
ccuuggaucugcauaucagcua

SEQ ID NO: 131264 - RNA, 22 nt, Human
ccgcgggcagggcuucaccuuu

SEQ ID NO: 131265 - RNA, 22 nt, Human
cauugcugccaaggugagcugg

SEQ ID NO: 131266 - RNA, 22 nt, Human
cauugcuguuaauugucucuag

SEQ ID NO: 131267 - RNA, 22 nt, Human
cauugcugugggcauuugcugc

SEQ ID NO: 131268 - RNA, 19 nt, Human
ccagaagggcaagcaaagg

SEQ ID NO: 131269 - RNA, 22 nt, Human
ccagaacgacgggcagaggcgc

SEQ ID NO: 131270 - RNA, 19 nt, Human
ccacuucuuugugugugag

SEQ ID NO: 131271 - RNA, 22 nt, Human
ccacuuucuaaauuggcgauuu

SEQ ID NO: 131272 - RNA, 22 nt, Human
ccacuguuggcccgaagggguc

SEQ ID NO: 131273 - RNA, 22 nt, Human
ccagaggcuuaugcagcugcug

SEQ ID NO: 131274 - RNA, 22 nt, Human
ccagaugggggcugugggaggg

SEQ ID NO: 131275 - RNA, 22 nt, Human
cauuggaugagggccucaucga

SEQ ID NO: 131276 - RNA, 22 nt, Human
ccagagcacaccguuugccuuc

SEQ ID NO: 131277 - RNA, 22 nt, Human
ccagcaagacucgcagugggau

SEQ ID NO: 131278 - RNA, 22 nt, Human
ccagacucucucauuuuccugu

SEQ ID NO: 131279 - RNA, 22 nt, Human
cauugucaaguggccgggucuu

SEQ ID NO: 131280 - RNA, 22 nt, Human
ccagccacagcuuccagcuccu

SEQ ID NO: 131281 - RNA, 22 nt, Human
ccagccugagcuugcugcccuc

SEQ ID NO: 131282 - RNA, 22 nt, Human
ccagcagaagcucccgcugggu

SEQ ID NO: 131283 - RNA, 22 nt, Human
ccaggaguccgugggucuugag

SEQ ID NO: 131284 - RNA, 23 nt, Human
ccagcugugccuggcccaggagc

SEQ ID NO: 131285 - RNA, 22 nt, Human
ccagcugggucccugcuggggc

SEQ ID NO: 131286 - RNA, 22 nt, Human
cauuuugguaauguucguuugc

SEQ ID NO: 131287 - RNA, 22 nt, Human
cauuuugguccucauguguagc

SEQ ID NO: 131288 - RNA, 22 nt, Human
ccaaagaagcaaugagaauagu

SEQ ID NO: 131289 - RNA, 23 nt, Human
ccagucgagucccaaccuucgcc

SEQ ID NO: 131290 - RNA, 22 nt, Human
ccaguccugucaggggagggga

SEQ ID NO: 131291 - RNA, 22 nt, Human
ccaaccaguuucuuggcuuuag

SEQ ID NO: 131292 - RNA, 22 nt, Human
ccaaggcuguggggcugugcag

SEQ ID NO: 131293 - RNA, 22 nt, Human
ccaaucaacuguguggcuuucu

SEQ ID NO: 131294 - RNA, 22 nt, Human
ccaaggugcagcccauggugaa

SEQ ID NO: 131295 - RNA, 22 nt, Human
ccaguguguuuuucucugacuc

SEQ ID NO: 131296 - RNA, 22 nt, Human
ccagggucggcaucagcguggg

SEQ ID NO: 131297 - RNA, 22 nt, Human
ccagggaggucauagugcuggu

SEQ ID NO: 131298 - RNA, 22 nt, Human
ccagggcuggguuugucggugu

SEQ ID NO: 131299 - RNA, 22 nt, Human
ccagggcuggaccagugcuugg

SEQ ID NO: 131300 - RNA, 22 nt, Human
ccagggcuggaggaggucagga

SEQ ID NO: 131301 - RNA, 22 nt, Human
ccagguggacggcgaguacagg

SEQ ID NO: 131302 - RNA, 22 nt, Human
ccaagcguguuuaggaaaugcu

SEQ ID NO: 131303 - RNA, 22 nt, Human
ccaagagcuucccauagcuucu

SEQ ID NO: 131304 - RNA, 22 nt, Human
ccauggccaauugcaccuugcu

SEQ ID NO: 131305 - RNA, 22 nt, Human
ccauuucacaucccugacaugu

SEQ ID NO: 131306 - RNA, 23 nt, Human
ccaugugcaggguucagcacuua

SEQ ID NO: 131307 - RNA, 22 nt, Human
ccaugugaccugugucaguugc

SEQ ID NO: 131308 - RNA, 16 nt, Human
cccaccuggacuaccu

SEQ ID NO: 131309 - RNA, 22 nt, Human
cccagaccagagugccuggacg

SEQ ID NO: 131310 - RNA, 22 nt, Human
cccaagcuccacauuuuagcuu

SEQ ID NO: 131311 - RNA, 22 nt, Human
cccaaccagaaauugacagaga

SEQ ID NO: 131312 - RNA, 18 nt, Human
cccaccugcccagguuca

SEQ ID NO: 131313 - RNA, 22 nt, Human
ccagaacguuugugcgaggcag

SEQ ID NO: 131314 - RNA, 22 nt, Human
ccauuuggccauucaguuguuc

SEQ ID NO: 131315 - RNA, 20 nt, Human
ccagaagagaagaaaaggaa

SEQ ID NO: 131316 - RNA, 22 nt, Human
ccaccucuaccuggccggccuu

SEQ ID NO: 131317 - RNA, 22 nt, Human
ccaccuggcagcaggcucggca

SEQ ID NO: 131318 - RNA, 16 nt, Human
ccacccagagaauauu

SEQ ID NO: 131319 - RNA, 22 nt, Human
ccaccacugaggcacaggagcc

SEQ ID NO: 131320 - RNA, 22 nt, Human
ccaugauguugccuacacugcu

SEQ ID NO: 131321 - RNA, 22 nt, Human
ccauggaaaagacgggcaggcc

SEQ ID NO: 131322 - RNA, 22 nt, Human
ccaccccagaaagggaaggcca

SEQ ID NO: 131323 - RNA, 22 nt, Human
ccaguggugcauguuugagcaa

SEQ ID NO: 131324 - RNA, 22 nt, Human
ccaccacauuugccuagacuuu

SEQ ID NO: 131325 - RNA, 23 nt, Human
ccacaugugagcccaccgugccc

SEQ ID NO: 131326 - RNA, 21 nt, Human
ccacaucaugucaccuccuag

SEQ ID NO: 131327 - RNA, 22 nt, Human
ccaaagaauuuggaaaaucuga

SEQ ID NO: 131328 - RNA, 22 nt, Human
ccaaacauuucaaauuuagaga

SEQ ID NO: 131329 - RNA, 22 nt, Human
ccaaauuguuguuguuguuguu

SEQ ID NO: 131330 - RNA, 20 nt, Human
caugaugcaaacaguaacgu

SEQ ID NO: 131331 - RNA, 22 nt, Human
caugcagauugccaggcucccu

SEQ ID NO: 131332 - RNA, 22 nt, Human
caugccaguagccggcuugacu

SEQ ID NO: 131333 - RNA, 22 nt, Human
cauggcacagaagaugucguuu

SEQ ID NO: 131334 - RNA, 22 nt, Human
cauggccaaagaauuauauuuu

SEQ ID NO: 131335 - RNA, 22 nt, Human
cauggcacuuuugugucuaaau

SEQ ID NO: 131336 - RNA, 22 nt, Human
ccaaggcugcagccgugacgcg

SEQ ID NO: 131337 - RNA, 22 nt, Human
ccaaccaguuaucuccuaaggu

SEQ ID NO: 131338 - RNA, 22 nt, Human
caugugguauugugagauccac

SEQ ID NO: 131339 - RNA, 22 nt, Human
ccacagcauugaaaucuauaau

SEQ ID NO: 131340 - RNA, 19 nt, Human
ccacacacuggucucuggg

SEQ ID NO: 131341 - RNA, 22 nt, Human
ccacccugguuacugugccagg

SEQ ID NO: 131342 - RNA, 22 nt, Human
ccacccuuccauucuuccucuu

SEQ ID NO: 131343 - RNA, 22 nt, Human
ccacccacuucucugcccucca

SEQ ID NO: 131344 - RNA, 22 nt, Human
ccacuacauugagugcuuucuc

SEQ ID NO: 131345 - RNA, 23 nt, Human
ccacuccucccaggccacccugc

SEQ ID NO: 131346 - RNA, 22 nt, Human
ccacucucucccucuguagggg

SEQ ID NO: 131347 - RNA, 22 nt, Human
caucaauagguauuugagagac

SEQ ID NO: 131348 - RNA, 22 nt, Human
caucaggcugggaacacagauc

SEQ ID NO: 131349 - RNA, 22 nt, Human
cauguguuucuuaagccaggcc

SEQ ID NO: 131350 - RNA, 22 nt, Human
cauaucuccagguucugcugga

SEQ ID NO: 131351 - RNA, 21 nt, Human
caucaagaucaauggagggcu

SEQ ID NO: 131352 - RNA, 22 nt, Human
caucacggagcaugagaagaca

SEQ ID NO: 131353 - RNA, 22 nt, Human
cauuccccaacucaacagggcu

SEQ ID NO: 131354 - RNA, 22 nt, Human
caucagucugaaagccagggag

SEQ ID NO: 131355 - RNA, 22 nt, Human
caucgagaauuggcagcuaaag

SEQ ID NO: 131356 - RNA, 22 nt, Human
cauccagcuccugggggccacc

SEQ ID NO: 131357 - RNA, 22 nt, Human
cauuggcacauguauucugggc

SEQ ID NO: 131358 - RNA, 22 nt, Human
cauugggcggggaccucggcug

SEQ ID NO: 131359 - RNA, 22 nt, Human
caugaugaacugugcuguuagg

SEQ ID NO: 131360 - RNA, 22 nt, Human
cacuguugagcaauguacagug

SEQ ID NO: 131361 - RNA, 22 nt, Human
cagcacaggugugaggccugau

SEQ ID NO: 131362 - RNA, 22 nt, Human
cagcacugcccuaccccuccac

SEQ ID NO: 131363 - RNA, 22 nt, Human
cagaacugaauaaagccaggau

SEQ ID NO: 131364 - RNA, 22 nt, Human
cagcagccuccccggccgaccu

SEQ ID NO: 131365 - RNA, 22 nt, Human
cagcccuguugcgcuuccggcg

SEQ ID NO: 131366 - RNA, 22 nt, Human
cagacgguuaaacgauuuugcu

SEQ ID NO: 131367 - RNA, 22 nt, Human
cagaccuggaaaacaggcuugc

SEQ ID NO: 131368 - RNA, 21 nt, Human
cagcccccauacccugcccag

SEQ ID NO: 131369 - RNA, 22 nt, Human
cagccccucuucucuccucgga

SEQ ID NO: 131370 - RNA, 22 nt, Human
cagaccucucaggcuguucuug

SEQ ID NO: 131371 - RNA, 22 nt, Human
cagccagaucgccuuccgccuc

SEQ ID NO: 131372 - RNA, 22 nt, Human
cacugcacuccagccugggcaa

SEQ ID NO: 131373 - RNA, 22 nt, Human
cacugcaaccuccaccucccgg

SEQ ID NO: 131374 - RNA, 22 nt, Human
cacugcugaggcccguguuacu

SEQ ID NO: 131375 - RNA, 22 nt, Human
cagacuccugcuccucuggggc

SEQ ID NO: 131376 - RNA, 22 nt, Human
cagacugagaaagugccacagg

SEQ ID NO: 131377 - RNA, 23 nt, Human
cacucgcaggcccagcucucagg

SEQ ID NO: 131378 - RNA, 22 nt, Human
cagagagcguccauccggugcc

SEQ ID NO: 131379 - RNA, 23 nt, Human
cagaccccuggcucugacccccu

SEQ ID NO: 131380 - RNA, 22 nt, Human
caccuuccgcccacugaccgcc

SEQ ID NO: 131381 - RNA, 22 nt, Human
caccgaacuuugcaaaugcaau

SEQ ID NO: 131382 - RNA, 20 nt, Human
caccggguugcugguuucuu

SEQ ID NO: 131383 - RNA, 22 nt, Human
caccgagagccacuuccggaac

SEQ ID NO: 131384 - RNA, 22 nt, Human
caccugcaaauuccagauuucu

SEQ ID NO: 131385 - RNA, 18 nt, Human
cacgcaacuguaaaaccc

SEQ ID NO: 131386 - RNA, 22 nt, Human
cacccugacuggcccugcagga

SEQ ID NO: 131387 - RNA, 20 nt, Human
cacccgguccucagcgacuc

SEQ ID NO: 131388 - RNA, 22 nt, Human
caccaccaguaccaucacacgc

SEQ ID NO: 131389 - RNA, 22 nt, Human
caccaucagacuucugggcagg

SEQ ID NO: 131390 - RNA, 22 nt, Human
cacugcguaguggcccgaagcu

SEQ ID NO: 131391 - RNA, 22 nt, Human
cacacgagcccuggagccagca

SEQ ID NO: 131392 - RNA, 22 nt, Human
cacacguuuagcuucuggcggc

SEQ ID NO: 131393 - RNA, 22 nt, Human
cacacguuucuacugcugccaa

SEQ ID NO: 131394 - RNA, 22 nt, Human
cacagcaggcagaacgugggca

SEQ ID NO: 131395 - RNA, 22 nt, Human
cacagcagcaucauuuaucugg

SEQ ID NO: 131396 - RNA, 19 nt, Human
cacuguccuagucgaggcc

SEQ ID NO: 131397 - RNA, 22 nt, Human
caaugcacauggacaucaggcu

SEQ ID NO: 131398 - RNA, 22 nt, Human
caaagaaccuucgagacagggc

SEQ ID NO: 131399 - RNA, 22 nt, Human
caagcagauauuuuagucaaga

SEQ ID NO: 131400 - RNA, 22 nt, Human
caagccacugggagcugcacac

SEQ ID NO: 131401 - RNA, 20 nt, Human
cacagcugacgaguauccaa

SEQ ID NO: 131402 - RNA, 22 nt, Human
cacagccaagacuuggccccau

SEQ ID NO: 131403 - RNA, 22 nt, Human
cacaucugaaggcggcucuagg

SEQ ID NO: 131404 - RNA, 22 nt, Human
cagguguugcaguugaagacug

SEQ ID NO: 131405 - RNA, 22 nt, Human
cagguggccggguaggaggugg

SEQ ID NO: 131406 - RNA, 22 nt, Human
caggagagucucugucuguacu

SEQ ID NO: 131407 - RNA, 22 nt, Human
cagguugucuaauuccaagggg

SEQ ID NO: 131408 - RNA, 22 nt, Human
caggacuuccucuaugguggcg

SEQ ID NO: 131409 - RNA, 22 nt, Human
cagguugaaaguggaggagcua

SEQ ID NO: 131410 - RNA, 20 nt, Human
cagguugcugcccccgccuc

SEQ ID NO: 131411 - RNA, 22 nt, Human
caggaacucuucugggugcuug

SEQ ID NO: 131412 - RNA, 22 nt, Human
caggaacagcaccaggagcuag

SEQ ID NO: 131413 - RNA, 22 nt, Human
caggacccaaccucccugcucu

SEQ ID NO: 131414 - RNA, 22 nt, Human
caggacccaacggugcaauguc

SEQ ID NO: 131415 - RNA, 22 nt, Human
caggacacaaaagguggagaag

SEQ ID NO: 131416 - RNA, 22 nt, Human
caggacacagacacuaaauaua

SEQ ID NO: 131417 - RNA, 22 nt, Human
caguggacacuuccucuacaau

SEQ ID NO: 131418 - RNA, 20 nt, Human
cagugcccguggaaaagaug

SEQ ID NO: 131419 - RNA, 22 nt, Human
caggcacaaugagcgccaucuu

SEQ ID NO: 131420 - RNA, 22 nt, Human
cagguuucuggaugcagcccca

SEQ ID NO: 131421 - RNA, 22 nt, Human
caggaggugugucccaccgggu

SEQ ID NO: 131422 - RNA, 22 nt, Human
caguggggaggccaggauagaa

SEQ ID NO: 131423 - RNA, 22 nt, Human
caguggagaccugccugcugga

SEQ ID NO: 131424 - RNA, 22 nt, Human
cagugguaaaugucguuccugu

SEQ ID NO: 131425 - RNA, 22 nt, Human
caggguugaugaauugucugua

SEQ ID NO: 131426 - RNA, 22 nt, Human
caggugggauuuugcugcuuga

SEQ ID NO: 131427 - RNA, 22 nt, Human
cauagcguuuacauguggauua

SEQ ID NO: 131428 - RNA, 22 nt, Human
cagguggauggcgagcccugca

SEQ ID NO: 131429 - RNA, 22 nt, Human
cagcccugagagaaccaucuau

SEQ ID NO: 131430 - RNA, 22 nt, Human
cagccccgcuggccucgccucc

SEQ ID NO: 131431 - RNA, 22 nt, Human
cagcccuggccucuucgcuuuc

SEQ ID NO: 131432 - RNA, 22 nt, Human
cagcgguggcaaggugacugug

SEQ ID NO: 131433 - RNA, 22 nt, Human
cagcaugcaaguccagaugugg

SEQ ID NO: 131434 - RNA, 22 nt, Human
cagcauggagacaaagugggca

SEQ ID NO: 131435 - RNA, 22 nt, Human
cagcauucuacuuugugaacug

SEQ ID NO: 131436 - RNA, 22 nt, Human
caggaacucggagcccaucucu

SEQ ID NO: 131437 - RNA, 22 nt, Human
cagccccaguuuucauaagacu

SEQ ID NO: 131438 - RNA, 22 nt, Human
cagagcagaaaccugggugauu

SEQ ID NO: 131439 - RNA, 22 nt, Human
cagcuucacuuaaaacaugcaa

SEQ ID NO: 131440 - RNA, 22 nt, Human
cagcuucaaaggcccugauggu

SEQ ID NO: 131441 - RNA, 22 nt, Human
cagcuauggaauuggcccagau

SEQ ID NO: 131442 - RNA, 22 nt, Human
cagccuacaucagaauaccaau

SEQ ID NO: 131443 - RNA, 22 nt, Human
caggccgccacugcagcagcug

SEQ ID NO: 131444 - RNA, 22 nt, Human
caggccccagggacugggcgcu

SEQ ID NO: 131445 - RNA, 22 nt, Human
caggaucccuggccuccgccca

SEQ ID NO: 131446 - RNA, 22 nt, Human
caggcgcauggugagcagauga

SEQ ID NO: 131447 - RNA, 22 nt, Human
cagggacgugagccaugucagu

SEQ ID NO: 131448 - RNA, 22 nt, Human
caggauuuaauaagauaguguu

SEQ ID NO: 131449 - RNA, 22 nt, Human
caggcacaagaucggcuagaua

SEQ ID NO: 131450 - RNA, 22 nt, Human
cagcuggaggagcagcuuccag

SEQ ID NO: 131451 - RNA, 22 nt, Human
cagcuggggagagacauggcag

SEQ ID NO: 131452 - RNA, 22 nt, Human
cagcugcugguguaucgggucc

SEQ ID NO: 131453 - RNA, 22 nt, Human
cagcugacaagaguccuuggag

SEQ ID NO: 131454 - RNA, 22 nt, Human
caggguuuuaguugcagguuau

SEQ ID NO: 131455 - RNA, 22 nt, Human
caggugcucugauauggggcug

SEQ ID NO: 131456 - RNA, 22 nt, Human
caggugccucugccccacgcgg

SEQ ID NO: 131457 - RNA, 22 nt, Human
cagcuucaugacaaacaguuuu

SEQ ID NO: 131458 - RNA, 22 nt, Human
aucugcugcuccuucuucuugc

SEQ ID NO: 131459 - RNA, 22 nt, Human
aucugcuguaguuggugccagu

SEQ ID NO: 131460 - RNA, 22 nt, Human
aucugugguacaugacggcugc

SEQ ID NO: 131461 - RNA, 19 nt, Human
auccuugcucacucacuga

SEQ ID NO: 131462 - RNA, 22 nt, Human
aucuucaaggacgccaagaucc

SEQ ID NO: 131463 - RNA, 22 nt, Human
aucuucaaagcacaucguuugu

SEQ ID NO: 131464 - RNA, 23 nt, Human
aucugagccuggucccacccgcu

SEQ ID NO: 131465 - RNA, 22 nt, Human
aucucccaaauuagccucuuga

SEQ ID NO: 131466 - RNA, 22 nt, Human
aucugcauguggcagguggauu

SEQ ID NO: 131467 - RNA, 22 nt, Human
aucucaaagauaugcugguaaa

SEQ ID NO: 131468 - RNA, 22 nt, Human
aucucagacucuccggguuccg

SEQ ID NO: 131469 - RNA, 22 nt, Human
aucucacuucugucauguggca

SEQ ID NO: 131470 - RNA, 22 nt, Human
aucuguuccccuaugcucucua

SEQ ID NO: 131471 - RNA, 22 nt, Human
aucugugauuuuggcaagauuu

SEQ ID NO: 131472 - RNA, 22 nt, Human
augaacugcaguauaaacuugg

SEQ ID NO: 131473 - RNA, 22 nt, Human
aucuuggauccuuugccagcuu

SEQ ID NO: 131474 - RNA, 22 nt, Human
augacagcucuagcacacagua

SEQ ID NO: 131475 - RNA, 22 nt, Human
aucuuggccuucuccuggagug

SEQ ID NO: 131476 - RNA, 19 nt, Human
augcacgugaaaugcauuu

SEQ ID NO: 131477 - RNA, 22 nt, Human
augcaggcuaagaguaaagacg

SEQ ID NO: 131478 - RNA, 22 nt, Human
augcaguuagguaauagucuca

SEQ ID NO: 131479 - RNA, 22 nt, Human
augcugcuccuuuucaggcauu

SEQ ID NO: 131480 - RNA, 22 nt, Human
augcccagaacccccuggaugg

SEQ ID NO: 131481 - RNA, 22 nt, Human
augauuuguuaacagacuuaau

SEQ ID NO: 131482 - RNA, 22 nt, Human
augccaccucuucugauuccag

SEQ ID NO: 131483 - RNA, 22 nt, Human
augccacuguuuaugucacuua

SEQ ID NO: 131484 - RNA, 22 nt, Human
auggagcagagcugaugggccu

SEQ ID NO: 131485 - RNA, 22 nt, Human
auggaggaugugcagcaugggc

SEQ ID NO: 131486 - RNA, 22 nt, Human
augcugccuccucuucagccgc

SEQ ID NO: 131487 - RNA, 22 nt, Human
auggaacauuaaucuucaaaug

SEQ ID NO: 131488 - RNA, 22 nt, Human
auggaacccgggcgucugcucu

SEQ ID NO: 131489 - RNA, 22 nt, Human
augggggccagggacccuggca

SEQ ID NO: 131490 - RNA, 22 nt, Human
auggagcgggaggauggaggag

SEQ ID NO: 131491 - RNA, 22 nt, Human
auggacguuuguguauuaugua

SEQ ID NO: 131492 - RNA, 22 nt, Human
augggcuuuacccucagagcuu

SEQ ID NO: 131493 - RNA, 22 nt, Human
auggaguguggccaggcaguaa

SEQ ID NO: 131494 - RNA, 22 nt, Human
auggagguuugucugguuuugu

SEQ ID NO: 131495 - RNA, 22 nt, Human
auggaggagcagaggguuucca

SEQ ID NO: 131496 - RNA, 22 nt, Human
auggauuggguugauggcauac

SEQ ID NO: 131497 - RNA, 22 nt, Human
auggccguggccagggucaggg

SEQ ID NO: 131498 - RNA, 22 nt, Human
auggcagcggagcuggaaauga

SEQ ID NO: 131499 - RNA, 22 nt, Human
auggcaucuucgguuggacugc

SEQ ID NO: 131500 - RNA, 22 nt, Human
augggcauggauggccgagucu

SEQ ID NO: 131501 - RNA, 22 nt, Human
auggaagagacaaugcuaucug

SEQ ID NO: 131502 - RNA, 22 nt, Human
auguaccgccuuggagaaaugc

SEQ ID NO: 131503 - RNA, 22 nt, Human
augguuacgcccucacccuacc

SEQ ID NO: 131504 - RNA, 22 nt, Human
augggucccuggccgcccucgg

SEQ ID NO: 131505 - RNA, 22 nt, Human
auguccccagacugcugugcag

SEQ ID NO: 131506 - RNA, 22 nt, Human
auggggucagagaauggugggu

SEQ ID NO: 131507 - RNA, 22 nt, Human
augggugggagugaaggggcuc

SEQ ID NO: 131508 - RNA, 22 nt, Human
auguccugguccacagaaggga

SEQ ID NO: 131509 - RNA, 22 nt, Human
auggggaggcggauggagugcu

SEQ ID NO: 131510 - RNA, 22 nt, Human
augggcggugcauuugcacagu

SEQ ID NO: 131511 - RNA, 19 nt, Human
augggaagcggccagcgga

SEQ ID NO: 131512 - RNA, 22 nt, Human
auggugaugaugaugaugauaa

SEQ ID NO: 131513 - RNA, 22 nt, Human
augugggguaggaggggggaau

SEQ ID NO: 131514 - RNA, 22 nt, Human
augugggugaggaggccauugu

SEQ ID NO: 131515 - RNA, 23 nt, Human
auguagcugcucccgaugcccuc

SEQ ID NO: 131516 - RNA, 22 nt, Human
augugcucaggucuauaucuca

SEQ ID NO: 131517 - RNA, 22 nt, Human
auuggcugucagcccggauggg

SEQ ID NO: 131518 - RNA, 22 nt, Human
auuucauccauuaagaguacuc

SEQ ID NO: 131519 - RNA, 22 nt, Human
auugcaggucguguggaaguga

SEQ ID NO: 131520 - RNA, 22 nt, Human
auuggccaguggacagcgccgu

SEQ ID NO: 131521 - RNA, 22 nt, Human
auuguucuagaauuuuuuuucc

SEQ ID NO: 131522 - RNA, 22 nt, Human
auugaagcauggagaugaggca

SEQ ID NO: 131523 - RNA, 22 nt, Human
caaaggauguguagugcaacca

SEQ ID NO: 131524 - RNA, 22 nt, Human
caaaguaggcuaagaccuucca

SEQ ID NO: 131525 - RNA, 22 nt, Human
caaaggagcccuuugccggguu

SEQ ID NO: 131526 - RNA, 22 nt, Human
auuuuugguuucaccugcacgc

SEQ ID NO: 131527 - RNA, 22 nt, Human
auuuuuucaugugugguugaga

SEQ ID NO: 131528 - RNA, 22 nt, Human
auuuuacuaugauaguugagaa

SEQ ID NO: 131529 - RNA, 22 nt, Human
auuuuaccauuaguuuguaaua

SEQ ID NO: 131530 - RNA, 22 nt, Human
auuuuggguguuaacaaugaaa

SEQ ID NO: 131531 - RNA, 22 nt, Human
auucugcaauaaucaguccuua

SEQ ID NO: 131532 - RNA, 22 nt, Human
auucuucauguugaagcuguca

SEQ ID NO: 131533 - RNA, 22 nt, Human
auugcauucaugcuccccuuag

SEQ ID NO: 131534 - RNA, 22 nt, Human
auugauuuugugcuuuccuacg

SEQ ID NO: 131535 - RNA, 22 nt, Human
auucguguauauacacauccac

SEQ ID NO: 131536 - RNA, 22 nt, Human
auucuccucaaaacaucugcug

SEQ ID NO: 131537 - RNA, 22 nt, Human
auucgcggcuugaucugcuugc

SEQ ID NO: 131538 - RNA, 22 nt, Human
auucgaucacugccgaggaccu

SEQ ID NO: 131539 - RNA, 22 nt, Human
auguugcugauccuguggcugu

SEQ ID NO: 131540 - RNA, 22 nt, Human
auguuguugaacucuuugcaug

SEQ ID NO: 131541 - RNA, 22 nt, Human
auucaccaucuugauccccucu

SEQ ID NO: 131542 - RNA, 22 nt, Human
auucuguugguuuaauagucaa

SEQ ID NO: 131543 - RNA, 17 nt, Human
uuugugauggcagaugc

SEQ ID NO: 131544 - RNA, 22 nt, Human
uuucagauuauguucauggguu

SEQ ID NO: 131545 - RNA, 22 nt, Human
uuucauggaggccaggacagag

SEQ ID NO: 131546 - RNA, 22 nt, Human
uuuccuucccuccugggccuuc

SEQ ID NO: 131547 - RNA, 22 nt, Human
uuucuuugggcccuggcagucu

SEQ ID NO: 131548 - RNA, 22 nt, Human
uuucugugguggguaguucaga

SEQ ID NO: 131549 - RNA, 22 nt, Human
uuucucugggugaugagguggc

SEQ ID NO: 131550 - RNA, 22 nt, Human
uuucugcuuucuaguugguguu

SEQ ID NO: 131551 - RNA, 22 nt, Human
uuugccggaucugucuccagcu

SEQ ID NO: 131552 - RNA, 22 nt, Human
uuugcugggaagccuucacucu

SEQ ID NO: 131553 - RNA, 22 nt, Human
uuugaugagaaaugacuuaagu

SEQ ID NO: 131554 - RNA, 22 nt, Human
uuugagugcccauguuucccag

SEQ ID NO: 131555 - RNA, 22 nt, Human
uuugagaaugucaaucacaaga

SEQ ID NO: 131556 - RNA, 22 nt, Human
uuuggucuggaaucuucagggu

SEQ ID NO: 131557 - RNA, 22 nt, Human
uuuggguuaguuuuccaaucuu

SEQ ID NO: 131558 - RNA, 22 nt, Human
uuugguguuuucaggaauauac

SEQ ID NO: 131559 - RNA, 22 nt, Human
uuuggcuccccaggaucugaaa

SEQ ID NO: 131560 - RNA, 22 nt, Human
uuuggcaccuccaaggacucgc

SEQ ID NO: 131561 - RNA, 22 nt, Human
uuuggccauuuguaugcaugau

SEQ ID NO: 131562 - RNA, 22 nt, Human
uuuggcuaccugggagggaaag

SEQ ID NO: 131563 - RNA, 22 nt, Human
uuuggcaagcagaugaagguag

SEQ ID NO: 131564 - RNA, 22 nt, Human
uuuggaugcugucauaugcugc

SEQ ID NO: 131565 - RNA, 22 nt, Human
uuguggcaggauggacagcaga

SEQ ID NO: 131566 - RNA, 18 nt, Human
uuuacgaacucacuugag

SEQ ID NO: 131567 - RNA, 22 nt, Human
uuuauuuggugguguuacuguu

SEQ ID NO: 131568 - RNA, 19 nt, Human
uuucacaaagagagcguga

SEQ ID NO: 131569 - RNA, 22 nt, Human
uuucacugaguaggagagcacu

SEQ ID NO: 131570 - RNA, 22 nt, Human
uuggaggcagagucuugcugag

SEQ ID NO: 131571 - RNA, 22 nt, Human
uuggaggccacagucaucuuua

SEQ ID NO: 131572 - RNA, 22 nt, Human
uuggaguucuucaugcucugua

SEQ ID NO: 131573 - RNA, 22 nt, Human
uuggccauuacugagccuggag

SEQ ID NO: 131574 - RNA, 22 nt, Human
uuggauguccucuguggaguau

SEQ ID NO: 131575 - RNA, 22 nt, Human
uuggauguggggauggaguggg

SEQ ID NO: 131576 - RNA, 22 nt, Human
uugauggaggaaaaguuggaau

SEQ ID NO: 131577 - RNA, 22 nt, Human
uuggcguuuccuguucugggug

SEQ ID NO: 131578 - RNA, 22 nt, Human
uuggaggucucugugguggugg

SEQ ID NO: 131579 - RNA, 22 nt, Human
uuggccaaggaccuuuuuggag

SEQ ID NO: 131580 - RNA, 22 nt, Human
uuggccuuacgcauggucggca

SEQ ID NO: 131581 - RNA, 22 nt, Human
uuggccuaggcacaggcaggug

SEQ ID NO: 131582 - RNA, 22 nt, Human
uugggcauuucuuauguauuuu

SEQ ID NO: 131583 - RNA, 22 nt, Human
uugggcuagaaacaacgugggu

SEQ ID NO: 131584 - RNA, 20 nt, Human
uuggggacaggagugugaug

SEQ ID NO: 131585 - RNA, 22 nt, Human
uuggugauugggaauggauggg

SEQ ID NO: 131586 - RNA, 22 nt, Human
uugguuccauuuuaccagcucu

SEQ ID NO: 131587 - RNA, 22 nt, Human
uugucagcuagugaugcuguuc

SEQ ID NO: 131588 - RNA, 22 nt, Human
uuguauuaauacacuccuuuuc

SEQ ID NO: 131589 - RNA, 22 nt, Human
uuguggacgcaauucaaggaua

SEQ ID NO: 131590 - RNA, 22 nt, Human
uucggcagaaagucauuugucu

SEQ ID NO: 131591 - RNA, 22 nt, Human
uucggugagcugcgggcgagga

SEQ ID NO: 131592 - RNA, 22 nt, Human
uuuuccgaccuuaggaaggaac

SEQ ID NO: 131593 - RNA, 22 nt, Human
uuuucuucucauucugaccuca

SEQ ID NO: 131594 - RNA, 22 nt, Human
uuuugccuauuguaucaucgua

SEQ ID NO: 131595 - RNA, 22 nt, Human
uucuugcgaaagaaugagcuga

SEQ ID NO: 131596 - RNA, 22 nt, Human
uucuucgacuguauaaaaguau

SEQ ID NO: 131597 - RNA, 22 nt, Human
uucuuuguccuagcauucuaca

SEQ ID NO: 131598 - RNA, 22 nt, Human
uugauagauuuuagaggcaggc

SEQ ID NO: 131599 - RNA, 22 nt, Human
uugaugacuaaagaaagcugcu

SEQ ID NO: 131600 - RNA, 22 nt, Human
uugaccagaaaaguuaguaauu

SEQ ID NO: 131601 - RNA, 22 nt, Human
uugaccauguggcccaggccaa

SEQ ID NO: 131602 - RNA, 20 nt, Human
uucacggaggccgcgccccc

SEQ ID NO: 131603 - RNA, 22 nt, Human
uucaccucuuuuuggggacauc

SEQ ID NO: 131604 - RNA, 22 nt, Human
uucacguuguugaagaaaauac

SEQ ID NO: 131605 - RNA, 23 nt, Human
uucaccaaugcuguccaaguacc

SEQ ID NO: 131606 - RNA, 22 nt, Human
uuugauuuuuugagcaguguau

SEQ ID NO: 131607 - RNA, 22 nt, Human
uuuauuugggauuucucaucug

SEQ ID NO: 131608 - RNA, 20 nt, Human
uucacagaggacucagguca

SEQ ID NO: 131609 - RNA, 22 nt, Human
uucagcauaggcugcucuucaa

SEQ ID NO: 131610 - RNA, 22 nt, Human
uucagcacuggacagcgagucu

SEQ ID NO: 131611 - RNA, 23 nt, Human
uucagcucuccugaagcaucugu

SEQ ID NO: 131612 - RNA, 22 nt, Human
uuugcuguaaugcaugucagag

SEQ ID NO: 131613 - RNA, 20 nt, Human
uucaggaccuuccaguccau

SEQ ID NO: 131614 - RNA, 22 nt, Human
uuuggcgucucucaggagcuca

SEQ ID NO: 131615 - RNA, 22 nt, Human
uucccgcugcuggaguuggggc

SEQ ID NO: 131616 - RNA, 22 nt, Human
uuuguugguugcacuggugggu

SEQ ID NO: 131617 - RNA, 22 nt, Human
uucccagggaucucuaguauuu

SEQ ID NO: 131618 - RNA, 22 nt, Human
uuccaaggagagcucgaccuca

SEQ ID NO: 131619 - RNA, 22 nt, Human
uuccucauuuggcacaucugag

SEQ ID NO: 131620 - RNA, 20 nt, Human
uuccucaaaagucugaugcu

SEQ ID NO: 131621 - RNA, 22 nt, Human
uuccuggaguggagggagguga

SEQ ID NO: 131622 - RNA, 22 nt, Human
uuccuucccccuucuuugccuu

SEQ ID NO: 131623 - RNA, 22 nt, Human
uucgcggccaggcggggaggcc

SEQ ID NO: 131624 - RNA, 17 nt, Human
uguguauucuccaggug

SEQ ID NO: 131625 - RNA, 22 nt, Human
ugugugcacguacauacuguau

SEQ ID NO: 131626 - RNA, 22 nt, Human
uguguguguccucauuugcaga

SEQ ID NO: 131627 - RNA, 22 nt, Human
uuggauugugaaaguauucucu

SEQ ID NO: 131628 - RNA, 23 nt, Human
ugugugugugugugugugugugu

SEQ ID NO: 131629 - RNA, 22 nt, Human
uguguguguguguguaauauau

SEQ ID NO: 131630 - RNA, 22 nt, Human
uguguguguuguaugaaauuuu

SEQ ID NO: 131631 - RNA, 19 nt, Human
uguguguguuuuguuugaa

SEQ ID NO: 131632 - RNA, 22 nt, Human
uuggagaaagcugcaggcucug

SEQ ID NO: 131633 - RNA, 21 nt, Human
uguguaccuucuuccgagcuc

SEQ ID NO: 131634 - RNA, 22 nt, Human
uguguauguauguauguaugua

SEQ ID NO: 131635 - RNA, 22 nt, Human
uuggaagagagauggggagaga

SEQ ID NO: 131636 - RNA, 20 nt, Human
uugcggccuaacagccccuu

SEQ ID NO: 131637 - RNA, 22 nt, Human
uugcggauguccacgucacacu

SEQ ID NO: 131638 - RNA, 22 nt, Human
uguuccacgcguaguuccugcu

SEQ ID NO: 131639 - RNA, 22 nt, Human
uguucaguuugcuaucauaauc

SEQ ID NO: 131640 - RNA, 22 nt, Human
uguucggaaaagggcaagcuau

SEQ ID NO: 131641 - RNA, 22 nt, Human
uguuccuggggaccugccuucc

SEQ ID NO: 131642 - RNA, 22 nt, Human
uguuccuuuuguuguuuuguuu

SEQ ID NO: 131643 - RNA, 22 nt, Human
uguguucagaagaggcugccgg

SEQ ID NO: 131644 - RNA, 22 nt, Human
uuggcaaaaauacuguaggccu

SEQ ID NO: 131645 - RNA, 22 nt, Human
uuggcauuccagaugcuuuucu

SEQ ID NO: 131646 - RNA, 22 nt, Human
uuggccaaaaaagucauuagaa

SEQ ID NO: 131647 - RNA, 22 nt, Human
uuggcaggcugcauguuuaugu

SEQ ID NO: 131648 - RNA, 22 nt, Human
uguuguucuuuuucuucuuguu

SEQ ID NO: 131649 - RNA, 22 nt, Human
uguuguuguuguuguuguuguu

SEQ ID NO: 131650 - RNA, 22 nt, Human
uuggggaugccccuacgggcua

SEQ ID NO: 131651 - RNA, 22 nt, Human
uuggggauugggugcaagggac

SEQ ID NO: 131652 - RNA, 22 nt, Human
uuggggccggcgcggaggaggg

SEQ ID NO: 131653 - RNA, 22 nt, Human
uugggggccuccuguuccccca

SEQ ID NO: 131654 - RNA, 22 nt, Human
uuggggggucagacuugauaca

SEQ ID NO: 131655 - RNA, 22 nt, Human
uugggucagcuuucagguagua

SEQ ID NO: 131656 - RNA, 22 nt, Human
uuggguguugguuccugggagg

SEQ ID NO: 131657 - RNA, 22 nt, Human
uugguugcugaugagcuuugag

SEQ ID NO: 131658 - RNA, 22 nt, Human
uuggucaagacugauaucaaga

SEQ ID NO: 131659 - RNA, 22 nt, Human
uugugacaauacagcauggaga

SEQ ID NO: 131660 - RNA, 22 nt, Human
uugugcucaguuguggucuauu

SEQ ID NO: 131661 - RNA, 22 nt, Human
uuggguagguccuucacggaua

SEQ ID NO: 131662 - RNA, 22 nt, Human
uugugcagugccuggacccagg

SEQ ID NO: 131663 - RNA, 23 nt, Human
uugugcggugcuuuggguuuaca

SEQ ID NO: 131664 - RNA, 22 nt, Human
uuagggacagcucuguagguga

SEQ ID NO: 131665 - RNA, 22 nt, Human
uuguuuacuugagcugcacucu

SEQ ID NO: 131666 - RNA, 22 nt, Human
uuguuucauggggacgacuggc

SEQ ID NO: 131667 - RNA, 22 nt, Human
uuguuccagaaacccaggggaa

SEQ ID NO: 131668 - RNA, 22 nt, Human
uugugugugcccaccuguggcc

SEQ ID NO: 131669 - RNA, 22 nt, Human
uugagcagccauuagcuggggu

SEQ ID NO: 131670 - RNA, 22 nt, Human
uugaggguggauugucagggga

SEQ ID NO: 131671 - RNA, 22 nt, Human
uugaggcugaucacuccuauaa

SEQ ID NO: 131672 - RNA, 22 nt, Human
ugucccuggacuccaggagcca

SEQ ID NO: 131673 - RNA, 20 nt, Human
ugucugguaagacgcccauc

SEQ ID NO: 131674 - RNA, 22 nt, Human
ugucugggauguuggcagccac

SEQ ID NO: 131675 - RNA, 22 nt, Human
uugauuuggcguuuuccuccug

SEQ ID NO: 131676 - RNA, 20 nt, Human
uugcaaagugaauagcaauu

SEQ ID NO: 131677 - RNA, 22 nt, Human
ugucugucugccauuuauucuc

SEQ ID NO: 131678 - RNA, 22 nt, Human
ugucuucagguuccucaccacu

SEQ ID NO: 131679 - RNA, 22 nt, Human
ugugccuguugguguagacaua

SEQ ID NO: 131680 - RNA, 22 nt, Human
uugcccccuguccuucccugua

SEQ ID NO: 131681 - RNA, 22 nt, Human
uugcaucaaauauguaccacag

SEQ ID NO: 131682 - RNA, 22 nt, Human
uugcauauguccagccaugcau

SEQ ID NO: 131683 - RNA, 22 nt, Human
ugguugcaguggugcuuauaca

SEQ ID NO: 131684 - RNA, 22 nt, Human
ugguugauuaauuuugccaagc

SEQ ID NO: 131685 - RNA, 22 nt, Human
uggugcccguggaaagagggag

SEQ ID NO: 131686 - RNA, 19 nt, Human
uggugcgcuguuccugagc

SEQ ID NO: 131687 - RNA, 22 nt, Human
uggugccuuccgagagcuguga

SEQ ID NO: 131688 - RNA, 22 nt, Human
uggugaggacccagauuuuccu

SEQ ID NO: 131689 - RNA, 22 nt, Human
uggucggugguguggggaggca

SEQ ID NO: 131690 - RNA, 22 nt, Human
ugguccuuuccauuggagacac

SEQ ID NO: 131691 - RNA, 22 nt, Human
uggugacaucuaccuagguaaa

SEQ ID NO: 131692 - RNA, 22 nt, Human
uggugugggauccugggaagga

SEQ ID NO: 131693 - RNA, 23 nt, Human
uggugugaggaaggaagacuuua

SEQ ID NO: 131694 - RNA, 22 nt, Human
ugguuacagaugaagaucggcc

SEQ ID NO: 131695 - RNA, 22 nt, Human
uucuuugcucaccugccgcucc

SEQ ID NO: 131696 - RNA, 22 nt, Human
ugguguccccugaguuucuauc

SEQ ID NO: 131697 - RNA, 19 nt, Human
ugguggaggugcaccugac

SEQ ID NO: 131698 - RNA, 22 nt, Human
uucuucuguuggcagagcauac

SEQ ID NO: 131699 - RNA, 22 nt, Human
uucuucuucuuccucauccuca

SEQ ID NO: 131700 - RNA, 22 nt, Human
uucuccucaaaccaucagacau

SEQ ID NO: 131701 - RNA, 22 nt, Human
uucuccugcccuuggacuucca

SEQ ID NO: 131702 - RNA, 22 nt, Human
uucuccacguucuucucggccu

SEQ ID NO: 131703 - RNA, 22 nt, Human
ugggucacuggccaagcucgac

SEQ ID NO: 131704 - RNA, 22 nt, Human
uggggcggaaggaggagaggug

SEQ ID NO: 131705 - RNA, 22 nt, Human
uggggcuggccaggaggagucu

SEQ ID NO: 131706 - RNA, 22 nt, Human
uggguguuccuggggugcaagg

SEQ ID NO: 131707 - RNA, 22 nt, Human
ugggugugggguaggguaagag

SEQ ID NO: 131708 - RNA, 22 nt, Human
ugggugccgcaucuugcuguuc

SEQ ID NO: 131709 - RNA, 23 nt, Human
uggguuucagugccaaugcugcc

SEQ ID NO: 131710 - RNA, 20 nt, Human
uggguucaguuguuucuggc

SEQ ID NO: 131711 - RNA, 17 nt, Human
uucugcucaggaacaga

SEQ ID NO: 131712 - RNA, 18 nt, Human
uucugcggugacagauau

SEQ ID NO: 131713 - RNA, 20 nt, Human
uucugcucuagagucuagaa

SEQ ID NO: 131714 - RNA, 22 nt, Human
uucuggacuuccaaauggcuuc

SEQ ID NO: 131715 - RNA, 22 nt, Human
uucuggagacccagcaacaggg

SEQ ID NO: 131716 - RNA, 22 nt, Human
ugguccaccgccucauucucug

SEQ ID NO: 131717 - RNA, 22 nt, Human
ugguccaaaccagugcuguggu

SEQ ID NO: 131718 - RNA, 22 nt, Human
ugguaugaaggaggccggcagc

SEQ ID NO: 131719 - RNA, 22 nt, Human
uucuguacuagaucuuaucagu

SEQ ID NO: 131720 - RNA, 22 nt, Human
uucuggaguuugaagaucaggu

SEQ ID NO: 131721 - RNA, 22 nt, Human
uggagccagcaggacucagagg

SEQ ID NO: 131722 - RNA, 22 nt, Human
uggagcugaaguacucucacua

SEQ ID NO: 131723 - RNA, 22 nt, Human
uuccaugccuaagagccugaag

SEQ ID NO: 131724 - RNA, 22 nt, Human
uuccaagcaccaugaaggccuc

SEQ ID NO: 131725 - RNA, 22 nt, Human
uggcugagcugcagcguggcuu

SEQ ID NO: 131726 - RNA, 22 nt, Human
uggcugaggcuuuucuuaaaga

SEQ ID NO: 131727 - RNA, 22 nt, Human
uggcugggagcuggaacugggc

SEQ ID NO: 131728 - RNA, 22 nt, Human
uggcuuuuuucuccccuuggau

SEQ ID NO: 131729 - RNA, 22 nt, Human
uuccugcuggucaaaguugccu

SEQ ID NO: 131730 - RNA, 22 nt, Human
uucccggccgccccccgcucgg

SEQ ID NO: 131731 - RNA, 22 nt, Human
uucccuuggcuuugauuguguu

SEQ ID NO: 131732 - RNA, 22 nt, Human
uuccgcuuucaauggcuuggcu

SEQ ID NO: 131733 - RNA, 22 nt, Human
uucgcucuucacacagugcuga

SEQ ID NO: 131734 - RNA, 22 nt, Human
uucgucauuaugcagccuguga

SEQ ID NO: 131735 - RNA, 22 nt, Human
uucgucaauaugcagccuguga

SEQ ID NO: 131736 - RNA, 18 nt, Human
uucgucauggggaucgua

SEQ ID NO: 131737 - RNA, 22 nt, Human
uggggccaggcuguuggcuucc

SEQ ID NO: 131738 - RNA, 21 nt, Human
uuccuggaggcagaaacguga

SEQ ID NO: 131739 - RNA, 22 nt, Human
uuccuguggggugucaucauag

SEQ ID NO: 131740 - RNA, 22 nt, Human
uguuggugcacugaaaggcagg

SEQ ID NO: 131741 - RNA, 18 nt, Human
uguugguguucacucacu

SEQ ID NO: 131742 - RNA, 21 nt, Human
uguugguugugggaaggagga

SEQ ID NO: 131743 - RNA, 22 nt, Human
uguguguguguguaugugcgug

SEQ ID NO: 131744 - RNA, 22 nt, Human
ugugugugugugugugugugug

SEQ ID NO: 131745 - RNA, 22 nt, Human
uguguguguauacauguauaua

SEQ ID NO: 131746 - RNA, 22 nt, Human
ugccuguguuugggguggggaa

SEQ ID NO: 131747 - RNA, 22 nt, Human
ugcucgggcuccuuugagugag

SEQ ID NO: 131748 - RNA, 22 nt, Human
ugcucugguccucccucggcgc

SEQ ID NO: 131749 - RNA, 22 nt, Human
ugcucgauuauuucauuuugca

SEQ ID NO: 131750 - RNA, 23 nt, Human
ugcucgccuucaggacuugggcu

SEQ ID NO: 131751 - RNA, 22 nt, Human
ugcugaccggccuccccccagc

SEQ ID NO: 131752 - RNA, 19 nt, Human
ugcugcaggaauucucaag

SEQ ID NO: 131753 - RNA, 22 nt, Human
ugcugccgccgccaccgccgcc

SEQ ID NO: 131754 - RNA, 22 nt, Human
uguuuaagugguuaaaggauuc

SEQ ID NO: 131755 - RNA, 22 nt, Human
uguuugaugugcacgugugugu

SEQ ID NO: 131756 - RNA, 22 nt, Human
uguuuucuuuccccuucuuuuc

SEQ ID NO: 131757 - RNA, 22 nt, Human
ugcugcggcgcaggcacuccag

SEQ ID NO: 131758 - RNA, 22 nt, Human
ugcugcucuucaccauggccuc

SEQ ID NO: 131759 - RNA, 22 nt, Human
ugcugcuguuaucauuuuacca

SEQ ID NO: 131760 - RNA, 22 nt, Human
ugcuguacaagacccucuguuu

SEQ ID NO: 131761 - RNA, 22 nt, Human
ugcuggagucucuugacccugg

SEQ ID NO: 131762 - RNA, 22 nt, Human
ugcuggaguggcacuguguggc

SEQ ID NO: 131763 - RNA, 22 nt, Human
ugcuugacucagcaucggcaau

SEQ ID NO: 131764 - RNA, 22 nt, Human
ugcuugaggcuugucaucuaac

SEQ ID NO: 131765 - RNA, 22 nt, Human
ugcuugugcacacacauguuau

SEQ ID NO: 131766 - RNA, 20 nt, Human
ugcugugugucuacuguggg

SEQ ID NO: 131767 - RNA, 20 nt, Human
ugcuguggguaagcuuuaua

SEQ ID NO: 131768 - RNA, 22 nt, Human
ugcuguugacuuuguuguucuu

SEQ ID NO: 131769 - RNA, 22 nt, Human
ugcuuacgcaaccuguguuugg

SEQ ID NO: 131770 - RNA, 22 nt, Human
uggaagcuagggguuucuguug

SEQ ID NO: 131771 - RNA, 22 nt, Human
uggaagcccagaaggaagcaga

SEQ ID NO: 131772 - RNA, 22 nt, Human
uggaagaagcuacaagcgguga

SEQ ID NO: 131773 - RNA, 23 nt, Human
uggaagaaaaugguuuggcugug

SEQ ID NO: 131774 - RNA, 22 nt, Human
uggaagggguuacgcagcagga

SEQ ID NO: 131775 - RNA, 22 nt, Human
uggaaggggagcuggaaagggg

SEQ ID NO: 131776 - RNA, 22 nt, Human
uggaaggaaauguguaucauaa

SEQ ID NO: 131777 - RNA, 22 nt, Human
uggaaugccgggccaggcuccg

SEQ ID NO: 131778 - RNA, 21 nt, Human
uggaauuggaaaccauucuau

SEQ ID NO: 131779 - RNA, 22 nt, Human
uggacagguacuucacauuauu

SEQ ID NO: 131780 - RNA, 22 nt, Human
uggacagugguggggaggagga

SEQ ID NO: 131781 - RNA, 22 nt, Human
uggagaugcacgagcaggugga

SEQ ID NO: 131782 - RNA, 22 nt, Human
uggacuguaauguguguggacc

SEQ ID NO: 131783 - RNA, 22 nt, Human
uggaaaugcuuagaggugaucu

SEQ ID NO: 131784 - RNA, 22 nt, Human
uuagaugcugugauuuuucaaa

SEQ ID NO: 131785 - RNA, 22 nt, Human
uggaacuuccucacuuucccuc

SEQ ID NO: 131786 - RNA, 22 nt, Human
uggaaauagauguaggaaauug

SEQ ID NO: 131787 - RNA, 22 nt, Human
ugcuuguuuguuuucuuccauu

SEQ ID NO: 131788 - RNA, 22 nt, Human
ugcuuguuuuguggcuucagcu

SEQ ID NO: 131789 - RNA, 22 nt, Human
uuaccugccucaaacacgaaug

SEQ ID NO: 131790 - RNA, 21 nt, Human
ugcuuuuguugucagcugcug

SEQ ID NO: 131791 - RNA, 21 nt, Human
uuacuggcagcagaaaccuga

SEQ ID NO: 131792 - RNA, 22 nt, Human
uggaaaagaugucuuccugaau

SEQ ID NO: 131793 - RNA, 22 nt, Human
uggguagcucaauagagccaca

SEQ ID NO: 131794 - RNA, 22 nt, Human
ugacgcauggccagcucugucu

SEQ ID NO: 131795 - RNA, 22 nt, Human
ugaccuccuaagugacagaauu

SEQ ID NO: 131796 - RNA, 22 nt, Human
ugaccucaagcaugcggagggc

SEQ ID NO: 131797 - RNA, 22 nt, Human
uggcucaguaaucgagucuccu

SEQ ID NO: 131798 - RNA, 22 nt, Human
uggguggauucgggaacuuguu

SEQ ID NO: 131799 - RNA, 22 nt, Human
ugggugggcagagucuaagaua

SEQ ID NO: 131800 - RNA, 22 nt, Human
ugggugaugagguccccagccc

SEQ ID NO: 131801 - RNA, 22 nt, Human
uggguggugaaauggaugggaa

SEQ ID NO: 131802 - RNA, 22 nt, Human
ugggugugcaccuacgaucucu

SEQ ID NO: 131803 - RNA, 19 nt, Human
ugacuggguucuaggcagg

SEQ ID NO: 131804 - RNA, 22 nt, Human
uggguguggaagcagcgugggg

SEQ ID NO: 131805 - RNA, 22 nt, Human
ugacugguauuuguaaaccaua

SEQ ID NO: 131806 - RNA, 22 nt, Human
uggguguguccauauuuugacu

SEQ ID NO: 131807 - RNA, 22 nt, Human
ugagacucuccugugcagccuc

SEQ ID NO: 131808 - RNA, 22 nt, Human
ugguagcaggugcuaaaggccu

SEQ ID NO: 131809 - RNA, 22 nt, Human
ugagagguagaacuuguagugu

SEQ ID NO: 131810 - RNA, 22 nt, Human
ugagagcuccacaccuugcccu

SEQ ID NO: 131811 - RNA, 22 nt, Human
uggucacgucgggguauugcca

SEQ ID NO: 131812 - RNA, 22 nt, Human
uggucccugaagagagaccuug

SEQ ID NO: 131813 - RNA, 21 nt, Human
ugguccaaggacucauaccug

SEQ ID NO: 131814 - RNA, 22 nt, Human
uggucaagcaaugaauuuauuu

SEQ ID NO: 131815 - RNA, 22 nt, Human
uggucacagauuuacaggaaug

SEQ ID NO: 131816 - RNA, 22 nt, Human
ugguaacgguuuccuugccauu

SEQ ID NO: 131817 - RNA, 22 nt, Human
uggguucugaucccaggacugc

SEQ ID NO: 131818 - RNA, 22 nt, Human
uggguucaaauccugguuccac

SEQ ID NO: 131819 - RNA, 20 nt, Human
ugguguacauuuccauaguu

SEQ ID NO: 131820 - RNA, 22 nt, Human
ugguggcuuuucguagguucac

SEQ ID NO: 131821 - RNA, 22 nt, Human
ugguggccucaguggcuucugu

SEQ ID NO: 131822 - RNA, 22 nt, Human
uggucugggaagaucacaauua

SEQ ID NO: 131823 - RNA, 22 nt, Human
ugaggaugagaaggaagagaag

SEQ ID NO: 131824 - RNA, 22 nt, Human
ugaggaggugcuaccagcgucu

SEQ ID NO: 131825 - RNA, 22 nt, Human
ugaggaggugggcacacagagu

SEQ ID NO: 131826 - RNA, 22 nt, Human
ugguucggcuguaaguauaucu

SEQ ID NO: 131827 - RNA, 22 nt, Human
ugguucugccacuuuccccuug

SEQ ID NO: 131828 - RNA, 22 nt, Human
ugguucacaagaauccagguag

SEQ ID NO: 131829 - RNA, 20 nt, Human
ugguguccuaugcuugugcu

SEQ ID NO: 131830 - RNA, 22 nt, Human
ugagcaccaggcaccacagcuc

SEQ ID NO: 131831 - RNA, 22 nt, Human
uggugcucucgauauauaaggc

SEQ ID NO: 131832 - RNA, 22 nt, Human
uggugcuuuuguggaugcuaac

SEQ ID NO: 131833 - RNA, 22 nt, Human
uggugcucuugauauauaaggc

SEQ ID NO: 131834 - RNA, 22 nt, Human
uggucugauggucccaccaccg

SEQ ID NO: 131835 - RNA, 22 nt, Human
ugguccucacccuacccagcug

SEQ ID NO: 131836 - RNA, 22 nt, Human
ugguccgagaacuguccugguu

SEQ ID NO: 131837 - RNA, 22 nt, Human
ugagcagagcacuugggaacga

SEQ ID NO: 131838 - RNA, 22 nt, Human
ugagucaccucucagaagccac

SEQ ID NO: 131839 - RNA, 22 nt, Human
ugagugcuuuucgguguaccgu

SEQ ID NO: 131840 - RNA, 22 nt, Human
ugguucugucugugcugggggg

SEQ ID NO: 131841 - RNA, 22 nt, Human
ugguuuccugauggacacuugg

SEQ ID NO: 131842 - RNA, 22 nt, Human
ugaucaacagggcuggaaagag

SEQ ID NO: 131843 - RNA, 20 nt, Human
ugauaugcgguacagagagg

SEQ ID NO: 131844 - RNA, 22 nt, Human
ugucagccacggugugaccggc

SEQ ID NO: 131845 - RNA, 23 nt, Human
ugucacugcggaguggccugcag

SEQ ID NO: 131846 - RNA, 20 nt, Human
ugucccuggagagcugcaga

SEQ ID NO: 131847 - RNA, 22 nt, Human
uguccuauuugugauaggugac

SEQ ID NO: 131848 - RNA, 21 nt, Human
uguccucggaucaguccacaa

SEQ ID NO: 131849 - RNA, 22 nt, Human
ugauuugguauccaggauuuaa

SEQ ID NO: 131850 - RNA, 22 nt, Human
ugauuuggcaucaguguauccu

SEQ ID NO: 131851 - RNA, 22 nt, Human
ugucacaccuggcgauaauggg

SEQ ID NO: 131852 - RNA, 22 nt, Human
ugauuuagguauuuucuuuugu

SEQ ID NO: 131853 - RNA, 22 nt, Human
ugaugaugccaaaauuuggcau

SEQ ID NO: 131854 - RNA, 22 nt, Human
ugcagaacacaguagacagaac

SEQ ID NO: 131855 - RNA, 22 nt, Human
ugcagaauauucuggugacaau

SEQ ID NO: 131856 - RNA, 21 nt, Human
ugcaaugcauugacagcagca

SEQ ID NO: 131857 - RNA, 22 nt, Human
ugucugauccuucaggagcccc

SEQ ID NO: 131858 - RNA, 22 nt, Human
ugucugaauuguaauguugcgu

SEQ ID NO: 131859 - RNA, 19 nt, Human
ugugaagaccucagugcgg

SEQ ID NO: 131860 - RNA, 22 nt, Human
ugugagucuugcaggucgcuca

SEQ ID NO: 131861 - RNA, 22 nt, Human
ugugagccuuuauuaaccucau

SEQ ID NO: 131862 - RNA, 22 nt, Human
ugugacugaaaaugauugagug

SEQ ID NO: 131863 - RNA, 22 nt, Human
ugccagcuccgaggagcugcag

SEQ ID NO: 131864 - RNA, 22 nt, Human
ugcauuacuuugauaagcgucu

SEQ ID NO: 131865 - RNA, 22 nt, Human
ugcauguuucuguauguuaaug

SEQ ID NO: 131866 - RNA, 22 nt, Human
ugcauguuuuaagugaagcuga

SEQ ID NO: 131867 - RNA, 22 nt, Human
ugcccccggcugcccaggggaa

SEQ ID NO: 131868 - RNA, 22 nt, Human
ugccccagcacauuuacuaucc

SEQ ID NO: 131869 - RNA, 22 nt, Human
ugccccuggaggagagcaaugg

SEQ ID NO: 131870 - RNA, 20 nt, Human
ugccagagagcucauacccu

SEQ ID NO: 131871 - RNA, 22 nt, Human
ugccaauuaccuauuucugaga

SEQ ID NO: 131872 - RNA, 22 nt, Human
ugccccuugccaggccucugcc

SEQ ID NO: 131873 - RNA, 22 nt, Human
ugcccugucccuagguuugugg

SEQ ID NO: 131874 - RNA, 22 nt, Human
ugcccugcagacccugcagugu

SEQ ID NO: 131875 - RNA, 22 nt, Human
ugccgccccggggcccccagcc

SEQ ID NO: 131876 - RNA, 22 nt, Human
ugugucgccaacaauugugucu

SEQ ID NO: 131877 - RNA, 22 nt, Human
ugccgggcugagcaagugcugc

SEQ ID NO: 131878 - RNA, 22 nt, Human
ugccgccgugggucccgacgcg

SEQ ID NO: 131879 - RNA, 22 nt, Human
uguguggccuccauaggguacu

SEQ ID NO: 131880 - RNA, 22 nt, Human
uguguggaggugggugaugucu

SEQ ID NO: 131881 - RNA, 22 nt, Human
ugugucuuuggcgaugucugga

SEQ ID NO: 131882 - RNA, 22 nt, Human
ugugugcuaguuuugucaguau

SEQ ID NO: 131883 - RNA, 22 nt, Human
ugcagcgugaggacagcugagc

SEQ ID NO: 131884 - RNA, 22 nt, Human
ugugauugcauugcagauuacu

SEQ ID NO: 131885 - RNA, 22 nt, Human
ugugcuggcuucugugagcuga

SEQ ID NO: 131886 - RNA, 22 nt, Human
ugcagugcagcuggaauaucuu

SEQ ID NO: 131887 - RNA, 22 nt, Human
ugcagugcagcuggaaguuggc

SEQ ID NO: 131888 - RNA, 22 nt, Human
ugcagugaugcuucuggcucag

SEQ ID NO: 131889 - RNA, 22 nt, Human
ugugcuugucguggagccaggc

SEQ ID NO: 131890 - RNA, 22 nt, Human
ugcaucauuaagguacaguugg

SEQ ID NO: 131891 - RNA, 22 nt, Human
uguggcaauauggaauguguuu

SEQ ID NO: 131892 - RNA, 22 nt, Human
ugcaucugagcacuacggugga

SEQ ID NO: 131893 - RNA, 22 nt, Human
ugcaucccugaggcauuauccu

SEQ ID NO: 131894 - RNA, 22 nt, Human
ugcaugcagcuggucgggcgcc

SEQ ID NO: 131895 - RNA, 17 nt, Human
ugcaugcgucugugaua

SEQ ID NO: 131896 - RNA, 22 nt, Human
ugcaugaucucacuuacaggug

SEQ ID NO: 131897 - RNA, 22 nt, Human
ucugcacagcucaccucccugg

SEQ ID NO: 131898 - RNA, 22 nt, Human
ucugauucucuuguugaccuag

SEQ ID NO: 131899 - RNA, 22 nt, Human
ucugauucauucugguaaaugg

SEQ ID NO: 131900 - RNA, 22 nt, Human
ucugaucagaagacaaaugagg

SEQ ID NO: 131901 - RNA, 22 nt, Human
ucugcgggccuggcucccagcg

SEQ ID NO: 131902 - RNA, 22 nt, Human
ucugcguggcgugguucugugc

SEQ ID NO: 131903 - RNA, 22 nt, Human
uggaagcuggcugaucugacuu

SEQ ID NO: 131904 - RNA, 22 nt, Human
ucuggcaguugccgcuucaguc

SEQ ID NO: 131905 - RNA, 21 nt, Human
ucuggccuauaaaguagucgc

SEQ ID NO: 131906 - RNA, 20 nt, Human
ucugcuugucuucagguucc

SEQ ID NO: 131907 - RNA, 17 nt, Human
ucuggguuucugauuua

SEQ ID NO: 131908 - RNA, 22 nt, Human
ucuggucugccgagauccauuu

SEQ ID NO: 131909 - RNA, 22 nt, Human
ucuggguuuccuucacaagcac

SEQ ID NO: 131910 - RNA, 22 nt, Human
ucugggucuaucccaugccuuu

SEQ ID NO: 131911 - RNA, 22 nt, Human
ucugguuccugcauucauucaa

SEQ ID NO: 131912 - RNA, 22 nt, Human
uggaaggugauucucugguuaa

SEQ ID NO: 131913 - RNA, 22 nt, Human
uggaagugggcaucaccaucca

SEQ ID NO: 131914 - RNA, 22 nt, Human
uggaaguggcaggggagacgua

SEQ ID NO: 131915 - RNA, 22 nt, Human
uggaagucuucucucccaugga

SEQ ID NO: 131916 - RNA, 22 nt, Human
uggagucucacuuccuggaauu

SEQ ID NO: 131917 - RNA, 22 nt, Human
ucugugcuccuuccuugucauc

SEQ ID NO: 131918 - RNA, 22 nt, Human
ucugucucugucaggcugcugc

SEQ ID NO: 131919 - RNA, 20 nt, Human
ucuguggcagguggcgcuug

SEQ ID NO: 131920 - RNA, 17 nt, Human
ucuguguccgcucaguc

SEQ ID NO: 131921 - RNA, 22 nt, Human
uggccgaugagcaugcgcugau

SEQ ID NO: 131922 - RNA, 20 nt, Human
uggcccgcgcuccuccugcu

SEQ ID NO: 131923 - RNA, 21 nt, Human
uggccaaggaauagaagcucu

SEQ ID NO: 131924 - RNA, 22 nt, Human
uggcaucacagacaaggcagca

SEQ ID NO: 131925 - RNA, 22 nt, Human
ucuugcucuguucuaaaggauu

SEQ ID NO: 131926 - RNA, 22 nt, Human
uggcgcucacccugcggcccug

SEQ ID NO: 131927 - RNA, 22 nt, Human
uggcggcggggagguaggcaga

SEQ ID NO: 131928 - RNA, 22 nt, Human
uggcucaggccuacgacgccuu

SEQ ID NO: 131929 - RNA, 22 nt, Human
uggcuacguacaauggaacuuu

SEQ ID NO: 131930 - RNA, 22 nt, Human
uggcucacaggaggcagaggug

SEQ ID NO: 131931 - RNA, 22 nt, Human
uggcgugaagcuggaaggcgga

SEQ ID NO: 131932 - RNA, 22 nt, Human
uggcaaggccacaggugcaguu

SEQ ID NO: 131933 - RNA, 22 nt, Human
ucuucaucucuaaaaugggaac

SEQ ID NO: 131934 - RNA, 22 nt, Human
uggcagugggaagcuggaaguc

SEQ ID NO: 131935 - RNA, 22 nt, Human
ucuucccgggcaucucugcuca

SEQ ID NO: 131936 - RNA, 22 nt, Human
uggaucuugaugcuccaagagu

SEQ ID NO: 131937 - RNA, 22 nt, Human
uggaucaugcgaggccuccccu

SEQ ID NO: 131938 - RNA, 20 nt, Human
uggaugacuucaggcagccu

SEQ ID NO: 131939 - RNA, 22 nt, Human
ucuucagacuguuguucuuuug

SEQ ID NO: 131940 - RNA, 20 nt, Human
ucuucagcuccaagucuggc

SEQ ID NO: 131941 - RNA, 23 nt, Human
uggcaaacgggaauaaaggaauu

SEQ ID NO: 131942 - RNA, 22 nt, Human
ucucgcuguuccugcuucaggu

SEQ ID NO: 131943 - RNA, 20 nt, Human
ucucuaacaugaaugcuauc

SEQ ID NO: 131944 - RNA, 22 nt, Human
ugcuucuuuaggauguaguuau

SEQ ID NO: 131945 - RNA, 22 nt, Human
ugcuucucucuaggaagacgcu

SEQ ID NO: 131946 - RNA, 22 nt, Human
ugcuucuuuccuuggugacuuc

SEQ ID NO: 131947 - RNA, 22 nt, Human
ugcuucuuugggggugaagaga

SEQ ID NO: 131948 - RNA, 22 nt, Human
ucucuccuccacaccgggugcu

SEQ ID NO: 131949 - RNA, 22 nt, Human
ucucucgguacagcuggcugga

SEQ ID NO: 131950 - RNA, 22 nt, Human
ugcuuggagaaucagucccagc

SEQ ID NO: 131951 - RNA, 22 nt, Human
ugcuugggucuguuuugcaaag

SEQ ID NO: 131952 - RNA, 22 nt, Human
ucugaccaggcucuuguagccu

SEQ ID NO: 131953 - RNA, 22 nt, Human
ucugaccccccuugccuccacu

SEQ ID NO: 131954 - RNA, 22 nt, Human
ucugacguugguucugcccuuu

SEQ ID NO: 131955 - RNA, 22 nt, Human
ucugagcaggaaagagcagaga

SEQ ID NO: 131956 - RNA, 22 nt, Human
ucugagucgcucccuggaucca

SEQ ID NO: 131957 - RNA, 22 nt, Human
ucugagugacguccugacagga

SEQ ID NO: 131958 - RNA, 22 nt, Human
ucugagugggaacucucaugac

SEQ ID NO: 131959 - RNA, 23 nt, Human
ugcuuugauuauuauucccaccu

SEQ ID NO: 131960 - RNA, 18 nt, Human
ucugaaggaaugauucca

SEQ ID NO: 131961 - RNA, 22 nt, Human
ugcuuuccuucccuauguugag

SEQ ID NO: 131962 - RNA, 22 nt, Human
ugcugcuguuuccuacaucuca

SEQ ID NO: 131963 - RNA, 22 nt, Human
ucucagggaugggaggccccag

SEQ ID NO: 131964 - RNA, 22 nt, Human
ugcuggugauuaaauccugaag

SEQ ID NO: 131965 - RNA, 22 nt, Human
ugcugggagcugggccucgaca

SEQ ID NO: 131966 - RNA, 20 nt, Human
ugcugggccaucuugcaugc

SEQ ID NO: 131967 - RNA, 22 nt, Human
ugcuggagccauguuuucucua

SEQ ID NO: 131968 - RNA, 22 nt, Human
ugcuggaaggguaguauuaacu

SEQ ID NO: 131969 - RNA, 22 nt, Human
ugcugguuucugaguaaccaca

SEQ ID NO: 131970 - RNA, 22 nt, Human
ucuccaccccugggaggcagaa

SEQ ID NO: 131971 - RNA, 22 nt, Human
ucucccaaaucuuucuagcaca

SEQ ID NO: 131972 - RNA, 22 nt, Human
ucuccccucuggucugggcucu

SEQ ID NO: 131973 - RNA, 22 nt, Human
ugcugugcuggcggcagaggcc

SEQ ID NO: 131974 - RNA, 22 nt, Human
ucgcuucugaguuggugacccc

SEQ ID NO: 131975 - RNA, 22 nt, Human
ucuagggcaguacaaauucaag

SEQ ID NO: 131976 - RNA, 22 nt, Human
ucgcucgcuggcuccugcccgc

SEQ ID NO: 131977 - RNA, 20 nt, Human
ucgcugcaagggaaauggag

SEQ ID NO: 131978 - RNA, 22 nt, Human
ucgcgcgugccacgcgccgcgg

SEQ ID NO: 131979 - RNA, 22 nt, Human
ugcgccccgcgggccuucgggc

SEQ ID NO: 131980 - RNA, 22 nt, Human
ugcggagggagcagucggcugu

SEQ ID NO: 131981 - RNA, 22 nt, Human
ugcggaaggcagcgcagggugg

SEQ ID NO: 131982 - RNA, 22 nt, Human
ugcgcgccgacggcuccgugac

SEQ ID NO: 131983 - RNA, 22 nt, Human
ugcugcucaagcugcagcaaaa

SEQ ID NO: 131984 - RNA, 23 nt, Human
ugcugcgggacccgagcgcgcgc

SEQ ID NO: 131985 - RNA, 22 nt, Human
ugcugcggauauacaggaucug

SEQ ID NO: 131986 - RNA, 23 nt, Human
ugcugcuggaguaucuacaaugc

SEQ ID NO: 131987 - RNA, 23 nt, Human
ucucaccaggauaugacugucac

SEQ ID NO: 131988 - RNA, 22 nt, Human
ucucaaagguuuuccucuuuuu

SEQ ID NO: 131989 - RNA, 22 nt, Human
ucucaaacuauauaugggguuc

SEQ ID NO: 131990 - RNA, 22 nt, Human
uccucguccucauccgcgucau

SEQ ID NO: 131991 - RNA, 22 nt, Human
uccucuccaggugagccgaaau

SEQ ID NO: 131992 - RNA, 22 nt, Human
uccuccucgccacgacucugcu

SEQ ID NO: 131993 - RNA, 22 nt, Human
uccucgccgucacgcagccucu

SEQ ID NO: 131994 - RNA, 22 nt, Human
ugcauuugcaauggguacacaa

SEQ ID NO: 131995 - RNA, 22 nt, Human
uccucaucuuaucaucccaaga

SEQ ID NO: 131996 - RNA, 19 nt, Human
ugccccacccucuauccag

SEQ ID NO: 131997 - RNA, 22 nt, Human
ugcccagcagggagcuaccugg

SEQ ID NO: 131998 - RNA, 18 nt, Human
ugcccaccagaagaggga

SEQ ID NO: 131999 - RNA, 22 nt, Human
ugcccacaggaagacaccagcg

SEQ ID NO: 132000 - RNA, 22 nt, Human
ugcaucccaaacaugguuuccu

SEQ ID NO: 132001 - RNA, 22 nt, Human
uccuacccccuucuccagcucc

SEQ ID NO: 132002 - RNA, 22 nt, Human
ugccaaagauagagguuugagu

SEQ ID NO: 132003 - RNA, 22 nt, Human
ugcaugguuauauacuacuagu

SEQ ID NO: 132004 - RNA, 22 nt, Human
ugcauguuauuguggcaagaau

SEQ ID NO: 132005 - RNA, 21 nt, Human
uccugccuuaguccagagcag

SEQ ID NO: 132006 - RNA, 22 nt, Human
uccugcucucuccauuccuucc

SEQ ID NO: 132007 - RNA, 22 nt, Human
ugccuacuuuaguacuuuaaag

SEQ ID NO: 132008 - RNA, 19 nt, Human
uccuugacuguauucagag

SEQ ID NO: 132009 - RNA, 21 nt, Human
ugccuggccuuugcuuuuccu

SEQ ID NO: 132010 - RNA, 22 nt, Human
ugccuggacgacaucacaguga

SEQ ID NO: 132011 - RNA, 22 nt, Human
ugcgcgcaccugcauauauaug

SEQ ID NO: 132012 - RNA, 22 nt, Human
ucgagcacaccagacuugcaga

SEQ ID NO: 132013 - RNA, 22 nt, Human
ugcgccuccugcugccugcccu

SEQ ID NO: 132014 - RNA, 22 nt, Human
ucgacguuguuuuuucucuguc

SEQ ID NO: 132015 - RNA, 18 nt, Human
ugcaggggaggggugaua

SEQ ID NO: 132016 - RNA, 22 nt, Human
ugcaggagcccaggaauacuau

SEQ ID NO: 132017 - RNA, 20 nt, Human
uccgaaucaugacuuugcac

SEQ ID NO: 132018 - RNA, 22 nt, Human
ugcaggaagcucagcggggccg

SEQ ID NO: 132019 - RNA, 21 nt, Human
ucccugcagccccaggccccc

SEQ ID NO: 132020 - RNA, 22 nt, Human
ucccugagagacuucuuuggcu

SEQ ID NO: 132021 - RNA, 22 nt, Human
ucccuguuuccugcgcuccuuc

SEQ ID NO: 132022 - RNA, 22 nt, Human
ucccugcgugagaaagcacuua

SEQ ID NO: 132023 - RNA, 22 nt, Human
ucccugccuccuggcagugcca

SEQ ID NO: 132024 - RNA, 22 nt, Human
uccgggcagcuccuggagcugu

SEQ ID NO: 132025 - RNA, 22 nt, Human
uccguccacacuuagagaguuu

SEQ ID NO: 132026 - RNA, 22 nt, Human
uccgggagcccccggaggagga

SEQ ID NO: 132027 - RNA, 22 nt, Human
uccgaccuuuacuucuugucuc

SEQ ID NO: 132028 - RNA, 22 nt, Human
uccgagggugacuaccgcuucc

SEQ ID NO: 132029 - RNA, 22 nt, Human
ucccagucuagagccggauugg

SEQ ID NO: 132030 - RNA, 22 nt, Human
ugcagguggcagcggggcacca

SEQ ID NO: 132031 - RNA, 22 nt, Human
ugcaguugcguuugcauuccau

SEQ ID NO: 132032 - RNA, 22 nt, Human
ucccacugucuucucgugcucg

SEQ ID NO: 132033 - RNA, 22 nt, Human
ugcaauggauaucugaacgugg

SEQ ID NO: 132034 - RNA, 22 nt, Human
ucccacgugccaucugcucugu

SEQ ID NO: 132035 - RNA, 22 nt, Human
ucccagccugacagugcaucaa

SEQ ID NO: 132036 - RNA, 22 nt, Human
ucccagguugaggccuugccug

SEQ ID NO: 132037 - RNA, 22 nt, Human
uccccaugaacuuguggcugcu

SEQ ID NO: 132038 - RNA, 22 nt, Human
uccccugccccccauccucugg

SEQ ID NO: 132039 - RNA, 21 nt, Human
uccccugugccuggcauacag

SEQ ID NO: 132040 - RNA, 22 nt, Human
ucccggcaccgggagccccugc

SEQ ID NO: 132041 - RNA, 22 nt, Human
ucccucgccccggguucuuucu

SEQ ID NO: 132042 - RNA, 23 nt, Human
ucccacauuucacagcacuuucc

SEQ ID NO: 132043 - RNA, 22 nt, Human
ugauugguauguauguuuguca

SEQ ID NO: 132044 - RNA, 22 nt, Human
uccagccauaucuuguagcccu

SEQ ID NO: 132045 - RNA, 22 nt, Human
uccagcugugcuccaggaggug

SEQ ID NO: 132046 - RNA, 22 nt, Human
uccagcuccugaguucacugcu

SEQ ID NO: 132047 - RNA, 22 nt, Human
uccaggacgccgacgugucggc

SEQ ID NO: 132048 - RNA, 22 nt, Human
uccagcuucugccugcugcugc

SEQ ID NO: 132049 - RNA, 22 nt, Human
uccaggagucagacagauggug

SEQ ID NO: 132050 - RNA, 22 nt, Human
ucuuccacuugaaccuucuguc

SEQ ID NO: 132051 - RNA, 22 nt, Human
ucagguuuaagcuacuggaauc

SEQ ID NO: 132052 - RNA, 22 nt, Human
ugagaccuaaaccgucuguccu

SEQ ID NO: 132053 - RNA, 22 nt, Human
ucagguuuuuaaggagcuagga

SEQ ID NO: 132054 - RNA, 22 nt, Human
ucaguagcauuuaauguucagu

SEQ ID NO: 132055 - RNA, 22 nt, Human
ucagucauacuuuaugauugaa

SEQ ID NO: 132056 - RNA, 22 nt, Human
ugagacuuggggggcugagggc

SEQ ID NO: 132057 - RNA, 23 nt, Human
ucagugccaaggagaacuuggug

SEQ ID NO: 132058 - RNA, 20 nt, Human
ucaguggcauaguugcuaag

SEQ ID NO: 132059 - RNA, 19 nt, Human
ugagauuguaugaggagau

SEQ ID NO: 132060 - RNA, 21 nt, Human
ugagcccaaagcuguauuggu

SEQ ID NO: 132061 - RNA, 22 nt, Human
ugagcagccagucauucaaaaa

SEQ ID NO: 132062 - RNA, 22 nt, Human
ucagugguuaaguucuguccac

SEQ ID NO: 132063 - RNA, 17 nt, Human
ucaguugugcgagcagc

SEQ ID NO: 132064 - RNA, 22 nt, Human
ucaguuguuggaaguagaugua

SEQ ID NO: 132065 - RNA, 22 nt, Human
ugaggaaugugacaaaaccaag

SEQ ID NO: 132066 - RNA, 22 nt, Human
ugaggaagugguuguaugguuu

SEQ ID NO: 132067 - RNA, 22 nt, Human
ugaggaugaggaagaagaagaa

SEQ ID NO: 132068 - RNA, 22 nt, Human
ugaggagggcuagagucuccug

SEQ ID NO: 132069 - RNA, 22 nt, Human
ucaucagccaaagaguccuuca

SEQ ID NO: 132070 - RNA, 22 nt, Human
ugaggcuuucacuuggcaaaga

SEQ ID NO: 132071 - RNA, 22 nt, Human
ucauccgcaaccacuuuagccu

SEQ ID NO: 132072 - RNA, 21 nt, Human
ucauccagguccugcuucuuc

SEQ ID NO: 132073 - RNA, 16 nt, Human
ucauaaacugcagcuu

SEQ ID NO: 132074 - RNA, 18 nt, Human
ugauggcuaagagccggg

SEQ ID NO: 132075 - RNA, 22 nt, Human
ugaugaugauacauuucuucag

SEQ ID NO: 132076 - RNA, 22 nt, Human
ucauggucucccagcccccucu

SEQ ID NO: 132077 - RNA, 22 nt, Human
uccaccuaagucuccgggagcu

SEQ ID NO: 132078 - RNA, 22 nt, Human
ugauucacgcuucucuuuaaac

SEQ ID NO: 132079 - RNA, 22 nt, Human
ugauucaguacuuucucuaacu

SEQ ID NO: 132080 - RNA, 22 nt, Human
ugauugcucagcuagccucuuu

SEQ ID NO: 132081 - RNA, 22 nt, Human
ugauugcucgacacucugcuug

SEQ ID NO: 132082 - RNA, 22 nt, Human
ucucaggcuuccuggugcugug

SEQ ID NO: 132083 - RNA, 22 nt, Human
ucucaccuagucuuggaggucu

SEQ ID NO: 132084 - RNA, 22 nt, Human
ucucagcuggcugggagcccug

SEQ ID NO: 132085 - RNA, 21 nt, Human
ucucaagguaacauuuaagau

SEQ ID NO: 132086 - RNA, 22 nt, Human
ucucaaagagcuacuggucuau

SEQ ID NO: 132087 - RNA, 22 nt, Human
uagcuucacuuuuguugaugcg

SEQ ID NO: 132088 - RNA, 22 nt, Human
uaggagcagauggcagcaggug

SEQ ID NO: 132089 - RNA, 21 nt, Human
uaggaacuguucugagugguc

SEQ ID NO: 132090 - RNA, 22 nt, Human
ucgauccaggaaggcugguuua

SEQ ID NO: 132091 - RNA, 17 nt, Human
ucuccuggcucuaucag

SEQ ID NO: 132092 - RNA, 22 nt, Human
ucuccugacaccucuugugggg

SEQ ID NO: 132093 - RNA, 18 nt, Human
ucuccgaccccgcggucc

SEQ ID NO: 132094 - RNA, 22 nt, Human
ucucccgcuuccugcuggcugc

SEQ ID NO: 132095 - RNA, 22 nt, Human
ucucugguggcuccaucaguag

SEQ ID NO: 132096 - RNA, 22 nt, Human
ucucugguagcucugugcucug

SEQ ID NO: 132097 - RNA, 20 nt, Human
ucucugccaaccaccuccuc

SEQ ID NO: 132098 - RNA, 22 nt, Human
ucucugcguucaucccaucaca

SEQ ID NO: 132099 - RNA, 19 nt, Human
ucucugguggcuccaucag

SEQ ID NO: 132100 - RNA, 22 nt, Human
ucucuugcuauugcgaacaggu

SEQ ID NO: 132101 - RNA, 22 nt, Human
ucucuucggagagaccuuugga

SEQ ID NO: 132102 - RNA, 22 nt, Human
uaucugaugcaggcucccagga

SEQ ID NO: 132103 - RNA, 17 nt, Human
ucugaccuuuacuccug

SEQ ID NO: 132104 - RNA, 22 nt, Human
ucuggugcacucugauauuuga

SEQ ID NO: 132105 - RNA, 22 nt, Human
ucuggggaugagugaugucgua

SEQ ID NO: 132106 - RNA, 22 nt, Human
ucuguggcaaacacagugacca

SEQ ID NO: 132107 - RNA, 19 nt, Human
ucuguggccuucccugaug

SEQ ID NO: 132108 - RNA, 22 nt, Human
ucugugugugcauguguguaua

SEQ ID NO: 132109 - RNA, 21 nt, Human
ucugugcuuuuuuggcuccua

SEQ ID NO: 132110 - RNA, 22 nt, Human
ucugugcuggacugauuucaua

SEQ ID NO: 132111 - RNA, 22 nt, Human
ucugucaguguccucguguggu

SEQ ID NO: 132112 - RNA, 22 nt, Human
ucuguguguguggcuaaacaag

SEQ ID NO: 132113 - RNA, 22 nt, Human
uauucagugcugguucuuuuuc

SEQ ID NO: 132114 - RNA, 22 nt, Human
ucugcuggugucauuuuugcua

SEQ ID NO: 132115 - RNA, 22 nt, Human
uaugggaaggauuugucuuuca

SEQ ID NO: 132116 - RNA, 20 nt, Human
uaugcgaagccuuucuggac

SEQ ID NO: 132117 - RNA, 22 nt, Human
ucuggaggucucagggcgggaa

SEQ ID NO: 132118 - RNA, 22 nt, Human
ucuggcucaggagcuguguuca

SEQ ID NO: 132119 - RNA, 22 nt, Human
uauguggcaggugggagaucag

SEQ ID NO: 132120 - RNA, 22 nt, Human
ucugggccacccgccuccaggg

SEQ ID NO: 132121 - RNA, 22 nt, Human
ucugggccaacccuuccauggg

SEQ ID NO: 132122 - RNA, 22 nt, Human
ucuggcuucaguaggguucacu

SEQ ID NO: 132123 - RNA, 22 nt, Human
ucugggaccuagacccauuguu

SEQ ID NO: 132124 - RNA, 22 nt, Human
ucuggcucuccagugcucuuag

SEQ ID NO: 132125 - RNA, 22 nt, Human
ucugcggccuagcgcccggcgc

SEQ ID NO: 132126 - RNA, 22 nt, Human
ucugcggccggaauucccuuca

SEQ ID NO: 132127 - RNA, 22 nt, Human
ucugcccaggaggucccauggg

SEQ ID NO: 132128 - RNA, 22 nt, Human
ucugccuucaggagcagacucu

SEQ ID NO: 132129 - RNA, 17 nt, Human
ucugccaguuuuagaau

SEQ ID NO: 132130 - RNA, 22 nt, Human
uccaggucauucucuccgaccg

SEQ ID NO: 132131 - RNA, 22 nt, Human
uccaugcaguagaggcgcuggg

SEQ ID NO: 132132 - RNA, 22 nt, Human
uccaucaccacagaggacagag

SEQ ID NO: 132133 - RNA, 22 nt, Human
uccaggaggacugagggggcug

SEQ ID NO: 132134 - RNA, 21 nt, Human
uccaggagcacgggacuagga

SEQ ID NO: 132135 - RNA, 22 nt, Human
uccaaggcuggaucuuuucuuu

SEQ ID NO: 132136 - RNA, 22 nt, Human
uccaaggcagacacauuuuuug

SEQ ID NO: 132137 - RNA, 22 nt, Human
uccaaggacucuugucagcugu

SEQ ID NO: 132138 - RNA, 22 nt, Human
uccaaggacuaaauucuagauu

SEQ ID NO: 132139 - RNA, 22 nt, Human
uccccaccuaagauacccaucu

SEQ ID NO: 132140 - RNA, 23 nt, Human
uccccagcugcccgugucccggg

SEQ ID NO: 132141 - RNA, 22 nt, Human
uacugccauuauccugcugaaa

SEQ ID NO: 132142 - RNA, 22 nt, Human
uacugauggagauaggcuauca

SEQ ID NO: 132143 - RNA, 22 nt, Human
uacugacguaguagaguugcuu

SEQ ID NO: 132144 - RNA, 22 nt, Human
uccccgcuccguagagaaagag

SEQ ID NO: 132145 - RNA, 22 nt, Human
uccccgcugcgcccgcugcugc

SEQ ID NO: 132146 - RNA, 22 nt, Human
uacuucccacuggggucuacca

SEQ ID NO: 132147 - RNA, 22 nt, Human
uccccggagucccuggccaggg

SEQ ID NO: 132148 - RNA, 22 nt, Human
ucccugccuuauuuucauaugc

SEQ ID NO: 132149 - RNA, 22 nt, Human
ucccugcugggcgaucuucucu

SEQ ID NO: 132150 - RNA, 22 nt, Human
ucccugagcucacauggcagga

SEQ ID NO: 132151 - RNA, 22 nt, Human
ucccguuucacuccuugccagc

SEQ ID NO: 132152 - RNA, 22 nt, Human
ucccgcccugcguucucccaug

SEQ ID NO: 132153 - RNA, 22 nt, Human
uccggcgaccuccagauguucc

SEQ ID NO: 132154 - RNA, 22 nt, Human
uccgcguugguuagagagggcu

SEQ ID NO: 132155 - RNA, 22 nt, Human
uccgugggucuugaagugucac

SEQ ID NO: 132156 - RNA, 22 nt, Human
uccgugguguuggcucuccggc

SEQ ID NO: 132157 - RNA, 21 nt, Human
uccguucgguuaaaaaggccc

SEQ ID NO: 132158 - RNA, 22 nt, Human
uccucagcaaacacuucacucu

SEQ ID NO: 132159 - RNA, 22 nt, Human
uccuccacuuagcgccacuggg

SEQ ID NO: 132160 - RNA, 18 nt, Human
uccggaggucagaguaaa

SEQ ID NO: 132161 - RNA, 22 nt, Human
uccucagcaagacgcuggcagc

SEQ ID NO: 132162 - RNA, 23 nt, Human
ucccuguuucagggccagaacug

SEQ ID NO: 132163 - RNA, 22 nt, Human
ucccuguggauuaaggagaugu

SEQ ID NO: 132164 - RNA, 22 nt, Human
ucccuuuuagccccgcccuccu

SEQ ID NO: 132165 - RNA, 22 nt, Human
uccgacacacgugcucgcagcg

SEQ ID NO: 132166 - RNA, 22 nt, Human
uagaacugcucucauacuugcu

SEQ ID NO: 132167 - RNA, 22 nt, Human
uccugaaggccugaguuccacc

SEQ ID NO: 132168 - RNA, 20 nt, Human
uagcacuguauccucuucau

SEQ ID NO: 132169 - RNA, 22 nt, Human
uccuggcgugggcuggcugcag

SEQ ID NO: 132170 - RNA, 22 nt, Human
uccuggccucugagucaagaac

SEQ ID NO: 132171 - RNA, 22 nt, Human
uccugggucugugagccauacu

SEQ ID NO: 132172 - RNA, 22 nt, Human
uccuggcuguuagagaggcaag

SEQ ID NO: 132173 - RNA, 22 nt, Human
uccugggcuugcucuuuccauu

SEQ ID NO: 132174 - RNA, 22 nt, Human
uccuggccuuggggagagaagu

SEQ ID NO: 132175 - RNA, 22 nt, Human
uccuggaagggaugguugagga

SEQ ID NO: 132176 - RNA, 22 nt, Human
uccuugaccuccugacaguaac

SEQ ID NO: 132177 - RNA, 22 nt, Human
ucaguuccccaaagccuccuag

SEQ ID NO: 132178 - RNA, 20 nt, Human
ucaguuucccuauuagguug

SEQ ID NO: 132179 - RNA, 22 nt, Human
ucaucggcugucaucuucacgu

SEQ ID NO: 132180 - RNA, 22 nt, Human
ucaucgauggggagcucuacaa

SEQ ID NO: 132181 - RNA, 22 nt, Human
ucaugggcaaacuuggggauca

SEQ ID NO: 132182 - RNA, 22 nt, Human
ucaugcagaguagaaagggcaa

SEQ ID NO: 132183 - RNA, 22 nt, Human
ucaugcagauaagaauaaguaa

SEQ ID NO: 132184 - RNA, 22 nt, Human
ucauguauucugggcaggagau

SEQ ID NO: 132185 - RNA, 22 nt, Human
ucauggcucuaaagacauagau

SEQ ID NO: 132186 - RNA, 22 nt, Human
ucauggguauaauuuuagaugu

SEQ ID NO: 132187 - RNA, 22 nt, Human
uccaagacagauaccuagaaga

SEQ ID NO: 132188 - RNA, 22 nt, Human
uccaagcgcuucuggagcuccu

SEQ ID NO: 132189 - RNA, 21 nt, Human
uccaaaggagacugagugugu

SEQ ID NO: 132190 - RNA, 22 nt, Human
uacaaucacccaaagagccaga

SEQ ID NO: 132191 - RNA, 17 nt, Human
ucauuucaguaaaucca

SEQ ID NO: 132192 - RNA, 20 nt, Human
ucauucagaaucaguaugca

SEQ ID NO: 132193 - RNA, 22 nt, Human
ucagucacugucucagacagga

SEQ ID NO: 132194 - RNA, 22 nt, Human
ucagguuuaagugacuggaauc

SEQ ID NO: 132195 - RNA, 22 nt, Human
guugucguucccccugcuuaaa

SEQ ID NO: 132196 - RNA, 22 nt, Human
uaaaggaguguauaauuguagu

SEQ ID NO: 132197 - RNA, 22 nt, Human
ucaagcacugugcaaugagcuu

SEQ ID NO: 132198 - RNA, 22 nt, Human
ucaagagauauaugcugguuua

SEQ ID NO: 132199 - RNA, 22 nt, Human
guuggguaauuaagcacagaaa

SEQ ID NO: 132200 - RNA, 19 nt, Human
ucaggaggucgaccuggca

SEQ ID NO: 132201 - RNA, 22 nt, Human
ucaggagaguguucaguggagg

SEQ ID NO: 132202 - RNA, 22 nt, Human
ucaggaggucugcugcggggug

SEQ ID NO: 132203 - RNA, 22 nt, Human
guuggaggaaggacaggaacag

SEQ ID NO: 132204 - RNA, 22 nt, Human
ucaggcgcucuucguggcugcc

SEQ ID NO: 132205 - RNA, 22 nt, Human
ucagggaggagaggcaggggga

SEQ ID NO: 132206 - RNA, 22 nt, Human
ucaguggaacacacagaguggg

SEQ ID NO: 132207 - RNA, 22 nt, Human
uaacaacuuucugguguaacuu

SEQ ID NO: 132208 - RNA, 22 nt, Human
ucagucauguuuaccagacgua

SEQ ID NO: 132209 - RNA, 20 nt, Human
ucagugggaaagugagagug

SEQ ID NO: 132210 - RNA, 19 nt, Human
ucagugggacauuugcuuu

SEQ ID NO: 132211 - RNA, 22 nt, Human
uaaccaggaaaaagauaugcau

SEQ ID NO: 132212 - RNA, 22 nt, Human
gugcucgagcugugcgcgcugc

SEQ ID NO: 132213 - RNA, 22 nt, Human
uagcguucuugcaugcuaaccu

SEQ ID NO: 132214 - RNA, 23 nt, Human
uagcggccaugacgggggucaca

SEQ ID NO: 132215 - RNA, 22 nt, Human
uagcuggaggggcaggaugcug

SEQ ID NO: 132216 - RNA, 22 nt, Human
uagcuaggugagcggcuccggc

SEQ ID NO: 132217 - RNA, 17 nt, Human
gugagcugagucaggac

SEQ ID NO: 132218 - RNA, 22 nt, Human
uagccaguuuauaaaguggaag

SEQ ID NO: 132219 - RNA, 22 nt, Human
gugcuguuagcgguuuauaaca

SEQ ID NO: 132220 - RNA, 22 nt, Human
gugcugcaugagcaucacguag

SEQ ID NO: 132221 - RNA, 22 nt, Human
gugcugucguggaacugggcug

SEQ ID NO: 132222 - RNA, 22 nt, Human
gugcugggaggcccaggaugga

SEQ ID NO: 132223 - RNA, 22 nt, Human
guggaagggaaaccgcacuggc

SEQ ID NO: 132224 - RNA, 22 nt, Human
guggacagacauaauccuaauu

SEQ ID NO: 132225 - RNA, 22 nt, Human
guggagaaagcuggaaucugag

SEQ ID NO: 132226 - RNA, 22 nt, Human
guggaaggaauuaacagacuag

SEQ ID NO: 132227 - RNA, 22 nt, Human
guggaagauauuucugguccag

SEQ ID NO: 132228 - RNA, 22 nt, Human
uaggcagauuccauauuuuggc

SEQ ID NO: 132229 - RNA, 22 nt, Human
guggagaugagauauaccccuu

SEQ ID NO: 132230 - RNA, 22 nt, Human
guggaggguuugcaaugugcag

SEQ ID NO: 132231 - RNA, 22 nt, Human
guggaguggguuguacucaggg

SEQ ID NO: 132232 - RNA, 22 nt, Human
guggauaaguuguuugaccuac

SEQ ID NO: 132233 - RNA, 22 nt, Human
guggagaucuggugcccccugg

SEQ ID NO: 132234 - RNA, 22 nt, Human
gugggcccaagcagcggcggcc

SEQ ID NO: 132235 - RNA, 22 nt, Human
guggggcgggucccccgccugg

SEQ ID NO: 132236 - RNA, 22 nt, Human
gugggggcagaagcgagugcag

SEQ ID NO: 132237 - RNA, 22 nt, Human
gugggggcuaaauugaggggug

SEQ ID NO: 132238 - RNA, 22 nt, Human
guggggguaggggguuuccugg

SEQ ID NO: 132239 - RNA, 22 nt, Human
gugggggugaggaauguucuau

SEQ ID NO: 132240 - RNA, 22 nt, Human
guggggguaggggguuuucugg

SEQ ID NO: 132241 - RNA, 22 nt, Human
gugggagaaugggaggaguaau

SEQ ID NO: 132242 - RNA, 22 nt, Human
gugggagggaguccugggagca

SEQ ID NO: 132243 - RNA, 22 nt, Human
gugggccaguuccucacaggua

SEQ ID NO: 132244 - RNA, 22 nt, Human
gugggcagauuaauuucucaau

SEQ ID NO: 132245 - RNA, 22 nt, Human
gugggcacguccuacugucacu

SEQ ID NO: 132246 - RNA, 18 nt, Human
gugggcacacacucuguu

SEQ ID NO: 132247 - RNA, 22 nt, Human
uaguccacagagggcaggguca

SEQ ID NO: 132248 - RNA, 22 nt, Human
uagucaauuagaaagaggccuu

SEQ ID NO: 132249 - RNA, 22 nt, Human
guggguauauauaugugugcug

SEQ ID NO: 132250 - RNA, 22 nt, Human
uaguggccacugaagugcuaga

SEQ ID NO: 132251 - RNA, 22 nt, Human
uaguggcccagcauuucucaau

SEQ ID NO: 132252 - RNA, 22 nt, Human
guggcuuuguuuccaaaugaaa

SEQ ID NO: 132253 - RNA, 22 nt, Human
guggcuugguauuaaggugcca

SEQ ID NO: 132254 - RNA, 22 nt, Human
guggccaaggcagagaaagagc

SEQ ID NO: 132255 - RNA, 23 nt, Human
uaggucacacauugggugguugc

SEQ ID NO: 132256 - RNA, 22 nt, Human
uaggggguuuuucuagagauug

SEQ ID NO: 132257 - RNA, 22 nt, Human
uaggccugcugaagagcaagcu

SEQ ID NO: 132258 - RNA, 20 nt, Human
guggcagugguggcagcagu

SEQ ID NO: 132259 - RNA, 22 nt, Human
guggcaaguuuucugacaagga

SEQ ID NO: 132260 - RNA, 22 nt, Human
guggucaagaccgggaauagga

SEQ ID NO: 132261 - RNA, 23 nt, Human
gugguguaaaugccaaaaugaaa

SEQ ID NO: 132262 - RNA, 22 nt, Human
gugguuugacccuucagguaaa

SEQ ID NO: 132263 - RNA, 22 nt, Human
guguucucagcacccacuucau

SEQ ID NO: 132264 - RNA, 22 nt, Human
uaugcgguccaucaggggcacu

SEQ ID NO: 132265 - RNA, 22 nt, Human
guguaucagaggcuguguuaua

SEQ ID NO: 132266 - RNA, 20 nt, Human
uaugugcaguuugguuuauc

SEQ ID NO: 132267 - RNA, 22 nt, Human
uaugugaguaccugucaugugc

SEQ ID NO: 132268 - RNA, 21 nt, Human
guguugugagguugguguuag

SEQ ID NO: 132269 - RNA, 22 nt, Human
guguugugauuggucagucacu

SEQ ID NO: 132270 - RNA, 22 nt, Human
guguugacacagccaucuuguc

SEQ ID NO: 132271 - RNA, 22 nt, Human
guguuggugagcucauuuccac

SEQ ID NO: 132272 - RNA, 22 nt, Human
guguugaaaaguagcacugcuu

SEQ ID NO: 132273 - RNA, 22 nt, Human
guguucuuuaugguuguagugu

SEQ ID NO: 132274 - RNA, 19 nt, Human
guguucuguuauacaguug

SEQ ID NO: 132275 - RNA, 22 nt, Human
guuccugagcaguuccuggcca

SEQ ID NO: 132276 - RNA, 22 nt, Human
guucaaggagcagcuugcuaca

SEQ ID NO: 132277 - RNA, 22 nt, Human
guucuucagauuccauuucagu

SEQ ID NO: 132278 - RNA, 23 nt, Human
guugccuuugcaucuucauccau

SEQ ID NO: 132279 - RNA, 22 nt, Human
guugguggaggcgagagaagaa

SEQ ID NO: 132280 - RNA, 22 nt, Human
ucaaccucccugcucaccccuc

SEQ ID NO: 132281 - RNA, 22 nt, Human
guuggugagaguuagggauuua

SEQ ID NO: 132282 - RNA, 22 nt, Human
guugggcugaagugugugcuua

SEQ ID NO: 132283 - RNA, 20 nt, Human
guugggagaagugucagcug

SEQ ID NO: 132284 - RNA, 22 nt, Human
ucaaccagcuuaucugcaggau

SEQ ID NO: 132285 - RNA, 22 nt, Human
gucaggugcaccuccaccaaca

SEQ ID NO: 132286 - RNA, 22 nt, Human
gucacuccuucccagagggagc

SEQ ID NO: 132287 - RNA, 22 nt, Human
guauuggcaguauacauagcac

SEQ ID NO: 132288 - RNA, 22 nt, Human
guauggaguuuuguugcacuuc

SEQ ID NO: 132289 - RNA, 22 nt, Human
guagagccaccaccaccauagc

SEQ ID NO: 132290 - RNA, 22 nt, Human
guccuggugccaccugcgggau

SEQ ID NO: 132291 - RNA, 22 nt, Human
gucccagaggacagggucacau

SEQ ID NO: 132292 - RNA, 22 nt, Human
guccuaugggaagggauccugg

SEQ ID NO: 132293 - RNA, 22 nt, Human
gucgguacuaguacugguguug

SEQ ID NO: 132294 - RNA, 22 nt, Human
gucguucugcuauucuaugagg

SEQ ID NO: 132295 - RNA, 22 nt, Human
gucgccuaauuaggguauccua

SEQ ID NO: 132296 - RNA, 22 nt, Human
gucgagaacauucauuaugcaa

SEQ ID NO: 132297 - RNA, 22 nt, Human
gucugcuuuuaucacaugucau

SEQ ID NO: 132298 - RNA, 22 nt, Human
gucugugguccaaaauugccuc

SEQ ID NO: 132299 - RNA, 22 nt, Human
gucuggagccacugcugcugcu

SEQ ID NO: 132300 - RNA, 22 nt, Human
gucuuugagccucaguuuccuc

SEQ ID NO: 132301 - RNA, 22 nt, Human
uacagaccaguaguucucagcg

SEQ ID NO: 132302 - RNA, 21 nt, Human
uacaucaguuuucuuggcuca

SEQ ID NO: 132303 - RNA, 22 nt, Human
gugaaauuguacacucaguacc

SEQ ID NO: 132304 - RNA, 20 nt, Human
gugaacuggagaacugaugu

SEQ ID NO: 132305 - RNA, 20 nt, Human
uacguguccgaugaucacag

SEQ ID NO: 132306 - RNA, 22 nt, Human
uacugggugagcugggcuggga

SEQ ID NO: 132307 - RNA, 22 nt, Human
uacguggcucguuaauuuccug

SEQ ID NO: 132308 - RNA, 20 nt, Human
uaccuccccagcagucauga

SEQ ID NO: 132309 - RNA, 22 nt, Human
uaccugguuucuuaaacccaaa

SEQ ID NO: 132310 - RNA, 22 nt, Human
uaccgcagagucauugugagga

SEQ ID NO: 132311 - RNA, 22 nt, Human
gugaaggcaugugugcugugcu

SEQ ID NO: 132312 - RNA, 20 nt, Human
gugaaguuuucugaagacag

SEQ ID NO: 132313 - RNA, 22 nt, Human
gugacugagcuggcaaaguaug

SEQ ID NO: 132314 - RNA, 21 nt, Human
gugaccuguuaugcaaaggca

SEQ ID NO: 132315 - RNA, 22 nt, Human
ggugcuggggaaauuaggguag

SEQ ID NO: 132316 - RNA, 22 nt, Human
ggugcugcugcugaacccagcu

SEQ ID NO: 132317 - RNA, 22 nt, Human
ggugcaaagauggcaguugcaa

SEQ ID NO: 132318 - RNA, 22 nt, Human
ggugccugggcacggaaagcau

SEQ ID NO: 132319 - RNA, 22 nt, Human
ggugcagucuggggcacauuau

SEQ ID NO: 132320 - RNA, 22 nt, Human
gguggggugagggggcgaggcc

SEQ ID NO: 132321 - RNA, 22 nt, Human
ggugacuucugaaccuggagug

SEQ ID NO: 132322 - RNA, 22 nt, Human
ggugugaauagagccuggagca

SEQ ID NO: 132323 - RNA, 22 nt, Human
guacugggaauggagccugggc

SEQ ID NO: 132324 - RNA, 22 nt, Human
guacuacagguuugguaguggg

SEQ ID NO: 132325 - RNA, 22 nt, Human
guaccuuucuaucuagaaggua

SEQ ID NO: 132326 - RNA, 22 nt, Human
gguuucuuuccucucugugccu

SEQ ID NO: 132327 - RNA, 22 nt, Human
gguuuguggagcuggaaacacu

SEQ ID NO: 132328 - RNA, 22 nt, Human
guugggguuucaguggcaguca

SEQ ID NO: 132329 - RNA, 22 nt, Human
guugggugccagaggcuucacg

SEQ ID NO: 132330 - RNA, 22 nt, Human
guuggggccuggagucucuugg

SEQ ID NO: 132331 - RNA, 22 nt, Human
guugggauugaaggugccucua

SEQ ID NO: 132332 - RNA, 22 nt, Human
guuggcgaaggaccuggaggag

SEQ ID NO: 132333 - RNA, 22 nt, Human
gugcuggcaaagagaacaucuu

SEQ ID NO: 132334 - RNA, 22 nt, Human
gugcuugaguaaaaauagucuu

SEQ ID NO: 132335 - RNA, 22 nt, Human
ggucgucuguccugucgccgcu

SEQ ID NO: 132336 - RNA, 22 nt, Human
ggucuagcucggugcuggcgac

SEQ ID NO: 132337 - RNA, 22 nt, Human
ggucggggcuggccggcguggu

SEQ ID NO: 132338 - RNA, 22 nt, Human
ggucgguuggagagaucaugaa

SEQ ID NO: 132339 - RNA, 22 nt, Human
gguccgcgcgcagaggcccugg

SEQ ID NO: 132340 - RNA, 22 nt, Human
ggucaucacugagagcagaucc

SEQ ID NO: 132341 - RNA, 22 nt, Human
guugugcaaaacaggaaggucu

SEQ ID NO: 132342 - RNA, 22 nt, Human
ggugaggagaaacucugccccu

SEQ ID NO: 132343 - RNA, 23 nt, Human
ggugagccuuucuaguagucuug

SEQ ID NO: 132344 - RNA, 22 nt, Human
ggugaucucagucuagaugguu

SEQ ID NO: 132345 - RNA, 22 nt, Human
ggugacucacauuaggacuucg

SEQ ID NO: 132346 - RNA, 22 nt, Human
ggucuuccuugggggacuugaa

SEQ ID NO: 132347 - RNA, 22 nt, Human
ggugaucucuggcucugcuugu

SEQ ID NO: 132348 - RNA, 22 nt, Human
guuugagcaaucccucuauccc

SEQ ID NO: 132349 - RNA, 22 nt, Human
ggucuucauucuaccagacuuu

SEQ ID NO: 132350 - RNA, 19 nt, Human
ggucugcggggugaccgug

SEQ ID NO: 132351 - RNA, 22 nt, Human
ggucugcgauggcaagggucuu

SEQ ID NO: 132352 - RNA, 22 nt, Human
ggucugauaccugcagguuguc

SEQ ID NO: 132353 - RNA, 22 nt, Human
ggcggagggcuguguccccggc

SEQ ID NO: 132354 - RNA, 22 nt, Human
ggcgccuuguggaaugagagcu

SEQ ID NO: 132355 - RNA, 22 nt, Human
ggcgcccucccuguccgucuuc

SEQ ID NO: 132356 - RNA, 22 nt, Human
ggcgccauuuuugccuucggag

SEQ ID NO: 132357 - RNA, 22 nt, Human
ggcgcuccccgccugcgucgcg

SEQ ID NO: 132358 - RNA, 22 nt, Human
ggcgcaguguucgcccucucgc

SEQ ID NO: 132359 - RNA, 22 nt, Human
ggccaguauacaaacuuccggu

SEQ ID NO: 132360 - RNA, 22 nt, Human
ggccagucaaggggauccugaa

SEQ ID NO: 132361 - RNA, 22 nt, Human
gguuuucagaaugcaguccugu

SEQ ID NO: 132362 - RNA, 22 nt, Human
ggccagcuuugagcugcaggaa

SEQ ID NO: 132363 - RNA, 22 nt, Human
ggccccggaggccguuagcuua

SEQ ID NO: 132364 - RNA, 22 nt, Human
ggccccagggauuaggccaacc

SEQ ID NO: 132365 - RNA, 22 nt, Human
gguugggauuauccaaggcaga

SEQ ID NO: 132366 - RNA, 22 nt, Human
gguuugccagugcuggaaugca

SEQ ID NO: 132367 - RNA, 22 nt, Human
ggcggcccaggugcuccaggcg

SEQ ID NO: 132368 - RNA, 22 nt, Human
ggcggcugcuccuugcccucgg

SEQ ID NO: 132369 - RNA, 22 nt, Human
ggcggugcgaggaugcagggcu

SEQ ID NO: 132370 - RNA, 22 nt, Human
ggcgggggagccaggaacccag

SEQ ID NO: 132371 - RNA, 22 nt, Human
gucaucugagggacgagauuuc

SEQ ID NO: 132372 - RNA, 22 nt, Human
gucagugcuuuaguucaggaug

SEQ ID NO: 132373 - RNA, 22 nt, Human
gucaguggugcuuaaaguuuca

SEQ ID NO: 132374 - RNA, 20 nt, Human
gucaucucagggacugucug

SEQ ID NO: 132375 - RNA, 22 nt, Human
gucagugaaccuucaccaaacc

SEQ ID NO: 132376 - RNA, 22 nt, Human
gucaguccugugccuuuccgga

SEQ ID NO: 132377 - RNA, 22 nt, Human
gucaggaugagggaugaggagu

SEQ ID NO: 132378 - RNA, 22 nt, Human
gucagacucuggggccccaggc

SEQ ID NO: 132379 - RNA, 20 nt, Human
gucagaggacccuagagcga

SEQ ID NO: 132380 - RNA, 22 nt, Human
gucaaaggcggugcaggaggag

SEQ ID NO: 132381 - RNA, 22 nt, Human
gucacgucgggacagacugggg

SEQ ID NO: 132382 - RNA, 22 nt, Human
gucacuuugcuugcgaugcucc

SEQ ID NO: 132383 - RNA, 22 nt, Human
guccucgggcucacucccaggg

SEQ ID NO: 132384 - RNA, 22 nt, Human
guccccugcuguggaucugugg

SEQ ID NO: 132385 - RNA, 22 nt, Human
gucccuggucuaccguggcuuc

SEQ ID NO: 132386 - RNA, 22 nt, Human
guccuguccugcugagcuccug

SEQ ID NO: 132387 - RNA, 22 nt, Human
guccuggagcagcuggaagaug

SEQ ID NO: 132388 - RNA, 22 nt, Human
guccuguguaaguacuugcuca

SEQ ID NO: 132389 - RNA, 22 nt, Human
guccuguccuguccuggagaca

SEQ ID NO: 132390 - RNA, 22 nt, Human
ggcucccccauggcugacagac

SEQ ID NO: 132391 - RNA, 22 nt, Human
guccccuauaugaggaagccau

SEQ ID NO: 132392 - RNA, 22 nt, Human
ggcugcagugcaacucuuucua

SEQ ID NO: 132393 - RNA, 23 nt, Human
ggcgugcugggcugacccuuggc

SEQ ID NO: 132394 - RNA, 22 nt, Human
ggcuaaggacgggcaaguccca

SEQ ID NO: 132395 - RNA, 22 nt, Human
ggcgucuugcgggcgguagcgc

SEQ ID NO: 132396 - RNA, 22 nt, Human
ggcgggucuagggcccuggagu

SEQ ID NO: 132397 - RNA, 22 nt, Human
ggcuccagauguccccuggcaa

SEQ ID NO: 132398 - RNA, 22 nt, Human
ggcuagggaucuagaccaggac

SEQ ID NO: 132399 - RNA, 22 nt, Human
ggcuauuguuuuaaaaaaugag

SEQ ID NO: 132400 - RNA, 22 nt, Human
ggcuagggagacagagggcaug

SEQ ID NO: 132401 - RNA, 22 nt, Human
ggcuaaucaagaaggcccagug

SEQ ID NO: 132402 - RNA, 22 nt, Human
ggcucccgugggaugguggagc

SEQ ID NO: 132403 - RNA, 22 nt, Human
ggcuccccagagcuccuuacuc

SEQ ID NO: 132404 - RNA, 22 nt, Human
guccaucuugcaaugagaccua

SEQ ID NO: 132405 - RNA, 22 nt, Human
guccaugugcuaacagugcuua

SEQ ID NO: 132406 - RNA, 22 nt, Human
guccaauguggcaccacagggg

SEQ ID NO: 132407 - RNA, 22 nt, Human
ggcugcuggaguugggucucuc

SEQ ID NO: 132408 - RNA, 22 nt, Human
ggcugcugcccaccccugcaug

SEQ ID NO: 132409 - RNA, 21 nt, Human
ggcugcucgugaugaacuuca

SEQ ID NO: 132410 - RNA, 22 nt, Human
ggcugcuauuggucuggcuugg

SEQ ID NO: 132411 - RNA, 22 nt, Human
ggcuggaacuucuucuggcauu

SEQ ID NO: 132412 - RNA, 22 nt, Human
ggcugcuugauagauaugagua

SEQ ID NO: 132413 - RNA, 22 nt, Human
gucgucgcucccaccuuccgcu

SEQ ID NO: 132414 - RNA, 22 nt, Human
gucggagcggcugcacaggggg

SEQ ID NO: 132415 - RNA, 22 nt, Human
gucgcuuuccugaggggucuca

SEQ ID NO: 132416 - RNA, 22 nt, Human
gucgagcuggaggagcgaaugg

SEQ ID NO: 132417 - RNA, 22 nt, Human
guccuucgcggcugaggccauu

SEQ ID NO: 132418 - RNA, 22 nt, Human
gucuccugcccacccugguccc

SEQ ID NO: 132419 - RNA, 22 nt, Human
gucuggugguggguguagggca

SEQ ID NO: 132420 - RNA, 22 nt, Human
gucugcucauguuugguuugug

SEQ ID NO: 132421 - RNA, 22 nt, Human
gucugguggaguuguauauacu

SEQ ID NO: 132422 - RNA, 22 nt, Human
ggcuggagcaggcugcacagug

SEQ ID NO: 132423 - RNA, 22 nt, Human
ggcugggaggcggaggcugaga

SEQ ID NO: 132424 - RNA, 22 nt, Human
gggagcccuggacgggcgguau

SEQ ID NO: 132425 - RNA, 22 nt, Human
gggagccucccacugggggaag

SEQ ID NO: 132426 - RNA, 22 nt, Human
gggagcucaccaugcucugcau

SEQ ID NO: 132427 - RNA, 22 nt, Human
gugcaucuguaauuacaauggu

SEQ ID NO: 132428 - RNA, 22 nt, Human
gggagcuggagcuggaagacuc

SEQ ID NO: 132429 - RNA, 19 nt, Human
gugcacugucacuuugcuc

SEQ ID NO: 132430 - RNA, 22 nt, Human
gggacugcgagauucucaaggg

SEQ ID NO: 132431 - RNA, 22 nt, Human
gugauuucaaauauagagugag

SEQ ID NO: 132432 - RNA, 22 nt, Human
gugauggggagagcgcagcuuu

SEQ ID NO: 132433 - RNA, 22 nt, Human
gugauggucgagcgcuuguugu

SEQ ID NO: 132434 - RNA, 22 nt, Human
gugaugugugaaggucugcagg

SEQ ID NO: 132435 - RNA, 19 nt, Human
gugaugaugccacuccaac

SEQ ID NO: 132436 - RNA, 22 nt, Human
gggagaaccagccagugcaagg

SEQ ID NO: 132437 - RNA, 20 nt, Human
gggacugagccuuguuugug

SEQ ID NO: 132438 - RNA, 22 nt, Human
gggacugguuguguguggugug

SEQ ID NO: 132439 - RNA, 22 nt, Human
gggacagcuggggguaaagcau

SEQ ID NO: 132440 - RNA, 22 nt, Human
gggacaggacuccuggggccug

SEQ ID NO: 132441 - RNA, 22 nt, Human
gugcugcaaggauggagaggca

SEQ ID NO: 132442 - RNA, 19 nt, Human
gggauuccuggcuuuagaa

SEQ ID NO: 132443 - RNA, 22 nt, Human
gugcucaagacauuaggaauau

SEQ ID NO: 132444 - RNA, 22 nt, Human
gugcucaucuucuguaacuguu

SEQ ID NO: 132445 - RNA, 22 nt, Human
gggauguuuugcaggcaaagaa

SEQ ID NO: 132446 - RNA, 22 nt, Human
gggaugaaugccuggcuccccc

SEQ ID NO: 132447 - RNA, 22 nt, Human
gugccgcuggagcuggaauuga

SEQ ID NO: 132448 - RNA, 22 nt, Human
gugcccaguugaggccaggacu

SEQ ID NO: 132449 - RNA, 22 nt, Human
gugccgaugaggccuggcauuc

SEQ ID NO: 132450 - RNA, 22 nt, Human
gugccgggcugcggcaaggugu

SEQ ID NO: 132451 - RNA, 22 nt, Human
gggaggcagacgcuggagccca

SEQ ID NO: 132452 - RNA, 21 nt, Human
gggagugaguaaugauggggg

SEQ ID NO: 132453 - RNA, 22 nt, Human
gggagggggauucuggcgagaa

SEQ ID NO: 132454 - RNA, 22 nt, Human
gggauacuuuguuucccugcca

SEQ ID NO: 132455 - RNA, 22 nt, Human
gugaccagacagagucuagccc

SEQ ID NO: 132456 - RNA, 22 nt, Human
gugaaggggaagcagggagagg

SEQ ID NO: 132457 - RNA, 22 nt, Human
gugaagcacaugggcguugggu

SEQ ID NO: 132458 - RNA, 22 nt, Human
gugacugagugaagguugggua

SEQ ID NO: 132459 - RNA, 22 nt, Human
gugaggugauugcugguguuug

SEQ ID NO: 132460 - RNA, 22 nt, Human
gggaagaagaaaagagguggga

SEQ ID NO: 132461 - RNA, 22 nt, Human
gggaagccugggugauccuaaa

SEQ ID NO: 132462 - RNA, 18 nt, Human
gggaagaugccacaguga

SEQ ID NO: 132463 - RNA, 22 nt, Human
ggcuucaaaacacaugucaaga

SEQ ID NO: 132464 - RNA, 22 nt, Human
ggcuuguccuucugguugucuu

SEQ ID NO: 132465 - RNA, 22 nt, Human
ggcuguggcagcuggaaguggu

SEQ ID NO: 132466 - RNA, 22 nt, Human
ggcugugaaguacguugaaggu

SEQ ID NO: 132467 - RNA, 22 nt, Human
ggcuggggccuguugaagaugc

SEQ ID NO: 132468 - RNA, 22 nt, Human
ggcuuacgcgcuaacagugaau

SEQ ID NO: 132469 - RNA, 22 nt, Human
ggcugugggguccuguggugug

SEQ ID NO: 132470 - RNA, 22 nt, Human
ggcugugguggacgcgggaaac

SEQ ID NO: 132471 - RNA, 22 nt, Human
ggccaccuaagguugugcauca

SEQ ID NO: 132472 - RNA, 21 nt, Human
ggccagauucucccauagcug

SEQ ID NO: 132473 - RNA, 22 nt, Human
ggccacauuccagagggcugaa

SEQ ID NO: 132474 - RNA, 19 nt, Human
ggccacacuauuaaaagau

SEQ ID NO: 132475 - RNA, 23 nt, Human
gcucuccaucacaugguguggca

SEQ ID NO: 132476 - RNA, 22 nt, Human
gcuguguucauccugcccaggu

SEQ ID NO: 132477 - RNA, 22 nt, Human
ggcuucuuaacauuuggacacc

SEQ ID NO: 132478 - RNA, 19 nt, Human
ggcuuugcccuucgcuccg

SEQ ID NO: 132479 - RNA, 22 nt, Human
ggcuuugggaggaugaggcggu

SEQ ID NO: 132480 - RNA, 22 nt, Human
ggcuuuuucccuaggguaagag

SEQ ID NO: 132481 - RNA, 22 nt, Human
gcuguuggaggaguucagugcu

SEQ ID NO: 132482 - RNA, 22 nt, Human
gcuguugugaggaucagcauau

SEQ ID NO: 132483 - RNA, 22 nt, Human
gcuguuguugcacggaaggugg

SEQ ID NO: 132484 - RNA, 22 nt, Human
gggaaaucugcuuccuagggcu

SEQ ID NO: 132485 - RNA, 22 nt, Human
gcuuacuguuccuguuggugcu

SEQ ID NO: 132486 - RNA, 22 nt, Human
gggaacccaaauaggaaaauug

SEQ ID NO: 132487 - RNA, 22 nt, Human
gcuucacucugagacuuggagc

SEQ ID NO: 132488 - RNA, 22 nt, Human
gggaacgacuguuaguacuugg

SEQ ID NO: 132489 - RNA, 22 nt, Human
gggacgggcuagcugccguggc

SEQ ID NO: 132490 - RNA, 22 nt, Human
gggaccaaaugcuaccauucua

SEQ ID NO: 132491 - RNA, 20 nt, Human
gcuugcggacagguggcuca

SEQ ID NO: 132492 - RNA, 20 nt, Human
gcuugcgugggaggaggggg

SEQ ID NO: 132493 - RNA, 22 nt, Human
gcuugcaucaggggcuggggcc

SEQ ID NO: 132494 - RNA, 22 nt, Human
gcuugcugaacaggaaccuggc

SEQ ID NO: 132495 - RNA, 22 nt, Human
gggaagugagcuggaaucaagg

SEQ ID NO: 132496 - RNA, 20 nt, Human
gggaauggauggauugcucc

SEQ ID NO: 132497 - RNA, 20 nt, Human
gggaucgaguaccuccgggu

SEQ ID NO: 132498 - RNA, 21 nt, Human
gggagccucauuuucuucauc

SEQ ID NO: 132499 - RNA, 22 nt, Human
gcuuuugcaaagcuggagaauu

SEQ ID NO: 132500 - RNA, 22 nt, Human
gcuuucccaaccuucuugguau

SEQ ID NO: 132501 - RNA, 22 nt, Human
gggcagagggcgagcugggaga

SEQ ID NO: 132502 - RNA, 22 nt, Human
gggcagagagcuggaacuccuu

SEQ ID NO: 132503 - RNA, 22 nt, Human
ggaaaggacuggagcccagcgc

SEQ ID NO: 132504 - RNA, 22 nt, Human
gggccccgggcgcggcugcggg

SEQ ID NO: 132505 - RNA, 20 nt, Human
gggccagguggaccaggggc

SEQ ID NO: 132506 - RNA, 22 nt, Human
gggcccggguaggggaagagag

SEQ ID NO: 132507 - RNA, 22 nt, Human
ggaagccugggcgcaggcaggg

SEQ ID NO: 132508 - RNA, 22 nt, Human
gggccggagaagguagcugaag

SEQ ID NO: 132509 - RNA, 22 nt, Human
ggaagcugucugcccggcgcuc

SEQ ID NO: 132510 - RNA, 21 nt, Human
ggaauagcuuaaagugagggg

SEQ ID NO: 132511 - RNA, 18 nt, Human
ggaauagcuuguuuccca

SEQ ID NO: 132512 - RNA, 22 nt, Human
ggaccucagccaucccucggag

SEQ ID NO: 132513 - RNA, 22 nt, Human
ggacggcuagcagcagaauuca

SEQ ID NO: 132514 - RNA, 22 nt, Human
ggacccagggcuuauucauguu

SEQ ID NO: 132515 - RNA, 21 nt, Human
ggacucguucgccgugccagc

SEQ ID NO: 132516 - RNA, 22 nt, Human
ggacuucuggggacuguagauu

SEQ ID NO: 132517 - RNA, 22 nt, Human
ggacuggugaagccuucggaga

SEQ ID NO: 132518 - RNA, 22 nt, Human
gggcuuguuaacuuggcuucca

SEQ ID NO: 132519 - RNA, 22 nt, Human
ggaccagagcuaaugcgcgccc

SEQ ID NO: 132520 - RNA, 22 nt, Human
ggaauguuuuccagaccuagau

SEQ ID NO: 132521 - RNA, 22 nt, Human
ggaaugcuuggcaugagaaccu

SEQ ID NO: 132522 - RNA, 22 nt, Human
ggaaugcagugagcauuagaua

SEQ ID NO: 132523 - RNA, 22 nt, Human
ggcauuccucucuguucaugga

SEQ ID NO: 132524 - RNA, 22 nt, Human
gguggccuaacaaugguggcaa

SEQ ID NO: 132525 - RNA, 22 nt, Human
gguggccggcaccccacccucg

SEQ ID NO: 132526 - RNA, 20 nt, Human
ggcaucugacaacuaguugc

SEQ ID NO: 132527 - RNA, 22 nt, Human
ggugcuuuucacaagcauggga

SEQ ID NO: 132528 - RNA, 22 nt, Human
ggccaagagaggauggagggau

SEQ ID NO: 132529 - RNA, 22 nt, Human
ggccaaagagcacaaugaauag

SEQ ID NO: 132530 - RNA, 22 nt, Human
ggccacgggguuugcugaaacu

SEQ ID NO: 132531 - RNA, 22 nt, Human
ggccaauuuccuagacauuagu

SEQ ID NO: 132532 - RNA, 22 nt, Human
ggugugggcagaugcccuacuu

SEQ ID NO: 132533 - RNA, 22 nt, Human
gguguggguguuaguuugcuua

SEQ ID NO: 132534 - RNA, 22 nt, Human
gguguggcaguggaccugugaa

SEQ ID NO: 132535 - RNA, 22 nt, Human
ggugugugugugugugugugug

SEQ ID NO: 132536 - RNA, 20 nt, Human
ggcauuuuuuaguugagcuu

SEQ ID NO: 132537 - RNA, 22 nt, Human
ggugucuuugauguugggcuga

SEQ ID NO: 132538 - RNA, 22 nt, Human
ggugucguuucacaugacccag

SEQ ID NO: 132539 - RNA, 19 nt, Human
ggcacccagagucccccug

SEQ ID NO: 132540 - RNA, 22 nt, Human
ggcacagcgacuaccaucgaaa

SEQ ID NO: 132541 - RNA, 22 nt, Human
ggcaaggaagaaagcagaaguu

SEQ ID NO: 132542 - RNA, 20 nt, Human
ggcagagcuaugucuguugc

SEQ ID NO: 132543 - RNA, 18 nt, Human
ggugagggagcuggaagc

SEQ ID NO: 132544 - RNA, 20 nt, Human
ggcagcaaccauaugcuaca

SEQ ID NO: 132545 - RNA, 20 nt, Human
ggucagccaagaaguuaccu

SEQ ID NO: 132546 - RNA, 22 nt, Human
gguauccaaauaaagcagguaa

SEQ ID NO: 132547 - RNA, 22 nt, Human
ggucccacgauguaccugucug

SEQ ID NO: 132548 - RNA, 22 nt, Human
ggucgagcagcacccguucggc

SEQ ID NO: 132549 - RNA, 22 nt, Human
ggucauacaaggcacuggugau

SEQ ID NO: 132550 - RNA, 23 nt, Human
ggauggacauacguaugcacagg

SEQ ID NO: 132551 - RNA, 22 nt, Human
ggaugcagcagagaccuggagu

SEQ ID NO: 132552 - RNA, 22 nt, Human
ggaugauuuucaguuguguggg

SEQ ID NO: 132553 - RNA, 22 nt, Human
ggaggucagcuggaggggaggc

SEQ ID NO: 132554 - RNA, 22 nt, Human
ggagucguguuugggaucggag

SEQ ID NO: 132555 - RNA, 22 nt, Human
ggagugauuugucuugucuggu

SEQ ID NO: 132556 - RNA, 22 nt, Human
ggagugaguauguucugaugca

SEQ ID NO: 132557 - RNA, 22 nt, Human
ggaggggaguuugccucugggg

SEQ ID NO: 132558 - RNA, 22 nt, Human
gggugcuucauaggugaugcug

SEQ ID NO: 132559 - RNA, 22 nt, Human
gggugggguaggugacucucgc

SEQ ID NO: 132560 - RNA, 22 nt, Human
ggguggugagagaacuuugcag

SEQ ID NO: 132561 - RNA, 22 nt, Human
ggguggcaagucuuucugcaac

SEQ ID NO: 132562 - RNA, 22 nt, Human
ggguucugggaggacuagggga

SEQ ID NO: 132563 - RNA, 22 nt, Human
ggauccuuccuggugaagacug

SEQ ID NO: 132564 - RNA, 22 nt, Human
ggaucgauuccaaauguagauc

SEQ ID NO: 132565 - RNA, 22 nt, Human
ggaucagcgagaagggcugaaa

SEQ ID NO: 132566 - RNA, 22 nt, Human
ggguuguagagcuggaagggga

SEQ ID NO: 132567 - RNA, 22 nt, Human
ggaucccaucgagcuggcuguc

SEQ ID NO: 132568 - RNA, 22 nt, Human
ggguuguuuguauuucucugaa

SEQ ID NO: 132569 - RNA, 22 nt, Human
ggguuuccugcucgcggguagc

SEQ ID NO: 132570 - RNA, 22 nt, Human
ggguuuuggggaggaagugagc

SEQ ID NO: 132571 - RNA, 22 nt, Human
ggguuuguuccuacuucuacuc

SEQ ID NO: 132572 - RNA, 22 nt, Human
gggggcugugugcccgcucccc

SEQ ID NO: 132573 - RNA, 23 nt, Human
gggggagcuggacuccuagaucc

SEQ ID NO: 132574 - RNA, 22 nt, Human
ggagccuggaguuucugauggg

SEQ ID NO: 132575 - RNA, 22 nt, Human
gggggcgcguggagggccgugg

SEQ ID NO: 132576 - RNA, 20 nt, Human
ggagcgggcauuuguguucc

SEQ ID NO: 132577 - RNA, 22 nt, Human
ggagcuaagagaauggacaagg

SEQ ID NO: 132578 - RNA, 22 nt, Human
ggaggcccagaaggaagcccag

SEQ ID NO: 132579 - RNA, 23 nt, Human
ggaggcccagaggucggccccac

SEQ ID NO: 132580 - RNA, 22 nt, Human
ggaggccccccaugcagcucca

SEQ ID NO: 132581 - RNA, 22 nt, Human
gggggcagguuccaggccagcu

SEQ ID NO: 132582 - RNA, 22 nt, Human
gggggacagugugccuggugug

SEQ ID NO: 132583 - RNA, 22 nt, Human
gggggagaauaugugaaggggg

SEQ ID NO: 132584 - RNA, 22 nt, Human
ggagcaguggaggggccagggu

SEQ ID NO: 132585 - RNA, 19 nt, Human
ggagcagauaaacauacuu

SEQ ID NO: 132586 - RNA, 22 nt, Human
ggggcuuccagcgcccgccggu

SEQ ID NO: 132587 - RNA, 22 nt, Human
ggggcuggguuugcgcaggcuc

SEQ ID NO: 132588 - RNA, 18 nt, Human
gggcuuuacagaguggag

SEQ ID NO: 132589 - RNA, 22 nt, Human
gggcuuuuccaacacucuggag

SEQ ID NO: 132590 - RNA, 22 nt, Human
ggagcaagagugagcaagcaga

SEQ ID NO: 132591 - RNA, 22 nt, Human
ggaagaggaagaugaggcagca

SEQ ID NO: 132592 - RNA, 20 nt, Human
gccugggagaagaucaggga

SEQ ID NO: 132593 - RNA, 22 nt, Human
ggaagaagagggagcuguggga

SEQ ID NO: 132594 - RNA, 19 nt, Human
ggaacgcugggcuccccuc

SEQ ID NO: 132595 - RNA, 22 nt, Human
ggaagacuuagaguagcaucag

SEQ ID NO: 132596 - RNA, 22 nt, Human
gccugggugcugugggguggag

SEQ ID NO: 132597 - RNA, 22 nt, Human
gccugggcuuccgggacccggg

SEQ ID NO: 132598 - RNA, 22 nt, Human
gccuggggaacuugauccuguc

SEQ ID NO: 132599 - RNA, 22 nt, Human
gccugggccgggcgcggccccc

SEQ ID NO: 132600 - RNA, 22 nt, Human
ggacuuggcagugucaaauuua

SEQ ID NO: 132601 - RNA, 22 nt, Human
ggacauugaagcuggaaaggga

SEQ ID NO: 132602 - RNA, 22 nt, Human
ggacauaccgugccccaaugcg

SEQ ID NO: 132603 - RNA, 18 nt, Human
ggacaguuguagaggacu

SEQ ID NO: 132604 - RNA, 22 nt, Human
ggacagggagcaaaaacguccc

SEQ ID NO: 132605 - RNA, 22 nt, Human
ggagguggagcuggaaguucca

SEQ ID NO: 132606 - RNA, 22 nt, Human
ggagucugugucuugaagcagu

SEQ ID NO: 132607 - RNA, 22 nt, Human
ggagugaaugguggccguguuu

SEQ ID NO: 132608 - RNA, 19 nt, Human
ggaggguguccucaguguc

SEQ ID NO: 132609 - RNA, 22 nt, Human
ggagggcuggacguacuagggc

SEQ ID NO: 132610 - RNA, 22 nt, Human
ggaggccagagaagagccaggc

SEQ ID NO: 132611 - RNA, 22 nt, Human
ggaggcacugaaaguccuacag

SEQ ID NO: 132612 - RNA, 22 nt, Human
ggaggaggggcggggaggggag

SEQ ID NO: 132613 - RNA, 22 nt, Human
ggaggccgugcugugcugccag

SEQ ID NO: 132614 - RNA, 22 nt, Human
ggaggcggaaguccaagcaggu

SEQ ID NO: 132615 - RNA, 22 nt, Human
ggaggaugaggguggugguguu

SEQ ID NO: 132616 - RNA, 22 nt, Human
ggaggagggaguucaggaguau

SEQ ID NO: 132617 - RNA, 22 nt, Human
ggagcugaacccuuaacuggcu

SEQ ID NO: 132618 - RNA, 22 nt, Human
ggaggaagagaccagggggcuu

SEQ ID NO: 132619 - RNA, 22 nt, Human
ggagaccagaaggaagcuucga

SEQ ID NO: 132620 - RNA, 22 nt, Human
ggagaccaauuaaugaaggaau

SEQ ID NO: 132621 - RNA, 22 nt, Human
ggagagcguggaugggcuucca

SEQ ID NO: 132622 - RNA, 22 nt, Human
gcgcggcgcggguccucggccu

SEQ ID NO: 132623 - RNA, 22 nt, Human
gcgcgggugagucacgggcgga

SEQ ID NO: 132624 - RNA, 22 nt, Human
gcggacaauggaagaugucauu

SEQ ID NO: 132625 - RNA, 22 nt, Human
gcggaucuccuugagugggcaa

SEQ ID NO: 132626 - RNA, 22 nt, Human
ggaguucaaaucuuuuggaucu

SEQ ID NO: 132627 - RNA, 22 nt, Human
ggcacaggcugguaccaguuca

SEQ ID NO: 132628 - RNA, 22 nt, Human
ggcacccugcauuggcuugagu

SEQ ID NO: 132629 - RNA, 22 nt, Human
ggcacuggguugcagagagaga

SEQ ID NO: 132630 - RNA, 22 nt, Human
ggcacgagccaguguguguguu

SEQ ID NO: 132631 - RNA, 22 nt, Human
ggcaauauuauaagggcauuua

SEQ ID NO: 132632 - RNA, 22 nt, Human
ggcagcgcuuggcugcucgaca

SEQ ID NO: 132633 - RNA, 21 nt, Human
ggcagccuggcaggggcacug

SEQ ID NO: 132634 - RNA, 22 nt, Human
ggcagcagaacuggcccuguau

SEQ ID NO: 132635 - RNA, 22 nt, Human
ggcagcagaaccaacuguggcu

SEQ ID NO: 132636 - RNA, 22 nt, Human
gcguaccugaaauuacggcacu

SEQ ID NO: 132637 - RNA, 22 nt, Human
gcgucucugggcugacccaggu

SEQ ID NO: 132638 - RNA, 22 nt, Human
gcgguuguucugugugcaugga

SEQ ID NO: 132639 - RNA, 22 nt, Human
gcguggaugauuuugagucggu

SEQ ID NO: 132640 - RNA, 22 nt, Human
gcgugcauguguguaugcgugu

SEQ ID NO: 132641 - RNA, 22 nt, Human
gcgugcauggccguguguaugc

SEQ ID NO: 132642 - RNA, 22 nt, Human
gcucagagaaaacuggggcuug

SEQ ID NO: 132643 - RNA, 22 nt, Human
gcucagagaugucugcugccuu

SEQ ID NO: 132644 - RNA, 19 nt, Human
gcuccugcagcuagagugc

SEQ ID NO: 132645 - RNA, 22 nt, Human
ggcagguggcacugcugcuccc

SEQ ID NO: 132646 - RNA, 22 nt, Human
ggcagucaucacuuauucauca

SEQ ID NO: 132647 - RNA, 22 nt, Human
ggcaguagucagaggguuuuac

SEQ ID NO: 132648 - RNA, 22 nt, Human
gcuaguguuccacgaugugugu

SEQ ID NO: 132649 - RNA, 22 nt, Human
gcuaggagccucgacucuggag

SEQ ID NO: 132650 - RNA, 22 nt, Human
ggcaugcaaaugugggugaccu

SEQ ID NO: 132651 - RNA, 22 nt, Human
ggcagugguaggagcccaggag

SEQ ID NO: 132652 - RNA, 22 nt, Human
ggcauggugggggaggacuugg

SEQ ID NO: 132653 - RNA, 22 nt, Human
ggcauugauggggucuugggga

SEQ ID NO: 132654 - RNA, 22 nt, Human
gcugagcagaacaauuagaaau

SEQ ID NO: 132655 - RNA, 22 nt, Human
gcugagcaaugcacugccgcau

SEQ ID NO: 132656 - RNA, 22 nt, Human
gcucucuggccugggaggagga

SEQ ID NO: 132657 - RNA, 22 nt, Human
gcucucucuucugcaggccuua

SEQ ID NO: 132658 - RNA, 22 nt, Human
gcauguucaaguuaguauauuu

SEQ ID NO: 132659 - RNA, 22 nt, Human
gcugacucugcuuuuagccucc

SEQ ID NO: 132660 - RNA, 22 nt, Human
gcccgccaacuugccagcggug

SEQ ID NO: 132661 - RNA, 22 nt, Human
gcccgaccgcgccggcccgcac

SEQ ID NO: 132662 - RNA, 22 nt, Human
gccccaggggaggugcccugca

SEQ ID NO: 132663 - RNA, 15 nt, Human
gccccaggaaucaaa

SEQ ID NO: 132664 - RNA, 22 nt, Human
gcccuguuauagucugaggccu

SEQ ID NO: 132665 - RNA, 20 nt, Human
gcccuucccccuccgcgagc

SEQ ID NO: 132666 - RNA, 22 nt, Human
gcccugccauugaucggcccag

SEQ ID NO: 132667 - RNA, 22 nt, Human
gcugguggcagagcuccgcggc

SEQ ID NO: 132668 - RNA, 22 nt, Human
gcccucugccacaggacgccag

SEQ ID NO: 132669 - RNA, 22 nt, Human
gcuguugagucagacaaguuuu

SEQ ID NO: 132670 - RNA, 22 nt, Human
gcuguugcaaucaaggccaugg

SEQ ID NO: 132671 - RNA, 22 nt, Human
gcuguuucuuuggcaaacugau

SEQ ID NO: 132672 - RNA, 22 nt, Human
gcuguggagaagcugccuaugg

SEQ ID NO: 132673 - RNA, 22 nt, Human
gcuguggaaaaugggucuccaa

SEQ ID NO: 132674 - RNA, 20 nt, Human
gcugugccaugacccucgag

SEQ ID NO: 132675 - RNA, 22 nt, Human
gcuguccugggaacaggcacua

SEQ ID NO: 132676 - RNA, 22 nt, Human
gcugugacaagaggcugcuucu

SEQ ID NO: 132677 - RNA, 18 nt, Human
gcuguccgguagcuggug

SEQ ID NO: 132678 - RNA, 22 nt, Human
gcuguguaugaugcaggcaccu

SEQ ID NO: 132679 - RNA, 22 nt, Human
gcuguggguuccuccccugucc

SEQ ID NO: 132680 - RNA, 22 nt, Human
gcuguggcuccaauggugagcc

SEQ ID NO: 132681 - RNA, 22 nt, Human
gccgcaacggacccugggaguc

SEQ ID NO: 132682 - RNA, 22 nt, Human
gccgcagauucugagacgugua

SEQ ID NO: 132683 - RNA, 22 nt, Human
gccgccgccgccuuuguugcgg

SEQ ID NO: 132684 - RNA, 22 nt, Human
gcuucuguuaggauguggcuua

SEQ ID NO: 132685 - RNA, 22 nt, Human
gcuuccuuagcuuaccaaguau

SEQ ID NO: 132686 - RNA, 22 nt, Human
gcuucugugagugcagaugcug

SEQ ID NO: 132687 - RNA, 22 nt, Human
gcuucccacagcuggacugggg

SEQ ID NO: 132688 - RNA, 21 nt, Human
gcuucaauucauccaccucuc

SEQ ID NO: 132689 - RNA, 22 nt, Human
gccugcagccagggaguucucu

SEQ ID NO: 132690 - RNA, 17 nt, Human
ggaagaaaaggaucauc

SEQ ID NO: 132691 - RNA, 22 nt, Human
gccggcccugcgcggggcggaa

SEQ ID NO: 132692 - RNA, 22 nt, Human
gccgggagaggcggcgcagggg

SEQ ID NO: 132693 - RNA, 20 nt, Human
gccggggcauaggggccguc

SEQ ID NO: 132694 - RNA, 22 nt, Human
gccguuccuacucucucugugu

SEQ ID NO: 132695 - RNA, 21 nt, Human
gccgugcgccuccaggcgcgc

SEQ ID NO: 132696 - RNA, 22 nt, Human
gccuccagaggggacaaaaauu

SEQ ID NO: 132697 - RNA, 22 nt, Human
gccuccggagucgcagugucuu

SEQ ID NO: 132698 - RNA, 22 nt, Human
gccuagggacuuugguuuagau

SEQ ID NO: 132699 - RNA, 18 nt, Human
gccucuguugacagaguu

SEQ ID NO: 132700 - RNA, 15 nt, Human
gccgcgcuggggagc

SEQ ID NO: 132701 - RNA, 22 nt, Human
gcuugaggaacucagacuugag

SEQ ID NO: 132702 - RNA, 18 nt, Human
gccgccuugcucgugaac

SEQ ID NO: 132703 - RNA, 22 nt, Human
gccgcgggucugggucuggcuc

SEQ ID NO: 132704 - RNA, 22 nt, Human
gcuugcuuuguaaauaucugug

SEQ ID NO: 132705 - RNA, 22 nt, Human
gcuugggcugaaggccuggguc

SEQ ID NO: 132706 - RNA, 18 nt, Human
gcuuggguggcuauguuu

SEQ ID NO: 132707 - RNA, 22 nt, Human
gcuuggagaacguuuucuagaa

SEQ ID NO: 132708 - RNA, 22 nt, Human
gcuuuccuggcccugucccugc

SEQ ID NO: 132709 - RNA, 22 nt, Human
gaucccagaggcggggauagga

SEQ ID NO: 132710 - RNA, 22 nt, Human
gcagggcucagccgcucccacc

SEQ ID NO: 132711 - RNA, 21 nt, Human
gcaggggugugugagcugggg

SEQ ID NO: 132712 - RNA, 22 nt, Human
gcagggcucuggagucaggcug

SEQ ID NO: 132713 - RNA, 22 nt, Human
gcaggucacagcugauuggcca

SEQ ID NO: 132714 - RNA, 22 nt, Human
gaucuguccuggcaguuaacac

SEQ ID NO: 132715 - RNA, 22 nt, Human
gaucugguuccaggacauugca

SEQ ID NO: 132716 - RNA, 18 nt, Human
gaugaagaggaagaggag

SEQ ID NO: 132717 - RNA, 22 nt, Human
gcagguccgagagggucgggua

SEQ ID NO: 132718 - RNA, 22 nt, Human
gcagugcauggaagggggugug

SEQ ID NO: 132719 - RNA, 22 nt, Human
gcaguuaccuauuuuguagaaa

SEQ ID NO: 132720 - RNA, 22 nt, Human
gcaguugguccagccucggcug

SEQ ID NO: 132721 - RNA, 22 nt, Human
gcaguugugguuucguuuccuu

SEQ ID NO: 132722 - RNA, 22 nt, Human
gagucaguuguugcaccacuag

SEQ ID NO: 132723 - RNA, 22 nt, Human
gaguauuacuaaaauucgccua

SEQ ID NO: 132724 - RNA, 22 nt, Human
gccaaucaggaggcuguacauc

SEQ ID NO: 132725 - RNA, 20 nt, Human
gccaaggaggagaaacaggc

SEQ ID NO: 132726 - RNA, 19 nt, Human
gccacccaucauauggagg

SEQ ID NO: 132727 - RNA, 20 nt, Human
gccaccucugcucuuucccg

SEQ ID NO: 132728 - RNA, 22 nt, Human
gcauccugacuauggugguggu

SEQ ID NO: 132729 - RNA, 23 nt, Human
gcaucgcaggucuaagauuagcu

SEQ ID NO: 132730 - RNA, 22 nt, Human
gaguucaaagaucuaggaagag

SEQ ID NO: 132731 - RNA, 22 nt, Human
gccagccggugaguggaagcgg

SEQ ID NO: 132732 - RNA, 22 nt, Human
gaugccggggucguagccgugg

SEQ ID NO: 132733 - RNA, 22 nt, Human
gaugcauccuuucugucuucuc

SEQ ID NO: 132734 - RNA, 22 nt, Human
gaguggucacuaauuuccuuaa

SEQ ID NO: 132735 - RNA, 22 nt, Human
gaucccaguccuacccucauaa

SEQ ID NO: 132736 - RNA, 21 nt, Human
gaucgcaaugugggaaucaug

SEQ ID NO: 132737 - RNA, 18 nt, Human
gccagcccuccaaccucc

SEQ ID NO: 132738 - RNA, 22 nt, Human
gccccaaccccuccuuggucua

SEQ ID NO: 132739 - RNA, 22 nt, Human
gcccagcuuuuugaggcaggca

SEQ ID NO: 132740 - RNA, 22 nt, Human
gccaucugcuuagauugcuggg

SEQ ID NO: 132741 - RNA, 22 nt, Human
gccaucuucggcagccgccugg

SEQ ID NO: 132742 - RNA, 23 nt, Human
gccaucugcugggugccccggcc

SEQ ID NO: 132743 - RNA, 22 nt, Human
gccagggcucgagcaggccagc

SEQ ID NO: 132744 - RNA, 22 nt, Human
gauggugcaauuaucgugcaug

SEQ ID NO: 132745 - RNA, 22 nt, Human
gauggugauggcccuaagcuga

SEQ ID NO: 132746 - RNA, 22 nt, Human
gaugguaucugcuggcuuucag

SEQ ID NO: 132747 - RNA, 22 nt, Human
gauggggaaaaaauggaucuuu

SEQ ID NO: 132748 - RNA, 22 nt, Human
gccccgcgcgcguagcgccgcu

SEQ ID NO: 132749 - RNA, 22 nt, Human
gcccccgccuugcugggccagg

SEQ ID NO: 132750 - RNA, 22 nt, Human
gcccccauuccugcggccuuca

SEQ ID NO: 132751 - RNA, 22 nt, Human
gaugguggaggaaucgcugaag

SEQ ID NO: 132752 - RNA, 22 nt, Human
gcccccagcuggcuugaggauu

SEQ ID NO: 132753 - RNA, 22 nt, Human
gcccuguguguuugcacugauu

SEQ ID NO: 132754 - RNA, 22 nt, Human
gcccuggucguggagggcaaca

SEQ ID NO: 132755 - RNA, 22 nt, Human
gcccuggcauuucuauucaugu

SEQ ID NO: 132756 - RNA, 22 nt, Human
gauuccugcuauucacagggcu

SEQ ID NO: 132757 - RNA, 22 nt, Human
gcccuguuuucuggguuccuug

SEQ ID NO: 132758 - RNA, 22 nt, Human
gauuuugaaccuuauuuggaaa

SEQ ID NO: 132759 - RNA, 22 nt, Human
gccugccucugacuggggcuga

SEQ ID NO: 132760 - RNA, 18 nt, Human
gccugccagccgagggac

SEQ ID NO: 132761 - RNA, 22 nt, Human
gcacauaugcuguaagcacaug

SEQ ID NO: 132762 - RNA, 22 nt, Human
gcacccagggcaggaagugagg

SEQ ID NO: 132763 - RNA, 22 nt, Human
gcaccacccaaaggcggggcuc

SEQ ID NO: 132764 - RNA, 22 nt, Human
gccugcaggaaggugugccugu

SEQ ID NO: 132765 - RNA, 22 nt, Human
gccugcacucaaacacucucuu

SEQ ID NO: 132766 - RNA, 22 nt, Human
gcaauaaguuuucucuucuguc

SEQ ID NO: 132767 - RNA, 22 nt, Human
gcagaaguauuguacgguggga

SEQ ID NO: 132768 - RNA, 22 nt, Human
gccugcugggcucuuccugcug

SEQ ID NO: 132769 - RNA, 21 nt, Human
gccugcuguucacccugccac

SEQ ID NO: 132770 - RNA, 22 nt, Human
gcacucuguggagacaagauag

SEQ ID NO: 132771 - RNA, 22 nt, Human
gcagagcacccugcagugguau

SEQ ID NO: 132772 - RNA, 22 nt, Human
gccugggguuugcggggcugca

SEQ ID NO: 132773 - RNA, 22 nt, Human
gcagaggcugccgugggcagga

SEQ ID NO: 132774 - RNA, 22 nt, Human
gcagauaguaggagcuaaucuu

SEQ ID NO: 132775 - RNA, 22 nt, Human
gcgcgccugccucccgcggugc

SEQ ID NO: 132776 - RNA, 22 nt, Human
gcgcgcucugcgaggacacgcu

SEQ ID NO: 132777 - RNA, 21 nt, Human
gcgcgcucgugcucgacgcgc

SEQ ID NO: 132778 - RNA, 22 nt, Human
gcagcauuaccaagacauggca

SEQ ID NO: 132779 - RNA, 23 nt, Human
gcagccaacccacgugagagaag

SEQ ID NO: 132780 - RNA, 20 nt, Human
gcagcagacagacaggggac

SEQ ID NO: 132781 - RNA, 22 nt, Human
gcagcagugugggcugaaccua

SEQ ID NO: 132782 - RNA, 21 nt, Human
gcagcucaggauauagacuug

SEQ ID NO: 132783 - RNA, 20 nt, Human
gcgcuucccuacgcucugcu

SEQ ID NO: 132784 - RNA, 22 nt, Human
gcgcucuccugcagacagccuc

SEQ ID NO: 132785 - RNA, 23 nt, Human
gcgggcggagccgggaggcgggg

SEQ ID NO: 132786 - RNA, 22 nt, Human
gcagagcugucuaagucacuuc

SEQ ID NO: 132787 - RNA, 22 nt, Human
gcaggaaugguacauaccuguu

SEQ ID NO: 132788 - RNA, 22 nt, Human
gcaggccuccccugcuggagcu

SEQ ID NO: 132789 - RNA, 22 nt, Human
gcagugccauguggaggaucuc

SEQ ID NO: 132790 - RNA, 22 nt, Human
gcguggccugcugaaggacuuc

SEQ ID NO: 132791 - RNA, 22 nt, Human
gcaguagauccagcagccugca

SEQ ID NO: 132792 - RNA, 22 nt, Human
gcagguggaagcagcagacuca

SEQ ID NO: 132793 - RNA, 22 nt, Human
gcagguuguuuaaauuaggauu

SEQ ID NO: 132794 - RNA, 22 nt, Human
gcaggccgauuuguuagaaguc

SEQ ID NO: 132795 - RNA, 22 nt, Human
gcaggguaggugacagguaguc

SEQ ID NO: 132796 - RNA, 22 nt, Human
gcuagcugugcuuggaaguuug

SEQ ID NO: 132797 - RNA, 22 nt, Human
gcagugcugcgacagucgggug

SEQ ID NO: 132798 - RNA, 22 nt, Human
gcucagccuuuuguucuauuca

SEQ ID NO: 132799 - RNA, 22 nt, Human
gcauagauauguaaugcaucau

SEQ ID NO: 132800 - RNA, 22 nt, Human
gcaucccagaagauucugauuu

SEQ ID NO: 132801 - RNA, 22 nt, Human
gcucaugggcccagagcagccc

SEQ ID NO: 132802 - RNA, 22 nt, Human
gcaugcgugcgugcgugcaugu

SEQ ID NO: 132803 - RNA, 22 nt, Human
gcucccagcuuuuguccacggc

SEQ ID NO: 132804 - RNA, 23 nt, Human
gcucauguugcuucuguucuguc

SEQ ID NO: 132805 - RNA, 22 nt, Human
gcucggcuggcucaucucaugu

SEQ ID NO: 132806 - RNA, 23 nt, Human
gcugaagcccacucccugggucu

SEQ ID NO: 132807 - RNA, 20 nt, Human
gcucuucuccgggucugccu

SEQ ID NO: 132808 - RNA, 22 nt, Human
gcaugcaggaagggcuugggga

SEQ ID NO: 132809 - RNA, 22 nt, Human
aauuacuuuaggaaaacuccuc

SEQ ID NO: 132810 - RNA, 22 nt, Human
aagaggaggacgguucccagaa

SEQ ID NO: 132811 - RNA, 22 nt, Human
uggucugggaagaucacaauua

SEQ ID NO: 132812 - RNA, 22 nt, Human
ucagccuugguuuugguguugg

SEQ ID NO: 132813 - RNA, 22 nt, Human
ucuccucucugaucuugcuccg

SEQ ID NO: 132814 - RNA, 23 nt, Human
ucucccagaaguucucggggacu

SEQ ID NO: 132815 - RNA, 22 nt, Human
agagggagagaccuccgugccu

SEQ ID NO: 132816 - RNA, 22 nt, Human
aggaaaguugcuuguagugcug

SEQ ID NO: 132817 - RNA, 22 nt, Human
uucuuauuuuucguaaauccug

SEQ ID NO: 132818 - RNA, 22 nt, Human
agcaggaggguuuuguagaguc

SEQ ID NO: 132819 - RNA, 22 nt, Human
auuucacucuuaauugcuuccu

SEQ ID NO: 132820 - RNA, 22 nt, Human
gaggaggucaccuggugagcaa

SEQ ID NO: 132821 - RNA, 22 nt, Human
ucacaucugugugauugucauu

SEQ ID NO: 132822 - RNA, 22 nt, Human
uggucacgucgggguauugcca

SEQ ID NO: 132823 - RNA, 22 nt, Human
aacaaaacauuuuacgaauaua

SEQ ID NO: 132824 - RNA, 22 nt, Human
aguggcugugaaauacauggga

SEQ ID NO: 132825 - RNA, 22 nt, Human
ucauaagucucauauaugucca

SEQ ID NO: 132826 - RNA, 22 nt, Human
ugguggaggugggggguauuuu

SEQ ID NO: 132827 - RNA, 22 nt, Human
cagcacuuccuccgugagcccc

SEQ ID NO: 132828 - RNA, 22 nt, Human
aggcuuagaugaguucccacau

SEQ ID NO: 132829 - RNA, 22 nt, Human
cucagaauugucaccucaaaaa

SEQ ID NO: 132830 - RNA, 20 nt, Human
ugggauggaaucaccugcac

SEQ ID NO: 132831 - RNA, 22 nt, Human
uuuaugauguagccuagagcug

SEQ ID NO: 132832 - RNA, 22 nt, Human
aggcugggaaguguguccugag

SEQ ID NO: 132833 - RNA, 22 nt, Human
uccagaaagccguugacuuauu

SEQ ID NO: 132834 - RNA, 22 nt, Human
uuauuucauguaaaauuuaugu

SEQ ID NO: 132835 - RNA, 22 nt, Human
gagcaggucucaguucugccuc

SEQ ID NO: 132836 - RNA, 19 nt, Human
uccaaaauacuuguuacug

SEQ ID NO: 132837 - RNA, 22 nt, Human
uaagugcuagaauuccagguuu

SEQ ID NO: 132838 - RNA, 23 nt, Human
ggccuuuuuaaccgcgagcgaca

SEQ ID NO: 132839 - RNA, 22 nt, Human
ggagacagauggcgucucaguu

SEQ ID NO: 132840 - RNA, 22 nt, Human
uuuggcugucauuugaaaaugu

SEQ ID NO: 132841 - RNA, 22 nt, Human
uaaaaauuagauauguauuuag

SEQ ID NO: 132842 - RNA, 22 nt, Human
ggcagggagagcgccgccaugc

SEQ ID NO: 132843 - RNA, 22 nt, Human
caacauuucaaggucuuuagga

SEQ ID NO: 132844 - RNA, 22 nt, Human
cuguuuuugccugugacaaaaa

SEQ ID NO: 132845 - RNA, 22 nt, Human
guuuaaaagcaaccaacaggcu

SEQ ID NO: 132846 - RNA, 22 nt, Human
uguuccucuuagucuuaugugu

SEQ ID NO: 132847 - RNA, 22 nt, Human
auguuagcaucuggcacuaugg

SEQ ID NO: 132848 - RNA, 22 nt, Human
cuuuuuuucuccauauuucugg

SEQ ID NO: 132849 - RNA, 22 nt, Human
ucccauauuauggggaaaaacu

SEQ ID NO: 132850 - RNA, 22 nt, Human
guugggcugaagugugugcuua

SEQ ID NO: 132851 - RNA, 22 nt, Human
aaggggaggccugcgcuuucgg

SEQ ID NO: 132852 - RNA, 22 nt, Human
gggagcuggagcuggaagacuc

SEQ ID NO: 132853 - RNA, 20 nt, Human
guugggagaagugucagcug

SEQ ID NO: 132854 - RNA, 22 nt, Human
augagugugugguucuaaauga

SEQ ID NO: 132855 - RNA, 22 nt, Human
ggaaaaauggguggugauauga

SEQ ID NO: 132856 - RNA, 22 nt, Human
uguuaaaaagucccuguuuugu

SEQ ID NO: 132857 - RNA, 22 nt, Human
acucacuguuuugaaauugaac

SEQ ID NO: 132858 - RNA, 22 nt, Human
ugggccaaaugucugcauaagu

SEQ ID NO: 132859 - RNA, 22 nt, Human
cuuuucauuucauggaauacaa

SEQ ID NO: 132860 - RNA, 22 nt, Human
uuccucauucuggggcauguug

SEQ ID NO: 132861 - RNA, 23 nt, Human
uaaauuuuauucugauaacacag

SEQ ID NO: 132862 - RNA, 21 nt, Human
ugaagcccugugaggugcuua

SEQ ID NO: 132863 - RNA, 22 nt, Human
auuuaaagaguaauacaaucca

SEQ ID NO: 132864 - RNA, 22 nt, Human
cccauuuuuuggauguguggau

SEQ ID NO: 132865 - RNA, 22 nt, Human
ugaauaaauaaacuuuuacuac

SEQ ID NO: 132866 - RNA, 22 nt, Human
gaaaaagagaaggaguucagua

SEQ ID NO: 132867 - RNA, 22 nt, Human
gccuuuuaaggcagagggagau

SEQ ID NO: 132868 - RNA, 22 nt, Human
acuaaguagaggagugaugauu

SEQ ID NO: 132869 - RNA, 22 nt, Human
aacugcauaagcuucgggaccu

SEQ ID NO: 132870 - RNA, 22 nt, Human
uuuauugcuaugucuugauugu

SEQ ID NO: 132871 - RNA, 22 nt, Human
gacuggcucuaucaggauaaau

SEQ ID NO: 132872 - RNA, 22 nt, Human
uuauauuuuauuuaauuaaaua

SEQ ID NO: 132873 - RNA, 22 nt, Human
gagacugugucugucaagcuag

SEQ ID NO: 132874 - RNA, 22 nt, Human
agcagagggucaguuuuuuagu

SEQ ID NO: 132875 - RNA, 22 nt, Human
cucugcuagaaggucaaucucu

SEQ ID NO: 132876 - RNA, 22 nt, Human
gugguggggaguuggauggaag

SEQ ID NO: 132877 - RNA, 22 nt, Human
caggaggaggccgggaggaagc

SEQ ID NO: 132878 - RNA, 22 nt, Human
aauacagcacucacaccucccu

SEQ ID NO: 132879 - RNA, 18 nt, Human
cccagaggaaugccugga

SEQ ID NO: 132880 - RNA, 22 nt, Human
cugguuuauuucauaguuuguu

SEQ ID NO: 132881 - RNA, 22 nt, Human
ccuucugcuggucaucccagug

SEQ ID NO: 132882 - RNA, 22 nt, Human
aagggaggguaggaagagggag

SEQ ID NO: 132883 - RNA, 22 nt, Human
cagcagaggagguggcagcacc

SEQ ID NO: 132884 - RNA, 22 nt, Human
aaacugcuuucucugccuuucc

SEQ ID NO: 132885 - RNA, 22 nt, Human
ucaccauguacaugaagggcgg

SEQ ID NO: 132886 - RNA, 22 nt, Human
uauuuuaaaagcauuaauucuu

SEQ ID NO: 132887 - RNA, 22 nt, Human
aggccagggacaaugaggcaga

SEQ ID NO: 132888 - RNA, 22 nt, Human
agugugaguuacaaagugugaa

SEQ ID NO: 132889 - RNA, 22 nt, Human
gauggcaaugcuagaaauuuag

SEQ ID NO: 132890 - RNA, 22 nt, Human
ggcagagcugugcgcccaccca

SEQ ID NO: 132891 - RNA, 22 nt, Human
ggaaagagaaacaugaacuaga

SEQ ID NO: 132892 - RNA, 22 nt, Human
uccuugaauugcguccacaaga

SEQ ID NO: 132893 - RNA, 22 nt, Human
uggcuucagacuucugcuacgu

SEQ ID NO: 132894 - RNA, 22 nt, Human
caaaaaauccauagaaagaggu

SEQ ID NO: 132895 - RNA, 22 nt, Human
ggcagaggaagcuggaaguggg

SEQ ID NO: 132896 - RNA, 22 nt, Human
ccugcccaucccaccccagcau

SEQ ID NO: 132897 - RNA, 22 nt, Human
gcaggcaggauucagagauaca

SEQ ID NO: 132898 - RNA, 22 nt, Human
uuauuuaaguauuuauugaagu

SEQ ID NO: 132899 - RNA, 22 nt, Human
aagaggaggcuggaauccuaaa

SEQ ID NO: 132900 - RNA, 20 nt, Human
gacaugagggagcaaagagc

SEQ ID NO: 132901 - RNA, 22 nt, Human
aggacacuuccugaguggacaa

SEQ ID NO: 132902 - RNA, 22 nt, Human
ucauaaguuguugacuagcaaa

SEQ ID NO: 132903 - RNA, 22 nt, Human
auuuuuuuggucauaugagaua

SEQ ID NO: 132904 - RNA, 22 nt, Human
auguaaauauuuauauaugcau

SEQ ID NO: 132905 - RNA, 22 nt, Human
ucacuguaggaaucucuaaauu

SEQ ID NO: 132906 - RNA, 22 nt, Human
agucacuguuuaaucuagcuaa

SEQ ID NO: 132907 - RNA, 22 nt, Human
cccuuuuuuauggaguuggcca

SEQ ID NO: 132908 - RNA, 22 nt, Human
gaggucagugugggggcaaggg

SEQ ID NO: 132909 - RNA, 22 nt, Human
gagcagcugagcuggaaugaga

SEQ ID NO: 132910 - RNA, 22 nt, Human
ggcagggaauucagagggaagg

SEQ ID NO: 132911 - RNA, 22 nt, Human
uguagggaggaaggguuggaaa

SEQ ID NO: 132912 - RNA, 22 nt, Human
agaugaugugugucuucagcua

SEQ ID NO: 132913 - RNA, 22 nt, Human
ugaguacauuugauuaucagag

SEQ ID NO: 132914 - RNA, 22 nt, Human
aauuucuuucagcugcuuuaag

SEQ ID NO: 132915 - RNA, 22 nt, Human
auaaauucuaugauggauuggg

SEQ ID NO: 132916 - RNA, 22 nt, Human
auuauacauuaggagauugauu

SEQ ID NO: 132917 - RNA, 22 nt, Human
agauauuauuuucuauuuauca

SEQ ID NO: 132918 - RNA, 22 nt, Human
aguuucuugaagacugauguuu

SEQ ID NO: 132919 - RNA, 22 nt, Human
uuuauuuuccaugucucuaggu

SEQ ID NO: 132920 - RNA, 22 nt, Human
auuaugaauuguguuacgaaga

SEQ ID NO: 132921 - RNA, 22 nt, Human
agccagcauauauauaguugaa

SEQ ID NO: 132922 - RNA, 22 nt, Human
uacaggaggaugugcagccagg

SEQ ID NO: 132923 - RNA, 22 nt, Human
aggugcuugcauacugcuugac

SEQ ID NO: 132924 - RNA, 22 nt, Human
caaagcuucaucuguuguuuug

SEQ ID NO: 132925 - RNA, 22 nt, Human
aggggauggagcuggaaggcag

SEQ ID NO: 132926 - RNA, 22 nt, Human
gauuaaaggucuugauuauaag

SEQ ID NO: 132927 - RNA, 22 nt, Human
uuauuuaagaucuuaauauaua

SEQ ID NO: 132928 - RNA, 22 nt, Human
uauuuuauuuagguuuaguugu

SEQ ID NO: 132929 - RNA, 22 nt, Human
uucacauucauuucuuauguuu

SEQ ID NO: 132930 - RNA, 22 nt, Human
uccaggagucagacagauggug

SEQ ID NO: 132931 - RNA, 22 nt, Human
cuauguuucagauauauauaua

SEQ ID NO: 132932 - RNA, 22 nt, Human
aguuuuugccucgaauucugcg

SEQ ID NO: 132933 - RNA, 22 nt, Human
cucccaucacaauucagggccu

SEQ ID NO: 132934 - RNA, 22 nt, Human
cagagcagaaaccugggugauu

SEQ ID NO: 132935 - RNA, 22 nt, Human
uucuaauauuaugauuucuaag

SEQ ID NO: 132936 - RNA, 22 nt, Human
cauccagcuccugggggccacc

SEQ ID NO: 132937 - RNA, 22 nt, Human
acuggguuguuugucucaugag

SEQ ID NO: 132938 - RNA, 22 nt, Human
uugaaaaaauguguuuaaggag

SEQ ID NO: 132939 - RNA, 22 nt, Human
aaagaugaaguucagcgaagaa

SEQ ID NO: 132940 - RNA, 22 nt, Human
gcaggggguaaggggcagggcu

SEQ ID NO: 132941 - RNA, 22 nt, Human
gaaguaaaacaguaacuuuguu

SEQ ID NO: 132942 - RNA, 22 nt, Human
uauaaugucuuuguugaaaucu

SEQ ID NO: 132943 - RNA, 22 nt, Human
auagaaauagacaaugcaaaga

SEQ ID NO: 132944 - RNA, 22 nt, Human
gucugcagcacugugcacgguc

SEQ ID NO: 132945 - RNA, 20 nt, Human
cauuccaugcaucuuggucc

SEQ ID NO: 132946 - RNA, 22 nt, Human
cuggguguggugggugcugccg

SEQ ID NO: 132947 - RNA, 22 nt, Human
agucaccuacagcucaugcuuc

SEQ ID NO: 132948 - RNA, 22 nt, Human
cauuuugguaauguucguuugc

SEQ ID NO: 132949 - RNA, 22 nt, Human
ggagggaggggugggagaugga

SEQ ID NO: 132950 - RNA, 22 nt, Human
aaggaaaguuaagguaaacucu

SEQ ID NO: 132951 - RNA, 22 nt, Human
ucccaagugcuccucuggcccc

SEQ ID NO: 132952 - RNA, 22 nt, Human
ggagacagugacuuagagacug

SEQ ID NO: 132953 - RNA, 22 nt, Human
uuugcaggaaauguacugaaug

SEQ ID NO: 132954 - RNA, 22 nt, Human
uacuuacacugaagcaaagaua

SEQ ID NO: 132955 - RNA, 22 nt, Human
uuucuugugauuuugaugaacu

SEQ ID NO: 132956 - RNA, 22 nt, Human
aguauuuuaaaauacauuaucc

SEQ ID NO: 132957 - RNA, 22 nt, Human
aauuuuauuuuuuccccuagau

SEQ ID NO: 132958 - RNA, 22 nt, Human
uagugcuucauucuauugguuu

SEQ ID NO: 132959 - RNA, 22 nt, Human
cuugcuuuaucugguuucucau

SEQ ID NO: 132960 - RNA, 22 nt, Human
auuaaaaaugagaguagggauu

SEQ ID NO: 132961 - RNA, 22 nt, Human
acacaggacacaaaagucacca

SEQ ID NO: 132962 - RNA, 22 nt, Human
cuguuaauugugaauuuuacau

SEQ ID NO: 132963 - RNA, 22 nt, Human
ugaaguuuagaaaaagugccuu

SEQ ID NO: 132964 - RNA, 22 nt, Human
uguugaaacagcuauugacuuu

SEQ ID NO: 132965 - RNA, 22 nt, Human
agauggaggaaagcaguuagaa

SEQ ID NO: 132966 - RNA, 22 nt, Human
aggguggcuggaguggucuggu

SEQ ID NO: 132967 - RNA, 22 nt, Human
aguucaauuguuuuguaaaagu

SEQ ID NO: 132968 - RNA, 22 nt, Human
aaggugcugaggguccuggcuu

SEQ ID NO: 132969 - RNA, 22 nt, Human
gccugcaggaaggugugccugu

SEQ ID NO: 132970 - RNA, 22 nt, Human
agagacaggguuuugucguguu

SEQ ID NO: 132971 - RNA, 17 nt, Human
ccagcugcucccucaga

SEQ ID NO: 132972 - RNA, 22 nt, Human
gcugcgcugggacgccaccaac

SEQ ID NO: 132973 - RNA, 22 nt, Human
cuuggcuccuucacagggagau

SEQ ID NO: 132974 - RNA, 22 nt, Human
gcagaugagagugugaucuggg

SEQ ID NO: 132975 - RNA, 22 nt, Human
caagcagauauuuuagucaaga

SEQ ID NO: 132976 - RNA, 22 nt, Human
cacugugagugcaagcaggggu

SEQ ID NO: 132977 - RNA, 22 nt, Human
uaugaauauaccacaauuuagg

SEQ ID NO: 132978 - RNA, 22 nt, Human
uauuuuuuuaacauuuauugua

SEQ ID NO: 132979 - RNA, 22 nt, Human
acugucuuguuguaugugagcu

SEQ ID NO: 132980 - RNA, 22 nt, Human
aauuuuauuagacaggcauaau

SEQ ID NO: 132981 - RNA, 22 nt, Human
gaauagauuagaaagaguaugu

SEQ ID NO: 132982 - RNA, 22 nt, Human
gaggagggagcuggaagcucuu

SEQ ID NO: 132983 - RNA, 19 nt, Human
gcugggauaggauguauuu

SEQ ID NO: 132984 - RNA, 22 nt, Human
uuuuuucuucucuaucuuaaua

SEQ ID NO: 132985 - RNA, 22 nt, Human
aaacccuagcguuguuuauuga

SEQ ID NO: 132986 - RNA, 22 nt, Human
guggcaaguuuucugacaagga

SEQ ID NO: 132987 - RNA, 22 nt, Human
aacucugcaaugaaaucauguu

SEQ ID NO: 132988 - RNA, 23 nt, Human
cugaaauucagaugcuaaagaua

SEQ ID NO: 132989 - RNA, 22 nt, Human
uuuuugggccaaauauauuuac

SEQ ID NO: 132990 - RNA, 22 nt, Human
uguauauguguguagcauguua

SEQ ID NO: 132991 - RNA, 22 nt, Human
aauaucuugaguuauaaauuca

SEQ ID NO: 132992 - RNA, 22 nt, Human
gauguuaauauguuucaccaaa

SEQ ID NO: 132993 - RNA, 22 nt, Human
uaugggcaagagauaggugguc

SEQ ID NO: 132994 - RNA, 22 nt, Human
uauuguauuagcucuuggagau

SEQ ID NO: 132995 - RNA, 22 nt, Human
cauaaauuuuaccuuguaagug

SEQ ID NO: 132996 - RNA, 22 nt, Human
uucuccaccugcuccucccacc

SEQ ID NO: 132997 - RNA, 22 nt, Human
aaugcagaugugucuuuaauuu

SEQ ID NO: 132998 - RNA, 22 nt, Human
uucauagaagggaguuuuuccu

SEQ ID NO: 132999 - RNA, 22 nt, Human
cccagccugaucucggccagcu

SEQ ID NO: 133000 - RNA, 22 nt, Human
aagagugaguagcuugguuggu

SEQ ID NO: 133001 - RNA, 22 nt, Human
gagggggaaaagggcagcagag

SEQ ID NO: 133002 - RNA, 22 nt, Human
aguaggauguuuagcccuucuu

SEQ ID NO: 133003 - RNA, 22 nt, Human
ucugcccaggaggucccauggg

SEQ ID NO: 133004 - RNA, 22 nt, Human
ucaguagcauuuaauguucagu

SEQ ID NO: 133005 - RNA, 22 nt, Human
ccagccuucugaugggacccuc

SEQ ID NO: 133006 - RNA, 22 nt, Human
gaauacaaauaauaccaaggug

SEQ ID NO: 133007 - RNA, 22 nt, Human
ucgagaccagcuagaaggaagu

SEQ ID NO: 133008 - RNA, 22 nt, Human
gcaucacacgcacauacacaca

SEQ ID NO: 133009 - RNA, 22 nt, Human
ccagaggcuuaugcagcugcug

SEQ ID NO: 133010 - RNA, 22 nt, Human
guuuugaugugauuucucaugu

SEQ ID NO: 133011 - RNA, 22 nt, Human
auuuuuuuaggcugucagccgc

SEQ ID NO: 133012 - RNA, 22 nt, Human
agcccagguggagugugugggg

SEQ ID NO: 133013 - RNA, 22 nt, Human
gaggaggcuggagaggccagga

SEQ ID NO: 133014 - RNA, 22 nt, Human
gcugcaggaggugguagggucu

SEQ ID NO: 133015 - RNA, 22 nt, Human
auuuccacaaauuaagauugca

SEQ ID NO: 133016 - RNA, 22 nt, Human
cuuccauucugauggcuaauua

SEQ ID NO: 133017 - RNA, 22 nt, Human
ucccagguugaggccuugccug

SEQ ID NO: 133018 - RNA, 17 nt, Human
agggaaguagggugggc

SEQ ID NO: 133019 - RNA, 22 nt, Human
gucuugugaagacggcagaaag

SEQ ID NO: 133020 - RNA, 22 nt, Human
aacugaaguuuucagauuuugc

SEQ ID NO: 133021 - RNA, 22 nt, Human
uaauaauuaacagugauggguc

SEQ ID NO: 133022 - RNA, 22 nt, Human
ucaguuacucugauguccugug

SEQ ID NO: 133023 - RNA, 22 nt, Human
aggggaggggaguaucaggauu

SEQ ID NO: 133024 - RNA, 22 nt, Human
uuuauucuuugcuagguuccau

SEQ ID NO: 133025 - RNA, 22 nt, Human
uuuuuuuuacuccggacagcuc

SEQ ID NO: 133026 - RNA, 22 nt, Human
cugaguuuuucaaaucugaauu

SEQ ID NO: 133027 - RNA, 22 nt, Human
aagucauuaucucuucuaaucu

SEQ ID NO: 133028 - RNA, 22 nt, Human
agagggagagauuggcaaucag

SEQ ID NO: 133029 - RNA, 22 nt, Human
gcugggacacacagucuucuuu

SEQ ID NO: 133030 - RNA, 22 nt, Human
guuguuuuuguuaaaacaguga

SEQ ID NO: 133031 - RNA, 22 nt, Human
aauugcuuucacaaguguuaua

SEQ ID NO: 133032 - RNA, 22 nt, Human
caguggacacuuccucuacaau

SEQ ID NO: 133033 - RNA, 21 nt, Human
auacaguucagcuuuuacuau

SEQ ID NO: 133034 - RNA, 20 nt, Human
cuuauuuuggagaacuuuuc

SEQ ID NO: 133035 - RNA, 22 nt, Human
ggcagggacugggauauggaga

SEQ ID NO: 133036 - RNA, 22 nt, Human
aaauucuuccaggaggaaauac

SEQ ID NO: 133037 - RNA, 22 nt, Human
augugaaagagguguucagugg

SEQ ID NO: 133038 - RNA, 22 nt, Human
cuaauaauuuacugagugcuac

SEQ ID NO: 133039 - RNA, 22 nt, Human
cauuuacauaacaguaacgcug

SEQ ID NO: 133040 - RNA, 19 nt, Human
uccuacaugagacagagag

SEQ ID NO: 133041 - RNA, 22 nt, Human
auacacuucauguuuucaucug

SEQ ID NO: 133042 - RNA, 22 nt, Human
guauaaauaucuauauuguuac

SEQ ID NO: 133043 - RNA, 22 nt, Human
agagggagccugcacagcuuuc

SEQ ID NO: 133044 - RNA, 22 nt, Human
gaugauaacagcauuucaacug

SEQ ID NO: 133045 - RNA, 22 nt, Human
uacaaaauucaaauaauguuug

SEQ ID NO: 133046 - RNA, 22 nt, Human
uaacaguauacuacaucauauu

SEQ ID NO: 133047 - RNA, 22 nt, Human
cucaaaauccauaaaaucaggu

SEQ ID NO: 133048 - RNA, 22 nt, Human
uagggaggguuugggguggagg

SEQ ID NO: 133049 - RNA, 22 nt, Human
uucugcuuuaaagcucauguuu

SEQ ID NO: 133050 - RNA, 22 nt, Human
cagaaacacuguauuuagggaa

SEQ ID NO: 133051 - RNA, 22 nt, Human
agcggaggaggcggagcaggga

SEQ ID NO: 133052 - RNA, 22 nt, Human
cagaguccugcaccagcuccag

SEQ ID NO: 133053 - RNA, 22 nt, Human
ggcugggaggcggaggcugaga

SEQ ID NO: 133054 - RNA, 22 nt, Human
ggagguggagcuggaaguucca

SEQ ID NO: 133055 - RNA, 22 nt, Human
uaguucugaauagcauugaaga

SEQ ID NO: 133056 - RNA, 22 nt, Human
gcaguuaccuauuuuguagaaa

SEQ ID NO: 133057 - RNA, 22 nt, Human
gagcacugagcuggaauuggag

SEQ ID NO: 133058 - RNA, 20 nt, Human
uggcccgcgcuccuccugcu

SEQ ID NO: 133059 - RNA, 22 nt, Human
aauguaaauaauuguaaaauuu

SEQ ID NO: 133060 - RNA, 22 nt, Human
uaacauuuaguuuuaagauggu

SEQ ID NO: 133061 - RNA, 22 nt, Human
caugaugagaguaauaacacag

SEQ ID NO: 133062 - RNA, 22 nt, Human
auuuucuugucucuguuguagg

SEQ ID NO: 133063 - RNA, 21 nt, Human
uucuauauugagaauuggcua

SEQ ID NO: 133064 - RNA, 22 nt, Human
guacuugauucauuauugcauu

SEQ ID NO: 133065 - RNA, 22 nt, Human
uucuagcucauggugacagauc

SEQ ID NO: 133066 - RNA, 22 nt, Human
guuuucuaaaacacauauaagu

SEQ ID NO: 133067 - RNA, 22 nt, Human
accuugggcccagaccggcacg

SEQ ID NO: 133068 - RNA, 20 nt, Human
ucacuguaauugccuacauu

SEQ ID NO: 133069 - RNA, 22 nt, Human
aaauauauccuucuguccugcc

SEQ ID NO: 133070 - RNA, 22 nt, Human
cuucagagugacucagcaucuu

SEQ ID NO: 133071 - RNA, 22 nt, Human
cuggaaaaauggauccugucuu

SEQ ID NO: 133072 - RNA, 22 nt, Human
uaagaaacauuuuuaugacagu

SEQ ID NO: 133073 - RNA, 22 nt, Human
ggaagcuguugugagugcagca

SEQ ID NO: 133074 - RNA, 22 nt, Human
aguaauaaacaacucauuuugg

SEQ ID NO: 133075 - RNA, 22 nt, Human
ugccuaguuuaaaucauuuucu

SEQ ID NO: 133076 - RNA, 22 nt, Human
uccagggaggggcggcaggggu

SEQ ID NO: 133077 - RNA, 22 nt, Human
uguacuguuuucuaggcaaaaa

SEQ ID NO: 133078 - RNA, 22 nt, Human
auuucauaaaaacuuuaccuga

SEQ ID NO: 133079 - RNA, 22 nt, Human
cagcuccagcccaggcagcucc

SEQ ID NO: 133080 - RNA, 22 nt, Human
uugcuuucuuuguagguuuucc

SEQ ID NO: 133081 - RNA, 22 nt, Human
gauuugucuauauucaaauaug

SEQ ID NO: 133082 - RNA, 22 nt, Human
uuuguuuuggugucaugcguga

SEQ ID NO: 133083 - RNA, 22 nt, Human
uuuuccuucugauacuccauuu

SEQ ID NO: 133084 - RNA, 17 nt, Human
guucucaaacugacuga

SEQ ID NO: 133085 - RNA, 22 nt, Human
aaauauauauaauauauauauu

SEQ ID NO: 133086 - RNA, 22 nt, Human
uucagcaagugucucuacuguc

SEQ ID NO: 133087 - RNA, 22 nt, Human
ggagguguguucuguuuuagug

SEQ ID NO: 133088 - RNA, 22 nt, Human
cucuaagcuuugguguuucacu

SEQ ID NO: 133089 - RNA, 22 nt, Human
uuuuuaagguuuguuuauauau

SEQ ID NO: 133090 - RNA, 22 nt, Human
gcuguguaugaugcaggcaccu

SEQ ID NO: 133091 - RNA, 20 nt, Human
acccagaguccuccccgcgc

SEQ ID NO: 133092 - RNA, 22 nt, Human
ugcucacugcuuguguucaguu

SEQ ID NO: 133093 - RNA, 22 nt, Human
gaaagugaauguaacauguuau

SEQ ID NO: 133094 - RNA, 22 nt, Human
uuuguuaugguuggaagcagga

SEQ ID NO: 133095 - RNA, 22 nt, Human
uggcucagcgcggccuggucuu

SEQ ID NO: 133096 - RNA, 22 nt, Human
uuuuuuuaaguuuugauuuuag

SEQ ID NO: 133097 - RNA, 21 nt, Human
uuuuucuccagaguuuccacu

SEQ ID NO: 133098 - RNA, 22 nt, Human
agugaaaacugaaucaccuucc

SEQ ID NO: 133099 - RNA, 22 nt, Human
uggaaggggagcuggaaagggg

SEQ ID NO: 133100 - RNA, 23 nt, Human
aagaaugcuucugaagagcugcc

SEQ ID NO: 133101 - RNA, 23 nt, Human
aaaguacuuaaucugcaaaccac

SEQ ID NO: 133102 - RNA, 22 nt, Human
ccugggccuaaacaaacaagag

SEQ ID NO: 133103 - RNA, 22 nt, Human
ugaauaaucuuggguauuaaua

SEQ ID NO: 133104 - RNA, 22 nt, Human
aacuuucuuugcaucuaaguuu

SEQ ID NO: 133105 - RNA, 22 nt, Human
uuuguuugcuaguauuuuguuu

SEQ ID NO: 133106 - RNA, 22 nt, Human
auauguuaugccauuuucaagg

SEQ ID NO: 133107 - RNA, 22 nt, Human
uguaaauucuauacacuuaaaa

SEQ ID NO: 133108 - RNA, 22 nt, Human
gagaaggagcagaaaaucuccu

SEQ ID NO: 133109 - RNA, 22 nt, Human
guauauuuaugagcauuagccu

SEQ ID NO: 133110 - RNA, 22 nt, Human
acagagcucccagccaucuccu

SEQ ID NO: 133111 - RNA, 22 nt, Human
uuucagagaaagcccaaagacu

SEQ ID NO: 133112 - RNA, 22 nt, Human
cuaaaacuuuuccaaauuaugu

SEQ ID NO: 133113 - RNA, 22 nt, Human
caagaaaaaacaugaugagugu

SEQ ID NO: 133114 - RNA, 22 nt, Human
uugaauaaggcauaaagauacu

SEQ ID NO: 133115 - RNA, 22 nt, Human
uuauuuuuguaacacuguauag

SEQ ID NO: 133116 - RNA, 22 nt, Human
cagcucugcugggaggaugcag

SEQ ID NO: 133117 - RNA, 22 nt, Human
ugagggagggggagccguucua

SEQ ID NO: 133118 - RNA, 22 nt, Human
ggcuucuuaacauuuggacacc

SEQ ID NO: 133119 - RNA, 22 nt, Human
aagagaaagggaaaaugguaaa

SEQ ID NO: 133120 - RNA, 22 nt, Human
auucaucuguacuucaauaucu

SEQ ID NO: 133121 - RNA, 22 nt, Human
uauauauaauguguacagguga

SEQ ID NO: 133122 - RNA, 22 nt, Human
uuugaagaccuuaucucuaaau

SEQ ID NO: 133123 - RNA, 22 nt, Human
auucauuuuuacaucaccaaua

SEQ ID NO: 133124 - RNA, 22 nt, Human
ucucaaagagcuacuggucuau

SEQ ID NO: 133125 - RNA, 22 nt, Human
guauuauauaaccauugguucu

SEQ ID NO: 133126 - RNA, 22 nt, Human
ucugaguuaaaauuccagaggu

SEQ ID NO: 133127 - RNA, 22 nt, Human
acccccaggacacugccucuga

SEQ ID NO: 133128 - RNA, 22 nt, Human
uaaaugaaaggguuuaauuuau

SEQ ID NO: 133129 - RNA, 22 nt, Human
caauaccucuuggugauugggc

SEQ ID NO: 133130 - RNA, 22 nt, Human
uuuaauuauaucugggcaguua

SEQ ID NO: 133131 - RNA, 22 nt, Human
gcaguaaauugagagucauguu

SEQ ID NO: 133132 - RNA, 22 nt, Human
aauucuuuguuccucugccaag

SEQ ID NO: 133133 - RNA, 23 nt, Human
ugccaggaagaaugaccucugcu

SEQ ID NO: 133134 - RNA, 22 nt, Human
guaaauacuaugagauaaugaa

SEQ ID NO: 133135 - RNA, 22 nt, Human
cuuuaaaaauguauuuuugugg

SEQ ID NO: 133136 - RNA, 22 nt, Human
uuuuucugacugcuaacaaaaa

SEQ ID NO: 133137 - RNA, 23 nt, Human
gcuuugaaaaugcuuucuuccag

SEQ ID NO: 133138 - RNA, 22 nt, Human
uuuuuuaaucaaguaggaaaca

SEQ ID NO: 133139 - RNA, 22 nt, Human
auacauauaugcacauuaauau

SEQ ID NO: 133140 - RNA, 22 nt, Human
uccugagaagcacuuaauacac

SEQ ID NO: 133141 - RNA, 22 nt, Human
ugaaaaauauuuuuagaaauaa

SEQ ID NO: 133142 - RNA, 22 nt, Human
gauauauuucaaauucuuuugc

SEQ ID NO: 133143 - RNA, 22 nt, Human
uaauugaacguucauuuuuaau

SEQ ID NO: 133144 - RNA, 22 nt, Human
uugggaacaggcuucccacugg

SEQ ID NO: 133145 - RNA, 21 nt, Human
ugcuuucugugcuuuuucugc

SEQ ID NO: 133146 - RNA, 22 nt, Human
cccagagggcugaggauaugaa

SEQ ID NO: 133147 - RNA, 22 nt, Human
aauguucucuaaucuuucucuu

SEQ ID NO: 133148 - RNA, 22 nt, Human
cuccagcagaaagggcgagugg

SEQ ID NO: 133149 - RNA, 22 nt, Human
auuuuucuuucacauuuucuua

SEQ ID NO: 133150 - RNA, 22 nt, Human
cugaaagacgaggggaagucgg

SEQ ID NO: 133151 - RNA, 22 nt, Human
ucaguauuagugcauuaucagg

SEQ ID NO: 133152 - RNA, 22 nt, Human
ugugucucucuuagguugucug

SEQ ID NO: 133153 - RNA, 22 nt, Human
agucuagagcuuuuaucaggcc

SEQ ID NO: 133154 - RNA, 22 nt, Human
aaauagucagaaaucaacgugc

SEQ ID NO: 133155 - RNA, 22 nt, Human
ugaggagggcuagagucuccug

SEQ ID NO: 133156 - RNA, 22 nt, Human
uuauaagugccucuuuauuuuc

SEQ ID NO: 133157 - RNA, 22 nt, Human
cagagcugucauuugccaguga

SEQ ID NO: 133158 - RNA, 22 nt, Human
cacuguugagcaauguacagug

SEQ ID NO: 133159 - RNA, 21 nt, Human
gccugcuguucacccugccac

SEQ ID NO: 133160 - RNA, 22 nt, Human
uucauuuccauuuuauagauaa

SEQ ID NO: 133161 - RNA, 22 nt, Human
cugaaagacagccaggcaaagc

SEQ ID NO: 133162 - RNA, 22 nt, Human
cauauuaugcauguuguucuuu

SEQ ID NO: 133163 - RNA, 22 nt, Human
uacaacuuacuugaauggcuuu

SEQ ID NO: 133164 - RNA, 22 nt, Human
ccagcaggagacuagcaacaua

SEQ ID NO: 133165 - RNA, 22 nt, Human
auauauacuuugacacauucug

SEQ ID NO: 133166 - RNA, 22 nt, Human
gaaauagagacaguaagugucu

SEQ ID NO: 133167 - RNA, 22 nt, Human
ggcugcagggaacaggaugggu

SEQ ID NO: 133168 - RNA, 22 nt, Human
ugagagggagacagcucuagca

SEQ ID NO: 133169 - RNA, 22 nt, Human
aaugaguuuguucuauuauuug

SEQ ID NO: 133170 - RNA, 22 nt, Human
auuagaagagcuuuuuacucuu

SEQ ID NO: 133171 - RNA, 22 nt, Human
augcccagaacccccuggaugg

SEQ ID NO: 133172 - RNA, 22 nt, Human
agagggcaggcugguugggguc

SEQ ID NO: 133173 - RNA, 22 nt, Human
guggagaaagcuggaaucugag

SEQ ID NO: 133174 - RNA, 22 nt, Human
gcacugagacuuuagauuggag

SEQ ID NO: 133175 - RNA, 22 nt, Human
agaggcagagcugggguuugac

SEQ ID NO: 133176 - RNA, 19 nt, Human
auuuccuggcauauaucac

SEQ ID NO: 133177 - RNA, 22 nt, Human
caaagccuggggagaguaagga

SEQ ID NO: 133178 - RNA, 22 nt, Human
guauugauuguuuuaaaagauu

SEQ ID NO: 133179 - RNA, 22 nt, Human
uguugucaugcagucaguggua

SEQ ID NO: 133180 - RNA, 22 nt, Human
caagaaguugacagccagguga

SEQ ID NO: 133181 - RNA, 20 nt, Human
cucuuuaugagaccacuguc

SEQ ID NO: 133182 - RNA, 22 nt, Human
aaacagcugcaguacacggccu

SEQ ID NO: 133183 - RNA, 20 nt, Human
agcuuucaccaguacuucca

SEQ ID NO: 133184 - RNA, 22 nt, Human
uuuuauaaaaccuguuugaccu

SEQ ID NO: 133185 - RNA, 22 nt, Human
uauguuaaauguuugauguuua

SEQ ID NO: 133186 - RNA, 22 nt, Human
cugagguccucagagggaaagg

SEQ ID NO: 133187 - RNA, 22 nt, Human
uggcaagcuguuggcagauagc

SEQ ID NO: 133188 - RNA, 22 nt, Human
auggucugcucagucucuugac

SEQ ID NO: 133189 - RNA, 22 nt, Human
uauguauaacuugauaggauga

SEQ ID NO: 133190 - RNA, 22 nt, Human
uuuaacauaugaaagaauauuu

SEQ ID NO: 133191 - RNA, 22 nt, Human
aauauuuaaauagaauuacauc

SEQ ID NO: 133192 - RNA, 22 nt, Human
gcucccaauuccuuuuacaauu

SEQ ID NO: 133193 - RNA, 22 nt, Human
ugguggagucugggggaggcuu

SEQ ID NO: 133194 - RNA, 22 nt, Human
uucacuguucuuagagaagacc

SEQ ID NO: 133195 - RNA, 22 nt, Human
gcucugaacugucaugaauugg

SEQ ID NO: 133196 - RNA, 22 nt, Human
ggcuagggaucuagaccaggac

SEQ ID NO: 133197 - RNA, 22 nt, Human
aguucauccucauuuacaagga

SEQ ID NO: 133198 - RNA, 22 nt, Human
gauaaauaguguuuggggacau

SEQ ID NO: 133199 - RNA, 22 nt, Human
guccuguguaaguacuugcuca

SEQ ID NO: 133200 - RNA, 22 nt, Human
cuauacuuagaacuccauuuuc

SEQ ID NO: 133201 - RNA, 22 nt, Human
uuuauguuuguuuuugaaauaa

SEQ ID NO: 133202 - RNA, 22 nt, Human
aauuuaauugguuuuuacuugu

SEQ ID NO: 133203 - RNA, 18 nt, Human
uucaggcucuugcaugaa

SEQ ID NO: 133204 - RNA, 22 nt, Human
cagacagaaggcuccuugaggu

SEQ ID NO: 133205 - RNA, 22 nt, Human
auuugcuuguucaccaguacuu

SEQ ID NO: 133206 - RNA, 22 nt, Human
caaauuuuuauuuaccaucugc

SEQ ID NO: 133207 - RNA, 22 nt, Human
aguuuaaauuguucuaucagaa

SEQ ID NO: 133208 - RNA, 22 nt, Human
uggcaggggaaaagggguggga

SEQ ID NO: 133209 - RNA, 22 nt, Human
ccaugauguugccuacacugcu

SEQ ID NO: 133210 - RNA, 22 nt, Human
gggccaaggggagcuggaaggg

SEQ ID NO: 133211 - RNA, 22 nt, Human
gcagagcugucuaagucacuuc

SEQ ID NO: 133212 - RNA, 22 nt, Human
agaguguagugaaaagagauua

SEQ ID NO: 133213 - RNA, 22 nt, Human
ccucaggaauuuauucuucugu

SEQ ID NO: 133214 - RNA, 22 nt, Human
augaguuaaguagcccuucaug

SEQ ID NO: 133215 - RNA, 21 nt, Human
aaguuucucccuaauuguugc

SEQ ID NO: 133216 - RNA, 22 nt, Human
uucuucuucuuccucauccuca

SEQ ID NO: 133217 - RNA, 22 nt, Human
aaaauauucuauaucaaagaua

SEQ ID NO: 133218 - RNA, 22 nt, Human
uuaugccuguuaggcagcaucu

SEQ ID NO: 133219 - RNA, 22 nt, Human
ucccagaaauccaggcuuaaau

SEQ ID NO: 133220 - RNA, 22 nt, Human
uggggcugguaccguaauauau

SEQ ID NO: 133221 - RNA, 18 nt, Human
aaacccacguauucaggc

SEQ ID NO: 133222 - RNA, 22 nt, Human
gaauuagacggcaucacauggg

SEQ ID NO: 133223 - RNA, 22 nt, Human
uaguuuuaagcugacauuguuc

SEQ ID NO: 133224 - RNA, 22 nt, Human
gacggaggacaucagcaguguc

SEQ ID NO: 133225 - RNA, 22 nt, Human
gccugagauuggacauuauuua

SEQ ID NO: 133226 - RNA, 22 nt, Human
uaauuauuaauuuuagguugcu

SEQ ID NO: 133227 - RNA, 22 nt, Human
uuucuaaaauuacugcagucgg

SEQ ID NO: 133228 - RNA, 22 nt, Human
ggaagcucaauacuuuccucuu

SEQ ID NO: 133229 - RNA, 22 nt, Human
cauuugcuuaucacucuucuuu

SEQ ID NO: 133230 - RNA, 22 nt, Human
aagacagaaaagcagagagagg

SEQ ID NO: 133231 - RNA, 22 nt, Human
uuuuuuuagaaagaucauaguu

SEQ ID NO: 133232 - RNA, 22 nt, Human
uuuugcuucuaguauauuuuuu

SEQ ID NO: 133233 - RNA, 22 nt, Human
ucacuucuaugaucugucucuu

SEQ ID NO: 133234 - RNA, 22 nt, Human
caggaaaauaauggugauggga

SEQ ID NO: 133235 - RNA, 22 nt, Human
gaguucuagauguauuauuaau

SEQ ID NO: 133236 - RNA, 22 nt, Human
auguucucagguuguauuuauu

SEQ ID NO: 133237 - RNA, 22 nt, Human
ucugacuucuuuuauuaucauu

SEQ ID NO: 133238 - RNA, 22 nt, Human
ggcagaggagcuggaaacaugg

SEQ ID NO: 133239 - RNA, 22 nt, Human
uuggaaaagaaauacucauaua

SEQ ID NO: 133240 - RNA, 22 nt, Human
uccucagcaaacacuucacucu

SEQ ID NO: 133241 - RNA, 22 nt, Human
caggagagucucugucuguacu

SEQ ID NO: 133242 - RNA, 22 nt, Human
ucuaaaaauuagaaauuagguc

SEQ ID NO: 133243 - RNA, 22 nt, Human
aggcaggggagcuggaagggua

SEQ ID NO: 133244 - RNA, 22 nt, Human
aggggcugugucauuuguccua

SEQ ID NO: 133245 - RNA, 22 nt, Human
gaauggcagaaugaagcagugu

SEQ ID NO: 133246 - RNA, 22 nt, Human
aguucaugugguuuaacuuaau

SEQ ID NO: 133247 - RNA, 22 nt, Human
uuccuguggggugucaucauag

SEQ ID NO: 133248 - RNA, 22 nt, Human
uuccucauuuggcacaucugag

SEQ ID NO: 133249 - RNA, 19 nt, Human
auucuucucuuccugcugu

SEQ ID NO: 133250 - RNA, 18 nt, Human
gacaaaaguacagacaga

SEQ ID NO: 133251 - RNA, 22 nt, Human
uuguuuuaguagaaguuacaug

SEQ ID NO: 133252 - RNA, 22 nt, Human
gaagcccuggaggggcuggagg

SEQ ID NO: 133253 - RNA, 22 nt, Human
cauaucuccagguucugcugga

SEQ ID NO: 133254 - RNA, 22 nt, Human
gauaagugauucugauucacau

SEQ ID NO: 133255 - RNA, 22 nt, Human
uauuaaaagagaaaaagccacc

SEQ ID NO: 133256 - RNA, 22 nt, Human
gagaacuguguauucuuuuuca

SEQ ID NO: 133257 - RNA, 22 nt, Human
gagggaggugacaaggacauag

SEQ ID NO: 133258 - RNA, 22 nt, Human
acuuuauacuagugauaguuug

SEQ ID NO: 133259 - RNA, 19 nt, Human
agauggcaaaaugcaaaga

SEQ ID NO: 133260 - RNA, 22 nt, Human
cugccacuaccaugcuggauga

SEQ ID NO: 133261 - RNA, 22 nt, Human
ucugcagggcccuuggcuccug

SEQ ID NO: 133262 - RNA, 22 nt, Human
gggaaaaaggaguuagagauaa

SEQ ID NO: 133263 - RNA, 22 nt, Human
ugcauaagguuaaauuagcaga

SEQ ID NO: 133264 - RNA, 22 nt, Human
gauacuuuguggaauccuggau

SEQ ID NO: 133265 - RNA, 22 nt, Human
gcugcagggagcuggaaggcuc

SEQ ID NO: 133266 - RNA, 22 nt, Human
uaagcuauuccugaagaagguu

SEQ ID NO: 133267 - RNA, 22 nt, Human
agagagggaugguguccagaga

SEQ ID NO: 133268 - RNA, 22 nt, Human
ggugucucagauuguaaaaugu

SEQ ID NO: 133269 - RNA, 22 nt, Human
gcugcccauugcucucccacuc

SEQ ID NO: 133270 - RNA, 22 nt, Human
gcacuguauuuaaauauuuaaa

SEQ ID NO: 133271 - RNA, 22 nt, Human
ggacauaguugcuauggagagu

SEQ ID NO: 133272 - RNA, 23 nt, Human
cauguacacacagcuguacagug

SEQ ID NO: 133273 - RNA, 19 nt, Human
uggaggcacuaacaaacuc

SEQ ID NO: 133274 - RNA, 22 nt, Human
uagugcuuaaaacagaauuuuc

SEQ ID NO: 133275 - RNA, 22 nt, Human
ugaauuagagugaaggaaagcu

SEQ ID NO: 133276 - RNA, 22 nt, Human
ccagcugcugcaccgugcaugg

SEQ ID NO: 133277 - RNA, 22 nt, Human
uuaaaucaggcaucauuucagu

SEQ ID NO: 133278 - RNA, 21 nt, Human
uaauaauugggggcagggugg

SEQ ID NO: 133279 - RNA, 22 nt, Human
cccccucuggcuccagucugac

SEQ ID NO: 133280 - RNA, 22 nt, Human
ugcugcucaagcugcagcaaaa

SEQ ID NO: 133281 - RNA, 22 nt, Human
cagacagaguuguuucuucucc

SEQ ID NO: 133282 - RNA, 22 nt, Human
acauauggcagguugaucaaug

SEQ ID NO: 133283 - RNA, 22 nt, Human
uaggaagagauuuucacauggc

SEQ ID NO: 133284 - RNA, 20 nt, Human
uggagggaggaggggcccaa

SEQ ID NO: 133285 - RNA, 22 nt, Human
cuucauaagauuguugugagga

SEQ ID NO: 133286 - RNA, 22 nt, Human
uauucuucaacuuuucuccucu

SEQ ID NO: 133287 - RNA, 22 nt, Human
uuguccacuaagaaagugcccu

SEQ ID NO: 133288 - RNA, 22 nt, Human
agaggcaggcagcagagaagau

SEQ ID NO: 133289 - RNA, 22 nt, Human
gaggaggagaagcggcggcgga

SEQ ID NO: 133290 - RNA, 22 nt, Human
agucauuugaggcaugauuaug

SEQ ID NO: 133291 - RNA, 22 nt, Human
cuuuuucuugugguuaauaucu

SEQ ID NO: 133292 - RNA, 22 nt, Human
agaagaaugguuugaaagauuu

SEQ ID NO: 133293 - RNA, 22 nt, Human
acauuuuaaaaacaguaccugg

SEQ ID NO: 133294 - RNA, 22 nt, Human
cuucccaucaagcuggaggaug

SEQ ID NO: 133295 - RNA, 22 nt, Human
auaaaacagaucaggagaauga

SEQ ID NO: 133296 - RNA, 21 nt, Human
gaaaaucuaaugugacaaugc

SEQ ID NO: 133297 - RNA, 22 nt, Human
uuuucugauccuucuaacuuga

SEQ ID NO: 133298 - RNA, 22 nt, Human
aguugugagaaugaacacugaa

SEQ ID NO: 133299 - RNA, 22 nt, Human
aucaaaauuuucagauacuaca

SEQ ID NO: 133300 - RNA, 22 nt, Human
ucagucugcuauagguauuugu

SEQ ID NO: 133301 - RNA, 22 nt, Human
cuuuuucuuaucuuuuucuaug

SEQ ID NO: 133302 - RNA, 22 nt, Human
ucaguuuaauuggaucuuuuuc

SEQ ID NO: 133303 - RNA, 22 nt, Human
auuaaauagcagaagaaagaug

SEQ ID NO: 133304 - RNA, 22 nt, Human
acuguugagggaagcagaugaa

SEQ ID NO: 133305 - RNA, 22 nt, Human
accugagauuuuuacucaguaa

SEQ ID NO: 133306 - RNA, 22 nt, Human
cuaaaaauguucuaguaguuca

SEQ ID NO: 133307 - RNA, 22 nt, Human
caaggaaaacagaugaucaaca

SEQ ID NO: 133308 - RNA, 20 nt, Human
aauaaauauaacccauaauu

SEQ ID NO: 133309 - RNA, 22 nt, Human
aacugguaauuuaguauuacug

SEQ ID NO: 133310 - RNA, 22 nt, Human
aaaaaaacuaauuuuaaaugug

SEQ ID NO: 133311 - RNA, 22 nt, Human
ugagggaguguggauacaguag

SEQ ID NO: 133312 - RNA, 22 nt, Human
gaauuacagaguuguuaaguca

SEQ ID NO: 133313 - RNA, 21 nt, Human
aacaaaagggaagaacagcug

SEQ ID NO: 133314 - RNA, 22 nt, Human
guuuuguucaugaacauugggu

SEQ ID NO: 133315 - RNA, 22 nt, Human
uuauuuuauaaagagaagacuu

SEQ ID NO: 133316 - RNA, 22 nt, Human
acuuugaauuagaauuuugcug

SEQ ID NO: 133317 - RNA, 22 nt, Human
gcuuuucaaguuacaauuagcu

SEQ ID NO: 133318 - RNA, 22 nt, Human
uugugcauuuuguuuuacuuau

SEQ ID NO: 133319 - RNA, 20 nt, Human
aagacacuguccccacugga

SEQ ID NO: 133320 - RNA, 19 nt, Human
gauauugagcugagaauuc

SEQ ID NO: 133321 - RNA, 22 nt, Human
gggaaaaaggaaccuuauuacu

SEQ ID NO: 133322 - RNA, 22 nt, Human
augaacugcaguauaaacuugg

SEQ ID NO: 133323 - RNA, 22 nt, Human
agguuaggaggggagugccaca

SEQ ID NO: 133324 - RNA, 22 nt, Human
guagaaaauagauugucucuug

SEQ ID NO: 133325 - RNA, 22 nt, Human
uuuuacaaugcaaauucuugcu

SEQ ID NO: 133326 - RNA, 22 nt, Human
augcaugaucccgguaugugaa

SEQ ID NO: 133327 - RNA, 22 nt, Human
auguuuaauuugaaauuuuauu

SEQ ID NO: 133328 - RNA, 22 nt, Human
uuuuuauaagagcagcagaguu

SEQ ID NO: 133329 - RNA, 22 nt, Human
gccugcugggcucuuccugcug

SEQ ID NO: 133330 - RNA, 22 nt, Human
auguuugugauugcugaaaaga

SEQ ID NO: 133331 - RNA, 22 nt, Human
auuuucuucauuuugauuguau

SEQ ID NO: 133332 - RNA, 22 nt, Human
cacuauguacauaauagcugcu

SEQ ID NO: 133333 - RNA, 22 nt, Human
ggaaauauaagcaguuugugug

SEQ ID NO: 133334 - RNA, 22 nt, Human
guggaagauauuucugguccag

SEQ ID NO: 133335 - RNA, 20 nt, Human
caacacugcccauuguuugc

SEQ ID NO: 133336 - RNA, 22 nt, Human
aauggcaagccacaugcuuuuc

SEQ ID NO: 133337 - RNA, 22 nt, Human
acauuccugaagguaaugagaa

SEQ ID NO: 133338 - RNA, 22 nt, Human
aauguuguaaauauucuuugag

SEQ ID NO: 133339 - RNA, 22 nt, Human
aggaagaagggacagaauuuug

SEQ ID NO: 133340 - RNA, 19 nt, Human
ccagaagggcaagcaaagg

SEQ ID NO: 133341 - RNA, 22 nt, Human
cugucucugauaagcucgaggg

SEQ ID NO: 133342 - RNA, 23 nt, Human
aaugugaaauugaguuuuuguua

SEQ ID NO: 133343 - RNA, 22 nt, Human
gggcaagaagcuggaagcauuc

SEQ ID NO: 133344 - RNA, 19 nt, Human
aacucugccgaggcaagcc

SEQ ID NO: 133345 - RNA, 21 nt, Human
ggcugcucgugaugaacuuca

SEQ ID NO: 133346 - RNA, 19 nt, Human
uagaggagaauggcaaaga

SEQ ID NO: 133347 - RNA, 22 nt, Human
cagggccaggccucaggggcgc

SEQ ID NO: 133348 - RNA, 22 nt, Human
auaaaucaagggcaguauuucc

SEQ ID NO: 133349 - RNA, 22 nt, Human
auaaaaauguuuuuguguggua

SEQ ID NO: 133350 - RNA, 22 nt, Human
aaacccauauaccagcugugcu

SEQ ID NO: 133351 - RNA, 22 nt, Human
ccucccaccguaucucaguggc

SEQ ID NO: 133352 - RNA, 22 nt, Human
uauuucuagggcaugaaaauaa

SEQ ID NO: 133353 - RNA, 20 nt, Human
agguugguuuacuagucugu

SEQ ID NO: 133354 - RNA, 20 nt, Human
gauuuaacgcugcgucuguc

SEQ ID NO: 133355 - RNA, 21 nt, Human
uuccauggacccugucagugu

SEQ ID NO: 133356 - RNA, 22 nt, Human
gagagaggggaagagaagcucu

SEQ ID NO: 133357 - RNA, 22 nt, Human
aucuaaaacuacgaauacuacc

SEQ ID NO: 133358 - RNA, 20 nt, Human
uauuucaaugugccaaguuu

SEQ ID NO: 133359 - RNA, 19 nt, Human
agagucuccacuccacuug

SEQ ID NO: 133360 - RNA, 22 nt, Human
uggacagguacuucacauuauu

SEQ ID NO: 133361 - RNA, 22 nt, Human
uuggaagacagccgucuuuauu

SEQ ID NO: 133362 - RNA, 22 nt, Human
gggagggggauucuggcgagaa

SEQ ID NO: 133363 - RNA, 22 nt, Human
agcagggagaccaucucuuccu

SEQ ID NO: 133364 - RNA, 22 nt, Human
uaaauuugugaauuagcuauca

SEQ ID NO: 133365 - RNA, 22 nt, Human
ggcagagguagcuggaaccagg

SEQ ID NO: 133366 - RNA, 22 nt, Human
gcgccgacccucccugccggac

SEQ ID NO: 133367 - RNA, 22 nt, Human
ggggagggcugagcacgguuga

SEQ ID NO: 133368 - RNA, 22 nt, Human
cuggguuuggcugugcuugaau

SEQ ID NO: 133369 - RNA, 22 nt, Human
uagguggaaccauaugaaauuu

SEQ ID NO: 133370 - RNA, 22 nt, Human
auuauaauucauuaggcuuagu

SEQ ID NO: 133371 - RNA, 22 nt, Human
cugacacagccauuguccuugu

SEQ ID NO: 133372 - RNA, 22 nt, Human
aauaaugguuugauucucacau

SEQ ID NO: 133373 - RNA, 22 nt, Human
uacagcuuccucuaugguggcc

SEQ ID NO: 133374 - RNA, 22 nt, Human
gugcugggaggcccaggaugga

SEQ ID NO: 133375 - RNA, 22 nt, Human
uugcaugauuuaagaauaucug

SEQ ID NO: 133376 - RNA, 22 nt, Human
aggcaggcucaaugcccagucu

SEQ ID NO: 133377 - RNA, 22 nt, Human
guacauauggcacaugcuauuu

SEQ ID NO: 133378 - RNA, 22 nt, Human
aucuucaaggacgccaagaucc

SEQ ID NO: 133379 - RNA, 22 nt, Human
gaaugcacacgugugugcaugc

SEQ ID NO: 133380 - RNA, 23 nt, Human
aggcugccacucagggugaggcu

SEQ ID NO: 133381 - RNA, 22 nt, Human
aagcucugggacugaggcuccu

SEQ ID NO: 133382 - RNA, 22 nt, Human
cggggcuggcguuagggaggca

SEQ ID NO: 133383 - RNA, 22 nt, Human
aaaugcacaauaaaguaaaggc

SEQ ID NO: 133384 - RNA, 22 nt, Human
ugcuugaacccaggaaguggag

SEQ ID NO: 133385 - RNA, 21 nt, Human
uugauuuagcagaucuagcug

SEQ ID NO: 133386 - RNA, 18 nt, Human
acucugaagcuaagucac

SEQ ID NO: 133387 - RNA, 22 nt, Human
cuucuggaggcugcagaaaaga

SEQ ID NO: 133388 - RNA, 22 nt, Human
aauucugaggccauuuauuucc

SEQ ID NO: 133389 - RNA, 22 nt, Human
ugagguuacauuaggaauaacc

SEQ ID NO: 133390 - RNA, 20 nt, Human
aaccuauuguaauauucuaa

SEQ ID NO: 133391 - RNA, 22 nt, Human
ccccauuugaagauugggggua

SEQ ID NO: 133392 - RNA, 22 nt, Human
aggcagagaggucuuccuggaa

SEQ ID NO: 133393 - RNA, 19 nt, Human
agcucaggcccaucguccc

SEQ ID NO: 133394 - RNA, 22 nt, Human
uggugcucucgauauauaaggc

SEQ ID NO: 133395 - RNA, 22 nt, Human
ucccugcugggcgaucuucucu

SEQ ID NO: 133396 - RNA, 22 nt, Human
aaauagauuugacuacuuggug

SEQ ID NO: 133397 - RNA, 22 nt, Human
auucauucugaccucaagagaa

SEQ ID NO: 133398 - RNA, 22 nt, Human
cauuuuccucugcugguguuca

SEQ ID NO: 133399 - RNA, 22 nt, Human
guuuauucuuuuauuugugaga

SEQ ID NO: 133400 - RNA, 22 nt, Human
cacaauuuccauugagcagcag

SEQ ID NO: 133401 - RNA, 22 nt, Human
uaaagcacucaaaauuguagcu

SEQ ID NO: 133402 - RNA, 22 nt, Human
ucuauuguuauccuuuccauuu

SEQ ID NO: 133403 - RNA, 22 nt, Human
uucuugucuuuguuauguagga

SEQ ID NO: 133404 - RNA, 22 nt, Human
uauauaauacacaaauauguac

SEQ ID NO: 133405 - RNA, 22 nt, Human
accugcagguguuuccacacuu

SEQ ID NO: 133406 - RNA, 22 nt, Human
gaauacaagccugccaccugga

SEQ ID NO: 133407 - RNA, 22 nt, Human
ugauauaaaagauucuuauuga

SEQ ID NO: 133408 - RNA, 22 nt, Human
ugugaagaauuaaugugaauca

SEQ ID NO: 133409 - RNA, 22 nt, Human
ugaaaaaugcuuuaaugcaugu

SEQ ID NO: 133410 - RNA, 22 nt, Human
acuauuguccgauuucuuuacu

SEQ ID NO: 133411 - RNA, 18 nt, Human
ucagaggagauaccuaaa

SEQ ID NO: 133412 - RNA, 22 nt, Human
uggcaaggccacaggugcaguu

SEQ ID NO: 133413 - RNA, 22 nt, Human
guguugaugugucuguauucua

SEQ ID NO: 133414 - RNA, 18 nt, Human
auucauuugcguuuggcu

SEQ ID NO: 133415 - RNA, 20 nt, Human
gcauggcuggcugcugucug

SEQ ID NO: 133416 - RNA, 22 nt, Human
aaucacuuagaacccaggaagu

SEQ ID NO: 133417 - RNA, 22 nt, Human
aaauguauuagccuaugugaga

SEQ ID NO: 133418 - RNA, 22 nt, Human
aggaaaauggaccagaguuguu

SEQ ID NO: 133419 - RNA, 22 nt, Human
agggagcagcuagagggggucc

SEQ ID NO: 133420 - RNA, 22 nt, Human
aggggaggcugcgggcugccgu

SEQ ID NO: 133421 - RNA, 22 nt, Human
augggagggugaggaggcagcu

SEQ ID NO: 133422 - RNA, 22 nt, Human
aaaaguuguaauauuuccuuua

SEQ ID NO: 133423 - RNA, 22 nt, Human
uuuaaaauguuuuauuuauuua

SEQ ID NO: 133424 - RNA, 22 nt, Human
agaguacagaagcauuucagau

SEQ ID NO: 133425 - RNA, 22 nt, Human
aggaggcaaaugagagggcuca

SEQ ID NO: 133426 - RNA, 22 nt, Human
uguacauuuacaaaagcuuuau

SEQ ID NO: 133427 - RNA, 22 nt, Human
caguacugucuuccugauggca

SEQ ID NO: 133428 - RNA, 22 nt, Human
aaaagguuauagcuuugccuug

SEQ ID NO: 133429 - RNA, 22 nt, Human
guuuggguggcuagagaaagaa

SEQ ID NO: 133430 - RNA, 22 nt, Human
ugaauguggucaggaaauuguu

SEQ ID NO: 133431 - RNA, 22 nt, Human
agugcucagggaaugccacuga

SEQ ID NO: 133432 - RNA, 20 nt, Human
auaaauaggauuuucugaca

SEQ ID NO: 133433 - RNA, 23 nt, Human
gccaaacugcccguucucucugc

SEQ ID NO: 133434 - RNA, 22 nt, Human
ucauuuuaucaggaauggaauc

SEQ ID NO: 133435 - RNA, 22 nt, Human
acugcaggucccaucaccugcg

SEQ ID NO: 133436 - RNA, 22 nt, Human
ccugccugggcucacuugccag

SEQ ID NO: 133437 - RNA, 22 nt, Human
caaaucuguuaauuucaaguug

SEQ ID NO: 133438 - RNA, 22 nt, Human
acugaacuaaagaaaugggcaa

SEQ ID NO: 133439 - RNA, 22 nt, Human
gaaucucuuugucccugaguuu

SEQ ID NO: 133440 - RNA, 22 nt, Human
cuguuucucugccugcacacau

SEQ ID NO: 133441 - RNA, 22 nt, Human
cugggacacguugugcuuuaac

SEQ ID NO: 133442 - RNA, 22 nt, Human
gggucagggaggccccaccaug

SEQ ID NO: 133443 - RNA, 22 nt, Human
cacugguugccucuuucuguuc

SEQ ID NO: 133444 - RNA, 22 nt, Human
aguucauaucuacuuuuccauc

SEQ ID NO: 133445 - RNA, 22 nt, Human
acucugaaaggcuacaaaugcu

SEQ ID NO: 133446 - RNA, 22 nt, Human
uucuauaagagaugaauacagu

SEQ ID NO: 133447 - RNA, 18 nt, Human
uuccauuuuucagucuuc

SEQ ID NO: 133448 - RNA, 22 nt, Human
ggaaggugagugcugugugauu

SEQ ID NO: 133449 - RNA, 22 nt, Human
aaaauaauauuauaccacugcu

SEQ ID NO: 133450 - RNA, 21 nt, Human
ucagccuguccaguguuaacc

SEQ ID NO: 133451 - RNA, 22 nt, Human
uuaaucagacauucucaaguuu

SEQ ID NO: 133452 - RNA, 22 nt, Human
guuauuuugucuuguucaugaa

SEQ ID NO: 133453 - RNA, 22 nt, Human
ggggcucauuugcaggggggag

SEQ ID NO: 133454 - RNA, 22 nt, Human
ugccuuuuguguuuggcuaauc

SEQ ID NO: 133455 - RNA, 22 nt, Human
cuucauccguaccacggccaca

SEQ ID NO: 133456 - RNA, 22 nt, Human
uuuuuaaaagaugauuuaauga

SEQ ID NO: 133457 - RNA, 22 nt, Human
gugguggugaggcaaggggugu

SEQ ID NO: 133458 - RNA, 22 nt, Human
acagagggagugacggccaacc

SEQ ID NO: 133459 - RNA, 22 nt, Human
gugaaauuguacacucaguacc

SEQ ID NO: 133460 - RNA, 22 nt, Human
ugucccaucacagaggagacua

SEQ ID NO: 133461 - RNA, 19 nt, Human
ugccuggcaccagcuccac

SEQ ID NO: 133462 - RNA, 20 nt, Human
caugaugcaaacaguaacgu

SEQ ID NO: 133463 - RNA, 22 nt, Human
ucagcucucucuuggugaucuc

SEQ ID NO: 133464 - RNA, 22 nt, Human
gggaggcagacgcuggagccca

SEQ ID NO: 133465 - RNA, 22 nt, Human
agacacugacaggguccaugga

SEQ ID NO: 133466 - RNA, 22 nt, Human
acagcagguuauuguuauggca

SEQ ID NO: 133467 - RNA, 22 nt, Human
uaauauauuuuuuaagggaugu

SEQ ID NO: 133468 - RNA, 22 nt, Human
uuguuuaaagaacuucugacuu

SEQ ID NO: 133469 - RNA, 22 nt, Human
gaggaaaauggaguguaauuaa

SEQ ID NO: 133470 - RNA, 22 nt, Human
agugagaguauuaaugugaacu

SEQ ID NO: 133471 - RNA, 22 nt, Human
caugccugaucagcggccagca

SEQ ID NO: 133472 - RNA, 22 nt, Human
cucuugugucaccauggauaaa

SEQ ID NO: 133473 - RNA, 22 nt, Human
ccagggagggccacagggccau

SEQ ID NO: 133474 - RNA, 20 nt, Human
accccuccccacuccucgcc

SEQ ID NO: 133475 - RNA, 22 nt, Human
agaauuuguaucuacggugugc

SEQ ID NO: 133476 - RNA, 22 nt, Human
ggggaggguuuggaugagaguc

SEQ ID NO: 133477 - RNA, 22 nt, Human
ccuuuuuagaugugcgaauguu

SEQ ID NO: 133478 - RNA, 22 nt, Human
aauuuauccuuuugcuaaagca

SEQ ID NO: 133479 - RNA, 22 nt, Human
uuggggagaagagcuggucagg

SEQ ID NO: 133480 - RNA, 22 nt, Human
uucaauuacaucagaaucuaaa

SEQ ID NO: 133481 - RNA, 22 nt, Human
ggaggaugaggguggugguguu

SEQ ID NO: 133482 - RNA, 22 nt, Human
gaguaaaagaugaggcaguaga

SEQ ID NO: 133483 - RNA, 22 nt, Human
gggacaggacuccuggggccug

SEQ ID NO: 133484 - RNA, 22 nt, Human
auuucaacagaguuugaaggca

SEQ ID NO: 133485 - RNA, 22 nt, Human
ggccugcuaccagcugugaccu

SEQ ID NO: 133486 - RNA, 22 nt, Human
guugauaauuaauagcuuuuga

SEQ ID NO: 133487 - RNA, 22 nt, Human
uuucacuucgaucagaguuuuu

SEQ ID NO: 133488 - RNA, 22 nt, Human
gcagguggaagcagcagacuca

SEQ ID NO: 133489 - RNA, 20 nt, Human
agaaggagagaugaggcaaa

SEQ ID NO: 133490 - RNA, 22 nt, Human
gucccagaggacagggucacau

SEQ ID NO: 133491 - RNA, 22 nt, Human
ccauuuggccauucaguuguuc

SEQ ID NO: 133492 - RNA, 22 nt, Human
gugguuuagccuucauuaaccu

SEQ ID NO: 133493 - RNA, 17 nt, Human
ggaagaaaaggaucauc

SEQ ID NO: 133494 - RNA, 22 nt, Human
ugcauguuucuguauguuaaug

SEQ ID NO: 133495 - RNA, 22 nt, Human
uaaaaugcucagauaaauauau

SEQ ID NO: 133496 - RNA, 22 nt, Human
cagagguagaaguagauguuug

SEQ ID NO: 133497 - RNA, 22 nt, Human
ugcuuucagauaucuguuucaa

SEQ ID NO: 133498 - RNA, 22 nt, Human
cuuuacauuaauuucuacugau

SEQ ID NO: 133499 - RNA, 22 nt, Human
ugaggggaggggagaaaauggu

SEQ ID NO: 133500 - RNA, 22 nt, Human
agggcaggguuggugcuggugc

SEQ ID NO: 133501 - RNA, 22 nt, Human
uuucuauauucaguuucauaaa

SEQ ID NO: 133502 - RNA, 22 nt, Human
aaggaaaaccugacugaagaac

SEQ ID NO: 133503 - RNA, 21 nt, Human
uugugaaaguccaggaacaac

SEQ ID NO: 133504 - RNA, 20 nt, Human
cagagacaagagggaaggga

SEQ ID NO: 133505 - RNA, 22 nt, Human
uuccacaugaucauuguaauaa

SEQ ID NO: 133506 - RNA, 22 nt, Human
gauucuaucauucuguauauua

SEQ ID NO: 133507 - RNA, 22 nt, Human
ccugaguucuuauuuccaguca

SEQ ID NO: 133508 - RNA, 19 nt, Human
gagcaugacuggccuugca

SEQ ID NO: 133509 - RNA, 22 nt, Human
auaaaguaaugcauauaaugug

SEQ ID NO: 133510 - RNA, 22 nt, Human
uuugauuuuguuuauagugccg

SEQ ID NO: 133511 - RNA, 22 nt, Human
gccugggccgggcgcggccccc

SEQ ID NO: 133512 - RNA, 22 nt, Human
uauuuuuaccuaauuuaugaga

SEQ ID NO: 133513 - RNA, 22 nt, Human
agccugugacucugugaaacca

SEQ ID NO: 133514 - RNA, 22 nt, Human
uuuuaucagagcuugcagugug

SEQ ID NO: 133515 - RNA, 22 nt, Human
agcucugcuucuugggaagaug

SEQ ID NO: 133516 - RNA, 22 nt, Human
ucuuuaagugugugccuccagg

SEQ ID NO: 133517 - RNA, 22 nt, Human
acuuuaaaucuguugcuuagcu

SEQ ID NO: 133518 - RNA, 22 nt, Human
ggagagaacguaaucuaguauu

SEQ ID NO: 133519 - RNA, 22 nt, Human
uggaagugggcaucaccaucca

SEQ ID NO: 133520 - RNA, 22 nt, Human
cuucucuuggguguggugucuu

SEQ ID NO: 133521 - RNA, 22 nt, Human
aagaguggagcuggaaaguggg

SEQ ID NO: 133522 - RNA, 22 nt, Human
uauuaauugugguuauuguauu

SEQ ID NO: 133523 - RNA, 22 nt, Human
agguguaauuacucuugcaguu

SEQ ID NO: 133524 - RNA, 22 nt, Human
ccagggaggucauagugcuggu

SEQ ID NO: 133525 - RNA, 22 nt, Human
auugugaaugccugucagucuu

SEQ ID NO: 133526 - RNA, 22 nt, Human
gcugucccccaaagaugcuccu

SEQ ID NO: 133527 - RNA, 22 nt, Human
cauuauucaggcuuuggaauuu

SEQ ID NO: 133528 - RNA, 22 nt, Human
uaauaaaaauuuaauucacauu

SEQ ID NO: 133529 - RNA, 22 nt, Human
gaaaagaaaggaugguaugugu

SEQ ID NO: 133530 - RNA, 22 nt, Human
caacaagcgcucagagcaaagc

SEQ ID NO: 133531 - RNA, 22 nt, Human
auuuaagacuguggugcaguuu

SEQ ID NO: 133532 - RNA, 22 nt, Human
guuuuucuuugauuuagaacca

SEQ ID NO: 133533 - RNA, 22 nt, Human
uuucuauuuacagugcuaggua

SEQ ID NO: 133534 - RNA, 22 nt, Human
gggauggggagcuggaaagggg

SEQ ID NO: 133535 - RNA, 22 nt, Human
ccaccccagaaagggaaggcca

SEQ ID NO: 133536 - RNA, 21 nt, Human
aucagaggacaucucagggcc

SEQ ID NO: 133537 - RNA, 22 nt, Human
uagcauuucacugaucuucacu

SEQ ID NO: 133538 - RNA, 22 nt, Human
ugaaauuuuuuggagauaauuu

SEQ ID NO: 133539 - RNA, 22 nt, Human
ugucacagggauaccauggggc

SEQ ID NO: 133540 - RNA, 22 nt, Human
ugcaaaaguuuuauacacagau

SEQ ID NO: 133541 - RNA, 22 nt, Human
uccugggcuugcucuuuccauu

SEQ ID NO: 133542 - RNA, 17 nt, Human
ucuccuggcucuaucag

SEQ ID NO: 133543 - RNA, 22 nt, Human
ggugugaauagagccuggagca

SEQ ID NO: 133544 - RNA, 22 nt, Human
aaguuccacuagugacccagaa

SEQ ID NO: 133545 - RNA, 22 nt, Human
ucucccaaaucuuucuagcaca

SEQ ID NO: 133546 - RNA, 22 nt, Human
uggaagaaaugguugagccaug

SEQ ID NO: 133547 - RNA, 22 nt, Human
agaguucuauccagacucaugu

SEQ ID NO: 133548 - RNA, 22 nt, Human
uucuggagucuauuuugaaaag

SEQ ID NO: 133549 - RNA, 22 nt, Human
uuuucucuuugcuucucuaaaa

SEQ ID NO: 133550 - RNA, 22 nt, Human
aagaaauacagaaauggcagua

SEQ ID NO: 133551 - RNA, 22 nt, Human
uuuauguugagcaaaauaccac

SEQ ID NO: 133552 - RNA, 22 nt, Human
auucuccucaaaacaucugcug

SEQ ID NO: 133553 - RNA, 22 nt, Human
uagaccugugggggcagcgggc

SEQ ID NO: 133554 - RNA, 22 nt, Human
uaucauuuuacugugacauuuu

SEQ ID NO: 133555 - RNA, 22 nt, Human
gcccuagaguugagagcaccca

SEQ ID NO: 133556 - RNA, 22 nt, Human
agggaccacauccccucugugg

SEQ ID NO: 133557 - RNA, 22 nt, Human
cagggcagaguuaagaugcugg

SEQ ID NO: 133558 - RNA, 22 nt, Human
cagggagguuggauuggggccu

SEQ ID NO: 133559 - RNA, 22 nt, Human
uuaggcuuuauugaaaacaaua

SEQ ID NO: 133560 - RNA, 22 nt, Human
uuauuucaggcauuuguaaaug

SEQ ID NO: 133561 - RNA, 22 nt, Human
uuguugcaagccuggaaucugg

SEQ ID NO: 133562 - RNA, 22 nt, Human
cccagccuuugcuuccugguuc

SEQ ID NO: 133563 - RNA, 22 nt, Human
cuuauuagaaagaaaagacaug

SEQ ID NO: 133564 - RNA, 22 nt, Human
cacugcaaccuccaccucccgg

SEQ ID NO: 133565 - RNA, 22 nt, Human
gcacucugggucaucugcugcc

SEQ ID NO: 133566 - RNA, 22 nt, Human
cacugcacuccagccugggcaa

SEQ ID NO: 133567 - RNA, 22 nt, Human
uggucucaaagcaaggaaggaa

SEQ ID NO: 133568 - RNA, 22 nt, Human
gaugucccuggaggggacagga

SEQ ID NO: 133569 - RNA, 22 nt, Human
agauaacauguugcagauucug

SEQ ID NO: 133570 - RNA, 22 nt, Human
uucuuuucuucccuguuuauua

SEQ ID NO: 133571 - RNA, 22 nt, Human
guggugguguuggugacaaguu

SEQ ID NO: 133572 - RNA, 22 nt, Human
uuuguauuguuuauuucauuuu

SEQ ID NO: 133573 - RNA, 22 nt, Human
aaugcuuuuugcgaaaugugca

SEQ ID NO: 133574 - RNA, 22 nt, Human
ugcugccucccaucccucccga

SEQ ID NO: 133575 - RNA, 22 nt, Human
uuuaauauuacacuuaccuugu

SEQ ID NO: 133576 - RNA, 22 nt, Human
uggccaaauuggccugauguau

SEQ ID NO: 133577 - RNA, 22 nt, Human
cugggaggagacaggggauggg

SEQ ID NO: 133578 - RNA, 22 nt, Human
uaggcaaguggaccagagguuu

SEQ ID NO: 133579 - RNA, 17 nt, Human
aguuacugcacuugcca

SEQ ID NO: 133580 - RNA, 22 nt, Human
gcauuuuaauuggggcaguuag

SEQ ID NO: 133581 - RNA, 22 nt, Human
aauauuuaccuaccugucaucu

SEQ ID NO: 133582 - RNA, 19 nt, Human
uuccucaggugugaguuag

SEQ ID NO: 133583 - RNA, 21 nt, Human
uucugcuguucaccaccaccc

SEQ ID NO: 133584 - RNA, 22 nt, Human
gcugcgccgggagccggggccg

SEQ ID NO: 133585 - RNA, 22 nt, Human
agucccugauggacuggaugag

SEQ ID NO: 133586 - RNA, 22 nt, Human
aauuugcuccaaugucaguucu

SEQ ID NO: 133587 - RNA, 20 nt, Human
aggggcuguaguuagaugac

SEQ ID NO: 133588 - RNA, 22 nt, Human
ucagucucuggggcuucuguuu

SEQ ID NO: 133589 - RNA, 22 nt, Human
cuguuacggaggcuuucuaguu

SEQ ID NO: 133590 - RNA, 22 nt, Human
uccaggaggacugagggggcug

SEQ ID NO: 133591 - RNA, 22 nt, Human
ggcagguccugaguccugaggc

SEQ ID NO: 133592 - RNA, 22 nt, Human
gcacauaugcuguaagcacaug

SEQ ID NO: 133593 - RNA, 22 nt, Human
uuuaugucaaaaguaaaaugaa

SEQ ID NO: 133594 - RNA, 22 nt, Human
gauuuucauuauagcuaguuuc

SEQ ID NO: 133595 - RNA, 22 nt, Human
uuuuauaauacccuugacuaau

SEQ ID NO: 133596 - RNA, 22 nt, Human
uacaaagugauuuuggaauuga

SEQ ID NO: 133597 - RNA, 20 nt, Human
uuccccauaaaaauguucca

SEQ ID NO: 133598 - RNA, 22 nt, Human
cuucucuuccuucucauccuca

SEQ ID NO: 133599 - RNA, 22 nt, Human
uguucugauggauuacaugucu

SEQ ID NO: 133600 - RNA, 22 nt, Human
cagcuucuccauucuucuggcu

SEQ ID NO: 133601 - RNA, 22 nt, Human
ucgcccagguuggagugcagug

SEQ ID NO: 133602 - RNA, 22 nt, Human
gggagggaggagccccggccau

SEQ ID NO: 133603 - RNA, 22 nt, Human
aauaauuuuuuugugauuaugu

SEQ ID NO: 133604 - RNA, 22 nt, Human
ucagggaggagaggcaggggga

SEQ ID NO: 133605 - RNA, 22 nt, Human
acuuuuaauaguagauuuuuaa

SEQ ID NO: 133606 - RNA, 22 nt, Human
agagauacugcaggccauaaau

SEQ ID NO: 133607 - RNA, 22 nt, Human
aaugaaugaaugaaugauuaug

SEQ ID NO: 133608 - RNA, 22 nt, Human
uauuuccugcguuucugugagc

SEQ ID NO: 133609 - RNA, 22 nt, Human
aagacagugacagucacaauug

SEQ ID NO: 133610 - RNA, 22 nt, Human
caaauacaaauacgggcagcuu

SEQ ID NO: 133611 - RNA, 22 nt, Human
uugaaaaaaucugaggaggacc

SEQ ID NO: 133612 - RNA, 22 nt, Human
cauuuaaccccuugguacugaa

SEQ ID NO: 133613 - RNA, 22 nt, Human
guuaaaaugauuugugauuuau

SEQ ID NO: 133614 - RNA, 22 nt, Human
gggagguaaugggggugcaggg

SEQ ID NO: 133615 - RNA, 22 nt, Human
uacagucauaagguuucucucc

SEQ ID NO: 133616 - RNA, 20 nt, Human
uacaauauucccacuuugcu

SEQ ID NO: 133617 - RNA, 22 nt, Human
ccaaagaauuuggaaaaucuga

SEQ ID NO: 133618 - RNA, 22 nt, Human
aauguguauguguauauauaug

SEQ ID NO: 133619 - RNA, 23 nt, Human
gcccagaggccccuggccugagc

SEQ ID NO: 133620 - RNA, 22 nt, Human
ugcauuuucuaccacacccacu

SEQ ID NO: 133621 - RNA, 22 nt, Human
ugagggaggggaaugugugcag

SEQ ID NO: 133622 - RNA, 22 nt, Human
cagacagagcucacaagucuuu

SEQ ID NO: 133623 - RNA, 22 nt, Human
cagagaggagcacaaagugaag

SEQ ID NO: 133624 - RNA, 22 nt, Human
uugaguuuacauuguauuagcc

SEQ ID NO: 133625 - RNA, 22 nt, Human
acauaaaccccccuuccccagg

SEQ ID NO: 133626 - RNA, 22 nt, Human
cagguugucuaauuccaagggg

SEQ ID NO: 133627 - RNA, 22 nt, Human
uuucucuuguauuugaaucacu

SEQ ID NO: 133628 - RNA, 22 nt, Human
aucuggaacuucucugcauuga

SEQ ID NO: 133629 - RNA, 22 nt, Human
auauuauuaaaauagauggaua

SEQ ID NO: 133630 - RNA, 22 nt, Human
cccagaggcugaguugggagca

SEQ ID NO: 133631 - RNA, 22 nt, Human
ugaguuuuggaagauguuacag

SEQ ID NO: 133632 - RNA, 22 nt, Human
auugacagaaaauuggauggca

SEQ ID NO: 133633 - RNA, 22 nt, Human
guaggaaaugaauaagguaccu

SEQ ID NO: 133634 - RNA, 22 nt, Human
ggaggagggaguucaggaguau

SEQ ID NO: 133635 - RNA, 22 nt, Human
uuagucauucccucuugauauu

SEQ ID NO: 133636 - RNA, 22 nt, Human
cucuuuucaaaccuguuuaugg

SEQ ID NO: 133637 - RNA, 22 nt, Human
ggagaggaggugagaggaagua

SEQ ID NO: 133638 - RNA, 22 nt, Human
gaaggaaaagacgugcuaagua

SEQ ID NO: 133639 - RNA, 22 nt, Human
uuuguuuccagccuuuugucuu

SEQ ID NO: 133640 - RNA, 22 nt, Human
uuguuauuauuauuuucguucu

SEQ ID NO: 133641 - RNA, 21 nt, Human
agaugaggauacugaggccua

SEQ ID NO: 133642 - RNA, 22 nt, Human
aaacgcaauuucuugcauguca

SEQ ID NO: 133643 - RNA, 22 nt, Human
caagcacaauuucuacauguua

SEQ ID NO: 133644 - RNA, 22 nt, Human
aaucccaguugacagaacuguu

SEQ ID NO: 133645 - RNA, 22 nt, Human
auguuuucauuuagaagcuaau

SEQ ID NO: 133646 - RNA, 22 nt, Human
cggggaggagccagcggaggau

SEQ ID NO: 133647 - RNA, 22 nt, Human
uggagagauagucauucuagag

SEQ ID NO: 133648 - RNA, 22 nt, Human
uugaauuuagguuuaugugaaa

SEQ ID NO: 133649 - RNA, 22 nt, Human
aaauggaaguuuguucucagcc

SEQ ID NO: 133650 - RNA, 22 nt, Human
auaaaagcacaauagaguuaug

SEQ ID NO: 133651 - RNA, 22 nt, Human
gccugcagccagggaguucucu

SEQ ID NO: 133652 - RNA, 22 nt, Human
gccacucaguuuaggggcaagc

SEQ ID NO: 133653 - RNA, 22 nt, Human
uaggucugaggcugcaucuugg

SEQ ID NO: 133654 - RNA, 22 nt, Human
ugaauuuguaggaauucuccau

SEQ ID NO: 133655 - RNA, 22 nt, Human
ucuucagacuguuguucuuuug

SEQ ID NO: 133656 - RNA, 22 nt, Human
uuuaaauuucugaaucuugagg

SEQ ID NO: 133657 - RNA, 22 nt, Human
ugaguuucuuacucaggagcug

SEQ ID NO: 133658 - RNA, 22 nt, Human
agagcuauuucuuaaaagcugu

SEQ ID NO: 133659 - RNA, 22 nt, Human
uuuugaauaauucagaaacagc

SEQ ID NO: 133660 - RNA, 22 nt, Human
auuauucaaggugaggguaaaa

SEQ ID NO: 133661 - RNA, 22 nt, Human
auauaguacauguauauauaua

SEQ ID NO: 133662 - RNA, 22 nt, Human
gcuuucagggucacugucaaca

SEQ ID NO: 133663 - RNA, 21 nt, Human
uuucauuaguacaucaauuug

SEQ ID NO: 133664 - RNA, 22 nt, Human
gcaggagggggccuggagccca

SEQ ID NO: 133665 - RNA, 22 nt, Human
gugucccaaagauuagaaauca

SEQ ID NO: 133666 - RNA, 22 nt, Human
cagcacugcccuaccccuccac

SEQ ID NO: 133667 - RNA, 22 nt, Human
gaggcaggcggggcccaggugg

SEQ ID NO: 133668 - RNA, 22 nt, Human
aauggcaauagugcauuaugua

SEQ ID NO: 133669 - RNA, 22 nt, Human
gaggagcugggucagggagaca

SEQ ID NO: 133670 - RNA, 22 nt, Human
caaaacauucagagagcucacu

SEQ ID NO: 133671 - RNA, 22 nt, Human
cugcagauguagcugcuuuccu

SEQ ID NO: 133672 - RNA, 22 nt, Human
aaaguuacccaaucucuaugaa

SEQ ID NO: 133673 - RNA, 22 nt, Human
auugaaauuaauuucugcuuuc

SEQ ID NO: 133674 - RNA, 22 nt, Human
auuugaaaaucuaugaugugca

SEQ ID NO: 133675 - RNA, 22 nt, Human
aauggaaaaagaacuguuuaaa

SEQ ID NO: 133676 - RNA, 22 nt, Human
auuaaaaaaagauaaugaguua

SEQ ID NO: 133677 - RNA, 22 nt, Human
gaggguggggaauagacugcua

SEQ ID NO: 133678 - RNA, 22 nt, Human
uuuaaugucuuggaaaaagacu

SEQ ID NO: 133679 - RNA, 22 nt, Human
aaucaaauuucuugugguuguu

SEQ ID NO: 133680 - RNA, 22 nt, Human
guuuacaacaucuuguccuuca

SEQ ID NO: 133681 - RNA, 22 nt, Human
uuauauuaaaaaucgcuaacag

SEQ ID NO: 133682 - RNA, 22 nt, Human
uuugauuaccuggggcccucug

SEQ ID NO: 133683 - RNA, 22 nt, Human
ugcuuuuguaucagaguauuca

SEQ ID NO: 133684 - RNA, 22 nt, Human
ucucuggacggacauuuaaggu

SEQ ID NO: 133685 - RNA, 22 nt, Human
ccacccugguuacugugccagg

SEQ ID NO: 133686 - RNA, 19 nt, Human
agggagagucccaagagaa

SEQ ID NO: 133687 - RNA, 22 nt, Human
uuuauaauuguuauguuaccca

SEQ ID NO: 133688 - RNA, 22 nt, Human
cagguuguucugggcauggagg

SEQ ID NO: 133689 - RNA, 22 nt, Human
uuuuccuucuuccugccuugcc

SEQ ID NO: 133690 - RNA, 22 nt, Human
aagcugccugggaggaagggcu

SEQ ID NO: 133691 - RNA, 22 nt, Human
uacucauuggagaauuacgagg

SEQ ID NO: 133692 - RNA, 22 nt, Human
aagugauuuucccaccaucuac

SEQ ID NO: 133693 - RNA, 22 nt, Human
guucaaucucucaugcauuuuc

SEQ ID NO: 133694 - RNA, 22 nt, Human
cuuuuuaaaguaaauggcuaga

SEQ ID NO: 133695 - RNA, 22 nt, Human
gaggacccuuaggucagacaga

SEQ ID NO: 133696 - RNA, 18 nt, Human
aggcuggggaucacaggg

SEQ ID NO: 133697 - RNA, 22 nt, Human
gaaagagaugucguuugucuuc

SEQ ID NO: 133698 - RNA, 22 nt, Human
acuucccacugcagugacugag

SEQ ID NO: 133699 - RNA, 19 nt, Human
ugguggaggugcaccugac

SEQ ID NO: 133700 - RNA, 22 nt, Human
ucacuuccuugcagcuguagaa

SEQ ID NO: 133701 - RNA, 22 nt, Human
agcagggagacagugcagcauu

SEQ ID NO: 133702 - RNA, 22 nt, Human
auuuuauuuugggaucuuuuua

SEQ ID NO: 133703 - RNA, 22 nt, Human
uuuagguuguguucuggcaugu

SEQ ID NO: 133704 - RNA, 22 nt, Human
cagcuucaugacaaacaguuuu

SEQ ID NO: 133705 - RNA, 22 nt, Human
cugugucucccaaggaggguca

SEQ ID NO: 133706 - RNA, 22 nt, Human
aaaucuuucacauauuuuuuau

SEQ ID NO: 133707 - RNA, 22 nt, Human
cugccucucaugccugcuugcu

SEQ ID NO: 133708 - RNA, 22 nt, Human
uuuuuuuccaguuauucauuuu

SEQ ID NO: 133709 - RNA, 22 nt, Human
uaaaauaccacauauggugcuc

SEQ ID NO: 133710 - RNA, 22 nt, Human
ucuguuucaggggucuggaaug

SEQ ID NO: 133711 - RNA, 22 nt, Human
aaauauugaauuugaggaugua

SEQ ID NO: 133712 - RNA, 22 nt, Human
cggcugcagcggagcaggcugg

SEQ ID NO: 133713 - RNA, 22 nt, Human
agcauucuguggucuucuaugg

SEQ ID NO: 133714 - RNA, 22 nt, Human
cagcuucacuuaaaacaugcaa

SEQ ID NO: 133715 - RNA, 22 nt, Human
aaagccaagguccauguacuuu

SEQ ID NO: 133716 - RNA, 22 nt, Human
aagaaauagauagaggaauacu

SEQ ID NO: 133717 - RNA, 22 nt, Human
auaccuauagcagacugagacu

SEQ ID NO: 133718 - RNA, 22 nt, Human
gcauaacaacagacucuguguu

SEQ ID NO: 133719 - RNA, 22 nt, Human
uuaauauuuauugguaaucacu

SEQ ID NO: 133720 - RNA, 22 nt, Human
uuauuaauacaugcaccugcau

SEQ ID NO: 133721 - RNA, 22 nt, Human
guacugguuuucuuacucuggc

SEQ ID NO: 133722 - RNA, 22 nt, Human
cucacugucagcugcagggcuu

SEQ ID NO: 133723 - RNA, 22 nt, Human
caaaaauacuugccuguaucug

SEQ ID NO: 133724 - RNA, 22 nt, Human
aauuaaauguuugguuugagcu

SEQ ID NO: 133725 - RNA, 22 nt, Human
auuaucugacugaguagucugu

SEQ ID NO: 133726 - RNA, 22 nt, Human
uuaaugcagguacuguuacaau

SEQ ID NO: 133727 - RNA, 22 nt, Human
cuuaggaaauccuguacucccc

SEQ ID NO: 133728 - RNA, 22 nt, Human
aucauguauauuuuugcuauua

SEQ ID NO: 133729 - RNA, 22 nt, Human
uuauuuuuaggaauguagaggu

SEQ ID NO: 133730 - RNA, 22 nt, Human
uguaauuugguuagauuucuuu

SEQ ID NO: 133731 - RNA, 22 nt, Human
aucucccaaauuagccucuuga

SEQ ID NO: 133732 - RNA, 22 nt, Human
ugcagagagccagcucucucgg

SEQ ID NO: 133733 - RNA, 22 nt, Human
acaauaauguuuuuagguuauu

SEQ ID NO: 133734 - RNA, 22 nt, Human
agccacagucuguagccagcuu

SEQ ID NO: 133735 - RNA, 22 nt, Human
ucugaauauguuuaucaucucu

SEQ ID NO: 133736 - RNA, 22 nt, Human
uuaaaauuguuaacuuugguga

SEQ ID NO: 133737 - RNA, 22 nt, Human
gugcucaagacauuaggaauau

SEQ ID NO: 133738 - RNA, 22 nt, Human
uggagggaagcaaacacuagau

SEQ ID NO: 133739 - RNA, 22 nt, Human
agauucucccuccuggcgcugu

SEQ ID NO: 133740 - RNA, 20 nt, Human
gaacauaaauaacucuuuac

SEQ ID NO: 133741 - RNA, 20 nt, Human
ggcagagcuaugucuguugc

SEQ ID NO: 133742 - RNA, 22 nt, Human
caaaacccaagugcuauugcaa

SEQ ID NO: 133743 - RNA, 22 nt, Human
auuuauuugaagagccauugca

SEQ ID NO: 133744 - RNA, 22 nt, Human
guagucauugggucugugguca

SEQ ID NO: 133745 - RNA, 22 nt, Human
auugcaggucguguggaaguga

SEQ ID NO: 133746 - RNA, 22 nt, Human
uaauucuucaauccaguguuca

SEQ ID NO: 133747 - RNA, 23 nt, Human
aaauaauaauuucucuguuggga

SEQ ID NO: 133748 - RNA, 22 nt, Human
uuugaagaaacagucuuaagag

SEQ ID NO: 133749 - RNA, 22 nt, Human
acauuuugggagaaaguuguua

SEQ ID NO: 133750 - RNA, 23 nt, Human
aggcugcagaagaauagggucau

SEQ ID NO: 133751 - RNA, 22 nt, Human
uaaagugaaguucagaauggcu

SEQ ID NO: 133752 - RNA, 22 nt, Human
acauuuuaccaucuguggauga

SEQ ID NO: 133753 - RNA, 22 nt, Human
cuccugcuuuuucuucuuccga

SEQ ID NO: 133754 - RNA, 22 nt, Human
auuuacugagguaaauaaacug

SEQ ID NO: 133755 - RNA, 22 nt, Human
aacauuuauguuuugaccaagu

SEQ ID NO: 133756 - RNA, 22 nt, Human
gaaaacccuguauguagcguuu

SEQ ID NO: 133757 - RNA, 21 nt, Human
ccgaggagugcggggagcccc

SEQ ID NO: 133758 - RNA, 22 nt, Human
auaccaaugaaucccugagaau

SEQ ID NO: 133759 - RNA, 17 nt, Human
ucauuucaguaaaucca

SEQ ID NO: 133760 - RNA, 22 nt, Human
uugguuuacucuggggauaucu

SEQ ID NO: 133761 - RNA, 22 nt, Human
cuucauuucaggcugaagaaua

SEQ ID NO: 133762 - RNA, 22 nt, Human
cucugcuuguaucacauuugcu

SEQ ID NO: 133763 - RNA, 22 nt, Human
agcaaggguugguuuucugaca

SEQ ID NO: 133764 - RNA, 22 nt, Human
uuuaaaccuaucuaagaaauag

SEQ ID NO: 133765 - RNA, 22 nt, Human
uauuuuuacuguuugaugauuc

SEQ ID NO: 133766 - RNA, 22 nt, Human
agucacuguucugucaugucaa

SEQ ID NO: 133767 - RNA, 19 nt, Human
caggucuucuuggaggacu

SEQ ID NO: 133768 - RNA, 22 nt, Human
auggcagcggagcuggaaauga

SEQ ID NO: 133769 - RNA, 22 nt, Human
uccagaaaucucuguugauugu

SEQ ID NO: 133770 - RNA, 22 nt, Human
uugaaaaaugcccagcagacaa

SEQ ID NO: 133771 - RNA, 22 nt, Human
cuuacauuuguuuaguguuucc

SEQ ID NO: 133772 - RNA, 22 nt, Human
uuuaucaggccaucuuaugucu

SEQ ID NO: 133773 - RNA, 22 nt, Human
uugaagccaccacuguaaguca

SEQ ID NO: 133774 - RNA, 22 nt, Human
uaaaggcaaacucuccaaggau

SEQ ID NO: 133775 - RNA, 22 nt, Human
gggagaguagcuggaagguucu

SEQ ID NO: 133776 - RNA, 20 nt, Human
gugaacuggagaacugaugu

SEQ ID NO: 133777 - RNA, 22 nt, Human
aauuagaagcuguuagcaaaau

SEQ ID NO: 133778 - RNA, 22 nt, Human
agguuuggaaguggcgauccau

SEQ ID NO: 133779 - RNA, 22 nt, Human
uuucucuuucaaucugcaguac

SEQ ID NO: 133780 - RNA, 22 nt, Human
uggggcuggccaggaggagucu

SEQ ID NO: 133781 - RNA, 22 nt, Human
uccacagcagagcacgguaccu

SEQ ID NO: 133782 - RNA, 22 nt, Human
uuucagaaauggcacugaaauc

SEQ ID NO: 133783 - RNA, 22 nt, Human
cucuuucauucuguccuuguuu

SEQ ID NO: 133784 - RNA, 22 nt, Human
uuuuagaagcauuuaugagauu

SEQ ID NO: 133785 - RNA, 22 nt, Human
cagaguaaugugauuuccaugu

SEQ ID NO: 133786 - RNA, 22 nt, Human
agcuuucuauauaugaguugcu

SEQ ID NO: 133787 - RNA, 22 nt, Human
uuuauuuagguaaacaugaguu

SEQ ID NO: 133788 - RNA, 22 nt, Human
uucacugugauugggguggauu

SEQ ID NO: 133789 - RNA, 22 nt, Human
auagaagugaaaagggaugacu

SEQ ID NO: 133790 - RNA, 22 nt, Human
cugggagaugacucagagcagg

SEQ ID NO: 133791 - RNA, 22 nt, Human
cauuagggucuuuagacagcuc

SEQ ID NO: 133792 - RNA, 22 nt, Human
cagagacuuuugcuccgauucu

SEQ ID NO: 133793 - RNA, 22 nt, Human
auggagugggaggacaugaagg

SEQ ID NO: 133794 - RNA, 22 nt, Human
aucuugaaacauauaugcauuu

SEQ ID NO: 133795 - RNA, 22 nt, Human
uauuuugaggugaaagaguuug

SEQ ID NO: 133796 - RNA, 22 nt, Human
auucauauagcgcuuacagccu

SEQ ID NO: 133797 - RNA, 22 nt, Human
uauauacuugaaaauugcugag

SEQ ID NO: 133798 - RNA, 22 nt, Human
agggaggcccagcagacuggcg

SEQ ID NO: 133799 - RNA, 22 nt, Human
uguuuuguuuagguuuguuuuu

SEQ ID NO: 133800 - RNA, 22 nt, Human
ucagagaaguaggcuaauggug

SEQ ID NO: 133801 - RNA, 22 nt, Human
gugggugaguggggccgccuga

SEQ ID NO: 133802 - RNA, 22 nt, Human
ccaggcagaggggucuggagca

SEQ ID NO: 133803 - RNA, 23 nt, Human
uccugcagauaagcugguugaca

SEQ ID NO: 133804 - RNA, 22 nt, Human
uguaucuguguguauguguuua

SEQ ID NO: 133805 - RNA, 22 nt, Human
uuuuuggacccaucuucuuuuu

SEQ ID NO: 133806 - RNA, 22 nt, Human
uuuaaaacagcauuuaaaaggu

SEQ ID NO: 133807 - RNA, 19 nt, Human
acugggaugggcagugcca

SEQ ID NO: 133808 - RNA, 22 nt, Human
uccucagcaagacgcuggcagc

SEQ ID NO: 133809 - RNA, 21 nt, Human
ucucauuuuaacacagaguug

SEQ ID NO: 133810 - RNA, 22 nt, Human
acuuugugaauagaacuggaug

SEQ ID NO: 133811 - RNA, 22 nt, Human
caacaaguugauuucacgcugc

SEQ ID NO: 133812 - RNA, 22 nt, Human
aaacccaggguuuugucuuccc

SEQ ID NO: 133813 - RNA, 22 nt, Human
accaggaguuuugaccaggggc

SEQ ID NO: 133814 - RNA, 22 nt, Human
ugaagacaguuuuacucaugag

SEQ ID NO: 133815 - RNA, 22 nt, Human
auggaagagacaaugcuaucug

SEQ ID NO: 133816 - RNA, 21 nt, Human
auauuguugggguuuucuuuu

SEQ ID NO: 133817 - RNA, 22 nt, Human
ggcucacuguaccugccgccgc

SEQ ID NO: 133818 - RNA, 22 nt, Human
aauggcaaaaguuucggaaauu

SEQ ID NO: 133819 - RNA, 22 nt, Human
aucuuuguaaguaaucaaagcu

SEQ ID NO: 133820 - RNA, 22 nt, Human
uuuaaucaguugguaauauuga

SEQ ID NO: 133821 - RNA, 22 nt, Human
uuaucaaaaaauaguacuuuga

SEQ ID NO: 133822 - RNA, 23 nt, Human
cauuugauccucacaauaaaugg

SEQ ID NO: 133823 - RNA, 20 nt, Human
uggguucaguuguuucuggc

SEQ ID NO: 133824 - RNA, 22 nt, Human
gaauaagaauccacuucuggca

SEQ ID NO: 133825 - RNA, 22 nt, Human
ucaacagaagugauagcuauua

SEQ ID NO: 133826 - RNA, 20 nt, Human
uucacagaggacucagguca

SEQ ID NO: 133827 - RNA, 22 nt, Human
ggcaagcacugggugucuuagc

SEQ ID NO: 133828 - RNA, 22 nt, Human
uacuuaauuuuaaaagcuagau

SEQ ID NO: 133829 - RNA, 22 nt, Human
agucauuugucauuuuuuugag

SEQ ID NO: 133830 - RNA, 18 nt, Human
uuuaauaagccuguuaug

SEQ ID NO: 133831 - RNA, 21 nt, Human
ucauccagguccugcuucuuc

SEQ ID NO: 133832 - RNA, 22 nt, Human
ucuccuaauuacauacuugauu

SEQ ID NO: 133833 - RNA, 22 nt, Human
uggguucaaauccugguuccac

SEQ ID NO: 133834 - RNA, 18 nt, Human
acaaaaauagugcuuugg

SEQ ID NO: 133835 - RNA, 22 nt, Human
uuaacauuguccuuagcagauu

SEQ ID NO: 133836 - RNA, 22 nt, Human
agauuuucuuuuccaucuuugu

SEQ ID NO: 133837 - RNA, 22 nt, Human
aaauguaaacuguauuuauaaa

SEQ ID NO: 133838 - RNA, 22 nt, Human
augugcauguauguaucauauu

SEQ ID NO: 133839 - RNA, 22 nt, Human
gggggaggcucggcgccgcggu

SEQ ID NO: 133840 - RNA, 22 nt, Human
uauauuaaagugcuuugcagug

SEQ ID NO: 133841 - RNA, 22 nt, Human
gaaccauuuaauggagaugcuc

SEQ ID NO: 133842 - RNA, 22 nt, Human
gcauccaaggagcagaagugau

SEQ ID NO: 133843 - RNA, 22 nt, Human
guacauauccuuuacguuuugu

SEQ ID NO: 133844 - RNA, 22 nt, Human
cugccaggagaggccagggccc

SEQ ID NO: 133845 - RNA, 22 nt, Human
guggcaguaaagcuggaaaagu

SEQ ID NO: 133846 - RNA, 22 nt, Human
aggagaaagaccagccugccga

SEQ ID NO: 133847 - RNA, 22 nt, Human
ugcucuuuguagcugcuuugcu

SEQ ID NO: 133848 - RNA, 22 nt, Human
caauccccaggucccagaacag

SEQ ID NO: 133849 - RNA, 22 nt, Human
aagccugguuauuugaggaugu

SEQ ID NO: 133850 - RNA, 17 nt, Human
augcccagggcucccug

SEQ ID NO: 133851 - RNA, 21 nt, Human
acuccagccacugacugucuc

SEQ ID NO: 133852 - RNA, 22 nt, Human
uuggugaugcccaccuuuucau

SEQ ID NO: 133853 - RNA, 23 nt, Human
ucugccuccuaauuguugguguc

SEQ ID NO: 133854 - RNA, 22 nt, Human
ggccagcuuugagcugcaggaa

SEQ ID NO: 133855 - RNA, 22 nt, Human
caggggcuccaggugagccugg

SEQ ID NO: 133856 - RNA, 22 nt, Human
uuuauaauuacguaaaauauuu

SEQ ID NO: 133857 - RNA, 22 nt, Human
aaaguuacacgacuauuuaugu

SEQ ID NO: 133858 - RNA, 22 nt, Human
cacccccaggcuccccuucugg

SEQ ID NO: 133859 - RNA, 22 nt, Human
aauaaagcuugaaagcagggaa

SEQ ID NO: 133860 - RNA, 22 nt, Human
gauacugugggcacucauaaua

SEQ ID NO: 133861 - RNA, 22 nt, Human
ggcugggagguggcgaggaggc

SEQ ID NO: 133862 - RNA, 22 nt, Human
auuagugguguauuuggcacua

SEQ ID NO: 133863 - RNA, 22 nt, Human
agaauacaauuguucaguaaua

SEQ ID NO: 133864 - RNA, 22 nt, Human
augcggcugugggggaauggga

SEQ ID NO: 133865 - RNA, 22 nt, Human
uucuugugugaauauaauuaca

SEQ ID NO: 133866 - RNA, 22 nt, Human
ggcagggagagcaugcugauaa

SEQ ID NO: 133867 - RNA, 22 nt, Human
caauguuuuuccuuccuuaaua

SEQ ID NO: 133868 - RNA, 22 nt, Human
agaaaaggaagcuuagacugua

SEQ ID NO: 133869 - RNA, 22 nt, Human
ugguccaccgccucauucucug

SEQ ID NO: 133870 - RNA, 22 nt, Human
uggucucuacggaggaaagcug

SEQ ID NO: 133871 - RNA, 20 nt, Human
ucauucagaaucaguaugca

SEQ ID NO: 133872 - RNA, 22 nt, Human
agcucugauccuuuaaaggaga

SEQ ID NO: 133873 - RNA, 22 nt, Human
ugcagacuguuucuugacugaa

SEQ ID NO: 133874 - RNA, 22 nt, Human
uugcagagaacuaaagggagua

SEQ ID NO: 133875 - RNA, 22 nt, Human
auuauugcaagcagugaaggga

SEQ ID NO: 133876 - RNA, 20 nt, Human
uuuuuuaaauagagcuguug

SEQ ID NO: 133877 - RNA, 22 nt, Human
ucuuuaaggggccuuuguguca

SEQ ID NO: 133878 - RNA, 22 nt, Human
cuacuucucccuagaucagaaa

SEQ ID NO: 133879 - RNA, 22 nt, Human
uuuuuaauuuuaagcuauuugu

SEQ ID NO: 133880 - RNA, 22 nt, Human
ucccacgugccaucugcucugu

SEQ ID NO: 133881 - RNA, 22 nt, Human
auggaguguggccaggcaguaa

SEQ ID NO: 133882 - RNA, 22 nt, Human
ugauucacagacuucacaaggc

SEQ ID NO: 133883 - RNA, 22 nt, Human
uccaugcaguagaggcgcuggg

SEQ ID NO: 133884 - RNA, 22 nt, Human
agaacccaaggcccagggaugu

SEQ ID NO: 133885 - RNA, 22 nt, Human
augcuaaucaaacuuucugcag

SEQ ID NO: 133886 - RNA, 22 nt, Human
cauuuaucacuugcuaaacaua

SEQ ID NO: 133887 - RNA, 22 nt, Human
gagcagcucgagaaggaagcag

SEQ ID NO: 133888 - RNA, 22 nt, Human
cagaucacauccauccgucacc

SEQ ID NO: 133889 - RNA, 22 nt, Human
ugggauggacuuuagagaaucg

SEQ ID NO: 133890 - RNA, 19 nt, Human
ugcagcuguaugagcuuaa

SEQ ID NO: 133891 - RNA, 22 nt, Human
ccagcaaguaagucagugucag

SEQ ID NO: 133892 - RNA, 22 nt, Human
aagauauauaaggaaguucagu

SEQ ID NO: 133893 - RNA, 22 nt, Human
aaaauauaaaggauguggguuu

SEQ ID NO: 133894 - RNA, 22 nt, Human
ugcaaggcacccacucugcuuu

SEQ ID NO: 133895 - RNA, 22 nt, Human
cuuauucuucuggacuuggagu

SEQ ID NO: 133896 - RNA, 22 nt, Human
uauaagaaaagucauuaucaaa

SEQ ID NO: 133897 - RNA, 20 nt, Human
gggcucugcauccaucagcc

SEQ ID NO: 133898 - RNA, 22 nt, Human
ggaggucagcuggaggggaggc

SEQ ID NO: 133899 - RNA, 20 nt, Human
ugcagcucccccgcaguuuc

SEQ ID NO: 133900 - RNA, 22 nt, Human
uucucaauggcaacuuguugcu

SEQ ID NO: 133901 - RNA, 22 nt, Human
uaaaugauaguauugaagguag

SEQ ID NO: 133902 - RNA, 22 nt, Human
aagugagaugggagucagagga

SEQ ID NO: 133903 - RNA, 22 nt, Human
cguggaggucgcauauuccucu

SEQ ID NO: 133904 - RNA, 20 nt, Human
cuggaguguagcaguggcug

SEQ ID NO: 133905 - RNA, 20 nt, Human
ucuugucuggcagccuggag

SEQ ID NO: 133906 - RNA, 22 nt, Human
ugaggcaguucuuacuuguauu

SEQ ID NO: 133907 - RNA, 19 nt, Human
auacacguguauacauaca

SEQ ID NO: 133908 - RNA, 22 nt, Human
uaaaugcucuuuaaaagugcuu

SEQ ID NO: 133909 - RNA, 22 nt, Human
uauuuuagccaacagaaugaug

SEQ ID NO: 133910 - RNA, 22 nt, Human
uuggaagagagauggggagaga

SEQ ID NO: 133911 - RNA, 22 nt, Human
gugcagcugggcgcugaccuuc

SEQ ID NO: 133912 - RNA, 19 nt, Human
agggaggcaagagaaaugu

SEQ ID NO: 133913 - RNA, 22 nt, Human
cagaggagcgaguuggacgcca

SEQ ID NO: 133914 - RNA, 22 nt, Human
cgaaggaaucacuuaacacuuu

SEQ ID NO: 133915 - RNA, 22 nt, Human
uugguuaccuucagaaaugagu

SEQ ID NO: 133916 - RNA, 22 nt, Human
aauagaguccuguacugaauga

SEQ ID NO: 133917 - RNA, 22 nt, Human
auuaauaucaauauauuauaug

SEQ ID NO: 133918 - RNA, 22 nt, Human
uguuuaaauagaacauacugca

SEQ ID NO: 133919 - RNA, 22 nt, Human
ugaccucaagcaugcggagggc

SEQ ID NO: 133920 - RNA, 22 nt, Human
augaaaacgugugugugugugu

SEQ ID NO: 133921 - RNA, 19 nt, Human
cugggacaaugaaagcauc

SEQ ID NO: 133922 - RNA, 22 nt, Human
ugagaccuaaaccgucuguccu

SEQ ID NO: 133923 - RNA, 22 nt, Human
aaauauuaaugaugaagguagu

SEQ ID NO: 133924 - RNA, 22 nt, Human
gguuuucacgauccucccuuuu

SEQ ID NO: 133925 - RNA, 22 nt, Human
gacaacuucaguaaaguagauu

SEQ ID NO: 133926 - RNA, 22 nt, Human
gagggagagaugcuggaccggg

SEQ ID NO: 133927 - RNA, 22 nt, Human
uggggcuccuccuggcaggagg

SEQ ID NO: 133928 - RNA, 22 nt, Human
gccaggagaaaaggcgaaugau

SEQ ID NO: 133929 - RNA, 22 nt, Human
uuugauuuuuugagcaguguau

SEQ ID NO: 133930 - RNA, 22 nt, Human
caggaacagcaccaggagcuag

SEQ ID NO: 133931 - RNA, 22 nt, Human
aggcugccuaugaaggcagaag

SEQ ID NO: 133932 - RNA, 22 nt, Human
aggcaguguguagcuggaagag

SEQ ID NO: 133933 - RNA, 22 nt, Human
cgaggagguccaggagcaguag

SEQ ID NO: 133934 - RNA, 22 nt, Human
aaaauaaccuucauuugcauug

SEQ ID NO: 133935 - RNA, 20 nt, Human
ggagagggaaaggcuguacu

SEQ ID NO: 133936 - RNA, 22 nt, Human
aaaaggucacuguaaaaugacg

SEQ ID NO: 133937 - RNA, 22 nt, Human
ccucaucagaaagcagaaagca

SEQ ID NO: 133938 - RNA, 22 nt, Human
agggcugcugcuccgggcccag

SEQ ID NO: 133939 - RNA, 22 nt, Human
aggaaauaggaccagacaaagc

SEQ ID NO: 133940 - RNA, 22 nt, Human
uuucaugauuaacuuagugaau

SEQ ID NO: 133941 - RNA, 22 nt, Human
uugggauucugucagugugugu

SEQ ID NO: 133942 - RNA, 22 nt, Human
aucauuugaacagaauuuguuu

SEQ ID NO: 133943 - RNA, 22 nt, Human
guugguggaggcgagagaagaa

SEQ ID NO: 133944 - RNA, 22 nt, Human
auuuuuucaugugugguugaga

SEQ ID NO: 133945 - RNA, 22 nt, Human
ggaugaguuguauauaggauuc

SEQ ID NO: 133946 - RNA, 22 nt, Human
uucacaauuuuaaaaaguggaa

SEQ ID NO: 133947 - RNA, 22 nt, Human
cugugaaugguggccacgcguu

SEQ ID NO: 133948 - RNA, 21 nt, Human
uccaggagcacgggacuagga

SEQ ID NO: 133949 - RNA, 22 nt, Human
uuuuaaaagguugcuguuauaa

SEQ ID NO: 133950 - RNA, 22 nt, Human
aucuuugauuuuggcuuuuagg

SEQ ID NO: 133951 - RNA, 22 nt, Human
uccuucagaggacggcagccag

SEQ ID NO: 133952 - RNA, 22 nt, Human
ucaggagaguguucaguggagg

SEQ ID NO: 133953 - RNA, 22 nt, Human
gaaaaagucuuaaaguaaggca

SEQ ID NO: 133954 - RNA, 22 nt, Human
gaggagagaaauguuuucugug

SEQ ID NO: 133955 - RNA, 22 nt, Human
cagaaaacauuguguguauaag

SEQ ID NO: 133956 - RNA, 22 nt, Human
gaaaauaguucaucacaaugau

SEQ ID NO: 133957 - RNA, 22 nt, Human
aacacuguaucagucuucaaua

SEQ ID NO: 133958 - RNA, 22 nt, Human
ugucuuucuuucucuugacaga

SEQ ID NO: 133959 - RNA, 21 nt, Human
cuauaaaaaugguucuuugcg

SEQ ID NO: 133960 - RNA, 22 nt, Human
uuuuaauccucuugguaucuua

SEQ ID NO: 133961 - RNA, 20 nt, Human
ccuuguggaugucuuuuuug

SEQ ID NO: 133962 - RNA, 22 nt, Human
uuuugaugaccauucuucuuuu

SEQ ID NO: 133963 - RNA, 22 nt, Human
agcaagggucucucauggcuug

SEQ ID NO: 133964 - RNA, 22 nt, Human
ugcaaauuuuuuuauuuuuccu

SEQ ID NO: 133965 - RNA, 22 nt, Human
gcaggaaugguacauaccuguu

SEQ ID NO: 133966 - RNA, 22 nt, Human
uuuuuauaagauuuaaaaugua

SEQ ID NO: 133967 - RNA, 22 nt, Human
uuuucauagccagaaacugaaa

SEQ ID NO: 133968 - RNA, 22 nt, Human
auacuaagcucauuacauuuug

SEQ ID NO: 133969 - RNA, 22 nt, Human
uugcaucagcaggcauaauugg

SEQ ID NO: 133970 - RNA, 22 nt, Human
auguauauauacauguauugua

SEQ ID NO: 133971 - RNA, 22 nt, Human
aaauuaaaguuuuauuuagagc

SEQ ID NO: 133972 - RNA, 22 nt, Human
guuuauuucuuaucaucacuau

SEQ ID NO: 133973 - RNA, 20 nt, Human
uggaucaccauccuguugcu

SEQ ID NO: 133974 - RNA, 22 nt, Human
ggcugguggcgggcagcacaga

SEQ ID NO: 133975 - RNA, 23 nt, Human
uauuuuccccuguaauauguauu

SEQ ID NO: 133976 - RNA, 22 nt, Human
aaauggauaaucaagauaauca

SEQ ID NO: 133977 - RNA, 22 nt, Human
agacuucucuuggcuauauuau

SEQ ID NO: 133978 - RNA, 22 nt, Human
acagcucaggcccaucaacccc

SEQ ID NO: 133979 - RNA, 22 nt, Human
augguguaagacuguauuucuu

SEQ ID NO: 133980 - RNA, 22 nt, Human
ugaacauuuuugcuugcagcuu

SEQ ID NO: 133981 - RNA, 22 nt, Human
acauccagcagauuguccagag

SEQ ID NO: 133982 - RNA, 22 nt, Human
uacugcaguuccugcugucucc

SEQ ID NO: 133983 - RNA, 22 nt, Human
aucauguauaugcagcguuugu

SEQ ID NO: 133984 - RNA, 22 nt, Human
uccuccauguugugcacuugaa

SEQ ID NO: 133985 - RNA, 22 nt, Human
uuccagcaaagguaguguguua

SEQ ID NO: 133986 - RNA, 22 nt, Human
agcaaaauuccaaaaugcuaau

SEQ ID NO: 133987 - RNA, 22 nt, Human
aaggaugguaacaguuucauuu

SEQ ID NO: 133988 - RNA, 22 nt, Human
auuucauuuuagaaauaagugu

SEQ ID NO: 133989 - RNA, 22 nt, Human
uuaauauuaagauauugagugg

SEQ ID NO: 133990 - RNA, 21 nt, Human
aggcuuggaucuagacaggcc

SEQ ID NO: 133991 - RNA, 22 nt, Human
auauuugucuguuuuaguggca

SEQ ID NO: 133992 - RNA, 22 nt, Human
aguggagguuacagcuguacau

SEQ ID NO: 133993 - RNA, 22 nt, Human
aaauauagugacacuuauaguc

SEQ ID NO: 133994 - RNA, 22 nt, Human
uuuucaauuuucauuugcaaga

SEQ ID NO: 133995 - RNA, 22 nt, Human
uuaggggcuuaggcagaguuug

SEQ ID NO: 133996 - RNA, 22 nt, Human
ugguuauauaaggauuaaauac

SEQ ID NO: 133997 - RNA, 18 nt, Human
uucucucuggauaguagu

SEQ ID NO: 133998 - RNA, 22 nt, Human
cccuccagugucccagugggga

SEQ ID NO: 133999 - RNA, 22 nt, Human
cugggaguugacgaggcuugua

SEQ ID NO: 134000 - RNA, 22 nt, Human
cagugcucauagcuguuccucc

SEQ ID NO: 134001 - RNA, 23 nt, Human
uguaaaacaccguuauugcaccu

SEQ ID NO: 134002 - RNA, 22 nt, Human
uuaaguccuugguaauuuucuu

SEQ ID NO: 134003 - RNA, 22 nt, Human
acucauucgccuugcccaaggc

SEQ ID NO: 134004 - RNA, 22 nt, Human
uuuuauuuguauguugaaugua

SEQ ID NO: 134005 - RNA, 22 nt, Human
ucucuucacuuguaugcuauca

SEQ ID NO: 134006 - RNA, 22 nt, Human
cugauaauaaccauuuuaaaau

SEQ ID NO: 134007 - RNA, 22 nt, Human
uuuaccuuauguaaauaagagu

SEQ ID NO: 134008 - RNA, 22 nt, Human
auaaauuugacagcucuucaug

SEQ ID NO: 134009 - RNA, 22 nt, Human
ugcaggaacucgaaaacuauag

SEQ ID NO: 134010 - RNA, 22 nt, Human
caguagcuuuuugcagacaaga

SEQ ID NO: 134011 - RNA, 20 nt, Human
aaagauacuuuuuguaaugg

SEQ ID NO: 134012 - RNA, 22 nt, Human
gggagcugagcuggaagagaau

SEQ ID NO: 134013 - RNA, 22 nt, Human
aagaaaagcaucuuuguaguag

SEQ ID NO: 134014 - RNA, 22 nt, Human
aaaggaaacuaugaaucucugg

SEQ ID NO: 134015 - RNA, 22 nt, Human
uuuuguuuacauuaaauuuuga

SEQ ID NO: 134016 - RNA, 22 nt, Human
ucagcaggugcuuuguuuacuc

SEQ ID NO: 134017 - RNA, 22 nt, Human
auaaauuugccagcauauguuc

SEQ ID NO: 134018 - RNA, 22 nt, Human
ucagucacugucucagacagga

SEQ ID NO: 134019 - RNA, 22 nt, Human
aauuauuauguggaagacgacg

SEQ ID NO: 134020 - RNA, 22 nt, Human
auggagggguuguugcuugagu

SEQ ID NO: 134021 - RNA, 22 nt, Human
ugcuuguuuuguggcuucagcu

SEQ ID NO: 134022 - RNA, 22 nt, Human
aggaaaaagaagaaaagaauca

SEQ ID NO: 134023 - RNA, 22 nt, Human
ugcauugccucuauucauuaua

SEQ ID NO: 134024 - RNA, 22 nt, Human
ggcuagggagacagagggcaug

SEQ ID NO: 134025 - RNA, 22 nt, Human
ugagggaugccucuccuuccgg

SEQ ID NO: 134026 - RNA, 22 nt, Human
aucuguuccccuaugcucucua

SEQ ID NO: 134027 - RNA, 22 nt, Human
auuuuuuuuccugucucuuuca

SEQ ID NO: 134028 - RNA, 20 nt, Human
aaaaacaguaaugcugaaga

SEQ ID NO: 134029 - RNA, 22 nt, Human
auguugagaaucucucuucuaa

SEQ ID NO: 134030 - RNA, 22 nt, Human
ggcugugaaguacguugaaggu

SEQ ID NO: 134031 - RNA, 22 nt, Human
auauuucuacaggcugauuuua

SEQ ID NO: 134032 - RNA, 22 nt, Human
gggggcugugugcccgcucccc

SEQ ID NO: 134033 - RNA, 22 nt, Human
aguauuuaguauucuauauuag

SEQ ID NO: 134034 - RNA, 22 nt, Human
gauuuuaaaagauguauaaggu

SEQ ID NO: 134035 - RNA, 22 nt, Human
gugcccaguugaggccaggacu

SEQ ID NO: 134036 - RNA, 22 nt, Human
caacuucugcuuucuuccuugc

SEQ ID NO: 134037 - RNA, 22 nt, Human
uucuguuuauaauuugcaguug

SEQ ID NO: 134038 - RNA, 22 nt, Human
aggaggaggacucgccaggcca

SEQ ID NO: 134039 - RNA, 22 nt, Human
cagcucuggcuauugaggacca

SEQ ID NO: 134040 - RNA, 22 nt, Human
guuuuguagucuggagacuguc

SEQ ID NO: 134041 - RNA, 22 nt, Human
acugcauuaucaccaagaugua

SEQ ID NO: 134042 - RNA, 22 nt, Human
gaggagagcuggccagguuucu

SEQ ID NO: 134043 - RNA, 22 nt, Human
ugagggauuucuggccuuaacu

SEQ ID NO: 134044 - RNA, 22 nt, Human
uguuuucuuuccccuucuuuuc

SEQ ID NO: 134045 - RNA, 22 nt, Human
guggauggagcuggaagccauu

SEQ ID NO: 134046 - RNA, 22 nt, Human
ucccagaacggguucuucccag

SEQ ID NO: 134047 - RNA, 22 nt, Human
gugaaaaauggccaucaggaca

SEQ ID NO: 134048 - RNA, 22 nt, Human
uugcugccagcgcccugcaggg

SEQ ID NO: 134049 - RNA, 22 nt, Human
uugaauaguuuuggauagcaua

SEQ ID NO: 134050 - RNA, 23 nt, Human
acgggaggcggggcagggcugag

SEQ ID NO: 134051 - RNA, 22 nt, Human
aagacacuuucuaaauagaagu

SEQ ID NO: 134052 - RNA, 22 nt, Human
acaggcugcccgcuccccaccu

SEQ ID NO: 134053 - RNA, 22 nt, Human
agagggagcuccaagaucaagg

SEQ ID NO: 134054 - RNA, 21 nt, Human
gggagaguagcgguagggagg

SEQ ID NO: 134055 - RNA, 22 nt, Human
agauuaagcauuauaauuauaa

SEQ ID NO: 134056 - RNA, 22 nt, Human
auauauguauauacacauauau

SEQ ID NO: 134057 - RNA, 22 nt, Human
aaggagaggagucauugggaua

SEQ ID NO: 134058 - RNA, 22 nt, Human
aauauauaugggugcaugucug

SEQ ID NO: 134059 - RNA, 22 nt, Human
aaucaauuauccauuuguuagu

SEQ ID NO: 134060 - RNA, 22 nt, Human
acagcugagaugcuacuugugg

SEQ ID NO: 134061 - RNA, 19 nt, Human
gaguaaaacuagagagaaa

SEQ ID NO: 134062 - RNA, 22 nt, Human
auuaagucugacuggauuguau

SEQ ID NO: 134063 - RNA, 22 nt, Human
uggaagggguuacgcagcagga

SEQ ID NO: 134064 - RNA, 18 nt, Human
ggcugggcugugccccuu

SEQ ID NO: 134065 - RNA, 22 nt, Human
uaauuuugucacagugacaugc

SEQ ID NO: 134066 - RNA, 22 nt, Human
ucaccuuuugaauugcuguugu

SEQ ID NO: 134067 - RNA, 21 nt, Human
ccugcacuucccuccucaagu

SEQ ID NO: 134068 - RNA, 22 nt, Human
aggggaggcugggcuggggggc

SEQ ID NO: 134069 - RNA, 18 nt, Human
ggugagggagcuggaagc

SEQ ID NO: 134070 - RNA, 23 nt, Human
uuugaaucauuguggggcuuuug

SEQ ID NO: 134071 - RNA, 22 nt, Human
ugagaaaacaguuuguaauaau

SEQ ID NO: 134072 - RNA, 22 nt, Human
uggcagcucauuuggaaaugga

SEQ ID NO: 134073 - RNA, 22 nt, Human
auauuuuugcagaauuuuucgu

SEQ ID NO: 134074 - RNA, 22 nt, Human
aauuauguugaaauaugagaac

SEQ ID NO: 134075 - RNA, 23 nt, Human
cagagaaaauagaauaugcugug

SEQ ID NO: 134076 - RNA, 22 nt, Human
aggcaacagacaggcuugguuc

SEQ ID NO: 134077 - RNA, 19 nt, Human
ugccccacccucuauccag

SEQ ID NO: 134078 - RNA, 22 nt, Human
ucucucucucuuccagcauguu

SEQ ID NO: 134079 - RNA, 22 nt, Human
agauuucaauggauauugcaag

SEQ ID NO: 134080 - RNA, 22 nt, Human
ugcgccccgcgggccuucgggc

SEQ ID NO: 134081 - RNA, 22 nt, Human
gcuggucuggcaauccucaugg

SEQ ID NO: 134082 - RNA, 22 nt, Human
ugaaucaaugaauugcacuuca

SEQ ID NO: 134083 - RNA, 22 nt, Human
ugucuuuagagugaacagaaga

SEQ ID NO: 134084 - RNA, 22 nt, Human
uauauauaugcaccacaugugu

SEQ ID NO: 134085 - RNA, 23 nt, Human
gugagaccagagccuauucucag

SEQ ID NO: 134086 - RNA, 22 nt, Human
uuuauaaacacaagaugggcuc

SEQ ID NO: 134087 - RNA, 23 nt, Human
uuuuccaaaucgacucucuaguu

SEQ ID NO: 134088 - RNA, 22 nt, Human
agugaagauagagccaggucug

SEQ ID NO: 134089 - RNA, 22 nt, Human
guaaauaucucacgaaugauuc

SEQ ID NO: 134090 - RNA, 22 nt, Human
ugaagcuaguauuaacucagau

SEQ ID NO: 134091 - RNA, 22 nt, Human
ccugcuggagucuaguuggucu

SEQ ID NO: 134092 - RNA, 22 nt, Human
cuauuaauggccaggagucaug

SEQ ID NO: 134093 - RNA, 22 nt, Human
agacuccuucuaagaccucauu

SEQ ID NO: 134094 - RNA, 22 nt, Human
gucuuucuuuuacauauuugug

SEQ ID NO: 134095 - RNA, 22 nt, Human
aggggagggcuggccuuuggau

SEQ ID NO: 134096 - RNA, 22 nt, Human
uuucugagccacauauaauuug

SEQ ID NO: 134097 - RNA, 22 nt, Human
uuuuuauguaaaauauuaaaag

SEQ ID NO: 134098 - RNA, 22 nt, Human
ggggaggugugcaggacaccuc

SEQ ID NO: 134099 - RNA, 22 nt, Human
auguuuucuugucuggagaagu

SEQ ID NO: 134100 - RNA, 22 nt, Human
agaaacaagcccuagaaguccu

SEQ ID NO: 134101 - RNA, 22 nt, Human
gucucacuucauuuucuuagcc

SEQ ID NO: 134102 - RNA, 22 nt, Human
uaauauaacugccaguuaaggu

SEQ ID NO: 134103 - RNA, 22 nt, Human
guuuuuaguuuaaguuuuugca

SEQ ID NO: 134104 - RNA, 22 nt, Human
acauauaugugcauacaacuau

SEQ ID NO: 134105 - RNA, 23 nt, Human
guuauugcuggugcuggccagcc

SEQ ID NO: 134106 - RNA, 21 nt, Human
gcagcucaggauauagacuug

SEQ ID NO: 134107 - RNA, 22 nt, Human
uaaaaucaugacagauugacau

SEQ ID NO: 134108 - RNA, 22 nt, Human
ugcaugaucucacuuacaggug

SEQ ID NO: 134109 - RNA, 22 nt, Human
aguacuuuuuguucaauugugc

SEQ ID NO: 134110 - RNA, 22 nt, Human
acuuagaacagccuaugggaag

SEQ ID NO: 134111 - RNA, 22 nt, Human
ucagcucacaauguugagaaag

SEQ ID NO: 134112 - RNA, 23 nt, Human
uuucugaguuuuuuaaaagucca

SEQ ID NO: 134113 - RNA, 22 nt, Human
cagcuggggagagacauggcag

SEQ ID NO: 134114 - RNA, 22 nt, Human
caugccucuguuuuaguuguug

SEQ ID NO: 134115 - RNA, 22 nt, Human
guuuugugugugugcccacacg

SEQ ID NO: 134116 - RNA, 22 nt, Human
auauucaaugaggucauauaag

SEQ ID NO: 134117 - RNA, 22 nt, Human
aaaucauagccaugaacauuug

SEQ ID NO: 134118 - RNA, 22 nt, Human
gauuuugcuuuagugaaggaag

SEQ ID NO: 134119 - RNA, 22 nt, Human
aggccacucagggggccaagau

SEQ ID NO: 134120 - RNA, 23 nt, Human
aguggaggucgggguggggagac

SEQ ID NO: 134121 - RNA, 22 nt, Human
ggaggaggggcggggaggggag

SEQ ID NO: 134122 - RNA, 22 nt, Human
cuaauuguaagcuccuugaggg

SEQ ID NO: 134123 - RNA, 16 nt, Human
acauggcacacaguuu

SEQ ID NO: 134124 - RNA, 22 nt, Human
ugguucuagaugagaugaugag

SEQ ID NO: 134125 - RNA, 22 nt, Human
ucaccaugcccuucucugcucu

SEQ ID NO: 134126 - RNA, 23 nt, Human
uggcaaacgggaauaaaggaauu

SEQ ID NO: 134127 - RNA, 22 nt, Human
ugcuuaaccagccccuucccuu

SEQ ID NO: 134128 - RNA, 22 nt, Human
uggugcucuugauauauaaggc

SEQ ID NO: 134129 - RNA, 22 nt, Human
gguggcagaggaggcgggagag

SEQ ID NO: 134130 - RNA, 22 nt, Human
gagguagaggaaaagauuauca

SEQ ID NO: 134131 - RNA, 22 nt, Human
uaaaguguacaagucauaagua

SEQ ID NO: 134132 - RNA, 22 nt, Human
cucaucagagcccuccucuggc

SEQ ID NO: 134133 - RNA, 22 nt, Human
auuuuugguuauaaaauaguuu

SEQ ID NO: 134134 - RNA, 22 nt, Human
ugcccacuuugucuccaugcug

SEQ ID NO: 134135 - RNA, 22 nt, Human
aggcaguggagcuggaauaggc

SEQ ID NO: 134136 - RNA, 22 nt, Human
ggagggagugcaggcaggcaga

SEQ ID NO: 134137 - RNA, 22 nt, Human
aaugaauaaauuuuaaagacag

SEQ ID NO: 134138 - RNA, 22 nt, Human
auuuuguugaaacccuuguugu

SEQ ID NO: 134139 - RNA, 22 nt, Human
acauggcaugaauaauguguac

SEQ ID NO: 134140 - RNA, 22 nt, Human
uugcacgucacccuucccaccu

SEQ ID NO: 134141 - RNA, 22 nt, Human
uucuguguauggaagaaugucc

SEQ ID NO: 134142 - RNA, 21 nt, Human
uccauucuuggugguucugca

SEQ ID NO: 134143 - RNA, 22 nt, Human
auguuguugaacucuuugcaug

SEQ ID NO: 134144 - RNA, 22 nt, Human
auauuuuacagcucucguugaa

SEQ ID NO: 134145 - RNA, 22 nt, Human
aggcauauaguguuuaaaaaaa

SEQ ID NO: 134146 - RNA, 22 nt, Human
caggaacucggagcccaucucu

SEQ ID NO: 134147 - RNA, 17 nt, Human
cccugcacccuacucuc

SEQ ID NO: 134148 - RNA, 22 nt, Human
ugagauuuagaacuggauuuca

SEQ ID NO: 134149 - RNA, 22 nt, Human
cacauuuuccagaagaaucaga

SEQ ID NO: 134150 - RNA, 22 nt, Human
accuuuggaggacuagggucau

SEQ ID NO: 134151 - RNA, 22 nt, Human
ugucuuuuaaaaauguguaaaa

SEQ ID NO: 134152 - RNA, 22 nt, Human
uugucucuacagagaguaguag

SEQ ID NO: 134153 - RNA, 22 nt, Human
ucaccauguuuucauaggaaca

SEQ ID NO: 134154 - RNA, 23 nt, Human
agggcacugaagcuggaauuggg

SEQ ID NO: 134155 - RNA, 22 nt, Human
uacauuugauuuuugcuucuuu

SEQ ID NO: 134156 - RNA, 22 nt, Human
agcagcugagccccagcuguga

SEQ ID NO: 134157 - RNA, 22 nt, Human
gagaacagauaugaugacuuca

SEQ ID NO: 134158 - RNA, 22 nt, Human
ugggaggcugugggaauggguc

SEQ ID NO: 134159 - RNA, 22 nt, Human
ucccagccugacagugcaucaa

SEQ ID NO: 134160 - RNA, 17 nt, Human
agcagcuggguugaucu

SEQ ID NO: 134161 - RNA, 22 nt, Human
augccugcugucaggaacucuu

SEQ ID NO: 134162 - RNA, 22 nt, Human
cauccagggguacccuggagcc

SEQ ID NO: 134163 - RNA, 22 nt, Human
gccugggcuuccgggacccggg

SEQ ID NO: 134164 - RNA, 22 nt, Human
ccuccuuuccuguuuuccugag

SEQ ID NO: 134165 - RNA, 22 nt, Human
gcucagccuuuuguucuauuca

SEQ ID NO: 134166 - RNA, 22 nt, Human
augaggguggggaaugggccau

SEQ ID NO: 134167 - RNA, 22 nt, Human
ugaacuguccuuguugucuaga

SEQ ID NO: 134168 - RNA, 22 nt, Human
cagaaaaaaaugcagacuagca

SEQ ID NO: 134169 - RNA, 20 nt, Human
agucacagacccucagguag

SEQ ID NO: 134170 - RNA, 22 nt, Human
uggcagcauuuuuuccagaaca

SEQ ID NO: 134171 - RNA, 19 nt, Human
ggaacgcugggcuccccuc

SEQ ID NO: 134172 - RNA, 22 nt, Human
gugccugcucauucucaauauu

SEQ ID NO: 134173 - RNA, 22 nt, Human
cucuauuuuuucaucuuucagg

SEQ ID NO: 134174 - RNA, 22 nt, Human
agaugggacauuugucccuagg

SEQ ID NO: 134175 - RNA, 22 nt, Human
ucagucacugugaaaugaauuu

SEQ ID NO: 134176 - RNA, 22 nt, Human
uacuuaaaacacauuuagcauu

SEQ ID NO: 134177 - RNA, 17 nt, Human
uagccagcuugugauuu

SEQ ID NO: 134178 - RNA, 22 nt, Human
cagguggauggcgagcccugca

SEQ ID NO: 134179 - RNA, 22 nt, Human
aauggaaaaauccacagggaac

SEQ ID NO: 134180 - RNA, 22 nt, Human
uauuucaugagugaauaucuag

SEQ ID NO: 134181 - RNA, 22 nt, Human
uacccauuuugguucuugaugc

SEQ ID NO: 134182 - RNA, 22 nt, Human
ugucacagugcacagcuaagaa

SEQ ID NO: 134183 - RNA, 22 nt, Human
gaaacauuuguugaguacuugc

SEQ ID NO: 134184 - RNA, 22 nt, Human
aagaggaauaauaaaaauugca

SEQ ID NO: 134185 - RNA, 22 nt, Human
aggggcugagaguuugaugugg

SEQ ID NO: 134186 - RNA, 22 nt, Human
cagggcaucucugaaucuucac

SEQ ID NO: 134187 - RNA, 22 nt, Human
uuguuguuguuguuauuuaguu

SEQ ID NO: 134188 - RNA, 22 nt, Human
aagcucuuuccacuaaaccacu

SEQ ID NO: 134189 - RNA, 22 nt, Human
uaguggaaccuucuaaaugacg

SEQ ID NO: 134190 - RNA, 22 nt, Human
uaugugaaauggaauauagaaa

SEQ ID NO: 134191 - RNA, 20 nt, Human
uggcccagcacgacgaggac

SEQ ID NO: 134192 - RNA, 22 nt, Human
aagagaaacauauggccagauu

SEQ ID NO: 134193 - RNA, 22 nt, Human
augugaaauuugggcucuggga

SEQ ID NO: 134194 - RNA, 22 nt, Human
ucauuuaauuuggaacucagag

SEQ ID NO: 134195 - RNA, 22 nt, Human
agaggggaaggaugugauguga

SEQ ID NO: 134196 - RNA, 22 nt, Human
auguacugacuguacuuuuaaa

SEQ ID NO: 134197 - RNA, 22 nt, Human
aaagccauaucuauucuauucu

SEQ ID NO: 134198 - RNA, 22 nt, Human
agugccaucuuuaacuguccca

SEQ ID NO: 134199 - RNA, 22 nt, Human
gagaggaagugccugcucccag

SEQ ID NO: 134200 - RNA, 22 nt, Human
uccagccugaacuuuguccaga

SEQ ID NO: 134201 - RNA, 22 nt, Human
gcauucuugucaguggggucag

SEQ ID NO: 134202 - RNA, 23 nt, Human
uggguuucagugccaaugcugcc

SEQ ID NO: 134203 - RNA, 22 nt, Human
auuuucauauggguuauuugua

SEQ ID NO: 134204 - RNA, 22 nt, Human
uugaccagaaaaguuaguaauu

SEQ ID NO: 134205 - RNA, 17 nt, Human
auuguuuuuaauuugca

SEQ ID NO: 134206 - RNA, 22 nt, Human
uucugaaacauugcuauuuucc

SEQ ID NO: 134207 - RNA, 22 nt, Human
auguaaugucaaucuucagugg

SEQ ID NO: 134208 - RNA, 22 nt, Human
uucagguuuuuaaguucugccu

SEQ ID NO: 134209 - RNA, 22 nt, Human
uucaugucuuugauucugauaa

SEQ ID NO: 134210 - RNA, 22 nt, Human
cuggccagccucccagguaccc

SEQ ID NO: 134211 - RNA, 20 nt, Human
auggaaacacgcagccccaa

SEQ ID NO: 134212 - RNA, 22 nt, Human
acucagcaccuagaaagugugc

SEQ ID NO: 134213 - RNA, 22 nt, Human
cagccccagcacuuagcugagu

SEQ ID NO: 134214 - RNA, 22 nt, Human
uuacuguguguaaaauaucuuu

SEQ ID NO: 134215 - RNA, 22 nt, Human
ugcuucuuuaggauguaguuau

SEQ ID NO: 134216 - RNA, 22 nt, Human
ccacuuugagaagcugaugaaa

SEQ ID NO: 134217 - RNA, 21 nt, Human
uccugcagggcagcagagugg

SEQ ID NO: 134218 - RNA, 22 nt, Human
aaggaaaaaauggcuugugaua

SEQ ID NO: 134219 - RNA, 22 nt, Human
gauaauuauaggcuaagccacu

SEQ ID NO: 134220 - RNA, 22 nt, Human
uuugcauuaguuuagauuucaa

SEQ ID NO: 134221 - RNA, 22 nt, Human
acucugcaguaaggaauuguuu

SEQ ID NO: 134222 - RNA, 22 nt, Human
aagaaaagguaaccgcuuaucu

SEQ ID NO: 134223 - RNA, 22 nt, Human
gcccagccucagggcaucagcu

SEQ ID NO: 134224 - RNA, 22 nt, Human
cuaaaccaauauauuuucuucc

SEQ ID NO: 134225 - RNA, 22 nt, Human
agaaccaauacuacagcaagua

SEQ ID NO: 134226 - RNA, 22 nt, Human
guaagaauauacccaggaguca

SEQ ID NO: 134227 - RNA, 22 nt, Human
ucacuguuucaccgucugaagg

SEQ ID NO: 134228 - RNA, 22 nt, Human
uuuuagagacagcauggagaaa

SEQ ID NO: 134229 - RNA, 22 nt, Human
uauguauguauguauguauaug

SEQ ID NO: 134230 - RNA, 20 nt, Human
uccaguuuuggagacauucu

SEQ ID NO: 134231 - RNA, 22 nt, Human
uguuuuuuagagugauacuuuu

SEQ ID NO: 134232 - RNA, 22 nt, Human
uggcgcgcagccugcuggugcu

SEQ ID NO: 134233 - RNA, 22 nt, Human
cuuacaauuuucuuggacuuuu

SEQ ID NO: 134234 - RNA, 22 nt, Human
ucccagaaccuuuuagcuucac

SEQ ID NO: 134235 - RNA, 22 nt, Human
ugaauucaaacuuuuuaacaag

SEQ ID NO: 134236 - RNA, 22 nt, Human
aauaauacaauuggugucaugu

SEQ ID NO: 134237 - RNA, 22 nt, Human
auaguaaauguuaacagcaaca

SEQ ID NO: 134238 - RNA, 22 nt, Human
guggagaaauauguucagcuuc

SEQ ID NO: 134239 - RNA, 22 nt, Human
uuuucaaucaaguuuauuuaua

SEQ ID NO: 134240 - RNA, 22 nt, Human
ugcauguuuuaagugaagcuga

SEQ ID NO: 134241 - RNA, 22 nt, Human
ugagggucgcaagcaccaggcc

SEQ ID NO: 134242 - RNA, 22 nt, Human
guggaggguuugcaaugugcag

SEQ ID NO: 134243 - RNA, 21 nt, Human
agcaucugaggcaguuuccua

SEQ ID NO: 134244 - RNA, 23 nt, Human
uuugcaaauuggacacaaccaca

SEQ ID NO: 134245 - RNA, 22 nt, Human
auucccucaagagacccacagc

SEQ ID NO: 134246 - RNA, 22 nt, Human
uuuuuguaaaugaaguuuuauu

SEQ ID NO: 134247 - RNA, 22 nt, Human
gcagguuguuuaaauuaggauu

SEQ ID NO: 134248 - RNA, 21 nt, Human
agucaagcugccugcuuggca

SEQ ID NO: 134249 - RNA, 22 nt, Human
uuuuaaaacaugucaaaaugug

SEQ ID NO: 134250 - RNA, 22 nt, Human
uggaaggugauucucugguuaa

SEQ ID NO: 134251 - RNA, 22 nt, Human
uggcucaguaaucgagucuccu

SEQ ID NO: 134252 - RNA, 22 nt, Human
uuacuuucugggauaucaaaug

SEQ ID NO: 134253 - RNA, 22 nt, Human
guugggugccagaggcuucacg

SEQ ID NO: 134254 - RNA, 22 nt, Human
gcugcccucccagggcaagcuu

SEQ ID NO: 134255 - RNA, 22 nt, Human
aagccuccgugcugcuggaucu

SEQ ID NO: 134256 - RNA, 22 nt, Human
augcuuucucuucuauuucuca

SEQ ID NO: 134257 - RNA, 22 nt, Human
acaaucuuauuaguaguauaga

SEQ ID NO: 134258 - RNA, 22 nt, Human
aaacauaugccuucuuuuguaa

SEQ ID NO: 134259 - RNA, 22 nt, Human
guaagguuggaugcaaucaacu

SEQ ID NO: 134260 - RNA, 19 nt, Human
uccaccgcgugcaccucua

SEQ ID NO: 134261 - RNA, 23 nt, Human
uaagccugugccugcuaccugcu

SEQ ID NO: 134262 - RNA, 22 nt, Human
cagcaugguggagcugcucuuu

SEQ ID NO: 134263 - RNA, 22 nt, Human
gaggaggagacggaggccuggg

SEQ ID NO: 134264 - RNA, 22 nt, Human
aauguacucgaaugauguuaag

SEQ ID NO: 134265 - RNA, 22 nt, Human
ucacaggagucaaggaauagua

SEQ ID NO: 134266 - RNA, 21 nt, Human
gcagcaugagaaagccccaaa

SEQ ID NO: 134267 - RNA, 22 nt, Human
uaucuguagucucaugguuccu

SEQ ID NO: 134268 - RNA, 20 nt, Human
gagaaugucauuccuuuuuu

SEQ ID NO: 134269 - RNA, 22 nt, Human
ucccaaguguuuggcgaggaga

SEQ ID NO: 134270 - RNA, 22 nt, Human
ugaggaggugggcacacagagu

SEQ ID NO: 134271 - RNA, 21 nt, Human
uggcaggcagcuggaagcuug

SEQ ID NO: 134272 - RNA, 22 nt, Human
ugucacagagcgugcaacagaa

SEQ ID NO: 134273 - RNA, 22 nt, Human
uucuggccagggaagagggguc

SEQ ID NO: 134274 - RNA, 22 nt, Human
uucagaauguacugauagaaca

SEQ ID NO: 134275 - RNA, 22 nt, Human
cguuuugaguagauagccauau

SEQ ID NO: 134276 - RNA, 23 nt, Human
aggcagcaugcaacaggccauuu

SEQ ID NO: 134277 - RNA, 22 nt, Human
uauguacauauauguguauaua

SEQ ID NO: 134278 - RNA, 22 nt, Human
uuuugauacaaguuguaaaaaa

SEQ ID NO: 134279 - RNA, 22 nt, Human
ugcagaggagcuggaaggcugg

SEQ ID NO: 134280 - RNA, 21 nt, Human
auuggcagaucucuggauugu

SEQ ID NO: 134281 - RNA, 22 nt, Human
aaaauauuuaucuagcucuuaa

SEQ ID NO: 134282 - RNA, 22 nt, Human
cauuuagagaagauuacaagga

SEQ ID NO: 134283 - RNA, 22 nt, Human
auuugcauguuuauuucuuaga

SEQ ID NO: 134284 - RNA, 22 nt, Human
auagcaguauuaugagauaacu

SEQ ID NO: 134285 - RNA, 22 nt, Human
uauauauacauauagaauaugu

SEQ ID NO: 134286 - RNA, 22 nt, Human
uaauagauagggagaguugcug

SEQ ID NO: 134287 - RNA, 22 nt, Human
uucugaguguugucaccaugug

SEQ ID NO: 134288 - RNA, 22 nt, Human
auccuagacuccuaugccccaa

SEQ ID NO: 134289 - RNA, 22 nt, Human
acuucauuugaaaugguugaau

SEQ ID NO: 134290 - RNA, 18 nt, Human
uguugguguucacucacu

SEQ ID NO: 134291 - RNA, 22 nt, Human
aaaguaaagccuauuuaauaau

SEQ ID NO: 134292 - RNA, 22 nt, Human
accugcucucccucucgcaguc

SEQ ID NO: 134293 - RNA, 22 nt, Human
cgaaaaagaagugcaccauguu

SEQ ID NO: 134294 - RNA, 22 nt, Human
cauauacauauacaugcauaca

SEQ ID NO: 134295 - RNA, 22 nt, Human
uagcauaaaguuucuguguggu

SEQ ID NO: 134296 - RNA, 22 nt, Human
gucagacucuggggccccaggc

SEQ ID NO: 134297 - RNA, 22 nt, Human
auuuaaaaacugguacaacagg

SEQ ID NO: 134298 - RNA, 22 nt, Human
augauuaagguacgucauuucu

SEQ ID NO: 134299 - RNA, 22 nt, Human
ccugacucugauuucgcugcau

SEQ ID NO: 134300 - RNA, 22 nt, Human
cgggaggcggagcuccgcgggg

SEQ ID NO: 134301 - RNA, 22 nt, Human
caggggcuuuccuguuuaugga

SEQ ID NO: 134302 - RNA, 22 nt, Human
aguggcuguuccaggugaggac

SEQ ID NO: 134303 - RNA, 22 nt, Human
uuagaaauguccuacuaauaug

SEQ ID NO: 134304 - RNA, 22 nt, Human
gcacauauuuagaucuugaugu

SEQ ID NO: 134305 - RNA, 22 nt, Human
aaaauacuaggaaaauaaauca

SEQ ID NO: 134306 - RNA, 22 nt, Human
ugaggaggugcuaccagcgucu

SEQ ID NO: 134307 - RNA, 22 nt, Human
aaauuuauaacuuaaagugaau

SEQ ID NO: 134308 - RNA, 18 nt, Human
ccuucaucucugcuucuu

SEQ ID NO: 134309 - RNA, 22 nt, Human
gcaacuccuaggcgaggccuuc

SEQ ID NO: 134310 - RNA, 22 nt, Human
aguaagaaagaaugauaggccu

SEQ ID NO: 134311 - RNA, 22 nt, Human
cuccacagccccuccaguggca

SEQ ID NO: 134312 - RNA, 22 nt, Human
aggcagaugggagcuggaaguu

SEQ ID NO: 134313 - RNA, 22 nt, Human
uuuaaauaguugguuuuuuugc

SEQ ID NO: 134314 - RNA, 22 nt, Human
gagaggugaagcuaauuaauuu

SEQ ID NO: 134315 - RNA, 22 nt, Human
uucauggauuugugaaauuuag

SEQ ID NO: 134316 - RNA, 22 nt, Human
cauuuuaucagcacacgucacu

SEQ ID NO: 134317 - RNA, 22 nt, Human
cagaccuggaaaacaggcuugc

SEQ ID NO: 134318 - RNA, 22 nt, Human
aaaacauuuuacugccaucuca

SEQ ID NO: 134319 - RNA, 22 nt, Human
uuuuccuuagaaauacauugau

SEQ ID NO: 134320 - RNA, 22 nt, Human
ugagagguagaacuuguagugu

SEQ ID NO: 134321 - RNA, 22 nt, Human
uugaaagaacaauucugugaug

SEQ ID NO: 134322 - RNA, 22 nt, Human
uaggauauuuuagaaugguaca

SEQ ID NO: 134323 - RNA, 22 nt, Human
aucacacaccuguuaaauugug

SEQ ID NO: 134324 - RNA, 22 nt, Human
acaacuuuaauggguuucagcu

SEQ ID NO: 134325 - RNA, 22 nt, Human
uucuguacuagaucuuaucagu

SEQ ID NO: 134326 - RNA, 23 nt, Human
ucucacucauucuccucugucca

SEQ ID NO: 134327 - RNA, 22 nt, Human
cuuucucucaaacacacauaca

SEQ ID NO: 134328 - RNA, 22 nt, Human
guaugucuuaggguucaguaac

SEQ ID NO: 134329 - RNA, 22 nt, Human
uacuuuaauugcaaaaauaaau

SEQ ID NO: 134330 - RNA, 22 nt, Human
cuucuuucuuuucuucuucucu

SEQ ID NO: 134331 - RNA, 22 nt, Human
cuugcaaugaaggcacacuuau

SEQ ID NO: 134332 - RNA, 22 nt, Human
ugcauuuugaaggaaaaaaaug

SEQ ID NO: 134333 - RNA, 22 nt, Human
auucuacucuuuaaauaugaaa

SEQ ID NO: 134334 - RNA, 22 nt, Human
auuuuuauuugccuaugauaua

SEQ ID NO: 134335 - RNA, 22 nt, Human
cuccagggcuaccagguuuuag

SEQ ID NO: 134336 - RNA, 22 nt, Human
cuggaugucugggaggcuuccc

SEQ ID NO: 134337 - RNA, 22 nt, Human
uaguuauuucugcacuuaauga

SEQ ID NO: 134338 - RNA, 22 nt, Human
agauggggccugaggacacugu

SEQ ID NO: 134339 - RNA, 22 nt, Human
caggcagggagcuggaaaggau

SEQ ID NO: 134340 - RNA, 22 nt, Human
cgugccugguggagagcgaggg

SEQ ID NO: 134341 - RNA, 20 nt, Human
caggccuucaggauggcugg

SEQ ID NO: 134342 - RNA, 22 nt, Human
aaucccaguccuccugggggau

SEQ ID NO: 134343 - RNA, 22 nt, Human
ucaguggaacacacagaguggg

SEQ ID NO: 134344 - RNA, 22 nt, Human
agugucugcgggcagaggagcg

SEQ ID NO: 134345 - RNA, 22 nt, Human
cccaggaaugagcaggcagggg

SEQ ID NO: 134346 - RNA, 22 nt, Human
agaggagaauguaaauuuguca

SEQ ID NO: 134347 - RNA, 22 nt, Human
uggcacagcuugucauaaacuc

SEQ ID NO: 134348 - RNA, 22 nt, Human
aauagcaauuacccuucaacuc

SEQ ID NO: 134349 - RNA, 22 nt, Human
uucacugugauguuuaagagaa

SEQ ID NO: 134350 - RNA, 22 nt, Human
gguggggacuuggggucagcgg

SEQ ID NO: 134351 - RNA, 22 nt, Human
aaaaaguaccacuuggacacuu

SEQ ID NO: 134352 - RNA, 22 nt, Human
uggcaaacacaauauggguaca

SEQ ID NO: 134353 - RNA, 22 nt, Human
auggagggcagccccacuaaag

SEQ ID NO: 134354 - RNA, 22 nt, Human
gcucccagcuuuuguccacggc

SEQ ID NO: 134355 - RNA, 20 nt, Human
acagagauccucucuuuauc

SEQ ID NO: 134356 - RNA, 22 nt, Human
ugcuagggcaggaggugaggag

SEQ ID NO: 134357 - RNA, 22 nt, Human
uuacuuaucugaugugauuuuu

SEQ ID NO: 134358 - RNA, 22 nt, Human
uaacauuagcuuugcucaugca

SEQ ID NO: 134359 - RNA, 22 nt, Human
ccauagucacuuguccucuuuu

SEQ ID NO: 134360 - RNA, 22 nt, Human
ucagacacacaacuucugcuua

SEQ ID NO: 134361 - RNA, 22 nt, Human
gcauaauauugagaaauuauua

SEQ ID NO: 134362 - RNA, 22 nt, Human
ugauguuucugaagggguuacu

SEQ ID NO: 134363 - RNA, 22 nt, Human
uaguauuuguaauuaucaaagc

SEQ ID NO: 134364 - RNA, 22 nt, Human
uucugaaccauugagcacugcc

SEQ ID NO: 134365 - RNA, 22 nt, Human
ccuuugcccugagaaauguucc

SEQ ID NO: 134366 - RNA, 21 nt, Human
aaguuuuggcuguacaguugu

SEQ ID NO: 134367 - RNA, 22 nt, Human
ugaugaugaagaaauauuauca

SEQ ID NO: 134368 - RNA, 22 nt, Human
gucccucauaacuggcaggugu

SEQ ID NO: 134369 - RNA, 22 nt, Human
auagauuuuaucagauuuuauc

SEQ ID NO: 134370 - RNA, 22 nt, Human
aagaacaacugcuuuaaaagca

SEQ ID NO: 134371 - RNA, 22 nt, Human
auucuuuauuuucuguacuugc

SEQ ID NO: 134372 - RNA, 22 nt, Human
auuuauuuucccucaaguaccu

SEQ ID NO: 134373 - RNA, 22 nt, Human
ggaggggaguuugccucugggg

SEQ ID NO: 134374 - RNA, 22 nt, Human
auuguuuugugaaacauaguga

SEQ ID NO: 134375 - RNA, 22 nt, Human
ucuuucugaugggaagggucaa

SEQ ID NO: 134376 - RNA, 22 nt, Human
gaaggcagucuggggagcagcc

SEQ ID NO: 134377 - RNA, 22 nt, Human
auacaugacucacacauucugc

SEQ ID NO: 134378 - RNA, 22 nt, Mycobacterium bovis subsp bovis AF2122/97
gcggacacgaucgcgucggcua

SEQ ID NO: 134379 - RNA, 22 nt, Mycobacterium bovis subsp bovis AF2122/97
cuggucgucggcaauccagggu

SEQ ID NO: 134380 - RNA, 22 nt, Mycobacterium bovis subsp bovis AF2122/97
cuggucgacgaguggaugaccg

SEQ ID NO: 134381 - RNA, 22 nt, Mycobacterium bovis subsp bovis AF2122/97
gaagcgcucggguugcaacgua

SEQ ID NO: 134382 - RNA, 22 nt, Mycobacterium bovis subsp bovis AF2122/97
gggugaccgucauggaccacgg

SEQ ID NO: 134383 - RNA, 22 nt, Mycobacterium bovis subsp bovis AF2122/97
cugagcgauccggaaaccgacu

SEQ ID NO: 134384 - RNA, 22 nt, Mycobacterium bovis subsp bovis AF2122/97
ccgaucgcugcgcugaucgcgg

SEQ ID NO: 134385 - RNA, 22 nt, Mycobacterium bovis subsp bovis AF2122/97
cgcgagcagacacagagucgca

SEQ ID NO: 134386 - RNA, 22 nt, Mycobacterium bovis subsp bovis AF2122/97
ggcgagcagacacagacucgca

SEQ ID NO: 134387 - RNA, 22 nt, Mycobacterium bovis subsp bovis AF2122/97
gucgacaucgacaccagcgcgg

SEQ ID NO: 134388 - RNA, 22 nt, Mycobacterium bovis subsp bovis AF2122/97
acgagguugacuucgacguccc

SEQ ID NO: 134389 - RNA, 22 nt, Mycobacterium bovis subsp bovis AF2122/97
cucgucgcgcccuacaccgacc

SEQ ID NO: 134390 - RNA, 22 nt, Mycobacterium bovis subsp bovis AF2122/97
ugucgccgcaaccgucguuauc

SEQ ID NO: 134391 - RNA, 22 nt, Mycobacterium bovis subsp bovis AF2122/97
gggccggugcgaauggugcaac

SEQ ID NO: 134392 - RNA, 22 nt, Mycobacterium bovis subsp bovis AF2122/97
gcgugcgauucugugucuguuc

SEQ ID NO: 134393 - RNA, 22 nt, Mycobacterium bovis subsp bovis AF2122/97
cuaccgccgcgaccgcgagcau

SEQ ID NO: 134394 - RNA, 22 nt, Mycobacterium bovis subsp bovis AF2122/97
cgcggccucggccggucacacu

SEQ ID NO: 134395 - RNA, 21 nt, Mycobacterium bovis subsp bovis AF2122/97
cggugccgaugacggugucga

SEQ ID NO: 134396 - RNA, 22 nt, Mycobacterium bovis subsp bovis AF2122/97
gugagcagacgcaaaagccccc

SEQ ID NO: 134397 - RNA, 22 nt, Mycobacterium bovis subsp bovis AF2122/97
ucggugagcgccugcuucaggg

SEQ ID NO: 134398 - RNA, 22 nt, Mycobacterium bovis subsp bovis AF2122/97
uguucgcagcuguugcacguuc

SEQ ID NO: 134399 - RNA, 22 nt, Mycobacterium bovis subsp bovis AF2122/97
aggaugucggggcgaagcuuga

SEQ ID NO: 134400 - RNA, 22 nt, Mycobacterium bovis subsp bovis AF2122/97
acugcguugcaugaccgacggu

SEQ ID NO: 134401 - RNA, 22 nt, Mycobacterium bovis subsp bovis AF2122/97
uuuccccgcaagcgggucggcc

SEQ ID NO: 134402 - RNA, 22 nt, Mycobacterium bovis subsp bovis AF2122/97
accggcaggcagcucacgagau

SEQ ID NO: 134403 - RNA, 22 nt, Mycobacterium bovis subsp bovis AF2122/97
gguggagcuggcugccgcgcua

SEQ ID NO: 134404 - RNA, 22 nt, Mycobacterium bovis subsp bovis AF2122/97
cagugcgauucugugucugcuc

SEQ ID NO: 134405 - RNA, 22 nt, Mycobacterium bovis subsp bovis AF2122/97
ugagacccccgucgaagucuag

SEQ ID NO: 134406 - RNA, 22 nt, Mycobacterium bovis subsp bovis AF2122/97
gcuguuguucggcuacgucggc

SEQ ID NO: 134407 - RNA, 22 nt, Mycobacterium bovis subsp bovis AF2122/97
auggauggcgaggcguuguggu

SEQ ID NO: 134408 - RNA, 23 nt, Mycobacterium bovis subsp bovis AF2122/97
gacggagcgcuggaccggcaggc

SEQ ID NO: 134409 - RNA, 22 nt, Mycobacterium bovis subsp bovis AF2122/97
accgccgguccguucaugccgu

SEQ ID NO: 134410 - RNA, 22 nt, Mycobacterium bovis subsp bovis AF2122/97
aagcauuggagccggacccgcg

SEQ ID NO: 134411 - RNA, 22 nt, Mycobacterium bovis subsp bovis AF2122/97
ugcuccggcacguuggucgaga

SEQ ID NO: 134412 - RNA, 22 nt, Mycobacterium bovis subsp bovis AF2122/97
gcgacgcugaagagcccgacga

SEQ ID NO: 134413 - RNA, 22 nt, Mycobacterium bovis subsp bovis AF2122/97
gcaaccguugcucgaguccaga

SEQ ID NO: 134414 - RNA, 22 nt, Mycobacterium bovis subsp bovis AF2122/97
gggccgaugcggaacucgauca

SEQ ID NO: 134415 - RNA, 22 nt, Mycobacterium bovis subsp bovis AF2122/97
ucgccagccguuggcguggaaa

SEQ ID NO: 134416 - RNA, 22 nt, Mycobacterium bovis subsp bovis AF2122/97
cggucaccaucucgcagacaua

SEQ ID NO: 134417 - RNA, 22 nt, Mycobacterium bovis subsp bovis AF2122/97
gagaucgaccgggaaggugauc

SEQ ID NO: 134418 - RNA, 22 nt, Mycobacterium bovis subsp bovis AF2122/97
ugcgacucugugucugcucgcc

SEQ ID NO: 134419 - RNA, 22 nt, Mycobacterium bovis subsp bovis AF2122/97
uaucgugggaugcgcuacuccu

SEQ ID NO: 134420 - RNA, 22 nt, Mycobacterium bovis subsp bovis AF2122/97
agguuggcgccggggugcagag

SEQ ID NO: 134421 - RNA, 22 nt, Mycobacterium bovis subsp bovis AF2122/97
guggcggucgcuagguccggaa

SEQ ID NO: 134422 - RNA, 22 nt, Mycobacterium bovis subsp bovis AF2122/97
uagcugcguagcucgugccggu

SEQ ID NO: 134423 - RNA, 21 nt, Mycobacterium bovis subsp bovis AF2122/97
ugcgugguggaugcagaguca

SEQ ID NO: 134424 - RNA, 22 nt, Mycobacterium bovis subsp bovis AF2122/97
gccggcaugccgcgacauucac

SEQ ID NO: 134425 - RNA, 22 nt, Mycobacterium bovis subsp bovis AF2122/97
ugaucgaacaucugcccagagg

SEQ ID NO: 134426 - RNA, 22 nt, Mycobacterium bovis subsp bovis AF2122/97
acaccaagcgcccgcagcuugc

SEQ ID NO: 134427 - RNA, 20 nt, Mycobacterium bovis subsp bovis AF2122/97
gucgacgugcaguaccguca

SEQ ID NO: 134428 - RNA, 22 nt, Mycobacterium bovis subsp bovis AF2122/97
cucguggucgagccggccgucu

SEQ ID NO: 134429 - RNA, 22 nt, Mycobacterium bovis subsp bovis AF2122/97
ggggcgcugagcguggaguucg

SEQ ID NO: 134430 - RNA, 22 nt, Mycobacterium bovis subsp bovis AF2122/97
cuuuacgaggcgacccgguuga

SEQ ID NO: 134431 - RNA, 22 nt, Mycobacterium bovis subsp bovis AF2122/97
ugauguccgucgggaaggugau

SEQ ID NO: 134432 - RNA, 22 nt, Mycobacterium bovis subsp bovis AF2122/97
cgcgccgguuggggcauccggu

SEQ ID NO: 134433 - RNA, 22 nt, Mycobacterium bovis subsp bovis AF2122/97
ugggcuaccgaggucagggcgc

SEQ ID NO: 134434 - RNA, 22 nt, Mycobacterium bovis subsp bovis AF2122/97
gcaugcgcugcggcccggugac

SEQ ID NO: 134435 - RNA, 22 nt, Mycobacterium bovis subsp bovis AF2122/97
cgagcagacgcgaaaucccccg

SEQ ID NO: 134436 - RNA, 22 nt, Mycobacterium bovis subsp bovis AF2122/97
gggucgucgacgggcgcaacgu

SEQ ID NO: 134437 - RNA, 22 nt, Mycobacterium bovis subsp bovis AF2122/97
uuccucacaugcgcugaucggc

SEQ ID NO: 134438 - RNA, 18 nt, Mycobacterium bovis subsp bovis AF2122/97
accgguguuuucgucgcg

SEQ ID NO: 134439 - RNA, 22 nt, Mycobacterium bovis subsp bovis AF2122/97
guggugggaaccgcuccagggc

SEQ ID NO: 134440 - RNA, 22 nt, Mycobacterium bovis subsp bovis AF2122/97
ucgaugggcacaccgcuggcgc

SEQ ID NO: 134441 - RNA, 22 nt, Mycobacterium bovis subsp bovis AF2122/97
auggguucgaacguccaggugg

SEQ ID NO: 134442 - RNA, 21 nt, Mycobacterium bovis subsp bovis AF2122/97
ucgaaugugugggaucggccg

SEQ ID NO: 134443 - RNA, 22 nt, Mycobacterium bovis subsp bovis AF2122/97
uucacccagcgcgacgccgucg

SEQ ID NO: 134444 - RNA, 19 nt, Mycobacterium bovis subsp bovis AF2122/97
cgcccgaccggccuugauc

SEQ ID NO: 134445 - RNA, 22 nt, Mycobacterium bovis subsp bovis AF2122/97
uugaccgcgugucugggacgcg

SEQ ID NO: 134446 - RNA, 22 nt, Mycobacterium bovis subsp bovis AF2122/97
auuaguggucagaccggacgga

SEQ ID NO: 134447 - RNA, 21 nt, Mycobacterium bovis subsp bovis AF2122/97
cgaugcggcccagauugacgc

SEQ ID NO: 134448 - RNA, 22 nt, Mycobacterium bovis subsp bovis AF2122/97
ccucggcgucgguacgggcgau

SEQ ID NO: 134449 - RNA, 22 nt, Mycobacterium bovis subsp bovis AF2122/97
acggucgggcgccaucgacgcc

SEQ ID NO: 134450 - RNA, 22 nt, Mycobacterium bovis subsp bovis AF2122/97
ggucaucucggcgaucaccgag

SEQ ID NO: 134451 - RNA, 22 nt, Mycobacterium bovis subsp bovis AF2122/97
acgcgcacggggagcuggccga

SEQ ID NO: 134452 - RNA, 22 nt, Mycobacterium bovis subsp bovis AF2122/97
acacggcaaagaucaggaaugc

SEQ ID NO: 134453 - RNA, 20 nt, Mycobacterium bovis subsp bovis AF2122/97
ugcgauuccgcgucugcucg

SEQ ID NO: 134454 - RNA, 22 nt, Mycobacterium bovis subsp bovis AF2122/97
uggucacgcugauugccgggcc

SEQ ID NO: 134455 - RNA, 22 nt, Mycobacterium bovis subsp bovis AF2122/97
gagccgaaccacggcgacucug

SEQ ID NO: 134456 - RNA, 22 nt, Mycobacterium bovis subsp bovis AF2122/97
ugaccuugaucggugcgggucc

SEQ ID NO: 134457 - RNA, 22 nt, Mycobacterium bovis subsp bovis AF2122/97
cgagcguaacgccacggcgaau

SEQ ID NO: 134458 - RNA, 22 nt, Mycobacterium bovis subsp bovis AF2122/97
ucgcccugacgucacguucggc

SEQ ID NO: 134459 - RNA, 18 nt, Mycobacterium bovis subsp bovis AF2122/97
gcgcugcugucgauuucg

SEQ ID NO: 134460 - RNA, 22 nt, Mycobacterium bovis subsp bovis AF2122/97
ugucgcgucgccagguucacgc

SEQ ID NO: 134461 - RNA, 22 nt, Mycobacterium bovis subsp bovis AF2122/97
acuggccagcccgcacaaccac

SEQ ID NO: 134462 - RNA, 22 nt, Mycobacterium bovis subsp bovis AF2122/97
guugggcagcgucacggucguc

SEQ ID NO: 134463 - RNA, 22 nt, Mycobacterium bovis subsp bovis AF2122/97
cgaggaguagcgcaucccacga

SEQ ID NO: 134464 - RNA, 22 nt, Mycobacterium bovis subsp bovis AF2122/97
uugguuacgcugcgcuggucga

SEQ ID NO: 134465 - RNA, 22 nt, Mycobacterium bovis subsp bovis AF2122/97
gagcgagcccggugaugcggug

SEQ ID NO: 134466 - RNA, 22 nt, Mycobacterium bovis subsp bovis AF2122/97
ugaucgaucaggaacuggccgc

SEQ ID NO: 134467 - RNA, 22 nt, Mycobacterium bovis subsp bovis AF2122/97
cugccggacaugcgggugagug

SEQ ID NO: 134468 - RNA, 22 nt, Mycobacterium bovis subsp bovis AF2122/97
cagugcggucgaggcuccgaga

SEQ ID NO: 134469 - RNA, 22 nt, Mycobacterium bovis subsp bovis AF2122/97
cgagcucggcgaugcugagccg

SEQ ID NO: 134470 - RNA, 22 nt, Mycobacterium bovis subsp bovis AF2122/97
ggguggcuccggucagaucgac

SEQ ID NO: 134471 - RNA, 22 nt, Mycobacterium bovis subsp bovis AF2122/97
gccgucuggaucugcgaacgga

SEQ ID NO: 134472 - RNA, 22 nt, Mycobacterium bovis subsp bovis AF2122/97
ugcgcuugcccuugccgaguuu

SEQ ID NO: 134473 - RNA, 22 nt, Mycobacterium bovis subsp bovis AF2122/97
ucgccgccaugaaaccacuuga

SEQ ID NO: 134474 - RNA, 22 nt, Mycobacterium bovis subsp bovis AF2122/97
uaccggcugagcauugagcacg

SEQ ID NO: 134475 - RNA, 22 nt, Mycobacterium bovis subsp bovis AF2122/97
gagcagacgcaaaagcccccau

SEQ ID NO: 134476 - RNA, 20 nt, Mycobacterium bovis subsp bovis AF2122/97
cgcgccaacgcccugcucgc

SEQ ID NO: 134477 - RNA, 21 nt, Mycobacterium bovis subsp bovis AF2122/97
acgagcccaucgcgaacucgu

SEQ ID NO: 134478 - RNA, 22 nt, Mycobacterium bovis subsp bovis AF2122/97
ugcuggugaccggugcuugccg

SEQ ID NO: 134479 - RNA, 22 nt, Mycobacterium bovis subsp bovis AF2122/97
agggcgaguacaccgagggugc

SEQ ID NO: 134480 - RNA, 21 nt, Mycobacterium bovis subsp bovis AF2122/97
uaggcgaucgccucguccaag

SEQ ID NO: 134481 - RNA, 22 nt, Mycobacterium bovis subsp bovis AF2122/97
aaucagcgacaacgcaucggua

SEQ ID NO: 134482 - RNA, 22 nt, Mycobacterium bovis subsp bovis AF2122/97
ugggcgccuucgacgugacguu

SEQ ID NO: 134483 - RNA, 22 nt, Mycobacterium bovis subsp bovis AF2122/97
cggcgcguugaucgcacucaau

SEQ ID NO: 134484 - RNA, 22 nt, Mycobacterium bovis subsp bovis AF2122/97
aacagcgcaucgaucggugaca

SEQ ID NO: 134485 - RNA, 22 nt, Mycobacterium bovis subsp bovis AF2122/97
cgaggccgacgaaagguugccg

SEQ ID NO: 134486 - RNA, 22 nt, Mycobacterium bovis subsp bovis AF2122/97
guuuggcaagccuggaggaucu

SEQ ID NO: 134487 - RNA, 22 nt, Mycobacterium bovis subsp bovis AF2122/97
gcugaacuccuggccgaguguc

SEQ ID NO: 134488 - RNA, 22 nt, Mycobacterium bovis subsp bovis AF2122/97
uccgucaaacguugaaucgacu

SEQ ID NO: 134489 - RNA, 22 nt, Mycobacterium bovis subsp bovis AF2122/97
augcggugaccuucggcuucga

SEQ ID NO: 134490 - RNA, 23 nt, Mycobacterium bovis subsp bovis AF2122/97
caccgcguucggugugcggcgug

SEQ ID NO: 134491 - RNA, 22 nt, Mycobacterium bovis subsp bovis AF2122/97
gugguggucuccagcgcgcucg

SEQ ID NO: 134492 - RNA, 18 nt, Mycobacterium bovis subsp bovis AF2122/97
ugcagguugguggcaucc

SEQ ID NO: 134493 - RNA, 22 nt, Mycobacterium bovis subsp bovis AF2122/97
cgagcaucugaacgccugggug

SEQ ID NO: 134494 - RNA, 22 nt, Mycobacterium bovis subsp bovis AF2122/97
auaccgcgaucgcuuuggccgc

SEQ ID NO: 134495 - RNA, 22 nt, Mycobacterium bovis subsp bovis AF2122/97
ugccgguccuccgaacggaugu

SEQ ID NO: 134496 - RNA, 22 nt, Mycobacterium bovis subsp bovis AF2122/97
gggcuggacggugccggcgauc

SEQ ID NO: 134497 - RNA, 22 nt, Mycobacterium bovis subsp bovis AF2122/97
ggugacggucgucgcggcggca

SEQ ID NO: 134498 - RNA, 22 nt, Mycobacterium bovis subsp bovis AF2122/97
ucggggucguucagggcacgau

SEQ ID NO: 134499 - RNA, 22 nt, Mycobacterium bovis subsp bovis AF2122/97
ucucgcccucagugcacgcucg

SEQ ID NO: 134500 - RNA, 22 nt, Mycobacterium bovis subsp bovis AF2122/97
accaccagcugcaggucaucga

SEQ ID NO: 134501 - RNA, 22 nt, Mycobacterium bovis subsp bovis AF2122/97
cccgaagacgaccccggugaca

SEQ ID NO: 134502 - RNA, 22 nt, Mycobacterium bovis subsp bovis AF2122/97
gggcgagcagacgcagaaucgc

SEQ ID NO: 134503 - RNA, 22 nt, Mycobacterium bovis subsp bovis AF2122/97
gugcgggccugccgccgugacu

SEQ ID NO: 134504 - RNA, 22 nt, Mycobacterium bovis subsp bovis AF2122/97
accgacugaugagcgcgucagc

SEQ ID NO: 134505 - RNA, 22 nt, Mycobacterium bovis subsp bovis AF2122/97
ucguaaugaaugucgaaccuga

SEQ ID NO: 134506 - RNA, 22 nt, Mycobacterium bovis subsp bovis AF2122/97
gcgcgcuagcuggcaucccgaa

SEQ ID NO: 134507 - RNA, 22 nt, Mycobacterium bovis subsp bovis AF2122/97
cgucuccgacguacuggauggu

SEQ ID NO: 134508 - RNA, 22 nt, Mycobacterium bovis subsp bovis AF2122/97
ucagucuuucgucgcgguggcu

SEQ ID NO: 134509 - RNA, 22 nt, Mycobacterium bovis subsp bovis AF2122/97
cggccggccaguaucagcauca

SEQ ID NO: 134510 - RNA, 22 nt, Mycobacterium bovis subsp bovis AF2122/97
gagcagaccguguugucgcugg

SEQ ID NO: 134511 - RNA, 22 nt, Mycobacterium bovis subsp bovis AF2122/97
auuugggagcuuuugcgucugc

SEQ ID NO: 134512 - RNA, 18 nt, Mycobacterium bovis subsp bovis AF2122/97
uccguugcgccucgucga

SEQ ID NO: 134513 - RNA, 22 nt, Mycobacterium bovis subsp bovis AF2122/97
acgccgcgcacgacaugguuag

SEQ ID NO: 134514 - RNA, 22 nt, Mycobacterium bovis subsp bovis AF2122/97
cacgccgacgagcuuccgcgac

SEQ ID NO: 134515 - RNA, 22 nt, Mycobacterium bovis subsp bovis AF2122/97
gcggcgaccuguccggcgguua

SEQ ID NO: 134516 - RNA, 22 nt, Mycobacterium bovis subsp bovis AF2122/97
gacaugaucgacccugccaucc

SEQ ID NO: 134517 - RNA, 23 nt, Mycobacterium bovis subsp bovis AF2122/97
ugccggccgagcuguucgacguc

SEQ ID NO: 134518 - RNA, 22 nt, Mycobacterium bovis subsp bovis AF2122/97
ggagaagguaauacucaaggcu

SEQ ID NO: 134519 - RNA, 22 nt, Mycobacterium bovis subsp bovis AF2122/97
agcagacgcagaaucgcacugc

SEQ ID NO: 134520 - RNA, 22 nt, Mycobacterium bovis subsp bovis AF2122/97
ugugcgacgacgauccggucau

SEQ ID NO: 134521 - RNA, 21 nt, Mycobacterium bovis subsp bovis AF2122/97
uucagcacgcuggccgugauc

SEQ ID NO: 134522 - RNA, 19 nt, Mycobacterium bovis subsp bovis AF2122/97
cccguuccaaacucaagug

SEQ ID NO: 134523 - RNA, 22 nt, Mycobacterium bovis subsp bovis AF2122/97
gccgucggccugcgugggguga

SEQ ID NO: 134524 - RNA, 22 nt, Mycobacterium bovis subsp bovis AF2122/97
gccgccaccagugcacauucgg

SEQ ID NO: 134525 - RNA, 22 nt, Mycobacterium bovis subsp bovis AF2122/97
ggucaaccgggcauugcuggcg

SEQ ID NO: 134526 - RNA, 22 nt, Mycobacterium bovis subsp bovis AF2122/97
gccacugugaauggcacgacgc

SEQ ID NO: 134527 - RNA, 22 nt, Mycobacterium bovis subsp bovis AF2122/97
ggcgguggaauugcuuggagcc

SEQ ID NO: 134528 - RNA, 22 nt, Mycobacterium bovis subsp bovis AF2122/97
ugcgguauuuagcuccgguggc

SEQ ID NO: 134529 - RNA, 22 nt, Mycobacterium bovis subsp bovis AF2122/97
ugucgcgcaagcucuccggcac

SEQ ID NO: 134530 - RNA, 22 nt, Mycobacterium bovis subsp bovis AF2122/97
gagugugaaucccgcgacgccg

SEQ ID NO: 134531 - RNA, 22 nt, Mycobacterium bovis subsp bovis AF2122/97
ucaccgggaugcacgucgaguu

SEQ ID NO: 134532 - RNA, 22 nt, Mycobacterium bovis subsp bovis AF2122/97
uuggugaacguggugaucgagu

SEQ ID NO: 134533 - RNA, 22 nt, Mycobacterium bovis subsp bovis AF2122/97
ugccgucacuggugucggccgg

SEQ ID NO: 134534 - RNA, 22 nt, Mycobacterium bovis subsp bovis AF2122/97
ugcuguucguaguuguuggcgu

SEQ ID NO: 134535 - RNA, 22 nt, Mycobacterium bovis subsp bovis AF2122/97
ggcaacggcggcaacgccggca

SEQ ID NO: 134536 - RNA, 22 nt, Mycobacterium bovis subsp bovis AF2122/97
acaccaaggccgucagcuuggc

SEQ ID NO: 134537 - RNA, 22 nt, Mycobacterium bovis subsp bovis AF2122/97
gcgcugcugcguggcgauccgu

SEQ ID NO: 134538 - RNA, 22 nt, Mycobacterium bovis subsp bovis AF2122/97
ggcaccuaccgacaggacguaa

SEQ ID NO: 134539 - RNA, 22 nt, Mycobacterium bovis subsp bovis AF2122/97
ugcagcugcgaccguucguucu

SEQ ID NO: 134540 - RNA, 22 nt, Mycobacterium bovis subsp bovis AF2122/97
uccagcucguacuucucgucgg

SEQ ID NO: 134541 - RNA, 22 nt, Mycobacterium bovis subsp bovis AF2122/97
augccgaugguggugaucaucg

SEQ ID NO: 134542 - RNA, 22 nt, Mycobacterium bovis subsp bovis AF2122/97
gcagacgcaaaagcucccaaau

SEQ ID NO: 134543 - RNA, 22 nt, Mycobacterium bovis subsp bovis AF2122/97
ccgccgaacgugaacucacggc

SEQ ID NO: 134544 - RNA, 22 nt, Mycobacterium bovis subsp bovis AF2122/97
gcuucacaucauuuucuggaag

SEQ ID NO: 134545 - RNA, 22 nt, Mycobacterium bovis subsp bovis AF2122/97
cgccaguaugcggucggugcug

SEQ ID NO: 134546 - RNA, 22 nt, Mycobacterium bovis subsp bovis AF2122/97
ggugcgauuccgcgucugcucg

SEQ ID NO: 134547 - RNA, 22 nt, Mycobacterium bovis subsp bovis AF2122/97
cgggccgcagcgugcucgcugu

SEQ ID NO: 134548 - RNA, 22 nt, Mycobacterium bovis subsp bovis AF2122/97
ucgucgguguagggcgaacugc

SEQ ID NO: 134549 - RNA, 23 nt, Mycobacterium bovis subsp bovis AF2122/97
gcacgcgacaagcucguuugugg

SEQ ID NO: 134550 - RNA, 22 nt, Mycobacterium bovis subsp bovis AF2122/97
cgcgagcagacgcagagucgca

SEQ ID NO: 134551 - RNA, 22 nt, Mycobacterium bovis subsp bovis AF2122/97
ccgcauuugaucgccuccgggg

SEQ ID NO: 134552 - RNA, 22 nt, Mycobacterium bovis subsp bovis AF2122/97
cgucggcucggucucggugacg

SEQ ID NO: 134553 - RNA, 22 nt, Mycobacterium bovis subsp bovis AF2122/97
ccggcugcccaccaacgagcag

SEQ ID NO: 134554 - RNA, 22 nt, Mycobacterium bovis subsp bovis AF2122/97
accugcuccuugcugaucccgg

SEQ ID NO: 134555 - RNA, 22 nt, Mycobacterium bovis subsp bovis AF2122/97
cucagcaucgccgagcucgagc

SEQ ID NO: 134556 - RNA, 22 nt, Mycobacterium bovis subsp bovis AF2122/97
ggcggccgugcgcgugaucgac

SEQ ID NO: 134557 - RNA, 22 nt, Mycobacterium bovis subsp bovis AF2122/97
gaacgucucgugcuuggguggg

SEQ ID NO: 134558 - RNA, 22 nt, Mycobacterium bovis subsp bovis AF2122/97
cugcgauugguguuuccgccac

SEQ ID NO: 134559 - RNA, 22 nt, Mycobacterium bovis subsp bovis AF2122/97
cuggccaucgagggcaucgggc

SEQ ID NO: 134560 - RNA, 22 nt, Mycobacterium bovis subsp bovis AF2122/97
cggcgcuacuggcggugagagc

SEQ ID NO: 134561 - RNA, 22 nt, Mycobacterium bovis subsp bovis AF2122/97
ggcuggcagcucacgacgccuc

SEQ ID NO: 134562 - RNA, 22 nt, Mycobacterium bovis subsp bovis AF2122/97
ggggcggaucagcgccaccucc

SEQ ID NO: 134563 - RNA, 22 nt, Mycobacterium bovis subsp bovis AF2122/97
uccgcccucaguucacguucgg

SEQ ID NO: 134564 - RNA, 22 nt, Mycobacterium bovis subsp bovis AF2122/97
agcagacgcaaaagcccccauu

SEQ ID NO: 134565 - RNA, 22 nt, Mycobacterium bovis subsp bovis AF2122/97
ggugugauauaucaccuuugcc

SEQ ID NO: 134566 - RNA, 20 nt, Mycobacterium bovis subsp bovis AF2122/97
ucgccaggccguagaugccg

SEQ ID NO: 134567 - RNA, 22 nt, Mycobacterium bovis subsp bovis AF2122/97
gccguggccgaucagcccggcg

SEQ ID NO: 134568 - RNA, 22 nt, Mycobacterium bovis subsp bovis AF2122/97
cccaaaccagccuccugcuucg

SEQ ID NO: 134569 - RNA, 22 nt, Mycobacterium bovis subsp bovis AF2122/97
cggcgacgugcuugguagcugg

SEQ ID NO: 134570 - RNA, 22 nt, Mycobacterium bovis subsp bovis AF2122/97
ggggucgguauagaugucgguc

SEQ ID NO: 134571 - RNA, 22 nt, Mycobacterium bovis subsp bovis AF2122/97
ccucuucggggguggccggcuu

SEQ ID NO: 134572 - RNA, 22 nt, Mycobacterium bovis subsp bovis AF2122/97
cgcgggugcgugcacugggugu

SEQ ID NO: 134573 - RNA, 22 nt, Mycobacterium bovis subsp bovis AF2122/97
cauuccccggcguuggcgcagc

SEQ ID NO: 134574 - RNA, 22 nt, Mycobacterium bovis subsp bovis AF2122/97
cgucggcggaaaccaacagggu

SEQ ID NO: 134575 - RNA, 22 nt, Mycobacterium bovis subsp bovis AF2122/97
aaucucgcccccagugcacgcu

SEQ ID NO: 134576 - RNA, 22 nt, Mycobacterium bovis subsp bovis AF2122/97
ggugguuuugugucuguucggc

SEQ ID NO: 134577 - RNA, 22 nt, Mycobacterium bovis subsp bovis AF2122/97
gugcaagucgaucugccggcgc

SEQ ID NO: 134578 - RNA, 22 nt, Mycobacterium bovis subsp bovis AF2122/97
cggcacuucgguuugaccgacc

SEQ ID NO: 134579 - RNA, 22 nt, Mycobacterium bovis subsp bovis AF2122/97
accgcaucaaggaauugguugg

SEQ ID NO: 134580 - RNA, 22 nt, Mycobacterium bovis subsp bovis AF2122/97
auggucgagaagcguugccgcc

SEQ ID NO: 134581 - RNA, 22 nt, Mycobacterium bovis subsp bovis AF2122/97
ccguucgaccucgagucgcugc

SEQ ID NO: 134582 - RNA, 22 nt, Mycobacterium bovis subsp bovis AF2122/97
ccaucgccagcgucgacgugcc

SEQ ID NO: 134583 - RNA, 22 nt, Mycobacterium bovis subsp bovis AF2122/97
gaugucaccgagcaucucagcg

SEQ ID NO: 134584 - RNA, 22 nt, Mycobacterium bovis subsp bovis AF2122/97
ccgcccgggugcgccguagcug

SEQ ID NO: 134585 - RNA, 22 nt, Mycobacterium bovis subsp bovis AF2122/97
uggcggcguggucaccggcgug

SEQ ID NO: 134586 - RNA, 22 nt, Mycobacterium bovis subsp bovis AF2122/97
acggguugccggcacaucgcgc

SEQ ID NO: 134587 - RNA, 22 nt, Mycobacterium bovis subsp bovis AF2122/97
gcgggugcgguauuggugcccg

SEQ ID NO: 134588 - RNA, 22 nt, Mycobacterium bovis subsp bovis AF2122/97
gacuugcaugucggcggcgagu

SEQ ID NO: 134589 - RNA, 22 nt, Mycobacterium bovis subsp bovis AF2122/97
gcgugguacggugguguaccgu

SEQ ID NO: 134590 - RNA, 18 nt, Mycobacterium bovis subsp bovis AF2122/97
ugguggaccgcuaucggc

SEQ ID NO: 134591 - RNA, 22 nt, Mycobacterium bovis subsp bovis AF2122/97
gguggccaggaucaccgacgga

SEQ ID NO: 134592 - RNA, 22 nt, Mycobacterium bovis subsp bovis AF2122/97
ugcgggggcuuuuacgucugcu

SEQ ID NO: 134593 - RNA, 22 nt, Mycobacterium bovis subsp bovis AF2122/97
gggcaucgugcugggcggaucg

SEQ ID NO: 134594 - RNA, 22 nt, Mycobacterium bovis subsp bovis AF2122/97
cgggcgcucgagguguccgguc

SEQ ID NO: 134595 - RNA, 22 nt, Mycobacterium bovis subsp bovis AF2122/97
gcacccuggacaagcuggaauc

SEQ ID NO: 134596 - RNA, 22 nt, Mycobacterium bovis subsp bovis AF2122/97
cgaaaucgacauuagcgcggug

SEQ ID NO: 134597 - RNA, 22 nt, Mycobacterium bovis subsp bovis AF2122/97
cgagcagacgcggaaucgcacc

SEQ ID NO: 134598 - RNA, 22 nt, Mycobacterium bovis subsp bovis AF2122/97
gcugacucgguuuggugcgacg

SEQ ID NO: 134599 - RNA, 22 nt, Mycobacterium bovis subsp bovis AF2122/97
accgcggugcucgaucguggcc

SEQ ID NO: 134600 - RNA, 22 nt, Mycobacterium bovis subsp bovis AF2122/97
gcggaguccuugcucaccauga

SEQ ID NO: 134601 - RNA, 22 nt, Mycobacterium bovis subsp bovis AF2122/97
augggcgauucugcgucugcuc

SEQ ID NO: 134602 - RNA, 22 nt, Mycobacterium bovis subsp bovis AF2122/97
gggccagucuuucggagucaga

SEQ ID NO: 134603 - RNA, 22 nt, Mycobacterium bovis subsp bovis AF2122/97
gcgggcaucaccgucgugcagg

SEQ ID NO: 134604 - RNA, 22 nt, Mycobacterium bovis subsp bovis AF2122/97
ccgcgacagugaaauccacgac

SEQ ID NO: 134605 - RNA, 22 nt, Mycobacterium bovis subsp bovis AF2122/97
acguugcuggacauggugcggg

SEQ ID NO: 134606 - RNA, 22 nt, Mycobacterium bovis subsp bovis AF2122/97
uuggagguggccgccagcacga

SEQ ID NO: 134607 - RNA, 22 nt, Mycobacterium bovis subsp bovis AF2122/97
gcugcggccaccugcucggccg

SEQ ID NO: 134608 - RNA, 22 nt, Mycobacterium bovis subsp bovis AF2122/97
uggcuguaucgccccagggcgu

SEQ ID NO: 134609 - RNA, 22 nt, Mycobacterium bovis subsp bovis AF2122/97
cgguuugccgucgcucuugauc

SEQ ID NO: 134610 - RNA, 22 nt, Mycobacterium bovis subsp bovis AF2122/97
acggcccauuguggcggccguc

SEQ ID NO: 134611 - RNA, 22 nt, Mycobacterium bovis subsp bovis AF2122/97
uaucgguggugguugcggcugg

SEQ ID NO: 134612 - RNA, 22 nt, Mycobacterium bovis subsp bovis AF2122/97
uuguuugacuuauaucaaaaug

SEQ ID NO: 134613 - RNA, 22 nt, Mycobacterium bovis subsp bovis AF2122/97
aaaugggcgcuuaugcgucugc

SEQ ID NO: 134614 - RNA, 22 nt, Mycobacterium bovis subsp bovis AF2122/97
cgaaugugcacugguggcggcg

SEQ ID NO: 134615 - RNA, 22 nt, Mycobacterium bovis subsp bovis AF2122/97
caccuggcacugggugguggcc

SEQ ID NO: 134616 - RNA, 22 nt, Mycobacterium bovis subsp bovis AF2122/97
agucgcugcaggggcugccgag

SEQ ID NO: 134617 - RNA, 22 nt, Mycobacterium bovis subsp bovis AF2122/97
cggcgagcggacacauaagccc

SEQ ID NO: 134618 - RNA, 22 nt, Mycobacterium bovis subsp bovis AF2122/97
ccaucgacuugcugcagcuggc

SEQ ID NO: 134619 - RNA, 22 nt, Mycobacterium bovis subsp bovis AF2122/97
ggcggucaccaacguuggcgcc

SEQ ID NO: 134620 - RNA, 22 nt, Mycobacterium bovis subsp bovis AF2122/97
cccgagugugaaucgcacgacg

SEQ ID NO: 134621 - RNA, 22 nt, Mycobacterium bovis subsp bovis AF2122/97
acaccgaguucauggcgcccgc

SEQ ID NO: 134622 - RNA, 22 nt, Mycobacterium bovis subsp bovis AF2122/97
guacuucgucgacgucugaucg

SEQ ID NO: 134623 - RNA, 20 nt, Mycobacterium bovis subsp bovis AF2122/97
gggcuuuugcgucugcucgc

SEQ ID NO: 134624 - RNA, 22 nt, Mycobacterium bovis subsp bovis AF2122/97
agcugcagugcccgccggauga

SEQ ID NO: 134625 - RNA, 22 nt, Mycobacterium bovis subsp bovis AF2122/97
uuguuccugagcgagugguucc

SEQ ID NO: 134626 - RNA, 22 nt, Mycobacterium bovis subsp bovis AF2122/97
cgucgauucgagagguaaccga

SEQ ID NO: 134627 - RNA, 22 nt, Mycobacterium bovis subsp bovis AF2122/97
caccagcgcgguggugaucacc

SEQ ID NO: 134628 - RNA, 22 nt, Mycobacterium bovis subsp bovis AF2122/97
aucagcagcgugguugccgcgu

SEQ ID NO: 134629 - RNA, 22 nt, Mycobacterium bovis subsp bovis AF2122/97
ggcgggucaacgacccagacga

SEQ ID NO: 134630 - RNA, 22 nt, Mycobacterium bovis subsp bovis AF2122/97
gaguaggcgcaaaagaacauga

SEQ ID NO: 134631 - RNA, 22 nt, Mycobacterium bovis subsp bovis AF2122/97
cgaguggucugggcucgaccgc

SEQ ID NO: 134632 - RNA, 22 nt, Mycobacterium bovis subsp bovis AF2122/97
ccacgacgagcucgugcugccg

SEQ ID NO: 134633 - RNA, 22 nt, Mycobacterium bovis subsp bovis AF2122/97
ucgccuccuucgaggaagagcc

SEQ ID NO: 134634 - RNA, 22 nt, Mycobacterium bovis subsp bovis AF2122/97
gccuccccaauacagguccugc

SEQ ID NO: 134635 - RNA, 22 nt, Mycobacterium bovis subsp bovis AF2122/97
ucgucgacgugcugcgggaguc

SEQ ID NO: 134636 - RNA, 22 nt, Mycobacterium bovis subsp bovis AF2122/97
uaggggugcaccgauccgcccu

SEQ ID NO: 134637 - RNA, 20 nt, Mycobacterium bovis subsp bovis AF2122/97
cgcuggucguugaugcgcag

SEQ ID NO: 134638 - RNA, 22 nt, Mycobacterium bovis subsp bovis AF2122/97
uugggcggcggccuggagaucg

SEQ ID NO: 134639 - RNA, 22 nt, Mycobacterium bovis subsp bovis AF2122/97
ucgcgcugacgucgaucucgac

SEQ ID NO: 134640 - RNA, 22 nt, Mycobacterium bovis subsp bovis AF2122/97
gcguuugacucugcggauacca

SEQ ID NO: 134641 - RNA, 19 nt, Mycobacterium bovis subsp bovis AF2122/97
ggagugcccggugccggcg

SEQ ID NO: 134642 - RNA, 22 nt, Mycobacterium bovis subsp bovis AF2122/97
ugcggguacuggucggcaaugg

SEQ ID NO: 134643 - RNA, 22 nt, Mycobacterium bovis subsp bovis AF2122/97
gaguucuucgcgguggccaaga

SEQ ID NO: 134644 - RNA, 22 nt, Mycobacterium bovis subsp bovis AF2122/97
aagggucgcagugggcagcgau

SEQ ID NO: 134645 - RNA, 22 nt, Mycobacterium bovis subsp bovis AF2122/97
cgcgaauguaacgccacugcga

SEQ ID NO: 134646 - RNA, 22 nt, Mycobacterium bovis subsp bovis AF2122/97
gcgcgacaucgaacuggcguag

SEQ ID NO: 134647 - RNA, 22 nt, Mycobacterium bovis subsp bovis AF2122/97
cccagcuuggugucgcgagcau

SEQ ID NO: 134648 - RNA, 22 nt, Mycobacterium bovis subsp bovis AF2122/97
gacgaugccgugacgaauggcg

SEQ ID NO: 134649 - RNA, 22 nt, Mycobacterium bovis subsp bovis AF2122/97
gcgaggauucgacgaugcugag

SEQ ID NO: 134650 - RNA, 22 nt, Mycobacterium bovis subsp bovis AF2122/97
cacgcgugugacgcugcggcga

SEQ ID NO: 134651 - RNA, 22 nt, Mycobacterium bovis subsp bovis AF2122/97
cgggcaaggagacggucaccac

SEQ ID NO: 134652 - RNA, 21 nt, Mycobacterium bovis subsp bovis AF2122/97
gcucccgaucucccggggaga

SEQ ID NO: 134653 - RNA, 22 nt, Mycobacterium bovis subsp bovis AF2122/97
ccggcaugagucgaagccucaa

SEQ ID NO: 134654 - RNA, 22 nt, Mycobacterium bovis subsp bovis AF2122/97
uguagcgagcgaucuugucgau

SEQ ID NO: 134655 - RNA, 22 nt, Mycobacterium bovis subsp bovis AF2122/97
ugggacagcuggaaguuaucgg

SEQ ID NO: 134656 - RNA, 22 nt, Mycobacterium bovis subsp bovis AF2122/97
gcgguaucuacaggcucggcga

SEQ ID NO: 134657 - RNA, 22 nt, Mycobacterium bovis subsp bovis AF2122/97
cuggcggucggugccgucgaug

SEQ ID NO: 134658 - RNA, 22 nt, Mycobacterium bovis subsp bovis AF2122/97
gcucgcuggaugagcagcucgg

SEQ ID NO: 134659 - RNA, 22 nt, Mycobacterium bovis subsp bovis AF2122/97
gccguguuggcuccguuggugc

SEQ ID NO: 134660 - RNA, 22 nt, Mycobacterium bovis subsp bovis AF2122/97
ugcggcagacgcugcagcagua

SEQ ID NO: 134661 - RNA, 22 nt, Mycobacterium bovis subsp bovis AF2122/97
cgagcagacgcggaaucgcauc

SEQ ID NO: 134662 - RNA, 22 nt, Mycobacterium bovis subsp bovis AF2122/97
gucgcggaagcucgucggcgug

SEQ ID NO: 134663 - RNA, 22 nt, Mycobacterium bovis subsp bovis AF2122/97
cgaaggucucgacguacugcgc

SEQ ID NO: 134664 - RNA, 23 nt, Mycobacterium bovis subsp bovis AF2122/97
ccgccgguucggaugaucucgcc

SEQ ID NO: 134665 - RNA, 22 nt, Mycobacterium bovis subsp bovis AF2122/97
uguggccguagccgauguggcu

SEQ ID NO: 134666 - RNA, 22 nt, Mycobacterium bovis subsp bovis AF2122/97
aacaucacggugugcgucggcg

SEQ ID NO: 134667 - RNA, 22 nt, Mycobacterium bovis subsp bovis AF2122/97
aggcaaucagucaggucgcuau

SEQ ID NO: 134668 - RNA, 22 nt, Mycobacterium bovis subsp bovis AF2122/97
aagcugauucugauggcgauug

SEQ ID NO: 134669 - RNA, 22 nt, Mycobacterium bovis subsp bovis AF2122/97
gcgacagcggagucgaugccga

SEQ ID NO: 134670 - RNA, 22 nt, Mycobacterium bovis subsp bovis AF2122/97
ucggucaacagguucguggcgc

SEQ ID NO: 134671 - RNA, 22 nt, Mycobacterium bovis subsp bovis AF2122/97
uucggucacuuccucgucgcgc

SEQ ID NO: 134672 - RNA, 22 nt, Mycobacterium bovis subsp bovis AF2122/97
uccggacgcggucaugggcguu

SEQ ID NO: 134673 - RNA, 22 nt, Mycobacterium bovis subsp bovis AF2122/97
ugcuggccgaaugucgaugauc

SEQ ID NO: 134674 - RNA, 22 nt, Mycobacterium bovis subsp bovis AF2122/97
ggaagaagaacaccgacacuga

SEQ ID NO: 134675 - RNA, 22 nt, Mycobacterium bovis subsp bovis AF2122/97
gugagcugcagcgccccgaucc

SEQ ID NO: 134676 - RNA, 22 nt, Mycobacterium bovis subsp bovis AF2122/97
ccgacggugcugcggacaucga

SEQ ID NO: 134677 - RNA, 22 nt, Mycobacterium bovis subsp bovis AF2122/97
gcgaccgguugucauuccggcc

SEQ ID NO: 134678 - RNA, 22 nt, Mycobacterium bovis subsp bovis AF2122/97
gcgacucgcuggguguggguaa

SEQ ID NO: 134679 - RNA, 22 nt, Mycobacterium bovis subsp bovis AF2122/97
augcggugcggaucagaggacc

SEQ ID NO: 134680 - RNA, 22 nt, Mycobacterium bovis subsp bovis AF2122/97
cggcuucccagacuucggauuc

SEQ ID NO: 134681 - RNA, 22 nt, Mycobacterium bovis subsp bovis AF2122/97
gcgcacgagucgcugguggugg

SEQ ID NO: 134682 - RNA, 22 nt, Mycobacterium bovis subsp bovis AF2122/97
cgacgccgccccgauauugcag

SEQ ID NO: 134683 - RNA, 21 nt, Mycobacterium bovis subsp bovis AF2122/97
cggcuggcggccacggucgcc

SEQ ID NO: 134684 - RNA, 22 nt, Mycobacterium bovis subsp bovis AF2122/97
uguccgauguggcggcggcggg

SEQ ID NO: 134685 - RNA, 22 nt, Mycobacterium bovis subsp bovis AF2122/97
agccugcugggcgccgacgguu

SEQ ID NO: 134686 - RNA, 22 nt, Mycobacterium bovis subsp bovis AF2122/97
cuucccggacaaguggcgcacc

SEQ ID NO: 134687 - RNA, 22 nt, Mycobacterium bovis subsp bovis AF2122/97
ugccaugaccucguuugcgcac

SEQ ID NO: 134688 - RNA, 22 nt, Mycobacterium bovis subsp bovis AF2122/97
acccgggucggcacgacccggg

SEQ ID NO: 134689 - RNA, 22 nt, Mycobacterium bovis subsp bovis AF2122/97
ucgccgagccuuuaguuaucgu

SEQ ID NO: 134690 - RNA, 22 nt, Mycobacterium bovis subsp bovis AF2122/97
cacuggucguugcgccaggcgg

SEQ ID NO: 134691 - RNA, 22 nt, Mycobacterium bovis subsp bovis AF2122/97
agaucaggaucucgguguugug

SEQ ID NO: 134692 - RNA, 22 nt, Mycobacterium bovis subsp bovis AF2122/97
gccacggaauuguucgcugagc

SEQ ID NO: 134693 - RNA, 22 nt, Mycobacterium bovis subsp bovis AF2122/97
ugggacuucugacagaccugca

SEQ ID NO: 134694 - RNA, 20 nt, Mycobacterium bovis subsp bovis AF2122/97
ugguggacgcagagucagcg

SEQ ID NO: 134695 - RNA, 22 nt, Mycobacterium bovis subsp bovis AF2122/97
gaucuuguucgguaccgguggc

SEQ ID NO: 134696 - RNA, 22 nt, Mycobacterium bovis subsp bovis AF2122/97
ccgcagguguucggcgaccaga

SEQ ID NO: 134697 - RNA, 19 nt, Mycobacterium bovis subsp bovis AF2122/97
agcucgcgcagccgggcgg

SEQ ID NO: 134698 - RNA, 22 nt, Mycobacterium bovis subsp bovis AF2122/97
uggacggaucgggcacgguucg

SEQ ID NO: 134699 - RNA, 22 nt, Mycobacterium bovis subsp bovis AF2122/97
uggcgcaaccccugacccgaga

SEQ ID NO: 134700 - RNA, 22 nt, Mycobacterium bovis subsp bovis AF2122/97
aacgccgacgguuggggugucg

SEQ ID NO: 134701 - RNA, 22 nt, Mycobacterium bovis subsp bovis AF2122/97
ccugauggcgucgaucaccggc

SEQ ID NO: 134702 - RNA, 23 nt, Mycobacterium bovis subsp bovis AF2122/97
acgucaugaaugugguguugcgg

SEQ ID NO: 134703 - RNA, 22 nt, Mycobacterium bovis subsp bovis AF2122/97
ugcucgaagggggaaagguguu

SEQ ID NO: 134704 - RNA, 22 nt, Mycobacterium bovis subsp bovis AF2122/97
gcagcggaaccgcgauacgucc

SEQ ID NO: 134705 - RNA, 22 nt, Mycobacterium bovis subsp bovis AF2122/97
ucgcccugaguucacgcucggc

SEQ ID NO: 134706 - RNA, 22 nt, Mycobacterium bovis subsp bovis AF2122/97
ggugagcagacgcagagucgca

SEQ ID NO: 134707 - RNA, 22 nt, Mycobacterium bovis subsp bovis AF2122/97
cgcgagcagacgcaaaaucgcc

SEQ ID NO: 134708 - RNA, 22 nt, Mycobacterium bovis subsp bovis AF2122/97
acagcgcgguucgcggaccgaa

SEQ ID NO: 134709 - RNA, 23 nt, Mycobacterium bovis subsp bovis AF2122/97
gacgcacgucacagaacguggug

SEQ ID NO: 134710 - RNA, 22 nt, Mycobacterium bovis subsp bovis AF2122/97
augcugccggcauugaccacau

SEQ ID NO: 134711 - RNA, 22 nt, Mycobacterium bovis subsp bovis AF2122/97
ggugcgcucuggugccggagcu

SEQ ID NO: 134712 - RNA, 22 nt, Mycobacterium bovis subsp bovis AF2122/97
ucgaugacuaucugcggauggc

SEQ ID NO: 134713 - RNA, 22 nt, Mycobacterium bovis subsp bovis AF2122/97
ugacccaggcgccggucggugu

SEQ ID NO: 134714 - RNA, 22 nt, Mycobacterium bovis subsp bovis AF2122/97
uacggcauucggcacacguugu

SEQ ID NO: 134715 - RNA, 22 nt, Mycobacterium bovis subsp bovis AF2122/97
aucgggcagcugccuggcgugg

SEQ ID NO: 134716 - RNA, 22 nt, Mycobacterium bovis subsp bovis AF2122/97
ucgcggugcccacccagcauga

SEQ ID NO: 134717 - RNA, 22 nt, Mycobacterium bovis subsp bovis AF2122/97
ugcucugcaucgucgccggcgc

SEQ ID NO: 134718 - RNA, 22 nt, Mycobacterium bovis subsp bovis AF2122/97
caccgucaauacgauguugcug

SEQ ID NO: 134719 - RNA, 22 nt, Mycobacterium bovis subsp bovis AF2122/97
ugcugguggugacggcggccgg

SEQ ID NO: 134720 - RNA, 22 nt, Mycobacterium bovis subsp bovis AF2122/97
ccgagugaaggugggguacaug

SEQ ID NO: 134721 - RNA, 22 nt, Mycobacterium bovis subsp bovis AF2122/97
uguccgaagacacgaaccuggc

SEQ ID NO: 134722 - RNA, 22 nt, Mycobacterium bovis subsp bovis AF2122/97
ggaaguucuaucugccgccaaa

SEQ ID NO: 134723 - RNA, 22 nt, Mycobacterium bovis subsp bovis AF2122/97
ugaccgagagcaugcuggaguu

SEQ ID NO: 134724 - RNA, 22 nt, Mycobacterium bovis subsp bovis AF2122/97
uucggcgccccgcagggucgug

SEQ ID NO: 134725 - RNA, 22 nt, Mycobacterium bovis subsp bovis AF2122/97
cuggacguuugagacggugauc

SEQ ID NO: 134726 - RNA, 22 nt, Mycobacterium bovis subsp bovis AF2122/97
uagccgacaucgccggcgccuu

SEQ ID NO: 134727 - RNA, 22 nt, Mycobacterium bovis subsp bovis AF2122/97
ccggugcgaaaaauccgcucga

SEQ ID NO: 134728 - RNA, 22 nt, Mycobacterium bovis subsp bovis AF2122/97
ccguucuugaucagcggaccac

SEQ ID NO: 134729 - RNA, 22 nt, Mycobacterium bovis subsp bovis AF2122/97
aucgagauagccgcccugguca

SEQ ID NO: 134730 - RNA, 23 nt, Mycobacterium bovis subsp bovis AF2122/97
cgagcgguauggccggcgcugac

SEQ ID NO: 134731 - RNA, 22 nt, Mycobacterium bovis subsp bovis AF2122/97
auuugggagcuuuugcgucuuu

SEQ ID NO: 134732 - RNA, 22 nt, Mycobacterium bovis subsp bovis AF2122/97
gcgccgguguugauauugccgg

SEQ ID NO: 134733 - RNA, 22 nt, Mycobacterium bovis subsp bovis AF2122/97
gugcugguggucgucggcggag

SEQ ID NO: 134734 - RNA, 22 nt, Mycobacterium bovis subsp bovis AF2122/97
gcgcccggaccuggugaucggc

SEQ ID NO: 134735 - RNA, 22 nt, Mycobacterium bovis subsp bovis AF2122/97
cgccgagcgugaacucagugca

SEQ ID NO: 134736 - RNA, 22 nt, Mycobacterium bovis subsp bovis AF2122/97
ugggaugguuuucagcgcccga

SEQ ID NO: 134737 - RNA, 22 nt, Mycobacterium bovis subsp bovis AF2122/97
cucugggaccuggaccggcgga

SEQ ID NO: 134738 - RNA, 22 nt, Mycobacterium bovis subsp bovis AF2122/97
gcgucgugagauucacagucgg

SEQ ID NO: 134739 - RNA, 22 nt, Mycobacterium bovis subsp bovis AF2122/97
cagcgugaacugagggcggaga

SEQ ID NO: 134740 - RNA, 20 nt, Mycobacterium bovis subsp bovis AF2122/97
gccgcgcacgaggcuucggu

SEQ ID NO: 134741 - RNA, 22 nt, Mycobacterium bovis subsp bovis AF2122/97
cgguacgguccgcaguugggug

SEQ ID NO: 134742 - RNA, 22 nt, Mycobacterium bovis subsp bovis AF2122/97
ucagcgaucccaaugccugggu

SEQ ID NO: 134743 - RNA, 22 nt, Mycobacterium bovis subsp bovis AF2122/97
uugagcucggugagguugcgca

SEQ ID NO: 134744 - RNA, 22 nt, Mycobacterium bovis subsp bovis AF2122/97
gggcggcguucgaggccauccg

SEQ ID NO: 134745 - RNA, 22 nt, Mycobacterium bovis subsp bovis AF2122/97
gcuacggauuucgcccgucgaa

SEQ ID NO: 134746 - RNA, 22 nt, Mycobacterium bovis subsp bovis AF2122/97
ucgacgguguaacccgccgcga

SEQ ID NO: 134747 - RNA, 20 nt, Mycobacterium bovis subsp bovis AF2122/97
ucuggccaaggugucgagca

SEQ ID NO: 134748 - RNA, 22 nt, Mycobacterium bovis subsp bovis AF2122/97
aucgcggcagcaugucgucaac

SEQ ID NO: 134749 - RNA, 22 nt, Mycobacterium bovis subsp bovis AF2122/97
ggucgcaaugggcaggacuuug

SEQ ID NO: 134750 - RNA, 23 nt, Mycobacterium bovis subsp bovis AF2122/97
ccggcccggcauguucguccggg

SEQ ID NO: 134751 - RNA, 22 nt, Mycobacterium bovis subsp bovis AF2122/97
auggccgccgacgccaggucgu

SEQ ID NO: 134752 - RNA, 22 nt, Mycobacterium bovis subsp bovis AF2122/97
ggguacugagcaucggguuguu

SEQ ID NO: 134753 - RNA, 22 nt, Mycobacterium bovis subsp bovis AF2122/97
uuggugaacggcacucggcaua

SEQ ID NO: 134754 - RNA, 22 nt, Mycobacterium bovis subsp bovis AF2122/97
agcugcaugacgaacucggccu

SEQ ID NO: 134755 - RNA, 22 nt, Mycobacterium bovis subsp bovis AF2122/97
ggccgcggcucgcguagggcuu

SEQ ID NO: 134756 - RNA, 22 nt, Mycobacterium bovis subsp bovis AF2122/97
gccgaacgugaagccagggcga

SEQ ID NO: 134757 - RNA, 23 nt, Mycobacterium bovis subsp bovis AF2122/97
cgugcgauucugcgucugcucgc

SEQ ID NO: 134758 - RNA, 20 nt, Mycobacterium bovis subsp bovis AF2122/97
gaucuugucccggcgguggc

SEQ ID NO: 134759 - RNA, 22 nt, Mycobacterium bovis subsp bovis AF2122/97
ccagcugggugcugccgcuguc

SEQ ID NO: 134760 - RNA, 22 nt, Mycobacterium bovis subsp bovis AF2122/97
auucgucgagcaauugcuggua

SEQ ID NO: 134761 - RNA, 22 nt, Mycobacterium bovis subsp bovis AF2122/97
ucgcucggccgugguggucugc

SEQ ID NO: 134762 - RNA, 22 nt, Mycobacterium bovis subsp bovis AF2122/97
cccgucguacggcuggaucugg

SEQ ID NO: 134763 - RNA, 22 nt, Mycobacterium bovis subsp bovis AF2122/97
ggcggcuugaacuccggugccg

SEQ ID NO: 134764 - RNA, 22 nt, Mycobacterium bovis subsp bovis AF2122/97
ggugggcgcgucaucgacgcuu

SEQ ID NO: 134765 - RNA, 22 nt, Mycobacterium bovis subsp bovis AF2122/97
cucggcggugacguugggcucc

SEQ ID NO: 134766 - RNA, 22 nt, Mycobacterium bovis subsp bovis AF2122/97
ugcggugcucucgaccaucggg

SEQ ID NO: 134767 - RNA, 22 nt, Mycobacterium bovis subsp bovis AF2122/97
gugugcuggcggauuuucugga

SEQ ID NO: 134768 - RNA, 22 nt, Mycobacterium bovis subsp bovis AF2122/97
uguugacucugcguccaccgga

SEQ ID NO: 134769 - RNA, 23 nt, Mycobacterium bovis subsp bovis AF2122/97
gcccggcgauccucggucagugc

SEQ ID NO: 134770 - RNA, 22 nt, Mycobacterium bovis subsp bovis AF2122/97
aggcgguaccgguagcgccggu

SEQ ID NO: 134771 - RNA, 22 nt, Mycobacterium bovis subsp bovis AF2122/97
ucgaugucgaccagcuuggugu

SEQ ID NO: 134772 - RNA, 22 nt, Mycobacterium bovis subsp bovis AF2122/97
augguugcgccagguuugacgg

SEQ ID NO: 134773 - RNA, 22 nt, Mycobacterium bovis subsp bovis AF2122/97
aucgucaacgucggccagcgcg

SEQ ID NO: 134774 - RNA, 22 nt, Mycobacterium bovis subsp bovis AF2122/97
caccuucgacgacaucgacgcc

SEQ ID NO: 134775 - RNA, 22 nt, Mycobacterium bovis subsp bovis AF2122/97
agcaccgcggccagguucagcg

SEQ ID NO: 134776 - RNA, 22 nt, Mycobacterium bovis subsp bovis AF2122/97
ugagggcaucgucggucgccgg

SEQ ID NO: 134777 - RNA, 22 nt, Mycobacterium bovis subsp bovis AF2122/97
ucggccagcgccgagagcuggc

SEQ ID NO: 134778 - RNA, 21 nt, Mycobacterium bovis subsp bovis AF2122/97
cguggugcacgccaugcuggc

SEQ ID NO: 134779 - RNA, 22 nt, Mycobacterium bovis subsp bovis AF2122/97
guucggcgacacauccgucggu

SEQ ID NO: 134780 - RNA, 22 nt, Mycobacterium bovis subsp bovis AF2122/97
agucggugguagucggugcggc

SEQ ID NO: 134781 - RNA, 19 nt, Mycobacterium bovis subsp bovis AF2122/97
cggaaucgaagcacgcucc

SEQ ID NO: 134782 - RNA, 22 nt, Mycobacterium bovis subsp bovis AF2122/97
augcugcaguuucugcgcacgg

SEQ ID NO: 134783 - RNA, 22 nt, Mycobacterium bovis subsp bovis AF2122/97
guugucaugugcauggugaccg

SEQ ID NO: 134784 - RNA, 22 nt, Mycobacterium bovis subsp bovis AF2122/97
cgaccguuccgucgugcagucg

SEQ ID NO: 134785 - RNA, 22 nt, Mycobacterium bovis subsp bovis AF2122/97
gacgugcgccagcugcaguaau

SEQ ID NO: 134786 - RNA, 22 nt, Mycobacterium bovis subsp bovis AF2122/97
acgagcguaacgucacggcuga

SEQ ID NO: 134787 - RNA, 22 nt, Mycobacterium bovis subsp bovis AF2122/97
ucgucggcgaaaccggcucuac

SEQ ID NO: 134788 - RNA, 19 nt, Mycobacterium bovis subsp bovis AF2122/97
aagcugacggccuuggugu

SEQ ID NO: 134789 - RNA, 22 nt, Mycobacterium bovis subsp bovis AF2122/97
cugcgcaucgaggccggcgacg

SEQ ID NO: 134790 - RNA, 22 nt, Mycobacterium bovis subsp bovis AF2122/97
cgaucagcacgccucgggcguc

SEQ ID NO: 134791 - RNA, 22 nt, Mycobacterium bovis subsp bovis AF2122/97
aagacgcggucgacgacgcccu

SEQ ID NO: 134792 - RNA, 22 nt, Mycobacterium bovis subsp bovis AF2122/97
ccggaagcagcuccggauucaa

SEQ ID NO: 134793 - RNA, 22 nt, Mycobacterium bovis subsp bovis AF2122/97
ccgcgccagcgacgaugcagug

SEQ ID NO: 134794 - RNA, 22 nt, Mycobacterium bovis subsp bovis AF2122/97
aggaccguuucgauuuugacag

SEQ ID NO: 134795 - RNA, 22 nt, Mycobacterium bovis subsp bovis AF2122/97
ucgucgagggcgucaccgccgc

SEQ ID NO: 134796 - RNA, 22 nt, Mycobacterium bovis subsp bovis AF2122/97
uugccugggccuggaucucguc

SEQ ID NO: 134797 - RNA, 22 nt, Mycobacterium bovis subsp bovis AF2122/97
ggcggucaccgauugggagagg

SEQ ID NO: 134798 - RNA, 20 nt, Mycobacterium bovis subsp bovis AF2122/97
ugccgcggcugcggugauga

SEQ ID NO: 134799 - RNA, 22 nt, Mycobacterium bovis subsp bovis AF2122/97
gugcggcuaccccggcguccug

SEQ ID NO: 134800 - RNA, 22 nt, Mycobacterium bovis subsp bovis AF2122/97
aaugggcgauuuugcgucugcu

SEQ ID NO: 134801 - RNA, 22 nt, Mycobacterium bovis subsp bovis AF2122/97
uugcccgucgugcccuggacgu

SEQ ID NO: 134802 - RNA, 22 nt, Mycobacterium bovis subsp bovis AF2122/97
gcaucgacauuaccggcguaau

SEQ ID NO: 134803 - RNA, 23 nt, Mycobacterium bovis subsp bovis AF2122/97
ugggccggcacugcugucgugcg

SEQ ID NO: 134804 - RNA, 22 nt, Mycobacterium bovis subsp bovis AF2122/97
auguugggccgauucagcgaau

SEQ ID NO: 134805 - RNA, 22 nt, Mycobacterium bovis subsp bovis AF2122/97
agcgcgccggacaucgccgguc

SEQ ID NO: 134806 - RNA, 22 nt, Mycobacterium bovis subsp bovis AF2122/97
ccgucggcgaguuggcccgcga

SEQ ID NO: 134807 - RNA, 22 nt, Mycobacterium bovis subsp bovis AF2122/97
cugggcgauccaucggggaugc

SEQ ID NO: 134808 - RNA, 22 nt, Mycobacterium bovis subsp bovis AF2122/97
cccgcgucaucagcgcaccgcc

SEQ ID NO: 134809 - RNA, 22 nt, Mycobacterium bovis subsp bovis AF2122/97
gggcgcgcugucccgugaugcc

SEQ ID NO: 134810 - RNA, 22 nt, Mycobacterium bovis subsp bovis AF2122/97
gauucgccgucauggguuggcu

SEQ ID NO: 134811 - RNA, 23 nt, Mycobacterium bovis subsp bovis AF2122/97
aucagcuggauaggcaaggagac

SEQ ID NO: 134812 - RNA, 22 nt, Mycobacterium bovis subsp bovis AF2122/97
caucgccucgaccggcggaaac

SEQ ID NO: 134813 - RNA, 22 nt, Mycobacterium bovis subsp bovis AF2122/97
gcugcgugcacgaacuggucga

SEQ ID NO: 134814 - RNA, 22 nt, Mycobacterium bovis subsp bovis AF2122/97
ccgucucaccgaggauuucgac

SEQ ID NO: 134815 - RNA, 22 nt, Mycobacterium bovis subsp bovis AF2122/97
ucggccugucgcgcgaggugau

SEQ ID NO: 134816 - RNA, 22 nt, Mycobacterium bovis subsp bovis AF2122/97
agcugguucuugaagcgugguc

SEQ ID NO: 134817 - RNA, 22 nt, Mycobacterium bovis subsp bovis AF2122/97
cgacgcacccgccuauggcggc

SEQ ID NO: 134818 - RNA, 22 nt, Mycobacterium bovis subsp bovis AF2122/97
ugacgaccgcggugagcgcagc

SEQ ID NO: 134819 - RNA, 22 nt, Mycobacterium bovis subsp bovis AF2122/97
ccgcuuggggugacacgggguu

SEQ ID NO: 134820 - RNA, 22 nt, Mycobacterium bovis subsp bovis AF2122/97
ugggcacugaauaccggccagg

SEQ ID NO: 134821 - RNA, 22 nt, Mycobacterium bovis subsp bovis AF2122/97
guucggcgcuuuccgccauuug

SEQ ID NO: 134822 - RNA, 22 nt, Mycobacterium bovis subsp bovis AF2122/97
acccgcacggcgauguucauca

SEQ ID NO: 134823 - RNA, 22 nt, Mycobacterium bovis subsp bovis AF2122/97
aacuggccgugcucggcccgcu

SEQ ID NO: 134824 - RNA, 22 nt, Mycobacterium bovis subsp bovis AF2122/97
ugcuggccgcgaugaccgcggc

SEQ ID NO: 134825 - RNA, 22 nt, Mycobacterium bovis subsp bovis AF2122/97
ucgagugaguuccgggcaccac

SEQ ID NO: 134826 - RNA, 22 nt, Mycobacterium bovis subsp bovis AF2122/97
ggcggacuguucggagccggcg

SEQ ID NO: 134827 - RNA, 22 nt, Mycobacterium bovis subsp bovis AF2122/97
ggccgacgggucgguggacauc

SEQ ID NO: 134828 - RNA, 22 nt, Mycobacterium bovis subsp bovis AF2122/97
aacucagggagcagugccgugc

SEQ ID NO: 134829 - RNA, 20 nt, Mycobacterium bovis subsp bovis AF2122/97
uccacgguuuaucgugccca

SEQ ID NO: 134830 - RNA, 22 nt, Mycobacterium bovis subsp bovis AF2122/97
aaguagggucggcacaccucaa

SEQ ID NO: 134831 - RNA, 22 nt, Mycobacterium bovis subsp bovis AF2122/97
gucgcggacagucccauguuag

SEQ ID NO: 134832 - RNA, 22 nt, Mycobacterium bovis subsp bovis AF2122/97
uacguugcaacccgagcgcuuc

SEQ ID NO: 134833 - RNA, 22 nt, Mycobacterium bovis subsp bovis AF2122/97
accgagaagucguaugcggugc

SEQ ID NO: 134834 - RNA, 22 nt, Mycobacterium bovis subsp bovis AF2122/97
cuggcgguuuggcugcuguuga

SEQ ID NO: 134835 - RNA, 22 nt, Mycobacterium bovis subsp bovis AF2122/97
augguugguggugcauaucguc

SEQ ID NO: 134836 - RNA, 22 nt, Mycobacterium bovis subsp bovis AF2122/97
cgagcagacgcaaaaucgcccu

SEQ ID NO: 134837 - RNA, 22 nt, Mycobacterium bovis subsp bovis AF2122/97
acgggugaacugcacgcggugu

SEQ ID NO: 134838 - RNA, 22 nt, Mycobacterium bovis subsp bovis AF2122/97
uggacgcggugcagcggcagcg

SEQ ID NO: 134839 - RNA, 22 nt, Mycobacterium bovis subsp bovis AF2122/97
ugaccgguaagcgcggcgaugg

SEQ ID NO: 134840 - RNA, 22 nt, Mycobacterium bovis subsp bovis AF2122/97
gcuggcuggaucgugugguguc

SEQ ID NO: 134841 - RNA, 22 nt, Mycobacterium bovis subsp bovis AF2122/97
ugguuguccagaaucgauugcg

SEQ ID NO: 134842 - RNA, 22 nt, Mycobacterium bovis subsp bovis AF2122/97
ucuucgucgaggaacucggcga

SEQ ID NO: 134843 - RNA, 22 nt, Mycobacterium bovis subsp bovis AF2122/97
gccggcguuggcugccuugggu

SEQ ID NO: 134844 - RNA, 22 nt, Mycobacterium bovis subsp bovis AF2122/97
ucgacgguuccucguucggcac

SEQ ID NO: 134845 - RNA, 22 nt, Mycobacterium bovis subsp bovis AF2122/97
cgcccgccaaggacuuccgcgc

SEQ ID NO: 134846 - RNA, 22 nt, Mycobacterium bovis subsp bovis AF2122/97
gagcagacgcaaaaucgcccau

SEQ ID NO: 134847 - RNA, 22 nt, Mycobacterium bovis subsp bovis AF2122/97
gucgcgggauucacacucggcg

SEQ ID NO: 134848 - RNA, 22 nt, Mycobacterium bovis subsp bovis AF2122/97
cggcugucggccuauaccgaca

SEQ ID NO: 134849 - RNA, 22 nt, Mycobacterium bovis subsp bovis AF2122/97
aguacggccccguguccggcuc

SEQ ID NO: 134850 - RNA, 22 nt, Mycobacterium bovis subsp bovis AF2122/97
accaacacucgcuggccggccc

SEQ ID NO: 134851 - RNA, 22 nt, Mycobacterium bovis subsp bovis AF2122/97
cgcagcagcuugaugggguucu

SEQ ID NO: 134852 - RNA, 20 nt, Mycobacterium bovis subsp bovis AF2122/97
cggcgcugacaucauccucg

SEQ ID NO: 134853 - RNA, 22 nt, Mycobacterium bovis subsp bovis AF2122/97
aagcucgugcagcgauucgcca

SEQ ID NO: 134854 - RNA, 21 nt, Mycobacterium bovis subsp bovis AF2122/97
agcgguccuugaucagggacc

SEQ ID NO: 134855 - RNA, 22 nt, Mycobacterium bovis subsp bovis AF2122/97
cggucgcgauaccguguagcag

SEQ ID NO: 134856 - RNA, 22 nt, Mycobacterium bovis subsp bovis AF2122/97
cacacguggccgaucgguuacu

SEQ ID NO: 134857 - RNA, 22 nt, Mycobacterium bovis subsp bovis AF2122/97
uggccgauguaguccggccagu

SEQ ID NO: 134858 - RNA, 18 nt, Mycobacterium bovis subsp bovis AF2122/97
uuugagcauggccgcgcc

SEQ ID NO: 134859 - RNA, 22 nt, Mycobacterium bovis subsp bovis AF2122/97
cgagcagacgcaaaacccccuu

SEQ ID NO: 134860 - RNA, 22 nt, Mycobacterium bovis subsp bovis AF2122/97
ccccgagugugaacugcgcaac

SEQ ID NO: 134861 - RNA, 22 nt, Mycobacterium bovis subsp bovis AF2122/97
gcccugagcgcagacgcgaugc

SEQ ID NO: 134862 - RNA, 22 nt, Mycobacterium bovis subsp bovis AF2122/97
agucggcucccuucaucaauuc

SEQ ID NO: 134863 - RNA, 22 nt, Mycobacterium bovis subsp bovis AF2122/97
agucggcucgagcaacaccgug

SEQ ID NO: 134864 - RNA, 22 nt, Mycobacterium bovis subsp bovis AF2122/97
cggcaagcccgggcucgccgga

SEQ ID NO: 134865 - RNA, 22 nt, Mycobacterium bovis subsp bovis AF2122/97
ccgugagccggugcagagccgg

SEQ ID NO: 134866 - RNA, 22 nt, Mycobacterium bovis subsp bovis AF2122/97
gggucggcaagaccgagcuggc

SEQ ID NO: 134867 - RNA, 22 nt, Mycobacterium bovis subsp bovis AF2122/97
ucgggggcauuuugcgucugcu

SEQ ID NO: 134868 - RNA, 21 nt, Mycobacterium bovis subsp bovis AF2122/97
ucgucgagguaacgcaugcgc

SEQ ID NO: 134869 - RNA, 22 nt, Mycobacterium bovis subsp bovis AF2122/97
caguuguccgaugaggaacugg

SEQ ID NO: 134870 - RNA, 22 nt, Mycobacterium bovis subsp bovis AF2122/97
cugaaugccuauaucgcggcca

SEQ ID NO: 134871 - RNA, 20 nt, Mycobacterium bovis subsp bovis AF2122/97
acggccuggccugucggcgc

SEQ ID NO: 134872 - RNA, 22 nt, Mycobacterium bovis subsp bovis AF2122/97
ggcucggugaacaagaucgucg

SEQ ID NO: 134873 - RNA, 22 nt, Mycobacterium bovis subsp bovis AF2122/97
ugggcaugaucuguggaucagg

SEQ ID NO: 134874 - RNA, 22 nt, Mycobacterium bovis subsp bovis AF2122/97
gauuguucuggaugaucguggu

SEQ ID NO: 134875 - RNA, 22 nt, Mycobacterium bovis subsp bovis AF2122/97
uaucgguggccuccucggccug

SEQ ID NO: 134876 - RNA, 19 nt, Mycobacterium bovis subsp bovis AF2122/97
agaguuacagccucagcga

SEQ ID NO: 134877 - RNA, 22 nt, Mycobacterium bovis subsp bovis AF2122/97
cgucgcguuuuauguguucguc

SEQ ID NO: 134878 - RNA, 22 nt, Mycobacterium bovis subsp bovis AF2122/97
cgaucaucgacauucggccagc

SEQ ID NO: 134879 - RNA, 22 nt, Mycobacterium bovis subsp bovis AF2122/97
ugggcaggugauccucgccggc

SEQ ID NO: 134880 - RNA, 22 nt, Mycobacterium bovis subsp bovis AF2122/97
gcccaucgagauucgcggacug

SEQ ID NO: 134881 - RNA, 22 nt, Mycobacterium bovis subsp bovis AF2122/97
aaacugcaaccacgcaccgaug

SEQ ID NO: 134882 - RNA, 22 nt, Mycobacterium bovis subsp bovis AF2122/97
cgcucggugcugaccggccccu

SEQ ID NO: 134883 - RNA, 22 nt, Mycobacterium bovis subsp bovis AF2122/97
gacguagagcguggugcggaac

SEQ ID NO: 134884 - RNA, 23 nt, Mycobacterium bovis subsp bovis AF2122/97
gccguguacuuccaggagcagcc

SEQ ID NO: 134885 - RNA, 22 nt, Mycobacterium bovis subsp bovis AF2122/97
gucgauauggcggugucgcaca

SEQ ID NO: 134886 - RNA, 22 nt, Mycobacterium bovis subsp bovis AF2122/97
acguugaccgcgguggcgugcu

SEQ ID NO: 134887 - RNA, 23 nt, Mycobacterium bovis subsp bovis AF2122/97
ugcgggugacggucgccgauauc

SEQ ID NO: 134888 - RNA, 23 nt, Mycobacterium bovis subsp bovis AF2122/97
cauccugcuggugcggaccggca

SEQ ID NO: 134889 - RNA, 22 nt, Mycobacterium bovis subsp bovis AF2122/97
ucgacuccuauggugcggagca

SEQ ID NO: 134890 - RNA, 22 nt, Mycobacterium bovis subsp bovis AF2122/97
ccgggcaaccauuacacaguug

SEQ ID NO: 134891 - RNA, 22 nt, Mycobacterium bovis subsp bovis AF2122/97
cgccaacugcucaaccauaccg

SEQ ID NO: 134892 - RNA, 20 nt, Mycobacterium bovis subsp bovis AF2122/97
cgaucagcgucacgccuagu

SEQ ID NO: 134893 - RNA, 22 nt, Mycobacterium bovis subsp bovis AF2122/97
aaggugaacucacggcgagguu

SEQ ID NO: 134894 - RNA, 22 nt, Mycobacterium bovis subsp bovis AF2122/97
gcgccgucgauccuagccgcug

SEQ ID NO: 134895 - RNA, 22 nt, Mycobacterium bovis subsp bovis AF2122/97
cauggcucgcccagcugcgccg

SEQ ID NO: 134896 - RNA, 22 nt, Mycobacterium bovis subsp bovis AF2122/97
gguguucacggcgcacguagcc

SEQ ID NO: 134897 - RNA, 22 nt, Mycobacterium bovis subsp bovis AF2122/97
acgucagaaucucgcugcgcgg

SEQ ID NO: 134898 - RNA, 22 nt, Mycobacterium bovis subsp bovis AF2122/97
ugggaugaguccaccuggcggc

SEQ ID NO: 134899 - RNA, 22 nt, Mycobacterium bovis subsp bovis AF2122/97
gagccacgcaaaggguuagcgu

SEQ ID NO: 134900 - RNA, 22 nt, Mycobacterium bovis subsp bovis AF2122/97
agcggcacugugucgggcgcga

SEQ ID NO: 134901 - RNA, 22 nt, Mycobacterium bovis subsp bovis AF2122/97
uggccgaugugaugcgcaucgc

SEQ ID NO: 134902 - RNA, 19 nt, Mycobacterium bovis subsp bovis AF2122/97
gccaccgcgaaccgucgcc

SEQ ID NO: 134903 - RNA, 22 nt, Mycobacterium bovis subsp bovis AF2122/97
gucggcggacacaucucagucg

SEQ ID NO: 134904 - RNA, 22 nt, Mycobacterium bovis subsp bovis AF2122/97
aacggccuggcggccgcgucga

SEQ ID NO: 134905 - RNA, 22 nt, Mycobacterium bovis subsp bovis AF2122/97
ccggccgaacugacgugcuucg

SEQ ID NO: 134906 - RNA, 22 nt, Mycobacterium bovis subsp bovis AF2122/97
aggucgugcagauagcgcgggu

SEQ ID NO: 134907 - RNA, 22 nt, Mycobacterium bovis subsp bovis AF2122/97
gcugaugcggugacgguggccg

SEQ ID NO: 134908 - RNA, 22 nt, Mycobacterium bovis subsp bovis AF2122/97
ucgaggaugcuggcucgacggc

SEQ ID NO: 134909 - RNA, 22 nt, Mycobacterium bovis subsp bovis AF2122/97
ccgggcgguugagcgugauggu

SEQ ID NO: 134910 - RNA, 22 nt, Mycobacterium bovis subsp bovis AF2122/97
uggcuggucggaccgucagcga

SEQ ID NO: 134911 - RNA, 19 nt, Mycobacterium bovis subsp bovis AF2122/97
auucugcgucugcucggcg

SEQ ID NO: 134912 - RNA, 22 nt, Mycobacterium bovis subsp bovis AF2122/97
ucaggcugggcgaaccugggca

SEQ ID NO: 134913 - RNA, 22 nt, Mycobacterium bovis subsp bovis AF2122/97
gggcggcuuauggcucgucggu

SEQ ID NO: 134914 - RNA, 22 nt, Mycobacterium bovis subsp bovis AF2122/97
ucaccacugccaagaucaccga

SEQ ID NO: 134915 - RNA, 22 nt, Mycobacterium bovis subsp bovis AF2122/97
cagccggugcuaucgguuucga

SEQ ID NO: 134916 - RNA, 22 nt, Mycobacterium bovis subsp bovis AF2122/97
uggguuacccaccgagacugau

SEQ ID NO: 134917 - RNA, 22 nt, Mycobacterium bovis subsp bovis AF2122/97
cccggcuccucagcgggccgcu

SEQ ID NO: 134918 - RNA, 22 nt, Mycobacterium bovis subsp bovis AF2122/97
ggcgguagguccgagcuauccu

SEQ ID NO: 134919 - RNA, 22 nt, Mycobacterium bovis subsp bovis AF2122/97
gcggcgcgccuuggucuuggug

SEQ ID NO: 134920 - RNA, 22 nt, Mycobacterium bovis subsp bovis AF2122/97
ggcgcggcugcugagugagguc

SEQ ID NO: 134921 - RNA, 22 nt, Mycobacterium bovis subsp bovis AF2122/97
gaucugguguguuggcgcgccg

SEQ ID NO: 134922 - RNA, 22 nt, Mycobacterium bovis subsp bovis AF2122/97
aggucgacggguucgauggacu

SEQ ID NO: 134923 - RNA, 22 nt, Mycobacterium bovis subsp bovis AF2122/97
gccgcuggauggcaccggcggu

SEQ ID NO: 134924 - RNA, 19 nt, Mycobacterium bovis subsp bovis AF2122/97
ugcuggacgcagagucagc

SEQ ID NO: 134925 - RNA, 21 nt, Mycobacterium bovis subsp bovis AF2122/97
gcgucggcuugugcgcuccgu

SEQ ID NO: 134926 - RNA, 22 nt, Mycobacterium bovis subsp bovis AF2122/97
accaggucgccgccauaggggu

SEQ ID NO: 134927 - RNA, 22 nt, Mycobacterium bovis subsp bovis AF2122/97
ggucucgagcuugccggccgca

SEQ ID NO: 134928 - RNA, 23 nt, Mycobacterium bovis subsp bovis AF2122/97
gcgcggucccgcucaacaucguu

SEQ ID NO: 134929 - RNA, 22 nt, Mycobacterium bovis subsp bovis AF2122/97
cgcggucgggaguacaugccgu

SEQ ID NO: 134930 - RNA, 22 nt, Mycobacterium bovis subsp bovis AF2122/97
ccgggcugguucuggaucggcg

SEQ ID NO: 134931 - RNA, 22 nt, Mycobacterium bovis subsp bovis AF2122/97
ggucggauucgaggcagccggc

SEQ ID NO: 134932 - RNA, 20 nt, Mycobacterium bovis subsp bovis AF2122/97
gccacguuguaauugacggc

SEQ ID NO: 134933 - RNA, 22 nt, Mycobacterium bovis subsp bovis AF2122/97
guugucgacgaagugcacggcu

SEQ ID NO: 134934 - RNA, 22 nt, Mycobacterium bovis subsp bovis AF2122/97
cugccgauguggcggcgauggu

SEQ ID NO: 134935 - RNA, 23 nt, Mycobacterium bovis subsp bovis AF2122/97
ugucggacgugucaagcgcggca

SEQ ID NO: 134936 - RNA, 22 nt, Mycobacterium bovis subsp bovis AF2122/97
gcaugcgauucugcgucugcuc

SEQ ID NO: 134937 - RNA, 22 nt, Mycobacterium bovis subsp bovis AF2122/97
gggcgguugcucgagcugacgu

SEQ ID NO: 134938 - RNA, 23 nt, Mycobacterium bovis subsp bovis AF2122/97
gcugccgcagcggccggugcugg

SEQ ID NO: 134939 - RNA, 22 nt, Mycobacterium bovis subsp bovis AF2122/97
ccgguguuguagucgccggugu

SEQ ID NO: 134940 - RNA, 22 nt, Mycobacterium bovis subsp bovis AF2122/97
gagaucaacauuuugcaggcaa

SEQ ID NO: 134941 - RNA, 22 nt, Mycobacterium bovis subsp bovis AF2122/97
gcgggcggucgugcgacgaagu

SEQ ID NO: 134942 - RNA, 22 nt, Mycobacterium bovis subsp bovis AF2122/97
aucggcgaguagccgucgcaca

SEQ ID NO: 134943 - RNA, 22 nt, Mycobacterium bovis subsp bovis AF2122/97
cggucgacguuccuagcuuucg

SEQ ID NO: 134944 - RNA, 22 nt, Mycobacterium bovis subsp bovis AF2122/97
ucggcgcgaaucuuucugaagc

SEQ ID NO: 134945 - RNA, 22 nt, Mycobacterium bovis subsp bovis AF2122/97
gccgggcuggccauaauggcgg

SEQ ID NO: 134946 - RNA, 22 nt, Mycobacterium bovis subsp bovis AF2122/97
cgccgaguaccgcgcgauguuc

SEQ ID NO: 134947 - RNA, 22 nt, Mycobacterium bovis subsp bovis AF2122/97
cuggguucgacccaguccaagc

SEQ ID NO: 134948 - RNA, 21 nt, Mycobacterium bovis subsp bovis AF2122/97
cgccccagaugcacgcucggc

SEQ ID NO: 134949 - RNA, 22 nt, Mycobacterium bovis subsp bovis AF2122/97
ucgaagccgaacggcgccgggu

SEQ ID NO: 134950 - RNA, 22 nt, Mycobacterium bovis subsp bovis AF2122/97
gaccaugcggggccggugccgu

SEQ ID NO: 134951 - RNA, 22 nt, Mycobacterium bovis subsp bovis AF2122/97
ggcaugcagcuuggacacgucg

SEQ ID NO: 134952 - RNA, 22 nt, Mycobacterium bovis subsp bovis AF2122/97
ggcgaaggucgcauggucaagc

SEQ ID NO: 134953 - RNA, 22 nt, Mycobacterium bovis subsp bovis AF2122/97
ucgcagccacguuacgcucgcg

SEQ ID NO: 134954 - RNA, 22 nt, Mycobacterium bovis subsp bovis AF2122/97
cgagcagacgcaaaaucgccca

SEQ ID NO: 134955 - RNA, 22 nt, Mycobacterium bovis subsp bovis AF2122/97
ugccggcaucacugucgaucag

SEQ ID NO: 134956 - RNA, 22 nt, Mycobacterium bovis subsp bovis AF2122/97
gcagcugcucgacuugcucgga

SEQ ID NO: 134957 - RNA, 22 nt, Mycobacterium bovis subsp bovis AF2122/97
gucauagccgagcaggugcgcu

SEQ ID NO: 134958 - RNA, 22 nt, Mycobacterium bovis subsp bovis AF2122/97
ggccgacuuggugauuggugug

SEQ ID NO: 134959 - RNA, 22 nt, Mycobacterium bovis subsp bovis AF2122/97
cuguacgugugccuggcgaccu

SEQ ID NO: 134960 - RNA, 22 nt, Mycobacterium bovis subsp bovis AF2122/97
augccgguucuuccgaugcaug

SEQ ID NO: 134961 - RNA, 23 nt, Mycobacterium bovis subsp bovis AF2122/97
ggguccguuucccguggccgccc

SEQ ID NO: 134962 - RNA, 22 nt, Mycobacterium bovis subsp bovis AF2122/97
cguccgguugggauugucgagg

SEQ ID NO: 134963 - RNA, 22 nt, Mycobacterium bovis subsp bovis AF2122/97
gaucguugauccagccggccag

SEQ ID NO: 134964 - RNA, 22 nt, Mycobacterium bovis subsp bovis AF2122/97
ugccgagauauccagcgguacu

SEQ ID NO: 134965 - RNA, 22 nt, Mycobacterium bovis subsp bovis AF2122/97
ggaugcgcgcgguccccgagca

SEQ ID NO: 134966 - RNA, 22 nt, Mycobacterium bovis subsp bovis AF2122/97
ucgcgcccgugcaacagugacu

SEQ ID NO: 134967 - RNA, 22 nt, Mycobacterium bovis subsp bovis AF2122/97
agccgggucgccaggugcuggu

SEQ ID NO: 134968 - RNA, 22 nt, Mycobacterium bovis subsp bovis AF2122/97
gguccgaaggcuucggcaagcc

SEQ ID NO: 134969 - RNA, 22 nt, Mycobacterium bovis subsp bovis AF2122/97
cuucccgacguuucguucggug

SEQ ID NO: 134970 - RNA, 22 nt, Mycobacterium bovis subsp bovis AF2122/97
cggacaccagcggccaccgauu

SEQ ID NO: 134971 - RNA, 23 nt, Mycobacterium bovis subsp bovis AF2122/97
ucguaucucccugucccgcaacg

SEQ ID NO: 134972 - RNA, 23 nt, Mycobacterium bovis subsp bovis AF2122/97
cguggccagggccgaggucaccg

SEQ ID NO: 134973 - RNA, 22 nt, Mycobacterium bovis subsp bovis AF2122/97
ucgcgaggcaacgucgugaucg

SEQ ID NO: 134974 - RNA, 22 nt, Mycobacterium bovis subsp bovis AF2122/97
ucgcagccacguuacgcucgug

SEQ ID NO: 134975 - RNA, 22 nt, Mycobacterium bovis subsp bovis AF2122/97
ugccgccgagaugcagggucgc

SEQ ID NO: 134976 - RNA, 22 nt, Mycobacterium bovis subsp bovis AF2122/97
ccgugcagcgagcgcacuggcc

SEQ ID NO: 134977 - RNA, 22 nt, Mycobacterium bovis subsp bovis AF2122/97
auuugggcgauuuugcgucugc

SEQ ID NO: 134978 - RNA, 19 nt, Mycobacterium bovis subsp bovis AF2122/97
ggccaccggucccggcugc

SEQ ID NO: 134979 - RNA, 21 nt, Mycobacterium bovis subsp bovis AF2122/97
gcccagcaggaaaggccuuug

SEQ ID NO: 134980 - RNA, 22 nt, Mycobacterium bovis subsp bovis AF2122/97
ucuccgcccucaguucacguug

SEQ ID NO: 134981 - RNA, 22 nt, Mycobacterium bovis subsp bovis AF2122/97
ugacaacacggcggugguguga

SEQ ID NO: 134982 - RNA, 20 nt, Mycobacterium bovis subsp bovis AF2122/97
gccugcagaacguugaucuc

SEQ ID NO: 134983 - RNA, 22 nt, Mycobacterium bovis subsp bovis AF2122/97
guccucaagccggcguuccagc

SEQ ID NO: 134984 - RNA, 23 nt, Mycobacterium bovis subsp bovis AF2122/97
uacggcgucacgauguugaaggc

SEQ ID NO: 134985 - RNA, 22 nt, Mycobacterium bovis subsp bovis AF2122/97
cgcgagcgugacggcacugcga

SEQ ID NO: 134986 - RNA, 22 nt, Mycobacterium bovis subsp bovis AF2122/97
cgagcagacgcggaaucgcacu

SEQ ID NO: 134987 - RNA, 21 nt, Mycobacterium bovis subsp bovis AF2122/97
cgucgcggucaccgugcggga

SEQ ID NO: 134988 - RNA, 22 nt, Mycobacterium bovis subsp bovis AF2122/97
ccaccgcgacagucggcgcgcc

SEQ ID NO: 134989 - RNA, 23 nt, Mycobacterium bovis subsp bovis AF2122/97
ucgaaggaaaugacgcaaugacc

SEQ ID NO: 134990 - RNA, 22 nt, Mycobacterium bovis subsp bovis AF2122/97
accgcggacgucuacgccgucc

SEQ ID NO: 134991 - RNA, 22 nt, Mycobacterium bovis subsp bovis AF2122/97
uuugccgaccgcggcaucagcu

SEQ ID NO: 134992 - RNA, 22 nt, Mycobacterium bovis subsp bovis AF2122/97
gucggcuugcucgguguuggug

SEQ ID NO: 134993 - RNA, 22 nt, Mycobacterium bovis subsp bovis AF2122/97
uugucaaaguuggaggcgggau

SEQ ID NO: 134994 - RNA, 22 nt, Mycobacterium bovis subsp bovis AF2122/97
gaucgaaugcguaccgcggcuu

SEQ ID NO: 134995 - RNA, 22 nt, Mycobacterium bovis subsp bovis AF2122/97
cgucguccuuuccgugggggua

SEQ ID NO: 134996 - RNA, 22 nt, Mycobacterium bovis subsp bovis AF2122/97
accaucgucaugcgcgccggag

SEQ ID NO: 134997 - RNA, 22 nt, Mycobacterium bovis subsp bovis AF2122/97
ccagcgauuggcggcgacuggc

SEQ ID NO: 134998 - RNA, 22 nt, Mycobacterium bovis subsp bovis AF2122/97
guucagggcaucgguccgugcc

SEQ ID NO: 134999 - RNA, 22 nt, Mycobacterium bovis subsp bovis AF2122/97
augggucgauucggcggugccc

SEQ ID NO: 135000 - RNA, 22 nt, Mycobacterium bovis subsp bovis AF2122/97
ucccgggucgugccgacccggg

SEQ ID NO: 135001 - RNA, 22 nt, Mycobacterium bovis subsp bovis AF2122/97
gagcagacgcgaaagcacccca

SEQ ID NO: 135002 - RNA, 22 nt, Mycobacterium bovis subsp bovis AF2122/97
ugcucuuguccagugcggcgcc

SEQ ID NO: 135003 - RNA, 22 nt, Mycobacterium bovis subsp bovis AF2122/97
uccgugugucacgacgucgccu

SEQ ID NO: 135004 - RNA, 22 nt, Mycobacterium bovis subsp bovis AF2122/97
gccgaguucaucggccucgacg

SEQ ID NO: 135005 - RNA, 18 nt, Mycobacterium bovis subsp bovis AF2122/97
agggugugauguggcguc

SEQ ID NO: 135006 - RNA, 22 nt, Mycobacterium bovis subsp bovis AF2122/97
gucgccggcaucaccccaugac

SEQ ID NO: 135007 - RNA, 22 nt, Mycobacterium bovis subsp bovis AF2122/97
ucgccggucagcgugcagguag

SEQ ID NO: 135008 - RNA, 22 nt, Mycobacterium bovis subsp bovis AF2122/97
gggucuggcgguggacacccug

SEQ ID NO: 135009 - RNA, 21 nt, Mycobacterium bovis subsp bovis AF2122/97
gccgccgcgacgaccgucacc

SEQ ID NO: 135010 - RNA, 22 nt, Mycobacterium bovis subsp bovis AF2122/97
cgaguucggcaucacccgcaug

SEQ ID NO: 135011 - RNA, 22 nt, Mycobacterium bovis subsp bovis AF2122/97
ugggcuucugggacaucgcggu

SEQ ID NO: 135012 - RNA, 22 nt, Mycobacterium bovis subsp bovis AF2122/97
aacgagugcuggguggcagcga

SEQ ID NO: 135013 - RNA, 22 nt, Mycobacterium bovis subsp bovis AF2122/97
ggccgcagucacauggcaagga

SEQ ID NO: 135014 - RNA, 23 nt, Mycobacterium bovis subsp bovis AF2122/97
ugggcucaggauguggcugcgau

SEQ ID NO: 135015 - RNA, 22 nt, Mycobacterium bovis subsp bovis AF2122/97
ugggccuccugagcagcggcuu

SEQ ID NO: 135016 - RNA, 23 nt, Mycobacterium bovis subsp bovis AF2122/97
agguugccgaugcguaugguguc

SEQ ID NO: 135017 - RNA, 22 nt, Mycobacterium bovis subsp bovis AF2122/97
cacugguugucccaugggcggu

SEQ ID NO: 135018 - RNA, 21 nt, Mycobacterium bovis subsp bovis AF2122/97
ucgccguggcguuacgcucgc

SEQ ID NO: 135019 - RNA, 22 nt, Mycobacterium bovis subsp bovis AF2122/97
uggcggucgauccgucgggugc

SEQ ID NO: 135020 - RNA, 22 nt, Mycobacterium bovis subsp bovis AF2122/97
cgucgccaacgccgucaagcuc

SEQ ID NO: 135021 - RNA, 22 nt, Mycobacterium bovis subsp bovis AF2122/97
uugacucugcauccaccacgca

SEQ ID NO: 135022 - RNA, 22 nt, Mycobacterium bovis subsp bovis AF2122/97
ggucguucguggucgcgaugau

SEQ ID NO: 135023 - RNA, 22 nt, Mycobacterium bovis subsp bovis AF2122/97
uucaccggugcucuccgcgauc

SEQ ID NO: 135024 - RNA, 22 nt, Mycobacterium bovis subsp bovis AF2122/97
ugugaucggguugcggaucgcc

SEQ ID NO: 135025 - RNA, 22 nt, Mycobacterium bovis subsp bovis AF2122/97
uccuuuccgucgaugcggaagc

SEQ ID NO: 135026 - RNA, 22 nt, Mycobacterium bovis subsp bovis AF2122/97
ugggggugaucaacgccagcaa

SEQ ID NO: 135027 - RNA, 22 nt, Mycobacterium bovis subsp bovis AF2122/97
ugguggcugugucgaccgggaa

SEQ ID NO: 135028 - RNA, 22 nt, Mycobacterium bovis subsp bovis AF2122/97
aucagcggggacuugguuucgg

SEQ ID NO: 135029 - RNA, 22 nt, Mycobacterium bovis subsp bovis AF2122/97
aaccgcuacaaaugaaguuggu

SEQ ID NO: 135030 - RNA, 22 nt, Mycobacterium bovis subsp bovis AF2122/97
agguggcagauguugcgcucgc

SEQ ID NO: 135031 - RNA, 22 nt, Mycobacterium bovis subsp bovis AF2122/97
gguccucugauccgcaccgcau

SEQ ID NO: 135032 - RNA, 22 nt, Mycobacterium bovis subsp bovis AF2122/97
ugcaccaugggcggcaagcgcu

SEQ ID NO: 135033 - RNA, 22 nt, Mycobacterium bovis subsp bovis AF2122/97
acggguugcgggugggaccgua

SEQ ID NO: 135034 - RNA, 22 nt, Mycobacterium bovis subsp bovis AF2122/97
gaugcuggagguguugagcacc

SEQ ID NO: 135035 - RNA, 22 nt, Mycobacterium bovis subsp bovis AF2122/97
ugcggcucgucuacggcgggca

SEQ ID NO: 135036 - RNA, 22 nt, Mycobacterium bovis subsp bovis AF2122/97
acuggucuguaaucggugcccg

SEQ ID NO: 135037 - RNA, 22 nt, Mycobacterium bovis subsp bovis AF2122/97
gcccagcgguucauugccgacg

SEQ ID NO: 135038 - RNA, 22 nt, Mycobacterium bovis subsp bovis AF2122/97
aaguccagcagaucgaucucgc

SEQ ID NO: 135039 - RNA, 22 nt, Mycobacterium bovis subsp bovis AF2122/97
ggucagcacgcaugugcggugg

SEQ ID NO: 135040 - RNA, 20 nt, Mycobacterium bovis subsp bovis AF2122/97
gaguggagucuggucggccg

SEQ ID NO: 135041 - RNA, 19 nt, Mycobacterium bovis subsp bovis AF2122/97
ucagcuguacucgaugaau

SEQ ID NO: 135042 - RNA, 22 nt, Mycobacterium bovis subsp bovis AF2122/97
uagcuugucgaccgugcggucg

SEQ ID NO: 135043 - RNA, 22 nt, Mycobacterium bovis subsp bovis AF2122/97
ggugcagcggucagcaguccga

SEQ ID NO: 135044 - RNA, 22 nt, Mycobacterium bovis subsp bovis AF2122/97
ugcgggaguugcgggauugaug

SEQ ID NO: 135045 - RNA, 22 nt, Mycobacterium bovis subsp bovis AF2122/97
gcuggccagggcguuuccgcuc

SEQ ID NO: 135046 - RNA, 22 nt, Mycobacterium bovis subsp bovis AF2122/97
ggcggaguccggcagcgucaac

SEQ ID NO: 135047 - RNA, 22 nt, Mycobacterium bovis subsp bovis AF2122/97
ugcagucaauggugucucgucg

SEQ ID NO: 135048 - RNA, 22 nt, Mycobacterium bovis subsp bovis AF2122/97
gcccggagauguaguccucggu

SEQ ID NO: 135049 - RNA, 22 nt, Mycobacterium bovis subsp bovis AF2122/97
accgcccgucgggcgcgcuguu

SEQ ID NO: 135050 - RNA, 21 nt, Mycobacterium bovis subsp bovis AF2122/97
acuucgaucacgcggcgcggu

SEQ ID NO: 135051 - RNA, 22 nt, Mycobacterium bovis subsp bovis AF2122/97
gcaccccagagcacugauacgc

SEQ ID NO: 135052 - RNA, 22 nt, Mycobacterium bovis subsp bovis AF2122/97
ugcacccgcgauaucgcaguua

SEQ ID NO: 135053 - RNA, 22 nt, Mycobacterium bovis subsp bovis AF2122/97
ucgccaucguugcugauccccg

SEQ ID NO: 135054 - RNA, 22 nt, Mycobacterium bovis subsp bovis AF2122/97
cggucgcugaugcuggauguga

SEQ ID NO: 135055 - RNA, 22 nt, Mycobacterium bovis subsp bovis AF2122/97
gccgugaguucacguucggcgg

SEQ ID NO: 135056 - RNA, 22 nt, Mycobacterium bovis subsp bovis AF2122/97
gcggguguugacgauggaacgg

SEQ ID NO: 135057 - RNA, 22 nt, Mycobacterium bovis subsp bovis AF2122/97
ggccaucgcugcuugcugcgcc

SEQ ID NO: 135058 - RNA, 22 nt, Mycobacterium bovis subsp bovis AF2122/97
caucgcgguggugcgcgcuucg

SEQ ID NO: 135059 - RNA, 22 nt, Mycobacterium bovis subsp bovis AF2122/97
caccgguggucgccgagccacc

SEQ ID NO: 135060 - RNA, 22 nt, Mycobacterium bovis subsp bovis AF2122/97
ccgaucaaugggcgcccgguca

SEQ ID NO: 135061 - RNA, 22 nt, Mycobacterium bovis subsp bovis AF2122/97
gccagguugacguugguuucgg

SEQ ID NO: 135062 - RNA, 21 nt, Mycobacterium bovis subsp bovis AF2122/97
agcguugccagguagcgggca

SEQ ID NO: 135063 - RNA, 22 nt, Mycobacterium bovis subsp bovis AF2122/97
ugccagccgccgacgagcagca

SEQ ID NO: 135064 - RNA, 22 nt, Mycobacterium bovis subsp bovis AF2122/97
cgcgacgggaucaccgaccugc

SEQ ID NO: 135065 - RNA, 23 nt, Mycobacterium bovis subsp bovis AF2122/97
ugcgcggcugccgucuccugguc

SEQ ID NO: 135066 - RNA, 22 nt, Mycobacterium bovis subsp bovis AF2122/97
caacuucauuuguagcgguuac

SEQ ID NO: 135067 - RNA, 22 nt, Mycobacterium bovis subsp bovis AF2122/97
agugaucggcaccgcuuuggcg

SEQ ID NO: 135068 - RNA, 22 nt, Mycobacterium bovis subsp bovis AF2122/97
cggagcgacgucgcgaugguca

SEQ ID NO: 135069 - RNA, 22 nt, Mycobacterium bovis subsp bovis AF2122/97
gaucgccgauaucgacggccug

SEQ ID NO: 135070 - RNA, 22 nt, Mycobacterium bovis subsp bovis AF2122/97
ggcgagagggagggccaugugg

SEQ ID NO: 135071 - RNA, 19 nt, Mycobacterium bovis subsp bovis AF2122/97
cgcgcuaaugucgauuucg

SEQ ID NO: 135072 - RNA, 22 nt, Mycobacterium bovis subsp bovis AF2122/97
uuugcggcggcuguccgcagac

SEQ ID NO: 135073 - RNA, 22 nt, Mycobacterium bovis subsp bovis AF2122/97
ugccuuccaacggcggcgguuu

SEQ ID NO: 135074 - RNA, 22 nt, Mycobacterium bovis subsp bovis AF2122/97
gaugacagcgaggugcacucgg

SEQ ID NO: 135075 - RNA, 22 nt, Mycobacterium bovis subsp bovis AF2122/97
caugucgcugcuguacaucggc

SEQ ID NO: 135076 - RNA, 22 nt, Mycobacterium bovis subsp bovis AF2122/97
uuccacggacucgauucgcugc

SEQ ID NO: 135077 - RNA, 22 nt, Mycobacterium bovis subsp bovis AF2122/97
cggcgucaaccaggcggucgcu

SEQ ID NO: 135078 - RNA, 22 nt, Mycobacterium bovis subsp bovis AF2122/97
ccggcugcgcgcauccuggcga

SEQ ID NO: 135079 - RNA, 22 nt, Mycobacterium bovis subsp bovis AF2122/97
gcggguuuucggcuccgugcga

SEQ ID NO: 135080 - RNA, 22 nt, Mycobacterium bovis subsp bovis AF2122/97
ucgcccagcgagugcgccuggu

SEQ ID NO: 135081 - RNA, 22 nt, Mycobacterium bovis subsp bovis AF2122/97
cgcuaugcugacugauuccgcg

SEQ ID NO: 135082 - RNA, 22 nt, Mycobacterium bovis subsp bovis AF2122/97
uuccaucaccaaugcgcugggc

SEQ ID NO: 135083 - RNA, 22 nt, Mycobacterium bovis subsp bovis AF2122/97
cgaccgucgucgguguuggcgg

SEQ ID NO: 135084 - RNA, 22 nt, Mycobacterium bovis subsp bovis AF2122/97
cgagcguaaccgcacugcgaaa

SEQ ID NO: 135085 - RNA, 22 nt, Mycobacterium bovis subsp bovis AF2122/97
cggucccgcggggacagccgag

SEQ ID NO: 135086 - RNA, 23 nt, Mycobacterium bovis subsp bovis AF2122/97
cgcgcaccucccaacggucuugg

SEQ ID NO: 135087 - RNA, 22 nt, Mycobacterium bovis subsp bovis AF2122/97
acaccgguguugacgaugccgg

SEQ ID NO: 135088 - RNA, 22 nt, Mycobacterium bovis subsp bovis AF2122/97
gaugcgauuccgcgucugcucg

SEQ ID NO: 135089 - RNA, 22 nt, Mycobacterium bovis subsp bovis AF2122/97
ccgcgccuggucgcagguugcc

SEQ ID NO: 135090 - RNA, 22 nt, Mycobacterium bovis subsp bovis AF2122/97
aagaucaacaguggugcccaca

SEQ ID NO: 135091 - RNA, 22 nt, Mycobacterium bovis subsp bovis AF2122/97
gccggccuggauucgauauggg

SEQ ID NO: 135092 - RNA, 22 nt, Mycobacterium bovis subsp bovis AF2122/97
ucgcggcaugggaucacugggu

SEQ ID NO: 135093 - RNA, 22 nt, Mycobacterium bovis subsp bovis AF2122/97
augucguuaugagaacaucgcc

SEQ ID NO: 135094 - RNA, 22 nt, Mycobacterium bovis subsp bovis AF2122/97
cggacggcucagguagucguuc

SEQ ID NO: 135095 - RNA, 22 nt, Mycobacterium bovis subsp bovis AF2122/97
ccgcaggccgagcugcucccga

SEQ ID NO: 135096 - RNA, 22 nt, Mycobacterium bovis subsp bovis AF2122/97
cgguugacgggcguccgcgccg

SEQ ID NO: 135097 - RNA, 22 nt, Mycobacterium bovis subsp bovis AF2122/97
aaucgaaugaaagccguagguu

SEQ ID NO: 135098 - RNA, 22 nt, Mycobacterium bovis subsp bovis AF2122/97
cggccguaucgucgugcagauc

SEQ ID NO: 135099 - RNA, 22 nt, Mycobacterium bovis subsp bovis AF2122/97
ggccucgucgaaggucaggcgu

SEQ ID NO: 135100 - RNA, 22 nt, Mycobacterium bovis subsp bovis AF2122/97
ucuucgaucugauugccgaacc

SEQ ID NO: 135101 - RNA, 22 nt, Mycobacterium bovis subsp bovis AF2122/97
cgcgucauuggcgcggguuaug

SEQ ID NO: 135102 - RNA, 21 nt, Mycobacterium bovis subsp bovis AF2122/97
agcucggccaaaagcgccggc

SEQ ID NO: 135103 - RNA, 23 nt, Mycobacterium bovis subsp bovis AF2122/97
cgcugcgaucgaagacguccugc

SEQ ID NO: 135104 - RNA, 22 nt, Mycobacterium bovis subsp bovis AF2122/97
ccgguguugccgaugccggugu

SEQ ID NO: 135105 - RNA, 22 nt, Mycobacterium bovis subsp bovis AF2122/97
cgugcgggggcuuaugcgucug

SEQ ID NO: 135106 - RNA, 22 nt, Mycobacterium bovis subsp bovis AF2122/97
gugccgagcgugcaucuggggc

SEQ ID NO: 135107 - RNA, 22 nt, Mycobacterium bovis subsp bovis AF2122/97
ugcccgugggcgugcguaggcu

SEQ ID NO: 135108 - RNA, 22 nt, Mycobacterium bovis subsp bovis AF2122/97
gguauucgagccgucaccguug

SEQ ID NO: 135109 - RNA, 22 nt, Mycobacterium bovis subsp bovis AF2122/97
ugcgacucugcgucugcucgcg

SEQ ID NO: 135110 - RNA, 22 nt, Mycobacterium bovis subsp bovis AF2122/97
gcgagcccgggcuugccgacga

SEQ ID NO: 135111 - RNA, 22 nt, Mycobacterium bovis subsp bovis AF2122/97
uccgccgugaguucacguucgg

SEQ ID NO: 135112 - RNA, 22 nt, Mycobacterium bovis subsp bovis AF2122/97
gagcagacgcagaaguccccga

SEQ ID NO: 135113 - RNA, 22 nt, Mycobacterium bovis subsp bovis AF2122/97
ugucgggggcuuuugcgucuac

SEQ ID NO: 135114 - RNA, 22 nt, Mycobacterium bovis subsp bovis AF2122/97
ucgggugcuacgacuuugccgc

SEQ ID NO: 135115 - RNA, 22 nt, Mycobacterium bovis subsp bovis AF2122/97
aaucuggugaaugcaccccaua

SEQ ID NO: 135116 - RNA, 22 nt, Mycobacterium bovis subsp bovis AF2122/97
cgcccacgagccaccgcggcug

SEQ ID NO: 135117 - RNA, 22 nt, Mycobacterium bovis subsp bovis AF2122/97
aaccagcgaaugucguugccuc

SEQ ID NO: 135118 - RNA, 22 nt, Mycobacterium bovis subsp bovis AF2122/97
uaaccggacgugaccagaucac

SEQ ID NO: 135119 - RNA, 22 nt, Mycobacterium bovis subsp bovis AF2122/97
cugucguuguagaccggcccgu

SEQ ID NO: 135120 - RNA, 22 nt, Mycobacterium bovis subsp bovis AF2122/97
uuugcgucgagaucgacggcag

SEQ ID NO: 135121 - RNA, 22 nt, Mycobacterium bovis subsp bovis AF2122/97
ucgcgucgccagauucacaauc

SEQ ID NO: 135122 - RNA, 21 nt, Mycobacterium bovis subsp bovis AF2122/97
gccaacucaggcggacgaauc

SEQ ID NO: 135123 - RNA, 22 nt, Mycobacterium bovis subsp bovis AF2122/97
gccgugggacccucacugccug

SEQ ID NO: 135124 - RNA, 22 nt, Mycobacterium bovis subsp bovis AF2122/97
uuccuugugucaucgggcaggu

SEQ ID NO: 135125 - RNA, 22 nt, Mycobacterium bovis subsp bovis AF2122/97
cgccgccgugguugcacguucg

SEQ ID NO: 135126 - RNA, 22 nt, Mycobacterium bovis subsp bovis AF2122/97
agccgggcaucuggaaguggcu

SEQ ID NO: 135127 - RNA, 22 nt, Mycobacterium bovis subsp bovis AF2122/97
ugcaccugcggaccaugcauca

SEQ ID NO: 135128 - RNA, 22 nt, Mycobacterium bovis subsp bovis AF2122/97
cagacgcaaaagcccccgcacg

SEQ ID NO: 135129 - RNA, 20 nt, Mycobacterium bovis subsp bovis AF2122/97
gcgauucugauuugcccagc

SEQ ID NO: 135130 - RNA, 22 nt, Mycobacterium bovis subsp bovis AF2122/97
gaccauugcacgccuuugaggu

SEQ ID NO: 135131 - RNA, 22 nt, Mycobacterium bovis subsp bovis AF2122/97
ccucuaccuugugggcaccucc

SEQ ID NO: 135132 - RNA, 22 nt, Mycobacterium bovis subsp bovis AF2122/97
gcccgugcggauccaguccggu

SEQ ID NO: 135133 - RNA, 22 nt, Mycobacterium bovis subsp bovis AF2122/97
ggcgaucgguugucccgcgaca

SEQ ID NO: 135134 - RNA, 22 nt, Mycobacterium bovis subsp bovis AF2122/97
guggguggaacacggcuaggug

SEQ ID NO: 135135 - RNA, 22 nt, Mycobacterium bovis subsp bovis AF2122/97
accggguuggcguccagcgcgg

SEQ ID NO: 135136 - RNA, 22 nt, Mycobacterium bovis subsp bovis AF2122/97
uucgcgucgguggugcugaagu

SEQ ID NO: 135137 - RNA, 22 nt, Mycobacterium bovis subsp bovis AF2122/97
gacaccgguguugacgaugccg

SEQ ID NO: 135138 - RNA, 22 nt, Mycobacterium bovis subsp bovis AF2122/97
cgaagaacugguugccgucgac

SEQ ID NO: 135139 - RNA, 19 nt, Mycobacterium bovis subsp bovis AF2122/97
cguggcacuggaucgcggu

SEQ ID NO: 135140 - RNA, 22 nt, Mycobacterium bovis subsp bovis AF2122/97
caacuucgacgcugacggcuag

SEQ ID NO: 135141 - RNA, 22 nt, Mycobacterium bovis subsp bovis AF2122/97
gaacugagccgccgucagcgcc

SEQ ID NO: 135142 - RNA, 22 nt, Mycobacterium bovis subsp bovis AF2122/97
cagcggguuaggcagugcugcg

SEQ ID NO: 135143 - RNA, 22 nt, Mycobacterium bovis subsp bovis AF2122/97
acuggguuccggcaucgaucgc

SEQ ID NO: 135144 - RNA, 22 nt, Mycobacterium bovis subsp bovis AF2122/97
uuuggccuggcaugcguggaac

SEQ ID NO: 135145 - RNA, 22 nt, Mycobacterium bovis subsp bovis AF2122/97
cccgccugggugccgcuaccgg

SEQ ID NO: 135146 - RNA, 22 nt, Mycobacterium bovis subsp bovis AF2122/97
acggccggaguccagccagucg

SEQ ID NO: 135147 - RNA, 19 nt, Mycobacterium bovis subsp bovis AF2122/97
gguauucccgccacgcgga

SEQ ID NO: 135148 - RNA, 18 nt, Mycobacterium bovis subsp bovis AF2122/97
ucaucgagcacggguuga

SEQ ID NO: 135149 - RNA, 23 nt, Mycobacterium bovis subsp bovis AF2122/97
ugucguaugauucacgcucggcg

SEQ ID NO: 135150 - RNA, 22 nt, Mycobacterium bovis subsp bovis AF2122/97
ggauucgggucuuggugagccg

SEQ ID NO: 135151 - RNA, 22 nt, Mycobacterium bovis subsp bovis AF2122/97
gcugcagcggcucguggguggu

SEQ ID NO: 135152 - RNA, 20 nt, Mycobacterium bovis subsp bovis AF2122/97
caacggcgagcuucccgcac

SEQ ID NO: 135153 - RNA, 22 nt, Mycobacterium bovis subsp bovis AF2122/97
ggcgggacgcgguguacggugc

SEQ ID NO: 135154 - RNA, 21 nt, Mycobacterium bovis subsp bovis AF2122/97
agcgcgacuucacuuugugga

SEQ ID NO: 135155 - RNA, 22 nt, Mycobacterium bovis subsp bovis AF2122/97
ucgaugucggagcgcacugcgu

SEQ ID NO: 135156 - RNA, 22 nt, Mycobacterium bovis subsp bovis AF2122/97
cauggugggcgcgggccagcac

SEQ ID NO: 135157 - RNA, 20 nt, Mycobacterium bovis subsp bovis AF2122/97
acgagccgcguugccggcgg

SEQ ID NO: 135158 - RNA, 22 nt, Mycobacterium bovis subsp bovis AF2122/97
cggccgccgaaucgaugcgggc

SEQ ID NO: 135159 - RNA, 22 nt, Mycobacterium bovis subsp bovis AF2122/97
cggugaccgcgacccgcgcggu

SEQ ID NO: 135160 - RNA, 22 nt, Mycobacterium bovis subsp bovis AF2122/97
ccgcgaucuccuccucgcugag

SEQ ID NO: 135161 - RNA, 22 nt, Mycobacterium bovis subsp bovis AF2122/97
ugggguggugccgcugcucgag

SEQ ID NO: 135162 - RNA, 22 nt, Mycobacterium bovis subsp bovis AF2122/97
gaucuagcgaacgugggaucga

SEQ ID NO: 135163 - RNA, 22 nt, Mycobacterium bovis subsp bovis AF2122/97
accucgacgagcaccauccggu

SEQ ID NO: 135164 - RNA, 20 nt, Mycobacterium bovis subsp bovis AF2122/97
ugucuccggcgguguccauc

SEQ ID NO: 135165 - RNA, 22 nt, Mycobacterium bovis subsp bovis AF2122/97
agcugcuucuccccuuggucga

SEQ ID NO: 135166 - RNA, 22 nt, Mycobacterium bovis subsp bovis AF2122/97
cgagcguaacccggcugcgaaa

SEQ ID NO: 135167 - RNA, 22 nt, Mycobacterium bovis subsp bovis AF2122/97
agacgcuguugucgcgcccguu

SEQ ID NO: 135168 - RNA, 22 nt, Mycobacterium bovis subsp bovis AF2122/97
caagaaagaaauuaucgucacc

SEQ ID NO: 135169 - RNA, 22 nt, Mycobacterium bovis subsp bovis AF2122/97
gcuggccaguucgcccugaccu

SEQ ID NO: 135170 - RNA, 23 nt, Mycobacterium bovis subsp bovis AF2122/97
ccaugucgacgugaucgcugugg

SEQ ID NO: 135171 - RNA, 22 nt, Mycobacterium bovis subsp bovis AF2122/97
ucggugcggaaucguugugagu

SEQ ID NO: 135172 - RNA, 22 nt, Mycobacterium bovis subsp bovis AF2122/97
uugucgccgugcaccaccugga

SEQ ID NO: 135173 - RNA, 21 nt, Mycobacterium bovis subsp bovis AF2122/97
ccgugcugacccuguacccgc

SEQ ID NO: 135174 - RNA, 22 nt, Mycobacterium bovis subsp bovis AF2122/97
cgucgccaucagaaggucaucg

SEQ ID NO: 135175 - RNA, 22 nt, Mycobacterium bovis subsp bovis AF2122/97
gcccgauuuccucggugaaugg

SEQ ID NO: 135176 - RNA, 22 nt, Mycobacterium bovis subsp bovis AF2122/97
ugcuccuggugaugcgcuucac

SEQ ID NO: 135177 - RNA, 22 nt, Mycobacterium bovis subsp bovis AF2122/97
ugggcgauucugcgucugcucg

SEQ ID NO: 135178 - RNA, 22 nt, Mycobacterium bovis subsp bovis AF2122/97
aucaacacgcugcuguuguaca

SEQ ID NO: 135179 - RNA, 22 nt, Mycobacterium bovis subsp bovis AF2122/97
gagcagacgcaaaagcccccga

SEQ ID NO: 135180 - RNA, 22 nt, Mycobacterium bovis subsp bovis AF2122/97
gugccguucgacugcccguaga

SEQ ID NO: 135181 - RNA, 22 nt, Mycobacterium bovis subsp bovis AF2122/97
ccgcaucgagcgggcaugauug

SEQ ID NO: 135182 - RNA, 22 nt, Mycobacterium bovis subsp bovis AF2122/97
gcggaggagcgugcuucgauuc

SEQ ID NO: 135183 - RNA, 22 nt, Mycobacterium bovis subsp bovis AF2122/97
gccugcgccuugauccaggcgu

SEQ ID NO: 135184 - RNA, 22 nt, Mycobacterium bovis subsp bovis AF2122/97
ugcuggcccgagaaccgaugac

SEQ ID NO: 135185 - RNA, 22 nt, Mycobacterium bovis subsp bovis AF2122/97
ugcuagcggcccucauucaaac

SEQ ID NO: 135186 - RNA, 22 nt, Mycobacterium bovis subsp bovis AF2122/97
gaucaguccggcccgggcgaua

SEQ ID NO: 135187 - RNA, 22 nt, Mycobacterium bovis subsp bovis AF2122/97
auugcguggacugaugcgggug

SEQ ID NO: 135188 - RNA, 22 nt, Mycobacterium bovis subsp bovis AF2122/97
aguugccgaggauguugggcuu

SEQ ID NO: 135189 - RNA, 22 nt, Mycobacterium bovis subsp bovis AF2122/97
agucgauguugucgccacggcu

SEQ ID NO: 135190 - RNA, 22 nt, Mycobacterium bovis subsp bovis AF2122/97
ccguaucaccggucgcugacaa

SEQ ID NO: 135191 - RNA, 22 nt, Mycobacterium bovis subsp bovis AF2122/97
ccgaacgugaacugagggcgga

SEQ ID NO: 135192 - RNA, 22 nt, Mycobacterium bovis subsp bovis AF2122/97
ugcugugcaccgaugucgguuc

SEQ ID NO: 135193 - RNA, 22 nt, Mycobacterium bovis subsp bovis AF2122/97
cguugacucugcguccaccacg

SEQ ID NO: 135194 - RNA, 22 nt, Mycobacterium bovis subsp bovis AF2122/97
ccuccguuggccccggugccgg

SEQ ID NO: 135195 - RNA, 22 nt, Mycobacterium bovis subsp bovis AF2122/97
gugccgacgacgugguguucag

SEQ ID NO: 135196 - RNA, 22 nt, Mycobacterium bovis subsp bovis AF2122/97
cgcuugaugcccggucggcaag

SEQ ID NO: 135197 - RNA, 22 nt, Mycobacterium bovis subsp bovis AF2122/97
cugggcauugaacgcgcgcugc

SEQ ID NO: 135198 - RNA, 22 nt, Mycobacterium bovis subsp bovis AF2122/97
aucuggacgugcacgccaacgg

SEQ ID NO: 135199 - RNA, 22 nt, Mycobacterium bovis subsp bovis AF2122/97
acgucgaagacgaucaggcguu

SEQ ID NO: 135200 - RNA, 22 nt, Mycobacterium bovis subsp bovis AF2122/97
gcagugcgauucugcgucugcu

SEQ ID NO: 135201 - RNA, 22 nt, Mycobacterium bovis subsp bovis AF2122/97
gcgaugcgcgauuacgucgaac

SEQ ID NO: 135202 - RNA, 22 nt, Mycobacterium bovis subsp bovis AF2122/97
ugaacgggugcguugaucgcau

SEQ ID NO: 135203 - RNA, 22 nt, Mycobacterium bovis subsp bovis AF2122/97
ucccgguucuucaagaaacacu

SEQ ID NO: 135204 - RNA, 22 nt, Mycobacterium bovis subsp bovis AF2122/97
gcggcaguucgccaguggcgag

SEQ ID NO: 135205 - RNA, 22 nt, Mycobacterium bovis subsp bovis AF2122/97
acgcggucagcuucaggcauug

SEQ ID NO: 135206 - RNA, 22 nt, Mycobacterium bovis subsp bovis AF2122/97
uuguggcacaagucgcaucaaa

SEQ ID NO: 135207 - RNA, 22 nt, Mycobacterium bovis subsp bovis AF2122/97
ugccgcuucggcgugucgccga

SEQ ID NO: 135208 - RNA, 22 nt, Mycobacterium bovis subsp bovis AF2122/97
ucgcggcgauguggagcacgau

SEQ ID NO: 135209 - RNA, 22 nt, Mycobacterium bovis subsp bovis AF2122/97
uccucagucguugacagcgcuc

SEQ ID NO: 135210 - RNA, 22 nt, Mycobacterium bovis subsp bovis AF2122/97
ucgcucgcaucgcgaucuuuua

SEQ ID NO: 135211 - RNA, 22 nt, Mycobacterium bovis subsp bovis AF2122/97
aacgauguugggccggaaaugc

SEQ ID NO: 135212 - RNA, 22 nt, Mycobacterium bovis subsp bovis AF2122/97
uacucggcggacaucggaugcg

SEQ ID NO: 135213 - RNA, 22 nt, Mycobacterium bovis subsp bovis AF2122/97
uggccaagcggaccgucggcau

SEQ ID NO: 135214 - RNA, 22 nt, Mycobacterium bovis subsp bovis AF2122/97
uguuaucgacugauaaccgauu

SEQ ID NO: 135215 - RNA, 22 nt, Mycobacterium bovis subsp bovis AF2122/97
acagccaacgaguucgucgaca

SEQ ID NO: 135216 - RNA, 22 nt, Mycobacterium bovis subsp bovis AF2122/97
cacaccgcgaacggugucgauc

SEQ ID NO: 135217 - RNA, 22 nt, Mycobacterium bovis subsp bovis AF2122/97
gaccggaaaccuaccagcaggc

SEQ ID NO: 135218 - RNA, 22 nt, Mycobacterium bovis subsp bovis AF2122/97
cgccgagcgugaacugagggcg

SEQ ID NO: 135219 - RNA, 19 nt, Mycobacterium bovis subsp bovis AF2122/97
gccggccacuccgucggcg

SEQ ID NO: 135220 - RNA, 22 nt, Mycobacterium bovis subsp bovis AF2122/97
gcgguaguagaggucccgguag

SEQ ID NO: 135221 - RNA, 22 nt, Mycobacterium bovis subsp bovis AF2122/97
gccgcaccgacuaccaccgacu

SEQ ID NO: 135222 - RNA, 22 nt, Mycobacterium bovis subsp bovis AF2122/97
guguugcgcucgaugagccugg

SEQ ID NO: 135223 - RNA, 22 nt, Mycobacterium bovis subsp bovis AF2122/97
cugacgucgaucucgaugcguc

SEQ ID NO: 135224 - RNA, 22 nt, Mycobacterium bovis subsp bovis AF2122/97
aaccgagcggccagcaccugca

SEQ ID NO: 135225 - RNA, 22 nt, Mycobacterium bovis subsp bovis AF2122/97
ggggucaacaucgagcugaucu

SEQ ID NO: 135226 - RNA, 22 nt, Mycobacterium bovis subsp bovis AF2122/97
gcucgaacccggguuucggcga

SEQ ID NO: 135227 - RNA, 22 nt, Mycobacterium bovis subsp bovis AF2122/97
cuacgccgcgguguucaucgac

SEQ ID NO: 135228 - RNA, 22 nt, Mycobacterium bovis subsp bovis AF2122/97
aacggugaggagaucgcggcca

SEQ ID NO: 135229 - RNA, 22 nt, Mycobacterium bovis subsp bovis AF2122/97
gaggacgggucuugaccgaggc

SEQ ID NO: 135230 - RNA, 22 nt, Mycobacterium bovis subsp bovis AF2122/97
gucgcggacggggcagagcuag

SEQ ID NO: 135231 - RNA, 22 nt, Mycobacterium bovis subsp bovis AF2122/97
caacgccguuucggcgaucgcu

SEQ ID NO: 135232 - RNA, 22 nt, Mycobacterium bovis subsp bovis AF2122/97
aucgaggaaugcgccgcguacg

SEQ ID NO: 135233 - RNA, 22 nt, Mycobacterium bovis subsp bovis AF2122/97
ggcuuguucggugcggccgguc

SEQ ID NO: 135234 - RNA, 22 nt, Mycobacterium bovis subsp bovis AF2122/97
ccggccugaugaugguguugcu

SEQ ID NO: 135235 - RNA, 22 nt, Mycobacterium bovis subsp bovis AF2122/97
ucgguguguuggucacccgcgg

SEQ ID NO: 135236 - RNA, 22 nt, Mycobacterium bovis subsp bovis AF2122/97
cacggugagcccggugcgaaag

SEQ ID NO: 135237 - RNA, 22 nt, Mycobacterium bovis subsp bovis AF2122/97
cgagcagacgcaaaagccccca

SEQ ID NO: 135238 - RNA, 22 nt, Mycobacterium bovis subsp bovis AF2122/97
aagcucgauggauccagcggcc

SEQ ID NO: 135239 - RNA, 22 nt, Mycobacterium bovis subsp bovis AF2122/97
gacgauguggucguggucuccg

SEQ ID NO: 135240 - RNA, 22 nt, Mycobacterium bovis subsp bovis AF2122/97
ucggggacuucugcgucugcuc

SEQ ID NO: 135241 - RNA, 22 nt, Mycobacterium bovis subsp bovis AF2122/97
cggcaucgcgaaucgucgaaag

SEQ ID NO: 135242 - RNA, 22 nt, Mycobacterium bovis subsp bovis AF2122/97
gucgcaggauucccagucgcgg

SEQ ID NO: 135243 - RNA, 22 nt, Mycobacterium bovis subsp bovis AF2122/97
gccaacaccgacgacggucgca

SEQ ID NO: 135244 - RNA, 22 nt, Mycobacterium bovis subsp bovis AF2122/97
uggggcuauggcgcagcuggua

SEQ ID NO: 135245 - RNA, 22 nt, Mycobacterium bovis subsp bovis AF2122/97
ccggcggcaaacgauucgacgg

SEQ ID NO: 135246 - RNA, 22 nt, Mycobacterium bovis subsp bovis AF2122/97
aaccggcuguccagggccaucu

SEQ ID NO: 135247 - RNA, 22 nt, Mycobacterium bovis subsp bovis AF2122/97
gagaccuucgaccgauguucga

SEQ ID NO: 135248 - RNA, 22 nt, Mycobacterium bovis subsp bovis AF2122/97
aacaccgccgccgggcacuggc

SEQ ID NO: 135249 - RNA, 19 nt, Mycobacterium bovis subsp bovis AF2122/97
augcccugucgcuguaucg

SEQ ID NO: 135250 - RNA, 22 nt, Mycobacterium bovis subsp bovis AF2122/97
ccaccgggcugcaugucgcggc

SEQ ID NO: 135251 - RNA, 22 nt, Mycobacterium bovis subsp bovis AF2122/97
ggcaccguucgucgagggcggc

SEQ ID NO: 135252 - RNA, 22 nt, Mycobacterium bovis subsp bovis AF2122/97
gggcggugaggaguccaugccg

SEQ ID NO: 135253 - RNA, 22 nt, Mycobacterium bovis subsp bovis AF2122/97
aucaccaugcaacgcgaaaggg

SEQ ID NO: 135254 - RNA, 22 nt, Mycobacterium bovis subsp bovis AF2122/97
aguucgugauggaggaugccgu

SEQ ID NO: 135255 - RNA, 18 nt, Mycobacterium bovis subsp bovis AF2122/97
uggugcaccuuguuuggg

SEQ ID NO: 135256 - RNA, 22 nt, Mycobacterium bovis subsp bovis AF2122/97
guguccgucgugggccaguugg

SEQ ID NO: 135257 - RNA, 22 nt, Mycobacterium bovis subsp bovis AF2122/97
auucgggaguagcgcuccuuga

SEQ ID NO: 135258 - RNA, 21 nt, Mycobacterium bovis subsp bovis AF2122/97
ggugacacggcgggccgcgag

SEQ ID NO: 135259 - RNA, 22 nt, Mycobacterium bovis subsp bovis AF2122/97
gcgagcagacgcaaaaucgccc

SEQ ID NO: 135260 - RNA, 22 nt, Mycobacterium bovis subsp bovis AF2122/97
ccgguucaucguaaucgggguc

SEQ ID NO: 135261 - RNA, 22 nt, Mycobacterium bovis subsp bovis AF2122/97
cgggcgaucaaagccagcaccu

SEQ ID NO: 135262 - RNA, 22 nt, Mycobacterium bovis subsp bovis AF2122/97
aagaucguugauccccagugcu

SEQ ID NO: 135263 - RNA, 19 nt, Mycobacterium bovis subsp bovis AF2122/97
gcgcaccgacgaucagguc

SEQ ID NO: 135264 - RNA, 22 nt, Mycobacterium bovis subsp bovis AF2122/97
ucagcgucgaugaccaugucga

SEQ ID NO: 135265 - RNA, 22 nt, Mycobacterium bovis subsp bovis AF2122/97
ggcaacuccgggguggccagca

SEQ ID NO: 135266 - RNA, 22 nt, Mycobacterium bovis subsp bovis AF2122/97
ugucgucggucacucaagccgc

SEQ ID NO: 135267 - RNA, 21 nt, Mycobacterium bovis subsp bovis AF2122/97
gcgauucugcgucugcucgcg

SEQ ID NO: 135268 - RNA, 22 nt, Mycobacterium bovis subsp bovis AF2122/97
cgcaccgaaggagaucccgccg

SEQ ID NO: 135269 - RNA, 21 nt, Mycobacterium bovis subsp bovis AF2122/97
ccgugacguuacgcucgcgac

SEQ ID NO: 135270 - RNA, 22 nt, Mycobacterium bovis subsp bovis AF2122/97
ucgacgccgaacgucaacccga

SEQ ID NO: 135271 - RNA, 22 nt, Mycobacterium bovis subsp bovis AF2122/97
cgggggcuuuugcgucugcuga

SEQ ID NO: 135272 - RNA, 22 nt, Mycobacterium bovis subsp bovis AF2122/97
ccgauggucugccguacaccca

SEQ ID NO: 135273 - RNA, 22 nt, Mycobacterium bovis subsp bovis AF2122/97
cgugcgggggcuuuugcgacug

SEQ ID NO: 135274 - RNA, 22 nt, Mycobacterium bovis subsp bovis AF2122/97
uccguuggccgcguucguccau

SEQ ID NO: 135275 - RNA, 22 nt, Mycobacterium bovis subsp bovis AF2122/97
ugaggaggaugaguuugcccuc

SEQ ID NO: 135276 - RNA, 22 nt, Mycobacterium bovis subsp bovis AF2122/97
cggcgccgucaccaccaucacc

SEQ ID NO: 135277 - RNA, 22 nt, Mycobacterium bovis subsp bovis AF2122/97
aaucggccggcgacacuguugu

SEQ ID NO: 135278 - RNA, 22 nt, Mycobacterium bovis subsp bovis AF2122/97
cguggccgucgauugcgguggc

SEQ ID NO: 135279 - RNA, 22 nt, Mycobacterium bovis subsp bovis AF2122/97
ucgacgcgggaacaccguuggg

SEQ ID NO: 135280 - RNA, 22 nt, Mycobacterium bovis subsp bovis AF2122/97
ucaccugcccggucacaaucuc

SEQ ID NO: 135281 - RNA, 22 nt, Mycobacterium bovis subsp bovis AF2122/97
cagacgcaaaagcgccacuuuu

SEQ ID NO: 135282 - RNA, 19 nt, Mycobacterium bovis subsp bovis AF2122/97
gcgugacgagcgccugcgc

SEQ ID NO: 135283 - RNA, 22 nt, Mycobacterium bovis subsp bovis AF2122/97
gaagcugcugggccaguucgug

SEQ ID NO: 135284 - RNA, 20 nt, Mycobacterium bovis subsp bovis AF2122/97
ucgaucucggucaugccguc

SEQ ID NO: 135285 - RNA, 22 nt, Mycobacterium bovis subsp bovis AF2122/97
gaaccuggcacggcgggcugca

SEQ ID NO: 135286 - RNA, 22 nt, Mycobacterium bovis subsp bovis AF2122/97
auggucugacguucuggagcac

SEQ ID NO: 135287 - RNA, 18 nt, Mycobacterium bovis subsp bovis AF2122/97
gcccgcuacggucgcugg

SEQ ID NO: 135288 - RNA, 23 nt, Mycobacterium bovis subsp bovis AF2122/97
agaccgcucgacgcgggcgaucg

SEQ ID NO: 135289 - RNA, 20 nt, Mycobacterium bovis subsp bovis AF2122/97
cagcgcagccccgaugucga

SEQ ID NO: 135290 - RNA, 22 nt, Mycobacterium bovis subsp bovis AF2122/97
cgucugguugcucgguuggcgg

SEQ ID NO: 135291 - RNA, 22 nt, Mycobacterium bovis subsp bovis AF2122/97
accgucagggcaucaccgaggc

SEQ ID NO: 135292 - RNA, 22 nt, Mycobacterium bovis subsp bovis AF2122/97
gugucguccaugauucggccga

SEQ ID NO: 135293 - RNA, 22 nt, Mycobacterium bovis subsp bovis AF2122/97
cgcgugucggagagcccacgga

SEQ ID NO: 135294 - RNA, 22 nt, Mycobacterium bovis subsp bovis AF2122/97
acggccuagagaccgcaacuac

SEQ ID NO: 135295 - RNA, 22 nt, Mycobacterium bovis subsp bovis AF2122/97
gugacggucggggaaaucugcc

SEQ ID NO: 135296 - RNA, 23 nt, Mycobacterium bovis subsp bovis AF2122/97
caccggcgccggcggcaacaagu

SEQ ID NO: 135297 - RNA, 22 nt, Mycobacterium bovis subsp bovis AF2122/97
ggaguucaaugccacggcgucg

SEQ ID NO: 135298 - RNA, 22 nt, Mycobacterium bovis subsp bovis AF2122/97
cagacgcaaaagaacaugaugg

SEQ ID NO: 135299 - RNA, 22 nt, Mycobacterium bovis subsp bovis AF2122/97
accgggcuggucgacggccagc

SEQ ID NO: 135300 - RNA, 22 nt, Mycobacterium bovis subsp bovis AF2122/97
agcagacguaaaagcccccgca

SEQ ID NO: 135301 - RNA, 20 nt, Mycobacterium bovis subsp bovis AF2122/97
ccugaugugaguccagccgg

SEQ ID NO: 135302 - RNA, 22 nt, Mycobacterium bovis subsp bovis AF2122/97
cgcaucgagaucgacgucagcg

SEQ ID NO: 135303 - RNA, 22 nt, Mycobacterium bovis subsp bovis AF2122/97
ggugaugguggaggcagccgac

SEQ ID NO: 135304 - RNA, 22 nt, Mycobacterium bovis subsp bovis AF2122/97
agccggacuugccgcugcggcg

SEQ ID NO: 135305 - RNA, 22 nt, Mycobacterium bovis subsp bovis AF2122/97
gggcuaccuggaaccgcugcag

SEQ ID NO: 135306 - RNA, 22 nt, Mycobacterium bovis subsp bovis AF2122/97
ugucgucggcaugacgguggcu

SEQ ID NO: 135307 - RNA, 22 nt, Mycobacterium bovis subsp bovis AF2122/97
gguuugcugaagaagcugggug

SEQ ID NO: 135308 - RNA, 22 nt, Mycobacterium bovis subsp bovis AF2122/97
cgugcggugacggcgaugugca

SEQ ID NO: 135309 - RNA, 22 nt, Mycobacterium bovis subsp bovis AF2122/97
ccgccgauagugaauucggcga

SEQ ID NO: 135310 - RNA, 22 nt, Mycobacterium bovis subsp bovis AF2122/97
cgcgcuaucagcggcugauguu

SEQ ID NO: 135311 - RNA, 22 nt, Mycobacterium bovis subsp bovis AF2122/97
ccucgacguggugcgaguuggu

SEQ ID NO: 135312 - RNA, 22 nt, Mycobacterium bovis subsp bovis AF2122/97
aaggcuguggccggcgucgucg

SEQ ID NO: 135313 - RNA, 22 nt, Mycobacterium bovis subsp bovis AF2122/97
guggacgaccgcggugaccccc

SEQ ID NO: 135314 - RNA, 22 nt, Mycobacterium bovis subsp bovis AF2122/97
gaccguuuucgaugugcggguc

SEQ ID NO: 135315 - RNA, 22 nt, Mycobacterium bovis subsp bovis AF2122/97
gccgaacgugaacugacggcgg

SEQ ID NO: 135316 - RNA, 22 nt, Mycobacterium bovis subsp bovis AF2122/97
ucgcuggagcagaacccgcuaa

SEQ ID NO: 135317 - RNA, 22 nt, Mycobacterium bovis subsp bovis AF2122/97
ugggggcuucugcgucugcucg

SEQ ID NO: 135318 - RNA, 20 nt, Mycobacterium bovis subsp bovis AF2122/97
cacuccuggcuggauucggc

SEQ ID NO: 135319 - RNA, 22 nt, Mycobacterium bovis subsp bovis AF2122/97
cggugacuauuucggcgccgug

SEQ ID NO: 135320 - RNA, 22 nt, Mycobacterium bovis subsp bovis AF2122/97
gacugauccucgaugacaucgg

SEQ ID NO: 135321 - RNA, 21 nt, Mycobacterium bovis subsp bovis AF2122/97
ccggcucaccguuggccgggu

SEQ ID NO: 135322 - RNA, 22 nt, Mycobacterium bovis subsp bovis AF2122/97
aguccugggccaacugccggua

SEQ ID NO: 135323 - RNA, 22 nt, Mycobacterium bovis subsp bovis AF2122/97
cugcuggccagcguugcgcugu

SEQ ID NO: 135324 - RNA, 22 nt, Mycobacterium bovis subsp bovis AF2122/97
guacgcggagaucccggcgggg

SEQ ID NO: 135325 - RNA, 23 nt, Mycobacterium bovis subsp bovis AF2122/97
uccagcccgacucauacccgcug

SEQ ID NO: 135326 - RNA, 22 nt, Mycobacterium bovis subsp bovis AF2122/97
gguggccucgaggaacacgaca

SEQ ID NO: 135327 - RNA, 22 nt, Mycobacterium bovis subsp bovis AF2122/97
aacaggcgggauucgccgauca

SEQ ID NO: 135328 - RNA, 22 nt, Mycobacterium bovis subsp bovis AF2122/97
ugcgccgcgguugccgucggga

SEQ ID NO: 135329 - RNA, 22 nt, Mycobacterium bovis subsp bovis AF2122/97
gucgaccaugggugcggugccc

SEQ ID NO: 135330 - RNA, 23 nt, Mycobacterium bovis subsp bovis AF2122/97
ccgcguagucgugagugccggcc

SEQ ID NO: 135331 - RNA, 22 nt, Mycobacterium bovis subsp bovis AF2122/97
cugcggaugggucagcagauug

SEQ ID NO: 135332 - RNA, 22 nt, Mycobacterium bovis subsp bovis AF2122/97
uuccgcaauccuucgucggcgu

SEQ ID NO: 135333 - RNA, 23 nt, Mycobacterium bovis subsp bovis AF2122/97
acacuggugcuguugccggagac

SEQ ID NO: 135334 - RNA, 22 nt, Mycobacterium bovis subsp bovis AF2122/97
cgucgugaccugccggccggac

SEQ ID NO: 135335 - RNA, 22 nt, Mycobacterium bovis subsp bovis AF2122/97
ccacgccgagagccuugccauc

SEQ ID NO: 135336 - RNA, 22 nt, Mycobacterium bovis subsp bovis AF2122/97
cagccggaggaucucggcgaac

SEQ ID NO: 135337 - RNA, 22 nt, Mycobacterium bovis subsp bovis AF2122/97
ggcggcgguggcuugaccgcug

SEQ ID NO: 135338 - RNA, 22 nt, Mycobacterium bovis subsp bovis AF2122/97
ccggccgccaaauggcgccgga

SEQ ID NO: 135339 - RNA, 22 nt, Mycobacterium bovis subsp bovis AF2122/97
agacgagugaggccgcgcagau

SEQ ID NO: 135340 - RNA, 22 nt, Mycobacterium bovis subsp bovis AF2122/97
accggggcucagcucgccgaug

SEQ ID NO: 135341 - RNA, 22 nt, Mycobacterium bovis subsp bovis AF2122/97
cgaugcaccgcaauaugaccug

SEQ ID NO: 135342 - RNA, 22 nt, Mycobacterium bovis subsp bovis AF2122/97
cgccauggaaaugcuuugcacg

SEQ ID NO: 135343 - RNA, 22 nt, Mycobacterium bovis subsp bovis AF2122/97
cgucgcgcacgcgcuucuugag

SEQ ID NO: 135344 - RNA, 22 nt, Mycobacterium bovis subsp bovis AF2122/97
gaccucaucggccaucgcugcg

SEQ ID NO: 135345 - RNA, 22 nt, Mycobacterium bovis subsp bovis AF2122/97
cugauguagugggcggcggcgg

SEQ ID NO: 135346 - RNA, 22 nt, Mycobacterium bovis subsp bovis AF2122/97
cgggccgcaacuggcaacugag

SEQ ID NO: 135347 - RNA, 18 nt, Mycobacterium bovis subsp bovis AF2122/97
uggucgcgacggccuggc

SEQ ID NO: 135348 - RNA, 22 nt, Mycobacterium bovis subsp bovis AF2122/97
auuucggucggcucgucgacua

SEQ ID NO: 135349 - RNA, 22 nt, Mycobacterium bovis subsp bovis AF2122/97
cccgacagcaccaccgauaccg

SEQ ID NO: 135350 - RNA, 22 nt, Mycobacterium bovis subsp bovis AF2122/97
ugucgggggcuuuugcgacugc

SEQ ID NO: 135351 - RNA, 22 nt, Mycobacterium bovis subsp bovis AF2122/97
gcguucguuucaagcggaucga

SEQ ID NO: 135352 - RNA, 22 nt, Mycobacterium bovis subsp bovis AF2122/97
cgccgagcagacacagaaucgc

SEQ ID NO: 135353 - RNA, 22 nt, Mycobacterium bovis subsp bovis AF2122/97
ggccggacccgagcaccuugau

SEQ ID NO: 135354 - RNA, 22 nt, Mycobacterium bovis subsp bovis AF2122/97
gccggcuuggacgguuccccgg

SEQ ID NO: 135355 - RNA, 22 nt, Mycobacterium bovis subsp bovis AF2122/97
uucgcgcaucaacggauugacc

SEQ ID NO: 135356 - RNA, 22 nt, Mycobacterium bovis subsp bovis AF2122/97
cguugacucugcguccaccgug

SEQ ID NO: 135357 - RNA, 19 nt, Mycobacterium bovis subsp bovis AF2122/97
uuucacccgcaacgucugc

SEQ ID NO: 135358 - RNA, 22 nt, Mycobacterium bovis subsp bovis AF2122/97
uaccugggguucuugcugaucg

SEQ ID NO: 135359 - RNA, 22 nt, Mycobacterium bovis subsp bovis AF2122/97
cggcgagcagacacaaaaucgc

SEQ ID NO: 135360 - RNA, 22 nt, Mycobacterium bovis subsp bovis AF2122/97
cgccgucuggaccgacaugcuc

SEQ ID NO: 135361 - RNA, 22 nt, Mycobacterium bovis subsp bovis AF2122/97
ugcuggcuaccuacucggaguu

SEQ ID NO: 135362 - RNA, 22 nt, Mycobacterium bovis subsp bovis AF2122/97
ucgagcggcauaccagccgcac

SEQ ID NO: 135363 - RNA, 22 nt, Mycobacterium bovis subsp bovis AF2122/97
gcggcagggaaaggccgugguc

SEQ ID NO: 135364 - RNA, 22 nt, Mycobacterium bovis subsp bovis AF2122/97
cacccggcuggccauucaugcc

SEQ ID NO: 135365 - RNA, 22 nt, Mycobacterium bovis subsp bovis AF2122/97
gcgggcaucacuucggacgggg

SEQ ID NO: 135366 - RNA, 22 nt, Mycobacterium bovis subsp bovis AF2122/97
acaggucggcaccaccaucggg

SEQ ID NO: 135367 - RNA, 22 nt, Mycobacterium bovis subsp bovis AF2122/97
cgcuggucaagggcaacgacua

SEQ ID NO: 135368 - RNA, 22 nt, Mycobacterium bovis subsp bovis AF2122/97
ugcgcugacucugcguccacca

SEQ ID NO: 135369 - RNA, 22 nt, Mycobacterium bovis subsp bovis AF2122/97
aucacgucgacaugggguucgg

SEQ ID NO: 135370 - RNA, 22 nt, Mycobacterium bovis subsp bovis AF2122/97
gcgagacgcaaaaucgcccaaa

SEQ ID NO: 135371 - RNA, 22 nt, Mycobacterium bovis subsp bovis AF2122/97
ucgguggcgccgacaugccggu

SEQ ID NO: 135372 - RNA, 22 nt, Mycobacterium bovis subsp bovis AF2122/97
gaugcccgcacccgcuggucgu

SEQ ID NO: 135373 - RNA, 22 nt, Mycobacterium bovis subsp bovis AF2122/97
gccaacuguguaaugguugccc

SEQ ID NO: 135374 - RNA, 22 nt, Mycobacterium bovis subsp bovis AF2122/97
gcgaucauccgucggacuugau

SEQ ID NO: 135375 - RNA, 22 nt, Mycobacterium bovis subsp bovis AF2122/97
acgaucgucgcccaggccgcga

SEQ ID NO: 135376 - RNA, 22 nt, Mycobacterium bovis subsp bovis AF2122/97
acccgucgauguucgagccggu

SEQ ID NO: 135377 - RNA, 22 nt, Mycobacterium bovis subsp bovis AF2122/97
cgcccaguccauccggcggaca

SEQ ID NO: 135378 - RNA, 22 nt, Mycobacterium bovis subsp bovis AF2122/97
ggcgccuguuggacgggcgcuu

SEQ ID NO: 135379 - RNA, 22 nt, Mycobacterium bovis subsp bovis AF2122/97
uggcgcccaacuuggcggccug

SEQ ID NO: 135380 - RNA, 22 nt, Mycobacterium bovis subsp bovis AF2122/97
gcuugcccuugucgagguugcg

SEQ ID NO: 135381 - RNA, 22 nt, Mycobacterium bovis subsp bovis AF2122/97
aacagucgaccgacgcguucgu

SEQ ID NO: 135382 - RNA, 22 nt, Mycobacterium bovis subsp bovis AF2122/97
gguguuggcaagccggcgggca

SEQ ID NO: 135383 - RNA, 22 nt, Mycobacterium bovis subsp bovis AF2122/97
ucaacaucggcagcaaccucgc

SEQ ID NO: 135384 - RNA, 21 nt, Mycobacterium bovis subsp bovis AF2122/97
cucaagggcaagguuuggacc

SEQ ID NO: 135385 - RNA, 22 nt, Mycobacterium bovis subsp bovis AF2122/97
ggucuugacguugccguuggcg

SEQ ID NO: 135386 - RNA, 22 nt, Mycobacterium bovis subsp bovis AF2122/97
ugugcaccuccaccggccagcg

SEQ ID NO: 135387 - RNA, 22 nt, Mycobacterium bovis subsp bovis AF2122/97
gaauaccauugcccccgcggug

SEQ ID NO: 135388 - RNA, 22 nt, Mycobacterium bovis subsp bovis AF2122/97
gucguggacggcacgagcgcug

SEQ ID NO: 135389 - RNA, 22 nt, Mycobacterium bovis subsp bovis AF2122/97
gaugagaucaacgacgucgucc

SEQ ID NO: 135390 - RNA, 22 nt, Mycobacterium bovis subsp bovis AF2122/97
gccgaacagacacaaaaccacc

SEQ ID NO: 135391 - RNA, 22 nt, Mycobacterium bovis subsp bovis AF2122/97
gaaaaccuugcugccgaggcgg

SEQ ID NO: 135392 - RNA, 22 nt, Mycobacterium bovis subsp bovis AF2122/97
ucgcgucgucagauucacaauc

SEQ ID NO: 135393 - RNA, 22 nt, Mycobacterium bovis subsp bovis AF2122/97
gcgaccgguaucccggcgccgc

SEQ ID NO: 135394 - RNA, 22 nt, Mycobacterium bovis subsp bovis AF2122/97
gcgcaguacgucgagaccuucg

SEQ ID NO: 135395 - RNA, 20 nt, Mycobacterium bovis subsp bovis AF2122/97
cggauacacaacguggcugc

SEQ ID NO: 135396 - RNA, 22 nt, Mycobacterium bovis subsp bovis AF2122/97
cgggggauuucgcgucugcucg

SEQ ID NO: 135397 - RNA, 22 nt, Mycobacterium bovis subsp bovis AF2122/97
uggcggccaagguggugcccag

SEQ ID NO: 135398 - RNA, 22 nt, Mycobacterium bovis subsp bovis AF2122/97
gccaccgccagggcaauauccc

SEQ ID NO: 135399 - RNA, 22 nt, Mycobacterium bovis subsp bovis AF2122/97
ccagucggcgcgcucgccggug

SEQ ID NO: 135400 - RNA, 22 nt, Mycobacterium bovis subsp bovis AF2122/97
cgcugaggugcugguguuggac

SEQ ID NO: 135401 - RNA, 22 nt, Mycobacterium bovis subsp bovis AF2122/97
ggucgagucguggucgcaugag

SEQ ID NO: 135402 - RNA, 22 nt, Mycobacterium bovis subsp bovis AF2122/97
agcagacguaaaagcccccauu

SEQ ID NO: 135403 - RNA, 22 nt, Mycobacterium bovis subsp bovis AF2122/97
ucgcaguggcgucacgcuggcg

SEQ ID NO: 135404 - RNA, 22 nt, Mycobacterium bovis subsp bovis AF2122/97
uccgcugaccgagggcugggcu

SEQ ID NO: 135405 - RNA, 22 nt, Mycobacterium bovis subsp bovis AF2122/97
gagaccacagcaccgaccgacu

SEQ ID NO: 135406 - RNA, 22 nt, Mycobacterium bovis subsp bovis AF2122/97
gccaugccgaccgcggcgaucg

SEQ ID NO: 135407 - RNA, 19 nt, Mycobacterium bovis subsp bovis AF2122/97
gcgcgcaaggcgucccugc

SEQ ID NO: 135408 - RNA, 22 nt, Mycobacterium bovis subsp bovis AF2122/97
accgcgaucagcgcagcgaucg

SEQ ID NO: 135409 - RNA, 19 nt, Mycobacterium bovis subsp bovis AF2122/97
ucgagcguuggcgcgccga

SEQ ID NO: 135410 - RNA, 22 nt, Mycobacterium bovis subsp bovis AF2122/97
cagcguugucucggcgaacacc

SEQ ID NO: 135411 - RNA, 21 nt, Mycobacterium bovis subsp bovis AF2122/97
cgccgguggcguggucaccga

SEQ ID NO: 135412 - RNA, 22 nt, Mycobacterium bovis subsp bovis AF2122/97
ggcugaggccgccgaguuggcg

SEQ ID NO: 135413 - RNA, 22 nt, Mycobacterium bovis subsp bovis AF2122/97
uugcgugugacgccgcgcugag

SEQ ID NO: 135414 - RNA, 19 nt, Mycobacterium bovis subsp bovis AF2122/97
gugggcgcagagucaacgu

SEQ ID NO: 135415 - RNA, 22 nt, Mycobacterium bovis subsp bovis AF2122/97
cgucgaaccgcgaugagcccau

SEQ ID NO: 135416 - RNA, 22 nt, Mycobacterium bovis subsp bovis AF2122/97
guugcccgagggugcgaccuug

SEQ ID NO: 135417 - RNA, 22 nt, Mycobacterium bovis subsp bovis AF2122/97
ucgccgaccacggcgugccguu

SEQ ID NO: 135418 - RNA, 20 nt, Mycobacterium bovis subsp bovis AF2122/97
auugucgagccgguuccgca

SEQ ID NO: 135419 - RNA, 22 nt, Mycobacterium bovis subsp bovis AF2122/97
cauccgcaccugggugccaccg

SEQ ID NO: 135420 - RNA, 22 nt, Mycobacterium bovis subsp bovis AF2122/97
ucgccgaccugcgcacugucgc

SEQ ID NO: 135421 - RNA, 22 nt, Mycobacterium bovis subsp bovis AF2122/97
ucggugaugacccaagagcugc

SEQ ID NO: 135422 - RNA, 22 nt, Mycobacterium bovis subsp bovis AF2122/97
uuucgggcgauuuugcgucucg

SEQ ID NO: 135423 - RNA, 22 nt, Mycobacterium bovis subsp bovis AF2122/97
gaucaucauccucgacgauugg

SEQ ID NO: 135424 - RNA, 22 nt, Mycobacterium bovis subsp bovis AF2122/97
accacaccuacggucagggggu

SEQ ID NO: 135425 - RNA, 22 nt, Mycobacterium bovis subsp bovis AF2122/97
cgcugguuguucagcucgucgc

SEQ ID NO: 135426 - RNA, 22 nt, Mycobacterium bovis subsp bovis AF2122/97
ccgaccaccgcgaugcguuugc

SEQ ID NO: 135427 - RNA, 22 nt, Mycobacterium bovis subsp bovis AF2122/97
ccgccgauagugaauucggcgc

SEQ ID NO: 135428 - RNA, 22 nt, Mycobacterium bovis subsp bovis AF2122/97
gccgagcgugaacucagggcga

SEQ ID NO: 135429 - RNA, 22 nt, Mycobacterium bovis subsp bovis AF2122/97
aacucgucgaaccgcagcgcgu

SEQ ID NO: 135430 - RNA, 21 nt, Mycobacterium bovis subsp bovis AF2122/97
ucguggccgccgagggugacc

SEQ ID NO: 135431 - RNA, 19 nt, Mycobacterium bovis subsp bovis AF2122/97
cgccgccgagauggagucg

SEQ ID NO: 135432 - RNA, 22 nt, Mycobacterium bovis subsp bovis AF2122/97
uagcggcgaagcgggccacgcu

SEQ ID NO: 135433 - RNA, 22 nt, Mycobacterium bovis subsp bovis AF2122/97
acggugagggcgucgucgaguu

SEQ ID NO: 135434 - RNA, 22 nt, Mycobacterium bovis subsp bovis AF2122/97
ucuggucaccgacgugcaauuc

SEQ ID NO: 135435 - RNA, 22 nt, Mycobacterium bovis subsp bovis AF2122/97
uuccugcagcuuggucaggcga

SEQ ID NO: 135436 - RNA, 17 nt, Mycobacterium bovis subsp bovis AF2122/97
guugccggugggacgga

SEQ ID NO: 135437 - RNA, 22 nt, Mycobacterium bovis subsp bovis AF2122/97
uacgcgccaacgaucgaacagc

SEQ ID NO: 135438 - RNA, 22 nt, Mycobacterium bovis subsp bovis AF2122/97
acagcccugaacgcaaucuggg

SEQ ID NO: 135439 - RNA, 22 nt, Mycobacterium bovis subsp bovis AF2122/97
cgaacgugcacgcacugcgaag

SEQ ID NO: 135440 - RNA, 22 nt, Mycobacterium bovis subsp bovis AF2122/97
gucggcgccgacuuguuggcgc

SEQ ID NO: 135441 - RNA, 22 nt, Mycobacterium bovis subsp bovis AF2122/97
cgucuggugcagggauucuucg

SEQ ID NO: 135442 - RNA, 22 nt, Mycobacterium bovis subsp bovis AF2122/97
gguugccagcgaaccggaaugg

SEQ ID NO: 135443 - RNA, 22 nt, Mycobacterium bovis subsp bovis AF2122/97
caggguggugagaaugacgccc

SEQ ID NO: 135444 - RNA, 22 nt, Mycobacterium bovis subsp bovis AF2122/97
gaauuguccgguaaugcccagc

SEQ ID NO: 135445 - RNA, 22 nt, Mycobacterium bovis subsp bovis AF2122/97
cccgcggcgugcugguggucaa

SEQ ID NO: 135446 - RNA, 22 nt, Mycobacterium bovis subsp bovis AF2122/97
ugaccgagcgggugcgcuucca

SEQ ID NO: 135447 - RNA, 22 nt, Mycobacterium bovis subsp bovis AF2122/97
gcgcggucgacuuacgcgaugg

SEQ ID NO: 135448 - RNA, 22 nt, Mycobacterium bovis subsp bovis AF2122/97
gccuucgacucggcgccgagcg

SEQ ID NO: 135449 - RNA, 22 nt, Mycobacterium bovis subsp bovis AF2122/97
uuucgggcgauuuugcgucugc

SEQ ID NO: 135450 - RNA, 22 nt, Mycobacterium bovis subsp bovis AF2122/97
gaggagaugcuagaggcaacga

SEQ ID NO: 135451 - RNA, 22 nt, Mycobacterium bovis subsp bovis AF2122/97
cgaucguucguggcaccgcagc

SEQ ID NO: 135452 - RNA, 22 nt, Mycobacterium bovis subsp bovis AF2122/97
ggaacugcucgucgagcugcuc

SEQ ID NO: 135453 - RNA, 22 nt, Mycobacterium bovis subsp bovis AF2122/97
ccgguggcggugaugcugucgu

SEQ ID NO: 135454 - RNA, 22 nt, Mycobacterium bovis subsp bovis AF2122/97
ccgaccguguuaaccgcgcggg

SEQ ID NO: 135455 - RNA, 22 nt, Mycobacterium bovis subsp bovis AF2122/97
gggcccugguugaugaucacgu

SEQ ID NO: 135456 - RNA, 22 nt, Mycobacterium bovis subsp bovis AF2122/97
ggcugaguuuagucaagcgcgu

SEQ ID NO: 135457 - RNA, 22 nt, Mycobacterium bovis subsp bovis AF2122/97
cggcccuggucgacgccggagc

SEQ ID NO: 135458 - RNA, 21 nt, Mycobacterium bovis subsp bovis AF2122/97
gccggccauuuguucgaugcg

SEQ ID NO: 135459 - RNA, 22 nt, Mycobacterium bovis subsp bovis AF2122/97
gccgcggugcuagaacgcagcc

SEQ ID NO: 135460 - RNA, 22 nt, Mycobacterium bovis subsp bovis AF2122/97
cggucaaggugacgugcgugca

SEQ ID NO: 135461 - RNA, 22 nt, Mycobacterium bovis subsp bovis AF2122/97
gcugugguggcggaugauccgc

SEQ ID NO: 135462 - RNA, 22 nt, Mycobacterium bovis subsp bovis AF2122/97
aggcacacgccagacggcgccc

SEQ ID NO: 135463 - RNA, 22 nt, Mycobacterium bovis subsp bovis AF2122/97
ugccugguauccgcagagucaa

SEQ ID NO: 135464 - RNA, 22 nt, Mycobacterium bovis subsp bovis AF2122/97
uuuggcgccgaauacgccaacg

SEQ ID NO: 135465 - RNA, 22 nt, Mycobacterium bovis subsp bovis AF2122/97
uggcggucgccgaggcgguggu

SEQ ID NO: 135466 - RNA, 22 nt, Mycobacterium bovis subsp bovis AF2122/97
gcguugggcacguuggcgaccc

SEQ ID NO: 135467 - RNA, 22 nt, Mycobacterium bovis subsp bovis AF2122/97
ccgcugcugcucgugguugggg

SEQ ID NO: 135468 - RNA, 22 nt, Mycobacterium bovis subsp bovis AF2122/97
cugcagcugguuuccgucggcu

SEQ ID NO: 135469 - RNA, 22 nt, Mycobacterium bovis subsp bovis AF2122/97
cgguggcuuuugcgucugcucg

SEQ ID NO: 135470 - RNA, 22 nt, Mycobacterium bovis subsp bovis AF2122/97
agcaccuacaugugguggaggu

SEQ ID NO: 135471 - RNA, 22 nt, Mycobacterium bovis subsp bovis AF2122/97
acagcugcugguuugagucugc

SEQ ID NO: 135472 - RNA, 22 nt, Mycobacterium bovis subsp bovis AF2122/97
ugucgggggcuuuuacgucugc

SEQ ID NO: 135473 - RNA, 22 nt, Mycobacterium bovis subsp bovis AF2122/97
gcugccucgcugggcgcccagg

SEQ ID NO: 135474 - RNA, 22 nt, Mycobacterium bovis subsp bovis AF2122/97
aaagccccggggaccgucgaug

SEQ ID NO: 135475 - RNA, 22 nt, Mycobacterium bovis subsp bovis AF2122/97
cgucggcgaaaugggccauggu

SEQ ID NO: 135476 - RNA, 22 nt, Mycobacterium bovis subsp bovis AF2122/97
cggugugcuguuuggccagccg

SEQ ID NO: 135477 - RNA, 22 nt, Mycobacterium bovis subsp bovis AF2122/97
gcgcuaucgguuugagcgcccg

SEQ ID NO: 135478 - RNA, 21 nt, Mycobacterium bovis subsp bovis AF2122/97
uaccgguucgggcaagucgac

SEQ ID NO: 135479 - RNA, 20 nt, Mycobacterium bovis subsp bovis AF2122/97
ccgcgguucacgccgguggc

SEQ ID NO: 135480 - RNA, 21 nt, Mycobacterium bovis subsp bovis AF2122/97
gcgucgugccauucacagugg

SEQ ID NO: 135481 - RNA, 22 nt, Mycobacterium bovis subsp bovis AF2122/97
auggcguucgucggcugcggcg

SEQ ID NO: 135482 - RNA, 22 nt, Mycobacterium bovis subsp bovis AF2122/97
ucgucgacgugaucaccgauac

SEQ ID NO: 135483 - RNA, 22 nt, Mycobacterium bovis subsp bovis AF2122/97
ucgcaguggcguuacgcucgcg

SEQ ID NO: 135484 - RNA, 22 nt, Mycobacterium bovis subsp bovis AF2122/97
uccauggggucagucuugcgca

SEQ ID NO: 135485 - RNA, 22 nt, Mycobacterium bovis subsp bovis AF2122/97
cgguggugaacggaucgccgga

SEQ ID NO: 135486 - RNA, 22 nt, Mycobacterium bovis subsp bovis AF2122/97
guugguccucgaggucggcagu

SEQ ID NO: 135487 - RNA, 22 nt, Mycobacterium bovis subsp bovis AF2122/97
uugccggccagggugccguugg

SEQ ID NO: 135488 - RNA, 22 nt, Mycobacterium bovis subsp bovis AF2122/97
accgugauuguuccgcaccgac

SEQ ID NO: 135489 - RNA, 22 nt, Mycobacterium bovis subsp bovis AF2122/97
cgguacccaggcugcaaucauu

SEQ ID NO: 135490 - RNA, 22 nt, Mycobacterium bovis subsp bovis AF2122/97
uggccgcuuuucgauggugucg

SEQ ID NO: 135491 - RNA, 22 nt, Mycobacterium bovis subsp bovis AF2122/97
uuggccggguggucgagcccgc

SEQ ID NO: 135492 - RNA, 22 nt, Mycobacterium bovis subsp bovis AF2122/97
uggcgcggcggacggcaccauu

SEQ ID NO: 135493 - RNA, 22 nt, Mycobacterium bovis subsp bovis AF2122/97
ucgacgaugaccagucgccggc

SEQ ID NO: 135494 - RNA, 22 nt, Mycobacterium bovis subsp bovis AF2122/97
ucgaacgugaacggcuggaguc

SEQ ID NO: 135495 - RNA, 22 nt, Mycobacterium bovis subsp bovis AF2122/97
ucgcaguccgguuacgcucgcg

SEQ ID NO: 135496 - RNA, 22 nt, Mycobacterium bovis subsp bovis AF2122/97
aaagacgcaaaagcucccaaau

SEQ ID NO: 135497 - RNA, 21 nt, Mycobacterium bovis subsp bovis AF2122/97
uggacgcagagucaacgugua

SEQ ID NO: 135498 - RNA, 22 nt, Mycobacterium bovis subsp bovis AF2122/97
ggccccguggaccuggauugcg

SEQ ID NO: 135499 - RNA, 21 nt, Mycobacterium bovis subsp bovis AF2122/97
gucguucuccaggaucagguc

SEQ ID NO: 135500 - RNA, 22 nt, Mycobacterium bovis subsp bovis AF2122/97
cgagcagucgcuaaagcccccg

SEQ ID NO: 135501 - RNA, 22 nt, Mycobacterium bovis subsp bovis AF2122/97
ugcugggcuugaucgccggcac

SEQ ID NO: 135502 - RNA, 22 nt, Mycobacterium bovis subsp bovis AF2122/97
uggaccaccggugugcucgacg

SEQ ID NO: 135503 - RNA, 22 nt, Mycobacterium bovis subsp bovis AF2122/97
ucgacuugcccgaaccgcuggg

SEQ ID NO: 135504 - RNA, 22 nt, Mycobacterium bovis subsp bovis AF2122/97
gugagccauagguugucggugg

SEQ ID NO: 135505 - RNA, 22 nt, Mycobacterium bovis subsp bovis AF2122/97
acgcagcagcacguccauuagc

SEQ ID NO: 135506 - RNA, 22 nt, Mycobacterium bovis subsp bovis AF2122/97
ucggggucaaucaggcccagcc

SEQ ID NO: 135507 - RNA, 22 nt, Mycobacterium bovis subsp bovis AF2122/97
ccgaauuggcggccguuagcca

SEQ ID NO: 135508 - RNA, 22 nt, Mycobacterium bovis subsp bovis AF2122/97
cuugccggcgcaucgcgauugc

SEQ ID NO: 135509 - RNA, 22 nt, Mycobacterium bovis subsp bovis AF2122/97
caccugccgaucgcacagguug

SEQ ID NO: 135510 - RNA, 22 nt, Mycobacterium bovis subsp bovis AF2122/97
cggcgagcagacgcaaaaucgc

SEQ ID NO: 135511 - RNA, 22 nt, Mycobacterium bovis subsp bovis AF2122/97
aucgacaugacccucacgucgg

SEQ ID NO: 135512 - RNA, 22 nt, Mycobacterium bovis subsp bovis AF2122/97
cgcccgugccgcugaucguugc

SEQ ID NO: 135513 - RNA, 22 nt, Mycobacterium bovis subsp bovis AF2122/97
uggccgucgacaagcagcgugg

SEQ ID NO: 135514 - RNA, 22 nt, Mycobacterium bovis subsp bovis AF2122/97
uccguugacucugcguccacca

SEQ ID NO: 135515 - RNA, 22 nt, Mycobacterium bovis subsp bovis AF2122/97
ucccccuucaaggggaccggag

SEQ ID NO: 135516 - RNA, 22 nt, Mycobacterium bovis subsp bovis AF2122/97
gacccgauggaaguacccggca

SEQ ID NO: 135517 - RNA, 22 nt, Mycobacterium bovis subsp bovis AF2122/97
agcucgccguggcguuacgcuc

SEQ ID NO: 135518 - RNA, 22 nt, Mycobacterium bovis subsp bovis AF2122/97
gucgucgacgauccgacugagc

SEQ ID NO: 135519 - RNA, 22 nt, Mycobacterium bovis subsp bovis AF2122/97
ggccguugauucugcguccacc

SEQ ID NO: 135520 - RNA, 21 nt, Mycobacterium bovis subsp bovis AF2122/97
ggugucuuuggcggggccgcg

SEQ ID NO: 135521 - RNA, 22 nt, Mycobacterium bovis subsp bovis AF2122/97
ggcccgaacccacaucuccacg

SEQ ID NO: 135522 - RNA, 22 nt, Mycobacterium bovis subsp bovis AF2122/97
gcguugcccggccggcgucguc

SEQ ID NO: 135523 - RNA, 22 nt, Mycobacterium bovis subsp bovis AF2122/97
uggugccgggcacaaucacggc

SEQ ID NO: 135524 - RNA, 22 nt, Mycobacterium bovis subsp bovis AF2122/97
cgggucuauggguggaugcucg

SEQ ID NO: 135525 - RNA, 22 nt, Mycobacterium bovis subsp bovis AF2122/97
ggcggcgaugaugcgcacugag

SEQ ID NO: 135526 - RNA, 22 nt, Mycobacterium bovis subsp bovis AF2122/97
acccaggugucgaugcagaccg

SEQ ID NO: 135527 - RNA, 22 nt, Mycobacterium bovis subsp bovis AF2122/97
cguucgucaucguggguuccgg

SEQ ID NO: 135528 - RNA, 22 nt, Mycobacterium bovis subsp bovis AF2122/97
guugcgcauacccgacgugcug

SEQ ID NO: 135529 - RNA, 22 nt, Mycobacterium bovis subsp bovis AF2122/97
cgagcguaacgccaccgcgaaa

SEQ ID NO: 135530 - RNA, 22 nt, Mycobacterium bovis subsp bovis AF2122/97
gcgugccgcgcaaaccauggcc

SEQ ID NO: 135531 - RNA, 22 nt, Mycobacterium bovis subsp bovis AF2122/97
uugggaccaugccgcuggggug

SEQ ID NO: 135532 - RNA, 21 nt, Mycobacterium bovis subsp bovis AF2122/97
gaccgggaugaacggguacga

SEQ ID NO: 135533 - RNA, 22 nt, Mycobacterium bovis subsp bovis AF2122/97
gagcgcagcccggcaugggugg

SEQ ID NO: 135534 - RNA, 22 nt, Mycobacterium bovis subsp bovis AF2122/97
cgucaccaucgaagcggcgcac

SEQ ID NO: 135535 - RNA, 20 nt, Mycobacterium bovis subsp bovis AF2122/97
cucguccaggacggcaaguu

SEQ ID NO: 135536 - RNA, 22 nt, Mycobacterium bovis subsp bovis AF2122/97
gccgugcuggauuuggccggcg

SEQ ID NO: 135537 - RNA, 22 nt, Mycobacterium bovis subsp bovis AF2122/97
gccguacgucuucgaugcugac

SEQ ID NO: 135538 - RNA, 23 nt, Mycobacterium bovis subsp bovis AF2122/97
ucuguacgcggagccggacgugc

SEQ ID NO: 135539 - RNA, 22 nt, Mycobacterium bovis subsp bovis AF2122/97
cgucgugauugucaugcaacca

SEQ ID NO: 135540 - RNA, 22 nt, Mycobacterium bovis subsp bovis AF2122/97
ugguggccgggaucggcauggc

SEQ ID NO: 135541 - RNA, 22 nt, Mycobacterium bovis subsp bovis AF2122/97
gguucaccgacgccgccgaguc

SEQ ID NO: 135542 - RNA, 22 nt, Mycobacterium bovis subsp bovis AF2122/97
cuugccaugugacugcggccga

SEQ ID NO: 135543 - RNA, 20 nt, Mycobacterium bovis subsp bovis AF2122/97
gagccgcagcgggacccggu

SEQ ID NO: 135544 - RNA, 22 nt, Mycobacterium bovis subsp bovis AF2122/97
uccauaccgcgguauccgguga

SEQ ID NO: 135545 - RNA, 22 nt, Mycobacterium bovis subsp bovis AF2122/97
gaggggauuuugcgucugcuca

SEQ ID NO: 135546 - RNA, 17 nt, Mycobacterium bovis subsp bovis AF2122/97
cgguggaugcgcaguug

SEQ ID NO: 135547 - RNA, 22 nt, Mycobacterium bovis subsp bovis AF2122/97
gcgcuggucggaauuccucgaa

SEQ ID NO: 135548 - RNA, 22 nt, Mycobacterium bovis subsp bovis AF2122/97
gagcagacacacaaucgcaucc

SEQ ID NO: 135549 - RNA, 20 nt, Mycobacterium bovis subsp bovis AF2122/97
ucgcagccagguuacgcucg

SEQ ID NO: 135550 - RNA, 22 nt, Mycobacterium bovis subsp bovis AF2122/97
gugauccaucucuaugagcgug

SEQ ID NO: 135551 - RNA, 22 nt, Mycobacterium bovis subsp bovis AF2122/97
agucuuggugaccguccgguac

SEQ ID NO: 135552 - RNA, 22 nt, Mycobacterium bovis subsp bovis AF2122/97
ggacugccaacuucggguuguu

SEQ ID NO: 135553 - RNA, 22 nt, Mycobacterium bovis subsp bovis AF2122/97
cgaacagacacagaaucgcacg

SEQ ID NO: 135554 - RNA, 22 nt, Mycobacterium bovis subsp bovis AF2122/97
ucugcuggucgaugcgggacug

SEQ ID NO: 135555 - RNA, 22 nt, Mycobacterium bovis subsp bovis AF2122/97
cgccgagggugaaucucacgac

SEQ ID NO: 135556 - RNA, 22 nt, Mycobacterium bovis subsp bovis AF2122/97
cagccacaccagcccuuaugcg

SEQ ID NO: 135557 - RNA, 20 nt, Mycobacterium bovis subsp bovis AF2122/97
ugcuguguccgucggcgccc

SEQ ID NO: 135558 - RNA, 22 nt, Mycobacterium bovis subsp bovis AF2122/97
agccggagucaccgaaaucacu

SEQ ID NO: 135559 - RNA, 22 nt, Mycobacterium bovis subsp bovis AF2122/97
uacggcgacccgagguucggcu

SEQ ID NO: 135560 - RNA, 22 nt, Mycobacterium bovis subsp bovis AF2122/97
ccgcgacugugagucuggcgac

SEQ ID NO: 135561 - RNA, 22 nt, Mycobacterium bovis subsp bovis AF2122/97
ccgaacgcaucggugugacguu

SEQ ID NO: 135562 - RNA, 22 nt, Mycobacterium bovis subsp bovis AF2122/97
ggcggcuaccugaaggacauca

SEQ ID NO: 135563 - RNA, 22 nt, Mycobacterium bovis subsp bovis AF2122/97
gccgguugcuggcccgauugcc

SEQ ID NO: 135564 - RNA, 22 nt, Mycobacterium bovis subsp bovis AF2122/97
cggcgccuguuggaccggcgcc

SEQ ID NO: 135565 - RNA, 22 nt, Mycobacterium bovis subsp bovis AF2122/97
ccgacgaggaaauggcuccgau

SEQ ID NO: 135566 - RNA, 22 nt, Mycobacterium bovis subsp bovis AF2122/97
ggccacgccgcccuugccggac

SEQ ID NO: 135567 - RNA, 22 nt, Mycobacterium bovis subsp bovis AF2122/97
ucgucgggccgagguuuucggc

SEQ ID NO: 135568 - RNA, 20 nt, Mycobacterium bovis subsp bovis AF2122/97
ucucuccguugcugcagcug

SEQ ID NO: 135569 - RNA, 22 nt, Mycobacterium bovis subsp bovis AF2122/97
auugcgagccacgcagguugaa

SEQ ID NO: 135570 - RNA, 22 nt, Mycobacterium bovis subsp bovis AF2122/97
ggugaacgggagguucagcccg

SEQ ID NO: 135571 - RNA, 20 nt, Mycobacterium bovis subsp bovis AF2122/97
cgauggucagcgcuugcgga

SEQ ID NO: 135572 - RNA, 22 nt, Mycobacterium bovis subsp bovis AF2122/97
gcgccaucacacagcgcgucga

SEQ ID NO: 135573 - RNA, 22 nt, Mycobacterium bovis subsp bovis AF2122/97
ccugcacgacggugaugcccgc

SEQ ID NO: 135574 - RNA, 22 nt, Mycobacterium bovis subsp bovis AF2122/97
ucgccgaacgugaacugagggc

SEQ ID NO: 135575 - RNA, 22 nt, Mycobacterium bovis subsp bovis AF2122/97
cuugggcguuugcguucgccgc

SEQ ID NO: 135576 - RNA, 22 nt, Mycobacterium bovis subsp bovis AF2122/97
accugggucgccaccgacgacg

SEQ ID NO: 135577 - RNA, 22 nt, Mycobacterium bovis subsp bovis AF2122/97
acgcccgucguccucuugcacg

SEQ ID NO: 135578 - RNA, 22 nt, Mycobacterium bovis subsp bovis AF2122/97
ccugggugccgaucgagccggu

SEQ ID NO: 135579 - RNA, 22 nt, Mycobacterium bovis subsp bovis AF2122/97
agguucagcgucgagucgagga

SEQ ID NO: 135580 - RNA, 22 nt, Mycobacterium bovis subsp bovis AF2122/97
accgagucgcgaggcguuccgg

SEQ ID NO: 135581 - RNA, 21 nt, Mycobacterium bovis subsp bovis AF2122/97
caucgucaacacccgcucggu

SEQ ID NO: 135582 - RNA, 22 nt, Mycobacterium bovis subsp bovis AF2122/97
gggggcuuuugcgucugcucgg

SEQ ID NO: 135583 - RNA, 22 nt, Mycobacterium bovis subsp bovis AF2122/97
agugcgacucugcgucugcuca

SEQ ID NO: 135584 - RNA, 21 nt, Mycobacterium bovis subsp bovis AF2122/97
ucgugcgauucacugucggcg

SEQ ID NO: 135585 - RNA, 22 nt, Mycobacterium bovis subsp bovis AF2122/97
cccgguugaccgaagccggacu

SEQ ID NO: 135586 - RNA, 20 nt, Mycobacterium bovis subsp bovis AF2122/97
ucgacgugccccggaucacc

SEQ ID NO: 135587 - RNA, 22 nt, Mycobacterium bovis subsp bovis AF2122/97
uguuggggcuguccgguccggu

SEQ ID NO: 135588 - RNA, 22 nt, Mycobacterium bovis subsp bovis AF2122/97
ccgaggccgcguucgaguacgc

SEQ ID NO: 135589 - RNA, 22 nt, Mycobacterium bovis subsp bovis AF2122/97
uaucgagggcaccggccuguuc

SEQ ID NO: 135590 - RNA, 22 nt, Mycobacterium bovis subsp bovis AF2122/97
gaggagguguaccggguagagg

SEQ ID NO: 135591 - RNA, 22 nt, Mycobacterium bovis subsp bovis AF2122/97
cccggugagcugaucuucguga

SEQ ID NO: 135592 - RNA, 22 nt, Mycobacterium bovis subsp bovis AF2122/97
guucgggugcuagaugccgcau

SEQ ID NO: 135593 - RNA, 22 nt, Mycobacterium bovis subsp bovis AF2122/97
cccagccaggguaaggccuuug

SEQ ID NO: 135594 - RNA, 22 nt, Mycobacterium bovis subsp bovis AF2122/97
cggugucgaagaucgugggaca

SEQ ID NO: 135595 - RNA, 22 nt, Mycobacterium bovis subsp bovis AF2122/97
gccgggaugcacgcacgucacc

SEQ ID NO: 135596 - RNA, 23 nt, Mycobacterium bovis subsp bovis AF2122/97
ucgcagugccguuacgcucgugg

SEQ ID NO: 135597 - RNA, 22 nt, Mycobacterium bovis subsp bovis AF2122/97
ugaucgcuaggugcucgccggc

SEQ ID NO: 135598 - RNA, 22 nt, Mycobacterium bovis subsp bovis AF2122/97
augccagcgcgaagaccgccag

SEQ ID NO: 135599 - RNA, 22 nt, Mycobacterium bovis subsp bovis AF2122/97
ugguguaacggucuugcauucg

SEQ ID NO: 135600 - RNA, 22 nt, Mycobacterium bovis subsp bovis AF2122/97
acuccucagccggcggcccugg

SEQ ID NO: 135601 - RNA, 22 nt, Mycobacterium bovis subsp bovis AF2122/97
ucgucgccgguguaguccagcc

SEQ ID NO: 135602 - RNA, 22 nt, Mycobacterium bovis subsp bovis AF2122/97
gcccggagagaucggcgcugac

SEQ ID NO: 135603 - RNA, 19 nt, Mycobacterium bovis subsp bovis AF2122/97
gcgguggcucgugggcgcg

SEQ ID NO: 135604 - RNA, 22 nt, Mycobacterium bovis subsp bovis AF2122/97
cgagguguggucauggagcacc

SEQ ID NO: 135605 - RNA, 22 nt, Mycobacterium bovis subsp bovis AF2122/97
uugccggacggcagcaccagca

SEQ ID NO: 135606 - RNA, 22 nt, Mycobacterium bovis subsp bovis AF2122/97
cgugauacggaagcucgccgag

SEQ ID NO: 135607 - RNA, 22 nt, Mycobacterium bovis subsp bovis AF2122/97
gguggcagcggguccggcgacu

SEQ ID NO: 135608 - RNA, 22 nt, Mycobacterium bovis subsp bovis AF2122/97
gcagucgacagcguugcuaccg

SEQ ID NO: 135609 - RNA, 22 nt, Mycobacterium bovis subsp bovis AF2122/97
caucgggaaauuccauggcgug

SEQ ID NO: 135610 - RNA, 22 nt, Mycobacterium bovis subsp bovis AF2122/97
gcuggccgcgcuggcgugggug

SEQ ID NO: 135611 - RNA, 22 nt, Mycobacterium bovis subsp bovis AF2122/97
ucgucgucgcgguccugcuggu

SEQ ID NO: 135612 - RNA, 22 nt, Mycobacterium bovis subsp bovis AF2122/97
gcgagcguaacgccacggcgag

SEQ ID NO: 135613 - RNA, 23 nt, Mycobacterium bovis subsp bovis AF2122/97
ggcuggacuggucgacaccgcag

SEQ ID NO: 135614 - RNA, 22 nt, Mycobacterium bovis subsp bovis AF2122/97
ucgaugagcgauuggaacaacg

SEQ ID NO: 135615 - RNA, 22 nt, Mycobacterium bovis subsp bovis AF2122/97
aucggcaucgggaucgugcugg

SEQ ID NO: 135616 - RNA, 22 nt, Mycobacterium bovis subsp bovis AF2122/97
ggugaggucguagccgguggac

SEQ ID NO: 135617 - RNA, 22 nt, Mycobacterium bovis subsp bovis AF2122/97
gguggucccagcuucuguugug

SEQ ID NO: 135618 - RNA, 22 nt, Mycobacterium bovis subsp bovis AF2122/97
ggggauuuugcgucugcucggc

SEQ ID NO: 135619 - RNA, 22 nt, Mycobacterium bovis subsp bovis AF2122/97
caaccgcgacgcucaggccagc

SEQ ID NO: 135620 - RNA, 21 nt, Mycobacterium bovis subsp bovis AF2122/97
acgcggugaucaucuuggacg

SEQ ID NO: 135621 - RNA, 22 nt, Mycobacterium bovis subsp bovis AF2122/97
gcugcaacaucaaaccgacucc

SEQ ID NO: 135622 - RNA, 22 nt, Mycobacterium bovis subsp bovis AF2122/97
ugcgccgagaucgacguuagcg

SEQ ID NO: 135623 - RNA, 22 nt, Mycobacterium bovis subsp bovis AF2122/97
cgagcagacacagaaucgccca

SEQ ID NO: 135624 - RNA, 22 nt, Mycobacterium bovis subsp bovis AF2122/97
gugcucaugaccggccaaugcg

SEQ ID NO: 135625 - RNA, 22 nt, Mycobacterium bovis subsp bovis AF2122/97
gggcuuuugcgucugcucgccg

SEQ ID NO: 135626 - RNA, 22 nt, Mycobacterium bovis subsp bovis AF2122/97
ugguggacgcagagucaacgga

SEQ ID NO: 135627 - RNA, 22 nt, Mycobacterium bovis subsp bovis AF2122/97
ugcgugaagccuucgacgguca

SEQ ID NO: 135628 - RNA, 23 nt, Mycobacterium bovis subsp bovis AF2122/97
gucgccgaauucacuaucggcgg

SEQ ID NO: 135629 - RNA, 22 nt, Mycobacterium bovis subsp bovis AF2122/97
cccggcggcuuugcucgcccag

SEQ ID NO: 135630 - RNA, 22 nt, Mycobacterium bovis subsp bovis AF2122/97
ugcugguagagagugccguacg

SEQ ID NO: 135631 - RNA, 22 nt, Mycobacterium bovis subsp bovis AF2122/97
cgugagcagacgcaaaaucccc

SEQ ID NO: 135632 - RNA, 22 nt, Mycobacterium bovis subsp bovis AF2122/97
aaacggcugugcgaucccaugg

SEQ ID NO: 135633 - RNA, 22 nt, Mycobacterium bovis subsp bovis AF2122/97
ugcgccgaaggcccagcgcgga

SEQ ID NO: 135634 - RNA, 22 nt, Mycobacterium bovis subsp bovis AF2122/97
guucgcaucgaggagcggcaua

SEQ ID NO: 135635 - RNA, 22 nt, Mycobacterium bovis subsp bovis AF2122/97
ccgucgagaucgacgucagcgc

SEQ ID NO: 135636 - RNA, 22 nt, Mycobacterium bovis subsp bovis AF2122/97
gggcggcgucaagcagaaucac

SEQ ID NO: 135637 - RNA, 22 nt, Mycobacterium bovis subsp bovis AF2122/97
cgucgccgucccaggugaacca

SEQ ID NO: 135638 - RNA, 22 nt, Mycobacterium bovis subsp bovis AF2122/97
agccaagccguaguccucgacg

SEQ ID NO: 135639 - RNA, 22 nt, Mycobacterium bovis subsp bovis AF2122/97
ggcugacggcguggcggugcug

SEQ ID NO: 135640 - RNA, 22 nt, Mycobacterium bovis subsp bovis AF2122/97
gcgucgauugccuccgccucgg

SEQ ID NO: 135641 - RNA, 22 nt, Mycobacterium bovis subsp bovis AF2122/97
caggacgguuagugcugauggg

SEQ ID NO: 135642 - RNA, 22 nt, Mycobacterium bovis subsp bovis AF2122/97
guugccgcuccgggacgggcca

SEQ ID NO: 135643 - RNA, 22 nt, Mycobacterium bovis subsp bovis AF2122/97
ggguggacaccagcacguagug

SEQ ID NO: 135644 - RNA, 22 nt, Mycobacterium bovis subsp bovis AF2122/97
aaccggugcaacaacgcacgcu

SEQ ID NO: 135645 - RNA, 22 nt, Mycobacterium bovis subsp bovis AF2122/97
uucaucaguuggucgagguuga

SEQ ID NO: 135646 - RNA, 23 nt, Mycobacterium bovis subsp bovis AF2122/97
ugcgucagcagcggugcugccag

SEQ ID NO: 135647 - RNA, 22 nt, Mycobacterium bovis subsp bovis AF2122/97
ggucgacucgaucggcgagccc

SEQ ID NO: 135648 - RNA, 22 nt, Mycobacterium bovis subsp bovis AF2122/97
cugucgcgagcgcugcuaggca

SEQ ID NO: 135649 - RNA, 21 nt, Mycobacterium bovis subsp bovis AF2122/97
ugcggccacggcaaccugugc

SEQ ID NO: 135650 - RNA, 22 nt, Mycobacterium bovis subsp bovis AF2122/97
guggcgacaagagccguaaacu

SEQ ID NO: 135651 - RNA, 20 nt, Mycobacterium bovis subsp bovis AF2122/97
caucgguucucgggccagca

SEQ ID NO: 135652 - RNA, 22 nt, Mycobacterium bovis subsp bovis AF2122/97
uucaggccgaucggaggacgcc

SEQ ID NO: 135653 - RNA, 20 nt, Mycobacterium bovis subsp bovis AF2122/97
ggcgauuuugcgucugcucg

SEQ ID NO: 135654 - RNA, 22 nt, Mycobacterium bovis subsp bovis AF2122/97
uggucgcuguaaugcguugcuc

SEQ ID NO: 135655 - RNA, 22 nt, Mycobacterium bovis subsp bovis AF2122/97
guagugcauuucacagucggau

SEQ ID NO: 135656 - RNA, 22 nt, Mycobacterium bovis subsp bovis AF2122/97
uucgguauguccucuccgucga

SEQ ID NO: 135657 - RNA, 22 nt, Mycobacterium bovis subsp bovis AF2122/97
gcgcuguggcucacgacgacga

SEQ ID NO: 135658 - RNA, 22 nt, Mycobacterium bovis subsp bovis AF2122/97
agugcucgucguccugcucgac

SEQ ID NO: 135659 - RNA, 22 nt, Mycobacterium bovis subsp bovis AF2122/97
acuguuggccgcggagguauuc

SEQ ID NO: 135660 - RNA, 21 nt, Mycobacterium bovis subsp bovis AF2122/97
cauccguucggaggaccggca

SEQ ID NO: 135661 - RNA, 22 nt, Mycobacterium bovis subsp bovis AF2122/97
uggcagccaucacuuugucgcg

SEQ ID NO: 135662 - RNA, 22 nt, Mycobacterium bovis subsp bovis AF2122/97
cgcggguugagcuugcguccgu

SEQ ID NO: 135663 - RNA, 22 nt, Mycobacterium bovis subsp bovis AF2122/97
gcgaccgcaggaccaagcgcgg

SEQ ID NO: 135664 - RNA, 22 nt, Mycobacterium bovis subsp bovis AF2122/97
gccggaucuugccgcugguggu

SEQ ID NO: 135665 - RNA, 22 nt, Mycobacterium bovis subsp bovis AF2122/97
ucauguucuuucgcgucuacuc

SEQ ID NO: 135666 - RNA, 20 nt, Mycobacterium bovis subsp bovis AF2122/97
cggggacuuucaccucgucc

SEQ ID NO: 135667 - RNA, 22 nt, Mycobacterium bovis subsp bovis AF2122/97
gccgcacugcagcgacggccgg

SEQ ID NO: 135668 - RNA, 22 nt, Mycobacterium bovis subsp bovis AF2122/97
aagaguucgcgcagcgccucgg

SEQ ID NO: 135669 - RNA, 22 nt, Mycobacterium bovis subsp bovis AF2122/97
aaagcggucaaggacgcguucg

SEQ ID NO: 135670 - RNA, 22 nt, Mycobacterium bovis subsp bovis AF2122/97
gucgugagauucacagucgcag

SEQ ID NO: 135671 - RNA, 22 nt, Mycobacterium bovis subsp bovis AF2122/97
ggccgcggugcagcgaucguug

SEQ ID NO: 135672 - RNA, 20 nt, Mycobacterium bovis subsp bovis AF2122/97
ccgggcggaacgugucagcc

SEQ ID NO: 135673 - RNA, 22 nt, Mycobacterium bovis subsp bovis AF2122/97
gacgucgagggugauggugcgg

SEQ ID NO: 135674 - RNA, 22 nt, Mycobacterium bovis subsp bovis AF2122/97
gccgaauccagccaggagugug

SEQ ID NO: 135675 - RNA, 17 nt, Mycobacterium bovis subsp bovis AF2122/97
cguuggucggugaaugg

SEQ ID NO: 135676 - RNA, 22 nt, Mycobacterium bovis subsp bovis AF2122/97
ccgacugugaaucucacgacgc

SEQ ID NO: 135677 - RNA, 22 nt, Mycobacterium bovis subsp bovis AF2122/97
cgguuguguaucgaucgcaguu

SEQ ID NO: 135678 - RNA, 22 nt, Mycobacterium bovis subsp bovis AF2122/97
ggcccaggucacacacaucgca

SEQ ID NO: 135679 - RNA, 22 nt, Mycobacterium bovis subsp bovis AF2122/97
ggggucagcgccaggcgguggu

SEQ ID NO: 135680 - RNA, 22 nt, Mycobacterium bovis subsp bovis AF2122/97
acggacgacgagugcaucggug

SEQ ID NO: 135681 - RNA, 22 nt, Mycobacterium bovis subsp bovis AF2122/97
ggcggugcacagugccacaucg

SEQ ID NO: 135682 - RNA, 22 nt, Mycobacterium bovis subsp bovis AF2122/97
caucgucguggcagguguuggg

SEQ ID NO: 135683 - RNA, 22 nt, Mycobacterium bovis subsp bovis AF2122/97
acugccgacgucgauggugguu

SEQ ID NO: 135684 - RNA, 22 nt, Mycobacterium bovis subsp bovis AF2122/97
gacagcgauccgccggcgcggu

SEQ ID NO: 135685 - RNA, 22 nt, Mycobacterium bovis subsp bovis AF2122/97
ugcgggcgcugauguggucuca

SEQ ID NO: 135686 - RNA, 22 nt, Mycobacterium bovis subsp bovis AF2122/97
accagcucgcggggcagcuuga

SEQ ID NO: 135687 - RNA, 22 nt, Mycobacterium bovis subsp bovis AF2122/97
caagggcaucgaguugggcacc

SEQ ID NO: 135688 - RNA, 22 nt, Mycobacterium bovis subsp bovis AF2122/97
aaucggcacuguugcagcgggu

SEQ ID NO: 135689 - RNA, 22 nt, Mycobacterium bovis subsp bovis AF2122/97
ucuuucccuccagaucggugcg

SEQ ID NO: 135690 - RNA, 22 nt, Mycobacterium bovis subsp bovis AF2122/97
aucgcacguucugcugcagcgc

SEQ ID NO: 135691 - RNA, 22 nt, Mycobacterium bovis subsp bovis AF2122/97
ccguccuggcaggugcuggguu

SEQ ID NO: 135692 - RNA, 22 nt, Mycobacterium bovis subsp bovis AF2122/97
gucagggcgacuuuuugauccg

SEQ ID NO: 135693 - RNA, 22 nt, Mycobacterium bovis subsp bovis AF2122/97
ucggugagcuuggcagccugcg

SEQ ID NO: 135694 - RNA, 20 nt, Mycobacterium bovis subsp bovis AF2122/97
ccgagcuggaagugucggcc

SEQ ID NO: 135695 - RNA, 22 nt, Mycobacterium bovis subsp bovis AF2122/97
cccuaucuggucgcacgaggcg

SEQ ID NO: 135696 - RNA, 22 nt, Mycobacterium bovis subsp bovis AF2122/97
auugguaccggugcgcccggua

SEQ ID NO: 135697 - RNA, 22 nt, Mycobacterium bovis subsp bovis AF2122/97
ucgucgguggacaaggcggccc

SEQ ID NO: 135698 - RNA, 22 nt, Mycobacterium bovis subsp bovis AF2122/97
ugguccgauucgaacuccucgc

SEQ ID NO: 135699 - RNA, 22 nt, Mycobacterium bovis subsp bovis AF2122/97
gcggccaacgaggcagcggcgg

SEQ ID NO: 135700 - RNA, 22 nt, Mycobacterium bovis subsp bovis AF2122/97
ugggggcuuuuacgucugcucg

SEQ ID NO: 135701 - RNA, 22 nt, Mycobacterium bovis subsp bovis AF2122/97
aggcugucggcucucaccgaca

SEQ ID NO: 135702 - RNA, 22 nt, Mycobacterium bovis subsp bovis AF2122/97
cucggccguggcgucgaucaga

SEQ ID NO: 135703 - RNA, 22 nt, Mycobacterium bovis subsp bovis AF2122/97
gcccugaguucacgcucggcgc

SEQ ID NO: 135704 - RNA, 22 nt, Mycobacterium bovis subsp bovis AF2122/97
gaccugguugacaccggcgacc

SEQ ID NO: 135705 - RNA, 22 nt, Mycobacterium bovis subsp bovis AF2122/97
auguugcuguacucgccgaugu

SEQ ID NO: 135706 - RNA, 22 nt, Mycobacterium bovis subsp bovis AF2122/97
aacacgaccagccaggcauagg

SEQ ID NO: 135707 - RNA, 22 nt, Mycobacterium bovis subsp bovis AF2122/97
gguaucggugacgcgcgaccgg

SEQ ID NO: 135708 - RNA, 18 nt, Mycobacterium bovis subsp bovis AF2122/97
cggcuagccgaguacggc

SEQ ID NO: 135709 - RNA, 22 nt, Mycobacterium bovis subsp bovis AF2122/97
aucggaucacauugcgcccgga

SEQ ID NO: 135710 - RNA, 22 nt, Mycobacterium bovis subsp bovis AF2122/97
ccgagcuuggccgccgccaccu

SEQ ID NO: 135711 - RNA, 22 nt, Mycobacterium bovis subsp bovis AF2122/97
ccgugcugccguucaccggccu

SEQ ID NO: 135712 - RNA, 22 nt, Mycobacterium bovis subsp bovis AF2122/97
acgucgacauccgugcaccagg

SEQ ID NO: 135713 - RNA, 21 nt, Mycobacterium bovis subsp bovis AF2122/97
ugacgccaucaaguccgccgg

SEQ ID NO: 135714 - RNA, 22 nt, Mycobacterium bovis subsp bovis AF2122/97
ugaucgagacggcgaagcggcu

SEQ ID NO: 135715 - RNA, 22 nt, Mycobacterium bovis subsp bovis AF2122/97
gaagacgcaaaagcuccuaaau

SEQ ID NO: 135716 - RNA, 22 nt, Mycobacterium bovis subsp bovis AF2122/97
ccgccgaugacauauugccgcu

SEQ ID NO: 135717 - RNA, 22 nt, Mycobacterium bovis subsp bovis AF2122/97
cgccagcauggagggcaccaac

SEQ ID NO: 135718 - RNA, 22 nt, Mycobacterium bovis subsp bovis AF2122/97
aacggucugcgguugccagucg

SEQ ID NO: 135719 - RNA, 21 nt, Mycobacterium bovis subsp bovis AF2122/97
ugggggcuuuugcgucugcuc

SEQ ID NO: 135720 - RNA, 22 nt, Mycobacterium bovis subsp bovis AF2122/97
ccgagacugacguuuugcagug

SEQ ID NO: 135721 - RNA, 22 nt, Mycobacterium bovis subsp bovis AF2122/97
ggcccgugucgucgaccggccg

SEQ ID NO: 135722 - RNA, 22 nt, Mycobacterium bovis subsp bovis AF2122/97
aucacgucaaggaggugcggcu

SEQ ID NO: 135723 - RNA, 21 nt, Mycobacterium bovis subsp bovis AF2122/97
augucacgcgguccugaucgc

SEQ ID NO: 135724 - RNA, 22 nt, Mycobacterium bovis subsp bovis AF2122/97
acggucucggugcgugggguuu

SEQ ID NO: 135725 - RNA, 22 nt, Mycobacterium bovis subsp bovis AF2122/97
agaccuagccggcucgccggac

SEQ ID NO: 135726 - RNA, 22 nt, Mycobacterium bovis subsp bovis AF2122/97
aguucgcccacggcuguguguc

SEQ ID NO: 135727 - RNA, 22 nt, Mycobacterium bovis subsp bovis AF2122/97
uggcggagacgcuggcccgcga

SEQ ID NO: 135728 - RNA, 22 nt, Mycobacterium bovis subsp bovis AF2122/97
gacggguguucccggaucggug

SEQ ID NO: 135729 - RNA, 22 nt, Mycobacterium bovis subsp bovis AF2122/97
gacaaccguucugaugccgcgu

SEQ ID NO: 135730 - RNA, 22 nt, Mycobacterium bovis subsp bovis AF2122/97
uuggggugucggugcucugccc

SEQ ID NO: 135731 - RNA, 22 nt, Mycobacterium bovis subsp bovis AF2122/97
ggcggccgucgacggcggugac

SEQ ID NO: 135732 - RNA, 22 nt, Mycobacterium bovis subsp bovis AF2122/97
ggcgacgguucgcgguggccgu

SEQ ID NO: 135733 - RNA, 22 nt, Mycobacterium bovis subsp bovis AF2122/97
agguaaccacacaugccgcagg

SEQ ID NO: 135734 - RNA, 22 nt, Mycobacterium bovis subsp bovis AF2122/97
uccgucggugauccuggccacc

SEQ ID NO: 135735 - RNA, 22 nt, Mycobacterium bovis subsp bovis AF2122/97
ucucgaucagcaccgcaaggcc

SEQ ID NO: 135736 - RNA, 22 nt, Mycobacterium bovis subsp bovis AF2122/97
gcuacgucggaucugucggccg

SEQ ID NO: 135737 - RNA, 22 nt, Mycobacterium bovis subsp bovis AF2122/97
gggaaguguccacgugcccgca

SEQ ID NO: 135738 - RNA, 22 nt, Mycobacterium bovis subsp bovis AF2122/97
ggggccaugccgaggacacggu

SEQ ID NO: 135739 - RNA, 22 nt, Mycobacterium bovis subsp bovis AF2122/97
cgagcagacgcaaaaucacccg

SEQ ID NO: 135740 - RNA, 22 nt, Mycobacterium bovis subsp bovis AF2122/97
cgauguggcacugugcaccgcc

SEQ ID NO: 135741 - RNA, 22 nt, Mycobacterium bovis subsp bovis AF2122/97
caggggcucgauccggccgggc

SEQ ID NO: 135742 - RNA, 22 nt, Mycobacterium bovis subsp bovis AF2122/97
gggcggcaccgucaggucggcu

SEQ ID NO: 135743 - RNA, 20 nt, Mycobacterium bovis subsp bovis AF2122/97
ucgcagugcgguuacgcucg

SEQ ID NO: 135744 - RNA, 22 nt, Mycobacterium bovis subsp bovis AF2122/97
cgguggauucccggccugcaca

SEQ ID NO: 135745 - RNA, 22 nt, Mycobacterium bovis subsp bovis AF2122/97
gcucaugucgccguagaccggg

SEQ ID NO: 135746 - RNA, 20 nt, Mycobacterium bovis subsp bovis AF2122/97
ugcgauugugugucugcucg

SEQ ID NO: 135747 - RNA, 22 nt, Mycobacterium bovis subsp bovis AF2122/97
gugugugcggaacggccaucgg

SEQ ID NO: 135748 - RNA, 20 nt, Mycobacterium bovis subsp bovis AF2122/97
gcuugccgacccggcgccgu

SEQ ID NO: 135749 - RNA, 22 nt, Mycobacterium bovis subsp bovis AF2122/97
ucgaaacccagccaccucuugg

SEQ ID NO: 135750 - RNA, 22 nt, Mycobacterium bovis subsp bovis AF2122/97
gagcagacgcaaaaucgcccug

SEQ ID NO: 135751 - RNA, 22 nt, Mycobacterium bovis subsp bovis AF2122/97
uugucguuugccgauuaccuga

SEQ ID NO: 135752 - RNA, 22 nt, Mycobacterium bovis subsp bovis AF2122/97
ucgcugaggcuguaacucugca

SEQ ID NO: 135753 - RNA, 22 nt, Mycobacterium bovis subsp bovis AF2122/97
cccagucgugcucgcucucggc

SEQ ID NO: 135754 - RNA, 22 nt, Mycobacterium bovis subsp bovis AF2122/97
uucgcgcacuggguggcggccg

SEQ ID NO: 135755 - RNA, 22 nt, Mycobacterium bovis subsp bovis AF2122/97
cgguguuguagucgccgguguu

SEQ ID NO: 135756 - RNA, 22 nt, Mycobacterium bovis subsp bovis AF2122/97
gaugggugccacggugaauggu

SEQ ID NO: 135757 - RNA, 23 nt, Mycobacterium bovis subsp bovis AF2122/97
ccgggcgcacuggcgagcugcuu

SEQ ID NO: 135758 - RNA, 22 nt, Mycobacterium bovis subsp bovis AF2122/97
uccggcggugguguagcuucga

SEQ ID NO: 135759 - RNA, 22 nt, Mycobacterium bovis subsp bovis AF2122/97
cgaauacgccgcggucgccgac

SEQ ID NO: 135760 - RNA, 22 nt, Mycobacterium bovis subsp bovis AF2122/97
ugggggcuuuugcgucugcucg

SEQ ID NO: 135761 - RNA, 22 nt, Mycobacterium bovis subsp bovis AF2122/97
caugggugcgguaagcgcgucu

SEQ ID NO: 135762 - RNA, 22 nt, Mycobacterium bovis subsp bovis AF2122/97
ugacgaggaugauucggccgcg

SEQ ID NO: 135763 - RNA, 21 nt, Mycobacterium bovis subsp bovis AF2122/97
augucguccaccggcuuaugg

SEQ ID NO: 135764 - RNA, 22 nt, Mycobacterium bovis subsp bovis AF2122/97
aacuccagcaugcucucgguca

SEQ ID NO: 135765 - RNA, 22 nt, Mycobacterium bovis subsp bovis AF2122/97
gucgacauugauuugcuggccg

SEQ ID NO: 135766 - RNA, 22 nt, Mycobacterium bovis subsp bovis AF2122/97
aucagcuuuauuucgccucggg

SEQ ID NO: 135767 - RNA, 22 nt, Mycobacterium bovis subsp bovis AF2122/97
acugcgcccggcgcuggccucc

SEQ ID NO: 135768 - RNA, 22 nt, Mycobacterium bovis subsp bovis AF2122/97
accgcgaccaggucaacacucg

SEQ ID NO: 135769 - RNA, 22 nt, Mycobacterium bovis subsp bovis AF2122/97
ucgucggcucagcuucaccggc

SEQ ID NO: 135770 - RNA, 22 nt, Mycobacterium bovis subsp bovis AF2122/97
ggucggccaucaccuuacgcag

SEQ ID NO: 135771 - RNA, 20 nt, Mycobacterium bovis subsp bovis AF2122/97
agcagugagccgaucgcguc

SEQ ID NO: 135772 - RNA, 21 nt, Mycobacterium bovis subsp bovis AF2122/97
ccgcgcugacacuggaccauc

SEQ ID NO: 135773 - RNA, 22 nt, Mycobacterium bovis subsp bovis AF2122/97
ucuccuucagcagguucgugcg

SEQ ID NO: 135774 - RNA, 22 nt, Mycobacterium bovis subsp bovis AF2122/97
ggugccgcaugacccgcgccgg

SEQ ID NO: 135775 - RNA, 22 nt, Mycobacterium bovis subsp bovis AF2122/97
cgguggcauagguaguugcucg

SEQ ID NO: 135776 - RNA, 22 nt, Mycobacterium bovis subsp bovis AF2122/97
cgagcagacgcagaaucgcacg

SEQ ID NO: 135777 - RNA, 22 nt, Mycobacterium bovis subsp bovis AF2122/97
guaccgacgaucggucggcugc

SEQ ID NO: 135778 - RNA, 22 nt, Mycobacterium bovis subsp bovis AF2122/97
uugucgccgugcagucgcgcga

SEQ ID NO: 135779 - RNA, 22 nt, Mycobacterium bovis subsp bovis AF2122/97
ugaccugagccuugucugcgga

SEQ ID NO: 135780 - RNA, 16 nt, Mycobacterium bovis subsp bovis AF2122/97
ccucaccggccaggcg

SEQ ID NO: 135781 - RNA, 22 nt, Mycobacterium bovis subsp bovis AF2122/97
uucucccuagccggacuugccg

SEQ ID NO: 135782 - RNA, 22 nt, Mycobacterium bovis subsp bovis AF2122/97
ugucccgcacucgauccgcaag

SEQ ID NO: 135783 - RNA, 22 nt, Mycobacterium bovis subsp bovis AF2122/97
cccugguugcacguucggcgug

SEQ ID NO: 135784 - RNA, 22 nt, Mycobacterium bovis subsp bovis AF2122/97
cccccacucaaagcggguucuc

SEQ ID NO: 135785 - RNA, 23 nt, Mycobacterium bovis subsp bovis AF2122/97
ugguggucaccccgacgacgcuc

SEQ ID NO: 135786 - RNA, 22 nt, Mycobacterium bovis subsp bovis AF2122/97
gacggcaugcccgcccagcugc

SEQ ID NO: 135787 - RNA, 23 nt, Mycobacterium bovis subsp bovis AF2122/97
ucccaggugccauacgagcugaa

SEQ ID NO: 135788 - RNA, 19 nt, Mycobacterium bovis subsp bovis AF2122/97
gcacaaacggcucgguucc

SEQ ID NO: 135789 - RNA, 22 nt, Mycobacterium bovis subsp bovis AF2122/97
gcaggccgauguugguaccgca

SEQ ID NO: 135790 - RNA, 22 nt, Mycobacterium bovis subsp bovis AF2122/97
ucggccauggcgcgcuggacau

SEQ ID NO: 135791 - RNA, 22 nt, Mycobacterium bovis subsp bovis AF2122/97
cccuggugguccgaucguucau

SEQ ID NO: 135792 - RNA, 22 nt, Mycobacterium bovis subsp bovis AF2122/97
ccgcgucggccucagccggaaa

SEQ ID NO: 135793 - RNA, 22 nt, Mycobacterium bovis subsp bovis AF2122/97
ccgcggagcaugggcacgauga

SEQ ID NO: 135794 - RNA, 22 nt, Mycobacterium bovis subsp bovis AF2122/97
aguucaaccucuugucggccga

SEQ ID NO: 135795 - RNA, 22 nt, Mycobacterium bovis subsp bovis AF2122/97
cgggcacgguguugaucaccgg

SEQ ID NO: 135796 - RNA, 22 nt, Mycobacterium bovis subsp bovis AF2122/97
cugcaagcccagaucggugcgu

SEQ ID NO: 135797 - RNA, 22 nt, Mycobacterium bovis subsp bovis AF2122/97
gagcgugaacugagggcggaga

SEQ ID NO: 135798 - RNA, 22 nt, Mycobacterium bovis subsp bovis AF2122/97
accgguugcccgccguggaucg

SEQ ID NO: 135799 - RNA, 22 nt, Mycobacterium bovis subsp bovis AF2122/97
ucaaugucgaggauuucaucca

SEQ ID NO: 135800 - RNA, 22 nt, Mycobacterium bovis subsp bovis AF2122/97
uucgcagugcgugcacguucgg

SEQ ID NO: 135801 - RNA, 22 nt, Mycobacterium bovis subsp bovis AF2122/97
gagcagacgcaaaagcacccca

SEQ ID NO: 135802 - RNA, 22 nt, Mycobacterium bovis subsp bovis AF2122/97
gagcaugggcguggacguuguc

SEQ ID NO: 135803 - RNA, 22 nt, Mycobacterium bovis subsp bovis AF2122/97
ggugccaaaagcggaguccagg

SEQ ID NO: 135804 - RNA, 22 nt, Mycobacterium bovis subsp bovis AF2122/97
cgcucuggcguggaucucggcg

SEQ ID NO: 135805 - RNA, 22 nt, Mycobacterium bovis subsp bovis AF2122/97
gccaggucaucgagcgaaucca

SEQ ID NO: 135806 - RNA, 23 nt, Mycobacterium bovis subsp bovis AF2122/97
cugguugcaugacaaucacgacg

SEQ ID NO: 135807 - RNA, 22 nt, Mycobacterium bovis subsp bovis AF2122/97
cggagcagguggacgccgccgc

SEQ ID NO: 135808 - RNA, 22 nt, Mycobacterium bovis subsp bovis AF2122/97
gcggcgccgauguggaagccgu

SEQ ID NO: 135809 - RNA, 22 nt, Mycobacterium bovis subsp bovis AF2122/97
cgugaugguggccgugcagucg

SEQ ID NO: 135810 - RNA, 22 nt, Mycobacterium bovis subsp bovis AF2122/97
agcagacgcagaaucgcaucaa

SEQ ID NO: 135811 - RNA, 22 nt, Mycobacterium bovis subsp bovis AF2122/97
cggcaccggcaacgucggguug

SEQ ID NO: 135812 - RNA, 22 nt, Mycobacterium bovis subsp bovis AF2122/97
ccugacgaaucuggucgugcca

SEQ ID NO: 135813 - RNA, 22 nt, Mycobacterium bovis subsp bovis AF2122/97
cgacguggugguggccggcggu

SEQ ID NO: 135814 - RNA, 22 nt, Mycobacterium bovis subsp bovis AF2122/97
cgagcagacgcauaagcgccca

SEQ ID NO: 135815 - RNA, 22 nt, Mycobacterium bovis subsp bovis AF2122/97
ccgucgauguacuucaggcggu

SEQ ID NO: 135816 - RNA, 22 nt, Mycobacterium bovis subsp bovis AF2122/97
ucgcagugccguuacguucgug

SEQ ID NO: 135817 - RNA, 22 nt, Mycobacterium bovis subsp bovis AF2122/97
ccgcgcugaccgacguuuggcg

SEQ ID NO: 135818 - RNA, 21 nt, Mycobacterium bovis subsp bovis AF2122/97
gcccggcauggacuccucacc

SEQ ID NO: 135819 - RNA, 22 nt, Mycobacterium bovis subsp bovis AF2122/97
ucggcgacuucugcgucugcuc

SEQ ID NO: 135820 - RNA, 22 nt, Mycobacterium bovis subsp bovis AF2122/97
ugccagaacgugaugcuggggc

SEQ ID NO: 135821 - RNA, 22 nt, Mycobacterium bovis subsp bovis AF2122/97
gcgcacgucguugucggcuccu

SEQ ID NO: 135822 - RNA, 22 nt, Mycobacterium bovis subsp bovis AF2122/97
cggucccugaucaaggaccgcu

SEQ ID NO: 135823 - RNA, 22 nt, Mycobacterium bovis subsp bovis AF2122/97
gcaaaacgucagucucggugaa

SEQ ID NO: 135824 - RNA, 22 nt, Mycobacterium bovis subsp bovis AF2122/97
uucagccgugacguuacgcucg

SEQ ID NO: 135825 - RNA, 22 nt, Mycobacterium bovis subsp bovis AF2122/97
ccccggcgcgcacgucgggagu

SEQ ID NO: 135826 - RNA, 22 nt, Mycobacterium bovis subsp bovis AF2122/97
cugcgacugugaaucucacgac

SEQ ID NO: 135827 - RNA, 22 nt, Mycobacterium bovis subsp bovis AF2122/97
uaagcugcgccagccacgccgu

SEQ ID NO: 135828 - RNA, 22 nt, Mycobacterium bovis subsp bovis AF2122/97
cgagccaggcaaucagccgccg

SEQ ID NO: 135829 - RNA, 22 nt, Mycobacterium bovis subsp bovis AF2122/97
gacggggcacagucgucgagca

SEQ ID NO: 135830 - RNA, 20 nt, Mycobacterium bovis subsp bovis AF2122/97
aucaggccggcugcccccgc

SEQ ID NO: 135831 - RNA, 22 nt, Mycobacterium bovis subsp bovis AF2122/97
uccccgcggugcuggcgaugcu

SEQ ID NO: 135832 - RNA, 22 nt, Mycobacterium bovis subsp bovis AF2122/97
cgugaucgugugccucggcugg

SEQ ID NO: 135833 - RNA, 22 nt, Mycobacterium bovis subsp bovis AF2122/97
gagggcacugaacggucgguca

SEQ ID NO: 135834 - RNA, 22 nt, Mycobacterium bovis subsp bovis AF2122/97
gccggugguggacgccgccgcg

SEQ ID NO: 135835 - RNA, 19 nt, Mycobacterium bovis subsp bovis AF2122/97
aagaggucaccgagaucaa

SEQ ID NO: 135836 - RNA, 22 nt, Mycobacterium bovis subsp bovis AF2122/97
uggccuggagcgagggccgcga

SEQ ID NO: 135837 - RNA, 22 nt, Mycobacterium bovis subsp bovis AF2122/97
uucgaacucgccgcgcaccgug

SEQ ID NO: 135838 - RNA, 20 nt, Mycobacterium bovis subsp bovis AF2122/97
cggugcguugaucacguugg

SEQ ID NO: 135839 - RNA, 22 nt, Mycobacterium bovis subsp bovis AF2122/97
cguucgaacgggucgucgaauu

SEQ ID NO: 135840 - RNA, 22 nt, Mycobacterium bovis subsp bovis AF2122/97
gcuggcguugcugaugucgccg

SEQ ID NO: 135841 - RNA, 22 nt, Mycobacterium bovis subsp bovis AF2122/97
gcaccgcaucgccgaacuuccg

SEQ ID NO: 135842 - RNA, 22 nt, Mycobacterium bovis subsp bovis AF2122/97
cgucguggauuucacugucgcg

SEQ ID NO: 135843 - RNA, 22 nt, Mycobacterium bovis subsp bovis AF2122/97
cacaccgcgaugacuccggcga

SEQ ID NO: 135844 - RNA, 22 nt, Mycobacterium bovis subsp bovis AF2122/97
uucgucaccgacggccggcggg

SEQ ID NO: 135845 - RNA, 22 nt, Mycobacterium bovis subsp bovis AF2122/97
cugaugauccagcgcggcugcg

SEQ ID NO: 135846 - RNA, 22 nt, Mycobacterium bovis subsp bovis AF2122/97
caugcaucggaagaaccggcau

SEQ ID NO: 135847 - RNA, 22 nt, Mycobacterium bovis subsp bovis AF2122/97
aaauggggugcuuuugcgucug

SEQ ID NO: 135848 - RNA, 22 nt, Mycobacterium bovis subsp bovis AF2122/97
ggugcuggcggugcugcagcua

SEQ ID NO: 135849 - RNA, 22 nt, Mycobacterium bovis subsp bovis AF2122/97
cccgggucgugccgacccgggu

SEQ ID NO: 135850 - RNA, 22 nt, Mycobacterium bovis subsp bovis AF2122/97
agccggcuggugaccacgauca

SEQ ID NO: 135851 - RNA, 22 nt, Mycobacterium bovis subsp bovis AF2122/97
gagcagacgcagaaucgcaugc

SEQ ID NO: 135852 - RNA, 22 nt, Mycobacterium bovis subsp bovis AF2122/97
gcugugccgagggcuucgcugg

SEQ ID NO: 135853 - RNA, 22 nt, Mycobacterium bovis subsp bovis AF2122/97
ugagcagacgcaaaagaacccg

SEQ ID NO: 135854 - RNA, 22 nt, Mycobacterium bovis subsp bovis AF2122/97
augaucaagccgccgcggcccu

SEQ ID NO: 135855 - RNA, 22 nt, Mycobacterium bovis subsp bovis AF2122/97
gccuggucaccgugccgaaggu

SEQ ID NO: 135856 - RNA, 22 nt, Mycobacterium bovis subsp bovis AF2122/97
gacgguagagaccggcacgccg

SEQ ID NO: 135857 - RNA, 22 nt, Mycobacterium bovis subsp bovis AF2122/97
auggguuagguuuggcggccgc

SEQ ID NO: 135858 - RNA, 22 nt, Mycobacterium bovis subsp bovis AF2122/97
acgcgggugguacccccacugc

SEQ ID NO: 135859 - RNA, 22 nt, Mycobacterium bovis subsp bovis AF2122/97
gcucagcaucgucgaauccucg

SEQ ID NO: 135860 - RNA, 22 nt, Mycobacterium bovis subsp bovis AF2122/97
gggugccgcauucuucagcucg

SEQ ID NO: 135861 - RNA, 22 nt, Mycobacterium bovis subsp bovis AF2122/97
gguggcgcacaucgccgugcac

SEQ ID NO: 135862 - RNA, 22 nt, Mycobacterium bovis subsp bovis AF2122/97
auuuaggagcuuuugcgucuuc

SEQ ID NO: 135863 - RNA, 19 nt, Mycobacterium bovis subsp bovis AF2122/97
ugcacuccaccgcuggcgc

SEQ ID NO: 135864 - RNA, 22 nt, Mycobacterium bovis subsp bovis AF2122/97
ccagauacugcagggaaucggg

SEQ ID NO: 135865 - RNA, 22 nt, Mycobacterium bovis subsp bovis AF2122/97
ggugaucuccaugccgcccggc

SEQ ID NO: 135866 - RNA, 22 nt, Mycobacterium bovis subsp bovis AF2122/97
ucgcuguagaagcuggacugcc

SEQ ID NO: 135867 - RNA, 22 nt, Mycobacterium bovis subsp bovis AF2122/97
acgguacucuuugguaccaaac

SEQ ID NO: 135868 - RNA, 22 nt, Mycobacterium bovis subsp bovis AF2122/97
accgcgaccgcugcgacguugu

SEQ ID NO: 135869 - RNA, 20 nt, Mycobacterium bovis subsp bovis AF2122/97
cuacgcagcgaccauggcgc

SEQ ID NO: 135870 - RNA, 22 nt, Mycobacterium bovis subsp bovis AF2122/97
ggucaccgucacgcucgagccg

SEQ ID NO: 135871 - RNA, 22 nt, Mycobacterium bovis subsp bovis AF2122/97
ggucggucaaggucgcgugcac

SEQ ID NO: 135872 - RNA, 22 nt, Mycobacterium bovis subsp bovis AF2122/97
agcggcucaaacaggaugugcc

SEQ ID NO: 135873 - RNA, 23 nt, Mycobacterium bovis subsp bovis AF2122/97
ugacaguguggaccagcugagcg

SEQ ID NO: 135874 - RNA, 22 nt, Mycobacterium bovis subsp bovis AF2122/97
ggcagcggcacgucgacgcugg

SEQ ID NO: 135875 - RNA, 22 nt, Mycobacterium bovis subsp bovis AF2122/97
gggugcgagccaggccggcucg

SEQ ID NO: 135876 - RNA, 22 nt, Mycobacterium bovis subsp bovis AF2122/97
accugcacuucucgcugcugcc

SEQ ID NO: 135877 - RNA, 22 nt, Mycobacterium bovis subsp bovis AF2122/97
auguuggccgagccgagauuga

SEQ ID NO: 135878 - RNA, 22 nt, Mycobacterium bovis subsp bovis AF2122/97
aggugcacgcugucgagccagc

SEQ ID NO: 135879 - RNA, 22 nt, Mycobacterium bovis subsp bovis AF2122/97
cggcgagcaccgcauccaccgc

SEQ ID NO: 135880 - RNA, 22 nt, Mycobacterium bovis subsp bovis AF2122/97
acacgccacccugcugggcaug

SEQ ID NO: 135881 - RNA, 22 nt, Mycobacterium bovis subsp bovis AF2122/97
gucgacguguccaagcugcaug

SEQ ID NO: 135882 - RNA, 22 nt, Mycobacterium bovis subsp bovis AF2122/97
uuacgccgguugugguuggccg

SEQ ID NO: 135883 - RNA, 22 nt, Mycobacterium bovis subsp bovis AF2122/97
acgacuggcuuucggcaaggug

SEQ ID NO: 135884 - RNA, 22 nt, Mycobacterium bovis subsp bovis AF2122/97
ugagccgauccaggaacgauuc

SEQ ID NO: 135885 - RNA, 22 nt, Mycobacterium bovis subsp bovis AF2122/97
ccgcccaggcucccgcucgacg

SEQ ID NO: 135886 - RNA, 22 nt, Mycobacterium bovis subsp bovis AF2122/97
cagcguaugggcgggcaggcga

SEQ ID NO: 135887 - RNA, 22 nt, Mycobacterium bovis subsp bovis AF2122/97
ugcgagcgugcgggugcucguc

SEQ ID NO: 135888 - RNA, 22 nt, Mycobacterium bovis subsp bovis AF2122/97
cgccugguggggucgaacugug

SEQ ID NO: 135889 - RNA, 20 nt, Mycobacterium bovis subsp bovis AF2122/97
cucgucguucuacugcccgc

SEQ ID NO: 135890 - RNA, 22 nt, Mycobacterium bovis subsp bovis AF2122/97
ucggcaggcugcgccagcugcc

SEQ ID NO: 135891 - RNA, 22 nt, Mycobacterium bovis subsp bovis AF2122/97
aaggcugcggguaugaaacgca

SEQ ID NO: 135892 - RNA, 22 nt, Mycobacterium bovis subsp bovis AF2122/97
gcggacagaauacgcugccgau

SEQ ID NO: 135893 - RNA, 22 nt, Mycobacterium bovis subsp bovis AF2122/97
cggcuggcggaucccgcggauu

SEQ ID NO: 135894 - RNA, 22 nt, Mycobacterium bovis subsp bovis AF2122/97
augcucggggcccggugaucgc

SEQ ID NO: 135895 - RNA, 22 nt, Mycobacterium bovis subsp bovis AF2122/97
acacaccgacgaucucgccgac

SEQ ID NO: 135896 - RNA, 22 nt, Mycobacterium bovis subsp bovis AF2122/97
uggcucgcacuagcgaucggug

SEQ ID NO: 135897 - RNA, 22 nt, Mycobacterium bovis subsp bovis AF2122/97
gccgccggcauugugcuggcuu

SEQ ID NO: 135898 - RNA, 22 nt, Mycobacterium bovis subsp bovis AF2122/97
guguggcagucgcugcggcaug

SEQ ID NO: 135899 - RNA, 22 nt, Mycobacterium bovis subsp bovis AF2122/97
ccagcagcuugcugaucgccuc

SEQ ID NO: 135900 - RNA, 22 nt, Mycobacterium bovis subsp bovis AF2122/97
cugauagacgucggcucgcugc

SEQ ID NO: 135901 - RNA, 22 nt, Mycobacterium bovis subsp bovis AF2122/97
uugaggaucagguucagcuggc

SEQ ID NO: 135902 - RNA, 22 nt, Mycobacterium bovis subsp bovis AF2122/97
uccgguagagccgguuucgccg

SEQ ID NO: 135903 - RNA, 22 nt, Mycobacterium bovis subsp bovis AF2122/97
ggccucgccgcacaguugcggu

SEQ ID NO: 135904 - RNA, 22 nt, Mycobacterium bovis subsp bovis AF2122/97
gcagacgcaaaaucgcccaaau

SEQ ID NO: 135905 - RNA, 22 nt, Mycobacterium bovis subsp bovis AF2122/97
ugguucggcaaucagaucgaag

SEQ ID NO: 135906 - RNA, 22 nt, Mycobacterium bovis subsp bovis AF2122/97
ggcacugucagccuguccucac

SEQ ID NO: 135907 - RNA, 22 nt, Mycobacterium bovis subsp bovis AF2122/97
ucgggaaggcucgguucucguc

SEQ ID NO: 135908 - RNA, 22 nt, Mycobacterium bovis subsp bovis AF2122/97
gacaagggaucgauggccacgg

SEQ ID NO: 135909 - RNA, 20 nt, Mycobacterium bovis subsp bovis AF2122/97
uuuugcccagcacgaucgcc

SEQ ID NO: 135910 - RNA, 21 nt, Mycobacterium bovis subsp bovis AF2122/97
ucgaugugccggaaugcgccc

SEQ ID NO: 135911 - RNA, 22 nt, Mycobacterium bovis subsp bovis AF2122/97
auggucaugucgcugauggugg

SEQ ID NO: 135912 - RNA, 22 nt, Mycobacterium bovis subsp bovis AF2122/97
gauggcgaugcgcaccccgucg

SEQ ID NO: 135913 - RNA, 20 nt, Mycobacterium bovis subsp bovis AF2122/97
ucaucgugucuucgggcgcc

SEQ ID NO: 135914 - RNA, 22 nt, Mycobacterium bovis subsp bovis AF2122/97
accgccaccuugucccugcgcu

SEQ ID NO: 135915 - RNA, 22 nt, Mycobacterium bovis subsp bovis AF2122/97
ccuccugcgccuggcgcaccga

SEQ ID NO: 135916 - RNA, 22 nt, Mycobacterium bovis subsp bovis AF2122/97
ggugcuuuugcgucugcucggc

SEQ ID NO: 135917 - RNA, 22 nt, Mycobacterium bovis subsp bovis AF2122/97
cggacgaaguccucggcguucu

SEQ ID NO: 135918 - RNA, 22 nt, Mycobacterium bovis subsp bovis AF2122/97
auggcugaacgggcgccacgcg

SEQ ID NO: 135919 - RNA, 22 nt, Mycobacterium bovis subsp bovis AF2122/97
gcagcugauugcguucgcggcg

SEQ ID NO: 135920 - RNA, 22 nt, Mycobacterium bovis subsp bovis AF2122/97
gggcggugaacgcagccugguc

SEQ ID NO: 135921 - RNA, 22 nt, Mycobacterium bovis subsp bovis AF2122/97
ugaccagcagugcggccacggc

SEQ ID NO: 135922 - RNA, 22 nt, Mycobacterium bovis subsp bovis AF2122/97
cggccgugguagccgcgcugcu

SEQ ID NO: 135923 - RNA, 19 nt, Mycobacterium bovis subsp bovis AF2122/97
ucgucgucgacgauccgac

SEQ ID NO: 135924 - RNA, 22 nt, Mycobacterium bovis subsp bovis AF2122/97
ucgagcccggcgacuucgugau

SEQ ID NO: 135925 - RNA, 22 nt, Mycobacterium bovis subsp bovis AF2122/97
gagauguucgggaugucgcggg

SEQ ID NO: 135926 - RNA, 22 nt, Mycobacterium bovis subsp bovis AF2122/97
acgucgaguugaccgucgccuu

SEQ ID NO: 135927 - RNA, 22 nt, Mycobacterium bovis subsp bovis AF2122/97
cgaucccgcggucgaacggcac

SEQ ID NO: 135928 - RNA, 22 nt, Mycobacterium bovis subsp bovis AF2122/97
ucagacgaucccguuccugccc

SEQ ID NO: 135929 - RNA, 22 nt, Mycobacterium bovis subsp bovis AF2122/97
gacccgcggggauugcggcgga

SEQ ID NO: 135930 - RNA, 22 nt, Mycobacterium bovis subsp bovis AF2122/97
cgcgagcagacacagaaucgca

SEQ ID NO: 135931 - RNA, 22 nt, Mycobacterium bovis subsp bovis AF2122/97
caccagcggucgucaggugcuc

SEQ ID NO: 135932 - RNA, 22 nt, Mycobacterium bovis subsp bovis AF2122/97
ucggcggcuucgaugacacggu

SEQ ID NO: 135933 - RNA, 22 nt, Mycobacterium bovis subsp bovis AF2122/97
gaucggcgccagguccgaucgc

SEQ ID NO: 135934 - RNA, 21 nt, Mycobacterium bovis subsp bovis AF2122/97
gugaaucgucggaaccgccgu

SEQ ID NO: 135935 - RNA, 22 nt, Mycobacterium bovis subsp bovis AF2122/97
gccugguugggugaucgggacg

SEQ ID NO: 135936 - RNA, 22 nt, Mycobacterium bovis subsp bovis AF2122/97
aucgcgaugaugcugccccgca

SEQ ID NO: 135937 - RNA, 22 nt, Mycobacterium bovis subsp bovis AF2122/97
gugguugucgagcaucaucgcc

SEQ ID NO: 135938 - RNA, 22 nt, Mycobacterium bovis subsp bovis AF2122/97
agccccagucgcuuugucucga

SEQ ID NO: 135939 - RNA, 22 nt, Mycobacterium bovis subsp bovis AF2122/97
agccacaacgacgugcgccuac

SEQ ID NO: 135940 - RNA, 22 nt, Mycobacterium bovis subsp bovis AF2122/97
ccggcggccugaucagccugcu

SEQ ID NO: 135941 - RNA, 22 nt, Mycobacterium bovis subsp bovis AF2122/97
cggccauggcuccggccucggu

SEQ ID NO: 135942 - RNA, 22 nt, Mycobacterium bovis subsp bovis AF2122/97
ccgggcugggccugcgggucau

SEQ ID NO: 135943 - RNA, 22 nt, Mycobacterium bovis subsp bovis AF2122/97
ucucgcagugacguuacgcucg

SEQ ID NO: 135944 - RNA, 22 nt, Mycobacterium bovis subsp bovis AF2122/97
gcgcgaugugcugcucgggucu

SEQ ID NO: 135945 - RNA, 22 nt, Mycobacterium bovis subsp bovis AF2122/97
gucgugacauucacucucgugg

SEQ ID NO: 135946 - RNA, 22 nt, Mycobacterium bovis subsp bovis AF2122/97
gagucagguacuccugcgucgg

SEQ ID NO: 135947 - RNA, 22 nt, Mycobacterium bovis subsp bovis AF2122/97
guucgaaaaccacacugccguu

SEQ ID NO: 135948 - RNA, 22 nt, Mycobacterium bovis subsp bovis AF2122/97
uaggaacuggcuugugcccaau

SEQ ID NO: 135949 - RNA, 22 nt, Mycobacterium bovis subsp bovis AF2122/97
cgcggucugcaugacgaugggc

SEQ ID NO: 135950 - RNA, 22 nt, Mycobacterium bovis subsp bovis AF2122/97
gcggcgaucaagcccgacuagu

SEQ ID NO: 135951 - RNA, 22 nt, Mycobacterium bovis subsp bovis AF2122/97
ugcguuaucccacggcagauag

SEQ ID NO: 135952 - RNA, 22 nt, Mycobacterium bovis subsp bovis AF2122/97
gcuggcugucgggcaacggcgg

SEQ ID NO: 135953 - RNA, 22 nt, Mycobacterium bovis subsp bovis AF2122/97
uggaaaccgaucugggccgcca

SEQ ID NO: 135954 - RNA, 22 nt, Mycobacterium bovis subsp bovis AF2122/97
guaucgaguagccggucgucua

SEQ ID NO: 135955 - RNA, 22 nt, Mycobacterium bovis subsp bovis AF2122/97
cucggcgcgguaguugaugacc

SEQ ID NO: 135956 - RNA, 22 nt, Mycobacterium bovis subsp bovis AF2122/97
gcgcggcuccggugcuugucga

SEQ ID NO: 135957 - RNA, 22 nt, Mycobacterium bovis subsp bovis AF2122/97
gccaggacgucgacagcuucga

SEQ ID NO: 135958 - RNA, 22 nt, Mycobacterium bovis subsp bovis AF2122/97
gggccgccgauguggccgcgau

SEQ ID NO: 135959 - RNA, 22 nt, Mycobacterium bovis subsp bovis AF2122/97
cgauccacugaccgaguagcgc

SEQ ID NO: 135960 - RNA, 22 nt, Mycobacterium bovis subsp bovis AF2122/97
cgaaguaauuucgcggcuggcu

SEQ ID NO: 135961 - RNA, 22 nt, Mycobacterium bovis subsp bovis AF2122/97
uccacgcaacuggccgcgacac

SEQ ID NO: 135962 - RNA, 22 nt, Mycobacterium bovis subsp bovis AF2122/97
auuggccaguggccgggcgcua

SEQ ID NO: 135963 - RNA, 22 nt, Mycobacterium bovis subsp bovis AF2122/97
acgccggcaccccguugcugau

SEQ ID NO: 135964 - RNA, 22 nt, Mycobacterium bovis subsp bovis AF2122/97
gucugcguugagaccagcaucc

SEQ ID NO: 135965 - RNA, 22 nt, Mycobacterium bovis subsp bovis AF2122/97
uugccggccugauggucggugu

SEQ ID NO: 135966 - RNA, 22 nt, Mycobacterium bovis subsp bovis AF2122/97
cguccgaaggcaucggcgaguc

SEQ ID NO: 135967 - RNA, 22 nt, Mycobacterium bovis subsp bovis AF2122/97
uuggcgaguagacgcaaaagcc

SEQ ID NO: 135968 - RNA, 22 nt, Mycobacterium bovis subsp bovis AF2122/97
uuggugggauccagccccagcc

SEQ ID NO: 135969 - RNA, 22 nt, Mycobacterium bovis subsp bovis AF2122/97
uucggucgcggacucgucgcaa

SEQ ID NO: 135970 - RNA, 22 nt, Mycobacterium bovis subsp bovis AF2122/97
gcagcaaaccugagguggcuga

SEQ ID NO: 135971 - RNA, 22 nt, Mycobacterium bovis subsp bovis AF2122/97
cgccacgugccggugcucgacg

SEQ ID NO: 135972 - RNA, 22 nt, Mycobacterium bovis subsp bovis AF2122/97
ucucccggugcaccgccaccaa

SEQ ID NO: 135973 - RNA, 22 nt, Mycobacterium bovis subsp bovis AF2122/97
cgguaguuggccuaggcgucgg

SEQ ID NO: 135974 - RNA, 22 nt, Mycobacterium bovis subsp bovis AF2122/97
auuucgccgugacguuccgcuc

SEQ ID NO: 135975 - RNA, 22 nt, Mycobacterium bovis subsp bovis AF2122/97
cuccaccacccaguaguagaug

SEQ ID NO: 135976 - RNA, 22 nt, Mycobacterium bovis subsp bovis AF2122/97
cgaucgacgccaaucagacgaa

SEQ ID NO: 135977 - RNA, 22 nt, Mycobacterium bovis subsp bovis AF2122/97
acggcaucuccaugggucauga

SEQ ID NO: 135978 - RNA, 22 nt, Mycobacterium bovis subsp bovis AF2122/97
uucgccgagcagacgcaaaagc

SEQ ID NO: 135979 - RNA, 22 nt, Mycobacterium bovis subsp bovis AF2122/97
caagaugacccuaccggugcua

SEQ ID NO: 135980 - RNA, 22 nt, Mycobacterium bovis subsp bovis AF2122/97
aggacgucgucgauuucgucga

SEQ ID NO: 135981 - RNA, 22 nt, Mycobacterium bovis subsp bovis AF2122/97
gcgucgaugucgucgaaggugg

SEQ ID NO: 135982 - RNA, 22 nt, Mycobacterium bovis subsp bovis AF2122/97
gcacggguucguugcugugcau

SEQ ID NO: 135983 - RNA, 22 nt, Mycobacterium bovis subsp bovis AF2122/97
cgucugccccaccuucugcuug

SEQ ID NO: 135984 - RNA, 22 nt, Mycobacterium bovis subsp bovis AF2122/97
aacucgccaucgcgugggcgaa

SEQ ID NO: 135985 - RNA, 22 nt, Mycobacterium bovis subsp bovis AF2122/97
aaugaugccgucgguggccagg

SEQ ID NO: 135986 - RNA, 22 nt, Mycobacterium bovis subsp bovis AF2122/97
auugggcgauucugcgucugcu

SEQ ID NO: 135987 - RNA, 22 nt, Mycobacterium bovis subsp bovis AF2122/97
gcccggcuguugguccgacugg

SEQ ID NO: 135988 - RNA, 22 nt, Mycobacterium bovis subsp bovis AF2122/97
uaaccgcauacgaugucgcugc

SEQ ID NO: 135989 - RNA, 22 nt, Mycobacterium bovis subsp bovis AF2122/97
ccggaacgcccugguggugcug

SEQ ID NO: 135990 - RNA, 22 nt, Mycobacterium bovis subsp bovis AF2122/97
aaggcuggagcgcacagcgcgg

SEQ ID NO: 135991 - RNA, 22 nt, Mycobacterium bovis subsp bovis AF2122/97
ucgcuggucgacgcguucgguc

SEQ ID NO: 135992 - RNA, 22 nt, Mycobacterium bovis subsp bovis AF2122/97
uucggugagaucucuggugcgc

SEQ ID NO: 135993 - RNA, 22 nt, Mycobacterium bovis subsp bovis AF2122/97
cacauccggguucagcuugccc

SEQ ID NO: 135994 - RNA, 22 nt, Mycobacterium bovis subsp bovis AF2122/97
gccgucguguacagcagcgucu

SEQ ID NO: 135995 - RNA, 22 nt, Mycobacterium bovis subsp bovis AF2122/97
gcgcaugaacccuuccugcacc

SEQ ID NO: 135996 - RNA, 22 nt, Mycobacterium bovis subsp bovis AF2122/97
uucuuccaggcagagggcggug

SEQ ID NO: 135997 - RNA, 22 nt, Mycobacterium bovis subsp bovis AF2122/97
ucagguacgcgucagcagauug

SEQ ID NO: 135998 - RNA, 22 nt, Mycobacterium bovis subsp bovis AF2122/97
agcagacgcaaaaugcccccga

SEQ ID NO: 135999 - RNA, 23 nt, Mycobacterium bovis subsp bovis AF2122/97
uggucgaugcggucaaagcacgc

SEQ ID NO: 136000 - RNA, 22 nt, Mycobacterium bovis subsp bovis AF2122/97
agccuugcggacggcacagcug

SEQ ID NO: 136001 - RNA, 22 nt, Mycobacterium bovis subsp bovis AF2122/97
cgaguugguguuuccgcugcag

SEQ ID NO: 136002 - RNA, 22 nt, Mycobacterium bovis subsp bovis AF2122/97
ucgacaacgcgucgaaaggucg

SEQ ID NO: 136003 - RNA, 19 nt, Mycobacterium bovis subsp bovis AF2122/97
gggugaccggccagcgcgc

SEQ ID NO: 136004 - RNA, 22 nt, Mycobacterium bovis subsp bovis AF2122/97
augccgcccggguugaagccac

SEQ ID NO: 136005 - RNA, 22 nt, Mycobacterium bovis subsp bovis AF2122/97
augcugcucggacccagcggcu

SEQ ID NO: 136006 - RNA, 22 nt, Mycobacterium bovis subsp bovis AF2122/97
auucuugggugcugaucucugg

SEQ ID NO: 136007 - RNA, 22 nt, Mycobacterium bovis subsp bovis AF2122/97
gaugcccacgacgacgauaucg

SEQ ID NO: 136008 - RNA, 22 nt, Mycobacterium bovis subsp bovis AF2122/97
guugacugcgcggcccgguacc

SEQ ID NO: 136009 - RNA, 22 nt, Mycobacterium bovis subsp bovis AF2122/97
guuggugugaacgccgugucca

SEQ ID NO: 136010 - RNA, 22 nt, Mycobacterium bovis subsp bovis AF2122/97
ccgcgacugggaauccugcgac

SEQ ID NO: 136011 - RNA, 22 nt, Mycobacterium bovis subsp bovis AF2122/97
gcauucaacgcgucggcgaguu

SEQ ID NO: 136012 - RNA, 22 nt, Mycobacterium bovis subsp bovis AF2122/97
cguuggugaugccggugaccaa

SEQ ID NO: 136013 - RNA, 22 nt, Mycobacterium bovis subsp bovis AF2122/97
ugugcagccgauauugguuacu

SEQ ID NO: 136014 - RNA, 22 nt, Mycobacterium bovis subsp bovis AF2122/97
agcgcgcacuacugccucgccc

SEQ ID NO: 136015 - RNA, 22 nt, Mycobacterium bovis subsp bovis AF2122/97
caucgaggagaugcaggcgugg

SEQ ID NO: 136016 - RNA, 22 nt, Mycobacterium bovis subsp bovis AF2122/97
ugccgggguucgggaauacgac

SEQ ID NO: 136017 - RNA, 22 nt, Mycobacterium bovis subsp bovis AF2122/97
gccgccgucauagccgacacca

SEQ ID NO: 136018 - RNA, 22 nt, Mycobacterium bovis subsp bovis AF2122/97
cgagcagacgcaaaagccaccg

SEQ ID NO: 136019 - RNA, 22 nt, Mycobacterium bovis subsp bovis AF2122/97
ccgccagcagcugacgcgccac

SEQ ID NO: 136020 - RNA, 22 nt, Mycobacterium bovis subsp bovis AF2122/97
cugggcguccguuuccgcgccg

SEQ ID NO: 136021 - RNA, 22 nt, Mycobacterium bovis subsp bovis AF2122/97
auuuagugggcuuuugcgucug

SEQ ID NO: 136022 - RNA, 22 nt, Mycobacterium bovis subsp bovis AF2122/97
ucucggcgaaagucgacgacgu

SEQ ID NO: 136023 - RNA, 22 nt, Mycobacterium bovis subsp bovis AF2122/97
auccgcuagccaacguuaauaa

SEQ ID NO: 136024 - RNA, 18 nt, Mycobacterium bovis subsp bovis AF2122/97
auugugcguggcuguccg

SEQ ID NO: 136025 - RNA, 22 nt, Mycobacterium bovis subsp bovis AF2122/97
aucgugguggaggagaaccgcu

SEQ ID NO: 136026 - RNA, 22 nt, Mycobacterium bovis subsp bovis AF2122/97
uucgucccaacuuggcgacgcu

SEQ ID NO: 136027 - RNA, 22 nt, Mycobacterium bovis subsp bovis AF2122/97
gcgcgcagucgaaguugaccgg

SEQ ID NO: 136028 - RNA, 22 nt, Mycobacterium bovis subsp bovis AF2122/97
cgagcagacgcauaagcccccg

SEQ ID NO: 136029 - RNA, 22 nt, Mycobacterium bovis subsp bovis AF2122/97
uguaaccgaccgacgugccccg

SEQ ID NO: 136030 - RNA, 22 nt, Mycobacterium bovis subsp bovis AF2122/97
cagacgcaaaaggccccgaaau

SEQ ID NO: 136031 - RNA, 22 nt, Mycobacterium bovis subsp bovis AF2122/97
ugcagcgcaaggauuuugguga

SEQ ID NO: 136032 - RNA, 22 nt, Mycobacterium bovis subsp bovis AF2122/97
ucgucguccuugggucgcacgu

SEQ ID NO: 136033 - RNA, 22 nt, Mycobacterium bovis subsp bovis AF2122/97
gcgccgaugccgacgacaccag

SEQ ID NO: 136034 - RNA, 22 nt, Mycobacterium bovis subsp bovis AF2122/97
uccggcuacggucaccgcguau

SEQ ID NO: 136035 - RNA, 22 nt, Mycobacterium bovis subsp bovis AF2122/97
uccguccggucugaccacuaau

SEQ ID NO: 136036 - RNA, 22 nt, Mycobacterium bovis subsp bovis AF2122/97
cagcaaaagccauucauuucua

SEQ ID NO: 136037 - RNA, 22 nt, Mycobacterium bovis subsp bovis AF2122/97
ucgguguucgaacugcaggccc

SEQ ID NO: 136038 - RNA, 22 nt, Mycobacterium bovis subsp bovis AF2122/97
acggugcggccacgaucuggga

SEQ ID NO: 136039 - RNA, 22 nt, Mycobacterium bovis subsp bovis AF2122/97
ccgauguugccgcugccgaugu

SEQ ID NO: 136040 - RNA, 22 nt, Mycobacterium bovis subsp bovis AF2122/97
gucggcaggaaggaugcgauga

SEQ ID NO: 136041 - RNA, 22 nt, Mycobacterium bovis subsp bovis AF2122/97
ugcugcucgucggcggcuggca

SEQ ID NO: 136042 - RNA, 22 nt, Mycobacterium bovis subsp bovis AF2122/97
ucaucaccggaucgccgccgac

SEQ ID NO: 136043 - RNA, 22 nt, Mycobacterium bovis subsp bovis AF2122/97
ccggacggauuagccggacuca

SEQ ID NO: 136044 - RNA, 22 nt, Mycobacterium bovis subsp bovis AF2122/97
cugcugcuaccgcggaucgugg

SEQ ID NO: 136045 - RNA, 22 nt, Mycobacterium bovis subsp bovis AF2122/97
uacgggaucaccgcccaaugga

SEQ ID NO: 136046 - RNA, 19 nt, Mycobacterium bovis subsp bovis AF2122/97
guauucacucccugcccgc

SEQ ID NO: 136047 - RNA, 22 nt, Mycobacterium bovis subsp bovis AF2122/97
ugaccucguugaaacgagucga

SEQ ID NO: 136048 - RNA, 22 nt, Mycobacterium bovis subsp bovis AF2122/97
ccgcacggucacggugccggcc

SEQ ID NO: 136049 - RNA, 18 nt, Mycobacterium bovis subsp bovis AF2122/97
cgcugacaccaucagcau

SEQ ID NO: 136050 - RNA, 22 nt, Mycobacterium bovis subsp bovis AF2122/97
gcaacggcgaguugauggcgau

SEQ ID NO: 136051 - RNA, 22 nt, Mycobacterium bovis subsp bovis AF2122/97
ugcccgcucucggcgacucguu

SEQ ID NO: 136052 - RNA, 22 nt, Mycobacterium bovis subsp bovis AF2122/97
gccugaucuugccgcugguggu

SEQ ID NO: 136053 - RNA, 22 nt, Mycobacterium bovis subsp bovis AF2122/97
cgaacgccuggccaccgacggc

SEQ ID NO: 136054 - RNA, 22 nt, Mycobacterium bovis subsp bovis AF2122/97
uugcggauccagaucgacgagc

SEQ ID NO: 136055 - RNA, 20 nt, Mycobacterium bovis subsp bovis AF2122/97
acgugaccagaucaccgacc

SEQ ID NO: 136056 - RNA, 22 nt, Mycobacterium bovis subsp bovis AF2122/97
aagaccucacggcgcucggcca

SEQ ID NO: 136057 - RNA, 22 nt, Mycobacterium bovis subsp bovis AF2122/97
uggcgggcgauccgcggagagg

SEQ ID NO: 136058 - RNA, 22 nt, Mycobacterium bovis subsp bovis AF2122/97
uccgcgcaccacgaccgaaccg

SEQ ID NO: 136059 - RNA, 22 nt, Mycobacterium bovis subsp bovis AF2122/97
aucggcacggcgagacggccga

SEQ ID NO: 136060 - RNA, 22 nt, Mycobacterium bovis subsp bovis AF2122/97
ugcauagacccgcggcgcugua

SEQ ID NO: 136061 - RNA, 22 nt, Mycobacterium bovis subsp bovis AF2122/97
cggcgucguuggcggcgugguc

SEQ ID NO: 136062 - RNA, 22 nt, Mycobacterium bovis subsp bovis AF2122/97
gggugguggucgccaacgccga

SEQ ID NO: 136063 - RNA, 22 nt, Mycobacterium bovis subsp bovis AF2122/97
uucggggcgacaccggcgacga

SEQ ID NO: 136064 - RNA, 22 nt, Mycobacterium bovis subsp bovis AF2122/97
ggaaccgcugcgagugugcgcc

SEQ ID NO: 136065 - RNA, 22 nt, Mycobacterium bovis subsp bovis AF2122/97
gggcucgggcaaugucagcgcg

SEQ ID NO: 136066 - RNA, 22 nt, Mycobacterium bovis subsp bovis AF2122/97
guuccgccgacuggucgaggag

SEQ ID NO: 136067 - RNA, 22 nt, Mycobacterium bovis subsp bovis AF2122/97
ucggugacagcugcguggugcu

SEQ ID NO: 136068 - RNA, 22 nt, Mycobacterium bovis subsp bovis AF2122/97
ccucgagcucgcugaucacuga

SEQ ID NO: 136069 - RNA, 22 nt, Mycobacterium bovis subsp bovis AF2122/97
gcgcggugugcugcacucggcg

SEQ ID NO: 136070 - RNA, 19 nt, Mycobacterium bovis subsp bovis AF2122/97
uggacgguaccggucuucg

SEQ ID NO: 136071 - RNA, 22 nt, Mycobacterium bovis subsp bovis AF2122/97
cugcacgacagcgucgaagucg

SEQ ID NO: 136072 - RNA, 22 nt, Mycobacterium bovis subsp bovis AF2122/97
uugucgucgucggugccaaaau

SEQ ID NO: 136073 - RNA, 22 nt, Mycobacterium bovis subsp bovis AF2122/97
ucaggaucgggguagcugagcg

SEQ ID NO: 136074 - RNA, 22 nt, Mycobacterium bovis subsp bovis AF2122/97
cuguuguggccgcugucgucgg

SEQ ID NO: 136075 - RNA, 22 nt, Mycobacterium bovis subsp bovis AF2122/97
cgccgguguggaggccggcgcg

SEQ ID NO: 136076 - RNA, 22 nt, Mycobacterium bovis subsp bovis AF2122/97
auaucaccguuaucggagcgau

SEQ ID NO: 136077 - RNA, 22 nt, Mycobacterium bovis subsp bovis AF2122/97
cacggugaucggggaccggucg

SEQ ID NO: 136078 - RNA, 22 nt, Mycobacterium bovis subsp bovis AF2122/97
gccgccaggauuucguucgagc

SEQ ID NO: 136079 - RNA, 22 nt, Mycobacterium bovis subsp bovis AF2122/97
aauguggucgaugcccuggcgu

SEQ ID NO: 136080 - RNA, 22 nt, Mycobacterium bovis subsp bovis AF2122/97
accguggugaugcacgggaugu

SEQ ID NO: 136081 - RNA, 19 nt, Mycobacterium bovis subsp bovis AF2122/97
cguggcggugauggccggc

SEQ ID NO: 136082 - RNA, 22 nt, Mycobacterium bovis subsp bovis AF2122/97
gcuguccuguggcgcccgcagc

SEQ ID NO: 136083 - RNA, 22 nt, Mycobacterium bovis subsp bovis AF2122/97
gccgagcgugaacucagggcgg

SEQ ID NO: 136084 - RNA, 19 nt, Mycobacterium bovis subsp bovis AF2122/97
cccugcgaccuacgacuga

SEQ ID NO: 136085 - RNA, 22 nt, Mycobacterium bovis subsp bovis AF2122/97
ggcgcuggugcagcugaucggc

SEQ ID NO: 136086 - RNA, 22 nt, Mycobacterium bovis subsp bovis AF2122/97
cgacguucggguccggcgcugg

SEQ ID NO: 136087 - RNA, 22 nt, Mycobacterium bovis subsp bovis AF2122/97
aucgccuagccgcggcgggugg

SEQ ID NO: 136088 - RNA, 22 nt, Mycobacterium bovis subsp bovis AF2122/97
uuggugcgguauccggggaaga

SEQ ID NO: 136089 - RNA, 22 nt, Mycobacterium bovis subsp bovis AF2122/97
accucggugaacccgguggcgg

SEQ ID NO: 136090 - RNA, 22 nt, Mycobacterium bovis subsp bovis AF2122/97
gcugcgggaguacgggcgccgg

SEQ ID NO: 136091 - RNA, 22 nt, Mycobacterium bovis subsp bovis AF2122/97
ggcugauggccaacgaguuuua

SEQ ID NO: 136092 - RNA, 22 nt, Mycobacterium bovis subsp bovis AF2122/97
gucauugcgucauuuccuucga

SEQ ID NO: 136093 - RNA, 22 nt, Mycobacterium bovis subsp bovis AF2122/97
gccggacugggugcggcggugg

SEQ ID NO: 136094 - RNA, 22 nt, Mycobacterium bovis subsp bovis AF2122/97
uacugcugcagcgucugccgca

SEQ ID NO: 136095 - RNA, 22 nt, Mycobacterium bovis subsp bovis AF2122/97
uguugcaggcccucaccgguca

SEQ ID NO: 136096 - RNA, 22 nt, Mycobacterium bovis subsp bovis AF2122/97
cagccugaccgguucggcuaug

SEQ ID NO: 136097 - RNA, 22 nt, Mycobacterium bovis subsp bovis AF2122/97
gagcuggguccaccggcguuug

SEQ ID NO: 136098 - RNA, 22 nt, Mycobacterium bovis subsp bovis AF2122/97
guggaugucgccuuccuggcuc

SEQ ID NO: 136099 - RNA, 22 nt, Mycobacterium bovis subsp bovis AF2122/97
aggccgaguucgucaugcagcu

SEQ ID NO: 136100 - RNA, 21 nt, Mycobacterium bovis subsp bovis AF2122/97
acucgcagacgacgccgaggg

SEQ ID NO: 136101 - RNA, 22 nt, Mycobacterium bovis subsp bovis AF2122/97
ucgacgucuugucgcagcgagu

SEQ ID NO: 136102 - RNA, 22 nt, Mycobacterium bovis subsp bovis AF2122/97
gugaacaccgacagcaccaacc

SEQ ID NO: 136103 - RNA, 22 nt, Mycobacterium bovis subsp bovis AF2122/97
ggacaugaccgaacacgguugg

SEQ ID NO: 136104 - RNA, 21 nt, Mycobacterium bovis subsp bovis AF2122/97
gcugcgcuaugguugucacca

SEQ ID NO: 136105 - RNA, 18 nt, Mycobacterium bovis subsp bovis AF2122/97
acggguucuccggcggca

SEQ ID NO: 136106 - RNA, 22 nt, Mycobacterium bovis subsp bovis AF2122/97
gaucaccgaauugguagaugac

SEQ ID NO: 136107 - RNA, 22 nt, Mycobacterium bovis subsp bovis AF2122/97
acccgguuggacaugucgaucc

SEQ ID NO: 136108 - RNA, 22 nt, Mycobacterium bovis subsp bovis AF2122/97
aucgcuucauccaugagcugcu

SEQ ID NO: 136109 - RNA, 22 nt, Mycobacterium bovis subsp bovis AF2122/97
acguucuccauauaugccaaca

SEQ ID NO: 136110 - RNA, 22 nt, Mycobacterium bovis subsp bovis AF2122/97
ugcuccuggaaguacacggcgg

SEQ ID NO: 136111 - RNA, 22 nt, Mycobacterium bovis subsp bovis AF2122/97
acggucgccaaccuggcgagca

SEQ ID NO: 136112 - RNA, 23 nt, Mycobacterium bovis subsp bovis AF2122/97
uccagggcaugcugaccgucgcc

SEQ ID NO: 136113 - RNA, 22 nt, Mycobacterium bovis subsp bovis AF2122/97
cggcgaucgccacccggaguug

SEQ ID NO: 136114 - RNA, 22 nt, Mycobacterium bovis subsp bovis AF2122/97
ccaccgauugugucgaugcgca

SEQ ID NO: 136115 - RNA, 22 nt, Mycobacterium bovis subsp bovis AF2122/97
aacgucgccaggauggucgcga

SEQ ID NO: 136116 - RNA, 22 nt, Mycobacterium bovis subsp bovis AF2122/97
ccccaucgaggucggcgaggac

SEQ ID NO: 136117 - RNA, 22 nt, Mycobacterium bovis subsp bovis AF2122/97
ggcgccuggcccaucaccgcgg

SEQ ID NO: 136118 - RNA, 21 nt, Mycobacterium bovis subsp bovis AF2122/97
gcgcagcaucucagccagugc

SEQ ID NO: 136119 - RNA, 22 nt, Mycobacterium bovis subsp bovis AF2122/97
gcucaccacggagauccgccgg

SEQ ID NO: 136120 - RNA, 22 nt, Mycobacterium bovis subsp bovis AF2122/97
cgagcgugcacugggggcgaga

SEQ ID NO: 136121 - RNA, 22 nt, Mycobacterium bovis subsp bovis AF2122/97
gauggccuuucuguugcagggc

SEQ ID NO: 136122 - RNA, 22 nt, Mycobacterium bovis subsp bovis AF2122/97
uccaggguggugcggaucaggu

SEQ ID NO: 136123 - RNA, 22 nt, Mycobacterium bovis subsp bovis AF2122/97
gauggcgggucaucgcacccag

SEQ ID NO: 136124 - RNA, 22 nt, Mycobacterium bovis subsp bovis AF2122/97
ggcaggugcgcuaggucccggu

SEQ ID NO: 136125 - RNA, 22 nt, Mycobacterium bovis subsp bovis AF2122/97
caucggccaacgcaucgcgcgg

SEQ ID NO: 136126 - RNA, 23 nt, Mycobacterium bovis subsp bovis AF2122/97
accgacaccgucggcuuugugcg

SEQ ID NO: 136127 - RNA, 22 nt, Mycobacterium bovis subsp bovis AF2122/97
aucaccuuccucggcaugagau

SEQ ID NO: 136128 - RNA, 22 nt, Mycobacterium bovis subsp bovis AF2122/97
gcaccggcugccugguggcggc

SEQ ID NO: 136129 - RNA, 23 nt, Mycobacterium bovis subsp bovis AF2122/97
ucggaucgacuacaucgugagcc

SEQ ID NO: 136130 - RNA, 20 nt, Mycobacterium bovis subsp bovis AF2122/97
gccgucaacgguuucuuguu

SEQ ID NO: 136131 - RNA, 22 nt, Mycobacterium bovis subsp bovis AF2122/97
gucguucagauaacaacguggc

SEQ ID NO: 136132 - RNA, 23 nt, Mycobacterium bovis subsp bovis AF2122/97
cggacgucgacuuguugggcgcg

SEQ ID NO: 136133 - RNA, 22 nt, Mycobacterium bovis subsp bovis AF2122/97
cucgaguaccagcggauaccca

SEQ ID NO: 136134 - RNA, 20 nt, Mycobacterium bovis subsp bovis AF2122/97
gucgggauccccggcggcgc

SEQ ID NO: 136135 - RNA, 22 nt, Mycobacterium bovis subsp bovis AF2122/97
caggccgccauggugggugccg

SEQ ID NO: 136136 - RNA, 22 nt, Mycobacterium bovis subsp bovis AF2122/97
ugggccccuugaccgcugccca

SEQ ID NO: 136137 - RNA, 22 nt, Mycobacterium bovis subsp bovis AF2122/97
uugucgccgucucgguccagcu

SEQ ID NO: 136138 - RNA, 22 nt, Mycobacterium bovis subsp bovis AF2122/97
aucugcugggcuuugucgaugg

SEQ ID NO: 136139 - RNA, 22 nt, Mycobacterium bovis subsp bovis AF2122/97
gcgucgucagauucacagucag

SEQ ID NO: 136140 - RNA, 22 nt, Mycobacterium bovis subsp bovis AF2122/97
uuggccaacccgguguuggcau

SEQ ID NO: 136141 - RNA, 22 nt, Mycobacterium bovis subsp bovis AF2122/97
gaugaccgggcucgaucugggu

SEQ ID NO: 136142 - RNA, 22 nt, Mycobacterium bovis subsp bovis AF2122/97
uugaccggcgcgaccagcggcu

SEQ ID NO: 136143 - RNA, 22 nt, Mycobacterium bovis subsp bovis AF2122/97
gcgccgcggagauugaucgcga

SEQ ID NO: 136144 - RNA, 22 nt, Mycobacterium bovis subsp bovis AF2122/97
cgggcagcgucgggauaaucgg

SEQ ID NO: 136145 - RNA, 22 nt, Mycobacterium bovis subsp bovis AF2122/97
gccggaacgguguagucgauga

SEQ ID NO: 136146 - RNA, 22 nt, Mycobacterium bovis subsp bovis AF2122/97
cggcgcggguugucgacgagca

SEQ ID NO: 136147 - RNA, 21 nt, Mycobacterium bovis subsp bovis AF2122/97
gugauuuugcgucugcucgcg

SEQ ID NO: 136148 - RNA, 22 nt, Mycobacterium bovis subsp bovis AF2122/97
accggugugcuggcgaagguuc

SEQ ID NO: 136149 - RNA, 22 nt, Mycobacterium bovis subsp bovis AF2122/97
agguccaggaauucggcgaccc

SEQ ID NO: 136150 - RNA, 22 nt, Mycobacterium bovis subsp bovis AF2122/97
gggcuuccguaccgccgacauu

SEQ ID NO: 136151 - RNA, 22 nt, Mycobacterium bovis subsp bovis AF2122/97
ugcgccaccgccagaggauaac

SEQ ID NO: 136152 - RNA, 22 nt, Mycobacterium bovis subsp bovis AF2122/97
uguguucuucugcgggcaacca

SEQ ID NO: 136153 - RNA, 22 nt, Mycobacterium bovis subsp bovis AF2122/97
gucggugucgucuccgugcuga

SEQ ID NO: 136154 - RNA, 22 nt, Mycobacterium bovis subsp bovis AF2122/97
gcguugaacugauaggugcggc

SEQ ID NO: 136155 - RNA, 22 nt, Mycobacterium bovis subsp bovis AF2122/97
ugucgggggcuuaugcgucugc

SEQ ID NO: 136156 - RNA, 18 nt, Mycobacterium bovis subsp bovis AF2122/97
ucagcgaucggggugcgg

SEQ ID NO: 136157 - RNA, 22 nt, Mycobacterium bovis subsp bovis AF2122/97
cucgggucggguucgccgucga

SEQ ID NO: 136158 - RNA, 21 nt, Mycobacterium bovis subsp bovis AF2122/97
uccguggugaugaccgcccga

SEQ ID NO: 136159 - RNA, 20 nt, Mycobacterium bovis subsp bovis AF2122/97
aucgacacaaucgguggauc

SEQ ID NO: 136160 - RNA, 21 nt, Mycobacterium bovis subsp bovis AF2122/97
caucaggugcauaacguugcc

SEQ ID NO: 136161 - RNA, 22 nt, Mycobacterium bovis subsp bovis AF2122/97
ccgcgccacgaaguuggcugac

SEQ ID NO: 136162 - RNA, 22 nt, Mycobacterium bovis subsp bovis AF2122/97
gccuggaggaccuggacucggc

SEQ ID NO: 136163 - RNA, 22 nt, Mycobacterium bovis subsp bovis AF2122/97
cggggugcagaagccgcauugc

SEQ ID NO: 136164 - RNA, 22 nt, Mycobacterium bovis subsp bovis AF2122/97
gggcggcugggucgacuuugac

SEQ ID NO: 136165 - RNA, 22 nt, Mycobacterium bovis subsp bovis AF2122/97
gagaagaucaugccgcgggcga

SEQ ID NO: 136166 - RNA, 22 nt, Mycobacterium bovis subsp bovis AF2122/97
acugcuuuccugucugggcggc

SEQ ID NO: 136167 - RNA, 22 nt, Mycobacterium bovis subsp bovis AF2122/97
gacgcgaguuggccguccuccu

SEQ ID NO: 136168 - RNA, 22 nt, Mycobacterium bovis subsp bovis AF2122/97
ggucccuuaaacccgaaugccg

SEQ ID NO: 136169 - RNA, 22 nt, Mycobacterium bovis subsp bovis AF2122/97
aggcccgucgguuggcgauggu

SEQ ID NO: 136170 - RNA, 22 nt, Mycobacterium bovis subsp bovis AF2122/97
gguccgcgagcagcacgccauu

SEQ ID NO: 136171 - RNA, 22 nt, Mycobacterium bovis subsp bovis AF2122/97
gagcagacgcagaaucgcaccg

SEQ ID NO: 136172 - RNA, 23 nt, Mycobacterium bovis subsp bovis AF2122/97
ggccggcaugcugcgccagguau

SEQ ID NO: 136173 - RNA, 22 nt, Mycobacterium bovis subsp bovis AF2122/97
uucgucugauuggcgucgaucg

SEQ ID NO: 136174 - RNA, 22 nt, Mycobacterium bovis subsp bovis AF2122/97
ccgcuguugccguugguccagc

SEQ ID NO: 136175 - RNA, 22 nt, Mycobacterium bovis subsp bovis AF2122/97
cuggccgagcuggucaacggcg

SEQ ID NO: 136176 - RNA, 22 nt, Mycobacterium bovis subsp bovis AF2122/97
aguacgacaucgccgucagcgg

SEQ ID NO: 136177 - RNA, 22 nt, Mycobacterium bovis subsp bovis AF2122/97
acguaggucaggugcggcaccu

SEQ ID NO: 136178 - RNA, 22 nt, Mycobacterium bovis subsp bovis AF2122/97
ugccgcuggauccggaagccgu

SEQ ID NO: 136179 - RNA, 22 nt, Mycobacterium bovis subsp bovis AF2122/97
ggccuggcuggcgguggcgugu

SEQ ID NO: 136180 - RNA, 22 nt, Mycobacterium bovis subsp bovis AF2122/97
ugaucgcaugcccgugcgcggu

SEQ ID NO: 136181 - RNA, 22 nt, Mycobacterium bovis subsp bovis AF2122/97
ucgaugccucacccagguacac

SEQ ID NO: 136182 - RNA, 22 nt, Mycobacterium bovis subsp bovis AF2122/97
cggccgcggcggacuugaccgg

SEQ ID NO: 136183 - RNA, 22 nt, Mycobacterium bovis subsp bovis AF2122/97
gccacggcccuucguuuucggg

SEQ ID NO: 136184 - RNA, 22 nt, Mycobacterium bovis subsp bovis AF2122/97
cggccggcuguaugccggugau

SEQ ID NO: 136185 - RNA, 22 nt, Mycobacterium bovis subsp bovis AF2122/97
cgcgagcguaaccggacugcga

SEQ ID NO: 136186 - RNA, 20 nt, Mycobacterium bovis subsp bovis AF2122/97
ggucacccugggugagccgg

SEQ ID NO: 136187 - RNA, 22 nt, Mycobacterium bovis subsp bovis AF2122/97
auugggcgcuuaugcgucugcu

SEQ ID NO: 136188 - RNA, 22 nt, Mycobacterium bovis subsp bovis AF2122/97
gcggcgcggugauacgccggga

SEQ ID NO: 136189 - RNA, 22 nt, Mycobacterium bovis subsp bovis AF2122/97
gaccaucgaaucggugaucgac

SEQ ID NO: 136190 - RNA, 22 nt, Mycobacterium bovis subsp bovis AF2122/97
uuucgccgugacguuacgcugg

SEQ ID NO: 136191 - RNA, 22 nt, Mycobacterium bovis subsp bovis AF2122/97
cacgcccaucgguucguugaaa

SEQ ID NO: 136192 - RNA, 22 nt, Mycobacterium bovis subsp bovis AF2122/97
uaccgucgcugaccuuuuggcg

SEQ ID NO: 136193 - RNA, 22 nt, Mycobacterium bovis subsp bovis AF2122/97
guuggcgauguucucguugucg

SEQ ID NO: 136194 - RNA, 22 nt, Mycobacterium bovis subsp bovis AF2122/97
ugcugcccaaagaacagcgagc

SEQ ID NO: 136195 - RNA, 22 nt, Mycobacterium bovis subsp bovis AF2122/97
gucgccagauucacggucgcgc

SEQ ID NO: 136196 - RNA, 22 nt, Mycobacterium bovis subsp bovis AF2122/97
gguggacgaagacggguucuug

SEQ ID NO: 136197 - RNA, 22 nt, Mycobacterium bovis subsp bovis AF2122/97
cgacggcaacccgcugugugaa

SEQ ID NO: 136198 - RNA, 22 nt, Mycobacterium bovis subsp bovis AF2122/97
ggcggucuggcugcugggcguc

SEQ ID NO: 136199 - RNA, 22 nt, Mycobacterium bovis subsp bovis AF2122/97
gugcggaucaucgagaucggcg

SEQ ID NO: 136200 - RNA, 22 nt, Mycobacterium bovis subsp bovis AF2122/97
uuucauucguugcgcgcagacc

SEQ ID NO: 136201 - RNA, 22 nt, Mycobacterium bovis subsp bovis AF2122/97
uguccgagagguugacggcacu

SEQ ID NO: 136202 - RNA, 22 nt, Mycobacterium bovis subsp bovis AF2122/97
aucgggucggcaauggccgccg

SEQ ID NO: 136203 - RNA, 22 nt, Mycobacterium bovis subsp bovis AF2122/97
agcagacgcaaaaucgcccauu

SEQ ID NO: 136204 - RNA, 22 nt, Mycobacterium bovis subsp bovis AF2122/97
cgcggugagccuggacccggcg

SEQ ID NO: 136205 - RNA, 22 nt, Mycobacterium bovis subsp bovis AF2122/97
cgguggccaagaucggucccgu

SEQ ID NO: 136206 - RNA, 22 nt, Mycobacterium bovis subsp bovis AF2122/97
ggugcgcgcauguacucgaagc

SEQ ID NO: 136207 - RNA, 22 nt, Mycobacterium bovis subsp bovis AF2122/97
agcgccgagauugacguuuugc

SEQ ID NO: 136208 - RNA, 21 nt, Mycobacterium bovis subsp bovis AF2122/97
ugcggguaccacggcggcggc

SEQ ID NO: 136209 - RNA, 22 nt, Mycobacterium bovis subsp bovis AF2122/97
ccggcggacgacgucggguccc

SEQ ID NO: 136210 - RNA, 22 nt, Mycobacterium bovis subsp bovis AF2122/97
aauccggccugugucgggucgu

SEQ ID NO: 136211 - RNA, 23 nt, Mycobacterium bovis subsp bovis AF2122/97
ggcacgauggaaugucgcaacca

SEQ ID NO: 136212 - RNA, 22 nt, Mycobacterium bovis subsp bovis AF2122/97
aaguggcgcuuuugcgucugcu

SEQ ID NO: 136213 - RNA, 22 nt, Mycobacterium bovis subsp bovis AF2122/97
cagccggcgcauggucaaagcg

SEQ ID NO: 136214 - RNA, 20 nt, Mycobacterium bovis subsp bovis AF2122/97
ugggcggccgcgaccucuag

SEQ ID NO: 136215 - RNA, 22 nt, Mycobacterium bovis subsp bovis AF2122/97
augaucgcccagauuuucgccg

SEQ ID NO: 136216 - RNA, 22 nt, Mycobacterium bovis subsp bovis AF2122/97
gguugcuggucggccggaggcu

SEQ ID NO: 136217 - RNA, 22 nt, Mycobacterium bovis subsp bovis AF2122/97
guggccaccaacgccgagggcg

SEQ ID NO: 136218 - RNA, 22 nt, Mycobacterium bovis subsp bovis AF2122/97
gucggucaccgacggcgccguc

SEQ ID NO: 136219 - RNA, 22 nt, Mycobacterium bovis subsp bovis AF2122/97
cauugaaaccgaugaucaccgc

SEQ ID NO: 136220 - RNA, 22 nt, Mycobacterium bovis subsp bovis AF2122/97
ucggguuguucaacuccggcag

SEQ ID NO: 136221 - RNA, 22 nt, Mycobacterium bovis subsp bovis AF2122/97
gcggaugcggcaguucaucacc

SEQ ID NO: 136222 - RNA, 22 nt, Mycobacterium bovis subsp bovis AF2122/97
cggcgggcaugaggccaucgaa

SEQ ID NO: 136223 - RNA, 22 nt, Mycobacterium bovis subsp bovis AF2122/97
gugcuaguccucugcgugccgu

SEQ ID NO: 136224 - RNA, 22 nt, Mycobacterium bovis subsp bovis AF2122/97
cagguagugggugugcccggca

SEQ ID NO: 136225 - RNA, 22 nt, Mycobacterium bovis subsp bovis AF2122/97
gccgagcagacgcaaaagcacc

SEQ ID NO: 136226 - RNA, 22 nt, Mycobacterium bovis subsp bovis AF2122/97
gacaacgacaccgggcgccaac

SEQ ID NO: 136227 - RNA, 22 nt, Mycobacterium bovis subsp bovis AF2122/97
cgcgcccaacaagucgacgucc

SEQ ID NO: 136228 - RNA, 22 nt, Mycobacterium bovis subsp bovis AF2122/97
auccgcgcgacgaacuugucga

SEQ ID NO: 136229 - RNA, 22 nt, Mycobacterium bovis subsp bovis AF2122/97
cucccguucgcucggcacucgu

SEQ ID NO: 136230 - RNA, 22 nt, Mycobacterium bovis subsp bovis AF2122/97
gcacgucgucgcgggacaggua

SEQ ID NO: 136231 - RNA, 22 nt, Mycobacterium bovis subsp bovis AF2122/97
ucgccgaucggcguggugcccu

SEQ ID NO: 136232 - RNA, 22 nt, Mycobacterium bovis subsp bovis AF2122/97
gaccgauggugcguggcaugga

SEQ ID NO: 136233 - RNA, 22 nt, Mycobacterium bovis subsp bovis AF2122/97
gccaccacucaggccgcgguca

SEQ ID NO: 136234 - RNA, 22 nt, Mycobacterium bovis subsp bovis AF2122/97
cgggugaucaccgcggcagcgu

SEQ ID NO: 136235 - RNA, 22 nt, Mycobacterium bovis subsp bovis AF2122/97
acgccagaacucaauaccgucu

SEQ ID NO: 136236 - RNA, 22 nt, Mycobacterium bovis subsp bovis AF2122/97
acggggugcgcaucgccaucga

SEQ ID NO: 136237 - RNA, 22 nt, Mycobacterium bovis subsp bovis AF2122/97
uguucggcgccuucgcugucga

SEQ ID NO: 136238 - RNA, 22 nt, Mycobacterium bovis subsp bovis AF2122/97
gauggacaagccggacgucgac

SEQ ID NO: 136239 - RNA, 18 nt, Mycobacterium bovis subsp bovis AF2122/97
ugcgcgccgccagcuauc

SEQ ID NO: 136240 - RNA, 22 nt, Mycobacterium bovis subsp bovis AF2122/97
gcgaccgggaugucgauguuca

SEQ ID NO: 136241 - RNA, 22 nt, Mycobacterium bovis subsp bovis AF2122/97
agcgggaaccuguugggggcca

SEQ ID NO: 136242 - RNA, 22 nt, Mycobacterium bovis subsp bovis AF2122/97
gacgaccgcaggucggcaacgu

SEQ ID NO: 136243 - RNA, 22 nt, Mycobacterium bovis subsp bovis AF2122/97
gauccgcccagauuugccggaa

SEQ ID NO: 136244 - RNA, 22 nt, Mycobacterium bovis subsp bovis AF2122/97
agaaacacaaggagccgacaac

SEQ ID NO: 136245 - RNA, 22 nt, Mycobacterium bovis subsp bovis AF2122/97
auuggccaugcgcgggcgccgu

SEQ ID NO: 136246 - RNA, 22 nt, Mycobacterium bovis subsp bovis AF2122/97
gcccaaggaaugcccccagguc

SEQ ID NO: 136247 - RNA, 22 nt, Mycobacterium bovis subsp bovis AF2122/97
cguagagcgugggguugccggc

SEQ ID NO: 136248 - RNA, 22 nt, Mycobacterium bovis subsp bovis AF2122/97
ugggggcuuuacgucugcucgc

SEQ ID NO: 136249 - RNA, 22 nt, Mycobacterium bovis subsp bovis AF2122/97
gagcagacgcauaagcgcccau

SEQ ID NO: 136250 - RNA, 22 nt, Mycobacterium bovis subsp bovis AF2122/97
gugucggcggcaacgccgugcu

SEQ ID NO: 136251 - RNA, 22 nt, Mycobacterium bovis subsp bovis AF2122/97
accaucgucgggcucgagacgc

SEQ ID NO: 136252 - RNA, 22 nt, Mycobacterium bovis subsp bovis AF2122/97
ucuguugguguugcagccggug

SEQ ID NO: 136253 - RNA, 22 nt, Mycobacterium bovis subsp bovis AF2122/97
guccgcgagcggaacgucacgg

SEQ ID NO: 136254 - RNA, 22 nt, Mycobacterium bovis subsp bovis AF2122/97
cggucccgcaccgaccuugcgg

SEQ ID NO: 136255 - RNA, 22 nt, Mycobacterium bovis subsp bovis AF2122/97
gcgucauugggcccaacggggu

SEQ ID NO: 136256 - RNA, 22 nt, Mycobacterium bovis subsp bovis AF2122/97
gcugucaacggggguagcgcug

SEQ ID NO: 136257 - RNA, 22 nt, Mycobacterium bovis subsp bovis AF2122/97
uugcggguuuucaccgauucag

SEQ ID NO: 136258 - RNA, 21 nt, Mycobacterium bovis subsp bovis AF2122/97
cgcuggugucgaugucgacgg

SEQ ID NO: 136259 - RNA, 20 nt, Mycobacterium bovis subsp bovis AF2122/97
accucgcgccgcacaugguc

SEQ ID NO: 136260 - RNA, 22 nt, Mycobacterium bovis subsp bovis AF2122/97
uugccggccaucugauagccgg

SEQ ID NO: 136261 - RNA, 20 nt, Mycobacterium bovis subsp bovis AF2122/97
uccuggcggcguuguucggc

SEQ ID NO: 136262 - RNA, 22 nt, Mycobacterium bovis subsp bovis AF2122/97
cgccggccugguggccgcgcuc

SEQ ID NO: 136263 - RNA, 22 nt, Mycobacterium bovis subsp bovis AF2122/97
cgucggcacgcccaacgaggug

SEQ ID NO: 136264 - RNA, 22 nt, Mycobacterium bovis subsp bovis AF2122/97
gugccgaucuugcucggucaug

SEQ ID NO: 136265 - RNA, 22 nt, Mycobacterium bovis subsp bovis AF2122/97
ucaccgguccugcugcaucguc

SEQ ID NO: 136266 - RNA, 22 nt, Mycobacterium bovis subsp bovis AF2122/97
cgagcagacgcaaaauccccuc

SEQ ID NO: 136267 - RNA, 22 nt, Mycobacterium bovis subsp bovis AF2122/97
cgaguaucgcuugcgcaccgau

SEQ ID NO: 136268 - RNA, 22 nt, Mycobacterium bovis subsp bovis AF2122/97
ggccgacacuuccagcucgggg

SEQ ID NO: 136269 - RNA, 22 nt, Mycobacterium bovis subsp bovis AF2122/97
aggcgagauguggcccgcaggu

SEQ ID NO: 136270 - RNA, 22 nt, Mycobacterium bovis subsp bovis AF2122/97
gccugccgaggacuucgcgggc

SEQ ID NO: 136271 - RNA, 22 nt, Mycobacterium bovis subsp bovis AF2122/97
ucgaugccggccucgaucuggc

SEQ ID NO: 136272 - RNA, 22 nt, Mycobacterium bovis subsp bovis AF2122/97
ccgaugucaucgaggaucaguc

SEQ ID NO: 136273 - RNA, 22 nt, Mycobacterium bovis subsp bovis AF2122/97
gugcugcagcgcggugagggcc

SEQ ID NO: 136274 - RNA, 21 nt, Mycobacterium bovis subsp bovis AF2122/97
ccgcccuguaucggcgugucc

SEQ ID NO: 136275 - RNA, 22 nt, Mycobacterium bovis subsp bovis AF2122/97
agcagacacagaaucgcacugc

SEQ ID NO: 136276 - RNA, 22 nt, Mycobacterium bovis subsp bovis AF2122/97
cgagcguaacgccacugcgauu

SEQ ID NO: 136277 - RNA, 22 nt, Mycobacterium bovis subsp bovis AF2122/97
ucgcaccgcggucauuuucacc

SEQ ID NO: 136278 - RNA, 22 nt, Mycobacterium bovis subsp bovis AF2122/97
cacccugcgacugguggcccgc

SEQ ID NO: 136279 - RNA, 22 nt, Mycobacterium bovis subsp bovis AF2122/97
gccaaaucgagccgagaguggg

SEQ ID NO: 136280 - RNA, 22 nt, Mycobacterium bovis subsp bovis AF2122/97
guugaucccgcugcuuacccgg

SEQ ID NO: 136281 - RNA, 22 nt, Mycobacterium bovis subsp bovis AF2122/97
gugguggccguggccgcgucgu

SEQ ID NO: 136282 - RNA, 22 nt, Mycobacterium bovis subsp bovis AF2122/97
gucgccugcgucggcaacucgc

SEQ ID NO: 136283 - RNA, 22 nt, Mycobacterium bovis subsp bovis AF2122/97
gagaacugaacuccgccggccc

SEQ ID NO: 136284 - RNA, 22 nt, Mycobacterium bovis subsp bovis AF2122/97
cagacgcaaaaucgcccaauuc

SEQ ID NO: 136285 - RNA, 22 nt, Mycobacterium bovis subsp bovis AF2122/97
acgcgacgaauccacugcgcuu

SEQ ID NO: 136286 - RNA, 22 nt, Mycobacterium bovis subsp bovis AF2122/97
gcgaucagguucgacgcgcauc

SEQ ID NO: 136287 - RNA, 22 nt, Mycobacterium bovis subsp bovis AF2122/97
gcgguggcacgcuggucgguua

SEQ ID NO: 136288 - RNA, 22 nt, Mycobacterium bovis subsp bovis AF2122/97
cucguguucgaugcggccaucg

SEQ ID NO: 136289 - RNA, 22 nt, Mycobacterium bovis subsp bovis AF2122/97
gugcuuugaccgcaucgaccac

SEQ ID NO: 136290 - RNA, 22 nt, Mycobacterium bovis subsp bovis AF2122/97
ucgaccguccucagugugugag

SEQ ID NO: 136291 - RNA, 19 nt, Mycobacterium bovis subsp bovis AF2122/97
ugcgaaucgaagccugggc

SEQ ID NO: 136292 - RNA, 22 nt, Mycobacterium bovis subsp bovis AF2122/97
gcgcagcagcgacaggguggcg

SEQ ID NO: 136293 - RNA, 22 nt, Mycobacterium bovis subsp bovis AF2122/97
uacggcaucgauccgugggaga

SEQ ID NO: 136294 - RNA, 22 nt, Mycobacterium bovis subsp bovis AF2122/97
gacugugaaucugacgacgcga

SEQ ID NO: 136295 - RNA, 22 nt, Mycobacterium bovis subsp bovis AF2122/97
uggcggacuaccugccggguga

SEQ ID NO: 136296 - RNA, 22 nt, Mycobacterium bovis subsp bovis AF2122/97
ucgcccgguggugcugguagcc

SEQ ID NO: 136297 - RNA, 20 nt, Mycobacterium bovis subsp bovis AF2122/97
uggucgccuugaagaccgac

SEQ ID NO: 136298 - RNA, 22 nt, Mycobacterium bovis subsp bovis AF2122/97
ucguccaaugaaccacaacccc

SEQ ID NO: 136299 - RNA, 21 nt, Mycobacterium bovis subsp bovis AF2122/97
ggccgccucgucgaccaucgc

SEQ ID NO: 136300 - RNA, 22 nt, Mycobacterium bovis subsp bovis AF2122/97
gucuaccauuugggcgaucguc

SEQ ID NO: 136301 - RNA, 22 nt, Mycobacterium bovis subsp bovis AF2122/97
cagccgaucccgcaaauaguuc

SEQ ID NO: 136302 - RNA, 22 nt, Mycobacterium bovis subsp bovis AF2122/97
cguugcaauacacguugccgau

SEQ ID NO: 136303 - RNA, 22 nt, Mycobacterium bovis subsp bovis AF2122/97
cgguggcggcgaaccgcagcac

SEQ ID NO: 136304 - RNA, 22 nt, Mycobacterium bovis subsp bovis AF2122/97
cggcugcagugcgacgacgaga

SEQ ID NO: 136305 - RNA, 22 nt, Mycobacterium bovis subsp bovis AF2122/97
ucaugcgauucugcguccugcu

SEQ ID NO: 136306 - RNA, 22 nt, Mycobacterium bovis subsp bovis AF2122/97
ucggcgaaggugaucucgcugg

SEQ ID NO: 136307 - RNA, 22 nt, Mycobacterium bovis subsp bovis AF2122/97
agucgcaaaagcccccgacacg

SEQ ID NO: 136308 - RNA, 22 nt, Mycobacterium bovis subsp bovis AF2122/97
ugcucgccgcuuuuucggucgg

SEQ ID NO: 136309 - RNA, 22 nt, Mycobacterium bovis subsp bovis AF2122/97
cuacuucgacgucgaaccccgu

SEQ ID NO: 136310 - RNA, 21 nt, Mycobacterium bovis subsp bovis AF2122/97
ccguuaccgaucagcggacgg

SEQ ID NO: 136311 - RNA, 22 nt, Mycobacterium bovis subsp bovis AF2122/97
ucggcggugaucuugccuacuu

SEQ ID NO: 136312 - RNA, 22 nt, Mycobacterium bovis subsp bovis AF2122/97
aggacguugucggggcgccgaa

SEQ ID NO: 136313 - RNA, 22 nt, Mycobacterium bovis subsp bovis AF2122/97
cgucccgaucacccaaccaggc

SEQ ID NO: 136314 - RNA, 20 nt, Mycobacterium bovis subsp bovis AF2122/97
agccuuuguuccggaagcag

SEQ ID NO: 136315 - RNA, 22 nt, Mycobacterium bovis subsp bovis AF2122/97
ccacgcugagccguggcgaauu

SEQ ID NO: 136316 - RNA, 22 nt, Mycobacterium bovis subsp bovis AF2122/97
ccagcgugacgccacugcgaga

SEQ ID NO: 136317 - RNA, 22 nt, Mycobacterium bovis subsp bovis AF2122/97
ccggcggcaccaccugggucgg

SEQ ID NO: 136318 - RNA, 22 nt, Mycobacterium bovis subsp bovis AF2122/97
cuccgcaguccuuuaggggaca

SEQ ID NO: 136319 - RNA, 22 nt, Mycobacterium bovis subsp bovis AF2122/97
aucccgagggacacaucugugc

SEQ ID NO: 136320 - RNA, 22 nt, Mycobacterium bovis subsp bovis AF2122/97
cgccgcgccgucgucugagcaa

SEQ ID NO: 136321 - RNA, 22 nt, Mycobacterium bovis subsp bovis AF2122/97
cggacuccgaggcgaugcugcu

SEQ ID NO: 136322 - RNA, 22 nt, Mycobacterium bovis subsp bovis AF2122/97
uacgcggugaccguagccggau

SEQ ID NO: 136323 - RNA, 22 nt, Mycobacterium bovis subsp bovis AF2122/97
cgggggcuuuagcgacugcucg

SEQ ID NO: 136324 - RNA, 21 nt, Mycobacterium bovis subsp bovis AF2122/97
ucggcgaaccccgcggccggc

SEQ ID NO: 136325 - RNA, 22 nt, Mycobacterium bovis subsp bovis AF2122/97
ggcgacguuggcaccucggugc

SEQ ID NO: 136326 - RNA, 22 nt, Mycobacterium bovis subsp bovis AF2122/97
ggcgaagagcgcagccgggugu

SEQ ID NO: 136327 - RNA, 22 nt, Mycobacterium bovis subsp bovis AF2122/97
guuucgcugucgcuggccgugu

SEQ ID NO: 136328 - RNA, 21 nt, Mycobacterium bovis subsp bovis AF2122/97
ucgacggccguagcgccgccc

SEQ ID NO: 136329 - RNA, 23 nt, Mycobacterium bovis subsp bovis AF2122/97
ccgccaccagggcacguucggcg

SEQ ID NO: 136330 - RNA, 20 nt, Mycobacterium bovis subsp bovis AF2122/97
gccgaauucacuaucggcgg

SEQ ID NO: 136331 - RNA, 22 nt, Mycobacterium bovis subsp bovis AF2122/97
acccggccagcacguagucggc

SEQ ID NO: 136332 - RNA, 22 nt, Mycobacterium bovis subsp bovis AF2122/97
gccggguccacccggcugaucu

SEQ ID NO: 136333 - RNA, 22 nt, Mycobacterium bovis subsp bovis AF2122/97
cugcgaucgaagagaucgugag

SEQ ID NO: 136334 - RNA, 22 nt, Mycobacterium bovis subsp bovis AF2122/97
guguauggcguguucacccccg

SEQ ID NO: 136335 - RNA, 22 nt, Mycobacterium bovis subsp bovis AF2122/97
guggucgucgacgcgagugcca

SEQ ID NO: 136336 - RNA, 22 nt, Mycobacterium bovis subsp bovis AF2122/97
gccgccaccucgauguucuuga

SEQ ID NO: 136337 - RNA, 22 nt, Mycobacterium bovis subsp bovis AF2122/97
acguacggauauacugaacgca

SEQ ID NO: 136338 - RNA, 22 nt, Mycobacterium bovis subsp bovis AF2122/97
augauguugaccaucacccgca

SEQ ID NO: 136339 - RNA, 22 nt, Mycobacterium bovis subsp bovis AF2122/97
cgguccagucucgaugucgccg

SEQ ID NO: 136340 - RNA, 22 nt, Mycobacterium bovis subsp bovis AF2122/97
gcgccgaacgugcccugguggc

SEQ ID NO: 136341 - RNA, 22 nt, Mycobacterium bovis subsp bovis AF2122/97
acgucggguucuucaacaccgg

SEQ ID NO: 136342 - RNA, 22 nt, Mycobacterium bovis subsp bovis AF2122/97
agugcgcaggucggcgacgucg

SEQ ID NO: 136343 - RNA, 22 nt, Mycobacterium bovis subsp bovis AF2122/97
gagcagacgcagaaucgcauga

SEQ ID NO: 136344 - RNA, 22 nt, Mycobacterium bovis subsp bovis AF2122/97
ugugacgccaaccucgcgguca

SEQ ID NO: 136345 - RNA, 22 nt, Mycobacterium bovis subsp bovis AF2122/97
cgagcagucgcauaagcccccg

SEQ ID NO: 136346 - RNA, 22 nt, Mycobacterium bovis subsp bovis AF2122/97
acgguccguugucguuccuguc

SEQ ID NO: 136347 - RNA, 22 nt, Mycobacterium bovis subsp bovis AF2122/97
gcaucgcacuugagaucgagca

SEQ ID NO: 136348 - RNA, 22 nt, Mycobacterium bovis subsp bovis AF2122/97
aucaccggcaccauagccuggc

SEQ ID NO: 136349 - RNA, 22 nt, Mycobacterium bovis subsp bovis AF2122/97
uugcgggcauaguugcggcuga

SEQ ID NO: 136350 - RNA, 22 nt, Mycobacterium bovis subsp bovis AF2122/97
ggggccggccucacugccguua

SEQ ID NO: 136351 - RNA, 22 nt, Mycobacterium bovis subsp bovis AF2122/97
gcuggccgacguugacgaucgg

SEQ ID NO: 136352 - RNA, 22 nt, Mycobacterium bovis subsp bovis AF2122/97
acuucagcaccaccgacgcgaa

SEQ ID NO: 136353 - RNA, 22 nt, Mycobacterium bovis subsp bovis AF2122/97
acgcagaggacuagcacgucga

SEQ ID NO: 136354 - RNA, 22 nt, Mycobacterium bovis subsp bovis AF2122/97
ggcgauuuugcgucugcucgcc

SEQ ID NO: 136355 - RNA, 22 nt, Mycobacterium bovis subsp bovis AF2122/97
ggguggugcaggauggcgucga

SEQ ID NO: 136356 - RNA, 22 nt, Mycobacterium bovis subsp bovis AF2122/97
cgcggucaggucgccggucugg

SEQ ID NO: 136357 - RNA, 21 nt, Mycobacterium bovis subsp bovis AF2122/97
caccacgccggcgccgcggug

SEQ ID NO: 136358 - RNA, 22 nt, Mycobacterium bovis subsp bovis AF2122/97
uaccgauaccgggcgcaccggu

SEQ ID NO: 136359 - RNA, 22 nt, Mycobacterium bovis subsp bovis AF2122/97
cgcucgucguaucugauggggu

SEQ ID NO: 136360 - RNA, 22 nt, Mycobacterium bovis subsp bovis AF2122/97
accggaucuggcuggagcagaa

SEQ ID NO: 136361 - RNA, 22 nt, Mycobacterium bovis subsp bovis AF2122/97
gcggcguaccacccagcgcguc

SEQ ID NO: 136362 - RNA, 22 nt, Mycobacterium bovis subsp bovis AF2122/97
ucguuguuccuguuggccagca

SEQ ID NO: 136363 - RNA, 22 nt, Mycobacterium bovis subsp bovis AF2122/97
cuccggugccggcaguagucgg

SEQ ID NO: 136364 - RNA, 22 nt, Mycobacterium bovis subsp bovis AF2122/97
gaaucgcgaacacggcucccgc

SEQ ID NO: 136365 - RNA, 22 nt, Mycobacterium bovis subsp bovis AF2122/97
gguguucuuggcuggcgcgucc

SEQ ID NO: 136366 - RNA, 22 nt, Mycobacterium bovis subsp bovis AF2122/97
ugaccucgaugcggcgcagcga

SEQ ID NO: 136367 - RNA, 22 nt, Mycobacterium bovis subsp bovis AF2122/97
guuugguaccaaagaguaccgu

SEQ ID NO: 136368 - RNA, 22 nt, Mycobacterium bovis subsp bovis AF2122/97
aauggcguguaccgaggccagc

SEQ ID NO: 136369 - RNA, 22 nt, Mycobacterium bovis subsp bovis AF2122/97
uagacguccauaucgccaugcc

SEQ ID NO: 136370 - RNA, 22 nt, Mycobacterium bovis subsp bovis AF2122/97
gacggcaucggccccggcgugc

SEQ ID NO: 136371 - RNA, 22 nt, Mycobacterium bovis subsp bovis AF2122/97
ucggcgguucguuugaccguga

SEQ ID NO: 136372 - RNA, 23 nt, Mycobacterium bovis subsp bovis AF2122/97
cggacgaaaacccuggcggucau

SEQ ID NO: 136373 - RNA, 22 nt, Mycobacterium bovis subsp bovis AF2122/97
gcggaauccucggcgucgcccu

SEQ ID NO: 136374 - RNA, 22 nt, Mycobacterium bovis subsp bovis AF2122/97
aucgccaucgugcugcaauugc

SEQ ID NO: 136375 - RNA, 22 nt, Mycobacterium bovis subsp bovis AF2122/97
ccgcgcgguagcggucuagguc

SEQ ID NO: 136376 - RNA, 22 nt, Mycobacterium bovis subsp bovis AF2122/97
acgccugguaguuguucacgcu

SEQ ID NO: 136377 - RNA, 20 nt, Mycobacterium bovis subsp bovis AF2122/97
cacuggguacacgcucggcg

SEQ ID NO: 136378 - RNA, 22 nt, Mycobacterium bovis subsp bovis AF2122/97
augggcgauuuugcgucugcuc

SEQ ID NO: 136379 - RNA, 22 nt, Mycobacterium bovis subsp bovis AF2122/97
gacggcggccugguugaugaac

SEQ ID NO: 136380 - RNA, 22 nt, Mycobacterium bovis subsp bovis AF2122/97
cacggcgaugggcuggagcccg

SEQ ID NO: 136381 - RNA, 22 nt, Mycobacterium bovis subsp bovis AF2122/97
uuuugggcgauuuugcgucucg

SEQ ID NO: 136382 - RNA, 22 nt, Mycobacterium bovis subsp bovis AF2122/97
cgaguaacccguccgguggacg

SEQ ID NO: 136383 - RNA, 22 nt, Mycobacterium bovis subsp bovis AF2122/97
ggaucgacguaggcagccgguu

SEQ ID NO: 136384 - RNA, 22 nt, Mycobacterium bovis subsp bovis AF2122/97
cgcaggccacccgcggggccac

SEQ ID NO: 136385 - RNA, 21 nt, Mycobacterium bovis subsp bovis AF2122/97
gcgguggcggucguagacggc

SEQ ID NO: 136386 - RNA, 22 nt, Mycobacterium bovis subsp bovis AF2122/97
uucgguaucgccuccgccuuug

SEQ ID NO: 136387 - RNA, 22 nt, Mycobacterium bovis subsp bovis AF2122/97
ccgcaacaucugcgcgaugugc

SEQ ID NO: 136388 - RNA, 22 nt, Mycobacterium bovis subsp bovis AF2122/97
gccuugcugggaucggucagcu

SEQ ID NO: 136389 - RNA, 19 nt, Mycobacterium bovis subsp bovis AF2122/97
ucacgcaccccgugcagca

SEQ ID NO: 136390 - RNA, 22 nt, Mycobacterium bovis subsp bovis AF2122/97
ugccaguaccucucgaugccaa

SEQ ID NO: 136391 - RNA, 22 nt, Mycobacterium bovis subsp bovis AF2122/97
gcugaaccugauccucaagggc

SEQ ID NO: 136392 - RNA, 22 nt, Mycobacterium bovis subsp bovis AF2122/97
ccguuuggucccgaggugucgg

SEQ ID NO: 136393 - RNA, 22 nt, Mycobacterium bovis subsp bovis AF2122/97
cgagacgagccacggcuucgcc

SEQ ID NO: 136394 - RNA, 22 nt, Mycobacterium bovis subsp bovis AF2122/97
ggcugcgcugcguaccgacgug

SEQ ID NO: 136395 - RNA, 22 nt, Mycobacterium bovis subsp bovis AF2122/97
gugccggggggcgcgccaucga

SEQ ID NO: 136396 - RNA, 22 nt, Mycobacterium bovis subsp bovis AF2122/97
cagggccuccgacucgucuuca

SEQ ID NO: 136397 - RNA, 22 nt, Mycobacterium bovis subsp bovis AF2122/97
ccgauugugaaucugacgacgc

SEQ ID NO: 136398 - RNA, 22 nt, Mycobacterium bovis subsp bovis AF2122/97
ccgggcggaugaugggucggcu

SEQ ID NO: 136399 - RNA, 19 nt, Mycobacterium bovis subsp bovis AF2122/97
cgaggucguaugccguccg

SEQ ID NO: 136400 - RNA, 19 nt, Mycobacterium bovis subsp bovis AF2122/97
cgaccgcgcacguguuggc

SEQ ID NO: 136401 - RNA, 22 nt, Mycobacterium bovis subsp bovis AF2122/97
ucugcggggacaggaacgacau

SEQ ID NO: 136402 - RNA, 23 nt, Mycobacterium bovis subsp bovis AF2122/97
uagcccaguucacgugccaaaug

SEQ ID NO: 136403 - RNA, 22 nt, Mycobacterium bovis subsp bovis AF2122/97
gucguuguggcuuaagguuucu

SEQ ID NO: 136404 - RNA, 22 nt, Mycobacterium bovis subsp bovis AF2122/97
ucaccgcgaugaacgacgccga

SEQ ID NO: 136405 - RNA, 22 nt, Mycobacterium bovis subsp bovis AF2122/97
uucguacugaugcggcgucgag

SEQ ID NO: 136406 - RNA, 16 nt, Mycobacterium bovis subsp bovis AF2122/97
cgcugccgacgccgcc

SEQ ID NO: 136407 - RNA, 22 nt, Mycobacterium bovis subsp bovis AF2122/97
ggccgccgcaaagccgucaagu

SEQ ID NO: 136408 - RNA, 22 nt, Mycobacterium bovis subsp bovis AF2122/97
gcucugcuggucgauaagaucg

SEQ ID NO: 136409 - RNA, 22 nt, Mycobacterium bovis subsp bovis AF2122/97
ccagcucaucgccguagcugag

SEQ ID NO: 136410 - RNA, 20 nt, Mycobacterium bovis subsp bovis AF2122/97
ucacccaggacggccgaucc

SEQ ID NO: 136411 - RNA, 18 nt, Mycobacterium bovis subsp bovis AF2122/97
cgcagccuggucuauuuc

SEQ ID NO: 136412 - RNA, 22 nt, Mycobacterium bovis subsp bovis AF2122/97
gcccggcggauucggcaucuuu

SEQ ID NO: 136413 - RNA, 22 nt, Mycobacterium bovis subsp bovis AF2122/97
cucggcggcucgcggaggcauc

SEQ ID NO: 136414 - RNA, 22 nt, Mycobacterium bovis subsp bovis AF2122/97
gcagaugauccucggcggugau

SEQ ID NO: 136415 - RNA, 22 nt, Mycobacterium bovis subsp bovis AF2122/97
ucgucgaggcugugccguccgg

SEQ ID NO: 136416 - RNA, 21 nt, Mycobacterium bovis subsp bovis AF2122/97
accgaucggucccgagcuggu

SEQ ID NO: 136417 - RNA, 23 nt, Mycobacterium bovis subsp bovis AF2122/97
gcgauuuugcgucugcucgcgcc

SEQ ID NO: 136418 - RNA, 22 nt, Mycobacterium bovis subsp bovis AF2122/97
ccucgcccccgggcaugccguc

SEQ ID NO: 136419 - RNA, 22 nt, Mycobacterium bovis subsp bovis AF2122/97
gccaaaccggucugagaucgcg

SEQ ID NO: 136420 - RNA, 22 nt, Mycobacterium bovis subsp bovis AF2122/97
aacgggcgcugcgugagcacgu

SEQ ID NO: 136421 - RNA, 22 nt, Mycobacterium bovis subsp bovis AF2122/97
gucggucugaaaaugugcggcg

SEQ ID NO: 136422 - RNA, 22 nt, Mycobacterium bovis subsp bovis AF2122/97
uggugcgcagaccacgaucggc

SEQ ID NO: 136423 - RNA, 22 nt, Mycobacterium bovis subsp bovis AF2122/97
aaccgagcguugggccugccgu

SEQ ID NO: 136424 - RNA, 21 nt, Mycobacterium bovis subsp bovis AF2122/97
accgccaucagccgaccgaau

SEQ ID NO: 136425 - RNA, 22 nt, Mycobacterium bovis subsp bovis AF2122/97
gcugggccuuacgcaccugccg

SEQ ID NO: 136426 - RNA, 22 nt, Mycobacterium bovis subsp bovis AF2122/97
auaucgagucugcguccagggu

SEQ ID NO: 136427 - RNA, 22 nt, Mycobacterium bovis subsp bovis AF2122/97
ucugggcgucgucgcugccgga

SEQ ID NO: 136428 - RNA, 22 nt, Mycobacterium bovis subsp bovis AF2122/97
uugugcgauucugcgucugcuu

SEQ ID NO: 136429 - RNA, 22 nt, Mycobacterium bovis subsp bovis AF2122/97
ucugugcgcgguuugugcacag

SEQ ID NO: 136430 - RNA, 21 nt, Mycobacterium bovis subsp bovis AF2122/97
gcguucgaaucucguugccgc

SEQ ID NO: 136431 - RNA, 22 nt, Mycobacterium bovis subsp bovis AF2122/97
uaccagcuggccuuccggacac

SEQ ID NO: 136432 - RNA, 22 nt, Mycobacterium bovis subsp bovis AF2122/97
aucggcuuucccgccgcccgag

SEQ ID NO: 136433 - RNA, 22 nt, Mycobacterium bovis subsp bovis AF2122/97
gugcgguuguggggcgaucaga

SEQ ID NO: 136434 - RNA, 22 nt, Mycobacterium bovis subsp bovis AF2122/97
gugugagccugacagcccgaca

SEQ ID NO: 136435 - RNA, 22 nt, Mycobacterium bovis subsp bovis AF2122/97
ccgagcaacaggaccgcuuccu

SEQ ID NO: 136436 - RNA, 22 nt, Mycobacterium bovis subsp bovis AF2122/97
ggucaucgcgugauccuucgaa

SEQ ID NO: 136437 - RNA, 22 nt, Mycobacterium bovis subsp bovis AF2122/97
ucccggcguaguucaccgcggu

SEQ ID NO: 136438 - RNA, 22 nt, Mycobacterium bovis subsp bovis AF2122/97
cauccgcacggugcugauccca

SEQ ID NO: 136439 - RNA, 22 nt, Mycobacterium bovis subsp bovis AF2122/97
gagcagacgcagaaucgcccau

SEQ ID NO: 136440 - RNA, 22 nt, Mycobacterium bovis subsp bovis AF2122/97
agguguucuucaacgaugucuu

SEQ ID NO: 136441 - RNA, 22 nt, Mycobacterium bovis subsp bovis AF2122/97
ucgagcggaucuugugacgcgg

SEQ ID NO: 136442 - RNA, 22 nt, Mycobacterium bovis subsp bovis AF2122/97
acugcgaccggugugcgcgccg

SEQ ID NO: 136443 - RNA, 22 nt, Mycobacterium bovis subsp bovis AF2122/97
cgccgaacaaugugcggaucuc

SEQ ID NO: 136444 - RNA, 22 nt, Mycobacterium bovis subsp bovis AF2122/97
cgaugccgcgccacugcuugag

SEQ ID NO: 136445 - RNA, 22 nt, Mycobacterium bovis subsp bovis AF2122/97
gagucagccgcgguauggcgca

SEQ ID NO: 136446 - RNA, 19 nt, Mycobacterium bovis subsp bovis AF2122/97
gcgacgcccgcgccaccau

SEQ ID NO: 136447 - RNA, 22 nt, Mycobacterium bovis subsp bovis AF2122/97
gccgugccuccccggcgagucc

SEQ ID NO: 136448 - RNA, 22 nt, Mycobacterium bovis subsp bovis AF2122/97
ccgaccguucgaagauguggaa

SEQ ID NO: 136449 - RNA, 22 nt, Mycobacterium bovis subsp bovis AF2122/97
ggcgucgaucagggcugugucg

SEQ ID NO: 136450 - RNA, 20 nt, Mycobacterium bovis subsp bovis AF2122/97
ugaugggcccagucgugggu

SEQ ID NO: 136451 - RNA, 22 nt, Mycobacterium bovis subsp bovis AF2122/97
ugaccgaugagcaggcgaucac

SEQ ID NO: 136452 - RNA, 22 nt, Mycobacterium bovis subsp bovis AF2122/97
auggucaaagagcgguucgccg

SEQ ID NO: 136453 - RNA, 21 nt, Mycobacterium bovis subsp bovis AF2122/97
ucgaaggaucacgcgaugacc

SEQ ID NO: 136454 - RNA, 23 nt, Mycobacterium bovis subsp bovis AF2122/97
aacugcaccggcucaggcagauc

SEQ ID NO: 136455 - RNA, 22 nt, Mycobacterium bovis subsp bovis AF2122/97
cggaccaugguguuggccgguu

SEQ ID NO: 136456 - RNA, 22 nt, Mycobacterium bovis subsp bovis AF2122/97
aacgcgcgccccgcuuugucaa

SEQ ID NO: 136457 - RNA, 22 nt, Mycobacterium bovis subsp bovis AF2122/97
ccggggugcucgugcuggcgcg

SEQ ID NO: 136458 - RNA, 22 nt, Mycobacterium bovis subsp bovis AF2122/97
gcgagcguaacgccacggcgaa

SEQ ID NO: 136459 - RNA, 22 nt, Mycobacterium bovis subsp bovis AF2122/97
gaaauugggcgauuuugcgucu

SEQ ID NO: 136460 - RNA, 22 nt, Mycobacterium bovis subsp bovis AF2122/97
uagcgcgcauugagacuuucaa

SEQ ID NO: 136461 - RNA, 21 nt, Mycobacterium bovis subsp bovis AF2122/97
gcuuuuugcgucuguucgccg

SEQ ID NO: 136462 - RNA, 22 nt, Mycobacterium bovis subsp bovis AF2122/97
ccgacuaccggcacucgccgau

SEQ ID NO: 136463 - RNA, 22 nt, Mycobacterium bovis subsp bovis AF2122/97
gugucuggcggcggugacacug

SEQ ID NO: 136464 - RNA, 22 nt, Mycobacterium bovis subsp bovis AF2122/97
gacgcgaaagaacaugaugggc

SEQ ID NO: 136465 - RNA, 22 nt, Mycobacterium bovis subsp bovis AF2122/97
ugccggcggccaacaggcuuac

SEQ ID NO: 136466 - RNA, 22 nt, Mycobacterium bovis subsp bovis AF2122/97
cgcgucgucauuggagguggaa

SEQ ID NO: 136467 - RNA, 22 nt, Mycobacterium bovis subsp bovis AF2122/97
ugaugguggaaccuuuggccgc

SEQ ID NO: 136468 - RNA, 22 nt, Mycobacterium bovis subsp bovis AF2122/97
ccggauauccgcucuuggcuuc

SEQ ID NO: 136469 - RNA, 22 nt, Mycobacterium bovis subsp bovis AF2122/97
gccgcguguucgacuggguggu

SEQ ID NO: 136470 - RNA, 22 nt, Mycobacterium bovis subsp bovis AF2122/97
accgcgcuguuucggcugcucg

SEQ ID NO: 136471 - RNA, 22 nt, Mycobacterium bovis subsp bovis AF2122/97
ugcuggugcccaacgucucgac

SEQ ID NO: 136472 - RNA, 22 nt, Mycobacterium bovis subsp bovis AF2122/97
gucgguggucaccgcggcaggg

SEQ ID NO: 136473 - RNA, 22 nt, Mycobacterium bovis subsp bovis AF2122/97
gcugucgucgacgguggcggug

SEQ ID NO: 136474 - RNA, 20 nt, Mycobacterium bovis subsp bovis AF2122/97
ucuggcccgagcccaugaug

SEQ ID NO: 136475 - RNA, 22 nt, Mycobacterium bovis subsp bovis AF2122/97
cgccagcaccaccugguugggc

SEQ ID NO: 136476 - RNA, 22 nt, Mycobacterium bovis subsp bovis AF2122/97
gcuggugccggacgacgucgca

SEQ ID NO: 136477 - RNA, 22 nt, Mycobacterium bovis subsp bovis AF2122/97
ugcacuccgacccgccgacguu

SEQ ID NO: 136478 - RNA, 22 nt, Mycobacterium bovis subsp bovis AF2122/97
uggcgcugcaguacuuucacgc

SEQ ID NO: 136479 - RNA, 22 nt, Mycobacterium bovis subsp bovis AF2122/97
ggcgcggugucgguguugaccg

SEQ ID NO: 136480 - RNA, 22 nt, Mycobacterium bovis subsp bovis AF2122/97
cacggcguguuugagugcgagu

SEQ ID NO: 136481 - RNA, 22 nt, Mycobacterium bovis subsp bovis AF2122/97
cugggcgaugaagcgcuggguc

SEQ ID NO: 136482 - RNA, 22 nt, Mycobacterium bovis subsp bovis AF2122/97
ggcgagcagacacagagucgca

SEQ ID NO: 136483 - RNA, 22 nt, Mycobacterium bovis subsp bovis AF2122/97
ggcgccgguguucacgucgccg

SEQ ID NO: 136484 - RNA, 22 nt, Mycobacterium bovis subsp bovis AF2122/97
guucgacgaucuggccggucug

SEQ ID NO: 136485 - RNA, 22 nt, Mycobacterium bovis subsp bovis AF2122/97
ccaccaucagcagaucgacauc

SEQ ID NO: 136486 - RNA, 22 nt, Mycobacterium bovis subsp bovis AF2122/97
ggugagagcccauggcggucgu

SEQ ID NO: 136487 - RNA, 22 nt, Mycobacterium bovis subsp bovis AF2122/97
cguugacucugcgcccaccacg

SEQ ID NO: 136488 - RNA, 22 nt, Mycobacterium bovis subsp bovis AF2122/97
gcugcguccgucuuccgggccg

SEQ ID NO: 136489 - RNA, 22 nt, Mycobacterium bovis subsp bovis AF2122/97
cuggcuugccuccugccgcgac

SEQ ID NO: 136490 - RNA, 22 nt, Mycobacterium bovis subsp bovis AF2122/97
acgagauugccgucauggcugu

SEQ ID NO: 136491 - RNA, 22 nt, Mycobacterium bovis subsp bovis AF2122/97
ucgccggucucccagucgaaga

SEQ ID NO: 136492 - RNA, 22 nt, Mycobacterium bovis subsp bovis AF2122/97
cgcccggccgcuggucgcguac

SEQ ID NO: 136493 - RNA, 22 nt, Mycobacterium bovis subsp bovis AF2122/97
acaccgaacugaugcuggacgc

SEQ ID NO: 136494 - RNA, 22 nt, Mycobacterium bovis subsp bovis AF2122/97
guucgccgagauccuccggcug

SEQ ID NO: 136495 - RNA, 22 nt, Mycobacterium bovis subsp bovis AF2122/97
cgagcgugaacugagggcgaga

SEQ ID NO: 136496 - RNA, 22 nt, Mycobacterium bovis subsp bovis AF2122/97
cggccgcaguguucucggcgau

SEQ ID NO: 136497 - RNA, 22 nt, Mycobacterium bovis subsp bovis AF2122/97
gcgaaaaugccgaccaggcacc

SEQ ID NO: 136498 - RNA, 20 nt, Mycobacterium bovis subsp bovis AF2122/97
ucaucgccgguuacgaagcc

SEQ ID NO: 136499 - RNA, 22 nt, Mycobacterium bovis subsp bovis AF2122/97
cuggcgauaucagacguucgac

SEQ ID NO: 136500 - RNA, 22 nt, Mycobacterium bovis subsp bovis AF2122/97
ugggcgcuuaugcgucugcucg

SEQ ID NO: 136501 - RNA, 22 nt, Mycobacterium bovis subsp bovis AF2122/97
ucggcacggucuuggccugggu

SEQ ID NO: 136502 - RNA, 22 nt, Mycobacterium bovis subsp bovis AF2122/97
cggaugcgaguggugaguucuu

SEQ ID NO: 136503 - RNA, 22 nt, Mycobacterium bovis subsp bovis AF2122/97
gacgaaugcgaaugcauccgcu

SEQ ID NO: 136504 - RNA, 22 nt, Mycobacterium bovis subsp bovis AF2122/97
ggcugcugcggaguccacaccg

SEQ ID NO: 136505 - RNA, 22 nt, Mycobacterium bovis subsp bovis AF2122/97
guuggcgcagcucgucgguucc

SEQ ID NO: 136506 - RNA, 22 nt, Mycobacterium bovis subsp bovis AF2122/97
gagcggauuuuucgcaccggga

SEQ ID NO: 136507 - RNA, 20 nt, Mycobacterium bovis subsp bovis AF2122/97
ucgcuguguggucaucgaca

SEQ ID NO: 136508 - RNA, 18 nt, Mycobacterium bovis subsp bovis AF2122/97
ccgggaccgcgaacccgu

SEQ ID NO: 136509 - RNA, 22 nt, Mycobacterium bovis subsp bovis AF2122/97
ccaguucgguauguuuggcggc

SEQ ID NO: 136510 - RNA, 22 nt, Mycobacterium bovis subsp bovis AF2122/97
agucgcauaagcccccgacacg

SEQ ID NO: 136511 - RNA, 22 nt, Mycobacterium bovis subsp bovis AF2122/97
ccccguccgaagugaugcccgc

SEQ ID NO: 136512 - RNA, 22 nt, Mycobacterium bovis subsp bovis AF2122/97
agacgcauaagcccccgacacg

SEQ ID NO: 136513 - RNA, 22 nt, Mycobacterium bovis subsp bovis AF2122/97
ggcgcggaccuaucgguguggc

SEQ ID NO: 136514 - RNA, 22 nt, Mycobacterium bovis subsp bovis AF2122/97
gcgcugacacuccccucgggau

SEQ ID NO: 136515 - RNA, 22 nt, Mycobacterium bovis subsp bovis AF2122/97
gcgguggaucucggcgccgauu

SEQ ID NO: 136516 - RNA, 23 nt, Mycobacterium bovis subsp bovis AF2122/97
agggcgauuuugcgucugcucgc

SEQ ID NO: 136517 - RNA, 22 nt, Mycobacterium bovis subsp bovis AF2122/97
gccgaacgugcaaccauggcgg

SEQ ID NO: 136518 - RNA, 19 nt, Mycobacterium bovis subsp bovis AF2122/97
caacggcgacgggcucguc

SEQ ID NO: 136519 - RNA, 22 nt, Mycobacterium bovis subsp bovis AF2122/97
ugcggugaguucggcguccuug

SEQ ID NO: 136520 - RNA, 22 nt, Mycobacterium bovis subsp bovis AF2122/97
ugaucgacuucgaagacgaugg

SEQ ID NO: 136521 - RNA, 22 nt, Mycobacterium bovis subsp bovis AF2122/97
cggggugcagccgauacccggg

SEQ ID NO: 136522 - RNA, 22 nt, Mycobacterium bovis subsp bovis AF2122/97
ucgccggcgaauccgguaccug

SEQ ID NO: 136523 - RNA, 22 nt, Mycobacterium bovis subsp bovis AF2122/97
cggcaucgacaccggcgacccg

SEQ ID NO: 136524 - RNA, 22 nt, Mycobacterium bovis subsp bovis AF2122/97
accgguccccgaucaccguguc

SEQ ID NO: 136525 - RNA, 22 nt, Mycobacterium bovis subsp bovis AF2122/97
aucacgguggggcaucggcggc

SEQ ID NO: 136526 - RNA, 22 nt, Mycobacterium bovis subsp bovis AF2122/97
cguggaaugcaugaucgucgcc

SEQ ID NO: 136527 - RNA, 22 nt, Mycobacterium bovis subsp bovis AF2122/97
agcugcgacgggccgggcugga

SEQ ID NO: 136528 - RNA, 22 nt, Mycobacterium bovis subsp bovis AF2122/97
ugcugcucguaguuguuggcgu

SEQ ID NO: 136529 - RNA, 22 nt, Mycobacterium bovis subsp bovis AF2122/97
ggcugcgguucaugagugccug

SEQ ID NO: 136530 - RNA, 22 nt, Mycobacterium bovis subsp bovis AF2122/97
auucacuggauagccacacuau

SEQ ID NO: 136531 - RNA, 22 nt, Mycobacterium bovis subsp bovis AF2122/97
uggugucgcgggucgcggucug

SEQ ID NO: 136532 - RNA, 22 nt, Mycobacterium bovis subsp bovis AF2122/97
cgccgaucccgaaccggcgcuc

SEQ ID NO: 136533 - RNA, 22 nt, Mycobacterium bovis subsp bovis AF2122/97
gcaaucucgguggucaugauga

SEQ ID NO: 136534 - RNA, 22 nt, Mycobacterium bovis subsp bovis AF2122/97
gcucuaccacguccugcacgcg

SEQ ID NO: 136535 - RNA, 22 nt, Mycobacterium bovis subsp bovis AF2122/97
uacccggucgguguucgaccau

SEQ ID NO: 136536 - RNA, 22 nt, Mycobacterium bovis subsp bovis AF2122/97
augguuucgaacugacccgcga

SEQ ID NO: 136537 - RNA, 22 nt, Mycobacterium bovis subsp bovis AF2122/97
guugugcagguucguacuggca

SEQ ID NO: 136538 - RNA, 22 nt, Mycobacterium bovis subsp bovis AF2122/97
cugggcgcgcucaucgaccggg

SEQ ID NO: 136539 - RNA, 22 nt, Mycobacterium bovis subsp bovis AF2122/97
caacugcccgagucgcagcgcc

SEQ ID NO: 136540 - RNA, 22 nt, Mycobacterium bovis subsp bovis AF2122/97
auugggcgauuuugcgucugcu

SEQ ID NO: 136541 - RNA, 22 nt, Mycobacterium bovis subsp bovis AF2122/97
cacacccgccgcggucggcuac

SEQ ID NO: 136542 - RNA, 22 nt, Mycobacterium bovis subsp bovis AF2122/97
ccggguugggcuucggagcggu

SEQ ID NO: 136543 - RNA, 22 nt, Mycobacterium bovis subsp bovis AF2122/97
uacuggauccgccggcggcugc

SEQ ID NO: 136544 - RNA, 22 nt, Mycobacterium bovis subsp bovis AF2122/97
gcgaccgugaaucuggcgacgc

SEQ ID NO: 136545 - RNA, 22 nt, Mycobacterium bovis subsp bovis AF2122/97
auucggguuuccagaaccucgg

SEQ ID NO: 136546 - RNA, 22 nt, Mycobacterium bovis subsp bovis AF2122/97
ucgacgugaucaaugcugaucg

SEQ ID NO: 136547 - RNA, 22 nt, Mycobacterium bovis subsp bovis AF2122/97
uggucgaaaaagccgccguuuu

SEQ ID NO: 136548 - RNA, 22 nt, Mycobacterium bovis subsp bovis AF2122/97
ugcgggccuugacaucguggcg

SEQ ID NO: 136549 - RNA, 22 nt, Mycobacterium bovis subsp bovis AF2122/97
gccaccuucugcgcgaugcgca

SEQ ID NO: 136550 - RNA, 22 nt, Mycobacterium bovis subsp bovis AF2122/97
cucaucguguuggucgagccgg

SEQ ID NO: 136551 - RNA, 22 nt, Mycobacterium bovis subsp bovis AF2122/97
ugucaucuaccaauucggugau

SEQ ID NO: 136552 - RNA, 22 nt, Mycobacterium bovis subsp bovis AF2122/97
ggcugacacguuccgcccggca

SEQ ID NO: 136553 - RNA, 19 nt, Mycobacterium bovis subsp bovis AF2122/97
agcucgagugccgucguug

SEQ ID NO: 136554 - RNA, 22 nt, Mycobacterium bovis subsp bovis AF2122/97
uguuggugcgguuugcgccugc

SEQ ID NO: 136555 - RNA, 22 nt, Mycobacterium bovis subsp bovis AF2122/97
cgugcgauucugcgucugcucg

SEQ ID NO: 136556 - RNA, 21 nt, Mycobacterium bovis subsp bovis AF2122/97
cgauucugugucugcucggcg

SEQ ID NO: 136557 - RNA, 22 nt, Mycobacterium bovis subsp bovis AF2122/97
gaccagcaccgcggcgaccgca

SEQ ID NO: 136558 - RNA, 22 nt, Mycobacterium bovis subsp bovis AF2122/97
cauccgccuuaacgaagucggg

SEQ ID NO: 136559 - RNA, 22 nt, Mycobacterium bovis subsp bovis AF2122/97
gucggucuucaaggcgaccacg

SEQ ID NO: 136560 - RNA, 22 nt, Mycobacterium bovis subsp bovis AF2122/97
gccgaagccaagacagugcugg

SEQ ID NO: 136561 - RNA, 22 nt, Mycobacterium bovis subsp bovis AF2122/97
gcgggucugaugcaggaucgcg

SEQ ID NO: 136562 - RNA, 22 nt, Mycobacterium bovis subsp bovis AF2122/97
cgggaugccagcuagcgcgcgu

SEQ ID NO: 136563 - RNA, 22 nt, Mycobacterium bovis subsp bovis AF2122/97
agcagacgcauaagcccccgca

SEQ ID NO: 136564 - RNA, 21 nt, Mycobacterium bovis subsp bovis AF2122/97
gccagcacgguguucaaguug

SEQ ID NO: 136565 - RNA, 22 nt, Mycobacterium bovis subsp bovis AF2122/97
gcggugaucgacgaugucugua

SEQ ID NO: 136566 - RNA, 22 nt, Mycobacterium bovis subsp bovis AF2122/97
ugcacggcgaugcggucuggca

SEQ ID NO: 136567 - RNA, 22 nt, Mycobacterium bovis subsp bovis AF2122/97
auccaccggccagcauuuccuc

SEQ ID NO: 136568 - RNA, 22 nt, Mycobacterium bovis subsp bovis AF2122/97
cucguggcuaccgcaucgcugc

SEQ ID NO: 136569 - RNA, 22 nt, Mycobacterium bovis subsp bovis AF2122/97
ugggcgcuuacgcgucugcccg

SEQ ID NO: 136570 - RNA, 22 nt, Mycobacterium bovis subsp bovis AF2122/97
guggugauuggccuguauccgc

SEQ ID NO: 136571 - RNA, 22 nt, Mycobacterium bovis subsp bovis AF2122/97
cggcugauccccaucgagggca

SEQ ID NO: 136572 - RNA, 22 nt, Mycobacterium bovis subsp bovis AF2122/97
cguggccaguugaugcgugauc

SEQ ID NO: 136573 - RNA, 22 nt, Mycobacterium bovis subsp bovis AF2122/97
uuucgcgugacugagcggucug

SEQ ID NO: 136574 - RNA, 22 nt, Mycobacterium bovis subsp bovis AF2122/97
uucgccgccgagaucggugcgg

SEQ ID NO: 136575 - RNA, 22 nt, Mycobacterium bovis subsp bovis AF2122/97
gcggcccgccgaugugcugguc

SEQ ID NO: 136576 - RNA, 22 nt, Mycobacterium bovis subsp bovis AF2122/97
cuguccgcgcgcacaccaacgg

SEQ ID NO: 136577 - RNA, 22 nt, Mycobacterium bovis subsp bovis AF2122/97
uugugcgauucugcgucugcuc

SEQ ID NO: 136578 - RNA, 22 nt, Mycobacterium bovis subsp bovis AF2122/97
ucgcccugagaacacguucggc

SEQ ID NO: 136579 - RNA, 22 nt, Mycobacterium bovis subsp bovis AF2122/97
cagcugcuccgugacuacggcu

SEQ ID NO: 136580 - RNA, 22 nt, Mycobacterium bovis subsp bovis AF2122/97
gcgugcgauucugugucugcuc

SEQ ID NO: 136581 - RNA, 22 nt, Mycobacterium bovis subsp bovis AF2122/97
gucgggguggccuguuacgccg

SEQ ID NO: 136582 - RNA, 22 nt, Mycobacterium bovis subsp bovis AF2122/97
uaucugcuggccagucccgacg

SEQ ID NO: 136583 - RNA, 22 nt, Mycobacterium bovis subsp bovis AF2122/97
cuugcugguaugccgggccacc

SEQ ID NO: 136584 - RNA, 22 nt, Mycobacterium bovis subsp bovis AF2122/97
cgcgcucgaucauccgcggugc

SEQ ID NO: 136585 - RNA, 22 nt, Mycobacterium bovis subsp bovis AF2122/97
cgccagcguaacgucacggcga

SEQ ID NO: 136586 - RNA, 22 nt, Mycobacterium bovis subsp bovis AF2122/97
ucacgcuaacccuuugcguggc

SEQ ID NO: 136587 - RNA, 22 nt, Mycobacterium bovis subsp bovis AF2122/97
auugcucagcaucgggcuggcu

SEQ ID NO: 136588 - RNA, 22 nt, Mycobacterium bovis subsp bovis AF2122/97
ggggcugagcggguuugaguug

SEQ ID NO: 136589 - RNA, 22 nt, Mycobacterium bovis subsp bovis AF2122/97
aggucggcguaugggaaguacc

SEQ ID NO: 136590 - RNA, 18 nt, Mycobacterium bovis subsp bovis AF2122/97
cucggcgaccacguccuu

SEQ ID NO: 136591 - RNA, 22 nt, Mycobacterium bovis subsp bovis AF2122/97
ccgugcguguggucgccguugg

SEQ ID NO: 136592 - RNA, 22 nt, Mycobacterium bovis subsp bovis AF2122/97
guacagaucugguugugcccgu

SEQ ID NO: 136593 - RNA, 22 nt, Mycobacterium bovis subsp bovis AF2122/97
ucgggcggcaaacccccggagc

SEQ ID NO: 136594 - RNA, 22 nt, Mycobacterium bovis subsp bovis AF2122/97
gacaccguugccgacggccgcc

SEQ ID NO: 136595 - RNA, 22 nt, Mycobacterium bovis subsp bovis AF2122/97
ucgcgguugcuguuuaccgcca

SEQ ID NO: 136596 - RNA, 22 nt, Mycobacterium bovis subsp bovis AF2122/97
cauccuggccuauuccggcggu

SEQ ID NO: 136597 - RNA, 22 nt, Mycobacterium bovis subsp bovis AF2122/97
gacgccaucuaucugcucuaca

SEQ ID NO: 136598 - RNA, 22 nt, Mycobacterium bovis subsp bovis AF2122/97
gugguggacagcucccggcggg

SEQ ID NO: 136599 - RNA, 22 nt, Mycobacterium bovis subsp bovis AF2122/97
ucgggggcuuuugcgucugcuc

SEQ ID NO: 136600 - RNA, 22 nt, Mycobacterium bovis subsp bovis AF2122/97
aucggcgugcaagcgguguccg

SEQ ID NO: 136601 - RNA, 22 nt, Mycobacterium bovis subsp bovis AF2122/97
agcagacgcaaaagcccccuaa

SEQ ID NO: 136602 - RNA, 19 nt, Mycobacterium bovis subsp bovis AF2122/97
ugcugcugcagcgcagaau

SEQ ID NO: 136603 - RNA, 22 nt, Mycobacterium bovis subsp bovis AF2122/97
gcguggacagccguucgcgcau

SEQ ID NO: 136604 - RNA, 22 nt, Mycobacterium bovis subsp bovis AF2122/97
caggccgaccagagccucgacc

SEQ ID NO: 136605 - RNA, 22 nt, Mycobacterium bovis subsp bovis AF2122/97
aucaucgaggccgucgggccgg

SEQ ID NO: 136606 - RNA, 21 nt, Mycobacterium bovis subsp bovis AF2122/97
gcgcucgaucacuagcgcccc

SEQ ID NO: 136607 - RNA, 22 nt, Mycobacterium bovis subsp bovis AF2122/97
gucggcgugggcuuuggaaacg

SEQ ID NO: 136608 - RNA, 22 nt, Mycobacterium bovis subsp bovis AF2122/97
caccgacaccuauugccccgcc

SEQ ID NO: 136609 - RNA, 22 nt, Mycobacterium bovis subsp bovis AF2122/97
uugccaaugccgguguugacca

SEQ ID NO: 136610 - RNA, 22 nt, Mycobacterium bovis subsp bovis AF2122/97
ugggccaacacgugcgcggucg

SEQ ID NO: 136611 - RNA, 23 nt, Mycobacterium bovis subsp bovis AF2122/97
ccgacgacuaccagcucaccgag

SEQ ID NO: 136612 - RNA, 19 nt, Mycobacterium bovis subsp bovis AF2122/97
ggugagcagggucucgcgc

SEQ ID NO: 136613 - RNA, 22 nt, Mycobacterium bovis subsp bovis AF2122/97
gaugccgacguggucggacugg

SEQ ID NO: 136614 - RNA, 22 nt, Mycobacterium bovis subsp bovis AF2122/97
agcgucucggcggcguugcaga

SEQ ID NO: 136615 - RNA, 22 nt, Mycobacterium bovis subsp bovis AF2122/97
ggcgcgucaucaugccgggcac

SEQ ID NO: 136616 - RNA, 22 nt, Mycobacterium bovis subsp bovis AF2122/97
agaccgucgcggccaggcagca

SEQ ID NO: 136617 - RNA, 22 nt, Mycobacterium bovis subsp bovis AF2122/97
acggcccgacacgggcucggcc

SEQ ID NO: 136618 - RNA, 22 nt, Mycobacterium bovis subsp bovis AF2122/97
cggcguggccgaccccgcgguc

SEQ ID NO: 136619 - RNA, 22 nt, Mycobacterium bovis subsp bovis AF2122/97
ugggcugaacaggacggccgcc

SEQ ID NO: 136620 - RNA, 22 nt, Mycobacterium bovis subsp bovis AF2122/97
cccgacgccgaagucagcaccg

SEQ ID NO: 136621 - RNA, 22 nt, Mycobacterium bovis subsp bovis AF2122/97
agguuggugccgccacgcuuga

SEQ ID NO: 136622 - RNA, 22 nt, Mycobacterium bovis subsp bovis AF2122/97
agaacccgucuucguccaccgc

SEQ ID NO: 136623 - RNA, 22 nt, Mycobacterium bovis subsp bovis AF2122/97
ugggcgauucugugucugcucg

SEQ ID NO: 136624 - RNA, 20 nt, Mycobacterium bovis subsp bovis AF2122/97
uucaccguggcaaccccggc

SEQ ID NO: 136625 - RNA, 22 nt, Mycobacterium bovis subsp bovis AF2122/97
cgccaacgauccggugcgaguc

SEQ ID NO: 136626 - RNA, 22 nt, Mycobacterium bovis subsp bovis AF2122/97
ggucgguugcgcuguacuacac

SEQ ID NO: 136627 - RNA, 22 nt, Mycobacterium bovis subsp bovis AF2122/97
ggguugguggcggccagcagca

SEQ ID NO: 136628 - RNA, 21 nt, Mycobacterium bovis subsp bovis AF2122/97
cucgggcgugaagcucgccga

SEQ ID NO: 136629 - RNA, 22 nt, Mycobacterium bovis subsp bovis AF2122/97
uggucgaugaucaaggggcgcg

SEQ ID NO: 136630 - RNA, 22 nt, Mycobacterium bovis subsp bovis AF2122/97
cacgucggugaccagaugaucg

SEQ ID NO: 136631 - RNA, 22 nt, Mycobacterium bovis subsp bovis AF2122/97
uggcucagcgggucaacgaggc

SEQ ID NO: 136632 - RNA, 22 nt, Mycobacterium bovis subsp bovis AF2122/97
auccgggugcugaucgccggua

SEQ ID NO: 136633 - RNA, 22 nt, Mycobacterium bovis subsp bovis AF2122/97
ggugccgccguggcugacagcc

SEQ ID NO: 136634 - RNA, 22 nt, Mycobacterium bovis subsp bovis AF2122/97
guggcgguggcacccggccggg

SEQ ID NO: 136635 - RNA, 22 nt, Mycobacterium bovis subsp bovis AF2122/97
ucagcaccgaccaugccgaacg

SEQ ID NO: 136636 - RNA, 22 nt, Mycobacterium bovis subsp bovis AF2122/97
uggguguucuccucgaccuugu

SEQ ID NO: 136637 - RNA, 22 nt, Mycobacterium bovis subsp bovis AF2122/97
ccggguaucggcugcaccccgu

SEQ ID NO: 136638 - RNA, 22 nt, Mycobacterium bovis subsp bovis AF2122/97
guuuugggccucggcgagccga

SEQ ID NO: 136639 - RNA, 22 nt, Mycobacterium bovis subsp bovis AF2122/97
uccggcccaacaucguugaggu

SEQ ID NO: 136640 - RNA, 22 nt, Mycobacterium bovis subsp bovis AF2122/97
ugcggcacucgucaggcccgcg

SEQ ID NO: 136641 - RNA, 22 nt, Mycobacterium bovis subsp bovis AF2122/97
agcgcggugcgcuccaagguaa

SEQ ID NO: 136642 - RNA, 22 nt, Mycobacterium bovis subsp bovis AF2122/97
gcagcgccaaacucaaguuccg

SEQ ID NO: 136643 - RNA, 22 nt, Mycobacterium bovis subsp bovis AF2122/97
ucgguuccaggaugugguggau

SEQ ID NO: 136644 - RNA, 22 nt, Mycobacterium bovis subsp bovis AF2122/97
gaucuacgcgcgcaucgucgac

SEQ ID NO: 136645 - RNA, 22 nt, Mycobacterium bovis subsp bovis AF2122/97
uucaggcuacgguagcggugcg

SEQ ID NO: 136646 - RNA, 23 nt, Mycobacterium bovis subsp bovis AF2122/97
guuccgucaccgaagacgucgcc

SEQ ID NO: 136647 - RNA, 22 nt, Mycobacterium bovis subsp bovis AF2122/97
cggcauuggccagaccgguguu

SEQ ID NO: 136648 - RNA, 22 nt, Mycobacterium bovis subsp bovis AF2122/97
ccgagcuggucgccucguccag

SEQ ID NO: 136649 - RNA, 22 nt, Mycobacterium bovis subsp bovis AF2122/97
accgcagcggguugcgggcaug

SEQ ID NO: 136650 - RNA, 22 nt, Mycobacterium bovis subsp bovis AF2122/97
uguacagcuggaucgugcugca

SEQ ID NO: 136651 - RNA, 20 nt, Mycobacterium bovis subsp bovis AF2122/97
acgccggcggcaucggaucc

SEQ ID NO: 136652 - RNA, 22 nt, Mycobacterium bovis subsp bovis AF2122/97
ucggcggcuaucacaccggcga

SEQ ID NO: 136653 - RNA, 22 nt, Mycobacterium bovis subsp bovis AF2122/97
uagcguggcggcgccggacaac

SEQ ID NO: 136654 - RNA, 22 nt, Mycobacterium bovis subsp bovis AF2122/97
cgcggccgcguucugggcgacc

SEQ ID NO: 136655 - RNA, 22 nt, Mycobacterium bovis subsp bovis AF2122/97
gucggccagcguaaccggcagc

SEQ ID NO: 136656 - RNA, 22 nt, Mycobacterium bovis subsp bovis AF2122/97
uccgggucuaugucgagaccgu

SEQ ID NO: 136657 - RNA, 22 nt, Mycobacterium bovis subsp bovis AF2122/97
ccgaucauuucggugauuccgg

SEQ ID NO: 136658 - RNA, 22 nt, Mycobacterium bovis subsp bovis AF2122/97
uccucgacggcgucgggguacg

SEQ ID NO: 136659 - RNA, 19 nt, Mycobacterium bovis subsp bovis AF2122/97
guagcaggucugcuccggc

SEQ ID NO: 136660 - RNA, 22 nt, Mycobacterium bovis subsp bovis AF2122/97
ugcgguggucggggaguggcag

SEQ ID NO: 136661 - RNA, 22 nt, Mycobacterium bovis subsp bovis AF2122/97
cggcgguguuugaccgcugguc

SEQ ID NO: 136662 - RNA, 22 nt, Mycobacterium bovis subsp bovis AF2122/97
gucgauggccuggucgaugaau

SEQ ID NO: 136663 - RNA, 22 nt, Mycobacterium bovis subsp bovis AF2122/97
acccgcggccaaggcgucgguc

SEQ ID NO: 136664 - RNA, 22 nt, Mycobacterium bovis subsp bovis AF2122/97
cugcggagaucuaccagcucga

SEQ ID NO: 136665 - RNA, 22 nt, Mycobacterium bovis subsp bovis AF2122/97
gcgaucgcaagcucggcgcuug

SEQ ID NO: 136666 - RNA, 22 nt, Mycobacterium bovis subsp bovis AF2122/97
gcgccagugcugcgcgugcaca

SEQ ID NO: 136667 - RNA, 23 nt, Mycobacterium bovis subsp bovis AF2122/97
ucgcccuggcuucacguucggcg

SEQ ID NO: 136668 - RNA, 22 nt, Mycobacterium bovis subsp bovis AF2122/97
agggcaccggcgaucgugucca

SEQ ID NO: 136669 - RNA, 22 nt, Mycobacterium bovis subsp bovis AF2122/97
agggcgccgcugucgccggccc

SEQ ID NO: 136670 - RNA, 22 nt, Mycobacterium bovis subsp bovis AF2122/97
cgagcgcagcucgggcuucggc

SEQ ID NO: 136671 - RNA, 22 nt, Mycobacterium bovis subsp bovis AF2122/97
cuucgugcaccacgucggccuu

SEQ ID NO: 136672 - RNA, 22 nt, Mycobacterium bovis subsp bovis AF2122/97
cgcgccgaggcgcucuacgaac

SEQ ID NO: 136673 - RNA, 22 nt, Mycobacterium bovis subsp bovis AF2122/97
cccgauccacggugaccagggg

SEQ ID NO: 136674 - RNA, 22 nt, Mycobacterium bovis subsp bovis AF2122/97
uugcgcaggggcaugucagcgu

SEQ ID NO: 136675 - RNA, 21 nt, Mycobacterium bovis subsp bovis AF2122/97
cccuggugcuggccaccggcu

SEQ ID NO: 136676 - RNA, 22 nt, Mycobacterium bovis subsp bovis AF2122/97
ugguggacgcagagucaacacg

SEQ ID NO: 136677 - RNA, 22 nt, Mycobacterium bovis subsp bovis AF2122/97
uucgauguggcggaucagggcu

SEQ ID NO: 136678 - RNA, 22 nt, Mycobacterium bovis subsp bovis AF2122/97
auugggggcuuuugcgucugcu

SEQ ID NO: 136679 - RNA, 22 nt, Mycobacterium bovis subsp bovis AF2122/97
cagccgggugcgccgggcuugc

SEQ ID NO: 136680 - RNA, 22 nt, Mycobacterium bovis subsp bovis AF2122/97
gcaucgacgucuauucgcugcg

SEQ ID NO: 136681 - RNA, 22 nt, Mycobacterium bovis subsp bovis AF2122/97
gaggugacucgaugcuggagcu

SEQ ID NO: 136682 - RNA, 22 nt, Mycobacterium bovis subsp bovis AF2122/97
uugaugccgaacugguugauca

SEQ ID NO: 136683 - RNA, 22 nt, Mycobacterium bovis subsp bovis AF2122/97
gaaaccgggcaccuugauggau

SEQ ID NO: 136684 - RNA, 22 nt, Mycobacterium bovis subsp bovis AF2122/97
gaggugaugagggcggcgagua

SEQ ID NO: 136685 - RNA, 22 nt, Mycobacterium bovis subsp bovis AF2122/97
ccggugucacggagcuggcccc

SEQ ID NO: 136686 - RNA, 22 nt, Mycobacterium bovis subsp bovis AF2122/97
gagcagacgcagaaucgcacaa

SEQ ID NO: 136687 - RNA, 22 nt, Mycobacterium bovis subsp bovis AF2122/97
gccgagcgugaagucacggcgg

SEQ ID NO: 136688 - RNA, 22 nt, Mycobacterium bovis subsp bovis AF2122/97
aguggcgaaggucggcuucacc

SEQ ID NO: 136689 - RNA, 22 nt, Mycobacterium bovis subsp bovis AF2122/97
gcgccgccggggaucccgaccu

SEQ ID NO: 136690 - RNA, 22 nt, Mycobacterium bovis subsp bovis AF2122/97
aagaucagcucgcuucccgauc

SEQ ID NO: 136691 - RNA, 22 nt, Mycobacterium bovis subsp bovis AF2122/97
cacgccgcggcuguccucggug

SEQ ID NO: 136692 - RNA, 21 nt, Mycobacterium bovis subsp bovis AF2122/97
agggcgauuuugcgucugcuc

SEQ ID NO: 136693 - RNA, 22 nt, Mycobacterium bovis subsp bovis AF2122/97
gccaccggcgagaucgucucgg

SEQ ID NO: 136694 - RNA, 22 nt, Mycobacterium bovis subsp bovis AF2122/97
gcgcgcugugguaggcgaggcg

SEQ ID NO: 136695 - RNA, 22 nt, Mycobacterium bovis subsp bovis AF2122/97
guuucgggcgauuuugcguccu

SEQ ID NO: 136696 - RNA, 22 nt, Mycobacterium bovis subsp bovis AF2122/97
accagugucgcgagguccugcu

SEQ ID NO: 136697 - RNA, 22 nt, Mycobacterium bovis subsp bovis AF2122/97
gcgaucgacgacagcccgauca

SEQ ID NO: 136698 - RNA, 22 nt, Mycobacterium bovis subsp bovis AF2122/97
ccguucgccgacauggguuuug

SEQ ID NO: 136699 - RNA, 20 nt, Mycobacterium bovis subsp bovis AF2122/97
ugguggacgcagagucaacg

SEQ ID NO: 136700 - RNA, 22 nt, Mycobacterium bovis subsp bovis AF2122/97
accgccugcuuggcguugucca

SEQ ID NO: 136701 - RNA, 22 nt, Mycobacterium bovis subsp bovis AF2122/97
auggcgaacgaugccggcgguc

SEQ ID NO: 136702 - RNA, 22 nt, Mycobacterium bovis subsp bovis AF2122/97
ggccgcugucggucacguagac

SEQ ID NO: 136703 - RNA, 22 nt, Mycobacterium bovis subsp bovis AF2122/97
auucggucgccugaucgguucc

SEQ ID NO: 136704 - RNA, 22 nt, Mycobacterium bovis subsp bovis AF2122/97
gacgagcagacgcggaaucgca

SEQ ID NO: 136705 - RNA, 22 nt, Mycobacterium bovis subsp bovis AF2122/97
gaugcugugcuacuggccguua

SEQ ID NO: 136706 - RNA, 22 nt, Mycobacterium bovis subsp bovis AF2122/97
ucucgccgagguuagcggcauc

SEQ ID NO: 136707 - RNA, 22 nt, Mycobacterium bovis subsp bovis AF2122/97
gugcgucaccggaucaaagaca

SEQ ID NO: 136708 - RNA, 22 nt, Mycobacterium bovis subsp bovis AF2122/97
cggucgcuugcguucaccgcga

SEQ ID NO: 136709 - RNA, 22 nt, Mycobacterium bovis subsp bovis AF2122/97
cgggcagacgcguaagcgccca

SEQ ID NO: 136710 - RNA, 22 nt, Mycobacterium bovis subsp bovis AF2122/97
guguccagccacgcgccgcgcc

SEQ ID NO: 136711 - RNA, 22 nt, Mycobacterium bovis subsp bovis AF2122/97
cgggcguuggucuguacguugc

SEQ ID NO: 136712 - RNA, 22 nt, Mycobacterium bovis subsp bovis AF2122/97
gcccgcacccugcacgaccggc

SEQ ID NO: 136713 - RNA, 22 nt, Mycobacterium bovis subsp bovis AF2122/97
uugacucugcgcuuaccacgcg

SEQ ID NO: 136714 - RNA, 22 nt, Mycobacterium bovis subsp bovis AF2122/97
cgagcagacguaaagcccccaa

SEQ ID NO: 136715 - RNA, 22 nt, Mycobacterium bovis subsp bovis AF2122/97
gcgcugaccgcggcucaguuug

SEQ ID NO: 136716 - RNA, 22 nt, Mycobacterium bovis subsp bovis AF2122/97
ggcgcugacggccugauagauc

SEQ ID NO: 136717 - RNA, 22 nt, Mycobacterium bovis subsp bovis AF2122/97
guggcucggcgccguggccaua

SEQ ID NO: 136718 - RNA, 22 nt, Mycobacterium bovis subsp bovis AF2122/97
gcagacguaaaagcccccgaca

SEQ ID NO: 136719 - RNA, 22 nt, Mycobacterium bovis subsp bovis AF2122/97
agugccgcguucaugucggcau

SEQ ID NO: 136720 - RNA, 22 nt, Mycobacterium bovis subsp bovis AF2122/97
uacgucaucuaucaacgccuga

SEQ ID NO: 136721 - RNA, 22 nt, Mycobacterium bovis subsp bovis AF2122/97
ucaucgaggcuguaguuggcgc

SEQ ID NO: 136722 - RNA, 22 nt, Mycobacterium bovis subsp bovis AF2122/97
cgauguaucugacguacuggac

SEQ ID NO: 136723 - RNA, 22 nt, Mycobacterium bovis subsp bovis AF2122/97
ugguccggucggucgggacgua

SEQ ID NO: 136724 - RNA, 22 nt, Mycobacterium bovis subsp bovis AF2122/97
cgugagcagacgcaaagucgcc

SEQ ID NO: 136725 - RNA, 19 nt, Mycobacterium bovis subsp bovis AF2122/97
acgcccaacgaacgugggc

SEQ ID NO: 136726 - RNA, 22 nt, Mycobacterium bovis subsp bovis AF2122/97
cgaugcagcaggaccggugaga

SEQ ID NO: 136727 - RNA, 23 nt, Mycobacterium bovis subsp bovis AF2122/97
uccaacuccaagaugccgccccc

SEQ ID NO: 136728 - RNA, 22 nt, Mycobacterium bovis subsp bovis AF2122/97
ucggcguucuggucuacgagcu

SEQ ID NO: 136729 - RNA, 22 nt, Mycobacterium bovis subsp bovis AF2122/97
cauggcagguuuucgacgaugg

SEQ ID NO: 136730 - RNA, 22 nt, Mycobacterium bovis subsp bovis AF2122/97
uggcugacgacgaccgucggcg

SEQ ID NO: 136731 - RNA, 22 nt, Mycobacterium bovis subsp bovis AF2122/97
uuguugcuuucgguagugcugg

SEQ ID NO: 136732 - RNA, 22 nt, Mycobacterium bovis subsp bovis AF2122/97
ugggcgacuuugcgucugcuca

SEQ ID NO: 136733 - RNA, 22 nt, Mycobacterium bovis subsp bovis AF2122/97
gguccagugucagcgcggccau

SEQ ID NO: 136734 - RNA, 22 nt, Mycobacterium bovis subsp bovis AF2122/97
gccgggcauuacggccgucguu

SEQ ID NO: 136735 - RNA, 22 nt, Mycobacterium bovis subsp bovis AF2122/97
guacagcgagaccagcucgccc

SEQ ID NO: 136736 - RNA, 22 nt, Mycobacterium bovis subsp bovis AF2122/97
cgucgggaucuccagcacgucc

SEQ ID NO: 136737 - RNA, 22 nt, Mycobacterium bovis subsp bovis AF2122/97
guacgugcugggcaccgagcgc

SEQ ID NO: 136738 - RNA, 22 nt, Mycobacterium bovis subsp bovis AF2122/97
ucugacggugccaacccuggug

SEQ ID NO: 136739 - RNA, 22 nt, Mycobacterium bovis subsp bovis AF2122/97
gggguuggugauguagccgaua

SEQ ID NO: 136740 - RNA, 22 nt, Mycobacterium bovis subsp bovis AF2122/97
ccaggacgacaccggcaccuau

SEQ ID NO: 136741 - RNA, 22 nt, Mycobacterium bovis subsp bovis AF2122/97
gagcagacgcagaagucgccga

SEQ ID NO: 136742 - RNA, 23 nt, Mycobacterium bovis subsp bovis AF2122/97
gaggcgcuggcagcggcccgguu

SEQ ID NO: 136743 - RNA, 22 nt, Mycobacterium bovis subsp bovis AF2122/97
cgccuugguaggcguugccgac

SEQ ID NO: 136744 - RNA, 22 nt, Mycobacterium bovis subsp bovis AF2122/97
acgauguuccgccacgccgagc

SEQ ID NO: 136745 - RNA, 21 nt, Mycobacterium bovis subsp bovis AF2122/97
uuccacugccggcgccgguga

SEQ ID NO: 136746 - RNA, 22 nt, Mycobacterium bovis subsp bovis AF2122/97
uugaugcgauucugcgucugcu

SEQ ID NO: 136747 - RNA, 22 nt, Mycobacterium bovis subsp bovis AF2122/97
ccuguuucgaguucuucacguu

SEQ ID NO: 136748 - RNA, 22 nt, Mycobacterium bovis subsp bovis AF2122/97
acuggggcacggcacgcccgaa

SEQ ID NO: 136749 - RNA, 22 nt, Mycobacterium bovis subsp bovis AF2122/97
gugacguugcgaucguguccga

SEQ ID NO: 136750 - RNA, 22 nt, Mycobacterium bovis subsp bovis AF2122/97
guuugguugccuaccgcguggg

SEQ ID NO: 136751 - RNA, 22 nt, Mycobacterium bovis subsp bovis AF2122/97
ugcgccccgacgguucgguugc

SEQ ID NO: 136752 - RNA, 21 nt, Mycobacterium bovis subsp bovis AF2122/97
cagucgucuggcagcggccug

SEQ ID NO: 136753 - RNA, 22 nt, Mycobacterium bovis subsp bovis AF2122/97
gugguggcgcaauucgaccagg

SEQ ID NO: 136754 - RNA, 22 nt, Mycobacterium bovis subsp bovis AF2122/97
ugcucgaggacgcguugauccu

SEQ ID NO: 136755 - RNA, 22 nt, Mycobacterium bovis subsp bovis AF2122/97
gucggaucgucgacgacgacag

SEQ ID NO: 136756 - RNA, 22 nt, Mycobacterium bovis subsp bovis AF2122/97
gcguccuugccgcgugcaucga

SEQ ID NO: 136757 - RNA, 22 nt, Mycobacterium bovis subsp bovis AF2122/97
gccagcucaaaaaguacgguuc

SEQ ID NO: 136758 - RNA, 22 nt, Mycobacterium bovis subsp bovis AF2122/97
caccgacaucgacccggucgcg

SEQ ID NO: 136759 - RNA, 22 nt, Mycobacterium bovis subsp bovis AF2122/97
ggcgggggcaccguugcugcga

SEQ ID NO: 136760 - RNA, 22 nt, Mycobacterium bovis subsp bovis AF2122/97
gcggguaacggagguccgccgg

SEQ ID NO: 136761 - RNA, 22 nt, Mycobacterium bovis subsp bovis AF2122/97
agcgugcguuguugcaccgguu

SEQ ID NO: 136762 - RNA, 22 nt, Mycobacterium bovis subsp bovis AF2122/97
gccuggacuccgcuuuuggcac

SEQ ID NO: 136763 - RNA, 22 nt, Mycobacterium bovis subsp bovis AF2122/97
gccgccugcucggcggccugaa

SEQ ID NO: 136764 - RNA, 22 nt, Mycobacterium bovis subsp bovis AF2122/97
gcagaucggaaucgucgucgac

SEQ ID NO: 136765 - RNA, 22 nt, Mycobacterium bovis subsp bovis AF2122/97
cggccgccuugcguucggcguu

SEQ ID NO: 136766 - RNA, 22 nt, Mycobacterium bovis subsp bovis AF2122/97
agcgcggugauggccacccgcu

SEQ ID NO: 136767 - RNA, 22 nt, Mycobacterium bovis subsp bovis AF2122/97
uugccgcgccauuacgcucgcc

SEQ ID NO: 136768 - RNA, 22 nt, Mycobacterium bovis subsp bovis AF2122/97
acggucgucgucagccaaggca

SEQ ID NO: 136769 - RNA, 22 nt, Mycobacterium bovis subsp bovis AF2122/97
gcugacaucgucgaacaccagg

SEQ ID NO: 136770 - RNA, 22 nt, Mycobacterium bovis subsp bovis AF2122/97
cccagcaccgaccagugccggc

SEQ ID NO: 136771 - RNA, 22 nt, Mycobacterium bovis subsp bovis AF2122/97
cgcugcagcggcagccuccgcc

SEQ ID NO: 136772 - RNA, 19 nt, Mycobacterium bovis subsp bovis AF2122/97
gucgcgucccucuggcaag

SEQ ID NO: 136773 - RNA, 22 nt, Mycobacterium bovis subsp bovis AF2122/97
uggccuugcguagaaugucggc

SEQ ID NO: 136774 - RNA, 22 nt, Mycobacterium bovis subsp bovis AF2122/97
ucgacgugcggcagcagccuuc

SEQ ID NO: 136775 - RNA, 21 nt, Mycobacterium bovis subsp bovis AF2122/97
gcgauucugcgucugcucgcc

SEQ ID NO: 136776 - RNA, 22 nt, Mycobacterium bovis subsp bovis AF2122/97
gcgagcuggccacccggugugu

SEQ ID NO: 136777 - RNA, 22 nt, Mycobacterium bovis subsp bovis AF2122/97
cggucguggugcccgagcgaga

SEQ ID NO: 136778 - RNA, 22 nt, Mycobacterium bovis subsp bovis AF2122/97
ggcgggaucuccuucggugcgu

SEQ ID NO: 136779 - RNA, 19 nt, Mycobacterium bovis subsp bovis AF2122/97
cgcgccaaggucauuggcg

SEQ ID NO: 136780 - RNA, 22 nt, Mycobacterium bovis subsp bovis AF2122/97
gugugggcgacacccgaucaca

SEQ ID NO: 136781 - RNA, 22 nt, Mycobacterium bovis subsp bovis AF2122/97
gcuucggacucgcucuugcgca

SEQ ID NO: 136782 - RNA, 19 nt, Mycobacterium bovis subsp bovis AF2122/97
cgccaucgcgcugugccuc

SEQ ID NO: 136783 - RNA, 22 nt, Mycobacterium bovis subsp bovis AF2122/97
cacccgaucaaacuggccugga

SEQ ID NO: 136784 - RNA, 22 nt, Mycobacterium bovis subsp bovis AF2122/97
augaggcgauuuugcgucugcu

SEQ ID NO: 136785 - RNA, 22 nt, Mycobacterium bovis subsp bovis AF2122/97
cuucgauacuggugcggaucug

SEQ ID NO: 136786 - RNA, 22 nt, Mycobacterium bovis subsp bovis AF2122/97
guccggcuacgaucaugcccgc

SEQ ID NO: 136787 - RNA, 21 nt, Mycobacterium bovis subsp bovis AF2122/97
gcuaccgcgcccgugagcgcc

SEQ ID NO: 136788 - RNA, 22 nt, Mycobacterium bovis subsp bovis AF2122/97
gucgccgcggucgugcugggug

SEQ ID NO: 136789 - RNA, 22 nt, Mycobacterium bovis subsp bovis AF2122/97
gucgcgguuccaacuugagcgc

SEQ ID NO: 136790 - RNA, 22 nt, Mycobacterium bovis subsp bovis AF2122/97
gcccaucauguucuuuugcgcc

SEQ ID NO: 136791 - RNA, 22 nt, Mycobacterium bovis subsp bovis AF2122/97
cagacgcaaaagcaccccauuu

SEQ ID NO: 136792 - RNA, 22 nt, Mycobacterium bovis subsp bovis AF2122/97
cccgggucggcacgacccggga

SEQ ID NO: 136793 - RNA, 22 nt, Mycobacterium bovis subsp bovis AF2122/97
guacgcaacggcugucacacga

SEQ ID NO: 136794 - RNA, 22 nt, Mycobacterium bovis subsp bovis AF2122/97
ccuggaccaaucgcggcuugca

SEQ ID NO: 136795 - RNA, 22 nt, Mycobacterium bovis subsp bovis AF2122/97
agccggucggcgauggcccaca

SEQ ID NO: 136796 - RNA, 22 nt, Mycobacterium bovis subsp bovis AF2122/97
cgccgcuggccaucggauccga

SEQ ID NO: 136797 - RNA, 22 nt, Mycobacterium bovis subsp bovis AF2122/97
acggcgcccgcgcauggccaau

SEQ ID NO: 136798 - RNA, 22 nt, Mycobacterium bovis subsp bovis AF2122/97
cgagcguaacgccacugcgcua

SEQ ID NO: 136799 - RNA, 22 nt, Mycobacterium bovis subsp bovis AF2122/97
cggcguacagcucggcagccgg

SEQ ID NO: 136800 - RNA, 22 nt, Mycobacterium bovis subsp bovis AF2122/97
uuaguuaccaucguugcugaug

SEQ ID NO: 136801 - RNA, 22 nt, Mycobacterium bovis subsp bovis AF2122/97
ccggcgucuucgacaccccgga

SEQ ID NO: 136802 - RNA, 22 nt, Mycobacterium bovis subsp bovis AF2122/97
cgaggauuucgucgcgcggcug

SEQ ID NO: 136803 - RNA, 22 nt, Mycobacterium bovis subsp bovis AF2122/97
uugcgaggugcgggccucggcc

SEQ ID NO: 136804 - RNA, 22 nt, Mycobacterium bovis subsp bovis AF2122/97
gguggagggacucgagaauguc

SEQ ID NO: 136805 - RNA, 22 nt, Mycobacterium bovis subsp bovis AF2122/97
gucuggacuucgacgucgcccc

SEQ ID NO: 136806 - RNA, 22 nt, Mycobacterium bovis subsp bovis AF2122/97
aaccggcuggagcauccgauac

SEQ ID NO: 136807 - RNA, 22 nt, Mycobacterium bovis subsp bovis AF2122/97
cgccugcucccagcgcggcuau

SEQ ID NO: 136808 - RNA, 22 nt, Mycobacterium bovis subsp bovis AF2122/97
auugcgcacgucguugucggcu

SEQ ID NO: 136809 - RNA, 22 nt, Mycobacterium bovis subsp bovis AF2122/97
cgcugccgucgaucucgacgca

SEQ ID NO: 136810 - RNA, 22 nt, Mycobacterium bovis subsp bovis AF2122/97
cguuuucggagaccagcuugac

SEQ ID NO: 136811 - RNA, 22 nt, Mycobacterium bovis subsp bovis AF2122/97
auagcggcgcugaucuccgaca

SEQ ID NO: 136812 - RNA, 22 nt, Mycobacterium bovis subsp bovis AF2122/97
gggcucgcccguugguguagac

SEQ ID NO: 136813 - RNA, 22 nt, Mycobacterium bovis subsp bovis AF2122/97
gcagcuucgaugacuacgacca

SEQ ID NO: 136814 - RNA, 22 nt, Mycobacterium bovis subsp bovis AF2122/97
ugcccgucgcgaaguacgacug

SEQ ID NO: 136815 - RNA, 22 nt, Mycobacterium bovis subsp bovis AF2122/97
augcggugcgcgacggugaucg

SEQ ID NO: 136816 - RNA, 18 nt, Mycobacterium bovis subsp bovis AF2122/97
caccagaacgagaucggc

SEQ ID NO: 136817 - RNA, 22 nt, Mycobacterium bovis subsp bovis AF2122/97
aacacgucggcgcgcugcaggg

SEQ ID NO: 136818 - RNA, 22 nt, Mycobacterium bovis subsp bovis AF2122/97
gagggacuuaugcgucugcuag

SEQ ID NO: 136819 - RNA, 22 nt, Mycobacterium bovis subsp bovis AF2122/97
ggugcgcaaccguugggcgacc

SEQ ID NO: 136820 - RNA, 22 nt, Mycobacterium bovis subsp bovis AF2122/97
ugcguuucauacccgcagccuu

SEQ ID NO: 136821 - RNA, 22 nt, Mycobacterium bovis subsp bovis AF2122/97
uuugacuccacgcgaaacacag

SEQ ID NO: 136822 - RNA, 22 nt, Mycobacterium bovis subsp bovis AF2122/97
cgagggcuuuagugucugcucg

SEQ ID NO: 136823 - RNA, 22 nt, Mycobacterium bovis subsp bovis AF2122/97
ucgaugugcuccaugaucccgc

SEQ ID NO: 136824 - RNA, 22 nt, Mycobacterium bovis subsp bovis AF2122/97
gugacggcgagccgccaguuga

SEQ ID NO: 136825 - RNA, 19 nt, Mycobacterium bovis subsp bovis AF2122/97
ccgcgguggcuucacgguc

SEQ ID NO: 136826 - RNA, 21 nt, Mycobacterium bovis subsp bovis AF2122/97
gguucucgagguagcugggcu

SEQ ID NO: 136827 - RNA, 19 nt, Mycobacterium bovis subsp bovis AF2122/97
gcgauccggcggcuaucac

SEQ ID NO: 136828 - RNA, 22 nt, Mycobacterium bovis subsp bovis AF2122/97
ggcgcccgacuucuucgaaggg

SEQ ID NO: 136829 - RNA, 22 nt, Mycobacterium bovis subsp bovis AF2122/97
ugguggcaucacaguaggccuc

SEQ ID NO: 136830 - RNA, 22 nt, Mycobacterium bovis subsp bovis AF2122/97
gccgagcgcgccgaggucccca

SEQ ID NO: 136831 - RNA, 22 nt, Mycobacterium bovis subsp bovis AF2122/97
cugaucgcgucaucgaucgugc

SEQ ID NO: 136832 - RNA, 18 nt, Mycobacterium bovis subsp bovis AF2122/97
ucguugauacagcgacca

SEQ ID NO: 136833 - RNA, 22 nt, Mycobacterium bovis subsp bovis AF2122/97
ggcggcaccagcaauccgugga

SEQ ID NO: 136834 - RNA, 22 nt, Mycobacterium bovis subsp bovis AF2122/97
cgucucgguaugggagcugcuc

SEQ ID NO: 136835 - RNA, 22 nt, Mycobacterium bovis subsp bovis AF2122/97
gccggucgccuaagccccgggu

SEQ ID NO: 136836 - RNA, 22 nt, Mycobacterium bovis subsp bovis AF2122/97
ugguaggcaacaaacggcgggu

SEQ ID NO: 136837 - RNA, 22 nt, Mycobacterium bovis subsp bovis AF2122/97
ccaggacaggaugcugucggcc

SEQ ID NO: 136838 - RNA, 22 nt, Mycobacterium bovis subsp bovis AF2122/97
gcagagccgaucguccuguugc

SEQ ID NO: 136839 - RNA, 23 nt, Mycobacterium bovis subsp bovis AF2122/97
ucagcgugacgccgagaucagcg

SEQ ID NO: 136840 - RNA, 22 nt, Mycobacterium bovis subsp bovis AF2122/97
gccaugguugcacguucggcgu

SEQ ID NO: 136841 - RNA, 22 nt, Mycobacterium bovis subsp bovis AF2122/97
gaacgcgucggugggaucggug

SEQ ID NO: 136842 - RNA, 22 nt, Mycobacterium bovis subsp bovis AF2122/97
uugggaugcuaacagcgccagc

SEQ ID NO: 136843 - RNA, 22 nt, Mycobacterium bovis subsp bovis AF2122/97
agucagcggugcgaauggcugg

SEQ ID NO: 136844 - RNA, 22 nt, Mycobacterium bovis subsp bovis AF2122/97
augugccgcucaucgcccggug

SEQ ID NO: 136845 - RNA, 22 nt, Mycobacterium bovis subsp bovis AF2122/97
ugacagcgcugauccugguguu

SEQ ID NO: 136846 - RNA, 22 nt, Mycobacterium bovis subsp bovis AF2122/97
gacaccagaacgagaucggcca

SEQ ID NO: 136847 - RNA, 22 nt, Mycobacterium bovis subsp bovis AF2122/97
uugucaacgucggcgacaucaa

SEQ ID NO: 136848 - RNA, 22 nt, Mycobacterium bovis subsp bovis AF2122/97
cccggcucucuucgcgcgcugg

SEQ ID NO: 136849 - RNA, 22 nt, Mycobacterium bovis subsp bovis AF2122/97
augcgggugaugccgaacucgg

SEQ ID NO: 136850 - RNA, 22 nt, Mycobacterium bovis subsp bovis AF2122/97
ggguggugaaguuggcggccgg

SEQ ID NO: 136851 - RNA, 23 nt, Mycobacterium bovis subsp bovis AF2122/97
ugcgauucugugucugcucgcgc

SEQ ID NO: 136852 - RNA, 22 nt, Mycobacterium bovis subsp bovis AF2122/97
gcccucaguucacguucggcga

SEQ ID NO: 136853 - RNA, 22 nt, Mycobacterium bovis subsp bovis AF2122/97
gcgcggaaguccuuggcgggcg

SEQ ID NO: 136854 - RNA, 22 nt, Mycobacterium bovis subsp bovis AF2122/97
accgggagaaugccgccgcacu

SEQ ID NO: 136855 - RNA, 22 nt, Mycobacterium bovis subsp bovis AF2122/97
cguguugugcucgaucagcugg

SEQ ID NO: 136856 - RNA, 22 nt, Mycobacterium bovis subsp bovis AF2122/97
cacccguaugaucgcugcggcc

SEQ ID NO: 136857 - RNA, 22 nt, Mycobacterium bovis subsp bovis AF2122/97
agcguggacguacugucgucgc

SEQ ID NO: 136858 - RNA, 22 nt, Mycobacterium bovis subsp bovis AF2122/97
gcgucgacgguguggguucgga

SEQ ID NO: 136859 - RNA, 22 nt, Mycobacterium bovis subsp bovis AF2122/97
gcgauuuugcgucugcucgccg

SEQ ID NO: 136860 - RNA, 22 nt, Mycobacterium bovis subsp bovis AF2122/97
gcgcugcggcacuccgacgaca

SEQ ID NO: 136861 - RNA, 21 nt, Mycobacterium bovis subsp bovis AF2122/97
cgagcucgcggcccagaguuc

SEQ ID NO: 136862 - RNA, 22 nt, Mycobacterium bovis subsp bovis AF2122/97
ccgacccgcaucacggauauuc

SEQ ID NO: 136863 - RNA, 22 nt, Mycobacterium bovis subsp bovis AF2122/97
ucgagcucacccaggguggccg

SEQ ID NO: 136864 - RNA, 22 nt, Mycobacterium bovis subsp bovis AF2122/97
cgcccgaugccuccgcugugca

SEQ ID NO: 136865 - RNA, 22 nt, Mycobacterium bovis subsp bovis AF2122/97
cggaucgguggcgugcagaugu

SEQ ID NO: 136866 - RNA, 22 nt, Mycobacterium bovis subsp bovis AF2122/97
ugguuucccgugaggugaucgc

SEQ ID NO: 136867 - RNA, 22 nt, Mycobacterium bovis subsp bovis AF2122/97
gaugcaccggugucggugaccg

SEQ ID NO: 136868 - RNA, 22 nt, Mycobacterium bovis subsp bovis AF2122/97
gucggcuugucgacggccucgg

SEQ ID NO: 136869 - RNA, 22 nt, Mycobacterium bovis subsp bovis AF2122/97
uugccgggacuuuuuguguggc

SEQ ID NO: 136870 - RNA, 18 nt, Mycobacterium bovis subsp bovis AF2122/97
ugcggccggcgcucaggu

SEQ ID NO: 136871 - RNA, 22 nt, Mycobacterium bovis subsp bovis AF2122/97
gucgcuggugggaucgcagcgc

SEQ ID NO: 136872 - RNA, 22 nt, Mycobacterium bovis subsp bovis AF2122/97
gagcucggucagaucagcagca

SEQ ID NO: 136873 - RNA, 22 nt, Mycobacterium bovis subsp bovis AF2122/97
ccguaacgcgugcacuucggcg

SEQ ID NO: 136874 - RNA, 22 nt, Mycobacterium bovis subsp bovis AF2122/97
ccgaacgugcaacagcugcgaa

SEQ ID NO: 136875 - RNA, 22 nt, Mycobacterium bovis subsp bovis AF2122/97
gcuggcgggcgaccguccguug

SEQ ID NO: 136876 - RNA, 22 nt, Mycobacterium bovis subsp bovis AF2122/97
cagucgccggcuucgauguacg

SEQ ID NO: 136877 - RNA, 22 nt, Mycobacterium bovis subsp bovis AF2122/97
gagcgacaaagccagcgcgcca

SEQ ID NO: 136878 - RNA, 22 nt, Mycobacterium bovis subsp bovis AF2122/97
gacgaccgaugucugggugauc

SEQ ID NO: 136879 - RNA, 22 nt, Mycobacterium bovis subsp bovis AF2122/97
uaacagucugccaggaaucgcc

SEQ ID NO: 136880 - RNA, 22 nt, Mycobacterium bovis subsp bovis AF2122/97
ugugcggcugguaugccgcucg

SEQ ID NO: 136881 - RNA, 22 nt, Mycobacterium bovis subsp bovis AF2122/97
guugauuuccggucacuagucg

SEQ ID NO: 136882 - RNA, 22 nt, Mycobacterium bovis subsp bovis AF2122/97
gagccuguuccgcagcgaagac

SEQ ID NO: 136883 - RNA, 22 nt, Mycobacterium bovis subsp bovis AF2122/97
cgcugguggaauucgagcgcuc

SEQ ID NO: 136884 - RNA, 22 nt, Mycobacterium bovis subsp bovis AF2122/97
cggcggcgacgucuucucgccg

SEQ ID NO: 136885 - RNA, 22 nt, Mycobacterium bovis subsp bovis AF2122/97
cgcuccuaucaagucacgccgg

SEQ ID NO: 136886 - RNA, 22 nt, Mycobacterium bovis subsp bovis AF2122/97
ggcgggcccgaaucgaggcggu

SEQ ID NO: 136887 - RNA, 22 nt, Mycobacterium bovis subsp bovis AF2122/97
ucggcgcgguugucccgguucg

SEQ ID NO: 136888 - RNA, 21 nt, Mycobacterium bovis subsp bovis AF2122/97
uggugccgucggcguggacga

SEQ ID NO: 136889 - RNA, 22 nt, Mycobacterium bovis subsp bovis AF2122/97
gcuggccgccagcgaggcguug

SEQ ID NO: 136890 - RNA, 22 nt, Mycobacterium bovis subsp bovis AF2122/97
ccuuggaugcaggcuaucgccg

SEQ ID NO: 136891 - RNA, 22 nt, Mycobacterium bovis subsp bovis AF2122/97
uacuucgugcagcagcugcgcc

SEQ ID NO: 136892 - RNA, 22 nt, Mycobacterium bovis subsp bovis AF2122/97
cccgguguugaagaagcccgac

SEQ ID NO: 136893 - RNA, 22 nt, Mycobacterium bovis subsp bovis AF2122/97
cggucggucaaggucgcgugca

SEQ ID NO: 136894 - RNA, 22 nt, Mycobacterium bovis subsp bovis AF2122/97
ucguccugcgcgaggugaccau

SEQ ID NO: 136895 - RNA, 22 nt, Mycobacterium bovis subsp bovis AF2122/97
aagccgauggccgcggacgccg

SEQ ID NO: 136896 - RNA, 22 nt, Mycobacterium bovis subsp bovis AF2122/97
cguguugacucugcguccacca

SEQ ID NO: 136897 - RNA, 22 nt, Mycobacterium bovis subsp bovis AF2122/97
cccaggugcagugugcaccacg

SEQ ID NO: 136898 - RNA, 22 nt, Mycobacterium bovis subsp bovis AF2122/97
uauggcggcgaucaguccgcgc

SEQ ID NO: 136899 - RNA, 23 nt, Mycobacterium bovis subsp bovis AF2122/97
cggaucacgggaucguuaugccg

SEQ ID NO: 136900 - RNA, 22 nt, Mycobacterium bovis subsp bovis AF2122/97
gcucggaucaucaucuuguccg

SEQ ID NO: 136901 - RNA, 22 nt, Mycobacterium bovis subsp bovis AF2122/97
acccggucgagcaccccgauga

SEQ ID NO: 136902 - RNA, 22 nt, Mycobacterium bovis subsp bovis AF2122/97
cuggcgaucaccgugcgccgca

SEQ ID NO: 136903 - RNA, 22 nt, Mycobacterium bovis subsp bovis AF2122/97
cucgacgccgcaucaguacgaa

SEQ ID NO: 136904 - RNA, 22 nt, Mycobacterium bovis subsp bovis AF2122/97
gucguggucuugaagucgauca

SEQ ID NO: 136905 - RNA, 22 nt, Mycobacterium bovis subsp bovis AF2122/97
uuuccgcccgcagaacacguug

SEQ ID NO: 136906 - RNA, 21 nt, Mycobacterium bovis subsp bovis AF2122/97
gcgagcagggcaucaccgccg

SEQ ID NO: 136907 - RNA, 22 nt, Mycobacterium bovis subsp bovis AF2122/97
ucuugcccucaaggcggaucca

SEQ ID NO: 136908 - RNA, 22 nt, Mycobacterium bovis subsp bovis AF2122/97
uuugguacggaacguaggcaga

SEQ ID NO: 136909 - RNA, 22 nt, Mycobacterium bovis subsp bovis AF2122/97
gucggguuucuucaacuccggu

SEQ ID NO: 136910 - RNA, 22 nt, Mycobacterium bovis subsp bovis AF2122/97
cccagcaccugccaggacgggc

SEQ ID NO: 136911 - RNA, 22 nt, Mycobacterium bovis subsp bovis AF2122/97
gcggaucgacaaccaguugcgu

SEQ ID NO: 136912 - RNA, 19 nt, Mycobacterium bovis subsp bovis AF2122/97
gucgucagauucacggucg

SEQ ID NO: 136913 - RNA, 22 nt, Mycobacterium bovis subsp bovis AF2122/97
guggccgaacguggucauggcc

SEQ ID NO: 136914 - RNA, 22 nt, Mycobacterium bovis subsp bovis AF2122/97
gccggugcuggcgaguuggcgg

SEQ ID NO: 136915 - RNA, 22 nt, Mycobacterium bovis subsp bovis AF2122/97
ucgguccaccgacggcauagga

SEQ ID NO: 136916 - RNA, 22 nt, Mycobacterium bovis subsp bovis AF2122/97
cguuggcgaauccgugcgaguu

SEQ ID NO: 136917 - RNA, 22 nt, Mycobacterium bovis subsp bovis AF2122/97
uucgaccaguucauguugcggc

SEQ ID NO: 136918 - RNA, 22 nt, Mycobacterium bovis subsp bovis AF2122/97
aacccggugcuggccgugcccg

SEQ ID NO: 136919 - RNA, 22 nt, Mycobacterium bovis subsp bovis AF2122/97
cuggcgcuguugggacgcccgu

SEQ ID NO: 136920 - RNA, 22 nt, Mycobacterium bovis subsp bovis AF2122/97
ccgggucgcucaugcucucgau

SEQ ID NO: 136921 - RNA, 22 nt, Mycobacterium bovis subsp bovis AF2122/97
aguugguucggcgcggcguccg

SEQ ID NO: 136922 - RNA, 22 nt, Mycobacterium bovis subsp bovis AF2122/97
ccccuucgaagaagucgggcgc

SEQ ID NO: 136923 - RNA, 22 nt, Mycobacterium bovis subsp bovis AF2122/97
cucggcggauucgguagcacuu

SEQ ID NO: 136924 - RNA, 22 nt, Mycobacterium bovis subsp bovis AF2122/97
cgggggcuuaugcgacugcucg

SEQ ID NO: 136925 - RNA, 22 nt, Mycobacterium bovis subsp bovis AF2122/97
uugcguggauccgucaggugga

SEQ ID NO: 136926 - RNA, 22 nt, Mycobacterium bovis subsp bovis AF2122/97
ggcggucgagcggcggaugaag

SEQ ID NO: 136927 - RNA, 22 nt, Mycobacterium bovis subsp bovis AF2122/97
guucguagagcgccucggcgcg

SEQ ID NO: 136928 - RNA, 22 nt, Mycobacterium bovis subsp bovis AF2122/97
cacaccaucaccgugaugauca

SEQ ID NO: 136929 - RNA, 22 nt, Mycobacterium bovis subsp bovis AF2122/97
cagguguuguucggcgaugccc

SEQ ID NO: 136930 - RNA, 22 nt, Mycobacterium bovis subsp bovis AF2122/97
cuguggugucgacggacaugcu

SEQ ID NO: 136931 - RNA, 23 nt, Mycobacterium bovis subsp bovis AF2122/97
uccgcgucacaagauccgcucga

SEQ ID NO: 136932 - RNA, 22 nt, Mycobacterium bovis subsp bovis AF2122/97
accggcuacgcugcuguucacg

SEQ ID NO: 136933 - RNA, 22 nt, Mycobacterium bovis subsp bovis AF2122/97
uccguugcaacaccuucggaug

SEQ ID NO: 136934 - RNA, 22 nt, Mycobacterium bovis subsp bovis AF2122/97
gcugcucacugcgaucgcgagc

SEQ ID NO: 136935 - RNA, 22 nt, Mycobacterium bovis subsp bovis AF2122/97
cgacccuucguugagcgccgau

SEQ ID NO: 136936 - RNA, 22 nt, Mycobacterium bovis subsp bovis AF2122/97
gcgacgucaugaucgcgcuggg

SEQ ID NO: 136937 - RNA, 22 nt, Mycobacterium bovis subsp bovis AF2122/97
gcccgauaccgauggccgccgu

SEQ ID NO: 136938 - RNA, 22 nt, Mycobacterium bovis subsp bovis AF2122/97
auuucggggccuuuugcgucug

SEQ ID NO: 136939 - RNA, 22 nt, Mycobacterium bovis subsp bovis AF2122/97
ggcguggucaccggcguggucg

SEQ ID NO: 136940 - RNA, 22 nt, Mycobacterium bovis subsp bovis AF2122/97
gcccggggccuuggucacaugu

SEQ ID NO: 136941 - RNA, 22 nt, Mycobacterium bovis subsp bovis AF2122/97
uuccggcgcgaccggucugauc

SEQ ID NO: 136942 - RNA, 22 nt, Mycobacterium bovis subsp bovis AF2122/97
aucgccugcuggggcgccaucu

SEQ ID NO: 136943 - RNA, 22 nt, Mycobacterium bovis subsp bovis AF2122/97
gacggcguugggugcaucggcg

SEQ ID NO: 136944 - RNA, 22 nt, Mycobacterium bovis subsp bovis AF2122/97
ccaugagcacccggauggccug

SEQ ID NO: 136945 - RNA, 22 nt, Mycobacterium bovis subsp bovis AF2122/97
uggcgcuuggccuugucuacgu

SEQ ID NO: 136946 - RNA, 22 nt, Mycobacterium bovis subsp bovis AF2122/97
gcguugacucugcguccaccac

SEQ ID NO: 136947 - RNA, 22 nt, Mycobacterium bovis subsp bovis AF2122/97
acggugucauagagcgagaacc

SEQ ID NO: 136948 - RNA, 22 nt, Mycobacterium bovis subsp bovis AF2122/97
uggcagcaaucggguauccgau

SEQ ID NO: 136949 - RNA, 22 nt, Mycobacterium bovis subsp bovis AF2122/97
aagcagacgcagaaucgcacaa

SEQ ID NO: 136950 - RNA, 22 nt, Mycobacterium bovis subsp bovis AF2122/97
uuuccgcccucaguucacgcug

SEQ ID NO: 136951 - RNA, 22 nt, Mycobacterium bovis subsp bovis AF2122/97
ccuacacagcggccgcgucagc

SEQ ID NO: 136952 - RNA, 22 nt, Mycobacterium bovis subsp bovis AF2122/97
ucuccucgacccggcugcgggu

SEQ ID NO: 136953 - RNA, 22 nt, Mycobacterium bovis subsp bovis AF2122/97
uagcccaccggugcuguaggcg

SEQ ID NO: 136954 - RNA, 22 nt, Mycobacterium bovis subsp bovis AF2122/97
gcgguggucgcgaccggccccg

SEQ ID NO: 136955 - RNA, 22 nt, Mycobacterium bovis subsp bovis AF2122/97
ccgacccuggcgaagcgaccgg

SEQ ID NO: 136956 - RNA, 22 nt, Mycobacterium bovis subsp bovis AF2122/97
gcggccgguaauugcuuugauc

SEQ ID NO: 136957 - RNA, 22 nt, Mycobacterium bovis subsp bovis AF2122/97
acacagguacgcgggucggugu

SEQ ID NO: 136958 - RNA, 22 nt, Mycobacterium bovis subsp bovis AF2122/97
agucucguucuugccgaaccca

SEQ ID NO: 136959 - RNA, 22 nt, Mycobacterium bovis subsp bovis AF2122/97
aagcggggcgcgcguuccguau

SEQ ID NO: 136960 - RNA, 22 nt, Mycobacterium bovis subsp bovis AF2122/97
ugcugaucauccugauccucgu

SEQ ID NO: 136961 - RNA, 22 nt, Mycobacterium bovis subsp bovis AF2122/97
aguuugucgggaucuugaccaa

SEQ ID NO: 136962 - RNA, 22 nt, Mycobacterium bovis subsp bovis AF2122/97
gcugaccgggacgccggccugg

SEQ ID NO: 136963 - RNA, 22 nt, Mycobacterium bovis subsp bovis AF2122/97
agcagacgcaaaaucgcccaau

SEQ ID NO: 136964 - RNA, 22 nt, Mycobacterium bovis subsp bovis AF2122/97
cgagcgcgcgauccaucagcag

SEQ ID NO: 136965 - RNA, 22 nt, Mycobacterium bovis subsp bovis AF2122/97
ccgagaaggaagaagccgaccg

SEQ ID NO: 136966 - RNA, 22 nt, Mycobacterium bovis subsp bovis AF2122/97
aucgccgucgcgugcgaccugc

SEQ ID NO: 136967 - RNA, 22 nt, Mycobacterium bovis subsp bovis AF2122/97
agucggccagguacggcaucag

SEQ ID NO: 136968 - RNA, 22 nt, Mycobacterium bovis subsp bovis AF2122/97
gcgucguagguguggcccuccg

SEQ ID NO: 136969 - RNA, 22 nt, Mycobacterium bovis subsp bovis AF2122/97
gugguguucccaaugcccgggg

SEQ ID NO: 136970 - RNA, 22 nt, Mycobacterium bovis subsp bovis AF2122/97
ucggcuccguacuugccgugcu

SEQ ID NO: 136971 - RNA, 22 nt, Mycobacterium bovis subsp bovis AF2122/97
ggguaucgccucgacagcgcgc

SEQ ID NO: 136972 - RNA, 22 nt, Mycobacterium bovis subsp bovis AF2122/97
guggcgaccgacguugucgcgg

SEQ ID NO: 136973 - RNA, 22 nt, Mycobacterium bovis subsp bovis AF2122/97
cgaaaucgacagcagcgcgaca

SEQ ID NO: 136974 - RNA, 22 nt, Mycobacterium bovis subsp bovis AF2122/97
uggcgagcagacgcaaaagccc

SEQ ID NO: 136975 - RNA, 22 nt, Mycobacterium bovis subsp bovis AF2122/97
gccgagcguaacgccacugcga

SEQ ID NO: 136976 - RNA, 22 nt, Mycobacterium bovis subsp bovis AF2122/97
agcgagccagucagcaggccuu

SEQ ID NO: 136977 - RNA, 22 nt, Mycobacterium bovis subsp bovis AF2122/97
ucgggguuuaacgucuucuccg

SEQ ID NO: 136978 - RNA, 22 nt, Mycobacterium bovis subsp bovis AF2122/97
agccaccgucaugccgacgaca

SEQ ID NO: 136979 - RNA, 22 nt, Mycobacterium bovis subsp bovis AF2122/97
gcagacgcaaaaggccccgaau

SEQ ID NO: 136980 - RNA, 22 nt, Mycobacterium bovis subsp bovis AF2122/97
auggccgcgugugcaaguagcg

SEQ ID NO: 136981 - RNA, 22 nt, Mycobacterium bovis subsp bovis AF2122/97
uaaugcgauucugcgucugcuu

SEQ ID NO: 136982 - RNA, 22 nt, Mycobacterium bovis subsp bovis AF2122/97
cgcuggcugaucaacucauucg

SEQ ID NO: 136983 - RNA, 23 nt, Mycobacterium bovis subsp bovis AF2122/97
acgacgccggccacagccuugac

SEQ ID NO: 136984 - RNA, 22 nt, Mycobacterium bovis subsp bovis AF2122/97
cggcggugcugaucgccgugcg

SEQ ID NO: 136985 - RNA, 22 nt, Mycobacterium bovis subsp bovis AF2122/97
aacgcggugucggcggccugcc

SEQ ID NO: 136986 - RNA, 21 nt, Mycobacterium bovis subsp bovis AF2122/97
acuugccggcgccguuagccc

SEQ ID NO: 136987 - RNA, 22 nt, Mycobacterium bovis subsp bovis AF2122/97
ggugaucacgagggccuguuca

SEQ ID NO: 136988 - RNA, 22 nt, Mycobacterium bovis subsp bovis AF2122/97
accgggcgcaccgguaccggua

SEQ ID NO: 136989 - RNA, 22 nt, Mycobacterium bovis subsp bovis AF2122/97
cgcgcgguauguggaaagccac

SEQ ID NO: 136990 - RNA, 22 nt, Mycobacterium bovis subsp bovis AF2122/97
cggcgcuugauccuugcgccgg

SEQ ID NO: 136991 - RNA, 21 nt, Mycobacterium bovis subsp bovis AF2122/97
ucggugaauggcaacgugguc

SEQ ID NO: 136992 - RNA, 22 nt, Mycobacterium bovis subsp bovis AF2122/97
cguugguguucuacaucugggg

SEQ ID NO: 136993 - RNA, 22 nt, Mycobacterium bovis subsp bovis AF2122/97
cgagcgugcacugagggcgaga

SEQ ID NO: 136994 - RNA, 22 nt, Mycobacterium bovis subsp bovis AF2122/97
ucgaacauccacagcgccgcgg

SEQ ID NO: 136995 - RNA, 22 nt, Mycobacterium bovis subsp bovis AF2122/97
ugggcugcugcgccgcaucggc

SEQ ID NO: 136996 - RNA, 22 nt, Mycobacterium bovis subsp bovis AF2122/97
cgucggcgacgccaaccagacc

SEQ ID NO: 136997 - RNA, 22 nt, Mycobacterium bovis subsp bovis AF2122/97
caugcccgguagcucguugcgc

SEQ ID NO: 136998 - RNA, 20 nt, Mycobacterium bovis subsp bovis AF2122/97
agcgacuucauggccugguu

SEQ ID NO: 136999 - RNA, 22 nt, Mycobacterium bovis subsp bovis AF2122/97
ggcgagcagacgcagaaucgca

SEQ ID NO: 137000 - RNA, 22 nt, Mycobacterium bovis subsp bovis AF2122/97
aucugcagguuccuggguugac

SEQ ID NO: 137001 - RNA, 22 nt, Mycobacterium bovis subsp bovis AF2122/97
gcggcgaaggugagcuggggau

SEQ ID NO: 137002 - RNA, 22 nt, Mycobacterium bovis subsp bovis AF2122/97
gggcgccaccgcgauggcguca

SEQ ID NO: 137003 - RNA, 22 nt, Mycobacterium bovis subsp bovis AF2122/97
agcccaacaccugccacgacga

SEQ ID NO: 137004 - RNA, 22 nt, Mycobacterium bovis subsp bovis AF2122/97
gccggcggcaguaccggcccga

SEQ ID NO: 137005 - RNA, 22 nt, Mycobacterium bovis subsp bovis AF2122/97
auccaggaauugucagacguua

SEQ ID NO: 137006 - RNA, 22 nt, Mycobacterium bovis subsp bovis AF2122/97
uucaugccucgcucgcgcacgc

SEQ ID NO: 137007 - RNA, 22 nt, Mycobacterium bovis subsp bovis AF2122/97
ucggccuguuggucgccgccgg

SEQ ID NO: 137008 - RNA, 22 nt, Mycobacterium bovis subsp bovis AF2122/97
gugcggccacccugggugagcu

SEQ ID NO: 137009 - RNA, 22 nt, Mycobacterium bovis subsp bovis AF2122/97
guucggcaccggcggcgccggu

SEQ ID NO: 137010 - RNA, 22 nt, Mycobacterium bovis subsp bovis AF2122/97
acggccaugaugcaguucuacg

SEQ ID NO: 137011 - RNA, 22 nt, Mycobacterium bovis subsp bovis AF2122/97
cggccggcaauucgacuccgcu

SEQ ID NO: 137012 - RNA, 22 nt, Mycobacterium bovis subsp bovis AF2122/97
gagguugugauccagugcggcg

SEQ ID NO: 137013 - RNA, 22 nt, Mycobacterium bovis subsp bovis AF2122/97
uacuucgguuugugcugacuag

SEQ ID NO: 137014 - RNA, 22 nt, Mycobacterium bovis subsp bovis AF2122/97
cggugcgauucugcgucugcuc

SEQ ID NO: 137015 - RNA, 22 nt, Mycobacterium bovis subsp bovis AF2122/97
ucaugcgacucugcgucugcuc

SEQ ID NO: 137016 - RNA, 22 nt, Mycobacterium bovis subsp bovis AF2122/97
acaaccuguggcgacugcugga

SEQ ID NO: 137017 - RNA, 22 nt, Mycobacterium bovis subsp bovis AF2122/97
uuucgcagugccgucacgcucg

SEQ ID NO: 137018 - RNA, 22 nt, Mycobacterium bovis subsp bovis AF2122/97
uauccccugcacggcggcggau

SEQ ID NO: 137019 - RNA, 22 nt, Mycobacterium bovis subsp bovis AF2122/97
gugugcgcgcggacagcuggau

SEQ ID NO: 137020 - RNA, 22 nt, Mycobacterium bovis subsp bovis AF2122/97
aggucugucggaccuggccgcg

SEQ ID NO: 137021 - RNA, 22 nt, Mycobacterium bovis subsp bovis AF2122/97
ugucggucaaccuggcucgugu

SEQ ID NO: 137022 - RNA, 22 nt, Mycobacterium bovis subsp bovis AF2122/97
ucgguccaccccgcaggcgcug

SEQ ID NO: 137023 - RNA, 22 nt, Mycobacterium bovis subsp bovis AF2122/97
gugagguucuugaucacgacca

SEQ ID NO: 137024 - RNA, 22 nt, Mycobacterium bovis subsp bovis AF2122/97
gcgccuaugacgguccgcagga

SEQ ID NO: 137025 - RNA, 22 nt, Mycobacterium bovis subsp bovis AF2122/97
ccgcgcacgggcaugcgaucaa

SEQ ID NO: 137026 - RNA, 22 nt, Mycobacterium bovis subsp bovis AF2122/97
ucggcgaucugcccgauggcgg

SEQ ID NO: 137027 - RNA, 22 nt, Mycobacterium bovis subsp bovis AF2122/97
agcagucggcaccuggcugguc

SEQ ID NO: 137028 - RNA, 22 nt, Mycobacterium bovis subsp bovis AF2122/97
guuggcuaucgaccgcgucaaa

SEQ ID NO: 137029 - RNA, 22 nt, Mycobacterium bovis subsp bovis AF2122/97
augcucaagcuagcuuccagac

SEQ ID NO: 137030 - RNA, 22 nt, Mycobacterium bovis subsp bovis AF2122/97
acaggucgccccagacgcgcuc

SEQ ID NO: 137031 - RNA, 22 nt, Mycobacterium bovis subsp bovis AF2122/97
gcgauuuugugucugcucgccg

SEQ ID NO: 137032 - RNA, 22 nt, Mycobacterium bovis subsp bovis AF2122/97
accagcuccauggccagguugc

SEQ ID NO: 137033 - RNA, 22 nt, Mycobacterium bovis subsp bovis AF2122/97
caggcugcuggucggcccucuc

SEQ ID NO: 137034 - RNA, 22 nt, Mycobacterium bovis subsp bovis AF2122/97
gccagccagcgagcaugccggg

SEQ ID NO: 137035 - RNA, 22 nt, Mycobacterium bovis subsp bovis AF2122/97
ccggucccguaccguacuguug

SEQ ID NO: 137036 - RNA, 22 nt, Mycobacterium bovis subsp bovis AF2122/97
ugcgggaucagaucggcagucg

SEQ ID NO: 137037 - RNA, 22 nt, Mycobacterium bovis subsp bovis AF2122/97
agcaccgucgaauccgcggcuu

SEQ ID NO: 137038 - RNA, 22 nt, Mycobacterium bovis subsp bovis AF2122/97
augcugcuggccgacaugcucg

SEQ ID NO: 137039 - RNA, 22 nt, Mycobacterium bovis subsp bovis AF2122/97
uacggcauggucuuucugcugc

SEQ ID NO: 137040 - RNA, 23 nt, Mycobacterium bovis subsp bovis AF2122/97
gcuacuggcggcgagagcgucgg

SEQ ID NO: 137041 - RNA, 22 nt, Mycobacterium bovis subsp bovis AF2122/97
gucaugcggcaucggcgcgauc

SEQ ID NO: 137042 - RNA, 22 nt, Mycobacterium bovis subsp bovis AF2122/97
gcaugcccgaucggaucguucu

SEQ ID NO: 137043 - RNA, 22 nt, Mycobacterium bovis subsp bovis AF2122/97
aaggucgucaugcugaugcccg

SEQ ID NO: 137044 - RNA, 22 nt, Mycobacterium bovis subsp bovis AF2122/97
cugcugcuggccggccagcccg

SEQ ID NO: 137045 - RNA, 22 nt, Mycobacterium bovis subsp bovis AF2122/97
ccggcucacccagggugaccac

SEQ ID NO: 137046 - RNA, 22 nt, Mycobacterium bovis subsp bovis AF2122/97
ucgugcugucuugcuguuguaa

SEQ ID NO: 137047 - RNA, 22 nt, Mycobacterium bovis subsp bovis AF2122/97
cgaacguaacggcacugcgaau

SEQ ID NO: 137048 - RNA, 22 nt, Mycobacterium bovis subsp bovis AF2122/97
aaggacccggcggcguuugugu

SEQ ID NO: 137049 - RNA, 22 nt, Mycobacterium bovis subsp bovis AF2122/97
gcucgguuaucaguugauaaca

SEQ ID NO: 137050 - RNA, 22 nt, Mycobacterium bovis subsp bovis AF2122/97
cugcgccgcgagcugucggcac

SEQ ID NO: 137051 - RNA, 22 nt, Mycobacterium bovis subsp bovis AF2122/97
cgagcguaacgucacugcgaga

SEQ ID NO: 137052 - RNA, 20 nt, Mycobacterium bovis subsp bovis AF2122/97
ucgccgccaacaaggugccc

SEQ ID NO: 137053 - RNA, 22 nt, Mycobacterium bovis subsp bovis AF2122/97
auggccaaccucccgacuggua

SEQ ID NO: 137054 - RNA, 22 nt, Mycobacterium bovis subsp bovis AF2122/97
gcugccccgcgagcuggugcug

SEQ ID NO: 137055 - RNA, 22 nt, Mycobacterium bovis subsp bovis AF2122/97
gguguccuccgaucgggggaag

SEQ ID NO: 137056 - RNA, 22 nt, Mycobacterium bovis subsp bovis AF2122/97
cccggccacgaccguggcggca

SEQ ID NO: 137057 - RNA, 22 nt, Mycobacterium bovis subsp bovis AF2122/97
gucggguaucgcggcacccacg

SEQ ID NO: 137058 - RNA, 22 nt, Mycobacterium bovis subsp bovis AF2122/97
cgccgagcagacgcagaaucgc

SEQ ID NO: 137059 - RNA, 22 nt, Mycobacterium bovis subsp bovis AF2122/97
acgucgcggugcuguucgugga

SEQ ID NO: 137060 - RNA, 22 nt, Mycobacterium bovis subsp bovis AF2122/97
ccaggcucagcgggguaacauc

SEQ ID NO: 137061 - RNA, 22 nt, Mycobacterium bovis subsp bovis AF2122/97
gucgguucggucggccugcgaa

SEQ ID NO: 137062 - RNA, 22 nt, Mycobacterium bovis subsp bovis AF2122/97
ggcuuuugcgucuguucgccgc

SEQ ID NO: 137063 - RNA, 22 nt, Mycobacterium bovis subsp bovis AF2122/97
cgacuguggauccugcgacgcg

SEQ ID NO: 137064 - RNA, 22 nt, Mycobacterium bovis subsp bovis AF2122/97
auggugcgcuggcgcaucgcgu

SEQ ID NO: 137065 - RNA, 22 nt, Mycobacterium bovis subsp bovis AF2122/97
cgucugcugccgcgagccgacu

SEQ ID NO: 137066 - RNA, 22 nt, Mycobacterium bovis subsp bovis AF2122/97
gguggucgaaguaggccagcac

SEQ ID NO: 137067 - RNA, 22 nt, Mycobacterium bovis subsp bovis AF2122/97
gaccggcucggcaagccgcugc

SEQ ID NO: 137068 - RNA, 22 nt, Mycobacterium bovis subsp bovis AF2122/97
ugcccgccaccuucgucaggcc

SEQ ID NO: 137069 - RNA, 19 nt, Mycobacterium bovis subsp bovis AF2122/97
ggcugcguacucggcgguc

SEQ ID NO: 137070 - RNA, 22 nt, Mycobacterium bovis subsp bovis AF2122/97
agacgcaaaaucgcccgaaagc

SEQ ID NO: 137071 - RNA, 22 nt, Mycobacterium bovis subsp bovis AF2122/97
ucggcggucgccuaggcggcaa

SEQ ID NO: 137072 - RNA, 22 nt, Mycobacterium bovis subsp bovis AF2122/97
agcagacgcagaaucgcccaau

SEQ ID NO: 137073 - RNA, 22 nt, Mycobacterium bovis subsp bovis AF2122/97
gguucggcaagaacgagacuca

SEQ ID NO: 137074 - RNA, 22 nt, Mycobacterium bovis subsp bovis AF2122/97
uugcucgcgaucgcagugagca

SEQ ID NO: 137075 - RNA, 22 nt, Mycobacterium bovis subsp bovis AF2122/97
cgagcagacgcuaaagcccccg

SEQ ID NO: 137076 - RNA, 22 nt, Mycobacterium bovis subsp bovis AF2122/97
gugggcagaugggugauacgca

SEQ ID NO: 137077 - RNA, 22 nt, Mycobacterium bovis subsp bovis AF2122/97
ccgcaccagcacgccucguugc

SEQ ID NO: 137078 - RNA, 22 nt, Mycobacterium bovis subsp bovis AF2122/97
caccgggauggaaaccacccgc

SEQ ID NO: 137079 - RNA, 22 nt, Mycobacterium bovis subsp bovis AF2122/97
acgugcugcgcggggcacccgg

SEQ ID NO: 137080 - RNA, 22 nt, Mycobacterium bovis subsp bovis AF2122/97
ggugcggucgccgcggugcugg

SEQ ID NO: 137081 - RNA, 19 nt, Mycobacterium bovis subsp bovis AF2122/97
gacguauucgauucccugc

SEQ ID NO: 137082 - RNA, 22 nt, Mycobacterium bovis subsp bovis AF2122/97
uuuccagcggcacgcauucggc

SEQ ID NO: 137083 - RNA, 22 nt, Mycobacterium bovis subsp bovis AF2122/97
acgugggcgccucggcggguuc

SEQ ID NO: 137084 - RNA, 22 nt, Mycobacterium bovis subsp bovis AF2122/97
ucgaccgugacggcaggggcgu

SEQ ID NO: 137085 - RNA, 22 nt, Mycobacterium bovis subsp bovis AF2122/97
accggcacaccguuuucagagg

SEQ ID NO: 137086 - RNA, 20 nt, Mycobacterium bovis subsp bovis AF2122/97
uugguagccgaugcgugcag

SEQ ID NO: 137087 - RNA, 22 nt, Mycobacterium bovis subsp bovis AF2122/97
gcgugggugccgcgauacccga

SEQ ID NO: 137088 - RNA, 22 nt, Mycobacterium bovis subsp bovis AF2122/97
gccggccauagcggccauggaa

SEQ ID NO: 137089 - RNA, 22 nt, Mycobacterium bovis subsp bovis AF2122/97
ucggcggcggcccgauugucgc

SEQ ID NO: 137090 - RNA, 22 nt, Mycobacterium bovis subsp bovis AF2122/97
uugcugauugccggauugugcg

SEQ ID NO: 137091 - RNA, 22 nt, Mycobacterium bovis subsp bovis AF2122/97
ggucugguuggcgucgccgacg

SEQ ID NO: 137092 - RNA, 20 nt, Mycobacterium bovis subsp bovis AF2122/97
gccaugggcucucaccuccu

SEQ ID NO: 137093 - RNA, 22 nt, Mycobacterium bovis subsp bovis AF2122/97
ccgguuguccagauacgacgug

SEQ ID NO: 137094 - RNA, 22 nt, Mycobacterium bovis subsp bovis AF2122/97
ucggcuccuccucacgccgcug

SEQ ID NO: 137095 - RNA, 22 nt, Mycobacterium bovis subsp bovis AF2122/97
ugcgauaucggcaccggcuugc

SEQ ID NO: 137096 - RNA, 22 nt, Mycobacterium bovis subsp bovis AF2122/97
aagcagacgcagaaucgcauua

SEQ ID NO: 137097 - RNA, 22 nt, Mycobacterium bovis subsp bovis AF2122/97
ggcggccgcaauuagcgagggc

SEQ ID NO: 137098 - RNA, 22 nt, Mycobacterium bovis subsp bovis AF2122/97
gaggacgcaaaaucgcccgaaa

SEQ ID NO: 137099 - RNA, 22 nt, Mycobacterium bovis subsp bovis AF2122/97
ggcggcccgcaucgucgccggg

SEQ ID NO: 137100 - RNA, 22 nt, Mycobacterium bovis subsp bovis AF2122/97
gccggcgccggcacucccgacg

SEQ ID NO: 137101 - RNA, 22 nt, Mycobacterium bovis subsp bovis AF2122/97
ggaucgggugcuugcggugauc

SEQ ID NO: 137102 - RNA, 22 nt, Mycobacterium bovis subsp bovis AF2122/97
gcgcggacuaccgggucugcac

SEQ ID NO: 137103 - RNA, 22 nt, Mycobacterium bovis subsp bovis AF2122/97
gggcacccugucgaucgucuuc

SEQ ID NO: 137104 - RNA, 22 nt, Mycobacterium bovis subsp bovis AF2122/97
ggagacguuguauggcgagauc

SEQ ID NO: 137105 - RNA, 22 nt, Mycobacterium bovis subsp bovis AF2122/97
cagacgcaaaagcccacuaaau

SEQ ID NO: 137106 - RNA, 22 nt, Mycobacterium bovis subsp bovis AF2122/97
cgggucguugggaacuucccgg

SEQ ID NO: 137107 - RNA, 21 nt, Mycobacterium bovis subsp bovis AF2122/97
cgcgccauggcaacccggccc

SEQ ID NO: 137108 - RNA, 22 nt, Mycobacterium bovis subsp bovis AF2122/97
gacgucgucgcagccggccauc

SEQ ID NO: 137109 - RNA, 22 nt, Mycobacterium bovis subsp bovis AF2122/97
cgucggcgagaucgucggugug

SEQ ID NO: 137110 - RNA, 22 nt, Mycobacterium bovis subsp bovis AF2122/97
auucggggccuuuugcgucugc

SEQ ID NO: 137111 - RNA, 22 nt, Mycobacterium bovis subsp bovis AF2122/97
ucaacgacgucgucuuggcgcu

SEQ ID NO: 137112 - RNA, 22 nt, Mycobacterium bovis subsp bovis AF2122/97
gugcggccuaguuuggccaguu

SEQ ID NO: 137113 - RNA, 22 nt, Mycobacterium bovis subsp bovis AF2122/97
cgaacuaucgugacggcgccuu

SEQ ID NO: 137114 - RNA, 22 nt, Mycobacterium bovis subsp bovis AF2122/97
cguucgugacuaggaucaucga

SEQ ID NO: 137115 - RNA, 22 nt, Mycobacterium bovis subsp bovis AF2122/97
gacgagugccguugcggcgcac

SEQ ID NO: 137116 - RNA, 22 nt, Mycobacterium bovis subsp bovis AF2122/97
cguccaggagaacaaguggcgu

SEQ ID NO: 137117 - RNA, 22 nt, Mycobacterium bovis subsp bovis AF2122/97
aaaggccuuacccuggcugggu

SEQ ID NO: 137118 - RNA, 22 nt, Mycobacterium bovis subsp bovis AF2122/97
caccgcgaaucuguccaaccag

SEQ ID NO: 137119 - RNA, 22 nt, Mycobacterium bovis subsp bovis AF2122/97
gcgaaacacgggaucgggcgag

SEQ ID NO: 137120 - RNA, 22 nt, Mycobacterium bovis subsp bovis AF2122/97
gagcagacgcagaagcccccaa

SEQ ID NO: 137121 - RNA, 22 nt, Mycobacterium bovis subsp bovis AF2122/97
gcguggucggaugcaggccagc

SEQ ID NO: 137122 - RNA, 22 nt, Mycobacterium bovis subsp bovis AF2122/97
gagccgggaagucgguagcccg

SEQ ID NO: 137123 - RNA, 22 nt, Mycobacterium bovis subsp bovis AF2122/97
ccgaacgugaacucacggcgga

SEQ ID NO: 137124 - RNA, 22 nt, Mycobacterium bovis subsp bovis AF2122/97
gcggugugggucccauccguca

SEQ ID NO: 137125 - RNA, 22 nt, Mycobacterium bovis subsp bovis AF2122/97
gcgauucugcgucugcucgccg

SEQ ID NO: 137126 - RNA, 22 nt, Mycobacterium bovis subsp bovis AF2122/97
uuaggggcuuuugcgucugcuc

SEQ ID NO: 137127 - RNA, 22 nt, Mycobacterium bovis subsp bovis AF2122/97
auguugaccgagaugccgccga

SEQ ID NO: 137128 - RNA, 22 nt, Mycobacterium bovis subsp bovis AF2122/97
uucgugaucgcgagcgcaaugc

SEQ ID NO: 137129 - RNA, 22 nt, Mycobacterium bovis subsp bovis AF2122/97
cgacgaggcgcaacggauuccg

SEQ ID NO: 137130 - RNA, 22 nt, Mycobacterium bovis subsp bovis AF2122/97
gccgaguugcgucgcugggauc

SEQ ID NO: 137131 - RNA, 22 nt, Mycobacterium bovis subsp bovis AF2122/97
uggagauuggagacgucggccg

SEQ ID NO: 137132 - RNA, 23 nt, Mycobacterium bovis subsp bovis AF2122/97
ucauaccgaccaccuguccuagg

SEQ ID NO: 137133 - RNA, 22 nt, Mycobacterium bovis subsp bovis AF2122/97
gcccuggcgaguguggccggag

SEQ ID NO: 137134 - RNA, 22 nt, Mycobacterium bovis subsp bovis AF2122/97
ucgcgcuggcagacccgccgcc

SEQ ID NO: 137135 - RNA, 20 nt, Mycobacterium bovis subsp bovis AF2122/97
uagacgcaggaucaacggcu

SEQ ID NO: 137136 - RNA, 22 nt, Mycobacterium bovis subsp bovis AF2122/97
auugggggaucuugugcgcccg

SEQ ID NO: 137137 - RNA, 22 nt, Mycobacterium bovis subsp bovis AF2122/97
acgucgggcacgucgguuccga

SEQ ID NO: 137138 - RNA, 19 nt, Mycobacterium bovis subsp bovis AF2122/97
uuugauguuccgccggaug

SEQ ID NO: 137139 - RNA, 22 nt, Mycobacterium bovis subsp bovis AF2122/97
ugcggcagcgaaaggagcucca

SEQ ID NO: 137140 - RNA, 22 nt, Mycobacterium bovis subsp bovis AF2122/97
gagcugcuugggugggcgguca

SEQ ID NO: 137141 - RNA, 22 nt, Mycobacterium bovis subsp bovis AF2122/97
gacgucaagacgccggcgggca

SEQ ID NO: 137142 - RNA, 22 nt, Mycobacterium bovis subsp bovis AF2122/97
ccgacgaguaccacgcgcagga

SEQ ID NO: 137143 - RNA, 22 nt, Mycobacterium bovis subsp bovis AF2122/97
gaucgugacgccacgggugcgg

SEQ ID NO: 137144 - RNA, 22 nt, Mycobacterium bovis subsp bovis AF2122/97
cagacgcauaagcgcccaauuu

SEQ ID NO: 137145 - RNA, 22 nt, Mycobacterium bovis subsp bovis AF2122/97
ccagcagcgcguacagcaucga

SEQ ID NO: 137146 - RNA, 22 nt, Mycobacterium bovis subsp bovis AF2122/97
ccggugggcgauggucucguag

SEQ ID NO: 137147 - RNA, 22 nt, Mycobacterium bovis subsp bovis AF2122/97
gcgacggcaccgaucaucacgg

SEQ ID NO: 137148 - RNA, 22 nt, Mycobacterium bovis subsp bovis AF2122/97
aucggugcgcaagcgauacucg

SEQ ID NO: 137149 - RNA, 22 nt, Mycobacterium bovis subsp bovis AF2122/97
ggagccguguucgcgauucugc

SEQ ID NO: 137150 - RNA, 22 nt, Mycobacterium bovis subsp bovis AF2122/97
ucagcuaccaaggcaacgacau

SEQ ID NO: 137151 - RNA, 22 nt, Mycobacterium bovis subsp bovis AF2122/97
ggugcguccgcgcucggcuugu

SEQ ID NO: 137152 - RNA, 22 nt, Mycobacterium bovis subsp bovis AF2122/97
gcaucguccagcugcuuugugc

SEQ ID NO: 137153 - RNA, 22 nt, Mycobacterium bovis subsp bovis AF2122/97
gccagggucgcuucgggcagag

SEQ ID NO: 137154 - RNA, 22 nt, Mycobacterium bovis subsp bovis AF2122/97
gcgugaacugagggcggaaaau

SEQ ID NO: 137155 - RNA, 22 nt, Mycobacterium bovis subsp bovis AF2122/97
gcggugacgauaauuucuuucu

SEQ ID NO: 137156 - RNA, 22 nt, Mycobacterium bovis subsp bovis AF2122/97
gcgauagccgaaccacccgccg

SEQ ID NO: 137157 - RNA, 22 nt, Mycobacterium bovis subsp bovis AF2122/97
cgagcguaaccuggcugcgauu

SEQ ID NO: 137158 - RNA, 22 nt, Mycobacterium bovis subsp bovis AF2122/97
gucggugaccgugcccggaggg

SEQ ID NO: 137159 - RNA, 22 nt, Mycobacterium bovis subsp bovis AF2122/97
cgacggccaccaccagcgacuc

SEQ ID NO: 137160 - RNA, 20 nt, Mycobacterium bovis subsp bovis AF2122/97
gcgcugucccggccugcugg

SEQ ID NO: 137161 - RNA, 22 nt, Mycobacterium bovis subsp bovis AF2122/97
ucgccgagccuguaauuuugca

SEQ ID NO: 137162 - RNA, 22 nt, Mycobacterium bovis subsp bovis AF2122/97
ggcccagcgacucgccgagcuc

SEQ ID NO: 137163 - RNA, 22 nt, Mycobacterium bovis subsp bovis AF2122/97
gaugccgcgguuuguccgggag

SEQ ID NO: 137164 - RNA, 22 nt, Mycobacterium bovis subsp bovis AF2122/97
uccggcgucugguggcgguggc

SEQ ID NO: 137165 - RNA, 20 nt, Mycobacterium bovis subsp bovis AF2122/97
ccggccgucggcccgguacc

SEQ ID NO: 137166 - RNA, 22 nt, Mycobacterium bovis subsp bovis AF2122/97
ccguggucacagacgaucacga

SEQ ID NO: 137167 - RNA, 22 nt, Mycobacterium bovis subsp bovis AF2122/97
ucgauggugaugacgcuggcgc

SEQ ID NO: 137168 - RNA, 22 nt, Mycobacterium bovis subsp bovis AF2122/97
cgugcucgauccgacgcggcuc

SEQ ID NO: 137169 - RNA, 22 nt, Mycobacterium bovis subsp bovis AF2122/97
cgcgagcguaacguggcugcga

SEQ ID NO: 137170 - RNA, 22 nt, Mycobacterium bovis subsp bovis AF2122/97
caaaggccuuuccugcugggcu

SEQ ID NO: 137171 - RNA, 22 nt, Mycobacterium bovis subsp bovis AF2122/97
cagucgugccucggccgcagcu

SEQ ID NO: 137172 - RNA, 22 nt, Mycobacterium bovis subsp bovis AF2122/97
ggcacgaucuuccucggcgguc

SEQ ID NO: 137173 - RNA, 22 nt, Mycobacterium bovis subsp bovis AF2122/97
cgaucacgucgguggccgggcg

SEQ ID NO: 137174 - RNA, 22 nt, Mycobacterium bovis subsp bovis AF2122/97
cguaccgccugcacgccgggcc

SEQ ID NO: 137175 - RNA, 22 nt, Mycobacterium bovis subsp bovis AF2122/97
ucgucaccgcgggcaccggggu

SEQ ID NO: 137176 - RNA, 22 nt, Mycobacterium bovis subsp bovis AF2122/97
gccggucguggguacgggccuc

SEQ ID NO: 137177 - RNA, 22 nt, Mycobacterium bovis subsp bovis AF2122/97
acgguguucgguguggccgucg

SEQ ID NO: 137178 - RNA, 22 nt, Mycobacterium bovis subsp bovis AF2122/97
ugcgagucugugucugcucgcc

SEQ ID NO: 137179 - RNA, 22 nt, Mycobacterium bovis subsp bovis AF2122/97
ugcgacucugugucugcucgcg

SEQ ID NO: 137180 - RNA, 22 nt, Mycobacterium bovis subsp bovis AF2122/97
ugcgauuccgcgucugcucggc

SEQ ID NO: 137181 - RNA, 22 nt, Mycobacterium bovis subsp bovis AF2122/97
cugaugaaaugcaugccgccgg

SEQ ID NO: 137182 - RNA, 22 nt, Mycobacterium bovis subsp bovis AF2122/97
cccaggaacgggacgccgugug

SEQ ID NO: 137183 - RNA, 22 nt, Mycobacterium bovis subsp bovis AF2122/97
cccggguuugaccacgaugcug

SEQ ID NO: 137184 - RNA, 22 nt, Mycobacterium bovis subsp bovis AF2122/97
cgcgaucgcgucuggagugccg

SEQ ID NO: 137185 - RNA, 22 nt, Mycobacterium bovis subsp bovis AF2122/97
cggcagcggugguggugcggcu

SEQ ID NO: 137186 - RNA, 22 nt, Mycobacterium bovis subsp bovis AF2122/97
ccggcgaccacuggucggcugg

SEQ ID NO: 137187 - RNA, 22 nt, Mycobacterium bovis subsp bovis AF2122/97
agcagucgcaaaagcccccgca

SEQ ID NO: 137188 - RNA, 22 nt, Mycobacterium bovis subsp bovis AF2122/97
gcgccgaguccagguccuccag

SEQ ID NO: 137189 - RNA, 23 nt, Mycobacterium bovis subsp bovis AF2122/97
agggaugugguagccccggcgag

SEQ ID NO: 137190 - RNA, 22 nt, Mycobacterium bovis subsp bovis AF2122/97
gacugguacgccgaccugccgg

SEQ ID NO: 137191 - RNA, 22 nt, Mycobacterium bovis subsp bovis AF2122/97
acugcccagcgauuucgaccgu

SEQ ID NO: 137192 - RNA, 22 nt, Mycobacterium bovis subsp bovis AF2122/97
gccgccagcucucggcgcuggc

SEQ ID NO: 137193 - RNA, 22 nt, Mycobacterium bovis subsp bovis AF2122/97
gugguagagcaccugggcgagc

SEQ ID NO: 137194 - RNA, 22 nt, Mycobacterium bovis subsp bovis AF2122/97
aucgagauugagccggccccga

SEQ ID NO: 137195 - RNA, 22 nt, Mycobacterium bovis subsp bovis AF2122/97
ucaucgggcacaucgucgcggu

SEQ ID NO: 137196 - RNA, 22 nt, Mycobacterium bovis subsp bovis AF2122/97
ggcuccguagcagcguuggcua

SEQ ID NO: 137197 - RNA, 22 nt, Mycobacterium bovis subsp bovis AF2122/97
ggcgcgcuggccggucacccug

SEQ ID NO: 137198 - RNA, 22 nt, Mycobacterium bovis subsp bovis AF2122/97
cgaugcaggacggcgagggcuc

SEQ ID NO: 137199 - RNA, 22 nt, Mycobacterium bovis subsp bovis AF2122/97
accggccgucagcgcgcccguc

SEQ ID NO: 137200 - RNA, 22 nt, Mycobacterium bovis subsp bovis AF2122/97
cgagcagacgcagaaucgccca

SEQ ID NO: 137201 - RNA, 22 nt, Mycobacterium bovis subsp bovis AF2122/97
uugaugucggcgacuacaucuu

SEQ ID NO: 137202 - RNA, 20 nt, Mycobacterium bovis subsp bovis AF2122/97
ccgaagcacugaucgcagcg

SEQ ID NO: 137203 - RNA, 22 nt, Mycobacterium bovis subsp bovis AF2122/97
cgguccuacgcgugcucgucga

SEQ ID NO: 137204 - RNA, 22 nt, Mycobacterium bovis subsp bovis AF2122/97
gagacgcaaaaucgcccgaaaa

SEQ ID NO: 137205 - RNA, 22 nt, Mycobacterium bovis subsp bovis AF2122/97
acgggaccccgcgcaucgaagg

SEQ ID NO: 137206 - RNA, 22 nt, Mycobacterium bovis subsp bovis AF2122/97
cucugcgaccucggcgcgaaug

SEQ ID NO: 137207 - RNA, 22 nt, Mycobacterium bovis subsp bovis AF2122/97
gguggcuuccgaaaucgcgcgc

SEQ ID NO: 137208 - RNA, 22 nt, Mycobacterium bovis subsp bovis AF2122/97
ugacucugcguccagcaggcgg

SEQ ID NO: 137209 - RNA, 20 nt, Mycobacterium bovis subsp bovis AF2122/97
ucgcaguggcguuacgcucg

SEQ ID NO: 137210 - RNA, 20 nt, Mycobacterium bovis subsp bovis AF2122/97
agcauucgaugaugucggug

SEQ ID NO: 137211 - RNA, 22 nt, Mycobacterium bovis subsp bovis AF2122/97
cgagcagacacagaaucgcacg

SEQ ID NO: 137212 - RNA, 22 nt, Mycobacterium bovis subsp bovis AF2122/97
ccaagcucuggauggccugccg

SEQ ID NO: 137213 - RNA, 22 nt, Mycobacterium bovis subsp bovis AF2122/97
gguggcggugucgaagacgucg

SEQ ID NO: 137214 - RNA, 22 nt, Mycobacterium bovis subsp bovis AF2122/97
accucaacauucccgacgagaa

SEQ ID NO: 137215 - RNA, 22 nt, Mycobacterium bovis subsp bovis AF2122/97
augucgagucgaacucggcgcu

SEQ ID NO: 137216 - RNA, 22 nt, Mycobacterium bovis subsp bovis AF2122/97
cguggagaccgagaucagcggg

SEQ ID NO: 137217 - RNA, 22 nt, Mycobacterium bovis subsp bovis AF2122/97
aguugcacgaauuacuggaugu

SEQ ID NO: 137218 - RNA, 22 nt, Mycobacterium bovis subsp bovis AF2122/97
cguggagauguggguucgggcc

SEQ ID NO: 137219 - RNA, 22 nt, Mycobacterium bovis subsp bovis AF2122/97
cucagcugcagugcggugggcg

SEQ ID NO: 137220 - RNA, 22 nt, Mycobacterium bovis subsp bovis AF2122/97
ugucgcggcugaagagcucagu

SEQ ID NO: 137221 - RNA, 22 nt, Mycobacterium bovis subsp bovis AF2122/97
ccggugauaugggucgucucgu

SEQ ID NO: 137222 - RNA, 22 nt, Mycobacterium bovis subsp bovis AF2122/97
aagcggagcgcucgccccgcuu

SEQ ID NO: 137223 - RNA, 22 nt, Mycobacterium bovis subsp bovis AF2122/97
aucgguguucgccgcgaccguu

SEQ ID NO: 137224 - RNA, 22 nt, Mycobacterium bovis subsp bovis AF2122/97
gcaagcugcgggcgcuuggugu

SEQ ID NO: 137225 - RNA, 22 nt, Mycobacterium bovis subsp bovis AF2122/97
uccgccgcggucaucgcggcca

SEQ ID NO: 137226 - RNA, 21 nt, Mycobacterium bovis subsp bovis AF2122/97
caucuugaucaccccggcgac

SEQ ID NO: 137227 - RNA, 22 nt, Mycobacterium bovis subsp bovis AF2122/97
aucgaguugaugcgccaucgcg

SEQ ID NO: 137228 - RNA, 22 nt, Mycobacterium bovis subsp bovis AF2122/97
gcgccgguuggcugccgugguu

SEQ ID NO: 137229 - RNA, 19 nt, Mycobacterium bovis subsp bovis AF2122/97
agcaggaggcggguuuggg

SEQ ID NO: 137230 - RNA, 22 nt, Mycobacterium bovis subsp bovis AF2122/97
ugaucucacccgaaguuguguc

SEQ ID NO: 137231 - RNA, 22 nt, Mycobacterium bovis subsp bovis AF2122/97
cgucggcaauacuccgcugacg

SEQ ID NO: 137232 - RNA, 22 nt, Mycobacterium bovis subsp bovis AF2122/97
cggcgagacggaugccgugacg

SEQ ID NO: 137233 - RNA, 22 nt, Mycobacterium bovis subsp bovis AF2122/97
ugggugccguugcgucugcucg

SEQ ID NO: 137234 - RNA, 22 nt, Mycobacterium bovis subsp bovis AF2122/97
gagcagacgcagaaucgcaucg

SEQ ID NO: 137235 - RNA, 22 nt, Mycobacterium bovis subsp bovis AF2122/97
caagggcauggccguuuugcuc

SEQ ID NO: 137236 - RNA, 22 nt, Mycobacterium bovis subsp bovis AF2122/97
guuuuccucggugcgggcgcgc

SEQ ID NO: 137237 - RNA, 22 nt, Mycobacterium bovis subsp bovis AF2122/97
ucgauaucgagggcuacgugcg

SEQ ID NO: 137238 - RNA, 22 nt, Mycobacterium bovis subsp bovis AF2122/97
gcggcagcagugagcacccgca

SEQ ID NO: 137239 - RNA, 22 nt, Mycobacterium bovis subsp bovis AF2122/97
gucgcgacgaaccguccauccg

SEQ ID NO: 137240 - RNA, 22 nt, Mycobacterium bovis subsp bovis AF2122/97
ccaccgccacggccagcaccgc

SEQ ID NO: 137241 - RNA, 22 nt, Mycobacterium bovis subsp bovis AF2122/97
aucgcguccugcgcggaaucgg

SEQ ID NO: 137242 - RNA, 22 nt, Mycobacterium bovis subsp bovis AF2122/97
gcgacagugaugcccagucugc

SEQ ID NO: 137243 - RNA, 22 nt, Mycobacterium bovis subsp bovis AF2122/97
uaugcgcgaaaccucggcaccc

SEQ ID NO: 137244 - RNA, 22 nt, Mycobacterium bovis subsp bovis AF2122/97
acuacgucggugauuugguugc

SEQ ID NO: 137245 - RNA, 22 nt, Mycobacterium bovis subsp bovis AF2122/97
gaucgacaucagcacgccuugc

SEQ ID NO: 137246 - RNA, 22 nt, Mycobacterium bovis subsp bovis AF2122/97
cgucgccaagauugucgaugcu

SEQ ID NO: 137247 - RNA, 22 nt, Mycobacterium bovis subsp bovis AF2122/97
uagcgcccggccacuggccaau

SEQ ID NO: 137248 - RNA, 22 nt, Mycobacterium bovis subsp bovis AF2122/97
ggcggcucgggcauccugauga

SEQ ID NO: 137249 - RNA, 22 nt, Mycobacterium bovis subsp bovis AF2122/97
aaggugcggucaaugcgcucga

SEQ ID NO: 137250 - RNA, 22 nt, Mycobacterium bovis subsp bovis AF2122/97
uuggcggugugcgccgcccucg

SEQ ID NO: 137251 - RNA, 22 nt, Mycobacterium bovis subsp bovis AF2122/97
uaccggugcgcccgguaucggu

SEQ ID NO: 137252 - RNA, 19 nt, Mycobacterium bovis subsp bovis AF2122/97
gcccgaacccacggccggc

SEQ ID NO: 137253 - RNA, 22 nt, Mycobacterium bovis subsp bovis AF2122/97
cgaccaggcaauccagcaggug

SEQ ID NO: 137254 - RNA, 22 nt, Mycobacterium bovis subsp bovis AF2122/97
ugcgcggcgccugcuggcaguc

SEQ ID NO: 137255 - RNA, 22 nt, Mycobacterium bovis subsp bovis AF2122/97
ucgccaguggcgaguccccguu

SEQ ID NO: 137256 - RNA, 22 nt, Mycobacterium bovis subsp bovis AF2122/97
ccaucagggcgaagguguggcu

SEQ ID NO: 137257 - RNA, 22 nt, Mycobacterium bovis subsp bovis AF2122/97
cccugcuggagaucugcgcggu

SEQ ID NO: 137258 - RNA, 22 nt, Mycobacterium bovis subsp bovis AF2122/97
gugguuacggcaucguguucgg

SEQ ID NO: 137259 - RNA, 22 nt, Mycobacterium bovis subsp bovis AF2122/97
agcaugcgaccauugcaccgug

SEQ ID NO: 137260 - RNA, 22 nt, Mycobacterium bovis subsp bovis AF2122/97
cgcuugcgguugguggauucgg

SEQ ID NO: 137261 - RNA, 22 nt, Mycobacterium bovis subsp bovis AF2122/97
aucgcggcgguguugucgaugc

SEQ ID NO: 137262 - RNA, 22 nt, Mycobacterium bovis subsp bovis AF2122/97
uugccgcacaccauccgacggc

SEQ ID NO: 137263 - RNA, 22 nt, Mycobacterium bovis subsp bovis AF2122/97
gaggaauucgcacccgcugccg

SEQ ID NO: 137264 - RNA, 22 nt, Mycobacterium bovis subsp bovis AF2122/97
ggcuugucggaacucggcccca

SEQ ID NO: 137265 - RNA, 22 nt, Mycobacterium bovis subsp bovis AF2122/97
ucggccucccaugcggcgaucu

SEQ ID NO: 137266 - RNA, 21 nt, Mycobacterium bovis subsp bovis AF2122/97
aucagcgccgucuuuucccac

SEQ ID NO: 137267 - RNA, 22 nt, Mycobacterium bovis subsp bovis AF2122/97
gugcuugccgcgcuggggcgca

SEQ ID NO: 137268 - RNA, 20 nt, Mycobacterium bovis subsp bovis AF2122/97
cggugucgccgugcuugccg

SEQ ID NO: 137269 - RNA, 22 nt, Mycobacterium bovis subsp bovis AF2122/97
gacgaggccgucgccgcguugc

SEQ ID NO: 137270 - RNA, 22 nt, Mycobacterium bovis subsp bovis AF2122/97
ggcuugucgguacucggaccga

SEQ ID NO: 137271 - RNA, 22 nt, Mycobacterium bovis subsp bovis AF2122/97
ucuccgcccucaguucacgcug

SEQ ID NO: 137272 - RNA, 22 nt, Mycobacterium bovis subsp bovis AF2122/97
cguuucguugcggcgugcgauc

SEQ ID NO: 137273 - RNA, 22 nt, Mycobacterium bovis subsp bovis AF2122/97
guuaucggcggugaccguggga

SEQ ID NO: 137274 - RNA, 23 nt, Mycobacterium bovis subsp bovis AF2122/97
uggguguucuccgacacgcugga

SEQ ID NO: 137275 - RNA, 22 nt, Mycobacterium bovis subsp bovis AF2122/97
gaaggccgagcggaucugacau

SEQ ID NO: 137276 - RNA, 22 nt, Mycobacterium bovis subsp bovis AF2122/97
ucgacgagcacgcguaggaccg

SEQ ID NO: 137277 - RNA, 22 nt, Mycobacterium bovis subsp bovis AF2122/97
augcgcacgaauugcugguggc

SEQ ID NO: 137278 - RNA, 22 nt, Mycobacterium bovis subsp bovis AF2122/97
ugcgccgaaugugcacuggugg

SEQ ID NO: 137279 - RNA, 22 nt, Mycobacterium bovis subsp bovis AF2122/97
aucgccggugaccgcugacccc

SEQ ID NO: 137280 - RNA, 22 nt, Mycobacterium bovis subsp bovis AF2122/97
gcggcggaccuuggugcgcagg

SEQ ID NO: 137281 - RNA, 22 nt, Mycobacterium bovis subsp bovis AF2122/97
cgguugcggugccagccaaccg

SEQ ID NO: 137282 - RNA, 22 nt, Mycobacterium bovis subsp bovis AF2122/97
uucagggugcaugugaccgaug

SEQ ID NO: 137283 - RNA, 22 nt, Mycobacterium bovis subsp bovis AF2122/97
uuggccgaccagcgcuucgaua

SEQ ID NO: 137284 - RNA, 22 nt, Mycobacterium bovis subsp bovis AF2122/97
ggacgaucgccagaguggucga

SEQ ID NO: 137285 - RNA, 22 nt, Mycobacterium bovis subsp bovis AF2122/97
cacggugcaauggucgcaugcu

SEQ ID NO: 137286 - RNA, 22 nt, Mycobacterium bovis subsp bovis AF2122/97
cgccgauucgggauugucaccg

SEQ ID NO: 137287 - RNA, 22 nt, Mycobacterium bovis subsp bovis AF2122/97
agcuguuggugccaccgccgca

SEQ ID NO: 137288 - RNA, 22 nt, Mycobacterium bovis subsp bovis AF2122/97
ucgcugauagucgcuccauccg

SEQ ID NO: 137289 - RNA, 22 nt, Mycobacterium bovis subsp bovis AF2122/97
ggugucgagcacgcugggccga

SEQ ID NO: 137290 - RNA, 22 nt, Mycobacterium bovis subsp bovis AF2122/97
aacucgacgugcaucccgguga

SEQ ID NO: 137291 - RNA, 22 nt, Mycobacterium bovis subsp bovis AF2122/97
gagcagacgcaaaagcacccuu

SEQ ID NO: 137292 - RNA, 22 nt, Mycobacterium bovis subsp bovis AF2122/97
cacgagcguaaccccagugcga

SEQ ID NO: 137293 - RNA, 22 nt, Mycobacterium bovis subsp bovis AF2122/97
gucgagcuuggcccggccggcc

SEQ ID NO: 137294 - RNA, 22 nt, Mycobacterium bovis subsp bovis AF2122/97
ggucuugcucgacguucgcgca

SEQ ID NO: 137295 - RNA, 22 nt, Mycobacterium bovis subsp bovis AF2122/97
ucgccgggccaucguggagcgg

SEQ ID NO: 137296 - RNA, 22 nt, Mycobacterium bovis subsp bovis AF2122/97
uaugcguuccugugcgccacgg

SEQ ID NO: 137297 - RNA, 20 nt, Mycobacterium bovis subsp bovis AF2122/97
ccaccggugcuggagggauc

SEQ ID NO: 137298 - RNA, 22 nt, Mycobacterium bovis subsp bovis AF2122/97
ccgacgugagggucaugucgau

SEQ ID NO: 137299 - RNA, 22 nt, Mycobacterium bovis subsp bovis AF2122/97
gaggcgcuguucgaggcggucg

SEQ ID NO: 137300 - RNA, 22 nt, Mycobacterium bovis subsp bovis AF2122/97
ugauuccgcucggcucgugcac

SEQ ID NO: 137301 - RNA, 22 nt, Mycobacterium bovis subsp bovis AF2122/97
ggugaccgucgccgcgucguug

SEQ ID NO: 137302 - RNA, 22 nt, Mycobacterium bovis subsp bovis AF2122/97
uggugcugccgguguugccgau

SEQ ID NO: 137303 - RNA, 22 nt, Mycobacterium bovis subsp bovis AF2122/97
uuugccgaccugcugaccuggu

SEQ ID NO: 137304 - RNA, 22 nt, Mycobacterium bovis subsp bovis AF2122/97
gcccgccuacacaugcuggcgg

SEQ ID NO: 137305 - RNA, 22 nt, Mycobacterium bovis subsp bovis AF2122/97
gagcgguucgugcugggggugg

SEQ ID NO: 137306 - RNA, 22 nt, Mycobacterium bovis subsp bovis AF2122/97
ucgccgacggaguggccggcca

SEQ ID NO: 137307 - RNA, 22 nt, Mycobacterium bovis subsp bovis AF2122/97
ugcucgucggugacgccgugcu

SEQ ID NO: 137308 - RNA, 22 nt, Mycobacterium bovis subsp bovis AF2122/97
ugcgccagcgccucccgcagga

SEQ ID NO: 137309 - RNA, 22 nt, Mycobacterium bovis subsp bovis AF2122/97
aucgcagccacggaguucgauu

SEQ ID NO: 137310 - RNA, 22 nt, Mycobacterium bovis subsp bovis AF2122/97
cgaugacccgcaggcccagccc

SEQ ID NO: 137311 - RNA, 22 nt, Mycobacterium bovis subsp bovis AF2122/97
ggcagccagccuuaccgcaggc

SEQ ID NO: 137312 - RNA, 22 nt, Mycobacterium bovis subsp bovis AF2122/97
ccgaacgugcaaccacggcggc

SEQ ID NO: 137313 - RNA, 22 nt, Mycobacterium bovis subsp bovis AF2122/97
cgucgagcaggucggcgacggc

SEQ ID NO: 137314 - RNA, 22 nt, Mycobacterium bovis subsp bovis AF2122/97
gcagcaccgcugcugacgcacu

SEQ ID NO: 137315 - RNA, 22 nt, Mycobacterium bovis subsp bovis AF2122/97
gcggacgucgaugucgagcugu

SEQ ID NO: 137316 - RNA, 22 nt, Mycobacterium bovis subsp bovis AF2122/97
cgauuguguaucgcaccgacuu

SEQ ID NO: 137317 - RNA, 22 nt, Mycobacterium bovis subsp bovis AF2122/97
guuggcgaggccgcgcaauaca

SEQ ID NO: 137318 - RNA, 22 nt, Mycobacterium bovis subsp bovis AF2122/97
caggaggugcugcgggaggcga

SEQ ID NO: 137319 - RNA, 20 nt, Mycobacterium bovis subsp bovis AF2122/97
ccgcaucgacaacaccgccg

SEQ ID NO: 137320 - RNA, 22 nt, Mycobacterium bovis subsp bovis AF2122/97
uucucgcgcucgagugagcaga

SEQ ID NO: 137321 - RNA, 22 nt, Mycobacterium bovis subsp bovis AF2122/97
ucaaccgguauugguggcggcu

SEQ ID NO: 137322 - RNA, 22 nt, Mycobacterium bovis subsp bovis AF2122/97
cgagcagacgcagagucgcacu

SEQ ID NO: 137323 - RNA, 22 nt, Mycobacterium bovis subsp bovis AF2122/97
uggaagacgagcucgacgagau

SEQ ID NO: 137324 - RNA, 22 nt, Mycobacterium bovis subsp bovis AF2122/97
gcuggugagugcggcgaccgcu

SEQ ID NO: 137325 - RNA, 22 nt, Mycobacterium bovis subsp bovis AF2122/97
aaggcgagcgacgucuuucccg

SEQ ID NO: 137326 - RNA, 22 nt, Mycobacterium bovis subsp bovis AF2122/97
uugcuccgagacggaggucugc

SEQ ID NO: 137327 - RNA, 22 nt, Mycobacterium bovis subsp bovis AF2122/97
caacgcaucagugccggcgccg

SEQ ID NO: 137328 - RNA, 22 nt, Mycobacterium bovis subsp bovis AF2122/97
gccugcaaaauguugaucucac

SEQ ID NO: 137329 - RNA, 22 nt, Mycobacterium bovis subsp bovis AF2122/97
ccgccggcgaagccguugccgu

SEQ ID NO: 137330 - RNA, 22 nt, Mycobacterium bovis subsp bovis AF2122/97
augccgaggguauccugcggcc

SEQ ID NO: 137331 - RNA, 22 nt, Mycobacterium bovis subsp bovis AF2122/97
ucgggcauggucagcacgcacc

SEQ ID NO: 137332 - RNA, 22 nt, Mycobacterium bovis subsp bovis AF2122/97
cgcgacaccaacaccggugccg

SEQ ID NO: 137333 - RNA, 22 nt, Mycobacterium bovis subsp bovis AF2122/97
aauuccucuauuacgacgacgg

SEQ ID NO: 137334 - RNA, 22 nt, Mycobacterium bovis subsp bovis AF2122/97
agguagacgugucccgcauggg

SEQ ID NO: 137335 - RNA, 22 nt, Mycobacterium bovis subsp bovis AF2122/97
acccagguguagucaggaucgg

SEQ ID NO: 137336 - RNA, 22 nt, Mycobacterium bovis subsp bovis AF2122/97
ugcgggauuugcagguucucgc

SEQ ID NO: 137337 - RNA, 22 nt, Mycobacterium bovis subsp bovis AF2122/97
cgcgcggaguucggugacggua

SEQ ID NO: 137338 - RNA, 22 nt, Mycobacterium bovis subsp bovis AF2122/97
acuuggggugcuuuugcgucug

SEQ ID NO: 137339 - RNA, 22 nt, Mycobacterium bovis subsp bovis AF2122/97
augguguucgagcaugaacgug

SEQ ID NO: 137340 - RNA, 22 nt, Mycobacterium bovis subsp bovis AF2122/97
guuccgguguccgguuggucga

SEQ ID NO: 137341 - RNA, 18 nt, Mycobacterium bovis subsp bovis AF2122/97
ccggcguucuggugcucg

SEQ ID NO: 137342 - RNA, 22 nt, Mycobacterium bovis subsp bovis AF2122/97
ccgagaucaacguucugcaggc

SEQ ID NO: 137343 - RNA, 17 nt, Mycobacterium bovis subsp bovis AF2122/97
gucaccgucgccacagc

SEQ ID NO: 137344 - RNA, 19 nt, Mycobacterium bovis subsp bovis AF2122/97
acccaggccgucacuucga

SEQ ID NO: 137345 - RNA, 19 nt, Mycobacterium bovis subsp bovis AF2122/97
auagcccuggaucgccgcc

SEQ ID NO: 137346 - RNA, 22 nt, Mycobacterium bovis subsp bovis AF2122/97
uuggggugcuuucgcgucugcu

SEQ ID NO: 137347 - RNA, 22 nt, Mycobacterium bovis subsp bovis AF2122/97
gcgucgccagacucacagucgc

SEQ ID NO: 137348 - RNA, 22 nt, Mycobacterium bovis subsp bovis AF2122/97
ugccgauugugaaucuggcgac

SEQ ID NO: 137349 - RNA, 22 nt, Mycobacterium bovis subsp bovis AF2122/97
aaacugcaaccacgcaccgaug

SEQ ID NO: 137350 - RNA, 22 nt, Mycobacterium bovis subsp bovis AF2122/97
aaguccagcagaucgaucucgc

SEQ ID NO: 137351 - RNA, 22 nt, Mycobacterium bovis subsp bovis AF2122/97
aaggugaacucacggcgagguu

SEQ ID NO: 137352 - RNA, 22 nt, Mycobacterium bovis subsp bovis AF2122/97
aaggcuggagcgcacagcgcgg

SEQ ID NO: 137353 - RNA, 22 nt, Mycobacterium bovis subsp bovis AF2122/97
acugcccagcgauuucgaccgu

SEQ ID NO: 137354 - RNA, 22 nt, Mycobacterium bovis subsp bovis AF2122/97
acuccucagccggcggcccugg

SEQ ID NO: 137355 - RNA, 22 nt, Mycobacterium bovis subsp bovis AF2122/97
acugcuuuccugucugggcggc

SEQ ID NO: 137356 - RNA, 22 nt, Mycobacterium bovis subsp bovis AF2122/97
acugucccgagcgcaccaggaa

SEQ ID NO: 137357 - RNA, 22 nt, Mycobacterium bovis subsp bovis AF2122/97
acuggccagcccgcacaaccac

SEQ ID NO: 137358 - RNA, 22 nt, Mycobacterium bovis subsp bovis AF2122/97
acagcugcugguuugagucugc

SEQ ID NO: 137359 - RNA, 22 nt, Mycobacterium bovis subsp bovis AF2122/97
acaccaagcgcccgcagcuugc

SEQ ID NO: 137360 - RNA, 22 nt, Mycobacterium bovis subsp bovis AF2122/97
acaccaaggccgucagcuuggc

SEQ ID NO: 137361 - RNA, 22 nt, Mycobacterium bovis subsp bovis AF2122/97
aagugcaacacgaacguuggau

SEQ ID NO: 137362 - RNA, 22 nt, Mycobacterium bovis subsp bovis AF2122/97
caccugccgaucgcacagguug

SEQ ID NO: 137363 - RNA, 22 nt, Mycobacterium bovis subsp bovis AF2122/97
caauguuucgacgggcaccaaa

SEQ ID NO: 137364 - RNA, 20 nt, Mycobacterium bovis subsp bovis AF2122/97
cacuccuggcuggauucggc

SEQ ID NO: 137365 - RNA, 22 nt, Mycobacterium bovis subsp bovis AF2122/97
caaguaguaggcgagaucaccg

SEQ ID NO: 137366 - RNA, 22 nt, Mycobacterium bovis subsp bovis AF2122/97
caacugcccgagucgcagcgcc

SEQ ID NO: 137367 - RNA, 22 nt, Mycobacterium bovis subsp bovis AF2122/97
cacaccgcgaugacuccggcga

SEQ ID NO: 137368 - RNA, 22 nt, Mycobacterium bovis subsp bovis AF2122/97
cagccugaccgguucggcuaug

SEQ ID NO: 137369 - RNA, 22 nt, Mycobacterium bovis subsp bovis AF2122/97
cagcguugucucggcgaacacc

SEQ ID NO: 137370 - RNA, 22 nt, Mycobacterium bovis subsp bovis AF2122/97
caggaggugcugcgggaggcga

SEQ ID NO: 137371 - RNA, 22 nt, Mycobacterium bovis subsp bovis AF2122/97
cagcugcuccgugacuacggcu

SEQ ID NO: 137372 - RNA, 22 nt, Mycobacterium bovis subsp bovis AF2122/97
cagccggcgcauggucaaagcg

SEQ ID NO: 137373 - RNA, 22 nt, Mycobacterium bovis subsp bovis AF2122/97
cagcaaaagccauucauuucua

SEQ ID NO: 137374 - RNA, 22 nt, Mycobacterium bovis subsp bovis AF2122/97
auucucuucauggugguguuga

SEQ ID NO: 137375 - RNA, 22 nt, Mycobacterium bovis subsp bovis AF2122/97
auugcgagccacgcagguugaa

SEQ ID NO: 137376 - RNA, 21 nt, Mycobacterium bovis subsp bovis AF2122/97
auuugcaacgcaacggcgugc

SEQ ID NO: 137377 - RNA, 22 nt, Mycobacterium bovis subsp bovis AF2122/97
auggccaaccucccgacuggua

SEQ ID NO: 137378 - RNA, 22 nt, Mycobacterium bovis subsp bovis AF2122/97
augaggcgauuuugcgucugcu

SEQ ID NO: 137379 - RNA, 22 nt, Mycobacterium bovis subsp bovis AF2122/97
aucugcagguuccuggguugac

SEQ ID NO: 137380 - RNA, 22 nt, Mycobacterium bovis subsp bovis AF2122/97
aucaccuuccucggcaugagau

SEQ ID NO: 137381 - RNA, 22 nt, Mycobacterium bovis subsp bovis AF2122/97
aucgcagccacggaguucgauu

SEQ ID NO: 137382 - RNA, 22 nt, Mycobacterium bovis subsp bovis AF2122/97
auccaggaauugucagacguua

SEQ ID NO: 137383 - RNA, 22 nt, Mycobacterium bovis subsp bovis AF2122/97
aucaacacgcugcuguuguaca

SEQ ID NO: 137384 - RNA, 22 nt, Mycobacterium bovis subsp bovis AF2122/97
aguccugggccaacugccggua

SEQ ID NO: 137385 - RNA, 22 nt, Mycobacterium bovis subsp bovis AF2122/97
agucagagucucgggcauguac

SEQ ID NO: 137386 - RNA, 22 nt, Mycobacterium bovis subsp bovis AF2122/97
agguagagcagcaucagcgcgu

SEQ ID NO: 137387 - RNA, 22 nt, Mycobacterium bovis subsp bovis AF2122/97
aggucugucggaccuggccgcg

SEQ ID NO: 137388 - RNA, 22 nt, Mycobacterium bovis subsp bovis AF2122/97
cgagcagacgcagagucgcacu

SEQ ID NO: 137389 - RNA, 23 nt, Mycobacterium bovis subsp bovis AF2122/97
cauccugcuggugcggaccggca

SEQ ID NO: 137390 - RNA, 22 nt, Mycobacterium bovis subsp bovis AF2122/97
caggggcucgauccggccgggc

SEQ ID NO: 137391 - RNA, 22 nt, Mycobacterium bovis subsp bovis AF2122/97
cgccagcaccaccugguugggc

SEQ ID NO: 137392 - RNA, 21 nt, Mycobacterium bovis subsp bovis AF2122/97
cgccccagaugcacgcucggc

SEQ ID NO: 137393 - RNA, 22 nt, Mycobacterium bovis subsp bovis AF2122/97
cgcccgccaaggacuuccgcgc

SEQ ID NO: 137394 - RNA, 22 nt, Mycobacterium bovis subsp bovis AF2122/97
cgcccggccgcuggucgcguac

SEQ ID NO: 137395 - RNA, 22 nt, Mycobacterium bovis subsp bovis AF2122/97
cgggucuauggguggaugcucg

SEQ ID NO: 137396 - RNA, 22 nt, Mycobacterium bovis subsp bovis AF2122/97
cggucaccaucucgcagacaua

SEQ ID NO: 137397 - RNA, 22 nt, Mycobacterium bovis subsp bovis AF2122/97
cguggaaugcaugaucgucgcc

SEQ ID NO: 137398 - RNA, 22 nt, Mycobacterium bovis subsp bovis AF2122/97
gaagcugcugggccaguucgug

SEQ ID NO: 137399 - RNA, 22 nt, Mycobacterium bovis subsp bovis AF2122/97
cuugggcguuugcguucgccgc

SEQ ID NO: 137400 - RNA, 22 nt, Mycobacterium bovis subsp bovis AF2122/97
cuugcugguaugccgggccacc

SEQ ID NO: 137401 - RNA, 22 nt, Mycobacterium bovis subsp bovis AF2122/97
ggcgagcagacacagagucgca

SEQ ID NO: 137402 - RNA, 22 nt, Mycobacterium bovis subsp bovis AF2122/97
ggccgcugucggucacguagac

SEQ ID NO: 137403 - RNA, 22 nt, Mycobacterium bovis subsp bovis AF2122/97
ggccacgccgcccuugccggac

SEQ ID NO: 137404 - RNA, 22 nt, Mycobacterium bovis subsp bovis AF2122/97
ggcccaggucacacacaucgca

SEQ ID NO: 137405 - RNA, 22 nt, Mycobacterium bovis subsp bovis AF2122/97
ggcaacuccgggguggccagca

SEQ ID NO: 137406 - RNA, 22 nt, Mycobacterium bovis subsp bovis AF2122/97
gcuggccagggcguuuccgcuc

SEQ ID NO: 137407 - RNA, 22 nt, Mycobacterium bovis subsp bovis AF2122/97
gcuggccaguucgcccugaccu

SEQ ID NO: 137408 - RNA, 22 nt, Mycobacterium bovis subsp bovis AF2122/97
gcugggccuuacgcaccugccg

SEQ ID NO: 137409 - RNA, 22 nt, Mycobacterium bovis subsp bovis AF2122/97
gcugccccgcgagcuggugcug

SEQ ID NO: 137410 - RNA, 22 nt, Mycobacterium bovis subsp bovis AF2122/97
gcugaaccugauccucaagggc

SEQ ID NO: 137411 - RNA, 22 nt, Mycobacterium bovis subsp bovis AF2122/97
gcugaacuccuggccgaguguc

SEQ ID NO: 137412 - RNA, 22 nt, Mycobacterium bovis subsp bovis AF2122/97
gccgcaccgacuaccaccgacu

SEQ ID NO: 137413 - RNA, 22 nt, Mycobacterium bovis subsp bovis AF2122/97
gcagcugcucgacuugcucgga

SEQ ID NO: 137414 - RNA, 21 nt, Mycobacterium bovis subsp bovis AF2122/97
gccagcacgguguucaaguug

SEQ ID NO: 137415 - RNA, 22 nt, Mycobacterium bovis subsp bovis AF2122/97
gccaccacucaggccgcgguca

SEQ ID NO: 137416 - RNA, 22 nt, Mycobacterium bovis subsp bovis AF2122/97
gcccggagagaucggcgcugac

SEQ ID NO: 137417 - RNA, 21 nt, Mycobacterium bovis subsp bovis AF2122/97
gccaacucaggcggacgaauc

SEQ ID NO: 137418 - RNA, 22 nt, Mycobacterium bovis subsp bovis AF2122/97
gccagguugacguugguuucgg

SEQ ID NO: 137419 - RNA, 22 nt, Mycobacterium bovis subsp bovis AF2122/97
gggcgagcagacgcagaaucgc

SEQ ID NO: 137420 - RNA, 22 nt, Mycobacterium bovis subsp bovis AF2122/97
ggcguggucaccggcguggucg

SEQ ID NO: 137421 - RNA, 22 nt, Mycobacterium bovis subsp bovis AF2122/97
gugggcagaugggugauacgca

SEQ ID NO: 137422 - RNA, 22 nt, Mycobacterium bovis subsp bovis AF2122/97
gugguggccguggccgcgucgu

SEQ ID NO: 137423 - RNA, 22 nt, Mycobacterium bovis subsp bovis AF2122/97
gugguggcgcaauucgaccagg

SEQ ID NO: 137424 - RNA, 22 nt, Mycobacterium bovis subsp bovis AF2122/97
guggugggaaccgcuccagggc

SEQ ID NO: 137425 - RNA, 22 nt, Mycobacterium bovis subsp bovis AF2122/97
gggugguggucgccaacgccga

SEQ ID NO: 137426 - RNA, 20 nt, Mycobacterium bovis subsp bovis AF2122/97
ggucacccugggugagccgg

SEQ ID NO: 137427 - RNA, 22 nt, Mycobacterium bovis subsp bovis AF2122/97
ggucagcacgcaugugcggugg

SEQ ID NO: 137428 - RNA, 22 nt, Mycobacterium bovis subsp bovis AF2122/97
ggguggugaaguuggcggccgg

SEQ ID NO: 137429 - RNA, 22 nt, Mycobacterium bovis subsp bovis AF2122/97
gggguuggugauguagccgaua

SEQ ID NO: 137430 - RNA, 22 nt, Mycobacterium bovis subsp bovis AF2122/97
ucaggcugggcgaaccugggca

SEQ ID NO: 137431 - RNA, 19 nt, Mycobacterium bovis subsp bovis AF2122/97
ucagcuguacucgaugaau

SEQ ID NO: 137432 - RNA, 22 nt, Mycobacterium bovis subsp bovis AF2122/97
uauguucaauaaaucauuaugu

SEQ ID NO: 137433 - RNA, 22 nt, Mycobacterium bovis subsp bovis AF2122/97
uaagcugcgccagccacgccgu

SEQ ID NO: 137434 - RNA, 22 nt, Mycobacterium bovis subsp bovis AF2122/97
gugguggucuccagcgcgcucg

SEQ ID NO: 137435 - RNA, 22 nt, Mycobacterium bovis subsp bovis AF2122/97
ugacucugcguccagcaggcgg

SEQ ID NO: 137436 - RNA, 20 nt, Mycobacterium bovis subsp bovis AF2122/97
ucuggccaaggugucgagca

SEQ ID NO: 137437 - RNA, 22 nt, Mycobacterium bovis subsp bovis AF2122/97
ucagguacgcgucagcagauug

SEQ ID NO: 137438 - RNA, 23 nt, Mycobacterium bovis subsp bovis AF2122/97
ucccaggugccauacgagcugaa

SEQ ID NO: 137439 - RNA, 19 nt, Mycobacterium bovis subsp bovis AF2122/97
ugcacuccaccgcuggcgc

SEQ ID NO: 137440 - RNA, 22 nt, Mycobacterium bovis subsp bovis AF2122/97
ugcacuccgacccgccgacguu

SEQ ID NO: 137441 - RNA, 22 nt, Mycobacterium bovis subsp bovis AF2122/97
uggcagcaaucggguauccgau

SEQ ID NO: 137442 - RNA, 22 nt, Mycobacterium bovis subsp bovis AF2122/97
uggccaagcggaccgucggcau

SEQ ID NO: 137443 - RNA, 22 nt, Mycobacterium bovis subsp bovis AF2122/97
ugaucucacccgaaguuguguc

SEQ ID NO: 137444 - RNA, 22 nt, Mycobacterium bovis subsp bovis AF2122/97
ugagggcaucgucggucgccgg

SEQ ID NO: 137445 - RNA, 22 nt, Mycobacterium bovis subsp bovis AF2122/97
ugagacccccgucgaagucuag

SEQ ID NO: 137446 - RNA, 22 nt, Mycobacterium bovis subsp bovis AF2122/97
ugaggaggaugaguuugcccuc

SEQ ID NO: 137447 - RNA, 22 nt, Mycobacterium bovis subsp bovis AF2122/97
uggcucagcgggucaacgaggc

SEQ ID NO: 137448 - RNA, 22 nt, Mycobacterium bovis subsp bovis AF2122/97
uggcgagcagacgcaaaagccc

SEQ ID NO: 137449 - RNA, 22 nt, Mycobacterium bovis subsp bovis AF2122/97
ugggacagcuggaaguuaucgg

SEQ ID NO: 137450 - RNA, 22 nt, Mycobacterium bovis subsp bovis AF2122/97
ugguuucccgugaggugaucgc

SEQ ID NO: 137451 - RNA, 22 nt, Mycobacterium bovis subsp bovis AF2122/97
ugucccgcacucgauccgcaag

SEQ ID NO: 137452 - RNA, 22 nt, Mycobacterium bovis subsp bovis AF2122/97
ugucgcgcaagcucuccggcac

SEQ ID NO: 137453 - RNA, 22 nt, Mycobacterium bovis subsp bovis AF2122/97
agccccagucgcuuugucucga

SEQ ID NO: 137454 - RNA, 22 nt, Mycobacterium bovis subsp bovis AF2122/97
agccaagccguaguccucgacg

SEQ ID NO: 137455 - RNA, 22 nt, Mycobacterium bovis subsp bovis AF2122/97
agccuugcggacggcacagcug

SEQ ID NO: 137456 - RNA, 22 nt, Mycobacterium bovis subsp bovis AF2122/97
agccgggcaucuggaaguggcu

SEQ ID NO: 137457 - RNA, 22 nt, Mycobacterium bovis subsp bovis AF2122/97
acuacgucggugauuugguugc

SEQ ID NO: 137458 - RNA, 22 nt, Mycobacterium bovis subsp bovis AF2122/97
aauccggccugugucgggucgu

SEQ ID NO: 137459 - RNA, 19 nt, Mycobacterium bovis subsp bovis AF2122/97
acccaggccgucacuucga

SEQ ID NO: 137460 - RNA, 22 nt, Mycobacterium bovis subsp bovis AF2122/97
acgcagaggacuagcacgucga

SEQ ID NO: 137461 - RNA, 22 nt, Mycobacterium bovis subsp bovis AF2122/97
uuugguacggaacguaggcaga

SEQ ID NO: 137462 - RNA, 22 nt, Mycobacterium bovis subsp bovis AF2122/97
uuucauucguugcgcgcagacc

SEQ ID NO: 137463 - RNA, 22 nt, Mycobacterium bovis subsp bovis AF2122/97
ugguggcugugucgaccgggaa

SEQ ID NO: 137464 - RNA, 18 nt, Mycobacterium bovis subsp bovis AF2122/97
uggugcaccuuguuuggg

SEQ ID NO: 137465 - RNA, 23 nt, Mycobacterium bovis subsp bovis AF2122/97
ugguggucaccccgacgacgcuc

SEQ ID NO: 137466 - RNA, 22 nt, Mycobacterium bovis subsp bovis AF2122/97
ugggaugguuuucagcgcccga

SEQ ID NO: 137467 - RNA, 22 nt, Mycobacterium bovis subsp bovis AF2122/97
ugggcaugaucuguggaucagg

SEQ ID NO: 137468 - RNA, 22 nt, Mycobacterium bovis subsp bovis AF2122/97
ugggccaacacgugcgcggucg

SEQ ID NO: 137469 - RNA, 23 nt, Mycobacterium bovis subsp bovis AF2122/97
ugggcucaggauguggcugcgau

SEQ ID NO: 137470 - RNA, 22 nt, Mycobacterium bovis subsp bovis AF2122/97
ugggcugaacaggacggccgcc

SEQ ID NO: 137471 - RNA, 22 nt, Mycobacterium bovis subsp bovis AF2122/97
ugggcugcugcgccgcaucggc

SEQ ID NO: 137472 - RNA, 22 nt, Mycobacterium bovis subsp bovis AF2122/97
uucaggcuacgguagcggugcg

SEQ ID NO: 137473 - RNA, 22 nt, Mycobacterium bovis subsp bovis AF2122/97
uucaucaguuggucgagguuga

SEQ ID NO: 137474 - RNA, 22 nt, Mycobacterium bovis subsp bovis AF2122/97
uugaggaucagguucagcuggc

SEQ ID NO: 137475 - RNA, 22 nt, Mycobacterium bovis subsp bovis AF2122/97
uugcgcaggggcaugucagcgu

SEQ ID NO: 137476 - RNA, 22 nt, Mycobacterium bovis subsp bovis AF2122/97
uuguugcuuucgguagugcugg

SEQ ID NO: 137477 - RNA, 22 nt, Mycobacterium bovis subsp bovis AF2122/97
uugucgccgucucgguccagcu

SEQ ID NO: 137478 - RNA, 22 nt, Mycobacterium bovis subsp bovis AF2122/97
uugucgccgugcaccaccugga

SEQ ID NO: 137479 - RNA, 22 nt, Mycobacterium bovis subsp bovis AF2122/97
uugggauuguugauuccgccga

SEQ ID NO: 137480 - RNA, 22 nt, Mycobacterium bovis subsp bovis AF2122/97
uuggccaacccgguguuggcau

SEQ ID NO: 137481 - RNA, 22 nt, Mycobacterium bovis subsp bovis AF2122/97
gcagaugauccucggcggugau

SEQ ID NO: 137482 - RNA, 22 nt, Mycobacterium bovis subsp bovis AF2122/97
gcacggguucguugcugugcau

SEQ ID NO: 137483 - RNA, 22 nt, Mycobacterium bovis subsp bovis AF2122/97
gcaccccagagcacugauacgc

SEQ ID NO: 137484 - RNA, 22 nt, Mycobacterium bovis subsp bovis AF2122/97
gcagacucuuggucaugggcug

SEQ ID NO: 137485 - RNA, 22 nt, Mycobacterium bovis subsp bovis AF2122/97
gcagagccgaucguccuguugc

SEQ ID NO: 137486 - RNA, 22 nt, Mycobacterium bovis subsp bovis AF2122/97
gauggcgaugcgcaccccgucg

SEQ ID NO: 137487 - RNA, 22 nt, Mycobacterium bovis subsp bovis AF2122/97
gaugacagcgaggugcacucgg

SEQ ID NO: 137488 - RNA, 22 nt, Mycobacterium bovis subsp bovis AF2122/97
gcggcagcagugagcacccgca

SEQ ID NO: 137489 - RNA, 22 nt, Mycobacterium bovis subsp bovis AF2122/97
gcggccaacgaggcagcggcgg

SEQ ID NO: 137490 - RNA, 22 nt, Mycobacterium bovis subsp bovis AF2122/97
gcgccagugcugcgcgugcaca

SEQ ID NO: 137491 - RNA, 22 nt, Mycobacterium bovis subsp bovis AF2122/97
gcgauagccgaaccacccgccg

SEQ ID NO: 137492 - RNA, 22 nt, Mycobacterium bovis subsp bovis AF2122/97
gcgcagcagcgacaggguggcg

SEQ ID NO: 137493 - RNA, 21 nt, Mycobacterium bovis subsp bovis AF2122/97
gcgcagcaucucagccagugc

SEQ ID NO: 137494 - RNA, 22 nt, Mycobacterium bovis subsp bovis AF2122/97
gcgaaacacgggaucgggcgag

SEQ ID NO: 137495 - RNA, 22 nt, Mycobacterium bovis subsp bovis AF2122/97
gccuggacuccgcuuuuggcac

SEQ ID NO: 137496 - RNA, 20 nt, Mycobacterium bovis subsp bovis AF2122/97
gccugcagaacguugaucuc

SEQ ID NO: 137497 - RNA, 22 nt, Mycobacterium bovis subsp bovis AF2122/97
cuggcuugccuccugccgcgac

SEQ ID NO: 137498 - RNA, 22 nt, Mycobacterium bovis subsp bovis AF2122/97
gagcaugggcguggacguuguc

SEQ ID NO: 137499 - RNA, 22 nt, Mycobacterium bovis subsp bovis AF2122/97
gagcggauuuuucgcaccggga

SEQ ID NO: 137500 - RNA, 22 nt, Mycobacterium bovis subsp bovis AF2122/97
cuggguucgacccaguccaagc

SEQ ID NO: 137501 - RNA, 23 nt, Mycobacterium bovis subsp bovis AF2122/97
gaggcgcuggcagcggcccgguu

SEQ ID NO: 137502 - RNA, 22 nt, Mycobacterium bovis subsp bovis AF2122/97
gaggacgggucuugaccgaggc

SEQ ID NO: 137503 - RNA, 22 nt, Mycobacterium bovis subsp bovis AF2122/97
gaggagaugcuagaggcaacga

SEQ ID NO: 137504 - RNA, 22 nt, Mycobacterium bovis subsp bovis AF2122/97
gaggagguguaccggguagagg

SEQ ID NO: 137505 - RNA, 22 nt, Mycobacterium bovis subsp bovis AF2122/97
gaggggauuuugcgucugcuca

SEQ ID NO: 137506 - RNA, 22 nt, Mycobacterium bovis subsp bovis AF2122/97
gagggacuuaugcgucugcuag

SEQ ID NO: 137507 - RNA, 22 nt, Mycobacterium bovis subsp bovis AF2122/97
gaggugaugagggcggcgagua

SEQ ID NO: 137508 - RNA, 20 nt, Mycobacterium bovis subsp bovis AF2122/97
gaguggagucuggucggccg

SEQ ID NO: 137509 - RNA, 22 nt, Mycobacterium bovis subsp bovis AF2122/97
ccaagcucuggauggccugccg

SEQ ID NO: 137510 - RNA, 22 nt, Mycobacterium bovis subsp bovis AF2122/97
ccagcagcgcguacagcaucga

SEQ ID NO: 137511 - RNA, 22 nt, Mycobacterium bovis subsp bovis AF2122/97
ccagcucaucgccguagcugag

SEQ ID NO: 137512 - RNA, 22 nt, Mycobacterium bovis subsp bovis AF2122/97
ccaggacgacaccggcaccuau

SEQ ID NO: 137513 - RNA, 22 nt, Mycobacterium bovis subsp bovis AF2122/97
ccaccgccacggccagcaccgc

SEQ ID NO: 137514 - RNA, 22 nt, Mycobacterium bovis subsp bovis AF2122/97
cccagccaggguaaggccuuug

SEQ ID NO: 137515 - RNA, 22 nt, Mycobacterium bovis subsp bovis AF2122/97
cccagcaccgaccagugccggc

SEQ ID NO: 137516 - RNA, 22 nt, Mycobacterium bovis subsp bovis AF2122/97
cccagcaccugccaggacgggc

SEQ ID NO: 137517 - RNA, 22 nt, Mycobacterium bovis subsp bovis AF2122/97
cgggcagcgucgggauaaucgg

SEQ ID NO: 137518 - RNA, 22 nt, Mycobacterium bovis subsp bovis AF2122/97
cggcugcagugcgacgacgaga

SEQ ID NO: 137519 - RNA, 22 nt, Mycobacterium bovis subsp bovis AF2122/97
cggcaagcccgggcucgccgga

SEQ ID NO: 137520 - RNA, 22 nt, Mycobacterium bovis subsp bovis AF2122/97
cccuggugguccgaucguucau

SEQ ID NO: 137521 - RNA, 21 nt, Mycobacterium bovis subsp bovis AF2122/97
cccuggugcuggccaccggcu

SEQ ID NO: 137522 - RNA, 22 nt, Mycobacterium bovis subsp bovis AF2122/97
ccgcccaggcucccgcucgacg

SEQ ID NO: 137523 - RNA, 22 nt, Mycobacterium bovis subsp bovis AF2122/97
gcguggucggaugcaggccagc

SEQ ID NO: 137524 - RNA, 22 nt, Mycobacterium bovis subsp bovis AF2122/97
gcuugcccuugucgagguugcg

SEQ ID NO: 137525 - RNA, 22 nt, Mycobacterium bovis subsp bovis AF2122/97
gcgccgccggggaucccgaccu

SEQ ID NO: 137526 - RNA, 22 nt, Mycobacterium bovis subsp bovis AF2122/97
gcucaugucgccguagaccggg

SEQ ID NO: 137527 - RNA, 22 nt, Mycobacterium bovis subsp bovis AF2122/97
gcuuuuaugacugcucggcggg

SEQ ID NO: 137528 - RNA, 22 nt, Mycobacterium bovis subsp bovis AF2122/97
ggaacugcucgucgagcugcuc

SEQ ID NO: 137529 - RNA, 22 nt, Mycobacterium bovis subsp bovis AF2122/97
ggaaguucuaucugccgccaaa

SEQ ID NO: 137530 - RNA, 22 nt, Mycobacterium bovis subsp bovis AF2122/97
ggaguucaaugccacggcgucg

SEQ ID NO: 137531 - RNA, 22 nt, Mycobacterium bovis subsp bovis AF2122/97
ggugaugguggaggcagccgac

SEQ ID NO: 137532 - RNA, 22 nt, Mycobacterium bovis subsp bovis AF2122/97
ggugcuuuugcgucugcucggc

SEQ ID NO: 137533 - RNA, 22 nt, Mycobacterium bovis subsp bovis AF2122/97
gguggcagcggguccggcgacu

SEQ ID NO: 137534 - RNA, 22 nt, Mycobacterium bovis subsp bovis AF2122/97
gguggcgcacaucgccgugcac

SEQ ID NO: 137535 - RNA, 22 nt, Mycobacterium bovis subsp bovis AF2122/97
guaggucagggcguauuugucg

SEQ ID NO: 137536 - RNA, 22 nt, Mycobacterium bovis subsp bovis AF2122/97
guaggaggucuccagcagccgc

SEQ ID NO: 137537 - RNA, 22 nt, Mycobacterium bovis subsp bovis AF2122/97
gguggagggacucgagaauguc

SEQ ID NO: 137538 - RNA, 22 nt, Mycobacterium bovis subsp bovis AF2122/97
guccucaagccggcguuccagc

SEQ ID NO: 137539 - RNA, 22 nt, Mycobacterium bovis subsp bovis AF2122/97
gucgcuggugggaucgcagcgc

SEQ ID NO: 137540 - RNA, 22 nt, Mycobacterium bovis subsp bovis AF2122/97
gucauugcgucauuuccuucga

SEQ ID NO: 137541 - RNA, 22 nt, Mycobacterium bovis subsp bovis AF2122/97
guuuugggccucggcgagccga

SEQ ID NO: 137542 - RNA, 22 nt, Mycobacterium bovis subsp bovis AF2122/97
guuugguugccuaccgcguggg

SEQ ID NO: 137543 - RNA, 22 nt, Mycobacterium bovis subsp bovis AF2122/97
guugugaagacgccauucgcag

SEQ ID NO: 137544 - RNA, 22 nt, Mycobacterium bovis subsp bovis AF2122/97
guuucgggcgauuuugcguccu

SEQ ID NO: 137545 - RNA, 22 nt, Mycobacterium bovis subsp bovis AF2122/97
guugugaacggaaccgccggga

SEQ ID NO: 137546 - RNA, 22 nt, Mycobacterium bovis subsp bovis AF2122/97
ugcagcugcgaccguucguucu

SEQ ID NO: 137547 - RNA, 22 nt, Mycobacterium bovis subsp bovis AF2122/97
ugacccaggcgccggucggugu

SEQ ID NO: 137548 - RNA, 22 nt, Mycobacterium bovis subsp bovis AF2122/97
ugcugcccaaagaacagcgagc

SEQ ID NO: 137549 - RNA, 22 nt, Mycobacterium bovis subsp bovis AF2122/97
ugcgggaguugcgggauugaug

SEQ ID NO: 137550 - RNA, 18 nt, Mycobacterium bovis subsp bovis AF2122/97
ugcgcgccgccagcuauc

SEQ ID NO: 137551 - RNA, 22 nt, Mycobacterium bovis subsp bovis AF2122/97
ugcgccaccgccagaggauaac

SEQ ID NO: 137552 - RNA, 22 nt, Mycobacterium bovis subsp bovis AF2122/97
ugcgccagcgccucccgcagga

SEQ ID NO: 137553 - RNA, 22 nt, Mycobacterium bovis subsp bovis AF2122/97
ucgaaacccagccaccucuugg

SEQ ID NO: 137554 - RNA, 22 nt, Mycobacterium bovis subsp bovis AF2122/97
ucgcccagcgagugcgccuggu

SEQ ID NO: 137555 - RNA, 22 nt, Mycobacterium bovis subsp bovis AF2122/97
ucggccucccaugcggcgaucu

SEQ ID NO: 137556 - RNA, 22 nt, Mycobacterium bovis subsp bovis AF2122/97
ucggggacuucugcgucugcuc

SEQ ID NO: 137557 - RNA, 22 nt, Mycobacterium bovis subsp bovis AF2122/97
ucgguggcgccgacaugccggu

SEQ ID NO: 137558 - RNA, 22 nt, Mycobacterium bovis subsp bovis AF2122/97
ucuuucccuccagaucggugcg

SEQ ID NO: 137559 - RNA, 22 nt, Mycobacterium bovis subsp bovis AF2122/97
ucagcgucgaugaccaugucga

SEQ ID NO: 137560 - RNA, 22 nt, Mycobacterium bovis subsp bovis AF2122/97
uccuuuccgucgaugcggaagc

SEQ ID NO: 137561 - RNA, 22 nt, Mycobacterium bovis subsp bovis AF2122/97
uagguaaauaaauccguguuug

SEQ ID NO: 137562 - RNA, 22 nt, Human
aaaaaggagaaagagagggaga

SEQ ID NO: 137563 - RNA, 22 nt, Human
aaaaaguaccacuuggacacuu

SEQ ID NO: 137564 - RNA, 22 nt, Human
aaaagacaaggaucuggaguga

SEQ ID NO: 137565 - RNA, 22 nt, Human
aaaacuuucagggauacagaaa

SEQ ID NO: 137566 - RNA, 22 nt, Human
aaacuuuaggcacauggaucua

SEQ ID NO: 137567 - RNA, 22 nt, Human
aaacuugaggcaaugaaggugu

SEQ ID NO: 137568 - RNA, 22 nt, Human
aaacugacugaugugaucuuau

SEQ ID NO: 137569 - RNA, 21 nt, Human
aaagaagagcucagagguaga

SEQ ID NO: 137570 - RNA, 22 nt, Human
aaaaguuguaauauuuccuuua

SEQ ID NO: 137571 - RNA, 22 nt, Human
aaacccacauuccugcuuaggc

SEQ ID NO: 137572 - RNA, 22 nt, Human
aaacauguagugcaugaggauc

SEQ ID NO: 137573 - RNA, 22 nt, Human
aaaauauguugagauacugaaa

SEQ ID NO: 137574 - RNA, 22 nt, Human
aaaccagaguucauaguauuca

SEQ ID NO: 137575 - RNA, 22 nt, Human
aaacagcugcaguacacggccu

SEQ ID NO: 137576 - RNA, 18 nt, Human
aaacauggcuuaaaggcu

SEQ ID NO: 137577 - RNA, 23 nt, Human
aaagacuagaagccguggcugca

SEQ ID NO: 137578 - RNA, 22 nt, Human
aaaugguguucuuuagaugaaa

SEQ ID NO: 137579 - RNA, 22 nt, Human
aaauguuucauucuauuuuuag

SEQ ID NO: 137580 - RNA, 22 nt, Human
aaaugucugagacuucugaacu

SEQ ID NO: 137581 - RNA, 20 nt, Human
aaauucgacuaaaaccagaa

SEQ ID NO: 137582 - RNA, 22 nt, Human
aacaguuaagaggaggcagaga

SEQ ID NO: 137583 - RNA, 22 nt, Human
aacaucugagagcccuugugca

SEQ ID NO: 137584 - RNA, 20 nt, Human
aacagcucucgacuuaucuu

SEQ ID NO: 137585 - RNA, 22 nt, Human
aacagagauucuucccuucuuu

SEQ ID NO: 137586 - RNA, 22 nt, Human
aacacugaaaugucuuaagauu

SEQ ID NO: 137587 - RNA, 22 nt, Human
aacaaaacauuuuacgaauaua

SEQ ID NO: 137588 - RNA, 22 nt, Human
aacacaucagcacacuaacgga

SEQ ID NO: 137589 - RNA, 22 nt, Human
aacacuguaucagucuucaaua

SEQ ID NO: 137590 - RNA, 21 nt, Human
aaauuucauauggccaaccua

SEQ ID NO: 137591 - RNA, 22 nt, Human
aacucaggagagaguaacaggg

SEQ ID NO: 137592 - RNA, 22 nt, Human
aacgaugauaaauuguucucug

SEQ ID NO: 137593 - RNA, 19 nt, Human
aacuacagcgcacuguccu

SEQ ID NO: 137594 - RNA, 22 nt, Human
aaccguguucgggaacacuugu

SEQ ID NO: 137595 - RNA, 22 nt, Human
aacgcagagaguaaugcugaac

SEQ ID NO: 137596 - RNA, 22 nt, Human
aacgccgggacucgcagggagc

SEQ ID NO: 137597 - RNA, 22 nt, Human
aacgagcugggggggccggggg

SEQ ID NO: 137598 - RNA, 21 nt, Human
aacagguuuccuaccacuugc

SEQ ID NO: 137599 - RNA, 22 nt, Human
aacaguacaucaugaggucauc

SEQ ID NO: 137600 - RNA, 22 nt, Human
aacaucaaaggaagaaugauau

SEQ ID NO: 137601 - RNA, 22 nt, Human
aacaugggcaacuucuuuucag

SEQ ID NO: 137602 - RNA, 22 nt, Human
aacccacuaugauuguccucau

SEQ ID NO: 137603 - RNA, 22 nt, Human
aacccaagacaagcacuggcca

SEQ ID NO: 137604 - RNA, 22 nt, Human
aaccaggcgagagagcggucag

SEQ ID NO: 137605 - RNA, 22 nt, Human
aaccaguacuucucuauucagu

SEQ ID NO: 137606 - RNA, 22 nt, Human
aaccucgggcugcacuuggcac

SEQ ID NO: 137607 - RNA, 22 nt, Human
aaccaaucaaauuggaauugaa

SEQ ID NO: 137608 - RNA, 22 nt, Human
aaccuagaggaagaugggucag

SEQ ID NO: 137609 - RNA, 22 nt, Human
aaccagaagucaucagagcuga

SEQ ID NO: 137610 - RNA, 22 nt, Human
aaccuuauuguguaucaccaua

SEQ ID NO: 137611 - RNA, 22 nt, Human
aagcagcauaugacagcaucca

SEQ ID NO: 137612 - RNA, 22 nt, Human
aagccgagggaggugauggaga

SEQ ID NO: 137613 - RNA, 22 nt, Human
aagccagccaguuccagcagcu

SEQ ID NO: 137614 - RNA, 22 nt, Human
aagcaacccagugcuuguauag

SEQ ID NO: 137615 - RNA, 22 nt, Human
aagagggguggucugugaggau

SEQ ID NO: 137616 - RNA, 22 nt, Human
aagaccacaggaaucaaacagg

SEQ ID NO: 137617 - RNA, 22 nt, Human
aagaggacagucaaauggccgg

SEQ ID NO: 137618 - RNA, 22 nt, Human
aagaacaugggugugggcauuc

SEQ ID NO: 137619 - RNA, 22 nt, Human
aacuuucugaaaagcuugauca

SEQ ID NO: 137620 - RNA, 22 nt, Human
aagaaaccauauuaguuccugg

SEQ ID NO: 137621 - RNA, 22 nt, Human
aacugggugauucaggcuguuu

SEQ ID NO: 137622 - RNA, 22 nt, Human
aacugcauaagcuucgggaccu

SEQ ID NO: 137623 - RNA, 22 nt, Human
aacuggguuuaucuaaugugua

SEQ ID NO: 137624 - RNA, 23 nt, Human
aacugcaagguugcugggaagua

SEQ ID NO: 137625 - RNA, 22 nt, Human
aacuguugucacgaauguggcu

SEQ ID NO: 137626 - RNA, 19 nt, Human
aacucugccgaggcaagcc

SEQ ID NO: 137627 - RNA, 22 nt, Human
aacucugcaaugaaaucauguu

SEQ ID NO: 137628 - RNA, 22 nt, Human
aacgggguugauuauuggaaga

SEQ ID NO: 137629 - RNA, 22 nt, Human
aacgcaacaacuggagcuguag

SEQ ID NO: 137630 - RNA, 22 nt, Human
aacgcugugcacuggguccagg

SEQ ID NO: 137631 - RNA, 22 nt, Human
aaugguggaugucuguucugac

SEQ ID NO: 137632 - RNA, 22 nt, Human
aaugggauuaagaaagaucuug

SEQ ID NO: 137633 - RNA, 22 nt, Human
aauggacuucucugagccuguu

SEQ ID NO: 137634 - RNA, 22 nt, Human
aauggcaagccacaugcuuuuc

SEQ ID NO: 137635 - RNA, 22 nt, Human
aauggaaaggagccugacuaua

SEQ ID NO: 137636 - RNA, 22 nt, Human
aauucaacagucaguuaucuca

SEQ ID NO: 137637 - RNA, 22 nt, Human
aauguugacguuggccagggcc

SEQ ID NO: 137638 - RNA, 22 nt, Human
aauguuuaacuguggucagcag

SEQ ID NO: 137639 - RNA, 22 nt, Human
aaugacagccuauacugucugc

SEQ ID NO: 137640 - RNA, 22 nt, Human
aaugaaacuaguagaaucuuug

SEQ ID NO: 137641 - RNA, 22 nt, Human
aaugacaguggcacagucacuu

SEQ ID NO: 137642 - RNA, 22 nt, Human
aaugccuucauuggcgaagugc

SEQ ID NO: 137643 - RNA, 23 nt, Human
aaugaguugggcagcauacaggc

SEQ ID NO: 137644 - RNA, 22 nt, Human
aauccucguagugguuagaaag

SEQ ID NO: 137645 - RNA, 22 nt, Human
aauccaaacaggauuaccuauc

SEQ ID NO: 137646 - RNA, 22 nt, Human
aaucccaguugacagaacuguu

SEQ ID NO: 137647 - RNA, 22 nt, Human
aaucaagcugcuguuuguucua

SEQ ID NO: 137648 - RNA, 22 nt, Human
aaucuugggacagggacacuau

SEQ ID NO: 137649 - RNA, 22 nt, Human
aaucuuuuugaaggaggagaga

SEQ ID NO: 137650 - RNA, 22 nt, Human
aaugaacuuucaguucagagag

SEQ ID NO: 137651 - RNA, 22 nt, Human
aaucugaccguggagaucucca

SEQ ID NO: 137652 - RNA, 22 nt, Human
aauaggguccuuuguguuauau

SEQ ID NO: 137653 - RNA, 22 nt, Human
aauauagagcagaucuggcucu

SEQ ID NO: 137654 - RNA, 22 nt, Human
aauaauacaauuggugucaugu

SEQ ID NO: 137655 - RNA, 22 nt, Human
aaguggugagacccugcugaaa

SEQ ID NO: 137656 - RNA, 23 nt, Human
aaguggucaucuaucccaugguu

SEQ ID NO: 137657 - RNA, 23 nt, Human
aaguggugacugugcuacugaga

SEQ ID NO: 137658 - RNA, 22 nt, Human
aaguuaauugcuucuaguuaau

SEQ ID NO: 137659 - RNA, 22 nt, Human
aagugugugugcgcaugugcau

SEQ ID NO: 137660 - RNA, 22 nt, Human
aaguguggguaagcauuucuug

SEQ ID NO: 137661 - RNA, 22 nt, Human
aaguaauuugugaaggcauguu

SEQ ID NO: 137662 - RNA, 23 nt, Human
aagggcgauuaacauucgcucga

SEQ ID NO: 137663 - RNA, 22 nt, Human
aagggaaggaugggcauuuaca

SEQ ID NO: 137664 - RNA, 22 nt, Human
aaggcacauauuuuagagucac

SEQ ID NO: 137665 - RNA, 22 nt, Human
aaggcaggagaguaggaggugg

SEQ ID NO: 137666 - RNA, 22 nt, Human
aaggccuaggaguugacauggg

SEQ ID NO: 137667 - RNA, 22 nt, Human
aaggcggcggcggcggcugcgg

SEQ ID NO: 137668 - RNA, 22 nt, Human
aaggcgccacagugauugcaaa

SEQ ID NO: 137669 - RNA, 22 nt, Human
aaggcgauuuaaagauguuagg

SEQ ID NO: 137670 - RNA, 22 nt, Human
aaggcugaccaguuuacacuuu

SEQ ID NO: 137671 - RNA, 22 nt, Human
aagccuguugacagcugucagu

SEQ ID NO: 137672 - RNA, 22 nt, Human
aagccuccgugcugcuggaucu

SEQ ID NO: 137673 - RNA, 22 nt, Human
accaggcagcaccaaagccggu

SEQ ID NO: 137674 - RNA, 22 nt, Human
acauuuccaaagaugccaguca

SEQ ID NO: 137675 - RNA, 22 nt, Human
accaccacugacaccagcucgg

SEQ ID NO: 137676 - RNA, 22 nt, Human
accagcgcguuuucaguuucau

SEQ ID NO: 137677 - RNA, 22 nt, Human
accaccacauaguaggcacuua

SEQ ID NO: 137678 - RNA, 22 nt, Human
accaaucugguauauuccagaa

SEQ ID NO: 137679 - RNA, 22 nt, Human
acauggggaaaaaggccugcuc

SEQ ID NO: 137680 - RNA, 22 nt, Human
acaugguguggcacuaggggcu

SEQ ID NO: 137681 - RNA, 22 nt, Human
accaacuuuccaaagugccugg

SEQ ID NO: 137682 - RNA, 19 nt, Human
accaaacaguggacggagc

SEQ ID NO: 137683 - RNA, 22 nt, Human
accaacacgucugaguauuucc

SEQ ID NO: 137684 - RNA, 21 nt, Human
acccagaauggagccaagccu

SEQ ID NO: 137685 - RNA, 22 nt, Human
accaauguuuuauagaaaugcc

SEQ ID NO: 137686 - RNA, 20 nt, Human
acccaaagcucagcgugucc

SEQ ID NO: 137687 - RNA, 22 nt, Human
acccccacuccgcaguagaacu

SEQ ID NO: 137688 - RNA, 22 nt, Human
accccagcucugagccacacca

SEQ ID NO: 137689 - RNA, 22 nt, Human
acccauggcucucugggaugcu

SEQ ID NO: 137690 - RNA, 22 nt, Human
acccggccuacucagugcccag

SEQ ID NO: 137691 - RNA, 17 nt, Human
accaggggcagcacugc

SEQ ID NO: 137692 - RNA, 22 nt, Human
accagguugagacuucggcuuu

SEQ ID NO: 137693 - RNA, 22 nt, Human
accagccacccugccgcguccg

SEQ ID NO: 137694 - RNA, 22 nt, Human
accagccacacacauuagucac

SEQ ID NO: 137695 - RNA, 22 nt, Human
accacguccugguggcuguugg

SEQ ID NO: 137696 - RNA, 22 nt, Human
acauuuugggagaaaguuguua

SEQ ID NO: 137697 - RNA, 22 nt, Human
acaugcacagcaagggugagag

SEQ ID NO: 137698 - RNA, 22 nt, Human
acauugcagcuccuaccuuguc

SEQ ID NO: 137699 - RNA, 22 nt, Human
acaucuucuauggagguucgga

SEQ ID NO: 137700 - RNA, 22 nt, Human
acauugguauuaguguggcuga

SEQ ID NO: 137701 - RNA, 22 nt, Human
acauccaguaucagaagcauca

SEQ ID NO: 137702 - RNA, 22 nt, Human
acauauggcagguugaucaaug

SEQ ID NO: 137703 - RNA, 22 nt, Human
acaucuaugucugaggccuugg

SEQ ID NO: 137704 - RNA, 22 nt, Human
acaugaguuacuuccgauuccc

SEQ ID NO: 137705 - RNA, 22 nt, Human
acaguguuacuugauaguguau

SEQ ID NO: 137706 - RNA, 21 nt, Human
aauucccagaaacagcacaag

SEQ ID NO: 137707 - RNA, 22 nt, Human
aauguucauauggguagcagau

SEQ ID NO: 137708 - RNA, 21 nt, Human
acauguacacauguaugcaca

SEQ ID NO: 137709 - RNA, 22 nt, Human
acguaaacagcaaagacaugau

SEQ ID NO: 137710 - RNA, 22 nt, Human
acgggggagucuuuuacaucau

SEQ ID NO: 137711 - RNA, 22 nt, Human
acgggugcuuguucccgcugcu

SEQ ID NO: 137712 - RNA, 22 nt, Human
acguuauagaugcuucaugaaa

SEQ ID NO: 137713 - RNA, 22 nt, Human
acgugaccuuauuugaaaaaug

SEQ ID NO: 137714 - RNA, 23 nt, Human
acgaccuugcccucauuccaaag

SEQ ID NO: 137715 - RNA, 22 nt, Human
acgaagggggcauggugagagu

SEQ ID NO: 137716 - RNA, 22 nt, Human
acgcugagcucauggagaugca

SEQ ID NO: 137717 - RNA, 22 nt, Human
acggcuugaacgcgccuguggg

SEQ ID NO: 137718 - RNA, 22 nt, Human
accuuaagugauuaugacauau

SEQ ID NO: 137719 - RNA, 22 nt, Human
acgcaacacugcuauuuuuuuc

SEQ ID NO: 137720 - RNA, 22 nt, Human
accuggaccugccaccuaugag

SEQ ID NO: 137721 - RNA, 22 nt, Human
accuggacucugaucacuuuug

SEQ ID NO: 137722 - RNA, 22 nt, Human
accugcucucccucucgcaguc

SEQ ID NO: 137723 - RNA, 22 nt, Human
accuggcccugggucuccugac

SEQ ID NO: 137724 - RNA, 23 nt, Human
accuggucccaugggugggccug

SEQ ID NO: 137725 - RNA, 22 nt, Human
acgauaacaauaguagcaugua

SEQ ID NO: 137726 - RNA, 22 nt, Human
accuuagcuguuaaaacuaagu

SEQ ID NO: 137727 - RNA, 22 nt, Human
accuuguuguagguacaaaaga

SEQ ID NO: 137728 - RNA, 22 nt, Human
accuuggauauucuuacucggu

SEQ ID NO: 137729 - RNA, 22 nt, Human
accucccgacggcgcgggagaa

SEQ ID NO: 137730 - RNA, 22 nt, Human
accugaccagguggcuucccaa

SEQ ID NO: 137731 - RNA, 21 nt, Human
accugguuuacugaucccagg

SEQ ID NO: 137732 - RNA, 22 nt, Human
accuccauggcucagguuccaa

SEQ ID NO: 137733 - RNA, 22 nt, Human
accuggauauuuucaguugcau

SEQ ID NO: 137734 - RNA, 22 nt, Human
accugagauuuuuacucaguaa

SEQ ID NO: 137735 - RNA, 23 nt, Human
accgccgcugccgccgcccccgc

SEQ ID NO: 137736 - RNA, 21 nt, Human
accgucaguacuaguauugac

SEQ ID NO: 137737 - RNA, 22 nt, Human
accgcuggcacuggggacgggg

SEQ ID NO: 137738 - RNA, 22 nt, Human
accgauguggaaaauuucauuu

SEQ ID NO: 137739 - RNA, 22 nt, Human
accgagcaggguguuugcgcac

SEQ ID NO: 137740 - RNA, 20 nt, Human
acccagaguccuccccgcgc

SEQ ID NO: 137741 - RNA, 22 nt, Human
accgggcagcucugccccugcc

SEQ ID NO: 137742 - RNA, 22 nt, Human
accauccaggugagggagaccu

SEQ ID NO: 137743 - RNA, 22 nt, Human
accaugacugucacauuauuau

SEQ ID NO: 137744 - RNA, 22 nt, Human
accgucagguuagaaugagcac

SEQ ID NO: 137745 - RNA, 22 nt, Human
accggucucaccaaacgcccca

SEQ ID NO: 137746 - RNA, 22 nt, Human
accucagauuguggcuccgcug

SEQ ID NO: 137747 - RNA, 22 nt, Human
acccuacggacuugacugggcg

SEQ ID NO: 137748 - RNA, 22 nt, Human
agaggaauuauugaguuagauu

SEQ ID NO: 137749 - RNA, 22 nt, Human
agagcuuagaggaccuucgugc

SEQ ID NO: 137750 - RNA, 22 nt, Human
agaggcacccaguuaagcugca

SEQ ID NO: 137751 - RNA, 22 nt, Human
agagcuuuggaguaaguuuuga

SEQ ID NO: 137752 - RNA, 22 nt, Human
agagcugggacuuggacucaau

SEQ ID NO: 137753 - RNA, 22 nt, Human
agaggcuuuccuaagauugguu

SEQ ID NO: 137754 - RNA, 22 nt, Human
agaguggcaccuuaccugagac

SEQ ID NO: 137755 - RNA, 23 nt, Human
agauaaggaagcauuugagccag

SEQ ID NO: 137756 - RNA, 22 nt, Human
agauaacauguugcagauucug

SEQ ID NO: 137757 - RNA, 22 nt, Human
agagaauuugggaauauaaauc

SEQ ID NO: 137758 - RNA, 22 nt, Human
agagagggaugguguccagaga

SEQ ID NO: 137759 - RNA, 22 nt, Human
agagcuagaaggaagcauuucu

SEQ ID NO: 137760 - RNA, 22 nt, Human
agagccggagucuucuuguuug

SEQ ID NO: 137761 - RNA, 22 nt, Human
agagcagcaaucuuugaaauua

SEQ ID NO: 137762 - RNA, 22 nt, Human
agacuuugaaugaugacagcgu

SEQ ID NO: 137763 - RNA, 22 nt, Human
agagaaacauuaauugaugagg

SEQ ID NO: 137764 - RNA, 22 nt, Human
agacuuuggcagggccaguggu

SEQ ID NO: 137765 - RNA, 20 nt, Human
agagaacaguuuggucacag

SEQ ID NO: 137766 - RNA, 19 nt, Human
agagauuuucuguuuuagu

SEQ ID NO: 137767 - RNA, 22 nt, Human
agagauuuacaacuugggcuuu

SEQ ID NO: 137768 - RNA, 22 nt, Human
agagauugagcucagaagaccu

SEQ ID NO: 137769 - RNA, 21 nt, Human
agacugaugggaagacucugu

SEQ ID NO: 137770 - RNA, 22 nt, Human
agagaagaauccccugguggag

SEQ ID NO: 137771 - RNA, 22 nt, Human
agagacaggguuuugucguguu

SEQ ID NO: 137772 - RNA, 22 nt, Human
agagacauagcacaguuuuucg

SEQ ID NO: 137773 - RNA, 22 nt, Human
agagaacaggcagcuggugccg

SEQ ID NO: 137774 - RNA, 22 nt, Human
agacuugguaacuagugaagaa

SEQ ID NO: 137775 - RNA, 19 nt, Human
agacccaguuuucuagugu

SEQ ID NO: 137776 - RNA, 22 nt, Human
agaccagugaguaggccuuaga

SEQ ID NO: 137777 - RNA, 22 nt, Human
agaaucugcauuuuaacaagau

SEQ ID NO: 137778 - RNA, 22 nt, Human
agaaucaggaagacagccuggc

SEQ ID NO: 137779 - RNA, 22 nt, Human
agacacugacaggguccaugga

SEQ ID NO: 137780 - RNA, 22 nt, Human
agacagaacauaauuaguacug

SEQ ID NO: 137781 - RNA, 22 nt, Human
agacagaaaaguugucaaucau

SEQ ID NO: 137782 - RNA, 22 nt, Human
agaaauuguaauaaaucugguc

SEQ ID NO: 137783 - RNA, 22 nt, Human
agaacaagaaacccgaaaagug

SEQ ID NO: 137784 - RNA, 22 nt, Human
acuuugccuucuuacuguguug

SEQ ID NO: 137785 - RNA, 23 nt, Human
acuuugaggagaagaaugucagu

SEQ ID NO: 137786 - RNA, 22 nt, Human
acuuggucguggugcagcaugg

SEQ ID NO: 137787 - RNA, 22 nt, Human
acuuugucuugaucaaaggugu

SEQ ID NO: 137788 - RNA, 22 nt, Human
agaacaggaggaagccagcucc

SEQ ID NO: 137789 - RNA, 22 nt, Human
agaaagcacccugcacuuucug

SEQ ID NO: 137790 - RNA, 22 nt, Human
agaaacaagcccuagaaguccu

SEQ ID NO: 137791 - RNA, 22 nt, Human
acuucugcccuggcgagggcgu

SEQ ID NO: 137792 - RNA, 22 nt, Human
acuugcauuguguaguguuuuu

SEQ ID NO: 137793 - RNA, 22 nt, Human
acuugguccacaguaagugcuu

SEQ ID NO: 137794 - RNA, 22 nt, Human
acuguugugaauaaugaaaugc

SEQ ID NO: 137795 - RNA, 22 nt, Human
acuguggcugcuacccuggcuc

SEQ ID NO: 137796 - RNA, 22 nt, Human
acugugacugugucuucugggc

SEQ ID NO: 137797 - RNA, 22 nt, Human
acugugacucuguuucuuggau

SEQ ID NO: 137798 - RNA, 22 nt, Human
acugugauguaaagaaauaggc

SEQ ID NO: 137799 - RNA, 22 nt, Human
acuggguuguuugucucaugag

SEQ ID NO: 137800 - RNA, 22 nt, Human
acugggcaaggauaugaugggu

SEQ ID NO: 137801 - RNA, 19 nt, Human
acugggaugggcagugcca

SEQ ID NO: 137802 - RNA, 22 nt, Human
acugggacuguaugugcuggac

SEQ ID NO: 137803 - RNA, 22 nt, Human
acuggggcaggaaaguaugcug

SEQ ID NO: 137804 - RNA, 22 nt, Human
acuggugcucuggccaccgcug

SEQ ID NO: 137805 - RNA, 22 nt, Human
acugguuucaaguuggacugaa

SEQ ID NO: 137806 - RNA, 22 nt, Human
acugucauuaaugaauguaaua

SEQ ID NO: 137807 - RNA, 22 nt, Human
acugugaagagcauucuggcug

SEQ ID NO: 137808 - RNA, 22 nt, Human
acugcaggucccaucaccugcg

SEQ ID NO: 137809 - RNA, 22 nt, Human
acuggauuuugugguguaucuu

SEQ ID NO: 137810 - RNA, 22 nt, Human
acuggauucucuuacacagaug

SEQ ID NO: 137811 - RNA, 22 nt, Human
acuggagcccguggaggcgcag

SEQ ID NO: 137812 - RNA, 18 nt, Human
acugagcccaggacacac

SEQ ID NO: 137813 - RNA, 22 nt, Human
acugagcaaaacugauccuguu

SEQ ID NO: 137814 - RNA, 22 nt, Human
acugagaacuuggggacagagg

SEQ ID NO: 137815 - RNA, 22 nt, Human
acugacucacauuuugguuugc

SEQ ID NO: 137816 - RNA, 21 nt, Human
acugccaugcaggagccucca

SEQ ID NO: 137817 - RNA, 22 nt, Human
acugcacuccagcccgagcaac

SEQ ID NO: 137818 - RNA, 20 nt, Human
acugcaagagacagaugaaa

SEQ ID NO: 137819 - RNA, 22 nt, Human
acuacuguaauuuauuguuaca

SEQ ID NO: 137820 - RNA, 22 nt, Human
agcuugcccuuguaccagccag

SEQ ID NO: 137821 - RNA, 22 nt, Human
agcuugauggauugcugaggca

SEQ ID NO: 137822 - RNA, 22 nt, Human
agcuuucuauauaugaguugcu

SEQ ID NO: 137823 - RNA, 22 nt, Human
agcuuugcccaaugaguuaugu

SEQ ID NO: 137824 - RNA, 22 nt, Human
aggaaaaugaaggaagugggaa

SEQ ID NO: 137825 - RNA, 20 nt, Human
agcugucccugacacuagga

SEQ ID NO: 137826 - RNA, 22 nt, Human
agcugugaccuucaagagcuac

SEQ ID NO: 137827 - RNA, 22 nt, Human
aggaaauaguuuagucccaaaa

SEQ ID NO: 137828 - RNA, 22 nt, Human
agcuggauuaaucacagugacu

SEQ ID NO: 137829 - RNA, 22 nt, Human
aggaagccuggaguccugccca

SEQ ID NO: 137830 - RNA, 20 nt, Human
aggaaggagaaucugagcaa

SEQ ID NO: 137831 - RNA, 22 nt, Human
aggacucagcgucugucucccg

SEQ ID NO: 137832 - RNA, 22 nt, Human
aggacuguauacucuaggugaa

SEQ ID NO: 137833 - RNA, 22 nt, Human
aggacacuuccugaguggacaa

SEQ ID NO: 137834 - RNA, 22 nt, Human
aggacagagggaccagagccca

SEQ ID NO: 137835 - RNA, 22 nt, Human
agcuuugucccaagugcucugg

SEQ ID NO: 137836 - RNA, 22 nt, Human
agcuuggcaagcacuguuugag

SEQ ID NO: 137837 - RNA, 22 nt, Human
agcugcuuuacuggucggcugg

SEQ ID NO: 137838 - RNA, 22 nt, Human
agcugugccuauucguggcaag

SEQ ID NO: 137839 - RNA, 22 nt, Human
agcugugaccaguuacgaaauu

SEQ ID NO: 137840 - RNA, 20 nt, Human
agcuggcccccgguggccug

SEQ ID NO: 137841 - RNA, 22 nt, Human
agcuugaugaaagugggugcuc

SEQ ID NO: 137842 - RNA, 22 nt, Human
agcuugagauaauucaagcuga

SEQ ID NO: 137843 - RNA, 22 nt, Human
agcuguugaccuucccuuucag

SEQ ID NO: 137844 - RNA, 19 nt, Human
agcuuauuuacugcaggac

SEQ ID NO: 137845 - RNA, 22 nt, Human
agcugaggccccgcagcagggu

SEQ ID NO: 137846 - RNA, 22 nt, Human
agcucuuccuccauucuggcca

SEQ ID NO: 137847 - RNA, 22 nt, Human
agcugauugucuuuuuaaaagu

SEQ ID NO: 137848 - RNA, 22 nt, Human
agcugaugucucaccuguuaga

SEQ ID NO: 137849 - RNA, 22 nt, Human
agcugacagugcauggagggac

SEQ ID NO: 137850 - RNA, 22 nt, Human
agcugaccugauugcuuuucag

SEQ ID NO: 137851 - RNA, 22 nt, Human
agcugcugcaaguggugcuaac

SEQ ID NO: 137852 - RNA, 22 nt, Human
agcucacucaaguaccuggggu

SEQ ID NO: 137853 - RNA, 22 nt, Human
agcucggcuguccugugccccu

SEQ ID NO: 137854 - RNA, 22 nt, Human
agcucugugcaggcagaggcau

SEQ ID NO: 137855 - RNA, 19 nt, Human
agcucaggcccaucguccc

SEQ ID NO: 137856 - RNA, 22 nt, Human
agcucugcuucuugggaagaug

SEQ ID NO: 137857 - RNA, 22 nt, Human
agcggcgcgucuccgagcugga

SEQ ID NO: 137858 - RNA, 22 nt, Human
agcggugacauccuucugugcu

SEQ ID NO: 137859 - RNA, 22 nt, Human
agcuccugcgcacggugcacac

SEQ ID NO: 137860 - RNA, 22 nt, Human
agcgcucauuuuccuccugcuc

SEQ ID NO: 137861 - RNA, 22 nt, Human
agcgcuguguucccgugggcau

SEQ ID NO: 137862 - RNA, 22 nt, Human
agcgagccugugcacuucuaac

SEQ ID NO: 137863 - RNA, 22 nt, Human
agcgggucaugucggccgccca

SEQ ID NO: 137864 - RNA, 22 nt, Human
agcggcaggaagcgcgcaagcg

SEQ ID NO: 137865 - RNA, 22 nt, Human
agcggcaagguguauguggcag

SEQ ID NO: 137866 - RNA, 19 nt, Human
agcggccgccgcgggcgcc

SEQ ID NO: 137867 - RNA, 22 nt, Human
agcgcccguugagucgcgcggu

SEQ ID NO: 137868 - RNA, 22 nt, Human
agcgcaguuaccgcgcggggcu

SEQ ID NO: 137869 - RNA, 22 nt, Human
agccgcgcuguuccugcugcug

SEQ ID NO: 137870 - RNA, 23 nt, Human
agcccagcagagaaccuaggucc

SEQ ID NO: 137871 - RNA, 22 nt, Human
agcauuucuacugugucagaaa

SEQ ID NO: 137872 - RNA, 22 nt, Human
agcauucuguggucuucuaugg

SEQ ID NO: 137873 - RNA, 22 nt, Human
agcauucccuuugcagugucau

SEQ ID NO: 137874 - RNA, 22 nt, Human
agcccugaccuguccuguucug

SEQ ID NO: 137875 - RNA, 22 nt, Human
agcccuauacuuagauuuauuc

SEQ ID NO: 137876 - RNA, 22 nt, Human
agcccgggagggcugucuggga

SEQ ID NO: 137877 - RNA, 22 nt, Human
agccuggagcaggcucugcucu

SEQ ID NO: 137878 - RNA, 22 nt, Human
agcaucggacggagcaccugcu

SEQ ID NO: 137879 - RNA, 19 nt, Human
agcaucuccacagaaaaag

SEQ ID NO: 137880 - RNA, 22 nt, Human
agcaguuuauccucauaaugga

SEQ ID NO: 137881 - RNA, 22 nt, Human
agccagcauauauauaguugaa

SEQ ID NO: 137882 - RNA, 19 nt, Human
agcaguggagccaugccug

SEQ ID NO: 137883 - RNA, 22 nt, Human
agccacagucuguagccagcuu

SEQ ID NO: 137884 - RNA, 22 nt, Human
agcaggaggguuuuguagaguc

SEQ ID NO: 137885 - RNA, 22 nt, Human
agcaugaauugccauuuauuaa

SEQ ID NO: 137886 - RNA, 22 nt, Human
agcagcaggugaccucgaugcc

SEQ ID NO: 137887 - RNA, 19 nt, Human
agcagccaucgaccaugga

SEQ ID NO: 137888 - RNA, 22 nt, Human
agcagcaggcugggaugagucu

SEQ ID NO: 137889 - RNA, 22 nt, Human
agcacggugguuaagagagugg

SEQ ID NO: 137890 - RNA, 17 nt, Human
agcagcuggguugaucu

SEQ ID NO: 137891 - RNA, 22 nt, Human
agcacguucuucauuacuucac

SEQ ID NO: 137892 - RNA, 22 nt, Human
agcaggucagugguaaucaaaa

SEQ ID NO: 137893 - RNA, 22 nt, Human
agcaguucucugucuagcuaga

SEQ ID NO: 137894 - RNA, 18 nt, Human
agcaguugucucucucca

SEQ ID NO: 137895 - RNA, 22 nt, Human
aggccagugcagcuggaacaga

SEQ ID NO: 137896 - RNA, 22 nt, Human
aggauggaaguaacuggauaau

SEQ ID NO: 137897 - RNA, 22 nt, Human
aggccagggacaaugaggcaga

SEQ ID NO: 137898 - RNA, 22 nt, Human
aggcugccuaugaaggcagaag

SEQ ID NO: 137899 - RNA, 22 nt, Human
aggccgcuggggcagcgcccga

SEQ ID NO: 137900 - RNA, 22 nt, Human
aggccgcgguggcgaaggcguu

SEQ ID NO: 137901 - RNA, 22 nt, Human
aggccugaggaccagauaaaug

SEQ ID NO: 137902 - RNA, 22 nt, Human
aggccgguggaggagguggagg

SEQ ID NO: 137903 - RNA, 22 nt, Human
aggccugcccuuggggagccuu

SEQ ID NO: 137904 - RNA, 22 nt, Human
agggaaguucuagggagucugg

SEQ ID NO: 137905 - RNA, 21 nt, Human
aggcuuggaucuagacaggcc

SEQ ID NO: 137906 - RNA, 22 nt, Human
aggcugucucaccucaggaggg

SEQ ID NO: 137907 - RNA, 22 nt, Human
aggcgaagggaccagacgguag

SEQ ID NO: 137908 - RNA, 23 nt, Human
aggcugccacucagggugaggcu

SEQ ID NO: 137909 - RNA, 22 nt, Human
aggcggguuuaggacaaugcuu

SEQ ID NO: 137910 - RNA, 19 nt, Human
aggcugccucacccucccu

SEQ ID NO: 137911 - RNA, 22 nt, Human
aggcugcuggcaggcguggacg

SEQ ID NO: 137912 - RNA, 22 nt, Human
agggagcugcucugcuuccgug

SEQ ID NO: 137913 - RNA, 22 nt, Human
agggaagccggagcgacggggg

SEQ ID NO: 137914 - RNA, 22 nt, Human
agggcuugggggccuugaaggc

SEQ ID NO: 137915 - RNA, 22 nt, Human
aggggaggcugcgggcugccgu

SEQ ID NO: 137916 - RNA, 20 nt, Human
aggggcuguaguuagaugac

SEQ ID NO: 137917 - RNA, 22 nt, Human
aggggcugagaguuugaugugg

SEQ ID NO: 137918 - RNA, 20 nt, Human
agggucucuccuggcucugc

SEQ ID NO: 137919 - RNA, 22 nt, Human
agguagcuggugcugggcuccu

SEQ ID NO: 137920 - RNA, 22 nt, Human
agguaguagagaacucugcucu

SEQ ID NO: 137921 - RNA, 22 nt, Human
aggggauggagcuggaaggcag

SEQ ID NO: 137922 - RNA, 22 nt, Human
aggguuugugaagacuuggcca

SEQ ID NO: 137923 - RNA, 21 nt, Human
agguagauagccccaggaagg

SEQ ID NO: 137924 - RNA, 22 nt, Human
aggucgugggugagagagagac

SEQ ID NO: 137925 - RNA, 22 nt, Human
aggugcacugguacaggcuuca

SEQ ID NO: 137926 - RNA, 22 nt, Human
agguaugucccccgagugcagc

SEQ ID NO: 137927 - RNA, 22 nt, Human
agguauaguuauuucugcuccc

SEQ ID NO: 137928 - RNA, 22 nt, Human
agugaagauagagccaggucug

SEQ ID NO: 137929 - RNA, 22 nt, Human
agucuagcagagauaaagacgu

SEQ ID NO: 137930 - RNA, 22 nt, Human
agucggggagcgugaccagaga

SEQ ID NO: 137931 - RNA, 22 nt, Human
agucuagagcuuuuaucaggcc

SEQ ID NO: 137932 - RNA, 22 nt, Human
agucggguugcagacacauccu

SEQ ID NO: 137933 - RNA, 22 nt, Human
aguccagggcuuagucagcggg

SEQ ID NO: 137934 - RNA, 22 nt, Human
agucaacauuugagaugcaaug

SEQ ID NO: 137935 - RNA, 20 nt, Human
agucacagacccucagguag

SEQ ID NO: 137936 - RNA, 22 nt, Human
agucagaaggugucagaucuug

SEQ ID NO: 137937 - RNA, 22 nt, Human
agucaguguagaaagcccaggc

SEQ ID NO: 137938 - RNA, 22 nt, Human
agucaccuacagcucaugcuuc

SEQ ID NO: 137939 - RNA, 22 nt, Human
agucaguaugacuuauaguucu

SEQ ID NO: 137940 - RNA, 22 nt, Human
agucacacagccugacaaugga

SEQ ID NO: 137941 - RNA, 21 nt, Human
agucaagcugccugcuuggca

SEQ ID NO: 137942 - RNA, 22 nt, Human
aguauugguaaguguagcaaau

SEQ ID NO: 137943 - RNA, 23 nt, Human
aguauuguucaucuucaagacag

SEQ ID NO: 137944 - RNA, 22 nt, Human
aguaucuuccucaugaacacgu

SEQ ID NO: 137945 - RNA, 22 nt, Human
aguauucaguuagugagcuaag

SEQ ID NO: 137946 - RNA, 22 nt, Human
aguaucugccagaaucucaguu

SEQ ID NO: 137947 - RNA, 22 nt, Human
aguaucuauaucaaaaauggcu

SEQ ID NO: 137948 - RNA, 22 nt, Human
aguauccauccugcuguuucua

SEQ ID NO: 137949 - RNA, 21 nt, Human
aguagucgauucaggagaagu

SEQ ID NO: 137950 - RNA, 22 nt, Human
aguaaucgugaucgagagauca

SEQ ID NO: 137951 - RNA, 22 nt, Human
aguauagacaucaaacugaaga

SEQ ID NO: 137952 - RNA, 22 nt, Human
agguuuggguucauugcuggcu

SEQ ID NO: 137953 - RNA, 22 nt, Human
aggugcccucucuggcuccucc

SEQ ID NO: 137954 - RNA, 22 nt, Human
aggucugcccaggaugcugcuu

SEQ ID NO: 137955 - RNA, 22 nt, Human
agguggcguauguguucguguu

SEQ ID NO: 137956 - RNA, 22 nt, Human
agguggugacgaugcuccguac

SEQ ID NO: 137957 - RNA, 22 nt, Human
aggugggucgcaggcaucagug

SEQ ID NO: 137958 - RNA, 22 nt, Human
agguggucccaauggcugggca

SEQ ID NO: 137959 - RNA, 22 nt, Human
agguggucuuguggaugccgca

SEQ ID NO: 137960 - RNA, 22 nt, Human
auaggcauaacacugauguccu

SEQ ID NO: 137961 - RNA, 22 nt, Human
auaguguguaaagugcagugau

SEQ ID NO: 137962 - RNA, 22 nt, Human
auaugagaggaggagcaucagu

SEQ ID NO: 137963 - RNA, 22 nt, Human
auaugcacauguacauguauau

SEQ ID NO: 137964 - RNA, 22 nt, Human
auauaguuggguuucauucuac

SEQ ID NO: 137965 - RNA, 22 nt, Human
auagcaacucugcuuccuugcc

SEQ ID NO: 137966 - RNA, 22 nt, Human
auauuucuacaggcugauuuua

SEQ ID NO: 137967 - RNA, 22 nt, Human
auagcacuuaauaugaaacagu

SEQ ID NO: 137968 - RNA, 22 nt, Human
auagggaggcggagggagcugg

SEQ ID NO: 137969 - RNA, 22 nt, Human
auagcuauuauuauuucuguua

SEQ ID NO: 137970 - RNA, 22 nt, Human
auagcaucaugcuaucccccuu

SEQ ID NO: 137971 - RNA, 22 nt, Human
auaguuuuagauacugagaaaa

SEQ ID NO: 137972 - RNA, 22 nt, Human
auagaagugaaaagggaugacu

SEQ ID NO: 137973 - RNA, 22 nt, Human
auacaugacucacacauucugc

SEQ ID NO: 137974 - RNA, 22 nt, Human
auagauuuuaucagauuuuauc

SEQ ID NO: 137975 - RNA, 20 nt, Human
auagaguggugugucacauu

SEQ ID NO: 137976 - RNA, 22 nt, Human
auagacuagccaaagacuucug

SEQ ID NO: 137977 - RNA, 22 nt, Human
agugaaagaaaacuguuagaac

SEQ ID NO: 137978 - RNA, 21 nt, Human
agugagauuuaugccugguuc

SEQ ID NO: 137979 - RNA, 23 nt, Human
auacuuuuuuucuacguuaucuc

SEQ ID NO: 137980 - RNA, 22 nt, Human
agugaggggagaaugaggugga

SEQ ID NO: 137981 - RNA, 22 nt, Human
aucauccuagaaggaagcuagg

SEQ ID NO: 137982 - RNA, 22 nt, Human
aucaucccuuucucccagugaa

SEQ ID NO: 137983 - RNA, 22 nt, Human
aucaugcgguuaaggagugugu

SEQ ID NO: 137984 - RNA, 22 nt, Human
aucagugcacgcgaugggcaga

SEQ ID NO: 137985 - RNA, 22 nt, Human
auccucaaggaauuaaauaggg

SEQ ID NO: 137986 - RNA, 22 nt, Human
aucaugugacuagguuuggcca

SEQ ID NO: 137987 - RNA, 20 nt, Human
aucaugugcacugcugacag

SEQ ID NO: 137988 - RNA, 22 nt, Human
aucauugcuaguaaggaucuug

SEQ ID NO: 137989 - RNA, 22 nt, Human
auccugauggaaacugguauga

SEQ ID NO: 137990 - RNA, 22 nt, Human
auccgugagcgagcgagcaccc

SEQ ID NO: 137991 - RNA, 22 nt, Human
aucccuggccacgaagcugccc

SEQ ID NO: 137992 - RNA, 22 nt, Human
aucuaaaacuacgaauacuacc

SEQ ID NO: 137993 - RNA, 22 nt, Human
aucggucuccuauaauucaaac

SEQ ID NO: 137994 - RNA, 23 nt, Human
aucgcccggguccagucccggcu

SEQ ID NO: 137995 - RNA, 22 nt, Human
aucccacaccccuacaacauau

SEQ ID NO: 137996 - RNA, 22 nt, Human
aucgaguggugagaacacaaca

SEQ ID NO: 137997 - RNA, 22 nt, Human
auccaggggucugaauggauau

SEQ ID NO: 137998 - RNA, 22 nt, Human
auccacccugcaggccaacucu

SEQ ID NO: 137999 - RNA, 22 nt, Human
aucgcagaguggaaauugauga

SEQ ID NO: 138000 - RNA, 22 nt, Human
aucagagcuaguacuugcaggu

SEQ ID NO: 138001 - RNA, 22 nt, Human
aucaucuaaaauuggcucagau

SEQ ID NO: 138002 - RNA, 22 nt, Human
aucaugcugacacaguuuaucu

SEQ ID NO: 138003 - RNA, 22 nt, Human
aucagaagaaauggaugugacu

SEQ ID NO: 138004 - RNA, 22 nt, Human
aucacugcaggcauauaggggu

SEQ ID NO: 138005 - RNA, 19 nt, Human
aucagcaguuuugccugga

SEQ ID NO: 138006 - RNA, 22 nt, Human
aucagcucuugaugccuuucuu

SEQ ID NO: 138007 - RNA, 22 nt, Human
aucauaccaguuuccaucagga

SEQ ID NO: 138008 - RNA, 22 nt, Human
aucaauaaccauagugguuaca

SEQ ID NO: 138009 - RNA, 22 nt, Human
aucacuagaguuacauugccag

SEQ ID NO: 138010 - RNA, 22 nt, Human
aucacacaccuguuaaauugug

SEQ ID NO: 138011 - RNA, 22 nt, Human
auauuuuugcagaauuuuucgu

SEQ ID NO: 138012 - RNA, 22 nt, Human
auauuugcccccaugcccuggc

SEQ ID NO: 138013 - RNA, 22 nt, Human
auauucaaugaggucauauaag

SEQ ID NO: 138014 - RNA, 22 nt, Human
auauuauuaaaauagauggaua

SEQ ID NO: 138015 - RNA, 22 nt, Human
aucaaacuaugguccaugggca

SEQ ID NO: 138016 - RNA, 22 nt, Human
augauuaagguacgucauuucu

SEQ ID NO: 138017 - RNA, 22 nt, Human
augaauuugaacaccagguugg

SEQ ID NO: 138018 - RNA, 22 nt, Human
augacuguuaugaggugggugg

SEQ ID NO: 138019 - RNA, 22 nt, Human
augcacuugacucuauuccaca

SEQ ID NO: 138020 - RNA, 22 nt, Human
augcacuccucagcuguucugg

SEQ ID NO: 138021 - RNA, 19 nt, Human
augagccccaguucguucc

SEQ ID NO: 138022 - RNA, 22 nt, Human
augagaaauaauuguguacuga

SEQ ID NO: 138023 - RNA, 22 nt, Human
augacugaugcugacucauggg

SEQ ID NO: 138024 - RNA, 22 nt, Human
aucuucucucucaucaggauca

SEQ ID NO: 138025 - RNA, 22 nt, Human
augagcucuaaguacaugccca

SEQ ID NO: 138026 - RNA, 22 nt, Human
augaaacucuagcuuucagcac

SEQ ID NO: 138027 - RNA, 21 nt, Human
aucucaguccugggaaugauu

SEQ ID NO: 138028 - RNA, 23 nt, Human
augaacgcacugagaucauaauu

SEQ ID NO: 138029 - RNA, 22 nt, Human
aucugcuguaguuggugccagu

SEQ ID NO: 138030 - RNA, 23 nt, Human
augaaaugauacuuuauucacug

SEQ ID NO: 138031 - RNA, 22 nt, Human
augaaaacgugugugugugugu

SEQ ID NO: 138032 - RNA, 18 nt, Human
augcugacacaaugugga

SEQ ID NO: 138033 - RNA, 22 nt, Human
augcuugcccauguuucugaag

SEQ ID NO: 138034 - RNA, 22 nt, Human
auggccuuucucaguggugcuu

SEQ ID NO: 138035 - RNA, 22 nt, Human
augcugcuuguccauuuauuug

SEQ ID NO: 138036 - RNA, 22 nt, Human
augccugcugucaggaacucuu

SEQ ID NO: 138037 - RNA, 22 nt, Human
augccucuugagagccagugcu

SEQ ID NO: 138038 - RNA, 21 nt, Human
augcgcgguggagugagcgaa

SEQ ID NO: 138039 - RNA, 22 nt, Human
augaucacagugucagucauua

SEQ ID NO: 138040 - RNA, 22 nt, Human
augcagcggucagaggaacuca

SEQ ID NO: 138041 - RNA, 22 nt, Human
augaucaagaauuuuguauucc

SEQ ID NO: 138042 - RNA, 19 nt, Human
augcacgugaaaugcauuu

SEQ ID NO: 138043 - RNA, 22 nt, Human
augcccugggagugcuguacca

SEQ ID NO: 138044 - RNA, 22 nt, Human
augccgggguggcuccagcacc

SEQ ID NO: 138045 - RNA, 22 nt, Human
augcaggcuaagaguaaagacg

SEQ ID NO: 138046 - RNA, 22 nt, Human
augcugacaacaaagaaggaag

SEQ ID NO: 138047 - RNA, 22 nt, Human
augcggcugugggggaauggga

SEQ ID NO: 138048 - RNA, 22 nt, Human
augcacuacuagaugcaaaagu

SEQ ID NO: 138049 - RNA, 22 nt, Human
augcacuaugaugagcuagucu

SEQ ID NO: 138050 - RNA, 22 nt, Human
auuaagucugacuggauuguau

SEQ ID NO: 138051 - RNA, 22 nt, Human
auuaagacugcccauguuuuua

SEQ ID NO: 138052 - RNA, 18 nt, Human
auguuccugcaguuauuu

SEQ ID NO: 138053 - RNA, 22 nt, Human
auuaauaucaauauauuauaug

SEQ ID NO: 138054 - RNA, 22 nt, Human
auuaaguuauuaagcuaaauau

SEQ ID NO: 138055 - RNA, 22 nt, Human
auuagaagagcuuuuuacucuu

SEQ ID NO: 138056 - RNA, 22 nt, Human
auuaauguguaugauauaaauu

SEQ ID NO: 138057 - RNA, 22 nt, Human
auuacugaggcaaaguaguuuu

SEQ ID NO: 138058 - RNA, 22 nt, Human
auuaucugacugaguagucugu

SEQ ID NO: 138059 - RNA, 22 nt, Human
auuaucuauccgccaacaguaa

SEQ ID NO: 138060 - RNA, 22 nt, Human
auuauaguuuugcccuuaagaa

SEQ ID NO: 138061 - RNA, 21 nt, Human
auuauagugacuaaauugaua

SEQ ID NO: 138062 - RNA, 22 nt, Human
auguuuuuugaaaauguauuuu

SEQ ID NO: 138063 - RNA, 22 nt, Human
auuauacauuaggagauugauu

SEQ ID NO: 138064 - RNA, 22 nt, Human
auucaccaucuugauccccucu

SEQ ID NO: 138065 - RNA, 22 nt, Human
auguuccaugacuaugcaugaa

SEQ ID NO: 138066 - RNA, 22 nt, Human
auguaaauauuuauauaugcau

SEQ ID NO: 138067 - RNA, 20 nt, Human
augucaggaagggagucagg

SEQ ID NO: 138068 - RNA, 22 nt, Human
augugcacuggugugugcguuc

SEQ ID NO: 138069 - RNA, 22 nt, Human
augguuuugugaaaaugcuuug

SEQ ID NO: 138070 - RNA, 22 nt, Human
auguuagcaucuggcacuaugg

SEQ ID NO: 138071 - RNA, 22 nt, Human
auggccguggccagggucaggg

SEQ ID NO: 138072 - RNA, 18 nt, Human
auggcuccagugucuucc

SEQ ID NO: 138073 - RNA, 22 nt, Human
augguuuuguccucuuugguuc

SEQ ID NO: 138074 - RNA, 22 nt, Human
auguaacauaugugaucgcauu

SEQ ID NO: 138075 - RNA, 22 nt, Human
augugaaauuugggcucuggga

SEQ ID NO: 138076 - RNA, 22 nt, Human
augugagcuggaugaauuuaua

SEQ ID NO: 138077 - RNA, 22 nt, Human
augugaacuccagcugccaacc

SEQ ID NO: 138078 - RNA, 22 nt, Human
caaggaguuuggggaccaagga

SEQ ID NO: 138079 - RNA, 22 nt, Human
caagucucuagaaugcaauagu

SEQ ID NO: 138080 - RNA, 22 nt, Human
caaaacccaagugcuauugcaa

SEQ ID NO: 138081 - RNA, 22 nt, Human
caagaaccuagcgaucagguaa

SEQ ID NO: 138082 - RNA, 22 nt, Human
caagcgcgccgcuuccuuccgc

SEQ ID NO: 138083 - RNA, 22 nt, Human
caaagaagagauuuacagagcu

SEQ ID NO: 138084 - RNA, 22 nt, Human
caagaugcaagaccagucaggc

SEQ ID NO: 138085 - RNA, 17 nt, Human
caaccaggaaaggaggg

SEQ ID NO: 138086 - RNA, 22 nt, Human
caaccucuaucggucaggaagc

SEQ ID NO: 138087 - RNA, 22 nt, Human
caacguggauucuuccaggggc

SEQ ID NO: 138088 - RNA, 22 nt, Human
caacaaguugauuucacgcugc

SEQ ID NO: 138089 - RNA, 22 nt, Human
caacacaucaguucagucuuga

SEQ ID NO: 138090 - RNA, 22 nt, Human
caacauuucaaggucuuuagga

SEQ ID NO: 138091 - RNA, 20 nt, Human
caacacugcccauuguuugc

SEQ ID NO: 138092 - RNA, 22 nt, Human
cacaagacuaaguggcagagca

SEQ ID NO: 138093 - RNA, 22 nt, Human
caaaguauuuagcugacucgcu

SEQ ID NO: 138094 - RNA, 22 nt, Human
caauagcuauguaaccugaaga

SEQ ID NO: 138095 - RNA, 22 nt, Human
caaugccaggaaccugggggaa

SEQ ID NO: 138096 - RNA, 22 nt, Human
caaugcacauggacaucaggcu

SEQ ID NO: 138097 - RNA, 22 nt, Human
caauccccaggucccagaacag

SEQ ID NO: 138098 - RNA, 22 nt, Human
caaaugcaguggucgugcugga

SEQ ID NO: 138099 - RNA, 22 nt, Human
caaauggggaauagaugauggg

SEQ ID NO: 138100 - RNA, 22 nt, Human
caaguugcaugugcuugaaaua

SEQ ID NO: 138101 - RNA, 22 nt, Human
caccuggaggcagcaccgggcu

SEQ ID NO: 138102 - RNA, 22 nt, Human
caccuuccgcccacugaccgcc

SEQ ID NO: 138103 - RNA, 22 nt, Human
caccucagagcuccuucuucuc

SEQ ID NO: 138104 - RNA, 22 nt, Human
caccugcaaauuccagauuucu

SEQ ID NO: 138105 - RNA, 22 nt, Human
cacccugacuggcccugcagga

SEQ ID NO: 138106 - RNA, 22 nt, Human
caagguuucgaguucccaacca

SEQ ID NO: 138107 - RNA, 22 nt, Human
caaggguguacagauaugagag

SEQ ID NO: 138108 - RNA, 22 nt, Human
caccaucagacuucugggcagg

SEQ ID NO: 138109 - RNA, 22 nt, Human
cacaugugugugccuacaugca

SEQ ID NO: 138110 - RNA, 22 nt, Human
cacauugguagaauuuagaaga

SEQ ID NO: 138111 - RNA, 22 nt, Human
cacaugugggcacagggcugca

SEQ ID NO: 138112 - RNA, 22 nt, Human
caagcacaauuucuacauguua

SEQ ID NO: 138113 - RNA, 22 nt, Human
caagccacugggagcugcacac

SEQ ID NO: 138114 - RNA, 22 nt, Human
caagcagauauuuuagucaaga

SEQ ID NO: 138115 - RNA, 23 nt, Human
cacaggcagaaaucaagacggua

SEQ ID NO: 138116 - RNA, 22 nt, Human
cacaggacuuggcuucucacag

SEQ ID NO: 138117 - RNA, 22 nt, Human
caagagguaugagccgggauga

SEQ ID NO: 138118 - RNA, 22 nt, Human
cacauaguuuaucuucauuuuc

SEQ ID NO: 138119 - RNA, 22 nt, Human
cacagaggaugcccaagcgauc

SEQ ID NO: 138120 - RNA, 22 nt, Human
cacacguuucuacugcugccaa

SEQ ID NO: 138121 - RNA, 22 nt, Human
cacagccaagacuuggccccau

SEQ ID NO: 138122 - RNA, 22 nt, Human
cacagcaggcagaacgugggca

SEQ ID NO: 138123 - RNA, 22 nt, Human
cacacgagcccuggagccagca

SEQ ID NO: 138124 - RNA, 20 nt, Human
cacagcugacgaguauccaa

SEQ ID NO: 138125 - RNA, 23 nt, Human
auuuuuccacacacagacucagu

SEQ ID NO: 138126 - RNA, 22 nt, Human
caacaagcgcucagagcaaagc

SEQ ID NO: 138127 - RNA, 22 nt, Human
caaauacaaauacgggcagcuu

SEQ ID NO: 138128 - RNA, 22 nt, Human
caaaacauucagagagcucacu

SEQ ID NO: 138129 - RNA, 22 nt, Human
auuuuuuuggucauaugagaua

SEQ ID NO: 138130 - RNA, 22 nt, Human
auuuuagagaaacaaacguagg

SEQ ID NO: 138131 - RNA, 22 nt, Human
auuuuucucucaugugcaacua

SEQ ID NO: 138132 - RNA, 21 nt, Human
auuuggucaaugucugcguga

SEQ ID NO: 138133 - RNA, 22 nt, Human
auuuggaaacaugcugaccaug

SEQ ID NO: 138134 - RNA, 22 nt, Human
auuuggaaggcguuucucugua

SEQ ID NO: 138135 - RNA, 22 nt, Human
auuuagagaaguagcaaggucc

SEQ ID NO: 138136 - RNA, 22 nt, Human
auugaguauuguaaauaaaaca

SEQ ID NO: 138137 - RNA, 22 nt, Human
auugaaauuaauuucugcuuuc

SEQ ID NO: 138138 - RNA, 22 nt, Human
auuagcaccccuggauguggga

SEQ ID NO: 138139 - RNA, 22 nt, Human
auuuccugugaacuuuucugau

SEQ ID NO: 138140 - RNA, 22 nt, Human
auuuauuugaagagccauugca

SEQ ID NO: 138141 - RNA, 22 nt, Human
auuucacucuuaauugcuuccu

SEQ ID NO: 138142 - RNA, 22 nt, Human
auuuauuuucccucaaguaccu

SEQ ID NO: 138143 - RNA, 22 nt, Human
caggcagagagggcagugugga

SEQ ID NO: 138144 - RNA, 22 nt, Human
caggccacagcuaaagaggauu

SEQ ID NO: 138145 - RNA, 22 nt, Human
caggcaggagaaaaggcgcggg

SEQ ID NO: 138146 - RNA, 22 nt, Human
caggcagggcugccuucugcuu

SEQ ID NO: 138147 - RNA, 22 nt, Human
cagggcaucucugaaucuucac

SEQ ID NO: 138148 - RNA, 22 nt, Human
caggccgcccucuccuguuagc

SEQ ID NO: 138149 - RNA, 20 nt, Human
caggccuucaggauggcugg

SEQ ID NO: 138150 - RNA, 22 nt, Human
cagggagcggggagaucucggg

SEQ ID NO: 138151 - RNA, 22 nt, Human
cagggacgugagccaugucagu

SEQ ID NO: 138152 - RNA, 22 nt, Human
caggcgcugacgggaccgggcu

SEQ ID NO: 138153 - RNA, 22 nt, Human
caggcgcauggugagcagauga

SEQ ID NO: 138154 - RNA, 22 nt, Human
cauccagcuccugggggccacc

SEQ ID NO: 138155 - RNA, 22 nt, Human
caucccaacaggugaucuggua

SEQ ID NO: 138156 - RNA, 22 nt, Human
caguagcuuuuugcagacaaga

SEQ ID NO: 138157 - RNA, 22 nt, Human
cagguauuugaaggcaguggga

SEQ ID NO: 138158 - RNA, 22 nt, Human
cagguuguucugggcauggagg

SEQ ID NO: 138159 - RNA, 22 nt, Human
cagguugucuaauuccaagggg

SEQ ID NO: 138160 - RNA, 22 nt, Human
caugggcucuucuggacugcac

SEQ ID NO: 138161 - RNA, 22 nt, Human
caugcuggcacugaccagccua

SEQ ID NO: 138162 - RNA, 22 nt, Human
caugcuucccacauuccgauuu

SEQ ID NO: 138163 - RNA, 22 nt, Human
cauggcacagaagaugucguuu

SEQ ID NO: 138164 - RNA, 22 nt, Human
caugcuaacacguugcucaccg

SEQ ID NO: 138165 - RNA, 22 nt, Human
caugccugaucagcggccagca

SEQ ID NO: 138166 - RNA, 22 nt, Human
caugccaguagccggcuugacu

SEQ ID NO: 138167 - RNA, 22 nt, Human
caugccucuguuuuaguuguug

SEQ ID NO: 138168 - RNA, 22 nt, Human
caugcagcagaauaaugacuau

SEQ ID NO: 138169 - RNA, 22 nt, Human
caguuuuggaagaaacaaggaa

SEQ ID NO: 138170 - RNA, 22 nt, Human
caguugcagagugauguguuug

SEQ ID NO: 138171 - RNA, 22 nt, Human
caguugcuauugagagaacaca

SEQ ID NO: 138172 - RNA, 22 nt, Human
caguucaagauuguugcuuucu

SEQ ID NO: 138173 - RNA, 22 nt, Human
caguggacacuuccucuacaau

SEQ ID NO: 138174 - RNA, 22 nt, Human
caugaccauuuggguuugugcg

SEQ ID NO: 138175 - RNA, 23 nt, Human
cagucgacugugcccucccgagc

SEQ ID NO: 138176 - RNA, 22 nt, Human
cagucucuggugaguugacagu

SEQ ID NO: 138177 - RNA, 22 nt, Human
cagugcaacguugugcauucaa

SEQ ID NO: 138178 - RNA, 22 nt, Human
cagcucuccacccuccugguuc

SEQ ID NO: 138179 - RNA, 22 nt, Human
cagcucgaauaauggagaacug

SEQ ID NO: 138180 - RNA, 22 nt, Human
caggacacaaaagguggagaag

SEQ ID NO: 138181 - RNA, 22 nt, Human
caggaagucugaauucugagag

SEQ ID NO: 138182 - RNA, 22 nt, Human
caggaggaaaguuccacucaac

SEQ ID NO: 138183 - RNA, 21 nt, Human
caggccaaaagguucaacauu

SEQ ID NO: 138184 - RNA, 22 nt, Human
caggguugaugaauugucugua

SEQ ID NO: 138185 - RNA, 22 nt, Human
cagggggacuuguuagguuuua

SEQ ID NO: 138186 - RNA, 22 nt, Human
cagcuuauggcuucuccaguag

SEQ ID NO: 138187 - RNA, 22 nt, Human
cagggcacaguuauggaggugg

SEQ ID NO: 138188 - RNA, 22 nt, Human
cagggcagaguuaagaugcugg

SEQ ID NO: 138189 - RNA, 22 nt, Human
cagggcuugaaucaaggaaguc

SEQ ID NO: 138190 - RNA, 22 nt, Human
cagccuacaucagaauaccaau

SEQ ID NO: 138191 - RNA, 22 nt, Human
cagaucacucugggcggcggga

SEQ ID NO: 138192 - RNA, 20 nt, Human
cagaucuuauguuuuucugu

SEQ ID NO: 138193 - RNA, 22 nt, Human
cagauguuugaaugcuuaccac

SEQ ID NO: 138194 - RNA, 22 nt, Human
cagcacaggugugaggccugau

SEQ ID NO: 138195 - RNA, 22 nt, Human
cagcagccuccccggccgaccu

SEQ ID NO: 138196 - RNA, 22 nt, Human
cagacagagucuucccaucagu

SEQ ID NO: 138197 - RNA, 22 nt, Human
cagacagaaggcuccuugaggu

SEQ ID NO: 138198 - RNA, 22 nt, Human
cagcaugcaaguccagaugugg

SEQ ID NO: 138199 - RNA, 22 nt, Human
cagcaugguggagcugcucuuu

SEQ ID NO: 138200 - RNA, 23 nt, Human
cagagaaaauagaauaugcugug

SEQ ID NO: 138201 - RNA, 22 nt, Human
cagcccaggcucagauguuggg

SEQ ID NO: 138202 - RNA, 22 nt, Human
cagcugcgcagcgccgggccug

SEQ ID NO: 138203 - RNA, 22 nt, Human
cagcugcugguguaucgggucc

SEQ ID NO: 138204 - RNA, 22 nt, Human
cagaucacauccauccgucacc

SEQ ID NO: 138205 - RNA, 22 nt, Human
cagcuccagcccaggcagcucc

SEQ ID NO: 138206 - RNA, 22 nt, Human
cagcuccaucuugcuuauacca

SEQ ID NO: 138207 - RNA, 22 nt, Human
cagcucuggcuauugaggacca

SEQ ID NO: 138208 - RNA, 22 nt, Human
cagaguccugcaccagcuccag

SEQ ID NO: 138209 - RNA, 22 nt, Human
cagaggagcgaguuggacgcca

SEQ ID NO: 138210 - RNA, 22 nt, Human
cagaggcugagcugcgggauga

SEQ ID NO: 138211 - RNA, 22 nt, Human
cagagggagcuaaccagcagcc

SEQ ID NO: 138212 - RNA, 22 nt, Human
cagaggaugucuacaccuugag

SEQ ID NO: 138213 - RNA, 22 nt, Human
cagauggagaaagagugaaugg

SEQ ID NO: 138214 - RNA, 22 nt, Human
cacacacacacacacucucaca

SEQ ID NO: 138215 - RNA, 22 nt, Human
caaugaaaauuuaaguugcagc

SEQ ID NO: 138216 - RNA, 22 nt, Human
caaucuucucuagaguauucua

SEQ ID NO: 138217 - RNA, 18 nt, Human
cacgcaacuguaaaaccc

SEQ ID NO: 138218 - RNA, 22 nt, Human
cagagcagaaaccugggugauu

SEQ ID NO: 138219 - RNA, 22 nt, Human
cagagaugaggcuggcgugguu

SEQ ID NO: 138220 - RNA, 22 nt, Human
cacacaccagaaagccugggac

SEQ ID NO: 138221 - RNA, 22 nt, Human
cuggaagcgucggaggaagggc

SEQ ID NO: 138222 - RNA, 22 nt, Human
cuggagaucaguuggacaacag

SEQ ID NO: 138223 - RNA, 22 nt, Human
cugagaucaugggucagguggu

SEQ ID NO: 138224 - RNA, 22 nt, Human
cugacugaggaucaguucauca

SEQ ID NO: 138225 - RNA, 22 nt, Human
cugaccugugagcuaugccggc

SEQ ID NO: 138226 - RNA, 22 nt, Human
cugagaaauacccaagucuggu

SEQ ID NO: 138227 - RNA, 22 nt, Human
cuggccaggugggggguagugg

SEQ ID NO: 138228 - RNA, 22 nt, Human
cuggccagccucccagguaccc

SEQ ID NO: 138229 - RNA, 22 nt, Human
cuggccugugggcugucuccgg

SEQ ID NO: 138230 - RNA, 22 nt, Human
cuggaugucugggaggcuuccc

SEQ ID NO: 138231 - RNA, 22 nt, Human
cuggaucgccccgaugugcccc

SEQ ID NO: 138232 - RNA, 22 nt, Human
cuggagucagcaaggacgaggc

SEQ ID NO: 138233 - RNA, 22 nt, Human
cuccuugguuccggcguuggag

SEQ ID NO: 138234 - RNA, 22 nt, Human
cucgccugacucggaugggcug

SEQ ID NO: 138235 - RNA, 22 nt, Human
cucggagggcaaguacuggcug

SEQ ID NO: 138236 - RNA, 22 nt, Human
cuggggccccagcucggccccu

SEQ ID NO: 138237 - RNA, 22 nt, Human
cucuccagucauauucucaguc

SEQ ID NO: 138238 - RNA, 22 nt, Human
cucucacucccuccuucccucu

SEQ ID NO: 138239 - RNA, 22 nt, Human
cuccggggacgcagucgccgcc

SEQ ID NO: 138240 - RNA, 22 nt, Human
cuggcuuucauggcgcaguuga

SEQ ID NO: 138241 - RNA, 22 nt, Human
cuccccacucaacucccagacc

SEQ ID NO: 138242 - RNA, 22 nt, Human
cuccagucccuccuugcccagc

SEQ ID NO: 138243 - RNA, 21 nt, Human
cucauuccccgucccggcccc

SEQ ID NO: 138244 - RNA, 22 nt, Human
cuggccuuaucacaaagcuaga

SEQ ID NO: 138245 - RNA, 22 nt, Human
cuucacuccuggagugaguuuc

SEQ ID NO: 138246 - RNA, 22 nt, Human
cugaguuuuucaaaucugaauu

SEQ ID NO: 138247 - RNA, 22 nt, Human
cugagcggugagggcauacagc

SEQ ID NO: 138248 - RNA, 22 nt, Human
cugagcugcucccgcugcagcg

SEQ ID NO: 138249 - RNA, 22 nt, Human
cugagaggcacaaggcauuucg

SEQ ID NO: 138250 - RNA, 22 nt, Human
cuguuuggaugccauggucaag

SEQ ID NO: 138251 - RNA, 22 nt, Human
cugaauucuuguugucggagca

SEQ ID NO: 138252 - RNA, 22 nt, Human
cugaaucugccuccgaggguuu

SEQ ID NO: 138253 - RNA, 20 nt, Human
cugaccagcagccugucucc

SEQ ID NO: 138254 - RNA, 22 nt, Human
cugaccucuaaguaacagagaa

SEQ ID NO: 138255 - RNA, 22 nt, Human
cugaccgugccgcgguacugcu

SEQ ID NO: 138256 - RNA, 22 nt, Human
cugaaggacacgugaggagcca

SEQ ID NO: 138257 - RNA, 22 nt, Human
cugugucucccaaggaggguca

SEQ ID NO: 138258 - RNA, 22 nt, Human
cucuggacaucugcggugcuuc

SEQ ID NO: 138259 - RNA, 22 nt, Human
cugugguuucuaugggccuuga

SEQ ID NO: 138260 - RNA, 22 nt, Human
cuguggguggcugugccccagg

SEQ ID NO: 138261 - RNA, 22 nt, Human
cuguggaaugcaguugcgagca

SEQ ID NO: 138262 - RNA, 22 nt, Human
cucugcuagaaggucaaucucu

SEQ ID NO: 138263 - RNA, 22 nt, Human
cuguauggaggaggugcuagcc

SEQ ID NO: 138264 - RNA, 22 nt, Human
cuguagaugucagguuaaugag

SEQ ID NO: 138265 - RNA, 22 nt, Human
cucuggggaagugcacucgcug

SEQ ID NO: 138266 - RNA, 19 nt, Human
cucuggcuccugggcugcc

SEQ ID NO: 138267 - RNA, 22 nt, Human
cuuggcauguucaucugcuugg

SEQ ID NO: 138268 - RNA, 22 nt, Human
cuugcugggagagcuuuagaga

SEQ ID NO: 138269 - RNA, 22 nt, Human
cuugcucugggaauaugaguuu

SEQ ID NO: 138270 - RNA, 22 nt, Human
cugcuauaacacuaacaucuaa

SEQ ID NO: 138271 - RNA, 22 nt, Human
cugcggcaccaaccccuucaug

SEQ ID NO: 138272 - RNA, 22 nt, Human
cuuggugcgaagagucagggga

SEQ ID NO: 138273 - RNA, 22 nt, Human
cuugggacucccuguagcagug

SEQ ID NO: 138274 - RNA, 22 nt, Human
cugcuguugagguuccaggcca

SEQ ID NO: 138275 - RNA, 22 nt, Human
cugcuggugcugcccacacggu

SEQ ID NO: 138276 - RNA, 22 nt, Human
cugcugucuuuauuucacugcu

SEQ ID NO: 138277 - RNA, 22 nt, Human
cuuucucucaaacacacauaca

SEQ ID NO: 138278 - RNA, 22 nt, Human
cuggacucuuuguuuaguucug

SEQ ID NO: 138279 - RNA, 23 nt, Human
cuggacauucgcaaaguucaucu

SEQ ID NO: 138280 - RNA, 22 nt, Human
cugcuuguguugcucagaguca

SEQ ID NO: 138281 - RNA, 19 nt, Human
cuuguggcuaugcagauac

SEQ ID NO: 138282 - RNA, 22 nt, Human
cugccgaugcgcaguggcgccu

SEQ ID NO: 138283 - RNA, 22 nt, Human
cugccuggggaaugugaggauu

SEQ ID NO: 138284 - RNA, 22 nt, Human
cuugagcugaguuugcagcucu

SEQ ID NO: 138285 - RNA, 22 nt, Human
cuugcagccuggagcucagccu

SEQ ID NO: 138286 - RNA, 22 nt, Human
cuucuugggaggggcggagcuc

SEQ ID NO: 138287 - RNA, 22 nt, Human
cuucuggaggcucuagaggaga

SEQ ID NO: 138288 - RNA, 22 nt, Human
cuuccguuacugacaaaauguu

SEQ ID NO: 138289 - RNA, 22 nt, Human
cugccacuaccaugcuggauga

SEQ ID NO: 138290 - RNA, 21 nt, Human
cuucgcuguuccagcucuugg

SEQ ID NO: 138291 - RNA, 22 nt, Human
cugccaggagaggccagggccc

SEQ ID NO: 138292 - RNA, 22 nt, Human
cuucucugcugccugccucuuu

SEQ ID NO: 138293 - RNA, 22 nt, Human
cuucaguuaguuucaugugagc

SEQ ID NO: 138294 - RNA, 20 nt, Human
cugauguucgugcuuccugg

SEQ ID NO: 138295 - RNA, 22 nt, Human
cuucauuucaggcugaagaaua

SEQ ID NO: 138296 - RNA, 22 nt, Human
cugauuucaaauggugcuagau

SEQ ID NO: 138297 - RNA, 22 nt, Human
cugauuguagccacugugauga

SEQ ID NO: 138298 - RNA, 22 nt, Human
cugaugugcauguggggggaug

SEQ ID NO: 138299 - RNA, 22 nt, Human
cuucauguucaugcuaacauuu

SEQ ID NO: 138300 - RNA, 22 nt, Human
gagcagggagaggcagagaggc

SEQ ID NO: 138301 - RNA, 22 nt, Human
gagcaggcuggcagggccaggg

SEQ ID NO: 138302 - RNA, 22 nt, Human
gagcagcugagcuggaaugaga

SEQ ID NO: 138303 - RNA, 22 nt, Human
gagcagucuuugaaaggcacca

SEQ ID NO: 138304 - RNA, 22 nt, Human
gagcaggucuuugguaaugcuu

SEQ ID NO: 138305 - RNA, 22 nt, Human
gagcagcacagaccaaacagaa

SEQ ID NO: 138306 - RNA, 22 nt, Human
gaaccuggcagcccuauaucug

SEQ ID NO: 138307 - RNA, 22 nt, Human
gaaccauuuaauggagaugcuc

SEQ ID NO: 138308 - RNA, 22 nt, Human
gaacagauucaucuaguggcua

SEQ ID NO: 138309 - RNA, 22 nt, Human
gaacaguuucccuguagaaaau

SEQ ID NO: 138310 - RNA, 22 nt, Human
gaacauauuuagcaccuaauau

SEQ ID NO: 138311 - RNA, 22 nt, Human
gagauuguggcagcagcuguuu

SEQ ID NO: 138312 - RNA, 22 nt, Human
gagagcugucagcguagcaccg

SEQ ID NO: 138313 - RNA, 20 nt, Human
gagaggguuaggauauuugc

SEQ ID NO: 138314 - RNA, 22 nt, Human
gagaggcugagcaguccggguu

SEQ ID NO: 138315 - RNA, 22 nt, Human
gagaagugggggucugggauga

SEQ ID NO: 138316 - RNA, 22 nt, Human
gaaacguuguggaaaauccucu

SEQ ID NO: 138317 - RNA, 22 nt, Human
gagaagugaauaacgaagcagg

SEQ ID NO: 138318 - RNA, 22 nt, Human
gagaagucaggaguggagaaca

SEQ ID NO: 138319 - RNA, 23 nt, Human
gacuucacacucucaaccacugc

SEQ ID NO: 138320 - RNA, 22 nt, Human
gaaaagaaggcaggagcccaag

SEQ ID NO: 138321 - RNA, 22 nt, Human
gacuggcucuaucaggauaaau

SEQ ID NO: 138322 - RNA, 22 nt, Human
gacauugaauugaauccagauu

SEQ ID NO: 138323 - RNA, 22 nt, Human
gacaucuguccauggcacugga

SEQ ID NO: 138324 - RNA, 20 nt, Human
gacaugagggagcaaagagc

SEQ ID NO: 138325 - RNA, 19 nt, Human
gaauugcacgagcagaggc

SEQ ID NO: 138326 - RNA, 22 nt, Human
cuuuaagugaaaggggauuaaa

SEQ ID NO: 138327 - RNA, 22 nt, Human
gacucuucucucccaaaugccc

SEQ ID NO: 138328 - RNA, 22 nt, Human
cuuggugagcuccuggcgcagc

SEQ ID NO: 138329 - RNA, 21 nt, Human
cuuggagacucuuggccacau

SEQ ID NO: 138330 - RNA, 22 nt, Human
cuugcuguccgaugggucugua

SEQ ID NO: 138331 - RNA, 22 nt, Human
cuugccuuugaaagcauuucuc

SEQ ID NO: 138332 - RNA, 19 nt, Human
cuucaguguucaccuggcc

SEQ ID NO: 138333 - RNA, 22 nt, Human
gaagcuccaggaugccugcacu

SEQ ID NO: 138334 - RNA, 22 nt, Human
gaagcccuggaggggcuggagg

SEQ ID NO: 138335 - RNA, 22 nt, Human
cuucauccguaccacggccaca

SEQ ID NO: 138336 - RNA, 22 nt, Human
cuucauuacagcaaccauuuga

SEQ ID NO: 138337 - RNA, 22 nt, Human
cuucuguggcugagaaggcagc

SEQ ID NO: 138338 - RNA, 22 nt, Human
cuucuuagugauuuaacaugua

SEQ ID NO: 138339 - RNA, 22 nt, Human
cuucucuuugacaguugggugu

SEQ ID NO: 138340 - RNA, 22 nt, Human
cuucagcgucgucaguguugcu

SEQ ID NO: 138341 - RNA, 20 nt, Human
cuuauuuuggagaacuuuuc

SEQ ID NO: 138342 - RNA, 22 nt, Human
gaagcaccuggacggugccugg

SEQ ID NO: 138343 - RNA, 22 nt, Human
cuuacaauuuucuuggacuuuu

SEQ ID NO: 138344 - RNA, 22 nt, Human
gaacaaaagauagcccaaacau

SEQ ID NO: 138345 - RNA, 22 nt, Human
cuguuguguuauuugcagugca

SEQ ID NO: 138346 - RNA, 22 nt, Human
cuguuucucugccugcacacau

SEQ ID NO: 138347 - RNA, 20 nt, Human
cuguuugcuaucaugagcug

SEQ ID NO: 138348 - RNA, 22 nt, Human
cuguuuggcuuccacugcuucu

SEQ ID NO: 138349 - RNA, 22 nt, Human
cugugugugcacacguguaugg

SEQ ID NO: 138350 - RNA, 22 nt, Human
cuguggcuaggaagcuguggga

SEQ ID NO: 138351 - RNA, 22 nt, Human
cuguggcugcgcccugggggag

SEQ ID NO: 138352 - RNA, 22 nt, Human
cugugcuguuagcgauuuuuaa

SEQ ID NO: 138353 - RNA, 22 nt, Human
cuggcagcucugagucccuucu

SEQ ID NO: 138354 - RNA, 22 nt, Human
cuuugugcagcagaaaugugug

SEQ ID NO: 138355 - RNA, 20 nt, Human
cugaauaccacagagccauc

SEQ ID NO: 138356 - RNA, 19 nt, Human
cugacccaacauuaguuca

SEQ ID NO: 138357 - RNA, 22 nt, Human
cggugccccuagcgcgccgccc

SEQ ID NO: 138358 - RNA, 19 nt, Human
cggugcugauuggugcagu

SEQ ID NO: 138359 - RNA, 19 nt, Human
cgguaugaauguacuaugg

SEQ ID NO: 138360 - RNA, 22 nt, Human
cgguccugcucuuccucccguu

SEQ ID NO: 138361 - RNA, 20 nt, Human
cgggacacucaagcucuggg

SEQ ID NO: 138362 - RNA, 22 nt, Human
cggcuucucgggucggauuccg

SEQ ID NO: 138363 - RNA, 22 nt, Human
cgggcacagguugagguagaug

SEQ ID NO: 138364 - RNA, 22 nt, Human
cgggcacucagggucgaggugg

SEQ ID NO: 138365 - RNA, 22 nt, Human
cggcugcagcggagcaggcugg

SEQ ID NO: 138366 - RNA, 22 nt, Human
cggcugcgguucaccuagggca

SEQ ID NO: 138367 - RNA, 22 nt, Human
cucugguuucgcaggaaauaga

SEQ ID NO: 138368 - RNA, 22 nt, Human
cucucuaacuagagacaggagu

SEQ ID NO: 138369 - RNA, 22 nt, Human
cucuggcaacgauggugcuuau

SEQ ID NO: 138370 - RNA, 18 nt, Human
cucuggacagcaggcauc

SEQ ID NO: 138371 - RNA, 22 nt, Human
cucggcccuggucuuacgggac

SEQ ID NO: 138372 - RNA, 22 nt, Human
cggcgccccgcgcgggcggcuc

SEQ ID NO: 138373 - RNA, 22 nt, Human
cggacugaccugcucggggaga

SEQ ID NO: 138374 - RNA, 22 nt, Human
cggaagcacuagacacugacac

SEQ ID NO: 138375 - RNA, 22 nt, Human
cucagcugauuaauuucauguu

SEQ ID NO: 138376 - RNA, 22 nt, Human
cgcuucauugugggggccccca

SEQ ID NO: 138377 - RNA, 22 nt, Human
cuccuggagcagcaggcgcagg

SEQ ID NO: 138378 - RNA, 22 nt, Human
cuccccauuuucaugggcaggu

SEQ ID NO: 138379 - RNA, 22 nt, Human
cuccaguugugucuuguaagaa

SEQ ID NO: 138380 - RNA, 22 nt, Human
cuauuauuauugucguuuuaca

SEQ ID NO: 138381 - RNA, 22 nt, Human
cucaccugccuccccgcccucc

SEQ ID NO: 138382 - RNA, 22 nt, Human
cucacugucagcugcagggcuu

SEQ ID NO: 138383 - RNA, 22 nt, Human
cucagaauugucaccucaaaaa

SEQ ID NO: 138384 - RNA, 22 nt, Human
cgcugcagcggcugagucccgc

SEQ ID NO: 138385 - RNA, 22 nt, Human
cgcucggugagccaguggcgga

SEQ ID NO: 138386 - RNA, 22 nt, Human
cgcucggcuuucccuccgccgg

SEQ ID NO: 138387 - RNA, 19 nt, Human
cgcugcucccgcuguggcu

SEQ ID NO: 138388 - RNA, 22 nt, Human
cgcucugccugcccuaacuucc

SEQ ID NO: 138389 - RNA, 22 nt, Human
cgccuggccccgcagcgcuugu

SEQ ID NO: 138390 - RNA, 22 nt, Human
cuauuaauggccaggagucaug

SEQ ID NO: 138391 - RNA, 22 nt, Human
cuauguuuugcuagugaugggu

SEQ ID NO: 138392 - RNA, 22 nt, Human
cgaccccugaaaauggcagcca

SEQ ID NO: 138393 - RNA, 22 nt, Human
cgagcccaacccucccguccuc

SEQ ID NO: 138394 - RNA, 21 nt, Human
cuauaaaaaugguucuuugcg

SEQ ID NO: 138395 - RNA, 22 nt, Human
cgaagcuuuuguuggcgugucg

SEQ ID NO: 138396 - RNA, 22 nt, Human
cgacagauuauuuugugacugc

SEQ ID NO: 138397 - RNA, 22 nt, Human
ccuuuggaugucauucuuggca

SEQ ID NO: 138398 - RNA, 20 nt, Human
cguugccagcccggcccggg

SEQ ID NO: 138399 - RNA, 22 nt, Human
cguugguggguguguggucgga

SEQ ID NO: 138400 - RNA, 22 nt, Human
cgucagccacagcugccccggg

SEQ ID NO: 138401 - RNA, 22 nt, Human
cguauauaaauguauauacaca

SEQ ID NO: 138402 - RNA, 22 nt, Human
cggugcuuuccauaucagcagc

SEQ ID NO: 138403 - RNA, 22 nt, Human
cgugccugguggagagcgaggg

SEQ ID NO: 138404 - RNA, 22 nt, Human
cggucggagagaaugaccugga

SEQ ID NO: 138405 - RNA, 22 nt, Human
cgguugcaggaugugcgggcag

SEQ ID NO: 138406 - RNA, 22 nt, Human
cgguggcccauuguacgcagcu

SEQ ID NO: 138407 - RNA, 18 nt, Human
ccuucaucucugcuucuu

SEQ ID NO: 138408 - RNA, 22 nt, Human
cggggugugacggugcgggccu

SEQ ID NO: 138409 - RNA, 22 nt, Human
ccuuaauaguguucuaauguuu

SEQ ID NO: 138410 - RNA, 22 nt, Human
cgggguguggggcgguagugug

SEQ ID NO: 138411 - RNA, 22 nt, Human
cggggcuccgaagagcucgguu

SEQ ID NO: 138412 - RNA, 22 nt, Human
cggggcuggcguuagggaggca

SEQ ID NO: 138413 - RNA, 22 nt, Human
cggggcgggcgugggaggugga

SEQ ID NO: 138414 - RNA, 20 nt, Human
ccuguucacugcgcaguuuc

SEQ ID NO: 138415 - RNA, 22 nt, Human
cggggucuggaguuguggugug

SEQ ID NO: 138416 - RNA, 22 nt, Human
cggggaggagccagcggaggau

SEQ ID NO: 138417 - RNA, 22 nt, Human
cggggcaaggggggcuggugga

SEQ ID NO: 138418 - RNA, 22 nt, Human
ccugugcaugccaggguacacc

SEQ ID NO: 138419 - RNA, 22 nt, Human
ccuggggcucugcacagagcag

SEQ ID NO: 138420 - RNA, 22 nt, Human
ccugggcauuuguuucacaggu

SEQ ID NO: 138421 - RNA, 22 nt, Human
cggcuacccaugucauauucgu

SEQ ID NO: 138422 - RNA, 23 nt, Human
ccuggcugaccugaagguguagu

SEQ ID NO: 138423 - RNA, 22 nt, Human
ccugcuggagucuaguuggucu

SEQ ID NO: 138424 - RNA, 22 nt, Human
ccugcugcugaugcuguuucac

SEQ ID NO: 138425 - RNA, 22 nt, Human
cggcgcugguacaguggaagag

SEQ ID NO: 138426 - RNA, 22 nt, Human
cggcggcgaaccgaccugggug

SEQ ID NO: 138427 - RNA, 22 nt, Human
ccugcucuaauucauucaugcu

SEQ ID NO: 138428 - RNA, 22 nt, Human
cggccgcgggauggcgggcagc

SEQ ID NO: 138429 - RNA, 22 nt, Human
cggcccggccucgcggcgcaug

SEQ ID NO: 138430 - RNA, 22 nt, Human
cgcgcgguguuccgcauucugc

SEQ ID NO: 138431 - RNA, 22 nt, Human
cgcccccgaucggggccgccgc

SEQ ID NO: 138432 - RNA, 22 nt, Human
ccugcacuaccuggggcugcug

SEQ ID NO: 138433 - RNA, 22 nt, Human
cgcuagggagcacuuggcagug

SEQ ID NO: 138434 - RNA, 22 nt, Human
ccgcaccgucugccauacacgc

SEQ ID NO: 138435 - RNA, 22 nt, Human
ccgauuuauucugacaguuuau

SEQ ID NO: 138436 - RNA, 22 nt, Human
ccgcagucugcaaucucccugg

SEQ ID NO: 138437 - RNA, 22 nt, Human
ccgcagggcccggcgggcucag

SEQ ID NO: 138438 - RNA, 22 nt, Human
ccgccucucgcucccagcuugc

SEQ ID NO: 138439 - RNA, 22 nt, Human
ccgauuuaugucucugacuuga

SEQ ID NO: 138440 - RNA, 22 nt, Human
ccgccccaggcccugagccaag

SEQ ID NO: 138441 - RNA, 22 nt, Human
ccucacuucuuucucuucacuu

SEQ ID NO: 138442 - RNA, 22 nt, Human
ccucacaaagaaugucuagaca

SEQ ID NO: 138443 - RNA, 22 nt, Human
cgacgacaggcgcccgaggagg

SEQ ID NO: 138444 - RNA, 22 nt, Human
ccucauagccuuuccuacuuua

SEQ ID NO: 138445 - RNA, 22 nt, Human
cgcacaggcacagacacuggga

SEQ ID NO: 138446 - RNA, 22 nt, Human
cgcagcuucagggccaggaggg

SEQ ID NO: 138447 - RNA, 22 nt, Human
cgcacuggagcuggaacgaguc

SEQ ID NO: 138448 - RNA, 22 nt, Human
cgccaaccaggcuguccuccca

SEQ ID NO: 138449 - RNA, 22 nt, Human
ccugcaguuuuuccaugauaca

SEQ ID NO: 138450 - RNA, 21 nt, Human
ccugcacuucccuccucaagu

SEQ ID NO: 138451 - RNA, 22 nt, Human
ccugcaguagagguugguaggg

SEQ ID NO: 138452 - RNA, 19 nt, Human
ccugcugaagugaugcagc

SEQ ID NO: 138453 - RNA, 22 nt, Human
ccugcugagccuggugggcagc

SEQ ID NO: 138454 - RNA, 22 nt, Human
ccugccugggcucacuugccag

SEQ ID NO: 138455 - RNA, 22 nt, Human
ccugcccaucccaccccagcau

SEQ ID NO: 138456 - RNA, 22 nt, Human
ccugccagccugccaucccaca

SEQ ID NO: 138457 - RNA, 22 nt, Human
cccuggucucugacuugauccu

SEQ ID NO: 138458 - RNA, 22 nt, Human
ccugacuugguuuaggagaugg

SEQ ID NO: 138459 - RNA, 22 nt, Human
ccugacgcugauauauaguuaa

SEQ ID NO: 138460 - RNA, 22 nt, Human
cccuggcucaggcagcuuuguu

SEQ ID NO: 138461 - RNA, 17 nt, Human
cccugcacccuacucuc

SEQ ID NO: 138462 - RNA, 22 nt, Human
cccuaguuuauuugccuucuuu

SEQ ID NO: 138463 - RNA, 21 nt, Human
ccuccagccagagggucugga

SEQ ID NO: 138464 - RNA, 22 nt, Human
ccucccaccguaucucaguggc

SEQ ID NO: 138465 - RNA, 19 nt, Human
cccgauggagacuuagcag

SEQ ID NO: 138466 - RNA, 22 nt, Human
cccgccggccacaccggccgcc

SEQ ID NO: 138467 - RNA, 22 nt, Human
cccgaggagagguccaggcccu

SEQ ID NO: 138468 - RNA, 22 nt, Human
cccgacuccuccugguaccuaa

SEQ ID NO: 138469 - RNA, 22 nt, Human
cccgaaaauuguuguacugcag

SEQ ID NO: 138470 - RNA, 22 nt, Human
cccggcucggcuucuuccccac

SEQ ID NO: 138471 - RNA, 22 nt, Human
cccagcuggcaaaggcguccuu

SEQ ID NO: 138472 - RNA, 22 nt, Human
cccagcugaacuugcauuccaa

SEQ ID NO: 138473 - RNA, 19 nt, Human
ccggucaugcauuccuuug

SEQ ID NO: 138474 - RNA, 22 nt, Human
ccggcggaaacauggcggcgcc

SEQ ID NO: 138475 - RNA, 22 nt, Human
cccagccgcuguggucuagggu

SEQ ID NO: 138476 - RNA, 22 nt, Human
ccgggcggcauccagccguucc

SEQ ID NO: 138477 - RNA, 22 nt, Human
ccggcugcugaggcggccccgg

SEQ ID NO: 138478 - RNA, 22 nt, Human
cccagcucuggaagguggggga

SEQ ID NO: 138479 - RNA, 22 nt, Human
cccagccuuugcuuccugguuc

SEQ ID NO: 138480 - RNA, 22 nt, Human
cccagcccaucauuccugcaaa

SEQ ID NO: 138481 - RNA, 22 nt, Human
ccgcuggaagcgaguggugggc

SEQ ID NO: 138482 - RNA, 22 nt, Human
ccgcuggccgacuuccgagagc

SEQ ID NO: 138483 - RNA, 22 nt, Human
cccagaccagagugccuggacg

SEQ ID NO: 138484 - RNA, 22 nt, Human
ccgcucgggugcagagggcaga

SEQ ID NO: 138485 - RNA, 22 nt, Human
ccgcggauggggagucaccacc

SEQ ID NO: 138486 - RNA, 22 nt, Human
cccagaagaguauguguuugcu

SEQ ID NO: 138487 - RNA, 22 nt, Human
ccgcggcagaggcgggggcgcc

SEQ ID NO: 138488 - RNA, 22 nt, Human
ccgcggcuguaguggaggugga

SEQ ID NO: 138489 - RNA, 22 nt, Human
ccgcggcugcgcggugccccuc

SEQ ID NO: 138490 - RNA, 22 nt, Human
ccuagcauagcuuuugccuccc

SEQ ID NO: 138491 - RNA, 21 nt, Human
ccguuauucuucccaccccca

SEQ ID NO: 138492 - RNA, 22 nt, Human
ccccugcucagggaggagaccg

SEQ ID NO: 138493 - RNA, 22 nt, Human
ccccugggcccugagccgcgau

SEQ ID NO: 138494 - RNA, 22 nt, Human
ccccccaaauguuacagugacc

SEQ ID NO: 138495 - RNA, 22 nt, Human
ccccccaaaacuacuggccugu

SEQ ID NO: 138496 - RNA, 22 nt, Human
ccguccgcuccuccagccgcug

SEQ ID NO: 138497 - RNA, 22 nt, Human
ccgguguggguuucucgguagu

SEQ ID NO: 138498 - RNA, 22 nt, Human
cccaggucgucagcaguguggu

SEQ ID NO: 138499 - RNA, 22 nt, Human
ccaguguguuuuucucugacuc

SEQ ID NO: 138500 - RNA, 22 nt, Human
ccagugcagacgcggaacuggc

SEQ ID NO: 138501 - RNA, 22 nt, Human
ccagugcuuccaggaauacggu

SEQ ID NO: 138502 - RNA, 22 nt, Human
ccagucugccggcccggccccu

SEQ ID NO: 138503 - RNA, 22 nt, Human
ccagucuuggugucuguagcac

SEQ ID NO: 138504 - RNA, 22 nt, Human
ccagugacaaagucggaagucc

SEQ ID NO: 138505 - RNA, 20 nt, Human
cccuggcuggcaucuggacu

SEQ ID NO: 138506 - RNA, 22 nt, Human
cccuggacuccauuuucccgua

SEQ ID NO: 138507 - RNA, 22 nt, Human
ccagggcugcugccugggcugg

SEQ ID NO: 138508 - RNA, 22 nt, Human
ccagggcuggaggaggucagga

SEQ ID NO: 138509 - RNA, 22 nt, Human
cccgggcucuggcagaggcggu

SEQ ID NO: 138510 - RNA, 22 nt, Human
cccuccagugucccagugggga

SEQ ID NO: 138511 - RNA, 22 nt, Human
cccgguugggguuccagggcgc

SEQ ID NO: 138512 - RNA, 19 nt, Human
cccucggcuucugguuacu

SEQ ID NO: 138513 - RNA, 22 nt, Human
cccugaggcccacaagucccag

SEQ ID NO: 138514 - RNA, 21 nt, Human
ccgacggcgcagaugccggcc

SEQ ID NO: 138515 - RNA, 21 nt, Human
cccuugccugcacuccucggc

SEQ ID NO: 138516 - RNA, 22 nt, Human
cccugcacuguguggacucugg

SEQ ID NO: 138517 - RNA, 22 nt, Human
ccgagaucagaguaggauuugg

SEQ ID NO: 138518 - RNA, 22 nt, Human
ccgagguccugaagcaagggcc

SEQ ID NO: 138519 - RNA, 22 nt, Human
ccauggccaauugcaccuugcu

SEQ ID NO: 138520 - RNA, 22 nt, Human
ccgagcagggcgcccugcccca

SEQ ID NO: 138521 - RNA, 22 nt, Human
cccacccuacugcuacccagga

SEQ ID NO: 138522 - RNA, 22 nt, Human
ccgccacggggcaugggaggca

SEQ ID NO: 138523 - RNA, 22 nt, Human
ccaugugaccugugucaguugc

SEQ ID NO: 138524 - RNA, 23 nt, Human
ccaugugcaggguucagcacuua

SEQ ID NO: 138525 - RNA, 22 nt, Human
ccagcuuuucagaaucugccug

SEQ ID NO: 138526 - RNA, 22 nt, Human
ccagcucgaggcaggggcugca

SEQ ID NO: 138527 - RNA, 21 nt, Human
ccccuguggagcacauguggc

SEQ ID NO: 138528 - RNA, 23 nt, Human
ccccugcauggcaccacauuccc

SEQ ID NO: 138529 - RNA, 22 nt, Human
cccccucuggcuccagucugac

SEQ ID NO: 138530 - RNA, 22 nt, Human
ccccaguuucaccuaccccgcc

SEQ ID NO: 138531 - RNA, 22 nt, Human
ccagccacugacugauuuaaaa

SEQ ID NO: 138532 - RNA, 22 nt, Human
ccaggcagaggggucuggagca

SEQ ID NO: 138533 - RNA, 22 nt, Human
cccgcucaccccacuccaccag

SEQ ID NO: 138534 - RNA, 22 nt, Human
ccagggcggacaaggucuuuga

SEQ ID NO: 138535 - RNA, 22 nt, Human
ccaggcuaggaccgauuucccu

SEQ ID NO: 138536 - RNA, 22 nt, Human
ccagggaagaaagaugaagugc

SEQ ID NO: 138537 - RNA, 22 nt, Human
cccggcgccucguuuccuaguc

SEQ ID NO: 138538 - RNA, 20 nt, Human
caucaacaccuugucagccu

SEQ ID NO: 138539 - RNA, 22 nt, Human
cauuaccuggggagaggauacc

SEQ ID NO: 138540 - RNA, 22 nt, Human
caucaaaugcaagagcguucuu

SEQ ID NO: 138541 - RNA, 22 nt, Human
cccagcaccauaacucaggccu

SEQ ID NO: 138542 - RNA, 22 nt, Human
ccagaggcuuaugcagcugcug

SEQ ID NO: 138543 - RNA, 22 nt, Human
cccaucugugaaauggggcugc

SEQ ID NO: 138544 - RNA, 22 nt, Human
cccaguuguuccuauucuucuu

SEQ ID NO: 138545 - RNA, 22 nt, Human
ccagcaggagacuagcaacaua

SEQ ID NO: 138546 - RNA, 22 nt, Human
ccccaggcagcccuccaggagc

SEQ ID NO: 138547 - RNA, 22 nt, Human
ccagcaucagcucuuggcuggc

SEQ ID NO: 138548 - RNA, 22 nt, Human
cccaggccguguaaucagcagc

SEQ ID NO: 138549 - RNA, 22 nt, Human
cccaggcuggggcuccuccagc

SEQ ID NO: 138550 - RNA, 22 nt, Human
cccagggguugaggccguaggg

SEQ ID NO: 138551 - RNA, 22 nt, Human
cccagcgccugcccuccgccgc

SEQ ID NO: 138552 - RNA, 22 nt, Human
uuuuuguuauuuagguguagag

SEQ ID NO: 138553 - RNA, 22 nt, Human
uuuuugcuuuuuugucaucuaa

SEQ ID NO: 138554 - RNA, 22 nt, Human
uuuuucuccauuccaggugccu

SEQ ID NO: 138555 - RNA, 22 nt, Human
uuuuggauugcuaacucagggu

SEQ ID NO: 138556 - RNA, 22 nt, Human
uuuuggagaaaugggacuuaau

SEQ ID NO: 138557 - RNA, 18 nt, Human
uuuuguguuuauucugca

SEQ ID NO: 138558 - RNA, 22 nt, Human
uuuucucucacuucacauauuu

SEQ ID NO: 138559 - RNA, 22 nt, Human
uuuguugguugcacuggugggu

SEQ ID NO: 138560 - RNA, 22 nt, Human
uuuguucuagauaacugguaau

SEQ ID NO: 138561 - RNA, 22 nt, Human
uuuguugucuucauaauacuuu

SEQ ID NO: 138562 - RNA, 22 nt, Human
uuuguuuuggugucaugcguga

SEQ ID NO: 138563 - RNA, 22 nt, Human
uuuguuugcugagugaauucaa

SEQ ID NO: 138564 - RNA, 22 nt, Human
uuuguuaggguuucagcuagcc

SEQ ID NO: 138565 - RNA, 22 nt, Human
uuuguguuuucaggcacauggc

SEQ ID NO: 138566 - RNA, 22 nt, Human
uuuguguuuugaggucuugcaa

SEQ ID NO: 138567 - RNA, 23 nt, Human
gaugauggcaacuacauccggug

SEQ ID NO: 138568 - RNA, 22 nt, Human
gagaccaagcgugggugauaau

SEQ ID NO: 138569 - RNA, 22 nt, Human
gagcaugacgcaacaccaagug

SEQ ID NO: 138570 - RNA, 22 nt, Human
gauggcauucacaaacuuaacu

SEQ ID NO: 138571 - RNA, 22 nt, Human
gauggcaaugcuagaaauuuag

SEQ ID NO: 138572 - RNA, 22 nt, Human
gauggacgguuuuaccagacag

SEQ ID NO: 138573 - RNA, 22 nt, Human
gaugcuaauuaaugaagaggag

SEQ ID NO: 138574 - RNA, 18 nt, Human
gagaggcauuuagcugau

SEQ ID NO: 138575 - RNA, 22 nt, Human
gaugcauccuuucugucuucuc

SEQ ID NO: 138576 - RNA, 22 nt, Human
gauguaucugagcugcuuaggu

SEQ ID NO: 138577 - RNA, 22 nt, Human
gagcagcaggccagguugcagg

SEQ ID NO: 138578 - RNA, 22 nt, Human
gagcagcucgagaaggaagcag

SEQ ID NO: 138579 - RNA, 22 nt, Human
gagcagccugaggauucugcuc

SEQ ID NO: 138580 - RNA, 22 nt, Human
gagcacugagcuggaauuggag

SEQ ID NO: 138581 - RNA, 22 nt, Human
gagcaacacauugaaugaggau

SEQ ID NO: 138582 - RNA, 22 nt, Human
gagcacauguggagagucuggg

SEQ ID NO: 138583 - RNA, 22 nt, Human
gaugguggggggcagcugggag

SEQ ID NO: 138584 - RNA, 22 nt, Human
gaugggaaggugguaaaguuua

SEQ ID NO: 138585 - RNA, 22 nt, Human
gauggguugaguucauggagcc

SEQ ID NO: 138586 - RNA, 22 nt, Human
gagaucuguguuugcugaagcu

SEQ ID NO: 138587 - RNA, 22 nt, Human
gagauggauuuuuuugccaguc

SEQ ID NO: 138588 - RNA, 21 nt, Human
gcaaccagaccacagggcagu

SEQ ID NO: 138589 - RNA, 18 nt, Human
gagcucuucccuuuucuc

SEQ ID NO: 138590 - RNA, 22 nt, Human
gcaaaaacaguguagucuucug

SEQ ID NO: 138591 - RNA, 22 nt, Human
gcaaaugacuuagucacuccag

SEQ ID NO: 138592 - RNA, 22 nt, Human
gauuugucuauauucaaauaug

SEQ ID NO: 138593 - RNA, 22 nt, Human
gauuuucauuauagcuaguuuc

SEQ ID NO: 138594 - RNA, 19 nt, Human
gagccgcucccgcagccgg

SEQ ID NO: 138595 - RNA, 22 nt, Human
gagcgcacagaaggaagcagcc

SEQ ID NO: 138596 - RNA, 22 nt, Human
gagcgcgcaaucucuccagcug

SEQ ID NO: 138597 - RNA, 22 nt, Human
gagccuguuaggcaccuguguu

SEQ ID NO: 138598 - RNA, 22 nt, Human
gagccauggaggaugugcagca

SEQ ID NO: 138599 - RNA, 22 nt, Human
gauguuggugcauucacuucug

SEQ ID NO: 138600 - RNA, 22 nt, Human
gauguuaauauguuucaccaaa

SEQ ID NO: 138601 - RNA, 22 nt, Human
gagccaugagauaagagcaccu

SEQ ID NO: 138602 - RNA, 19 nt, Human
gagcaugacuggccuugca

SEQ ID NO: 138603 - RNA, 22 nt, Human
gagcaggucucaguucugccuc

SEQ ID NO: 138604 - RNA, 22 nt, Human
gcaauuggaaugaauucuauuu

SEQ ID NO: 138605 - RNA, 22 nt, Human
gcaaggacagaagcccacacag

SEQ ID NO: 138606 - RNA, 22 nt, Human
gaggaggagacggaggccuggg

SEQ ID NO: 138607 - RNA, 22 nt, Human
gaggagcggugcaugugggggc

SEQ ID NO: 138608 - RNA, 19 nt, Human
gcacacccugcaccaccau

SEQ ID NO: 138609 - RNA, 22 nt, Human
gagggagagaugcuggaccggg

SEQ ID NO: 138610 - RNA, 21 nt, Human
gcacucagucacuacucaaga

SEQ ID NO: 138611 - RNA, 22 nt, Human
gcacucuguggagacaagauag

SEQ ID NO: 138612 - RNA, 22 nt, Human
gaggcggugguggcgagaguca

SEQ ID NO: 138613 - RNA, 22 nt, Human
gaggcucagagggacuuucaag

SEQ ID NO: 138614 - RNA, 22 nt, Human
gaggaugacaaagaaggcagac

SEQ ID NO: 138615 - RNA, 22 nt, Human
gaggcagaggaaacagcucauu

SEQ ID NO: 138616 - RNA, 22 nt, Human
gcacaggcugcacgaccccagc

SEQ ID NO: 138617 - RNA, 22 nt, Human
gcaccacccaaaggcggggcuc

SEQ ID NO: 138618 - RNA, 22 nt, Human
gaggccagcacccagaugcaug

SEQ ID NO: 138619 - RNA, 22 nt, Human
gaggccauguggcccgggcugc

SEQ ID NO: 138620 - RNA, 22 nt, Human
gcaccgagaaggaagcaugccu

SEQ ID NO: 138621 - RNA, 22 nt, Human
gcacggucagggugggggagug

SEQ ID NO: 138622 - RNA, 22 nt, Human
gcagcgcugagaugauuuguug

SEQ ID NO: 138623 - RNA, 20 nt, Human
gcagcugacccuagugcuug

SEQ ID NO: 138624 - RNA, 22 nt, Human
gcaggacugauggagcauaugu

SEQ ID NO: 138625 - RNA, 22 nt, Human
gcaggaagauugcagaaggcug

SEQ ID NO: 138626 - RNA, 22 nt, Human
gcaggaaugguacauaccuguu

SEQ ID NO: 138627 - RNA, 22 nt, Human
gcaggcagauccagaagcacua

SEQ ID NO: 138628 - RNA, 22 nt, Human
gcaggagggggccuggagccca

SEQ ID NO: 138629 - RNA, 22 nt, Human
gaggugauuccucccauguaau

SEQ ID NO: 138630 - RNA, 22 nt, Human
gcaggcaggauucagagauaca

SEQ ID NO: 138631 - RNA, 22 nt, Human
gaggucuugagugacuuagcag

SEQ ID NO: 138632 - RNA, 22 nt, Human
gcagccagggaccuuugacuau

SEQ ID NO: 138633 - RNA, 22 nt, Human
gcagccaauggcgagccccaca

SEQ ID NO: 138634 - RNA, 23 nt, Human
gcagccaacccacgugagagaag

SEQ ID NO: 138635 - RNA, 22 nt, Human
gcagcccucuuggucacuaggc

SEQ ID NO: 138636 - RNA, 22 nt, Human
gcagccauggcuggccgggcau

SEQ ID NO: 138637 - RNA, 22 nt, Human
gaggggacugucuggcuccgag

SEQ ID NO: 138638 - RNA, 22 nt, Human
gcagagcugucuaagucacuuc

SEQ ID NO: 138639 - RNA, 22 nt, Human
gcagagaaugucagauuuuguu

SEQ ID NO: 138640 - RNA, 22 nt, Human
gcagagcacccugcagugguau

SEQ ID NO: 138641 - RNA, 22 nt, Human
gcagaggcaaagucuggaugac

SEQ ID NO: 138642 - RNA, 22 nt, Human
gcagaaguauuguacgguggga

SEQ ID NO: 138643 - RNA, 22 nt, Human
gagggggcaggcucggcaccgg

SEQ ID NO: 138644 - RNA, 22 nt, Human
gcagcaaucuucacagugucau

SEQ ID NO: 138645 - RNA, 22 nt, Human
gcagcaauaaaacugaaggugu

SEQ ID NO: 138646 - RNA, 22 nt, Human
gcagaugagagugugaucuggg

SEQ ID NO: 138647 - RNA, 22 nt, Human
gaggggcuccagguguugagga

SEQ ID NO: 138648 - RNA, 22 nt, Human
gaggggcggggcgggaggagag

SEQ ID NO: 138649 - RNA, 22 nt, Human
gccaguaaaguaucuccuuuug

SEQ ID NO: 138650 - RNA, 22 nt, Human
gauauuuugugaaaaaacaacu

SEQ ID NO: 138651 - RNA, 22 nt, Human
gccauggugagccaccuggugg

SEQ ID NO: 138652 - RNA, 22 nt, Human
gaugccuccaggaaagaggacg

SEQ ID NO: 138653 - RNA, 22 nt, Human
gaugcucuugauuggaccaggg

SEQ ID NO: 138654 - RNA, 22 nt, Human
gcccgccaacuugccagcggug

SEQ ID NO: 138655 - RNA, 22 nt, Human
gcccagccucagggcaucagcu

SEQ ID NO: 138656 - RNA, 22 nt, Human
gcauguucaaguuaguauauuu

SEQ ID NO: 138657 - RNA, 22 nt, Human
gauaccugccaagcugcacuca

SEQ ID NO: 138658 - RNA, 22 nt, Human
gauagguacuguaagguccucu

SEQ ID NO: 138659 - RNA, 22 nt, Human
gcauuccagaguugcuggaaaa

SEQ ID NO: 138660 - RNA, 22 nt, Human
gcaugcuguuuggaaacgauaa

SEQ ID NO: 138661 - RNA, 22 nt, Human
gcaugcgugcgugcgugcaugu

SEQ ID NO: 138662 - RNA, 22 nt, Human
gcauggaaaagggaugcuaacu

SEQ ID NO: 138663 - RNA, 22 nt, Human
gaguuggggcugcguguuucca

SEQ ID NO: 138664 - RNA, 22 nt, Human
gaguuucacguagaucaggguc

SEQ ID NO: 138665 - RNA, 22 nt, Human
gagguucgauacagcguauuua

SEQ ID NO: 138666 - RNA, 22 nt, Human
gagguuggggugucucucccca

SEQ ID NO: 138667 - RNA, 22 nt, Human
gagguuggagggcuggccugca

SEQ ID NO: 138668 - RNA, 21 nt, Human
gauuuuagggcagccaaacac

SEQ ID NO: 138669 - RNA, 22 nt, Human
gccucucagagcuguucaguuu

SEQ ID NO: 138670 - RNA, 22 nt, Human
gcaacguauauggguaaggaua

SEQ ID NO: 138671 - RNA, 22 nt, Human
gcacacuguaugcugguauuug

SEQ ID NO: 138672 - RNA, 22 nt, Human
gcacaaguccuccgacagcacg

SEQ ID NO: 138673 - RNA, 22 nt, Human
gccugggcuuccgggacccggg

SEQ ID NO: 138674 - RNA, 22 nt, Human
gccuggggaacuugauccuguc

SEQ ID NO: 138675 - RNA, 23 nt, Human
gcacuguuugaggagcacugugc

SEQ ID NO: 138676 - RNA, 22 nt, Human
gcacacaaaaauauguguugaa

SEQ ID NO: 138677 - RNA, 22 nt, Human
gccugcuugaaagcacuuucug

SEQ ID NO: 138678 - RNA, 21 nt, Human
gccgaugugacucuacguagu

SEQ ID NO: 138679 - RNA, 22 nt, Human
gccgcagauucugagacgugua

SEQ ID NO: 138680 - RNA, 22 nt, Human
gccgcaacggacccugggaguc

SEQ ID NO: 138681 - RNA, 22 nt, Human
gccgccgcucaccugggcgccg

SEQ ID NO: 138682 - RNA, 22 nt, Human
gauucugaaauuaacagacugg

SEQ ID NO: 138683 - RNA, 22 nt, Human
gauugcugccagcguguccgug

SEQ ID NO: 138684 - RNA, 22 nt, Human
gauugcauaugcauucugauac

SEQ ID NO: 138685 - RNA, 22 nt, Human
gccggcugggggcggagggcag

SEQ ID NO: 138686 - RNA, 22 nt, Human
gccgggagaggcggcgcagggg

SEQ ID NO: 138687 - RNA, 22 nt, Human
gccgcguggcagucuuggugac

SEQ ID NO: 138688 - RNA, 22 nt, Human
gccggagagccaacaccacgga

SEQ ID NO: 138689 - RNA, 22 nt, Human
gauuucauaaaacgagaaacuc

SEQ ID NO: 138690 - RNA, 21 nt, Human
gccgugcgccuccaggcgcgc

SEQ ID NO: 138691 - RNA, 22 nt, Human
gccaugguggggccucccugac

SEQ ID NO: 138692 - RNA, 22 nt, Human
gcuggcggguuggggaggcgga

SEQ ID NO: 138693 - RNA, 22 nt, Human
gcccagacaucuguugggaccu

SEQ ID NO: 138694 - RNA, 20 nt, Human
gcccacccgcacucccgccg

SEQ ID NO: 138695 - RNA, 22 nt, Human
gcccagaagguagcgaguaguc

SEQ ID NO: 138696 - RNA, 22 nt, Human
gcuggcgauggccgagucuccg

SEQ ID NO: 138697 - RNA, 22 nt, Human
gcuggaugucugugccaggcac

SEQ ID NO: 138698 - RNA, 22 nt, Human
gcuggccugcgagggcaggcug

SEQ ID NO: 138699 - RNA, 22 nt, Human
gccaucugcuuagauugcuggg

SEQ ID NO: 138700 - RNA, 22 nt, Human
gcugcucaaaaaaacacuagcu

SEQ ID NO: 138701 - RNA, 22 nt, Human
gcugcuacagagcuggaggggg

SEQ ID NO: 138702 - RNA, 22 nt, Human
gcugcuggcuuccugcuguuuu

SEQ ID NO: 138703 - RNA, 22 nt, Human
gcugcgcugggacgccaccaac

SEQ ID NO: 138704 - RNA, 22 nt, Human
gccagucgucuuuauuacagcu

SEQ ID NO: 138705 - RNA, 22 nt, Human
gcugcacgguccuggcaccacg

SEQ ID NO: 138706 - RNA, 22 nt, Human
gcucuggcuacuguggcuaccg

SEQ ID NO: 138707 - RNA, 22 nt, Human
gcugagcaaugcacugccgcau

SEQ ID NO: 138708 - RNA, 22 nt, Human
gccaaccagucgguccaggaag

SEQ ID NO: 138709 - RNA, 22 nt, Human
gccaaucaggaggcuguacauc

SEQ ID NO: 138710 - RNA, 19 nt, Human
gccacguuggcuaguugcc

SEQ ID NO: 138711 - RNA, 22 nt, Human
gcugcaggaggugguagggucu

SEQ ID NO: 138712 - RNA, 22 nt, Human
gcugccgcugcggggcgcgggc

SEQ ID NO: 138713 - RNA, 22 nt, Human
gccagcuuagaucccccagccc

SEQ ID NO: 138714 - RNA, 22 nt, Human
gccagccggugaguggaagcgg

SEQ ID NO: 138715 - RNA, 21 nt, Human
gccacugcugcucauucucug

SEQ ID NO: 138716 - RNA, 18 nt, Human
gccagcccuccaaccucc

SEQ ID NO: 138717 - RNA, 22 nt, Human
gcucaacucaacgucauuugaa

SEQ ID NO: 138718 - RNA, 22 nt, Human
gcucaagaccaagggagcgggg

SEQ ID NO: 138719 - RNA, 22 nt, Human
gcaucuguuagagugugcaugc

SEQ ID NO: 138720 - RNA, 22 nt, Human
gcucaacuucuaggacuucagg

SEQ ID NO: 138721 - RNA, 21 nt, Human
gcucccgaagugcucggcguu

SEQ ID NO: 138722 - RNA, 22 nt, Human
gcaguugguccagccucggcug

SEQ ID NO: 138723 - RNA, 22 nt, Human
gcuauacuugccuccucuccac

SEQ ID NO: 138724 - RNA, 22 nt, Human
gcuacaacugugucuguggggc

SEQ ID NO: 138725 - RNA, 22 nt, Human
gcguggccugcugaaggacuuc

SEQ ID NO: 138726 - RNA, 22 nt, Human
gcguggaugauuuugagucggu

SEQ ID NO: 138727 - RNA, 22 nt, Human
gcagcucagcacgcacagguaa

SEQ ID NO: 138728 - RNA, 22 nt, Human
gcagcguuaacauuuuuccugu

SEQ ID NO: 138729 - RNA, 22 nt, Human
gcggcggcggaggcgggggcag

SEQ ID NO: 138730 - RNA, 22 nt, Human
gcagcguguggcuaauggcucu

SEQ ID NO: 138731 - RNA, 22 nt, Human
gcguaccugaaauuacggcacu

SEQ ID NO: 138732 - RNA, 22 nt, Human
gcgguuguucugugugcaugga

SEQ ID NO: 138733 - RNA, 22 nt, Human
gcaggacuucuguuuaaccagu

SEQ ID NO: 138734 - RNA, 22 nt, Human
gcgauugguuuggggccagagu

SEQ ID NO: 138735 - RNA, 22 nt, Human
gcagccuccggccuggcccccu

SEQ ID NO: 138736 - RNA, 22 nt, Human
gcagccucugcaguucaggagg

SEQ ID NO: 138737 - RNA, 22 nt, Human
gcagccugaguuuagcucgucg

SEQ ID NO: 138738 - RNA, 22 nt, Human
gcggccucuuugcugccucagg

SEQ ID NO: 138739 - RNA, 22 nt, Human
gcggcaguccuuccaguacagg

SEQ ID NO: 138740 - RNA, 22 nt, Human
ggggccaaggcaaacuugaggg

SEQ ID NO: 138741 - RNA, 22 nt, Human
ggagagcguggaugggcuucca

SEQ ID NO: 138742 - RNA, 22 nt, Human
ggagaccaauuaaugaaggaau

SEQ ID NO: 138743 - RNA, 22 nt, Human
ggggaggugugcaggacaccuc

SEQ ID NO: 138744 - RNA, 22 nt, Human
ggggaggaagcuggaacacggg

SEQ ID NO: 138745 - RNA, 22 nt, Human
gggcugcuccgcccgcugcgcc

SEQ ID NO: 138746 - RNA, 22 nt, Human
ggagaaacuaguuagauccaau

SEQ ID NO: 138747 - RNA, 22 nt, Human
ggacuuggcagugucaaauuua

SEQ ID NO: 138748 - RNA, 22 nt, Human
ggacuuuggauuuuauucuaaa

SEQ ID NO: 138749 - RNA, 22 nt, Human
ggagaucuuggacuggccggcc

SEQ ID NO: 138750 - RNA, 22 nt, Human
ggggcggggagcaugagcuggg

SEQ ID NO: 138751 - RNA, 22 nt, Human
ggggcggcgugggcgcggugau

SEQ ID NO: 138752 - RNA, 22 nt, Human
ggggcgaguguggaccgcagcc

SEQ ID NO: 138753 - RNA, 22 nt, Human
ggggcugggaggccggcgcgca

SEQ ID NO: 138754 - RNA, 22 nt, Human
ggagggagugcaggcaggcaga

SEQ ID NO: 138755 - RNA, 22 nt, Human
ggguggugauacugcuucugcc

SEQ ID NO: 138756 - RNA, 22 nt, Human
ggacagacuuuacagccccggg

SEQ ID NO: 138757 - RNA, 22 nt, Human
ggacagacagcauggaaccaua

SEQ ID NO: 138758 - RNA, 22 nt, Human
gggcggggcucacggugcggca

SEQ ID NO: 138759 - RNA, 22 nt, Human
gggcgcgcggagccucgccggg

SEQ ID NO: 138760 - RNA, 22 nt, Human
gggcgcuguguuaggugcugua

SEQ ID NO: 138761 - RNA, 22 nt, Human
gggcggcguccucagucgggug

SEQ ID NO: 138762 - RNA, 22 nt, Human
ggaaguggauucagggcugcua

SEQ ID NO: 138763 - RNA, 22 nt, Human
ggaagcuguugugagugcagca

SEQ ID NO: 138764 - RNA, 22 nt, Human
gggccaaggggagcuggaaggg

SEQ ID NO: 138765 - RNA, 22 nt, Human
ggaaggggagcuggaaagggua

SEQ ID NO: 138766 - RNA, 22 nt, Human
gggcgagcgucucagccgggcg

SEQ ID NO: 138767 - RNA, 22 nt, Human
gggauggggagcuggaaagggg

SEQ ID NO: 138768 - RNA, 22 nt, Human
gggagggcuuggacccagaugu

SEQ ID NO: 138769 - RNA, 22 nt, Human
gggcagaaaggaaggcuggggg

SEQ ID NO: 138770 - RNA, 22 nt, Human
gggcaagaggguuugacaugag

SEQ ID NO: 138771 - RNA, 22 nt, Human
ggaaaaucaaaccauuuacagu

SEQ ID NO: 138772 - RNA, 22 nt, Human
gcuuuggcuucuccuggcagga

SEQ ID NO: 138773 - RNA, 22 nt, Human
gcuguggaaaaugggucuccaa

SEQ ID NO: 138774 - RNA, 22 nt, Human
gcuguggagaagcugccuaugg

SEQ ID NO: 138775 - RNA, 21 nt, Human
gggaggagcuucccuuugccc

SEQ ID NO: 138776 - RNA, 22 nt, Human
ggugucagccacuuugucggag

SEQ ID NO: 138777 - RNA, 22 nt, Human
ggugucaucugggcuggagaua

SEQ ID NO: 138778 - RNA, 22 nt, Human
gguguagagaaaauaguuguau

SEQ ID NO: 138779 - RNA, 22 nt, Human
gguugaagcuacuuucuggaug

SEQ ID NO: 138780 - RNA, 22 nt, Human
gguguacuucacucuuaccuag

SEQ ID NO: 138781 - RNA, 22 nt, Human
guaaaucccucucuuuguagau

SEQ ID NO: 138782 - RNA, 22 nt, Human
guaacuuuuuccucauuggcua

SEQ ID NO: 138783 - RNA, 22 nt, Human
guaagaauauacccaggaguca

SEQ ID NO: 138784 - RNA, 22 nt, Human
guacuacagguuugguaguggg

SEQ ID NO: 138785 - RNA, 22 nt, Human
guaagcagcaugacgguuggau

SEQ ID NO: 138786 - RNA, 22 nt, Human
guacugguuuucuuacucuggc

SEQ ID NO: 138787 - RNA, 22 nt, Human
guacugggaauggagccugggc

SEQ ID NO: 138788 - RNA, 22 nt, Human
guagagcagaaacauggagaaa

SEQ ID NO: 138789 - RNA, 22 nt, Human
guaggugggcuuccaagguccu

SEQ ID NO: 138790 - RNA, 22 nt, Human
guaggaaaugaauaagguaccu

SEQ ID NO: 138791 - RNA, 22 nt, Human
guagaucaugaaaauucacugc

SEQ ID NO: 138792 - RNA, 22 nt, Human
ggccgccacuuuccagugcugc

SEQ ID NO: 138793 - RNA, 22 nt, Human
ggccgccgcuuagcugagcccc

SEQ ID NO: 138794 - RNA, 20 nt, Human
ggccugagcauggcuggcag

SEQ ID NO: 138795 - RNA, 22 nt, Human
ggccugagaagcaaggacacaa

SEQ ID NO: 138796 - RNA, 22 nt, Human
ggccugcuaccagcugugaccu

SEQ ID NO: 138797 - RNA, 22 nt, Human
ggugcugcugcugaacccagcu

SEQ ID NO: 138798 - RNA, 22 nt, Human
ggcagugguaggagcccaggag

SEQ ID NO: 138799 - RNA, 22 nt, Human
ggcagguggcacugcugcuccc

SEQ ID NO: 138800 - RNA, 22 nt, Human
gguggggugagggggcgaggcc

SEQ ID NO: 138801 - RNA, 22 nt, Human
gguggggacuuggggucagcgg

SEQ ID NO: 138802 - RNA, 22 nt, Human
ggcagcuuucaauaggguuaug

SEQ ID NO: 138803 - RNA, 22 nt, Human
ggcagguccugaguccugaggc

SEQ ID NO: 138804 - RNA, 18 nt, Human
ggcagggcucagcugcuc

SEQ ID NO: 138805 - RNA, 22 nt, Human
ggugcagucuggggcacauuau

SEQ ID NO: 138806 - RNA, 22 nt, Human
ggcagcccuggacccuggagaa

SEQ ID NO: 138807 - RNA, 22 nt, Human
ggcagcagaacuggcccuguau

SEQ ID NO: 138808 - RNA, 22 nt, Human
ggcagcagaaccaacuguggcu

SEQ ID NO: 138809 - RNA, 22 nt, Human
ggcacuggguugcagagagaga

SEQ ID NO: 138810 - RNA, 22 nt, Human
ggcacgagccaguguguguguu

SEQ ID NO: 138811 - RNA, 22 nt, Human
ggucgguuggagagaucaugaa

SEQ ID NO: 138812 - RNA, 22 nt, Human
ggucgucuguccugucgccgcu

SEQ ID NO: 138813 - RNA, 22 nt, Human
ggucggggcuggccggcguggu

SEQ ID NO: 138814 - RNA, 22 nt, Human
ggucuuccuugggggacuugaa

SEQ ID NO: 138815 - RNA, 22 nt, Human
ggucugauaccugcagguuguc

SEQ ID NO: 138816 - RNA, 20 nt, Human
ggucuguuucuucuuuucau

SEQ ID NO: 138817 - RNA, 19 nt, Human
ggauaagguuggagugauc

SEQ ID NO: 138818 - RNA, 22 nt, Human
ggguguuaugccucugagucag

SEQ ID NO: 138819 - RNA, 22 nt, Human
gguagggaaggucucccacauu

SEQ ID NO: 138820 - RNA, 22 nt, Human
gguacgagcccugccuaguguc

SEQ ID NO: 138821 - RNA, 18 nt, Human
ggcugggcugugccccuu

SEQ ID NO: 138822 - RNA, 22 nt, Human
ggcugugaaguacguugaaggu

SEQ ID NO: 138823 - RNA, 22 nt, Human
ggcugggaggcggaggcugaga

SEQ ID NO: 138824 - RNA, 22 nt, Human
gcuggugugagauucucgaggg

SEQ ID NO: 138825 - RNA, 22 nt, Human
gcugguggcagagcuccgcggc

SEQ ID NO: 138826 - RNA, 22 nt, Human
gcuggucuggcaauccucaugg

SEQ ID NO: 138827 - RNA, 22 nt, Human
gcuggguaguucuuguuuggga

SEQ ID NO: 138828 - RNA, 19 nt, Human
gcugggauaggauguauuu

SEQ ID NO: 138829 - RNA, 22 nt, Human
ggcuuaguagggacagaugcac

SEQ ID NO: 138830 - RNA, 22 nt, Human
gcuguccugggaacaggcacua

SEQ ID NO: 138831 - RNA, 22 nt, Human
ggcuccagauguccccuggcaa

SEQ ID NO: 138832 - RNA, 22 nt, Human
gcuggauaaggaucaguuucuu

SEQ ID NO: 138833 - RNA, 22 nt, Human
gcugcuucgcugcacacccgag

SEQ ID NO: 138834 - RNA, 22 nt, Human
ggcucuggcgagcuuuaguaca

SEQ ID NO: 138835 - RNA, 22 nt, Human
ggcugcuauuggucuggcuugg

SEQ ID NO: 138836 - RNA, 22 nt, Human
ggcugcuggaguugggucucuc

SEQ ID NO: 138837 - RNA, 21 nt, Human
ggcugcucgugaugaacuuca

SEQ ID NO: 138838 - RNA, 21 nt, Human
gcuggcugucucuuacacggu

SEQ ID NO: 138839 - RNA, 22 nt, Human
ggcuggacuuucugcugggcuc

SEQ ID NO: 138840 - RNA, 22 nt, Human
ggcuggaacuucuucuggcauu

SEQ ID NO: 138841 - RNA, 22 nt, Human
gcuccccaggcccuccacucuc

SEQ ID NO: 138842 - RNA, 23 nt, Human
gcugaagcccacucccugggucu

SEQ ID NO: 138843 - RNA, 22 nt, Human
gcucugcuccaucuguuuccuc

SEQ ID NO: 138844 - RNA, 22 nt, Human
gcugcccucccagggcaagcuu

SEQ ID NO: 138845 - RNA, 22 nt, Human
gcugcccauugcucucccacuc

SEQ ID NO: 138846 - RNA, 22 nt, Human
ggccagcgugggggaguagcgg

SEQ ID NO: 138847 - RNA, 22 nt, Human
gcugcagggagcuggaaggcuc

SEQ ID NO: 138848 - RNA, 22 nt, Human
ggcccugcuuccccaguguaca

SEQ ID NO: 138849 - RNA, 22 nt, Human
ggccgccacacagauucccccg

SEQ ID NO: 138850 - RNA, 22 nt, Human
ggcccuggggcaggagcagagg

SEQ ID NO: 138851 - RNA, 22 nt, Human
ggccccagggauuaggccaacc

SEQ ID NO: 138852 - RNA, 22 nt, Human
ggccccggaggccguuagcuua

SEQ ID NO: 138853 - RNA, 22 nt, Human
ggccaguauacaaacuuccggu

SEQ ID NO: 138854 - RNA, 22 nt, Human
ggccagcuuugagcugcaggaa

SEQ ID NO: 138855 - RNA, 22 nt, Human
ggccuggccuccugcuuuucca

SEQ ID NO: 138856 - RNA, 22 nt, Human
ggccuggcacauaguaggcagu

SEQ ID NO: 138857 - RNA, 22 nt, Human
ggccugcucuggcuguggucag

SEQ ID NO: 138858 - RNA, 18 nt, Human
ggccucagccuggccgga

SEQ ID NO: 138859 - RNA, 22 nt, Human
ggccgggugggaggcagcggag

SEQ ID NO: 138860 - RNA, 22 nt, Human
ggccgggcaugcgagcugagcg

SEQ ID NO: 138861 - RNA, 22 nt, Human
ggcggugcgaggaugcagggcu

SEQ ID NO: 138862 - RNA, 22 nt, Human
ggcgggucuagggcccuggagu

SEQ ID NO: 138863 - RNA, 22 nt, Human
ggcgggggagccaggaacccag

SEQ ID NO: 138864 - RNA, 22 nt, Human
ggcggcugcuccuugcccucgg

SEQ ID NO: 138865 - RNA, 22 nt, Human
ggcuagggagacagagggcaug

SEQ ID NO: 138866 - RNA, 22 nt, Human
ggcggaggucacgcacccgcca

SEQ ID NO: 138867 - RNA, 22 nt, Human
ggcgcuccccgccugcgucgcg

SEQ ID NO: 138868 - RNA, 22 nt, Human
ggcgccugguauucuuccucuc

SEQ ID NO: 138869 - RNA, 22 nt, Human
gcugccuugaacuuggccuggg

SEQ ID NO: 138870 - RNA, 23 nt, Human
gcugccguuucccaucgugguga

SEQ ID NO: 138871 - RNA, 22 nt, Human
ggcgacuacugaaugcuugaaa

SEQ ID NO: 138872 - RNA, 22 nt, Human
ggccuugauuccggucauugaa

SEQ ID NO: 138873 - RNA, 22 nt, Human
gcugcuggcggagcuggcgcug

SEQ ID NO: 138874 - RNA, 22 nt, Human
gcugcgccgggagccggggccg

SEQ ID NO: 138875 - RNA, 22 nt, Human
gcugcgcgcagccggcgccgag

SEQ ID NO: 138876 - RNA, 22 nt, Human
gcggcccggguccccagcagca

SEQ ID NO: 138877 - RNA, 22 nt, Human
ggcagaaaacaauaaccauuuc

SEQ ID NO: 138878 - RNA, 22 nt, Human
ggcaagauccagcacaaacaca

SEQ ID NO: 138879 - RNA, 22 nt, Human
gcgggcgcuguggccccggccu

SEQ ID NO: 138880 - RNA, 22 nt, Human
gcggcuggcuguccaaacuggg

SEQ ID NO: 138881 - RNA, 19 nt, Human
gcggcggugccggcuggga

SEQ ID NO: 138882 - RNA, 22 nt, Human
gcggcgucccagcuccgacggc

SEQ ID NO: 138883 - RNA, 22 nt, Human
ggauccuucagcacugaggugu

SEQ ID NO: 138884 - RNA, 22 nt, Human
ggaugauacuuggagaaauauu

SEQ ID NO: 138885 - RNA, 22 nt, Human
ggaugcugcuccacaucccaca

SEQ ID NO: 138886 - RNA, 22 nt, Human
ggauggaugugaucugccuccu

SEQ ID NO: 138887 - RNA, 22 nt, Human
ggaugcguuugaauguguuugu

SEQ ID NO: 138888 - RNA, 23 nt, Human
ggauccugacauauaccaucacc

SEQ ID NO: 138889 - RNA, 22 nt, Human
ggaucccaucgagcuggcuguc

SEQ ID NO: 138890 - RNA, 22 nt, Human
gcuccagcuccauaaacauaag

SEQ ID NO: 138891 - RNA, 22 nt, Human
gcucccagcuuuuguccacggc

SEQ ID NO: 138892 - RNA, 22 nt, Human
gcucagcuggagagggacgggu

SEQ ID NO: 138893 - RNA, 22 nt, Human
gcggggcucuacuuggccugga

SEQ ID NO: 138894 - RNA, 22 nt, Human
gcggggggcucgggcagcucgg

SEQ ID NO: 138895 - RNA, 22 nt, Human
ggcaggaaguaaggaugcuaca

SEQ ID NO: 138896 - RNA, 22 nt, Human
gcgguggcuacuaaaguucgaa

SEQ ID NO: 138897 - RNA, 22 nt, Human
gcgggugagauucgagagaugg

SEQ ID NO: 138898 - RNA, 22 nt, Human
gcgguguuuuaacacucccucg

SEQ ID NO: 138899 - RNA, 22 nt, Human
ggagcagaggaaagaguagcau

SEQ ID NO: 138900 - RNA, 19 nt, Human
ggagcagauaaacauacuu

SEQ ID NO: 138901 - RNA, 22 nt, Human
ggagcaguggaggggccagggu

SEQ ID NO: 138902 - RNA, 22 nt, Human
gcgccgacccucccugccggac

SEQ ID NO: 138903 - RNA, 22 nt, Human
gccuuggacuaccacucccaca

SEQ ID NO: 138904 - RNA, 22 nt, Human
gccuucccuccucugcucucag

SEQ ID NO: 138905 - RNA, 22 nt, Human
gccuuucuugguuugucaggca

SEQ ID NO: 138906 - RNA, 22 nt, Human
gccuuuauauuacauuuggaag

SEQ ID NO: 138907 - RNA, 23 nt, Human
ggacgugaggcgcccuuuuuccc

SEQ ID NO: 138908 - RNA, 22 nt, Human
ggacggcuagcagcagaauuca

SEQ ID NO: 138909 - RNA, 22 nt, Human
gccuggaaugcaaugugacgaa

SEQ ID NO: 138910 - RNA, 22 nt, Human
gccuggccaaucgccgucuagg

SEQ ID NO: 138911 - RNA, 22 nt, Human
gccuggcagggagauuguaaga

SEQ ID NO: 138912 - RNA, 21 nt, Human
gccugcuguucacccugccac

SEQ ID NO: 138913 - RNA, 22 nt, Human
gccccaaccccuccuuggucua

SEQ ID NO: 138914 - RNA, 22 nt, Human
gcuggggaucgaaggcagagcc

SEQ ID NO: 138915 - RNA, 22 nt, Human
gcuggguuguucuccuggucca

SEQ ID NO: 138916 - RNA, 22 nt, Human
gcugggucucucccugguccug

SEQ ID NO: 138917 - RNA, 23 nt, Human
gcccagaggccccuggccugagc

SEQ ID NO: 138918 - RNA, 22 nt, Human
gcugggagaggcagcuuucgga

SEQ ID NO: 138919 - RNA, 22 nt, Human
ggaagcucaauacuuuccucuu

SEQ ID NO: 138920 - RNA, 22 nt, Human
ggaagcugucugcccggcgcuc

SEQ ID NO: 138921 - RNA, 22 nt, Human
gcccauggagaccucaggcugg

SEQ ID NO: 138922 - RNA, 22 nt, Human
gcccagcuuuuugaggcaggca

SEQ ID NO: 138923 - RNA, 22 nt, Human
gugcuugcgcauaacuggggcc

SEQ ID NO: 138924 - RNA, 22 nt, Human
ggccuugggauguggcugcagc

SEQ ID NO: 138925 - RNA, 22 nt, Human
ggccuugguggcuuugcugaug

SEQ ID NO: 138926 - RNA, 22 nt, Human
guggaaggaauuaacagacuag

SEQ ID NO: 138927 - RNA, 22 nt, Human
gggcaggcuggguggugguccc

SEQ ID NO: 138928 - RNA, 22 nt, Human
gggcaggggcagugguggcauu

SEQ ID NO: 138929 - RNA, 22 nt, Human
gugcuuuaccuuauuggucucg

SEQ ID NO: 138930 - RNA, 22 nt, Human
gggcagagagcuggaacuccuu

SEQ ID NO: 138931 - RNA, 22 nt, Human
gggccggagaagguagcugaag

SEQ ID NO: 138932 - RNA, 22 nt, Human
guggagaucuggugcccccugg

SEQ ID NO: 138933 - RNA, 22 nt, Human
guggagaugagauauaccccuu

SEQ ID NO: 138934 - RNA, 22 nt, Human
guggagaaauauguucagcuuc

SEQ ID NO: 138935 - RNA, 22 nt, Human
guggagaaagcuggaaucugag

SEQ ID NO: 138936 - RNA, 18 nt, Human
guggccauugaccagcuu

SEQ ID NO: 138937 - RNA, 22 nt, Human
guggccuuccuguuccuuugaa

SEQ ID NO: 138938 - RNA, 22 nt, Human
guggcgucgaugauggugucau

SEQ ID NO: 138939 - RNA, 22 nt, Human
guggcuuaauauuuauagcaga

SEQ ID NO: 138940 - RNA, 22 nt, Human
guggauggagcuggaagccauu

SEQ ID NO: 138941 - RNA, 22 nt, Human
guggcagagagcaagugucuga

SEQ ID NO: 138942 - RNA, 22 nt, Human
guggcaguaaagcuggaaaagu

SEQ ID NO: 138943 - RNA, 18 nt, Human
gugggcacacacucuguu

SEQ ID NO: 138944 - RNA, 22 nt, Human
gugggggugaggaauguucuau

SEQ ID NO: 138945 - RNA, 22 nt, Human
guggggguaggggguuuccugg

SEQ ID NO: 138946 - RNA, 22 nt, Human
gugggugaguggggccgccuga

SEQ ID NO: 138947 - RNA, 22 nt, Human
gugguuugcugguguacguuua

SEQ ID NO: 138948 - RNA, 22 nt, Human
guguagauuuguucaccuauua

SEQ ID NO: 138949 - RNA, 22 nt, Human
gugguggugaggcaaggggugu

SEQ ID NO: 138950 - RNA, 22 nt, Human
guggugggcgugguguaugccu

SEQ ID NO: 138951 - RNA, 22 nt, Human
gugguggggaguuggauggaag

SEQ ID NO: 138952 - RNA, 22 nt, Human
gggcggugccugucuccgaagc

SEQ ID NO: 138953 - RNA, 22 nt, Human
gggcuagggucagggggccacu

SEQ ID NO: 138954 - RNA, 22 nt, Human
gugguaccaguaggucagccau

SEQ ID NO: 138955 - RNA, 22 nt, Human
gugggugauacugccgugggag

SEQ ID NO: 138956 - RNA, 22 nt, Human
gggcgcgccaggagcugcgcgg

SEQ ID NO: 138957 - RNA, 22 nt, Human
gggcgccgggagugagagugag

SEQ ID NO: 138958 - RNA, 22 nt, Human
gugguccugguugucugagaga

SEQ ID NO: 138959 - RNA, 22 nt, Human
guggugauuugggucuagcuuu

SEQ ID NO: 138960 - RNA, 22 nt, Human
guggugaacauuugcaucugcu

SEQ ID NO: 138961 - RNA, 22 nt, Human
gggcggccugcucuguggggag

SEQ ID NO: 138962 - RNA, 22 nt, Human
guguugaaaaguagcacugcuu

SEQ ID NO: 138963 - RNA, 22 nt, Human
gggcuuuuccaacacucuggag

SEQ ID NO: 138964 - RNA, 22 nt, Human
gggcuuguuaacuuggcuucca

SEQ ID NO: 138965 - RNA, 22 nt, Human
guguuagcauggaacagaacgc

SEQ ID NO: 138966 - RNA, 22 nt, Human
gugugucucaguugcuccgaag

SEQ ID NO: 138967 - RNA, 22 nt, Human
gggcuguuugcauauguuuaua

SEQ ID NO: 138968 - RNA, 22 nt, Human
gugugcacaaucuggcaugugc

SEQ ID NO: 138969 - RNA, 22 nt, Human
guguggcgacucagagcugccu

SEQ ID NO: 138970 - RNA, 22 nt, Human
gugucccaaagauuagaaauca

SEQ ID NO: 138971 - RNA, 22 nt, Human
gugugaguggcuaagugugccu

SEQ ID NO: 138972 - RNA, 22 nt, Human
gugucuuggaacuggaauugag

SEQ ID NO: 138973 - RNA, 22 nt, Human
gggcugagagcuggaaucugag

SEQ ID NO: 138974 - RNA, 22 nt, Human
gggcugaugcuuauacauacug

SEQ ID NO: 138975 - RNA, 22 nt, Human
gggcuggcaguuuucugaguuc

SEQ ID NO: 138976 - RNA, 22 nt, Human
ggguuccugaagugguucagga

SEQ ID NO: 138977 - RNA, 21 nt, Human
gguagggaagguguuccucau

SEQ ID NO: 138978 - RNA, 22 nt, Human
guugcaaaugggaagaugguua

SEQ ID NO: 138979 - RNA, 22 nt, Human
gguaagcacuucauguacauga

SEQ ID NO: 138980 - RNA, 22 nt, Human
guugauauggaaacucuagguu

SEQ ID NO: 138981 - RNA, 22 nt, Human
gguagaggaugaggagguugga

SEQ ID NO: 138982 - RNA, 22 nt, Human
gggucggcacucuggcagcacc

SEQ ID NO: 138983 - RNA, 22 nt, Human
guucgucuguggugugaggugc

SEQ ID NO: 138984 - RNA, 22 nt, Human
gggucuggagauccgggugaag

SEQ ID NO: 138985 - RNA, 22 nt, Human
gggugcuuaagcuuguuuguaa

SEQ ID NO: 138986 - RNA, 22 nt, Human
guuccgcggccucgcgcugagc

SEQ ID NO: 138987 - RNA, 22 nt, Human
guuccugugcccuguucuuucc

SEQ ID NO: 138988 - RNA, 22 nt, Human
ggguggaaugugagugugugug

SEQ ID NO: 138989 - RNA, 22 nt, Human
guucugcccaggccuccccaac

SEQ ID NO: 138990 - RNA, 22 nt, Human
guucuuagcacuucugcccauu

SEQ ID NO: 138991 - RNA, 22 nt, Human
gggugguggagguuugacagac

SEQ ID NO: 138992 - RNA, 22 nt, Human
gggggagcuacaggucccuugg

SEQ ID NO: 138993 - RNA, 22 nt, Human
ggggcuuggguagagcagaaac

SEQ ID NO: 138994 - RNA, 22 nt, Human
ggggcuuggguaagaaugcaaa

SEQ ID NO: 138995 - RNA, 22 nt, Human
ggggcuggguuugcgcaggcuc

SEQ ID NO: 138996 - RNA, 23 nt, Human
gggggagcuggacuccuagaucc

SEQ ID NO: 138997 - RNA, 22 nt, Human
guuauacuuaugugcaaaaaua

SEQ ID NO: 138998 - RNA, 22 nt, Human
gggguuggaugccuuggaaauu

SEQ ID NO: 138999 - RNA, 22 nt, Human
ggggugaggcagggcagggguc

SEQ ID NO: 139000 - RNA, 22 nt, Human
ggggugagaguguuuuaaagca

SEQ ID NO: 139001 - RNA, 22 nt, Human
guuaaaugcagauucugacuca

SEQ ID NO: 139002 - RNA, 21 nt, Human
guuaccacugaugcaacagga

SEQ ID NO: 139003 - RNA, 22 nt, Human
guuaauaugcaaaacggaugcg

SEQ ID NO: 139004 - RNA, 22 nt, Human
ggggccaugauggacgagguga

SEQ ID NO: 139005 - RNA, 22 nt, Human
ggggauuucccaaugcgaagca

SEQ ID NO: 139006 - RNA, 22 nt, Human
ggggacggcuggccggggcccc

SEQ ID NO: 139007 - RNA, 22 nt, Human
guguugaugugucuguauucua

SEQ ID NO: 139008 - RNA, 22 nt, Human
guguucucagcacccacuucau

SEQ ID NO: 139009 - RNA, 23 nt, Human
guguuguugauuuucgaaucuuu

SEQ ID NO: 139010 - RNA, 22 nt, Human
guguuuguauccuccauauaac

SEQ ID NO: 139011 - RNA, 22 nt, Human
guguuggugagcucauuuccac

SEQ ID NO: 139012 - RNA, 22 nt, Human
guguugugauuggucagucacu

SEQ ID NO: 139013 - RNA, 22 nt, Human
guagccauuuucuagagaguua

SEQ ID NO: 139014 - RNA, 22 nt, Human
uaaccuugaagacugagcugac

SEQ ID NO: 139015 - RNA, 23 nt, Human
uaacacaguccuggucuuuggcc

SEQ ID NO: 139016 - RNA, 22 nt, Human
guagguggaggcaacacagcca

SEQ ID NO: 139017 - RNA, 22 nt, Human
guagggguggggagguggucug

SEQ ID NO: 139018 - RNA, 22 nt, Human
guaguauuuucugaggacuggu

SEQ ID NO: 139019 - RNA, 22 nt, Human
guaguggaauuuagaguauaau

SEQ ID NO: 139020 - RNA, 22 nt, Human
guauauccaauaggugaugaaa

SEQ ID NO: 139021 - RNA, 22 nt, Human
uaagauauugagugguaauuug

SEQ ID NO: 139022 - RNA, 22 nt, Human
guaucaggacuaaauuauggau

SEQ ID NO: 139023 - RNA, 23 nt, Human
gucaccuccccuugccuucuccc

SEQ ID NO: 139024 - RNA, 22 nt, Human
gucacuguuucacuguucauua

SEQ ID NO: 139025 - RNA, 22 nt, Human
gucagacugaguuccuggguac

SEQ ID NO: 139026 - RNA, 22 nt, Human
gucaaugcuuaguuugccugaa

SEQ ID NO: 139027 - RNA, 22 nt, Human
gucacaaaugauuuagcaauca

SEQ ID NO: 139028 - RNA, 22 nt, Human
uaagcguuugggaguuaugaac

SEQ ID NO: 139029 - RNA, 22 nt, Human
gguugccuuugcaguuggauca

SEQ ID NO: 139030 - RNA, 22 nt, Human
gguugcggaccagcugggcugc

SEQ ID NO: 139031 - RNA, 22 nt, Human
gguuccagacaguuauaugggc

SEQ ID NO: 139032 - RNA, 22 nt, Human
gguucuggaaaagaaagcaaag

SEQ ID NO: 139033 - RNA, 21 nt, Human
gguuucugcaaaccuuguaca

SEQ ID NO: 139034 - RNA, 22 nt, Human
uaaagcacucaaaauuguagcu

SEQ ID NO: 139035 - RNA, 22 nt, Human
gguugggauuauccaaggcaga

SEQ ID NO: 139036 - RNA, 19 nt, Human
ggugggacaggugagauau

SEQ ID NO: 139037 - RNA, 22 nt, Human
guuuugaugugauuucucaugu

SEQ ID NO: 139038 - RNA, 22 nt, Human
gguggcagaggaggcgggagag

SEQ ID NO: 139039 - RNA, 22 nt, Human
ggugcuuuucacaagcauggga

SEQ ID NO: 139040 - RNA, 22 nt, Human
gguggcuugcugguaggugugc

SEQ ID NO: 139041 - RNA, 22 nt, Human
guuuucuccugcuauacagugc

SEQ ID NO: 139042 - RNA, 22 nt, Human
ggucaaauaugaguaauuuccu

SEQ ID NO: 139043 - RNA, 22 nt, Human
ggucauacaaggcacuggugau

SEQ ID NO: 139044 - RNA, 22 nt, Human
ggucaauuuggucaaucguuua

SEQ ID NO: 139045 - RNA, 20 nt, Human
ggucagccaagaaguuaccu

SEQ ID NO: 139046 - RNA, 22 nt, Human
guuuuagugauaagaacaccaa

SEQ ID NO: 139047 - RNA, 22 nt, Human
uacaaaugaucaucucuuugaa

SEQ ID NO: 139048 - RNA, 22 nt, Human
uacaaauguuucuucuccuuuu

SEQ ID NO: 139049 - RNA, 22 nt, Human
gucaggaugagggaugaggagu

SEQ ID NO: 139050 - RNA, 20 nt, Human
gucagaggacccuagagcga

SEQ ID NO: 139051 - RNA, 22 nt, Human
gucugcagcacugugcacgguc

SEQ ID NO: 139052 - RNA, 22 nt, Human
uacacacacaugcauguacgug

SEQ ID NO: 139053 - RNA, 22 nt, Human
gucugccagauucugcuggauc

SEQ ID NO: 139054 - RNA, 18 nt, Human
uacagauguaugucuaca

SEQ ID NO: 139055 - RNA, 20 nt, Human
uacccgcagcugggucuggc

SEQ ID NO: 139056 - RNA, 22 nt, Human
uaccgaagcugcuuuugcaugu

SEQ ID NO: 139057 - RNA, 19 nt, Human
uacccggauagccagguag

SEQ ID NO: 139058 - RNA, 21 nt, Human
uacagcucaucaauuacugcu

SEQ ID NO: 139059 - RNA, 20 nt, Human
uaccagggguuugggacagc

SEQ ID NO: 139060 - RNA, 21 nt, Human
uaccacugaaauugaucguuc

SEQ ID NO: 139061 - RNA, 22 nt, Human
uacucauuggagaauuacgagg

SEQ ID NO: 139062 - RNA, 22 nt, Human
gugaagaugccucaggugaccc

SEQ ID NO: 139063 - RNA, 21 nt, Human
uacugugccagggcagcucug

SEQ ID NO: 139064 - RNA, 22 nt, Human
gugccuggaaucuuuucuucac

SEQ ID NO: 139065 - RNA, 22 nt, Human
uagcagcacuauuuguuguagu

SEQ ID NO: 139066 - RNA, 20 nt, Human
uagcacuguauccucuucau

SEQ ID NO: 139067 - RNA, 22 nt, Human
uagcacauaguaggcacaggcu

SEQ ID NO: 139068 - RNA, 22 nt, Human
gugcccaguugaggccaggacu

SEQ ID NO: 139069 - RNA, 22 nt, Human
gugccgggcugcggcaaggugu

SEQ ID NO: 139070 - RNA, 22 nt, Human
gugccgcuggagcuggaauuga

SEQ ID NO: 139071 - RNA, 22 nt, Human
gugccugcucauucucaauauu

SEQ ID NO: 139072 - RNA, 22 nt, Human
gugcagcugggcgcugaccuuc

SEQ ID NO: 139073 - RNA, 22 nt, Human
gugcaaugaguguggcaaagcc

SEQ ID NO: 139074 - RNA, 22 nt, Human
gugcacagaaacauacaaugug

SEQ ID NO: 139075 - RNA, 19 nt, Human
gugcacugucacuuugcuc

SEQ ID NO: 139076 - RNA, 22 nt, Human
uagaccugugggggcagcgggc

SEQ ID NO: 139077 - RNA, 22 nt, Human
uagacauuuacuuugaaaaaau

SEQ ID NO: 139078 - RNA, 23 nt, Human
uagacugcaggcuccuugagggc

SEQ ID NO: 139079 - RNA, 22 nt, Human
gugaugaaggccugcaccuggu

SEQ ID NO: 139080 - RNA, 22 nt, Human
gugaguugugugaguaagcaga

SEQ ID NO: 139081 - RNA, 22 nt, Human
gugaggugauugcugguguuug

SEQ ID NO: 139082 - RNA, 17 nt, Human
gugagcugagucaggac

SEQ ID NO: 139083 - RNA, 22 nt, Human
gugaggcccaggugaaauuaac

SEQ ID NO: 139084 - RNA, 22 nt, Human
uagacuuggaagagacauugga

SEQ ID NO: 139085 - RNA, 22 nt, Human
gugaugugugaaggucugcagg

SEQ ID NO: 139086 - RNA, 19 nt, Human
gugaugaugccacuccaac

SEQ ID NO: 139087 - RNA, 22 nt, Human
uagagcccucuggccacguugc

SEQ ID NO: 139088 - RNA, 22 nt, Human
uagaggccagggugucuugagu

SEQ ID NO: 139089 - RNA, 22 nt, Human
ucccagucuagagccggauugg

SEQ ID NO: 139090 - RNA, 22 nt, Human
uacuucaguuacaugaagguau

SEQ ID NO: 139091 - RNA, 22 nt, Human
uccuaagaaacagacugaaaag

SEQ ID NO: 139092 - RNA, 22 nt, Human
uagaaugggaggggaaucaucc

SEQ ID NO: 139093 - RNA, 19 nt, Human
uagagcagcuucagauucc

SEQ ID NO: 139094 - RNA, 23 nt, Human
uccaguagcuacgcaggguggag

SEQ ID NO: 139095 - RNA, 22 nt, Human
uagacuggaagcuccuugaggc

SEQ ID NO: 139096 - RNA, 22 nt, Human
uccucugagguccucucggcca

SEQ ID NO: 139097 - RNA, 22 nt, Human
uccuaguucugaccucgcucac

SEQ ID NO: 139098 - RNA, 22 nt, Human
uagcauccugugugaauguauu

SEQ ID NO: 139099 - RNA, 23 nt, Human
uccugcagauaagcugguugaca

SEQ ID NO: 139100 - RNA, 22 nt, Human
uagauuguaagcuccuugaggg

SEQ ID NO: 139101 - RNA, 22 nt, Human
uagccucauuauuuacucauga

SEQ ID NO: 139102 - RNA, 22 nt, Human
uagccaguuuauaaaguggaag

SEQ ID NO: 139103 - RNA, 22 nt, Human
uagcuucccagcuaaccauguc

SEQ ID NO: 139104 - RNA, 22 nt, Human
uccuuguucugauuuuucuggg

SEQ ID NO: 139105 - RNA, 21 nt, Human
uccuuguuucuuccaaaacug

SEQ ID NO: 139106 - RNA, 22 nt, Human
uccuuuggaaacuggaugucuu

SEQ ID NO: 139107 - RNA, 20 nt, Human
uagugaccaagagggcugcu

SEQ ID NO: 139108 - RNA, 22 nt, Human
ucguguuggaacugcuuuguaa

SEQ ID NO: 139109 - RNA, 22 nt, Human
ucgugagugcugucaccugcug

SEQ ID NO: 139110 - RNA, 22 nt, Human
ucgggacccccgcccgggcccg

SEQ ID NO: 139111 - RNA, 22 nt, Human
uagguggaaccauaugaaauuu

SEQ ID NO: 139112 - RNA, 22 nt, Human
ucggguguguguguuggguaug

SEQ ID NO: 139113 - RNA, 22 nt, Human
ucgggccacauccacacaucca

SEQ ID NO: 139114 - RNA, 21 nt, Human
ucgggcggcggcugaggcggc

SEQ ID NO: 139115 - RNA, 22 nt, Human
uaguacguuccaaaucacugga

SEQ ID NO: 139116 - RNA, 22 nt, Human
ucgcuugaacccaggaagugga

SEQ ID NO: 139117 - RNA, 22 nt, Human
uaggcauguaaaagugaguucg

SEQ ID NO: 139118 - RNA, 22 nt, Human
uaggcaauauuagacuuugucu

SEQ ID NO: 139119 - RNA, 22 nt, Human
uagggaggguuugggguggagg

SEQ ID NO: 139120 - RNA, 22 nt, Human
uccuuuuuagguuauuguacau

SEQ ID NO: 139121 - RNA, 22 nt, Human
ucgagauguuuguuguggugau

SEQ ID NO: 139122 - RNA, 22 nt, Human
ucgagcacaccagacuugcaga

SEQ ID NO: 139123 - RNA, 22 nt, Human
ucgagcgcucccugugcucucg

SEQ ID NO: 139124 - RNA, 22 nt, Human
ucgccuccucccagaucaacaa

SEQ ID NO: 139125 - RNA, 22 nt, Human
ucgcccagguuggagugcagug

SEQ ID NO: 139126 - RNA, 22 nt, Human
ucgcucgcuggcuccugcccgc

SEQ ID NO: 139127 - RNA, 22 nt, Human
ucgcgcgugccacgcgccgcgg

SEQ ID NO: 139128 - RNA, 22 nt, Human
uccagccauaucuuguagcccu

SEQ ID NO: 139129 - RNA, 22 nt, Human
uaccgcagagucauugugagga

SEQ ID NO: 139130 - RNA, 22 nt, Human
uccaggucgggggugggccggc

SEQ ID NO: 139131 - RNA, 22 nt, Human
uccagugaacaucauggcucca

SEQ ID NO: 139132 - RNA, 23 nt, Human
ucccacauuucacagcacuuucc

SEQ ID NO: 139133 - RNA, 22 nt, Human
ucccacacucaacacacaugua

SEQ ID NO: 139134 - RNA, 17 nt, Human
ucccacuucauuuucca

SEQ ID NO: 139135 - RNA, 22 nt, Human
uacucuggaguugagaugcgag

SEQ ID NO: 139136 - RNA, 21 nt, Human
uccauucuuggugguucugca

SEQ ID NO: 139137 - RNA, 22 nt, Human
uccauugucaauaguauugauu

SEQ ID NO: 139138 - RNA, 19 nt, Human
uaccagguuggagaggccc

SEQ ID NO: 139139 - RNA, 22 nt, Human
uccagaaaucucuguugauugu

SEQ ID NO: 139140 - RNA, 22 nt, Human
uccagacucaaaaaccagaugg

SEQ ID NO: 139141 - RNA, 19 nt, Human
uccaccgcgugcaccucua

SEQ ID NO: 139142 - RNA, 22 nt, Human
uccacgggagcgucggucucgg

SEQ ID NO: 139143 - RNA, 22 nt, Human
uccaccugucccugcuuccugc

SEQ ID NO: 139144 - RNA, 22 nt, Human
uacaccaugcuccagcaggaca

SEQ ID NO: 139145 - RNA, 22 nt, Human
uacaccuuaagccgcggcuccc

SEQ ID NO: 139146 - RNA, 22 nt, Human
ucauccugaagaaccugcuucc

SEQ ID NO: 139147 - RNA, 21 nt, Human
ucauccagguccugcuucuuc

SEQ ID NO: 139148 - RNA, 23 nt, Human
uaagccugugccugcuaccugcu

SEQ ID NO: 139149 - RNA, 22 nt, Human
uaaagacaauuucgagcuguag

SEQ ID NO: 139150 - RNA, 22 nt, Human
ucaggacacuuaauaggaacag

SEQ ID NO: 139151 - RNA, 22 nt, Human
ucaucagccaaagaguccuuca

SEQ ID NO: 139152 - RNA, 22 nt, Human
ucauuugggauuuuuuauaauu

SEQ ID NO: 139153 - RNA, 22 nt, Human
uaaaaucaugacagauugacau

SEQ ID NO: 139154 - RNA, 22 nt, Human
ucagcguuggccuccuccaggg

SEQ ID NO: 139155 - RNA, 22 nt, Human
ucagcguuaguuuuucaucuaa

SEQ ID NO: 139156 - RNA, 22 nt, Human
ucagcaguuaagcuucccugcc

SEQ ID NO: 139157 - RNA, 23 nt, Human
ucagaccaaccucuugcuggaac

SEQ ID NO: 139158 - RNA, 22 nt, Human
guuuucuaaaacacauauaagu

SEQ ID NO: 139159 - RNA, 22 nt, Human
ucagacacacaacuucugcuua

SEQ ID NO: 139160 - RNA, 22 nt, Human
ucagaagguacugaagacaugg

SEQ ID NO: 139161 - RNA, 22 nt, Human
ucagagccagacacacagcaga

SEQ ID NO: 139162 - RNA, 22 nt, Human
guuuugugugugugcccacacg

SEQ ID NO: 139163 - RNA, 22 nt, Human
guuuuguucaugaacauugggu

SEQ ID NO: 139164 - RNA, 22 nt, Human
ucacuguuucaccgucugaagg

SEQ ID NO: 139165 - RNA, 22 nt, Human
ucacucgccuuuucguucgccg

SEQ ID NO: 139166 - RNA, 23 nt, Human
ucacugccaagaaaaguuacaga

SEQ ID NO: 139167 - RNA, 22 nt, Human
ucacugccuagggcuacugugc

SEQ ID NO: 139168 - RNA, 22 nt, Human
ucaccgucucaguacggaggga

SEQ ID NO: 139169 - RNA, 22 nt, Human
ucacccagacugucugacucuu

SEQ ID NO: 139170 - RNA, 22 nt, Human
ucaccccagccuuaugacucag

SEQ ID NO: 139171 - RNA, 22 nt, Human
guuucuguggacucugcuuagg

SEQ ID NO: 139172 - RNA, 22 nt, Human
guuugagcaaucccucuauccc

SEQ ID NO: 139173 - RNA, 22 nt, Human
ucaccugccuggguggucaccu

SEQ ID NO: 139174 - RNA, 22 nt, Human
ucacauugcauuuucucauuug

SEQ ID NO: 139175 - RNA, 22 nt, Human
guugauuuaggguuuugguuuu

SEQ ID NO: 139176 - RNA, 22 nt, Human
guugugcaaaacaggaaggucu

SEQ ID NO: 139177 - RNA, 22 nt, Human
ucaagucaauagguuaguaggu

SEQ ID NO: 139178 - RNA, 22 nt, Human
ucaaggaagggguaggaauaau

SEQ ID NO: 139179 - RNA, 22 nt, Human
uauuaauugugguuauuguauu

SEQ ID NO: 139180 - RNA, 23 nt, Human
guuaccgaccugauucggcagcc

SEQ ID NO: 139181 - RNA, 22 nt, Human
guguguggacgucugagcccag

SEQ ID NO: 139182 - RNA, 22 nt, Human
guugaacagucacccugggagu

SEQ ID NO: 139183 - RNA, 22 nt, Human
uauuuguuucuaguggcagcaa

SEQ ID NO: 139184 - RNA, 22 nt, Human
uauuggcucagucagaaguuuu

SEQ ID NO: 139185 - RNA, 22 nt, Human
uaucuguagucucaugguuccu

SEQ ID NO: 139186 - RNA, 22 nt, Human
uauaugcacucagguguaugug

SEQ ID NO: 139187 - RNA, 22 nt, Human
guguccuguagaaacuguucca

SEQ ID NO: 139188 - RNA, 22 nt, Human
guguccaugugggugcucuccu

SEQ ID NO: 139189 - RNA, 22 nt, Human
gugcuaaguaaguauuuuggag

SEQ ID NO: 139190 - RNA, 22 nt, Human
uauauaauacacaaauauguac

SEQ ID NO: 139191 - RNA, 22 nt, Human
uauauauacauauagaauaugu

SEQ ID NO: 139192 - RNA, 22 nt, Human
uauacucaauaaauauuuggag

SEQ ID NO: 139193 - RNA, 21 nt, Human
ucagccuguccaguguuaacc

SEQ ID NO: 139194 - RNA, 23 nt, Human
ucagccgcuggcgaguccacugg

SEQ ID NO: 139195 - RNA, 22 nt, Human
ugaccucaagcaugcggagggc

SEQ ID NO: 139196 - RNA, 22 nt, Human
ugaccuacauuuauagcuguca

SEQ ID NO: 139197 - RNA, 22 nt, Human
ucagauggucauucacuagggu

SEQ ID NO: 139198 - RNA, 22 nt, Human
ucagcaaugggauucaggcuuu

SEQ ID NO: 139199 - RNA, 22 nt, Human
ucagcgucuccaaaagagcccg

SEQ ID NO: 139200 - RNA, 22 nt, Human
ucagccuugguuuugguguugg

SEQ ID NO: 139201 - RNA, 22 nt, Human
ucagcucacaauguugagaaag

SEQ ID NO: 139202 - RNA, 22 nt, Human
ucagcucucucuuggugaucuc

SEQ ID NO: 139203 - RNA, 22 nt, Human
ucagcugggagaaaguuuuagg

SEQ ID NO: 139204 - RNA, 21 nt, Human
ucaggaagagccaguucaugc

SEQ ID NO: 139205 - RNA, 22 nt, Human
ugacugguauuuguaaaccaua

SEQ ID NO: 139206 - RNA, 22 nt, Human
ucaggcaggaucccagggaagg

SEQ ID NO: 139207 - RNA, 22 nt, Human
ucaggagaguguucaguggagg

SEQ ID NO: 139208 - RNA, 19 nt, Human
ucaggaggucgaccuggca

SEQ ID NO: 139209 - RNA, 22 nt, Human
ugacacacagggggauggaguu

SEQ ID NO: 139210 - RNA, 22 nt, Human
ucacuguugccacggugauaau

SEQ ID NO: 139211 - RNA, 22 nt, Human
ucacuucuaugaucugucucuu

SEQ ID NO: 139212 - RNA, 22 nt, Human
ugacaagagaccccuccgcagg

SEQ ID NO: 139213 - RNA, 22 nt, Human
ucacuauagugccgaggacuga

SEQ ID NO: 139214 - RNA, 22 nt, Human
ucagagacaucagguuguagca

SEQ ID NO: 139215 - RNA, 22 nt, Human
ugacagugugcccggagguuag

SEQ ID NO: 139216 - RNA, 22 nt, Human
ucacccuguggcuauaaggcaa

SEQ ID NO: 139217 - RNA, 22 nt, Human
ucacagguuuaguccagcaguc

SEQ ID NO: 139218 - RNA, 22 nt, Human
ucacaugcucaccuaagccaca

SEQ ID NO: 139219 - RNA, 22 nt, Human
ucaccauguuuucauaggaaca

SEQ ID NO: 139220 - RNA, 22 nt, Human
ucaccaggauugggcuguaggc

SEQ ID NO: 139221 - RNA, 22 nt, Human
ucacugaauuucaagcuagugg

SEQ ID NO: 139222 - RNA, 22 nt, Human
ucacugaacucucauagagaaa

SEQ ID NO: 139223 - RNA, 22 nt, Human
ucacuggaaaacaaauguuuua

SEQ ID NO: 139224 - RNA, 22 nt, Human
ucacuggauucauguuucuuua

SEQ ID NO: 139225 - RNA, 22 nt, Human
ugaauuauaugguauugaacau

SEQ ID NO: 139226 - RNA, 22 nt, Human
ucaccuggagagcuugcuaaua

SEQ ID NO: 139227 - RNA, 22 nt, Human
ucaccuguuggauguauacugu

SEQ ID NO: 139228 - RNA, 19 nt, Human
ucacggucaaccagagccu

SEQ ID NO: 139229 - RNA, 22 nt, Human
ucacuaugcccagaauacaguu

SEQ ID NO: 139230 - RNA, 22 nt, Human
ugaaucugagccugcgcaaagu

SEQ ID NO: 139231 - RNA, 21 nt, Human
ucaaguccuggcuuugcucuu

SEQ ID NO: 139232 - RNA, 22 nt, Human
ugaauaaucuuggguauuaaua

SEQ ID NO: 139233 - RNA, 22 nt, Human
ucaagggaccaagcauucauua

SEQ ID NO: 139234 - RNA, 22 nt, Human
ucaauuuauguggcuauucauu

SEQ ID NO: 139235 - RNA, 22 nt, Human
ugaaggaggugaauccaugcau

SEQ ID NO: 139236 - RNA, 22 nt, Human
uauuuuaaaagcauuaauucuu

SEQ ID NO: 139237 - RNA, 22 nt, Human
ucaaaucugauaggcgacaccu

SEQ ID NO: 139238 - RNA, 22 nt, Human
uauuuuucacagauuggugcuu

SEQ ID NO: 139239 - RNA, 22 nt, Human
ugaagccacacuagcuuguccu

SEQ ID NO: 139240 - RNA, 21 nt, Human
ucaaccagguguugaaggcac

SEQ ID NO: 139241 - RNA, 22 nt, Human
ucaacagaagugauagcuauua

SEQ ID NO: 139242 - RNA, 22 nt, Human
ugaacuggauuugugagcuccu

SEQ ID NO: 139243 - RNA, 22 nt, Human
ucuuggucccugagcucuuuca

SEQ ID NO: 139244 - RNA, 22 nt, Human
ucuugcuguggcagaucuggag

SEQ ID NO: 139245 - RNA, 20 nt, Human
ucuugucuggcagccuggag

SEQ ID NO: 139246 - RNA, 22 nt, Human
ucuuuaucugugagcagucucc

SEQ ID NO: 139247 - RNA, 22 nt, Human
ucuuuccagaccagccccagcu

SEQ ID NO: 139248 - RNA, 19 nt, Human
ucuuugcuuuucuaagagg

SEQ ID NO: 139249 - RNA, 22 nt, Human
ucuuugcauggacauguguuuu

SEQ ID NO: 139250 - RNA, 22 nt, Human
ucuugcuggagucaaggcuaca

SEQ ID NO: 139251 - RNA, 22 nt, Human
ucuucuuugugguugcccaagg

SEQ ID NO: 139252 - RNA, 22 nt, Human
ucuucuuuccuuuugugcauuu

SEQ ID NO: 139253 - RNA, 22 nt, Human
ucuagcccucauggcugaaggc

SEQ ID NO: 139254 - RNA, 22 nt, Human
ucuaccuucagaaugugggguu

SEQ ID NO: 139255 - RNA, 20 nt, Human
uaguggaccuugaaggccuc

SEQ ID NO: 139256 - RNA, 22 nt, Human
ugcagaacacaguagacagaac

SEQ ID NO: 139257 - RNA, 22 nt, Human
ugcagcaucuccuugugccaug

SEQ ID NO: 139258 - RNA, 22 nt, Human
ugcagcagaauauggcugcagg

SEQ ID NO: 139259 - RNA, 22 nt, Human
ugcagccucacgcauccgcauu

SEQ ID NO: 139260 - RNA, 22 nt, Human
ugcagccuuuguccuugggcua

SEQ ID NO: 139261 - RNA, 22 nt, Human
ugcacauuucucacaauguaca

SEQ ID NO: 139262 - RNA, 22 nt, Human
uccaugcgcgauggccuggcuu

SEQ ID NO: 139263 - RNA, 22 nt, Human
ugcaaggcacccacucugcuuu

SEQ ID NO: 139264 - RNA, 19 nt, Human
ugcaagcuuuuucuuguua

SEQ ID NO: 139265 - RNA, 22 nt, Human
uccacagggaugccugcggcuu

SEQ ID NO: 139266 - RNA, 22 nt, Human
uccaccacgaaacugcagcugc

SEQ ID NO: 139267 - RNA, 22 nt, Human
uccaccaccaucacagucagac

SEQ ID NO: 139268 - RNA, 20 nt, Human
uccacugagcgucacggcag

SEQ ID NO: 139269 - RNA, 22 nt, Human
uccaguggcaccuuggcccuca

SEQ ID NO: 139270 - RNA, 22 nt, Human
uccagguccuacuggcccauag

SEQ ID NO: 139271 - RNA, 22 nt, Human
uccaaguuugagacugagagug

SEQ ID NO: 139272 - RNA, 22 nt, Human
uccaaauagcuggaugauggug

SEQ ID NO: 139273 - RNA, 22 nt, Human
ugaugaucaugcagguugguuu

SEQ ID NO: 139274 - RNA, 20 nt, Human
ugauccacucucauugcucu

SEQ ID NO: 139275 - RNA, 22 nt, Human
ugaucauugaacaucgaguuaa

SEQ ID NO: 139276 - RNA, 22 nt, Human
ucauuagcuaucagaguggaac

SEQ ID NO: 139277 - RNA, 22 nt, Human
ugaguguuguaaccauaugauu

SEQ ID NO: 139278 - RNA, 22 nt, Human
ugagugacuguugucaagaugg

SEQ ID NO: 139279 - RNA, 22 nt, Human
ugagugugugucuuggguaccg

SEQ ID NO: 139280 - RNA, 22 nt, Human
ugauagcaugcucucaguaaaa

SEQ ID NO: 139281 - RNA, 22 nt, Human
ugaguugucacaacgucacaag

SEQ ID NO: 139282 - RNA, 22 nt, Human
ucaggcgcucuucguggcugcc

SEQ ID NO: 139283 - RNA, 23 nt, Human
ugccaggaagaaugaccucugcu

SEQ ID NO: 139284 - RNA, 22 nt, Human
ugccagcuccgaggagcugcag

SEQ ID NO: 139285 - RNA, 22 nt, Human
ugccagauuaugucuccagggc

SEQ ID NO: 139286 - RNA, 20 nt, Human
ugccagagagcucauacccu

SEQ ID NO: 139287 - RNA, 22 nt, Human
ugccagugugccuuccgcucac

SEQ ID NO: 139288 - RNA, 22 nt, Human
ugccaaugauuccacaauggaa

SEQ ID NO: 139289 - RNA, 22 nt, Human
ugccaauuaccuauuucugaga

SEQ ID NO: 139290 - RNA, 22 nt, Human
ugcauugccauagcagggggau

SEQ ID NO: 139291 - RNA, 22 nt, Human
uccguugaggcugccaggcgag

SEQ ID NO: 139292 - RNA, 22 nt, Human
ugccaugguuguacaguagcag

SEQ ID NO: 139293 - RNA, 22 nt, Human
uccugggcuugcucuuuccauu

SEQ ID NO: 139294 - RNA, 22 nt, Human
uccugggucugugagccauacu

SEQ ID NO: 139295 - RNA, 21 nt, Human
uccugcagggcagcagagugg

SEQ ID NO: 139296 - RNA, 22 nt, Human
ugccuguguauuuccggccugc

SEQ ID NO: 139297 - RNA, 22 nt, Human
ucgaaugccaacaccgaaguuu

SEQ ID NO: 139298 - RNA, 22 nt, Human
ugccgggcugagcaagugcugc

SEQ ID NO: 139299 - RNA, 23 nt, Human
ugccggaucuacuuuggguucuc

SEQ ID NO: 139300 - RNA, 22 nt, Human
ugccgccgugggucccgacgcg

SEQ ID NO: 139301 - RNA, 22 nt, Human
ugcggugcgcccgggcgagugc

SEQ ID NO: 139302 - RNA, 22 nt, Human
ucgaugcuggcgcagguuucac

SEQ ID NO: 139303 - RNA, 22 nt, Human
ugcgccaggacacccguggcgg

SEQ ID NO: 139304 - RNA, 22 nt, Human
ucgccauguacaugaagggcgg

SEQ ID NO: 139305 - RNA, 22 nt, Human
ugcuaaguacauuccaggacuu

SEQ ID NO: 139306 - RNA, 22 nt, Human
ugcucacugcuuguguucaguu

SEQ ID NO: 139307 - RNA, 22 nt, Human
ugcucagaagacuuacugguua

SEQ ID NO: 139308 - RNA, 22 nt, Human
ucggccggagggggcgggcgca

SEQ ID NO: 139309 - RNA, 22 nt, Human
ucggcgaccugucauggaccaa

SEQ ID NO: 139310 - RNA, 22 nt, Human
ucggauuggggaugggugggag

SEQ ID NO: 139311 - RNA, 22 nt, Human
ucgugacuggacaaacuugggu

SEQ ID NO: 139312 - RNA, 22 nt, Human
ucgugaagaaauguggacuuca

SEQ ID NO: 139313 - RNA, 22 nt, Human
ucuaaaaauuagaaauuagguc

SEQ ID NO: 139314 - RNA, 22 nt, Human
ucgggggucgggcggcggucca

SEQ ID NO: 139315 - RNA, 22 nt, Human
ugcugcacuuauggcucugagg

SEQ ID NO: 139316 - RNA, 22 nt, Human
ugcugcacccuucauuuuccca

SEQ ID NO: 139317 - RNA, 22 nt, Human
ugcugacuauacauuuagcauu

SEQ ID NO: 139318 - RNA, 22 nt, Human
ugcucuguucaguguaucuugu

SEQ ID NO: 139319 - RNA, 22 nt, Human
ucgggcgaauguuguuuuucuc

SEQ ID NO: 139320 - RNA, 22 nt, Human
ugcucugcuaggagaagaauga

SEQ ID NO: 139321 - RNA, 22 nt, Human
ugcucgggcuccuuugagugag

SEQ ID NO: 139322 - RNA, 22 nt, Human
ucgggggaaccggcccgggccu

SEQ ID NO: 139323 - RNA, 23 nt, Human
ugcucgccuucaggacuugggcu

SEQ ID NO: 139324 - RNA, 20 nt, Human
ucugugugccaucaccuaac

SEQ ID NO: 139325 - RNA, 22 nt, Human
uggagagcaaugaggggcaggc

SEQ ID NO: 139326 - RNA, 22 nt, Human
uggagagcaggugaaggaaaga

SEQ ID NO: 139327 - RNA, 22 nt, Human
uggagcugaaguacucucacua

SEQ ID NO: 139328 - RNA, 22 nt, Human
uggaagcccagaaggaagcaga

SEQ ID NO: 139329 - RNA, 22 nt, Human
ucugggguucuuaauuuggaag

SEQ ID NO: 139330 - RNA, 22 nt, Human
uggaaggggccaggcgcggagu

SEQ ID NO: 139331 - RNA, 22 nt, Human
uggacccaccccagggccugcu

SEQ ID NO: 139332 - RNA, 22 nt, Human
uggacuguaauguguguggacc

SEQ ID NO: 139333 - RNA, 22 nt, Human
ucugguuuggguugcuauggcu

SEQ ID NO: 139334 - RNA, 22 nt, Human
uggacacugguggauauggaau

SEQ ID NO: 139335 - RNA, 22 nt, Human
ucugcagggcccuuggcuccug

SEQ ID NO: 139336 - RNA, 21 nt, Human
ucugccaguuucucuuacuuu

SEQ ID NO: 139337 - RNA, 22 nt, Human
ugcugccucugaauggagcagu

SEQ ID NO: 139338 - RNA, 22 nt, Human
ugcugccgccgccaccgccgcc

SEQ ID NO: 139339 - RNA, 19 nt, Human
ugcugcaggaauucucaag

SEQ ID NO: 139340 - RNA, 22 nt, Human
ucuggaggucucagggcgggaa

SEQ ID NO: 139341 - RNA, 22 nt, Human
uggaacugguuugcuucagacu

SEQ ID NO: 139342 - RNA, 22 nt, Human
uggaacuuccucacuuucccuc

SEQ ID NO: 139343 - RNA, 22 nt, Human
ucugccuucaggagcagacucu

SEQ ID NO: 139344 - RNA, 17 nt, Human
ucugccaguuuuagaau

SEQ ID NO: 139345 - RNA, 22 nt, Human
uggaaccuggcuucaaagggag

SEQ ID NO: 139346 - RNA, 22 nt, Human
ucuugggcaguccucuacuggu

SEQ ID NO: 139347 - RNA, 22 nt, Human
uggcccagaucucugaccuuga

SEQ ID NO: 139348 - RNA, 22 nt, Human
uggccccauuuuucuggagccu

SEQ ID NO: 139349 - RNA, 22 nt, Human
uggcccauccggcuccuccuug

SEQ ID NO: 139350 - RNA, 22 nt, Human
ucuuuauuucccuaacuugcua

SEQ ID NO: 139351 - RNA, 22 nt, Human
uggcccaagggaggcuuggccu

SEQ ID NO: 139352 - RNA, 22 nt, Human
uggccaaucagcugugaccugc

SEQ ID NO: 139353 - RNA, 22 nt, Human
uggccaugagaaucuuugcugu

SEQ ID NO: 139354 - RNA, 22 nt, Human
uggcagcucauuuggaaaugga

SEQ ID NO: 139355 - RNA, 22 nt, Human
uggcaugugaauuguuacauug

SEQ ID NO: 139356 - RNA, 18 nt, Human
uggcaugcuuugauacau

SEQ ID NO: 139357 - RNA, 22 nt, Human
uggauuguauugauugguuggc

SEQ ID NO: 139358 - RNA, 22 nt, Human
uggcacugaagcuggaaagccu

SEQ ID NO: 139359 - RNA, 22 nt, Human
uggcagaaugaagacuggggcc

SEQ ID NO: 139360 - RNA, 17 nt, Human
ugacagcuaaggggcuu

SEQ ID NO: 139361 - RNA, 22 nt, Human
ugacacagaccaaguggugcug

SEQ ID NO: 139362 - RNA, 22 nt, Human
ugacagaggagcuggaaugauu

SEQ ID NO: 139363 - RNA, 22 nt, Human
ugggggaggaggagacagacug

SEQ ID NO: 139364 - RNA, 22 nt, Human
uggggcuuucgcggagcgucgg

SEQ ID NO: 139365 - RNA, 22 nt, Human
ugggcaaaugcuuuuuagucaa

SEQ ID NO: 139366 - RNA, 22 nt, Human
ugggccacguggagucuguagg

SEQ ID NO: 139367 - RNA, 22 nt, Human
ugggcagagggugaggaaggcg

SEQ ID NO: 139368 - RNA, 21 nt, Human
uggggaugcauugcagaggca

SEQ ID NO: 139369 - RNA, 22 nt, Human
uggggagcucagcaccaucagu

SEQ ID NO: 139370 - RNA, 22 nt, Human
ugggccucuguuuccucaucug

SEQ ID NO: 139371 - RNA, 22 nt, Human
ugaaucagaccuucauugggua

SEQ ID NO: 139372 - RNA, 22 nt, Human
ugaagacaguuuuacucaugag

SEQ ID NO: 139373 - RNA, 18 nt, Human
ugggacucugacuugguu

SEQ ID NO: 139374 - RNA, 22 nt, Human
ugaaccgcuucauggugccugu

SEQ ID NO: 139375 - RNA, 22 nt, Human
uggcggcuggacuggggggcca

SEQ ID NO: 139376 - RNA, 22 nt, Human
uggcugagugaacauguccauu

SEQ ID NO: 139377 - RNA, 22 nt, Human
uggcuguuggagcuggaagaug

SEQ ID NO: 139378 - RNA, 22 nt, Human
uggcuugagcugggcccaccug

SEQ ID NO: 139379 - RNA, 21 nt, Human
ugaacaccaggagaaaucggu

SEQ ID NO: 139380 - RNA, 22 nt, Human
ugaacagacuauucucccaugu

SEQ ID NO: 139381 - RNA, 23 nt, Human
ugcaaaauuugcagaguucgaug

SEQ ID NO: 139382 - RNA, 22 nt, Human
ugcaaauucuuuacucugugau

SEQ ID NO: 139383 - RNA, 21 nt, Human
ugcaacugaaaggaauauggu

SEQ ID NO: 139384 - RNA, 22 nt, Human
ugcacgcgcccuucgauggccc

SEQ ID NO: 139385 - RNA, 22 nt, Human
ugucuguauuugaggacauugu

SEQ ID NO: 139386 - RNA, 22 nt, Human
ugucugggauguuggcagccac

SEQ ID NO: 139387 - RNA, 22 nt, Human
ugcacgcacuugcucuccagcg

SEQ ID NO: 139388 - RNA, 22 nt, Human
ugcacccacuuagcugaaguuc

SEQ ID NO: 139389 - RNA, 22 nt, Human
ugauugauaaugaagacaguca

SEQ ID NO: 139390 - RNA, 21 nt, Human
ugucagcaacaauacuuucuc

SEQ ID NO: 139391 - RNA, 22 nt, Human
ugauuuguuuaaauugcucguu

SEQ ID NO: 139392 - RNA, 22 nt, Human
ugcaaaaguuuuauacacagau

SEQ ID NO: 139393 - RNA, 22 nt, Human
uguauuuuuucccugaaauaaa

SEQ ID NO: 139394 - RNA, 22 nt, Human
ugauguggaucuauaacuguaa

SEQ ID NO: 139395 - RNA, 22 nt, Human
uguauauuuucuguauaaaaua

SEQ ID NO: 139396 - RNA, 22 nt, Human
ugauggugagaugucccguguu

SEQ ID NO: 139397 - RNA, 22 nt, Human
uguaccucagauuauugaucuc

SEQ ID NO: 139398 - RNA, 18 nt, Human
ugauggcuaagagccggg

SEQ ID NO: 139399 - RNA, 22 nt, Human
uguagcuccuaaagcccagcug

SEQ ID NO: 139400 - RNA, 22 nt, Human
uguagaccaaaccuucuaaacu

SEQ ID NO: 139401 - RNA, 22 nt, Human
uguaaauucuauacacuuaaaa

SEQ ID NO: 139402 - RNA, 22 nt, Human
ugaguuuuggaagauguuacag

SEQ ID NO: 139403 - RNA, 22 nt, Human
ugaguuuaggccaggauauggu

SEQ ID NO: 139404 - RNA, 22 nt, Human
uguaaacuuuugcauacugcuu

SEQ ID NO: 139405 - RNA, 22 nt, Human
ugguugcaguggugcuuauaca

SEQ ID NO: 139406 - RNA, 22 nt, Human
ugguugggguaacaaaaaggaa

SEQ ID NO: 139407 - RNA, 22 nt, Human
ugguugugcucuguuugaaagu

SEQ ID NO: 139408 - RNA, 22 nt, Human
ugagguguuugugcaccaucug

SEQ ID NO: 139409 - RNA, 22 nt, Human
uggugcacgugggcagucggcc

SEQ ID NO: 139410 - RNA, 22 nt, Human
ugaggaagugguuguaugguuu

SEQ ID NO: 139411 - RNA, 22 nt, Human
ugaggaaugugacaaaaccaag

SEQ ID NO: 139412 - RNA, 22 nt, Human
ugguggagucugggggaggcuu

SEQ ID NO: 139413 - RNA, 22 nt, Human
uggugcagacaggagccccgcu

SEQ ID NO: 139414 - RNA, 22 nt, Human
uggugcccguggaaagagggag

SEQ ID NO: 139415 - RNA, 19 nt, Human
ugaggauugagguccagua

SEQ ID NO: 139416 - RNA, 22 nt, Human
uggugacaucuaccuagguaaa

SEQ ID NO: 139417 - RNA, 22 nt, Human
ugcgccucugucacucagcauc

SEQ ID NO: 139418 - RNA, 19 nt, Human
ugcgggcugcggucagggc

SEQ ID NO: 139419 - RNA, 22 nt, Human
ugcgcgcaccugcauauauaug

SEQ ID NO: 139420 - RNA, 22 nt, Human
uguucuucaaacucaguuccac

SEQ ID NO: 139421 - RNA, 22 nt, Human
ugcggagggagcagucggcugu

SEQ ID NO: 139422 - RNA, 22 nt, Human
ugcuacaucuacugguaagggu

SEQ ID NO: 139423 - RNA, 22 nt, Human
ugcguugaggaccgcgagggcg

SEQ ID NO: 139424 - RNA, 21 nt, Human
uguugcuugucugagacuaug

SEQ ID NO: 139425 - RNA, 22 nt, Human
uguugcauguggcuguuugcca

SEQ ID NO: 139426 - RNA, 22 nt, Human
uguugccaucuaaaauguuacu

SEQ ID NO: 139427 - RNA, 22 nt, Human
uguugaucucuuuccaaauucu

SEQ ID NO: 139428 - RNA, 22 nt, Human
ugcuagggcaggaggugaggag

SEQ ID NO: 139429 - RNA, 22 nt, Human
ugcuagccacuauuguaaguau

SEQ ID NO: 139430 - RNA, 22 nt, Human
uguguuguuggggauguuuuca

SEQ ID NO: 139431 - RNA, 22 nt, Human
uguguuagguuuugggauggcu

SEQ ID NO: 139432 - RNA, 20 nt, Human
ugccugagcgcagcuccagg

SEQ ID NO: 139433 - RNA, 19 nt, Human
ugccuggcaccagcuccac

SEQ ID NO: 139434 - RNA, 22 nt, Human
ugccuuccuucuccccuccuuc

SEQ ID NO: 139435 - RNA, 22 nt, Human
uguuccggucuaucgugucaau

SEQ ID NO: 139436 - RNA, 22 nt, Human
uguuacugaaugucucugcuuu

SEQ ID NO: 139437 - RNA, 22 nt, Human
ugcauuuuuaauuuggaaaaaa

SEQ ID NO: 139438 - RNA, 22 nt, Human
ugccaucaugucagauuuggga

SEQ ID NO: 139439 - RNA, 22 nt, Human
ugugggaucauggaucagggcc

SEQ ID NO: 139440 - RNA, 22 nt, Human
ugccucucucugucauuaugcu

SEQ ID NO: 139441 - RNA, 22 nt, Human
uguguauguauguauguaugua

SEQ ID NO: 139442 - RNA, 22 nt, Human
ugugugggcgaagacagccuuu

SEQ ID NO: 139443 - RNA, 22 nt, Human
ugugguuuguaagcaaagcaaa

SEQ ID NO: 139444 - RNA, 22 nt, Human
ugugggaucguaaauuugggac

SEQ ID NO: 139445 - RNA, 22 nt, Human
ugcacugccuuucuuggcauga

SEQ ID NO: 139446 - RNA, 22 nt, Human
ugugcaucuggaggcaauguuu

SEQ ID NO: 139447 - RNA, 22 nt, Human
ugcagguggcagcggggcacca

SEQ ID NO: 139448 - RNA, 22 nt, Human
ugcauucugggucgcagagugg

SEQ ID NO: 139449 - RNA, 22 nt, Human
ugggggguuuagaaucugcccu

SEQ ID NO: 139450 - RNA, 22 nt, Human
uggggucuggcauaugguagau

SEQ ID NO: 139451 - RNA, 20 nt, Human
ugggggugcccaucuccccu

SEQ ID NO: 139452 - RNA, 22 nt, Human
ugggggauauggcuccauacuu

SEQ ID NO: 139453 - RNA, 22 nt, Human
ugggggaugacuugcucuuuca

SEQ ID NO: 139454 - RNA, 22 nt, Human
uucguucagcgcuugcgcaugc

SEQ ID NO: 139455 - RNA, 22 nt, Human
ugggucagauugagccccuggu

SEQ ID NO: 139456 - RNA, 22 nt, Human
ugggucaguagccuugcagaac

SEQ ID NO: 139457 - RNA, 22 nt, Human
uggcuuuucaccugcuccucug

SEQ ID NO: 139458 - RNA, 22 nt, Human
ugggaggcugugggaauggguc

SEQ ID NO: 139459 - RNA, 22 nt, Human
uuccccaccagagacagagcug

SEQ ID NO: 139460 - RNA, 22 nt, Human
uuccccgagccuggggaagcug

SEQ ID NO: 139461 - RNA, 22 nt, Human
uggggagucccaacgguggaag

SEQ ID NO: 139462 - RNA, 22 nt, Human
uggggcugguaccguaauauau

SEQ ID NO: 139463 - RNA, 22 nt, Human
ugggauucucagaaacacagag

SEQ ID NO: 139464 - RNA, 22 nt, Human
ugggauggacuuuagagaaucg

SEQ ID NO: 139465 - RNA, 20 nt, Human
uggcccagcacgacgaggac

SEQ ID NO: 139466 - RNA, 22 nt, Human
uggcccaucagggcaccugaga

SEQ ID NO: 139467 - RNA, 22 nt, Human
uggccugauuuugcuaagagaa

SEQ ID NO: 139468 - RNA, 22 nt, Human
uggccucauggccuuaucuggg

SEQ ID NO: 139469 - RNA, 22 nt, Human
uucaugcaagagugugaggucc

SEQ ID NO: 139470 - RNA, 23 nt, Human
uggccguccccugacucucuggc

SEQ ID NO: 139471 - RNA, 22 nt, Human
uggccgaugagcaugcgcugau

SEQ ID NO: 139472 - RNA, 22 nt, Human
uggcccugaaucaaggccagca

SEQ ID NO: 139473 - RNA, 22 nt, Human
uuccagucugggcucuucacug

SEQ ID NO: 139474 - RNA, 22 nt, Human
uuccagaacaauguggacguau

SEQ ID NO: 139475 - RNA, 22 nt, Human
uuccagguggcuuuccuggggg

SEQ ID NO: 139476 - RNA, 23 nt, Human
uggcucugagcuuccugguggcc

SEQ ID NO: 139477 - RNA, 22 nt, Human
uggcucacaggaggcagaggug

SEQ ID NO: 139478 - RNA, 22 nt, Human
uggcuacauuuauacucucauu

SEQ ID NO: 139479 - RNA, 22 nt, Human
uggcgcgcucgcucucgcugag

SEQ ID NO: 139480 - RNA, 22 nt, Human
uucagaccucaaauccacaugc

SEQ ID NO: 139481 - RNA, 22 nt, Human
uggcaucuggugauauggacua

SEQ ID NO: 139482 - RNA, 22 nt, Human
uggcaucacagacaaggcagca

SEQ ID NO: 139483 - RNA, 22 nt, Human
uucaggugguuuaagaauugga

SEQ ID NO: 139484 - RNA, 22 nt, Human
uucagcugcuugccugaaguca

SEQ ID NO: 139485 - RNA, 22 nt, Human
uucacuuuuucucugcuugaga

SEQ ID NO: 139486 - RNA, 22 nt, Human
uggcacaggcagaaggugccgc

SEQ ID NO: 139487 - RNA, 22 nt, Human
uucaccucuuuuuggggacauc

SEQ ID NO: 139488 - RNA, 22 nt, Human
uucacugacaguauugaggagg

SEQ ID NO: 139489 - RNA, 22 nt, Human
uggcagccugcgugaaggagcu

SEQ ID NO: 139490 - RNA, 22 nt, Human
uggcagcauuuuuuccagaaca

SEQ ID NO: 139491 - RNA, 22 nt, Human
uggcacaguuaaaguuguagaa

SEQ ID NO: 139492 - RNA, 22 nt, Human
uggcacguuggauugggaguuc

SEQ ID NO: 139493 - RNA, 22 nt, Human
uggcacugcccugucucggugg

SEQ ID NO: 139494 - RNA, 18 nt, Human
uggcaaugccaaaggcuu

SEQ ID NO: 139495 - RNA, 22 nt, Human
uggcaagcuguuggcagauagc

SEQ ID NO: 139496 - RNA, 22 nt, Human
uggcaaaaccugcaauuacuuu

SEQ ID NO: 139497 - RNA, 22 nt, Human
uggaugcuccaaguagaccuua

SEQ ID NO: 139498 - RNA, 22 nt, Human
uggaugccauuugauuaaggcu

SEQ ID NO: 139499 - RNA, 20 nt, Human
uggaugacuucaggcagccu

SEQ ID NO: 139500 - RNA, 22 nt, Human
uggauuguuuacaucaugucug

SEQ ID NO: 139501 - RNA, 20 nt, Human
uucacagaggacucagguca

SEQ ID NO: 139502 - RNA, 22 nt, Human
uggaucuugaugcuccaagagu

SEQ ID NO: 139503 - RNA, 22 nt, Human
uggaucaugcgaggccuccccu

SEQ ID NO: 139504 - RNA, 22 nt, Human
uucaacaacuugguucaaaugg

SEQ ID NO: 139505 - RNA, 22 nt, Human
uggaguuuuaaucuguacagaa

SEQ ID NO: 139506 - RNA, 22 nt, Human
uggaguuuauuugaauucuugg

SEQ ID NO: 139507 - RNA, 22 nt, Human
uggagucuugcuuugggagugc

SEQ ID NO: 139508 - RNA, 22 nt, Human
uggaguagaagggcuccuggaa

SEQ ID NO: 139509 - RNA, 22 nt, Human
uggaggauaacacaagaaguga

SEQ ID NO: 139510 - RNA, 22 nt, Human
uggaggaugacagagaugggcu

SEQ ID NO: 139511 - RNA, 20 nt, Human
ugcuccaggaacacuggccg

SEQ ID NO: 139512 - RNA, 23 nt, Human
uggugcagcgcaggccggguggc

SEQ ID NO: 139513 - RNA, 22 nt, Human
uggugcaggauuuauuuaacua

SEQ ID NO: 139514 - RNA, 22 nt, Human
uucuguguauggaagaaugucc

SEQ ID NO: 139515 - RNA, 22 nt, Human
uucugaaggcaggggcuaucuu

SEQ ID NO: 139516 - RNA, 22 nt, Human
uucugaugccuggguugcuucu

SEQ ID NO: 139517 - RNA, 19 nt, Human
ugguggaggugcaccugac

SEQ ID NO: 139518 - RNA, 22 nt, Human
uucuuauuuuucguaaauccug

SEQ ID NO: 139519 - RNA, 21 nt, Human
ugguguacauuuccauaguuu

SEQ ID NO: 139520 - RNA, 20 nt, Human
ugguguacauuuccauaguu

SEQ ID NO: 139521 - RNA, 22 nt, Human
uucuugucuuuguuauguagga

SEQ ID NO: 139522 - RNA, 22 nt, Human
uucuuguccacagaagagcuca

SEQ ID NO: 139523 - RNA, 22 nt, Human
uguaauucuaauccagagcugg

SEQ ID NO: 139524 - RNA, 22 nt, Human
uugaacauuagaauaaguaauu

SEQ ID NO: 139525 - RNA, 22 nt, Human
uugaacaguuuugucagguuca

SEQ ID NO: 139526 - RNA, 22 nt, Human
uugaaagaacaauucugugaug

SEQ ID NO: 139527 - RNA, 22 nt, Human
ugguugguuaaugugcccauuu

SEQ ID NO: 139528 - RNA, 22 nt, Human
ugguugugcuucuuugccucag

SEQ ID NO: 139529 - RNA, 22 nt, Human
ugguuuccugauggacacuugg

SEQ ID NO: 139530 - RNA, 23 nt, Human
uguaaaacaccguuauugcaccu

SEQ ID NO: 139531 - RNA, 22 nt, Human
uugcagauuucuuguccccauu

SEQ ID NO: 139532 - RNA, 22 nt, Human
ugugagccuuuauuaaccucau

SEQ ID NO: 139533 - RNA, 22 nt, Human
ugugaagugaugggugaccgag

SEQ ID NO: 139534 - RNA, 22 nt, Human
ugugauuucaaagggugucuuu

SEQ ID NO: 139535 - RNA, 23 nt, Human
ugucugccuaucaugugaaggac

SEQ ID NO: 139536 - RNA, 22 nt, Human
uugcacuccagcccgagcaaca

SEQ ID NO: 139537 - RNA, 22 nt, Human
uugcagagaacuaaagggagua

SEQ ID NO: 139538 - RNA, 21 nt, Human
uguccucggaucaguccacaa

SEQ ID NO: 139539 - RNA, 22 nt, Human
ugucacagugcacagcuaagaa

SEQ ID NO: 139540 - RNA, 22 nt, Human
ugucacaccucguuuagcauuc

SEQ ID NO: 139541 - RNA, 22 nt, Human
ugucaaguuguuaaguucuggg

SEQ ID NO: 139542 - RNA, 18 nt, Human
uguauuguucacuucugu

SEQ ID NO: 139543 - RNA, 22 nt, Human
uguaucucugacacagucucac

SEQ ID NO: 139544 - RNA, 22 nt, Human
uguauauguguguagcauguua

SEQ ID NO: 139545 - RNA, 22 nt, Human
ugucacagggauaccauggggc

SEQ ID NO: 139546 - RNA, 22 nt, Human
uuggugauugggaauggauggg

SEQ ID NO: 139547 - RNA, 22 nt, Human
uuggugauguagcagcaauugu

SEQ ID NO: 139548 - RNA, 19 nt, Human
uguugcagcuugaucggua

SEQ ID NO: 139549 - RNA, 22 nt, Human
uugguugaaauguguucaugcu

SEQ ID NO: 139550 - RNA, 22 nt, Human
uugguuaccuucagaaaugagu

SEQ ID NO: 139551 - RNA, 22 nt, Human
uugguguaauacaagcaauuug

SEQ ID NO: 139552 - RNA, 22 nt, Human
uguuguagacaguucacucgug

SEQ ID NO: 139553 - RNA, 18 nt, Human
uguugguguucacucacu

SEQ ID NO: 139554 - RNA, 22 nt, Human
uguugaagcaccucugucuuuc

SEQ ID NO: 139555 - RNA, 22 nt, Human
uugggauucugucagugugugu

SEQ ID NO: 139556 - RNA, 22 nt, Human
uugggcuagaaacaacgugggu

SEQ ID NO: 139557 - RNA, 22 nt, Human
uuggccugcuccagaacaaggg

SEQ ID NO: 139558 - RNA, 22 nt, Human
uuggcgcuauuauuaccacauu

SEQ ID NO: 139559 - RNA, 22 nt, Human
uuggccguuucacugggcaguu

SEQ ID NO: 139560 - RNA, 22 nt, Human
uguucccgaugacaggaccagg

SEQ ID NO: 139561 - RNA, 22 nt, Human
uuggccuuacgcauggucggca

SEQ ID NO: 139562 - RNA, 22 nt, Human
ugugggcugcuguuuccuugua

SEQ ID NO: 139563 - RNA, 22 nt, Human
uugcuuugcuucuuuaugguca

SEQ ID NO: 139564 - RNA, 23 nt, Human
uugcuugagcccaggaaguggag

SEQ ID NO: 139565 - RNA, 22 nt, Human
uguguggccuccauaggguacu

SEQ ID NO: 139566 - RNA, 22 nt, Human
uuggaguucuucaugcucugua

SEQ ID NO: 139567 - RNA, 22 nt, Human
uguggugcagcgggaacagcuu

SEQ ID NO: 139568 - RNA, 22 nt, Human
ugugguuggggucagauaggga

SEQ ID NO: 139569 - RNA, 22 nt, Human
uguggugcucagggaggauggg

SEQ ID NO: 139570 - RNA, 22 nt, Human
ugugcagugcguggguguugaa

SEQ ID NO: 139571 - RNA, 22 nt, Human
ugugcaguauugaaauauaugu

SEQ ID NO: 139572 - RNA, 20 nt, Human
uugcucucuuguguugaugu

SEQ ID NO: 139573 - RNA, 22 nt, Human
ugugcgcgugugcuuugugugu

SEQ ID NO: 139574 - RNA, 22 nt, Human
ugugcugcagcgagagcuacga

SEQ ID NO: 139575 - RNA, 22 nt, Human
ugugcuggcuucugugagcuga

SEQ ID NO: 139576 - RNA, 22 nt, Human
uugcugagcugaaccagccacc

SEQ ID NO: 139577 - RNA, 22 nt, Human
uugcugcgcugaccuccaguga

SEQ ID NO: 139578 - RNA, 22 nt, Human
uugcugccagcgcccugcaggg

SEQ ID NO: 139579 - RNA, 22 nt, Human
uugcugaggcuggggagaggug

SEQ ID NO: 139580 - RNA, 22 nt, Human
uuauuaauacaugcaccugcau

SEQ ID NO: 139581 - RNA, 22 nt, Human
uuuccuuaauuguaaaauggag

SEQ ID NO: 139582 - RNA, 22 nt, Human
uuaugguuuaauauccagcaca

SEQ ID NO: 139583 - RNA, 22 nt, Human
uuuccuuacuuauaaaaugggg

SEQ ID NO: 139584 - RNA, 21 nt, Human
uuucauuaguacaucaauuug

SEQ ID NO: 139585 - RNA, 22 nt, Human
uuaucuuuuaaaaacacuugug

SEQ ID NO: 139586 - RNA, 22 nt, Human
uuauauuaaaaaucgcuaacag

SEQ ID NO: 139587 - RNA, 22 nt, Human
uuucaugauuaacuuagugaau

SEQ ID NO: 139588 - RNA, 22 nt, Human
uuucacuucgaucagaguuuuu

SEQ ID NO: 139589 - RNA, 22 nt, Human
uuauaucagaaggugagauuga

SEQ ID NO: 139590 - RNA, 22 nt, Human
uuaccugcagagacguggaggc

SEQ ID NO: 139591 - RNA, 22 nt, Human
uuuacuguuuacagcuaaugca

SEQ ID NO: 139592 - RNA, 22 nt, Human
uuaccuaagaaacucauuucgu

SEQ ID NO: 139593 - RNA, 22 nt, Human
uuaccgagaacaugacuggaau

SEQ ID NO: 139594 - RNA, 22 nt, Human
uuacccuugaauuugugacaaa

SEQ ID NO: 139595 - RNA, 22 nt, Human
uguuuccuguaccacagguuuu

SEQ ID NO: 139596 - RNA, 22 nt, Human
uuagagaauagacuuuacccug

SEQ ID NO: 139597 - RNA, 20 nt, Human
uuacucaaccaggcuucuac

SEQ ID NO: 139598 - RNA, 22 nt, Human
uuacucucugaggcacucaaaa

SEQ ID NO: 139599 - RNA, 23 nt, Human
uuacuaugaaaauuccagucacu

SEQ ID NO: 139600 - RNA, 22 nt, Human
uuaccugccucaaacacgaaug

SEQ ID NO: 139601 - RNA, 23 nt, Human
uuagcccaggcuggagguagccc

SEQ ID NO: 139602 - RNA, 22 nt, Human
uuaggagugaguuacuuagggu

SEQ ID NO: 139603 - RNA, 22 nt, Human
uuucuggauaagcagggucucu

SEQ ID NO: 139604 - RNA, 22 nt, Human
uuucuguugugaccugacucuu

SEQ ID NO: 139605 - RNA, 20 nt, Human
uuugauugccccucugacuu

SEQ ID NO: 139606 - RNA, 22 nt, Human
uuugaugauuuucuagagugua

SEQ ID NO: 139607 - RNA, 22 nt, Human
uucacuguucuuagagaagacc

SEQ ID NO: 139608 - RNA, 22 nt, Human
uuugacaccaggagagaaaaca

SEQ ID NO: 139609 - RNA, 22 nt, Human
uuugaagaaacagucuuaagag

SEQ ID NO: 139610 - RNA, 22 nt, Human
uuauuuuguagcucugaucuuu

SEQ ID NO: 139611 - RNA, 22 nt, Human
uuauuuuuaggaauguagaggu

SEQ ID NO: 139612 - RNA, 22 nt, Human
uucaguagagguggaaauaaca

SEQ ID NO: 139613 - RNA, 22 nt, Human
uuuggucaucaaagacaaguaa

SEQ ID NO: 139614 - RNA, 22 nt, Human
uuugguaccucucgucacaaug

SEQ ID NO: 139615 - RNA, 22 nt, Human
uucaucuucaaaccccagugcc

SEQ ID NO: 139616 - RNA, 22 nt, Human
uucagguacuaagugcugauuc

SEQ ID NO: 139617 - RNA, 22 nt, Human
uuuggaugcugucauaugcugc

SEQ ID NO: 139618 - RNA, 22 nt, Human
uuugguguuuucaggaauauac

SEQ ID NO: 139619 - RNA, 22 nt, Human
uuccaaaugacaaugggcugua

SEQ ID NO: 139620 - RNA, 20 nt, Human
uuugucaacugcauccagca

SEQ ID NO: 139621 - RNA, 22 nt, Human
uuccccaugugaugcuauugcu

SEQ ID NO: 139622 - RNA, 22 nt, Human
uuuguggugagcagggaacguc

SEQ ID NO: 139623 - RNA, 17 nt, Human
uuugugauggcagaugc

SEQ ID NO: 139624 - RNA, 22 nt, Human
uugcaagcccugaagggcugga

SEQ ID NO: 139625 - RNA, 22 nt, Human
uugcacagaugcacaugguugc

SEQ ID NO: 139626 - RNA, 22 nt, Human
uugcacgucacccuucccaccu

SEQ ID NO: 139627 - RNA, 22 nt, Human
uugaguuuacauuguauuagcc

SEQ ID NO: 139628 - RNA, 22 nt, Human
uugcagugucaucuagacgugg

SEQ ID NO: 139629 - RNA, 22 nt, Human
uugcauauguccagccaugcau

SEQ ID NO: 139630 - RNA, 22 nt, Human
uugcaucagcaggcauaauugg

SEQ ID NO: 139631 - RNA, 22 nt, Human
uugccuagugguagugacuguu

SEQ ID NO: 139632 - RNA, 22 nt, Human
uugccuguuugagagcuguguu

SEQ ID NO: 139633 - RNA, 22 nt, Human
uugccaggggacaucuggagcc

SEQ ID NO: 139634 - RNA, 22 nt, Human
uugccgacuggccaaggaguaa

SEQ ID NO: 139635 - RNA, 18 nt, Human
uugcucucucugggggca

SEQ ID NO: 139636 - RNA, 22 nt, Human
uugcucaugucaccaaagcaca

SEQ ID NO: 139637 - RNA, 22 nt, Human
uugcggauguccacgucacacu

SEQ ID NO: 139638 - RNA, 20 nt, Human
uugcggccuaacagccccuu

SEQ ID NO: 139639 - RNA, 22 nt, Human
uuggacugguuuacauuucaag

SEQ ID NO: 139640 - RNA, 22 nt, Human
uuggagagggugggcuuugaag

SEQ ID NO: 139641 - RNA, 22 nt, Human
uugcugguggcucugauuucau

SEQ ID NO: 139642 - RNA, 22 nt, Human
uugcuugaacccaggaagugga

SEQ ID NO: 139643 - RNA, 22 nt, Human
uugcuugcggccuuugugccuu

SEQ ID NO: 139644 - RNA, 22 nt, Human
uugcuggaguagaaaacuuaac

SEQ ID NO: 139645 - RNA, 22 nt, Human
uugugacaauacagcauggaga

SEQ ID NO: 139646 - RNA, 22 nt, Human
uuuaaucaauaaccuccugggu

SEQ ID NO: 139647 - RNA, 22 nt, Human
uuuaauauucucuuugaaggaa

SEQ ID NO: 139648 - RNA, 22 nt, Human
uuggucaagacugauaucaaga

SEQ ID NO: 139649 - RNA, 22 nt, Human
uuggcaaaaauacuguaggccu

SEQ ID NO: 139650 - RNA, 22 nt, Human
uuggacuucauuuaccucucuc

SEQ ID NO: 139651 - RNA, 22 nt, Human
uuggugaugcuaggaauguagu

SEQ ID NO: 139652 - RNA, 19 nt, Human
uuggugaagguucacugac

SEQ ID NO: 139653 - RNA, 22 nt, Human
uuggugaugaaagugcugcgcu

SEQ ID NO: 139654 - RNA, 22 nt, Human
uuguagccaugucacaagcaca

SEQ ID NO: 139655 - RNA, 19 nt, Human
uugaauguuugauagucuc

SEQ ID NO: 139656 - RNA, 22 nt, Human
uugaggaagggaggcaaaacug

SEQ ID NO: 139657 - RNA, 22 nt, Human
uugaggguggauugucagggga

SEQ ID NO: 139658 - RNA, 20 nt, Human
uugaggagauauugaauacu

SEQ ID NO: 139659 - RNA, 22 nt, Human
uugaacucagcuacugguuggu

SEQ ID NO: 139660 - RNA, 22 nt, Human
uuuuucacacuccuuuccaguu

SEQ ID NO: 139661 - RNA, 22 nt, Human
uuuugggugcaaauuguuuguu

SEQ ID NO: 139662 - RNA, 18 nt, Human
uucuagaggucucaucca

SEQ ID NO: 139663 - RNA, 22 nt, Human
uucuccugacuggccauucagu

SEQ ID NO: 139664 - RNA, 22 nt, Human
uuuguucuucucaugcacacaa

SEQ ID NO: 139665 - RNA, 22 nt, Human
uuccgcuuucaauggcuuggcu

SEQ ID NO: 139666 - RNA, 22 nt, Human
uucguugaagcaacgacuuugg

SEQ ID NO: 139667 - RNA, 20 nt, Human
uucguuucaguguuggauca

SEQ ID NO: 139668 - RNA, 22 nt, Human
uucuggggccgugacgaggggc

SEQ ID NO: 139669 - RNA, 21 nt, Human
uucugcuguucaccaccaccc

SEQ ID NO: 139670 - RNA, 22 nt, Human
uucugggguaagcacugaggau

SEQ ID NO: 139671 - RNA, 20 nt, Human
uucugcagcagguguugaag

SEQ ID NO: 139672 - RNA, 20 nt, Human
uucugcucuagagucuagaa

SEQ ID NO: 139673 - RNA, 22 nt, Human
aaaugcuuuaauugaguucaug

SEQ ID NO: 139674 - RNA, 22 nt, Human
aaauauuugaaugguguaagau

SEQ ID NO: 139675 - RNA, 21 nt, Human
aaauccagugaucuccucuaa

SEQ ID NO: 139676 - RNA, 22 nt, Human
aaaucaagucagcugaauucca

SEQ ID NO: 139677 - RNA, 21 nt, Human
aacaaaagggaagaacagcug

SEQ ID NO: 139678 - RNA, 22 nt, Human
aacaaccuaguaguaucuuuca

SEQ ID NO: 139679 - RNA, 22 nt, Human
aacagaauaucaaaagauuaug

SEQ ID NO: 139680 - RNA, 22 nt, Human
aaauugucuuuaaucaggucau

SEQ ID NO: 139681 - RNA, 22 nt, Human
aaauuagucacaccagugucuu

SEQ ID NO: 139682 - RNA, 22 nt, Human
aacagguucaagccuugcagca

SEQ ID NO: 139683 - RNA, 22 nt, Human
aacaggcuaaauuguccauuuc

SEQ ID NO: 139684 - RNA, 19 nt, Human
aacaaaauaguucuaguua

SEQ ID NO: 139685 - RNA, 22 nt, Human
aacauuguggacaagggcaggu

SEQ ID NO: 139686 - RNA, 22 nt, Human
aaagucgugucagaaguuggga

SEQ ID NO: 139687 - RNA, 21 nt, Human
aaagugguaaggauuauuuug

SEQ ID NO: 139688 - RNA, 22 nt, Human
aaagggcugaaguagucucugu

SEQ ID NO: 139689 - RNA, 22 nt, Human
aaagggaugauuucugaagaua

SEQ ID NO: 139690 - RNA, 22 nt, Human
aaaguaaagccuauuuaauaau

SEQ ID NO: 139691 - RNA, 23 nt, Human
aaauaauaauuucucuguuggga

SEQ ID NO: 139692 - RNA, 22 nt, Human
aaaucugaaggaaacagcuuca

SEQ ID NO: 139693 - RNA, 22 nt, Human
aaaucgcuugaacccaggaagu

SEQ ID NO: 139694 - RNA, 22 nt, Human
aaauauugaauuugaggaugua

SEQ ID NO: 139695 - RNA, 22 nt, Human
aaaguugcauccuaugaccuca

SEQ ID NO: 139696 - RNA, 22 nt, Human
aaaguguuaacacuggcuacuu

SEQ ID NO: 139697 - RNA, 22 nt, Human
aaauauagugacacuuauaguc

SEQ ID NO: 139698 - RNA, 22 nt, Human
aaagaucaguuaacgccaucaa

SEQ ID NO: 139699 - RNA, 22 nt, Human
aaagccaagucugauuuuguug

SEQ ID NO: 139700 - RNA, 22 nt, Human
aaagccaagguccauguacuuu

SEQ ID NO: 139701 - RNA, 22 nt, Human
aaaggucagaugugucgaggag

SEQ ID NO: 139702 - RNA, 22 nt, Human
aaagacaauaauucucucuagc

SEQ ID NO: 139703 - RNA, 22 nt, Human
aaagagacaacaacaacuucua

SEQ ID NO: 139704 - RNA, 22 nt, Human
aaagagugugcauguaccugug

SEQ ID NO: 139705 - RNA, 22 nt, Human
aaaccgguacccuccugccugc

SEQ ID NO: 139706 - RNA, 23 nt, Human
aaacuacauuuauaguuuuucuc

SEQ ID NO: 139707 - RNA, 22 nt, Human
aaacaaauccaauaauaaaauu

SEQ ID NO: 139708 - RNA, 22 nt, Human
aaacaccaagagcuagcuauua

SEQ ID NO: 139709 - RNA, 22 nt, Human
aaaauauuuaucuagcucuuaa

SEQ ID NO: 139710 - RNA, 22 nt, Human
aaaauauucuauaucaaagaua

SEQ ID NO: 139711 - RNA, 22 nt, Human
aaaaguauaagugucuccugau

SEQ ID NO: 139712 - RNA, 22 nt, Human
aaaacauuuaggguuuuuuuua

SEQ ID NO: 139713 - RNA, 22 nt, Human
aagaggcagcuugguaggcauc

SEQ ID NO: 139714 - RNA, 22 nt, Human
aagcaaaagguuacacuucugg

SEQ ID NO: 139715 - RNA, 22 nt, Human
aagcagacugggccauaaggaa

SEQ ID NO: 139716 - RNA, 22 nt, Human
aagaugaguuacaaaggaguaa

SEQ ID NO: 139717 - RNA, 23 nt, Human
aagcaacagacuucaucagauau

SEQ ID NO: 139718 - RNA, 22 nt, Human
aagauauauaaggaaguucagu

SEQ ID NO: 139719 - RNA, 22 nt, Human
aagaugaucagagggcaagagg

SEQ ID NO: 139720 - RNA, 22 nt, Human
aagaaguccuugaggcgcaccc

SEQ ID NO: 139721 - RNA, 21 nt, Human
aagacguaguuggguggacca

SEQ ID NO: 139722 - RNA, 20 nt, Human
aagacacuguccccacugga

SEQ ID NO: 139723 - RNA, 19 nt, Human
aagaacaguucuaauuuca

SEQ ID NO: 139724 - RNA, 22 nt, Human
aagacagugacagucacaauug

SEQ ID NO: 139725 - RNA, 22 nt, Human
aaccaaguaaagagguuucauu

SEQ ID NO: 139726 - RNA, 22 nt, Human
aaggccacacuugcuggccagc

SEQ ID NO: 139727 - RNA, 22 nt, Human
aaggcgaggggcacagcugaga

SEQ ID NO: 139728 - RNA, 22 nt, Human
aagcuuugggcagaagaggauu

SEQ ID NO: 139729 - RNA, 22 nt, Human
aagcuguuauuucacagguuca

SEQ ID NO: 139730 - RNA, 22 nt, Human
aagcugcagacccccugucuca

SEQ ID NO: 139731 - RNA, 22 nt, Human
aagcgcaaggugucagcagguu

SEQ ID NO: 139732 - RNA, 22 nt, Human
aagcugccugggaggaagggcu

SEQ ID NO: 139733 - RNA, 22 nt, Human
aagcuagguccuccugaacugc

SEQ ID NO: 139734 - RNA, 22 nt, Human
aagcacuaauauuuuggcaccu

SEQ ID NO: 139735 - RNA, 22 nt, Human
aagcacagggacucaggaccgg

SEQ ID NO: 139736 - RNA, 22 nt, Human
aagcgcggccgccgcggucgcu

SEQ ID NO: 139737 - RNA, 22 nt, Human
aagcagugacucucagaggcag

SEQ ID NO: 139738 - RNA, 22 nt, Human
aaucacuggcuccucacggcaa

SEQ ID NO: 139739 - RNA, 23 nt, Human
aaucacuggauuugagcaugagg

SEQ ID NO: 139740 - RNA, 19 nt, Human
aaucacaagcaauaggggu

SEQ ID NO: 139741 - RNA, 22 nt, Human
aaucaucuguuguucccuugga

SEQ ID NO: 139742 - RNA, 22 nt, Human
aauacagcacucacaccucccu

SEQ ID NO: 139743 - RNA, 20 nt, Human
aauagcacagcucaaacauu

SEQ ID NO: 139744 - RNA, 23 nt, Human
aaguugucauguaaaaugggcua

SEQ ID NO: 139745 - RNA, 20 nt, Human
aagugcuguuagcugccuga

SEQ ID NO: 139746 - RNA, 23 nt, Human
aagugcucaguggacagcauugc

SEQ ID NO: 139747 - RNA, 22 nt, Human
aagugcuggccuacucaaucga

SEQ ID NO: 139748 - RNA, 22 nt, Human
aauaacuuacucuaugcuuagu

SEQ ID NO: 139749 - RNA, 22 nt, Human
aauaacuuaaugacuguguaca

SEQ ID NO: 139750 - RNA, 21 nt, Human
aaguuuuggcuguacaguugu

SEQ ID NO: 139751 - RNA, 20 nt, Human
aagucuauuuagaguugcuu

SEQ ID NO: 139752 - RNA, 22 nt, Human
aaguccgggcagcaggaauucu

SEQ ID NO: 139753 - RNA, 20 nt, Human
aaguagguuucaguugcugu

SEQ ID NO: 139754 - RNA, 18 nt, Human
aaguaguuugagauuguu

SEQ ID NO: 139755 - RNA, 22 nt, Human
aaggugcugaggguccuggcuu

SEQ ID NO: 139756 - RNA, 22 nt, Human
aaggugccacuucccucagacu

SEQ ID NO: 139757 - RNA, 22 nt, Human
aaguagaaaaccgcacuggacu

SEQ ID NO: 139758 - RNA, 22 nt, Human
aaguacugauucuguuccucaa

SEQ ID NO: 139759 - RNA, 22 nt, Human
aagguauaaauaacucgggagg

SEQ ID NO: 139760 - RNA, 22 nt, Human
aagggcuucucgccugugugca

SEQ ID NO: 139761 - RNA, 22 nt, Human
aaggucuuggcucuggccgcac

SEQ ID NO: 139762 - RNA, 19 nt, Human
aaggcuuucugagugaaaa

SEQ ID NO: 139763 - RNA, 22 nt, Human
aaggaaaguuaagguaaacucu

SEQ ID NO: 139764 - RNA, 22 nt, Human
acaucacuugguuaaugugguc

SEQ ID NO: 139765 - RNA, 21 nt, Human
acauccaggguccucacugcc

SEQ ID NO: 139766 - RNA, 22 nt, Human
acauccagcagauuguccagag

SEQ ID NO: 139767 - RNA, 22 nt, Human
acaggccuggguucaaauuugg

SEQ ID NO: 139768 - RNA, 22 nt, Human
acagguuggagguguggaguca

SEQ ID NO: 139769 - RNA, 22 nt, Human
acaggcugcccgcuccccaccu

SEQ ID NO: 139770 - RNA, 22 nt, Human
acagcugagaugcuacuugugg

SEQ ID NO: 139771 - RNA, 22 nt, Human
acagcucaggcccaucaacccc

SEQ ID NO: 139772 - RNA, 19 nt, Human
acagccuguugguggggcu

SEQ ID NO: 139773 - RNA, 22 nt, Human
acagcugguugaaggggaccaa

SEQ ID NO: 139774 - RNA, 22 nt, Human
acagcuggaggucugugagcac

SEQ ID NO: 139775 - RNA, 22 nt, Human
acaggacaaaaaucuggauggc

SEQ ID NO: 139776 - RNA, 22 nt, Human
acaggaaaugaaaugguaucua

SEQ ID NO: 139777 - RNA, 22 nt, Human
acagccaacgucuuucuuacuu

SEQ ID NO: 139778 - RNA, 23 nt, Human
acagcaagaggaccagaugugag

SEQ ID NO: 139779 - RNA, 22 nt, Human
acagccacccuggaacgguugu

SEQ ID NO: 139780 - RNA, 22 nt, Human
acagccacuaugacagauuuag

SEQ ID NO: 139781 - RNA, 20 nt, Human
acagccguaaugguccuugg

SEQ ID NO: 139782 - RNA, 22 nt, Human
acagcauagaggaaauguggaa

SEQ ID NO: 139783 - RNA, 22 nt, Human
acagagggagugacggccaacc

SEQ ID NO: 139784 - RNA, 23 nt, Human
acagaggcaucagagcagcaggc

SEQ ID NO: 139785 - RNA, 22 nt, Human
acacugguucucuuaacccuau

SEQ ID NO: 139786 - RNA, 22 nt, Human
acacgguggccagcaguaggug

SEQ ID NO: 139787 - RNA, 22 nt, Human
acacucagaaaggcagagguuc

SEQ ID NO: 139788 - RNA, 22 nt, Human
acacgugcaggagaauguagug

SEQ ID NO: 139789 - RNA, 22 nt, Human
acacuuacugcauuuuucuaua

SEQ ID NO: 139790 - RNA, 22 nt, Human
acacuagcgcaaauacgcccau

SEQ ID NO: 139791 - RNA, 22 nt, Human
acacucaugcucagcuggugcu

SEQ ID NO: 139792 - RNA, 21 nt, Human
acagaaguggcuuggucucag

SEQ ID NO: 139793 - RNA, 22 nt, Human
acagacaucaucaacaucuucc

SEQ ID NO: 139794 - RNA, 23 nt, Human
acacauguuuaugcuugggggca

SEQ ID NO: 139795 - RNA, 22 nt, Human
acacagugaccuacauuccaaa

SEQ ID NO: 139796 - RNA, 22 nt, Human
acacccuuuagcaauucuucaa

SEQ ID NO: 139797 - RNA, 22 nt, Human
acacccuugcagacgguuccuu

SEQ ID NO: 139798 - RNA, 22 nt, Human
acacgauguuuuaagccccuaa

SEQ ID NO: 139799 - RNA, 20 nt, Human
acacaccugcucagacugag

SEQ ID NO: 139800 - RNA, 21 nt, Human
acacagcuggagcaucccggu

SEQ ID NO: 139801 - RNA, 22 nt, Human
acacaggacacaaaagucacca

SEQ ID NO: 139802 - RNA, 22 nt, Human
acacgcacaccugugcacucgu

SEQ ID NO: 139803 - RNA, 22 nt, Human
acacacaugccuuuccuaagua

SEQ ID NO: 139804 - RNA, 22 nt, Human
acacaagaaugugcacucagcc

SEQ ID NO: 139805 - RNA, 22 nt, Human
acacacagaaggaagccccacu

SEQ ID NO: 139806 - RNA, 19 nt, Human
acacaccagugccugugac

SEQ ID NO: 139807 - RNA, 22 nt, Human
acaaugugcuuaugaaggcagu

SEQ ID NO: 139808 - RNA, 22 nt, Human
acacaacuuuauuaauuuauac

SEQ ID NO: 139809 - RNA, 22 nt, Human
acaaucuuauuaguaguauaga

SEQ ID NO: 139810 - RNA, 21 nt, Human
acaaugaguuugaggcaucag

SEQ ID NO: 139811 - RNA, 22 nt, Human
acaauaauguuuuuagguuauu

SEQ ID NO: 139812 - RNA, 23 nt, Human
acaaguguuuccaauauggcugg

SEQ ID NO: 139813 - RNA, 22 nt, Human
acaagaaaggucugggaacaau

SEQ ID NO: 139814 - RNA, 20 nt, Human
acaacuuaguugagagacua

SEQ ID NO: 139815 - RNA, 22 nt, Human
acaaggaagaaaacauuacuuu

SEQ ID NO: 139816 - RNA, 22 nt, Human
acaaggccugagggugacagca

SEQ ID NO: 139817 - RNA, 22 nt, Human
aauucuguugguuagaguugga

SEQ ID NO: 139818 - RNA, 22 nt, Human
aauuauucuugccuagguuuaa

SEQ ID NO: 139819 - RNA, 22 nt, Human
aauugcuuucacaaguguuaua

SEQ ID NO: 139820 - RNA, 22 nt, Human
aauuucagaccaacgagucagg

SEQ ID NO: 139821 - RNA, 22 nt, Human
aauuucuccuuuucaguuagau

SEQ ID NO: 139822 - RNA, 22 nt, Human
acaaaaauauuguagaagugcu

SEQ ID NO: 139823 - RNA, 22 nt, Human
acaaccaugucaguucaaacca

SEQ ID NO: 139824 - RNA, 20 nt, Human
acaaccacugcucacaguuu

SEQ ID NO: 139825 - RNA, 22 nt, Human
acaaaucccuguaaacacagcu

SEQ ID NO: 139826 - RNA, 22 nt, Human
acaaacugggauaggauccugu

SEQ ID NO: 139827 - RNA, 22 nt, Human
aauggaccuuaaauugcuucag

SEQ ID NO: 139828 - RNA, 22 nt, Human
aaucacuuagaacccaggaagu

SEQ ID NO: 139829 - RNA, 22 nt, Human
aaucgguugaacccaggaagug

SEQ ID NO: 139830 - RNA, 22 nt, Human
aaucgacuguagagacuuggcg

SEQ ID NO: 139831 - RNA, 22 nt, Human
aaugcuaaagaagaaggaguag

SEQ ID NO: 139832 - RNA, 22 nt, Human
aaugggauaggucuucaggaau

SEQ ID NO: 139833 - RNA, 22 nt, Human
aaugguaauauuucauaguugu

SEQ ID NO: 139834 - RNA, 22 nt, Human
acuuccuuccagcaaauggcau

SEQ ID NO: 139835 - RNA, 22 nt, Human
acuggcaugauagaccauaaca

SEQ ID NO: 139836 - RNA, 22 nt, Human
acuggcauuccuaggggagggg

SEQ ID NO: 139837 - RNA, 22 nt, Human
acuggcgucugucuccccugcc

SEQ ID NO: 139838 - RNA, 22 nt, Human
acuguugcuuguuuggaauguu

SEQ ID NO: 139839 - RNA, 22 nt, Human
acuguucacccagcacuagcag

SEQ ID NO: 139840 - RNA, 22 nt, Human
acuuugccagcucccugcuggc

SEQ ID NO: 139841 - RNA, 22 nt, Human
agaaauggccagacuugccccu

SEQ ID NO: 139842 - RNA, 22 nt, Human
agacaaucaacuguugaugccu

SEQ ID NO: 139843 - RNA, 22 nt, Human
agacaauuccauccuacguggg

SEQ ID NO: 139844 - RNA, 22 nt, Human
agaaugucaagucaagaacaau

SEQ ID NO: 139845 - RNA, 22 nt, Human
agacccugauucugcuggcggu

SEQ ID NO: 139846 - RNA, 22 nt, Human
agaauuuguaucuacggugugc

SEQ ID NO: 139847 - RNA, 22 nt, Human
agaccauagugauguuuacguc

SEQ ID NO: 139848 - RNA, 22 nt, Human
agacacagcaauaacuacuguu

SEQ ID NO: 139849 - RNA, 22 nt, Human
agaauacaauuguucaguaaua

SEQ ID NO: 139850 - RNA, 21 nt, Human
agaaugaagaagaggucuuug

SEQ ID NO: 139851 - RNA, 22 nt, Human
agaagcaauuggaaaguacagg

SEQ ID NO: 139852 - RNA, 22 nt, Human
agaaguguacuuagagaacaua

SEQ ID NO: 139853 - RNA, 22 nt, Human
agaaggcagaaaagcuuuacaa

SEQ ID NO: 139854 - RNA, 22 nt, Human
agaaccauccugguuccagcuu

SEQ ID NO: 139855 - RNA, 22 nt, Human
agaaggcaucugcucgcuucca

SEQ ID NO: 139856 - RNA, 22 nt, Human
agaacauaucuguuuucuaacu

SEQ ID NO: 139857 - RNA, 22 nt, Human
agaagaagacccuaaggaaagg

SEQ ID NO: 139858 - RNA, 22 nt, Human
acugaacuaaagaaaugggcaa

SEQ ID NO: 139859 - RNA, 22 nt, Human
acugacuacauguccugucauu

SEQ ID NO: 139860 - RNA, 22 nt, Human
acugcagauccucugagaaacc

SEQ ID NO: 139861 - RNA, 22 nt, Human
acugaucuguguaauauguuac

SEQ ID NO: 139862 - RNA, 22 nt, Human
acugaggaagccugucaucauc

SEQ ID NO: 139863 - RNA, 22 nt, Human
acugaugacaaugugaguguuc

SEQ ID NO: 139864 - RNA, 22 nt, Human
acugccauauuaggagcuucag

SEQ ID NO: 139865 - RNA, 22 nt, Human
acugcauuucauaaauuacaau

SEQ ID NO: 139866 - RNA, 22 nt, Human
acugcuguugugauggguauuu

SEQ ID NO: 139867 - RNA, 22 nt, Human
acucagucauuuggggaacagu

SEQ ID NO: 139868 - RNA, 22 nt, Human
acucaaccaucugcauuuuuga

SEQ ID NO: 139869 - RNA, 21 nt, Human
acuccagccacugacugucuc

SEQ ID NO: 139870 - RNA, 22 nt, Human
acucucugcugcugagcuuggg

SEQ ID NO: 139871 - RNA, 22 nt, Human
acucugcaguaaggaauuguuu

SEQ ID NO: 139872 - RNA, 22 nt, Human
acucggcggccucgagugcugg

SEQ ID NO: 139873 - RNA, 22 nt, Human
acucucaauuaucuggacugaa

SEQ ID NO: 139874 - RNA, 23 nt, Human
acucucuguuuggaggcacuggu

SEQ ID NO: 139875 - RNA, 22 nt, Human
acgugugugugcacguguguau

SEQ ID NO: 139876 - RNA, 22 nt, Human
acguugaaaugggcauuuuccg

SEQ ID NO: 139877 - RNA, 22 nt, Human
acuaggugggugucacugacuc

SEQ ID NO: 139878 - RNA, 22 nt, Human
acgucaucguugucaucgucau

SEQ ID NO: 139879 - RNA, 22 nt, Human
acguccaccccguaccagauca

SEQ ID NO: 139880 - RNA, 22 nt, Human
acucagcaccuagaaagugugc

SEQ ID NO: 139881 - RNA, 22 nt, Human
acuaugugucuguaucuggugc

SEQ ID NO: 139882 - RNA, 22 nt, Human
acagucucucaagcauauccug

SEQ ID NO: 139883 - RNA, 22 nt, Human
acagugguggagggcuguccug

SEQ ID NO: 139884 - RNA, 22 nt, Human
acagucuuggauuccaggaguc

SEQ ID NO: 139885 - RNA, 20 nt, Human
acgccgcgaggugagcuggu

SEQ ID NO: 139886 - RNA, 22 nt, Human
acgcgcuccagcaggugcuuca

SEQ ID NO: 139887 - RNA, 22 nt, Human
acgccggguaaggucauucugc

SEQ ID NO: 139888 - RNA, 14 nt, Human
acagaagucugcua

SEQ ID NO: 139889 - RNA, 22 nt, Human
acggccgaugacuccagcaugg

SEQ ID NO: 139890 - RNA, 22 nt, Human
acggcggguuccgggccagccc

SEQ ID NO: 139891 - RNA, 22 nt, Human
acgccugccuguacuugugggg

SEQ ID NO: 139892 - RNA, 22 nt, Human
agauauuauuuucuauuuauca

SEQ ID NO: 139893 - RNA, 22 nt, Human
agaugaccaguaagugguugaa

SEQ ID NO: 139894 - RNA, 22 nt, Human
agaugacuaacauaguauugcu

SEQ ID NO: 139895 - RNA, 22 nt, Human
agagcagcuuuucggaaccacu

SEQ ID NO: 139896 - RNA, 22 nt, Human
agagcaucgguggaguccccac

SEQ ID NO: 139897 - RNA, 22 nt, Human
agagcuauuucuuaaaagcugu

SEQ ID NO: 139898 - RNA, 22 nt, Human
agagggagccugcacagcuuuc

SEQ ID NO: 139899 - RNA, 22 nt, Human
agaggugcuuaugcucaugguu

SEQ ID NO: 139900 - RNA, 22 nt, Human
agacuagccaaaggacuuuaua

SEQ ID NO: 139901 - RNA, 22 nt, Human
agaccguguguggguugcggug

SEQ ID NO: 139902 - RNA, 22 nt, Human
agcaaaauuccaaaaugcuaau

SEQ ID NO: 139903 - RNA, 22 nt, Human
agcaacauggaguuugugcgca

SEQ ID NO: 139904 - RNA, 22 nt, Human
agcaaggagcugaaaccgggcu

SEQ ID NO: 139905 - RNA, 22 nt, Human
agcaaagccucuuugaaaaaaa

SEQ ID NO: 139906 - RNA, 22 nt, Human
agcaagggucucucauggcuug

SEQ ID NO: 139907 - RNA, 19 nt, Human
agauggcaaaaugcaaaga

SEQ ID NO: 139908 - RNA, 21 nt, Human
agaugcaguuugcaggugggu

SEQ ID NO: 139909 - RNA, 22 nt, Human
agauggcuccaguguccagagg

SEQ ID NO: 139910 - RNA, 22 nt, Human
agaugggacauuugucccuagg

SEQ ID NO: 139911 - RNA, 22 nt, Human
agauguugucucuuacguuuga

SEQ ID NO: 139912 - RNA, 22 nt, Human
agaugaguaaauggagucuucc

SEQ ID NO: 139913 - RNA, 22 nt, Human
agauaucuuguuggcauaaaug

SEQ ID NO: 139914 - RNA, 21 nt, Human
agaugaggauacugaggccua

SEQ ID NO: 139915 - RNA, 20 nt, Human
agaugcccaacucuguuuug

SEQ ID NO: 139916 - RNA, 22 nt, Human
agauggaguccugaagccagaa

SEQ ID NO: 139917 - RNA, 22 nt, Human
agccauggaggaugugcagcau

SEQ ID NO: 139918 - RNA, 22 nt, Human
agccagauuuuuugagaggcga

SEQ ID NO: 139919 - RNA, 22 nt, Human
agccacacuuagucacaaagau

SEQ ID NO: 139920 - RNA, 22 nt, Human
agcauucagacaucugauggau

SEQ ID NO: 139921 - RNA, 22 nt, Human
agccccggugagggaguccugu

SEQ ID NO: 139922 - RNA, 22 nt, Human
agccagugucgugugacaugag

SEQ ID NO: 139923 - RNA, 22 nt, Human
agccagugcagcuggaaauuca

SEQ ID NO: 139924 - RNA, 22 nt, Human
agccauggagaacagacuugaa

SEQ ID NO: 139925 - RNA, 22 nt, Human
agccucucugaugugacagcua

SEQ ID NO: 139926 - RNA, 22 nt, Human
agcgaaaagaauggaguggagu

SEQ ID NO: 139927 - RNA, 22 nt, Human
agcgacuguaagagggccccgg

SEQ ID NO: 139928 - RNA, 22 nt, Human
agccuacauuugacuauagucu

SEQ ID NO: 139929 - RNA, 22 nt, Human
agccuaauuuguaggucugugu

SEQ ID NO: 139930 - RNA, 22 nt, Human
agccggccucggacagagggag

SEQ ID NO: 139931 - RNA, 22 nt, Human
agccgcugaauuugaaacaagc

SEQ ID NO: 139932 - RNA, 22 nt, Human
agccgcgcagccucauuaagga

SEQ ID NO: 139933 - RNA, 22 nt, Human
agccugaaccaauauagcagcc

SEQ ID NO: 139934 - RNA, 22 nt, Human
agcgcggccuuacacccagggg

SEQ ID NO: 139935 - RNA, 21 nt, Human
agcgcugcauccaccauggcu

SEQ ID NO: 139936 - RNA, 22 nt, Human
agcgcgcggggcugcggcaggg

SEQ ID NO: 139937 - RNA, 22 nt, Human
agcacuugggugauaguacuuu

SEQ ID NO: 139938 - RNA, 22 nt, Human
agcaauguuggccuauauaccu

SEQ ID NO: 139939 - RNA, 19 nt, Human
agcaccuaucuggauaagg

SEQ ID NO: 139940 - RNA, 22 nt, Human
agcaccuuguucagaucuuaca

SEQ ID NO: 139941 - RNA, 22 nt, Human
agcaauucagagcauggacuuu

SEQ ID NO: 139942 - RNA, 22 nt, Human
agcaaaacuaaagacacagaca

SEQ ID NO: 139943 - RNA, 22 nt, Human
agauuuggaauggggguucaua

SEQ ID NO: 139944 - RNA, 20 nt, Human
agcacaggcagucauucagu

SEQ ID NO: 139945 - RNA, 22 nt, Human
agcacagugccugacauauaug

SEQ ID NO: 139946 - RNA, 22 nt, Human
agcagcaaugacaauucaacca

SEQ ID NO: 139947 - RNA, 22 nt, Human
agcacgcccaccuccugcggcg

SEQ ID NO: 139948 - RNA, 22 nt, Human
agcacauguuucuuuugcaauu

SEQ ID NO: 139949 - RNA, 22 nt, Human
agcacuagcugcuugucucaag

SEQ ID NO: 139950 - RNA, 22 nt, Human
agcacuaccggucacggccaug

SEQ ID NO: 139951 - RNA, 22 nt, Human
agcagcugagccccagcuguga

SEQ ID NO: 139952 - RNA, 22 nt, Human
agcagagggucaguuuuuuagu

SEQ ID NO: 139953 - RNA, 22 nt, Human
agcaggauggaguaacgugaaa

SEQ ID NO: 139954 - RNA, 22 nt, Human
agcaugucuaacucuucagggu

SEQ ID NO: 139955 - RNA, 22 nt, Human
agcaggaaggcuagaagcagga

SEQ ID NO: 139956 - RNA, 22 nt, Human
agcagccgccgccgccgcgcac

SEQ ID NO: 139957 - RNA, 22 nt, Human
agcagcaccuguccucgcugcu

SEQ ID NO: 139958 - RNA, 21 nt, Human
aggcagcgauuuucauauugc

SEQ ID NO: 139959 - RNA, 20 nt, Human
aggcagacaaggagucuguu

SEQ ID NO: 139960 - RNA, 22 nt, Human
aggcacagaauccagucugcug

SEQ ID NO: 139961 - RNA, 19 nt, Human
aggcagccccaacuugcau

SEQ ID NO: 139962 - RNA, 23 nt, Human
aggcagcaugcaacaggccauuu

SEQ ID NO: 139963 - RNA, 22 nt, Human
aggcauguugcuucgggcuuug

SEQ ID NO: 139964 - RNA, 22 nt, Human
aggcaucguguuuuucugcuuu

SEQ ID NO: 139965 - RNA, 22 nt, Human
aggcaguggcuuuuguuguguu

SEQ ID NO: 139966 - RNA, 22 nt, Human
aggcaggcucaaugcccagucu

SEQ ID NO: 139967 - RNA, 22 nt, Human
aggccacucagggggccaagau

SEQ ID NO: 139968 - RNA, 22 nt, Human
aggccaggcgccggcgcgagac

SEQ ID NO: 139969 - RNA, 22 nt, Human
aggcugcucucgccggcggugu

SEQ ID NO: 139970 - RNA, 22 nt, Human
aggccgagaugacagagccacu

SEQ ID NO: 139971 - RNA, 22 nt, Human
aggcccagcaccagcggucuuc

SEQ ID NO: 139972 - RNA, 20 nt, Human
aggccgcccgcugccgcuuc

SEQ ID NO: 139973 - RNA, 22 nt, Human
aggcaguggagcuggaauaggc

SEQ ID NO: 139974 - RNA, 22 nt, Human
aggcagugccuggaccccagcu

SEQ ID NO: 139975 - RNA, 22 nt, Human
aggcaguguggagggcuguugc

SEQ ID NO: 139976 - RNA, 22 nt, Human
aggcagugguguuugcuggugg

SEQ ID NO: 139977 - RNA, 22 nt, Human
aggcauuuaaagauguaagacu

SEQ ID NO: 139978 - RNA, 22 nt, Human
aggcauuuaucaggaaauguuc

SEQ ID NO: 139979 - RNA, 22 nt, Human
aggcaacagacaggcuugguuc

SEQ ID NO: 139980 - RNA, 22 nt, Human
aggauggauagcaaggaagccg

SEQ ID NO: 139981 - RNA, 22 nt, Human
aggauugucuccugugaugugc

SEQ ID NO: 139982 - RNA, 22 nt, Human
aggaguuugaaaacuuaacuaa

SEQ ID NO: 139983 - RNA, 22 nt, Human
aggauuagucaccauuauuauu

SEQ ID NO: 139984 - RNA, 22 nt, Human
aggacacagaguauggaagugu

SEQ ID NO: 139985 - RNA, 22 nt, Human
aggauugaaaaaacacauauau

SEQ ID NO: 139986 - RNA, 22 nt, Human
aggauucuccuguuucccaccc

SEQ ID NO: 139987 - RNA, 22 nt, Human
aggagcugccggauggggcaug

SEQ ID NO: 139988 - RNA, 22 nt, Human
aggaggcaaaugagagggcuca

SEQ ID NO: 139989 - RNA, 22 nt, Human
aggagcacugggcaugucaccc

SEQ ID NO: 139990 - RNA, 22 nt, Human
aggaauuugggguuacaugaug

SEQ ID NO: 139991 - RNA, 22 nt, Human
aggacaagacaaggaccagaga

SEQ ID NO: 139992 - RNA, 22 nt, Human
agcggcaggacgucuucuucga

SEQ ID NO: 139993 - RNA, 22 nt, Human
aggaaauaagggcacuucagau

SEQ ID NO: 139994 - RNA, 22 nt, Human
agguuuaggaaaacugagaguc

SEQ ID NO: 139995 - RNA, 22 nt, Human
agguuuggccuuggggggaguu

SEQ ID NO: 139996 - RNA, 22 nt, Human
agguugggagaggucacccuga

SEQ ID NO: 139997 - RNA, 20 nt, Human
agguugguuuacuagucugu

SEQ ID NO: 139998 - RNA, 22 nt, Human
agguuuggaaguggcgauccau

SEQ ID NO: 139999 - RNA, 22 nt, Human
agguggcuaugaggaugcaguc

SEQ ID NO: 140000 - RNA, 19 nt, Human
aggugaugugacucuagaa

SEQ ID NO: 140001 - RNA, 22 nt, Human
aggugcauuuacuuggggcccu

SEQ ID NO: 140002 - RNA, 22 nt, Human
aggugcagcugguggagucugg

SEQ ID NO: 140003 - RNA, 22 nt, Human
aggugcucaguaauugauuguu

SEQ ID NO: 140004 - RNA, 22 nt, Human
aggucuugcggaagauauggcu

SEQ ID NO: 140005 - RNA, 22 nt, Human
aggugugcacccggucgcuucc

SEQ ID NO: 140006 - RNA, 22 nt, Human
agguuaauaugaacagcagaag

SEQ ID NO: 140007 - RNA, 22 nt, Human
aggugucauuauagaccagaua

SEQ ID NO: 140008 - RNA, 22 nt, Human
aggucggcuuuuuuccuuucac

SEQ ID NO: 140009 - RNA, 22 nt, Human
agggcuucugcugcagagaccu

SEQ ID NO: 140010 - RNA, 22 nt, Human
agggcugggcuuggcaggcugg

SEQ ID NO: 140011 - RNA, 22 nt, Human
agggcugcugcuccgggcccag

SEQ ID NO: 140012 - RNA, 22 nt, Human
aggggcuuguggaguugcuggu

SEQ ID NO: 140013 - RNA, 22 nt, Human
aggguaccugauuuauggagca

SEQ ID NO: 140014 - RNA, 22 nt, Human
aggguggcacucugggggcucc

SEQ ID NO: 140015 - RNA, 22 nt, Human
agggucgucuggguccgugggg

SEQ ID NO: 140016 - RNA, 22 nt, Human
aggcuucaaggacagcagccac

SEQ ID NO: 140017 - RNA, 22 nt, Human
aggcugucucagccugcuugca

SEQ ID NO: 140018 - RNA, 22 nt, Human
agggcaggguuggugcuggugc

SEQ ID NO: 140019 - RNA, 22 nt, Human
agggccagcagcuuggccaacc

SEQ ID NO: 140020 - RNA, 22 nt, Human
agggccaagaaagaguggcuuu

SEQ ID NO: 140021 - RNA, 22 nt, Human
aguacuuggaaaaaugcccacu

SEQ ID NO: 140022 - RNA, 20 nt, Human
agugaguuaucagcuacagu

SEQ ID NO: 140023 - RNA, 21 nt, Human
agugaguagagcacugaguca

SEQ ID NO: 140024 - RNA, 23 nt, Human
agugaugcaguaucugggucugu

SEQ ID NO: 140025 - RNA, 23 nt, Human
agugaagcugguuagugaugacc

SEQ ID NO: 140026 - RNA, 22 nt, Human
aguggagguuacagcuguacau

SEQ ID NO: 140027 - RNA, 21 nt, Human
aguggcacuguuucuucccua

SEQ ID NO: 140028 - RNA, 22 nt, Human
agugccauggcugcuagauggc

SEQ ID NO: 140029 - RNA, 23 nt, Human
agugaucuguguuugaagaaugc

SEQ ID NO: 140030 - RNA, 22 nt, Human
agugccaucuuuaacuguccca

SEQ ID NO: 140031 - RNA, 22 nt, Human
agugaugcuuuggagaagaucc

SEQ ID NO: 140032 - RNA, 20 nt, Human
agugauuuguuaguacauug

SEQ ID NO: 140033 - RNA, 22 nt, Human
aguggcuguuccaggugaggac

SEQ ID NO: 140034 - RNA, 22 nt, Human
aguggugaucuguuacagucac

SEQ ID NO: 140035 - RNA, 23 nt, Human
aguggccgaucaucucgggcuug

SEQ ID NO: 140036 - RNA, 22 nt, Human
aguggcuagaucaugagugagc

SEQ ID NO: 140037 - RNA, 22 nt, Human
aguggcugugaaauacauggga

SEQ ID NO: 140038 - RNA, 22 nt, Human
agugcucagggaaugccacuga

SEQ ID NO: 140039 - RNA, 20 nt, Human
aguguuggugcuuuucccag

SEQ ID NO: 140040 - RNA, 22 nt, Human
aguuaucuauaaaucccugagg

SEQ ID NO: 140041 - RNA, 22 nt, Human
aguguucaauuugagcucaaag

SEQ ID NO: 140042 - RNA, 22 nt, Human
aguguuaggaauuaauguaggg

SEQ ID NO: 140043 - RNA, 22 nt, Human
aguguccaacucagcuugucaa

SEQ ID NO: 140044 - RNA, 22 nt, Human
agugucugcgggcagaggagcg

SEQ ID NO: 140045 - RNA, 22 nt, Human
aguguggccaaugaggaugggc

SEQ ID NO: 140046 - RNA, 20 nt, Human
aguguugaacuacacuuccc

SEQ ID NO: 140047 - RNA, 22 nt, Human
aguggcuggcaggggagggucc

SEQ ID NO: 140048 - RNA, 22 nt, Human
agugugacccauggcaagggca

SEQ ID NO: 140049 - RNA, 22 nt, Human
aguggugccuaagcgcggaggc

SEQ ID NO: 140050 - RNA, 23 nt, Human
aguguucagcauguaguaaauac

SEQ ID NO: 140051 - RNA, 22 nt, Human
aguggggcccaagaaucugcau

SEQ ID NO: 140052 - RNA, 22 nt, Human
auacauauaugcacauuaauau

SEQ ID NO: 140053 - RNA, 22 nt, Human
auaaucuuugaguagaguugag

SEQ ID NO: 140054 - RNA, 22 nt, Human
auacacauguuauuguggaagc

SEQ ID NO: 140055 - RNA, 22 nt, Human
auaaauucuaugauggauuggg

SEQ ID NO: 140056 - RNA, 22 nt, Human
auaaaaucugaagcaagaauaa

SEQ ID NO: 140057 - RNA, 22 nt, Human
auaaaguaaugcauauaaugug

SEQ ID NO: 140058 - RNA, 22 nt, Human
aguuuuugagaauucuucugaa

SEQ ID NO: 140059 - RNA, 22 nt, Human
aguuucuugaagacugauguuu

SEQ ID NO: 140060 - RNA, 22 nt, Human
aguuuaaauuguucuaucagaa

SEQ ID NO: 140061 - RNA, 22 nt, Human
aguuuucugccucuggaugcgu

SEQ ID NO: 140062 - RNA, 22 nt, Human
aguuggcauuuuauuuaaguau

SEQ ID NO: 140063 - RNA, 22 nt, Human
aguugguauuuacugcaguugg

SEQ ID NO: 140064 - RNA, 22 nt, Human
aguuguuuuucuuagauuuuag

SEQ ID NO: 140065 - RNA, 22 nt, Human
aguuccaaauuugcaagaaaau

SEQ ID NO: 140066 - RNA, 22 nt, Human
aguugcuaauacaaaaaguccc

SEQ ID NO: 140067 - RNA, 22 nt, Human
aguugcagguucacguaucuug

SEQ ID NO: 140068 - RNA, 22 nt, Human
auucuguugguuuaauagucaa

SEQ ID NO: 140069 - RNA, 22 nt, Human
auucuguuuaauacacgaaagg

SEQ ID NO: 140070 - RNA, 17 nt, Human
auucuuauacucuguga

SEQ ID NO: 140071 - RNA, 22 nt, Human
auucugcauuucuaaccagguc

SEQ ID NO: 140072 - RNA, 22 nt, Human
auucugcaauaaucaguccuua

SEQ ID NO: 140073 - RNA, 22 nt, Human
auucaagauaagggucugggag

SEQ ID NO: 140074 - RNA, 22 nt, Human
auguuguugaacucuuugcaug

SEQ ID NO: 140075 - RNA, 22 nt, Human
auguugcugauccuguggcugu

SEQ ID NO: 140076 - RNA, 22 nt, Human
auguuguuuauggguuaucaag

SEQ ID NO: 140077 - RNA, 22 nt, Human
auucgaucacugccgaggaccu

SEQ ID NO: 140078 - RNA, 22 nt, Human
auucuaugaaugacuguuagau

SEQ ID NO: 140079 - RNA, 22 nt, Human
auucuagaguuucaauccaagg

SEQ ID NO: 140080 - RNA, 22 nt, Human
auucucuauugguaaauuugac

SEQ ID NO: 140081 - RNA, 22 nt, Human
auugacuucccaucaggugagu

SEQ ID NO: 140082 - RNA, 17 nt, Human
auucuaguuggcuuuuu

SEQ ID NO: 140083 - RNA, 22 nt, Human
auucgcggcuugaucugcuugc

SEQ ID NO: 140084 - RNA, 22 nt, Human
auuccagggaaauggggaugga

SEQ ID NO: 140085 - RNA, 22 nt, Human
auuccccagcaggccuuuuguu

SEQ ID NO: 140086 - RNA, 20 nt, Human
auucuuguuccauuucccag

SEQ ID NO: 140087 - RNA, 22 nt, Human
auucuugauauagauaguuaau

SEQ ID NO: 140088 - RNA, 22 nt, Human
auugaguucaccucuuucagaa

SEQ ID NO: 140089 - RNA, 22 nt, Human
auugccauaauagagccaugua

SEQ ID NO: 140090 - RNA, 22 nt, Human
auucuuauaaaaaguguugacu

SEQ ID NO: 140091 - RNA, 22 nt, Human
auugagcuguugaagucccaca

SEQ ID NO: 140092 - RNA, 22 nt, Human
auuuucauauggguuauuugua

SEQ ID NO: 140093 - RNA, 23 nt, Human
auuuccuaaaagauaaucauuac

SEQ ID NO: 140094 - RNA, 22 nt, Human
auuuuuagucuugcugcaauca

SEQ ID NO: 140095 - RNA, 21 nt, Human
auuuuucagaaggaugugaua

SEQ ID NO: 140096 - RNA, 22 nt, Human
auuuuucacauuuugggggaca

SEQ ID NO: 140097 - RNA, 22 nt, Human
auuuuuucaugugugguugaga

SEQ ID NO: 140098 - RNA, 19 nt, Human
auuuugguucuuuccauuc

SEQ ID NO: 140099 - RNA, 22 nt, Human
caaauuuuuauuuaccaucugc

SEQ ID NO: 140100 - RNA, 22 nt, Human
auuuuuagagugaaagaauuaa

SEQ ID NO: 140101 - RNA, 22 nt, Human
auuuuguugaaacccuuguugu

SEQ ID NO: 140102 - RNA, 22 nt, Human
caaauacguuuggcuggagcac

SEQ ID NO: 140103 - RNA, 22 nt, Human
caaaucagaucagagacaggcu

SEQ ID NO: 140104 - RNA, 22 nt, Human
auuggccaguggacagcgccgu

SEQ ID NO: 140105 - RNA, 22 nt, Human
auuggcugucagcccggauggg

SEQ ID NO: 140106 - RNA, 19 nt, Human
auucuucucuuccugcugu

SEQ ID NO: 140107 - RNA, 22 nt, Human
auugagaugcuuaaaucuucac

SEQ ID NO: 140108 - RNA, 22 nt, Human
auuucauccauuaagaguacuc

SEQ ID NO: 140109 - RNA, 22 nt, Human
auuucagcagcccauguuugga

SEQ ID NO: 140110 - RNA, 22 nt, Human
auuuggucuguaauuacaugga

SEQ ID NO: 140111 - RNA, 22 nt, Human
auuuaucugcucuucgcguuga

SEQ ID NO: 140112 - RNA, 22 nt, Human
auuugcuuguucaccaguacuu

SEQ ID NO: 140113 - RNA, 22 nt, Human
auuuccagcagcauauuugucu

SEQ ID NO: 140114 - RNA, 22 nt, Human
auugugaaugccugucagucuu

SEQ ID NO: 140115 - RNA, 23 nt, Human
auuugcugaucguagaugacuag

SEQ ID NO: 140116 - RNA, 22 nt, Human
auguuuucauuuagaagcuaau

SEQ ID NO: 140117 - RNA, 22 nt, Human
auguuuucuugucuggagaagu

SEQ ID NO: 140118 - RNA, 22 nt, Human
auguaguccuuauuugacauaa

SEQ ID NO: 140119 - RNA, 22 nt, Human
augugacaagugugggcagggc

SEQ ID NO: 140120 - RNA, 22 nt, Human
auggcagcggagcuggaaauga

SEQ ID NO: 140121 - RNA, 22 nt, Human
auguccugguccacagaaggga

SEQ ID NO: 140122 - RNA, 22 nt, Human
augggucccuggccgcccucgg

SEQ ID NO: 140123 - RNA, 22 nt, Human
augguuacgcccucacccuacc

SEQ ID NO: 140124 - RNA, 22 nt, Human
augggcauggauggccgagucu

SEQ ID NO: 140125 - RNA, 22 nt, Human
auggcaucuucgguuggacugc

SEQ ID NO: 140126 - RNA, 22 nt, Human
augggcauacaaaugcuacccu

SEQ ID NO: 140127 - RNA, 22 nt, Human
augggcggugcauuugcacagu

SEQ ID NO: 140128 - RNA, 22 nt, Human
auggggucagagaauggugggu

SEQ ID NO: 140129 - RNA, 22 nt, Human
auggaacccgggcgucugcucu

SEQ ID NO: 140130 - RNA, 22 nt, Human
auggaagagacaaugcuaucug

SEQ ID NO: 140131 - RNA, 22 nt, Human
augcugccuccucuucagccgc

SEQ ID NO: 140132 - RNA, 22 nt, Human
auggaggaugugcagcaugggc

SEQ ID NO: 140133 - RNA, 22 nt, Human
augccaccucuucugauuccag

SEQ ID NO: 140134 - RNA, 22 nt, Human
augauucuaccaaugccaucuu

SEQ ID NO: 140135 - RNA, 22 nt, Human
augccacuguuuaugucacuua

SEQ ID NO: 140136 - RNA, 22 nt, Human
augcugcuccuuuucaggcauu

SEQ ID NO: 140137 - RNA, 22 nt, Human
augcaguuagguaauagucuca

SEQ ID NO: 140138 - RNA, 22 nt, Human
augaggagucaaggagucggag

SEQ ID NO: 140139 - RNA, 22 nt, Human
augaggccacaguuauagauuu

SEQ ID NO: 140140 - RNA, 21 nt, Human
augagguggcuacuaaagagu

SEQ ID NO: 140141 - RNA, 22 nt, Human
augaaacuggagcgccuggagg

SEQ ID NO: 140142 - RNA, 22 nt, Human
augaacugcaguauaaacuugg

SEQ ID NO: 140143 - RNA, 23 nt, Human
augcaacauugccaguaugggca

SEQ ID NO: 140144 - RNA, 22 nt, Human
augaggccuaauacccauuccu

SEQ ID NO: 140145 - RNA, 22 nt, Human
augacagcucuagcacacagua

SEQ ID NO: 140146 - RNA, 22 nt, Human
augaccuucuuuccuuaaauuu

SEQ ID NO: 140147 - RNA, 22 nt, Human
aucuauguaucucagaagcuag

SEQ ID NO: 140148 - RNA, 22 nt, Human
aucuugaaacauauaugcauuu

SEQ ID NO: 140149 - RNA, 22 nt, Human
aucuuggauccuuugccagcuu

SEQ ID NO: 140150 - RNA, 19 nt, Human
aucuuucagcagcuccccu

SEQ ID NO: 140151 - RNA, 22 nt, Human
aucuaauguggcaaguugcuga

SEQ ID NO: 140152 - RNA, 22 nt, Human
aucguggcacgucgccgcagcg

SEQ ID NO: 140153 - RNA, 21 nt, Human
aucugugucauuagguggcag

SEQ ID NO: 140154 - RNA, 22 nt, Human
aucugcugccuaggguuugucu

SEQ ID NO: 140155 - RNA, 22 nt, Human
aucugugauuuuggcaagauuu

SEQ ID NO: 140156 - RNA, 20 nt, Human
aucugugaugagaacgguuu

SEQ ID NO: 140157 - RNA, 22 nt, Human
aucugcugcuccuucuucuugc

SEQ ID NO: 140158 - RNA, 22 nt, Human
auccuucaaaaggaauagcagg

SEQ ID NO: 140159 - RNA, 22 nt, Human
auacuacaucacagccaagaag

SEQ ID NO: 140160 - RNA, 22 nt, Human
auacagccuaguuugaguccca

SEQ ID NO: 140161 - RNA, 22 nt, Human
auaaugccucauaggguguucc

SEQ ID NO: 140162 - RNA, 22 nt, Human
cagcuucaugacaaacaguuuu

SEQ ID NO: 140163 - RNA, 22 nt, Human
cagcuucuccauucuucuggcu

SEQ ID NO: 140164 - RNA, 22 nt, Human
caggugccucugccccacgcgg

SEQ ID NO: 140165 - RNA, 22 nt, Human
caggugcucugauauggggcug

SEQ ID NO: 140166 - RNA, 22 nt, Human
cagcuugcccugauguggaaga

SEQ ID NO: 140167 - RNA, 22 nt, Human
cagcuuaccucccacagcucuc

SEQ ID NO: 140168 - RNA, 22 nt, Human
cagcuguggagauggggugcau

SEQ ID NO: 140169 - RNA, 22 nt, Human
cagcuguauuucucugguuaga

SEQ ID NO: 140170 - RNA, 22 nt, Human
cagcugacaagaguccuuggag

SEQ ID NO: 140171 - RNA, 22 nt, Human
cagcuggggagagacauggcag

SEQ ID NO: 140172 - RNA, 22 nt, Human
cagcuggaggagcagcuuccag

SEQ ID NO: 140173 - RNA, 22 nt, Human
cagcuauggaauuggcccagau

SEQ ID NO: 140174 - RNA, 22 nt, Human
caggaggugugucccaccgggu

SEQ ID NO: 140175 - RNA, 23 nt, Human
caggggacaggugaccugggcuc

SEQ ID NO: 140176 - RNA, 22 nt, Human
cagcgguggcaaggugacugug

SEQ ID NO: 140177 - RNA, 22 nt, Human
cagcuucaaaggcccugauggu

SEQ ID NO: 140178 - RNA, 22 nt, Human
cagcuacuaccuguagacaaag

SEQ ID NO: 140179 - RNA, 22 nt, Human
cagcuucacuuaaaacaugcaa

SEQ ID NO: 140180 - RNA, 22 nt, Human
cagagccagcuguccuuggcau

SEQ ID NO: 140181 - RNA, 22 nt, Human
cagagcugagucuucaagguug

SEQ ID NO: 140182 - RNA, 22 nt, Human
cagagcugucauuugccaguga

SEQ ID NO: 140183 - RNA, 22 nt, Human
cagccgcucaugggcccggagc

SEQ ID NO: 140184 - RNA, 22 nt, Human
cagccccagcacuuagcugagu

SEQ ID NO: 140185 - RNA, 22 nt, Human
caggacagaaauaaggaauaua

SEQ ID NO: 140186 - RNA, 22 nt, Human
caggacccaacggugcaauguc

SEQ ID NO: 140187 - RNA, 22 nt, Human
caggacuuccucuaugguggcg

SEQ ID NO: 140188 - RNA, 22 nt, Human
cagcccuggccucuucgcuuuc

SEQ ID NO: 140189 - RNA, 19 nt, Human
caggacaguuugccaagaa

SEQ ID NO: 140190 - RNA, 22 nt, Human
cagccccgcuggccucgccucc

SEQ ID NO: 140191 - RNA, 22 nt, Human
cagcccugagagaaccaucuau

SEQ ID NO: 140192 - RNA, 22 nt, Human
cagccccucuucucuccucgga

SEQ ID NO: 140193 - RNA, 22 nt, Human
cauaacuugguguuggaaacug

SEQ ID NO: 140194 - RNA, 22 nt, Human
cauaagaauauuuaguggcagc

SEQ ID NO: 140195 - RNA, 22 nt, Human
cauagcguuuacauguggauua

SEQ ID NO: 140196 - RNA, 22 nt, Human
caggugggauuuugcugcuuga

SEQ ID NO: 140197 - RNA, 22 nt, Human
cauauuaugcauguuguucuuu

SEQ ID NO: 140198 - RNA, 22 nt, Human
caggguuuuaguugcagguuau

SEQ ID NO: 140199 - RNA, 22 nt, Human
caggccgccacugcagcagcug

SEQ ID NO: 140200 - RNA, 22 nt, Human
caggaucccuggccuccgccca

SEQ ID NO: 140201 - RNA, 22 nt, Human
caguggagaccugccugcugga

SEQ ID NO: 140202 - RNA, 22 nt, Human
caguguugcuaaugaauucauu

SEQ ID NO: 140203 - RNA, 22 nt, Human
caggauauguucaagguuuucu

SEQ ID NO: 140204 - RNA, 22 nt, Human
caggcacaaugagcgccaucuu

SEQ ID NO: 140205 - RNA, 19 nt, Human
caggauuguuuaaagcuuu

SEQ ID NO: 140206 - RNA, 22 nt, Human
cagucugcuggcuuuuucagca

SEQ ID NO: 140207 - RNA, 22 nt, Human
caggcacagcuaagacuggcca

SEQ ID NO: 140208 - RNA, 22 nt, Human
cagugcuggaggggugcuugca

SEQ ID NO: 140209 - RNA, 22 nt, Human
caggaacagcaccaggagcuag

SEQ ID NO: 140210 - RNA, 22 nt, Human
caggaagagaacugcucagccu

SEQ ID NO: 140211 - RNA, 20 nt, Human
cagguugcugcccccgccuc

SEQ ID NO: 140212 - RNA, 22 nt, Human
cagguggccggguaggaggugg

SEQ ID NO: 140213 - RNA, 22 nt, Human
cagguugaagagguuaacgaua

SEQ ID NO: 140214 - RNA, 22 nt, Human
cacaucugaaggcggcucuagg

SEQ ID NO: 140215 - RNA, 22 nt, Human
cacaucucagggcuacaggcag

SEQ ID NO: 140216 - RNA, 22 nt, Human
cacagugugguauauuucccaa

SEQ ID NO: 140217 - RNA, 22 nt, Human
cacauuguuuggucagagcaua

SEQ ID NO: 140218 - RNA, 22 nt, Human
cagacacgucccuguugaccug

SEQ ID NO: 140219 - RNA, 22 nt, Human
cagacagaguuguuucuucucc

SEQ ID NO: 140220 - RNA, 22 nt, Human
cagacagagcucacaagucuuu

SEQ ID NO: 140221 - RNA, 22 nt, Human
cacagcuggggaagcugaggcc

SEQ ID NO: 140222 - RNA, 22 nt, Human
cagaaagaaguggggauagagg

SEQ ID NO: 140223 - RNA, 22 nt, Human
cagaaaaaaaugcagacuagca

SEQ ID NO: 140224 - RNA, 22 nt, Human
cacaucaaacuuacuaagauuu

SEQ ID NO: 140225 - RNA, 22 nt, Human
caaagaaccuucgagacagggc

SEQ ID NO: 140226 - RNA, 22 nt, Human
caauggagccaagaggaggaaa

SEQ ID NO: 140227 - RNA, 22 nt, Human
caaugggagaugcagaacagcu

SEQ ID NO: 140228 - RNA, 22 nt, Human
caauggaguccucuuccucuuu

SEQ ID NO: 140229 - RNA, 20 nt, Human
caauguuggcaguauagagc

SEQ ID NO: 140230 - RNA, 22 nt, Human
cacgggcgacgugaucuaggac

SEQ ID NO: 140231 - RNA, 23 nt, Human
cacucgcaggcccagcucucagg

SEQ ID NO: 140232 - RNA, 22 nt, Human
cacugugagugcaagcaggggu

SEQ ID NO: 140233 - RNA, 22 nt, Human
cacagcagcaucauuuaucugg

SEQ ID NO: 140234 - RNA, 18 nt, Human
cacagcauccaaguuaug

SEQ ID NO: 140235 - RNA, 22 nt, Human
cacacguuuagcuucuggcggc

SEQ ID NO: 140236 - RNA, 22 nt, Human
cacugcacuccagccugggcaa

SEQ ID NO: 140237 - RNA, 22 nt, Human
cacacagcuagugacaggagaa

SEQ ID NO: 140238 - RNA, 22 nt, Human
caccaccaguaccaucacacgc

SEQ ID NO: 140239 - RNA, 22 nt, Human
caccagcgacugugaccagcaa

SEQ ID NO: 140240 - RNA, 20 nt, Human
cacccgguccucagcgacuc

SEQ ID NO: 140241 - RNA, 22 nt, Human
cacccgacugaggacgccgccc

SEQ ID NO: 140242 - RNA, 22 nt, Human
cacccccaggcuccccuucugg

SEQ ID NO: 140243 - RNA, 20 nt, Human
caccggguugcugguuucuu

SEQ ID NO: 140244 - RNA, 22 nt, Human
caccgaacuuugcaaaugcaau

SEQ ID NO: 140245 - RNA, 22 nt, Human
cacuaaccauguucccaacagc

SEQ ID NO: 140246 - RNA, 23 nt, Human
cagaccccuggcucugacccccu

SEQ ID NO: 140247 - RNA, 22 nt, Human
cacuauguacauaauagcugcu

SEQ ID NO: 140248 - RNA, 22 nt, Human
cagaccagaaggaagccgacaa

SEQ ID NO: 140249 - RNA, 22 nt, Human
cagagagcguccauccggugcc

SEQ ID NO: 140250 - RNA, 22 nt, Human
cagagacuuuugcuccgauucu

SEQ ID NO: 140251 - RNA, 22 nt, Human
cagacugagaaagugccacagg

SEQ ID NO: 140252 - RNA, 22 nt, Human
cagacgguuaaacgauuuugcu

SEQ ID NO: 140253 - RNA, 22 nt, Human
cacugcugaggcccguguuacu

SEQ ID NO: 140254 - RNA, 22 nt, Human
cacugcaaccuccaccucccgg

SEQ ID NO: 140255 - RNA, 22 nt, Human
cagccagaucgccuuccgccuc

SEQ ID NO: 140256 - RNA, 22 nt, Human
cagcauucuacuuugugaacug

SEQ ID NO: 140257 - RNA, 22 nt, Human
cagcauugagcacagaaggaaa

SEQ ID NO: 140258 - RNA, 22 nt, Human
cagaaguugcuugagagagagc

SEQ ID NO: 140259 - RNA, 22 nt, Human
cagaccuggaaaacaggcuugc

SEQ ID NO: 140260 - RNA, 22 nt, Human
cagccccaguuuucauaagacu

SEQ ID NO: 140261 - RNA, 22 nt, Human
cagcccuguugcgcuuccggcg

SEQ ID NO: 140262 - RNA, 22 nt, Human
cagcacuuccuccgugagcccc

SEQ ID NO: 140263 - RNA, 20 nt, Human
cagcagucagcucuccaaug

SEQ ID NO: 140264 - RNA, 21 nt, Human
cagcagaugccagggucucug

SEQ ID NO: 140265 - RNA, 22 nt, Human
cagcagaugacuauuggagcug

SEQ ID NO: 140266 - RNA, 22 nt, Human
cagcagaggagguggcagcacc

SEQ ID NO: 140267 - RNA, 21 nt, Human
cagcagaaaugagaggagaaa

SEQ ID NO: 140268 - RNA, 22 nt, Human
cagcacugcccuaccccuccac

SEQ ID NO: 140269 - RNA, 22 nt, Human
cauuucuugugagccgcauccu

SEQ ID NO: 140270 - RNA, 20 nt, Human
caugaguccgugaguggccc

SEQ ID NO: 140271 - RNA, 22 nt, Human
caucgagaauuggcagcuaaag

SEQ ID NO: 140272 - RNA, 22 nt, Human
caucugcagccucugcauuccc

SEQ ID NO: 140273 - RNA, 22 nt, Human
caucaggcugggaacacagauc

SEQ ID NO: 140274 - RNA, 22 nt, Human
cauccagagcugccugaccccg

SEQ ID NO: 140275 - RNA, 22 nt, Human
cauugcugccaaggugagcugg

SEQ ID NO: 140276 - RNA, 22 nt, Human
cauugcugugggcauuugcugc

SEQ ID NO: 140277 - RNA, 22 nt, Human
caucacggagcaugagaagaca

SEQ ID NO: 140278 - RNA, 22 nt, Human
caucaacagucuacuuuuugcc

SEQ ID NO: 140279 - RNA, 22 nt, Human
cauuagugaggggcugccugcu

SEQ ID NO: 140280 - RNA, 22 nt, Human
caugugcaucagccaauuggag

SEQ ID NO: 140281 - RNA, 22 nt, Human
caucaauagguauuugagagac

SEQ ID NO: 140282 - RNA, 21 nt, Human
caucaagaucaauggagggcu

SEQ ID NO: 140283 - RNA, 22 nt, Human
cagguguugcaguugaagacug

SEQ ID NO: 140284 - RNA, 22 nt, Human
ccacucagaagaaacaagagag

SEQ ID NO: 140285 - RNA, 22 nt, Human
ccacccuuccauucuuccucuu

SEQ ID NO: 140286 - RNA, 22 nt, Human
ccacccugguuacugugccagg

SEQ ID NO: 140287 - RNA, 22 nt, Human
ccaccacugaggcacaggagcc

SEQ ID NO: 140288 - RNA, 22 nt, Human
cauucauagaaucaguuuggga

SEQ ID NO: 140289 - RNA, 22 nt, Human
cauguggaaaugcaugcuuuuu

SEQ ID NO: 140290 - RNA, 22 nt, Human
ccaccacauuugccuagacuuu

SEQ ID NO: 140291 - RNA, 23 nt, Human
ccacaugugagcccaccgugccc

SEQ ID NO: 140292 - RNA, 22 nt, Human
caugguaaucggggccaucugu

SEQ ID NO: 140293 - RNA, 22 nt, Human
cauguauguuaguggcugcuuu

SEQ ID NO: 140294 - RNA, 22 nt, Human
ccaaggcuggagggcuuaugua

SEQ ID NO: 140295 - RNA, 22 nt, Human
ccaaccaaagggccuaaggucu

SEQ ID NO: 140296 - RNA, 22 nt, Human
ccaaccaguuucuuggcuuuag

SEQ ID NO: 140297 - RNA, 22 nt, Human
ccaaggcugcagccgugacgcg

SEQ ID NO: 140298 - RNA, 22 nt, Human
cauggcacuuuugugucuaaau

SEQ ID NO: 140299 - RNA, 19 nt, Human
cauggcgguaaagaggcug

SEQ ID NO: 140300 - RNA, 22 nt, Human
cauggcggcgcucucccugccu

SEQ ID NO: 140301 - RNA, 22 nt, Human
caugcagauugccaggcucccu

SEQ ID NO: 140302 - RNA, 22 nt, Human
ccaguggugcauguuugagcaa

SEQ ID NO: 140303 - RNA, 22 nt, Human
ccaguuguggagaauuguuuga

SEQ ID NO: 140304 - RNA, 22 nt, Human
ccacuacauugagugcuuucuc

SEQ ID NO: 140305 - RNA, 17 nt, Human
ccacuagauagguugug

SEQ ID NO: 140306 - RNA, 22 nt, Human
ccacccacuucucugcccucca

SEQ ID NO: 140307 - RNA, 22 nt, Human
ccaccuggcagcaggcucggca

SEQ ID NO: 140308 - RNA, 22 nt, Human
ccagaacgacgggcagaggcgc

SEQ ID NO: 140309 - RNA, 22 nt, Human
cccaagcuccacauuuuagcuu

SEQ ID NO: 140310 - RNA, 22 nt, Human
cccacgccuucuuucuucaaau

SEQ ID NO: 140311 - RNA, 22 nt, Human
ccacuauaucaaggauuuuguu

SEQ ID NO: 140312 - RNA, 22 nt, Human
ccaaccaguuaucuccuaaggu

SEQ ID NO: 140313 - RNA, 22 nt, Human
ccagguggacggcgaguacagg

SEQ ID NO: 140314 - RNA, 19 nt, Human
ccaacaguacugaagcacu

SEQ ID NO: 140315 - RNA, 22 nt, Human
ccaaauuaccuucuuggauuca

SEQ ID NO: 140316 - RNA, 22 nt, Human
ccagggcuggaccagugcuugg

SEQ ID NO: 140317 - RNA, 22 nt, Human
ccagggcuggguuugucggugu

SEQ ID NO: 140318 - RNA, 22 nt, Human
ccagggaggucauagugcuggu

SEQ ID NO: 140319 - RNA, 22 nt, Human
ccaggcucaccuggagccccug

SEQ ID NO: 140320 - RNA, 22 nt, Human
ccaggcuccccaggaggcccuu

SEQ ID NO: 140321 - RNA, 19 nt, Human
ccacacacuggucucuggg

SEQ ID NO: 140322 - RNA, 22 nt, Human
ccacagcauugaaaucuauaau

SEQ ID NO: 140323 - RNA, 23 nt, Human
ccagucgagucccaaccuucgcc

SEQ ID NO: 140324 - RNA, 22 nt, Human
ccagugagauagugguauaugc

SEQ ID NO: 140325 - RNA, 22 nt, Human
ccagugcaguacaaaccuuagu

SEQ ID NO: 140326 - RNA, 22 nt, Human
cauuuugguccucauguguagc

SEQ ID NO: 140327 - RNA, 22 nt, Human
cauuuuuccucaggcaauuuga

SEQ ID NO: 140328 - RNA, 22 nt, Human
ccagcugggucccugcuggggc

SEQ ID NO: 140329 - RNA, 17 nt, Human
ccagcugcucccucaga

SEQ ID NO: 140330 - RNA, 22 nt, Human
ccagcugcugcaccgugcaugg

SEQ ID NO: 140331 - RNA, 22 nt, Human
ccaggcccugccugugguuccu

SEQ ID NO: 140332 - RNA, 22 nt, Human
ccagcagaagcucccgcugggu

SEQ ID NO: 140333 - RNA, 22 nt, Human
ccagcaaguaagucagugucag

SEQ ID NO: 140334 - RNA, 22 nt, Human
ccagccugagcuugcugcccuc

SEQ ID NO: 140335 - RNA, 22 nt, Human
ccagccugccaagcccagcccu

SEQ ID NO: 140336 - RNA, 22 nt, Human
ccagccacagcuuccagcuccu

SEQ ID NO: 140337 - RNA, 22 nt, Human
ccagcaugcucagucuaaauug

SEQ ID NO: 140338 - RNA, 23 nt, Human
cauuugauccucacaauaaaugg

SEQ ID NO: 140339 - RNA, 22 nt, Human
cauuuaucacuugcuaaacaua

SEQ ID NO: 140340 - RNA, 22 nt, Human
ccagcaagacucgcagugggau

SEQ ID NO: 140341 - RNA, 18 nt, Human
cauuguacaaugcuuuau

SEQ ID NO: 140342 - RNA, 22 nt, Human
ccagacuggggauuuugccagg

SEQ ID NO: 140343 - RNA, 22 nt, Human
ccagacuggggcuccuugaggg

SEQ ID NO: 140344 - RNA, 22 nt, Human
ccagaugggggcugugggaggg

SEQ ID NO: 140345 - RNA, 22 nt, Human
ccagagcaccgaaacgagcuuu

SEQ ID NO: 140346 - RNA, 22 nt, Human
ccagaacguuugugcgaggcag

SEQ ID NO: 140347 - RNA, 22 nt, Human
ccacucucucccucuguagggg

SEQ ID NO: 140348 - RNA, 20 nt, Human
ccagaagagaagaaaaggaa

SEQ ID NO: 140349 - RNA, 22 nt, Human
cauugcuguuaauugucucuag

SEQ ID NO: 140350 - RNA, 22 nt, Human
ccuugggagcgcccuguccggg

SEQ ID NO: 140351 - RNA, 22 nt, Human
ccuuggcuuaccuucugugugg

SEQ ID NO: 140352 - RNA, 22 nt, Human
ccuugguuuagcaauuuuucuu

SEQ ID NO: 140353 - RNA, 22 nt, Human
ccuugcgaggaugcugugagcu

SEQ ID NO: 140354 - RNA, 22 nt, Human
ccuucgcuggcaucuccaggua

SEQ ID NO: 140355 - RNA, 22 nt, Human
ccuuuuagagaagugcauccag

SEQ ID NO: 140356 - RNA, 22 nt, Human
ccggcugagccucgccgcggcc

SEQ ID NO: 140357 - RNA, 22 nt, Human
ccggcggguggagcaugcgcgg

SEQ ID NO: 140358 - RNA, 22 nt, Human
cccagagacuuuguccgacgac

SEQ ID NO: 140359 - RNA, 22 nt, Human
ccagagaugcagugggugcagu

SEQ ID NO: 140360 - RNA, 19 nt, Human
ccuggccaacgucaacauu

SEQ ID NO: 140361 - RNA, 22 nt, Human
ccagagcacaccguuugccuuc

SEQ ID NO: 140362 - RNA, 22 nt, Human
ccuggaccgacacaggaaggga

SEQ ID NO: 140363 - RNA, 22 nt, Human
ccgcgcccccggcugugccccc

SEQ ID NO: 140364 - RNA, 19 nt, Human
ccgagcagauugauguuuc

SEQ ID NO: 140365 - RNA, 22 nt, Human
ccuggcauuagaaauuccguca

SEQ ID NO: 140366 - RNA, 22 nt, Human
ccuggccacagggcucugcauu

SEQ ID NO: 140367 - RNA, 22 nt, Human
ccugggcucgcgcacuucaccc

SEQ ID NO: 140368 - RNA, 22 nt, Human
ccgaggaguagggugucuacgg

SEQ ID NO: 140369 - RNA, 22 nt, Human
ccuggcccagcuggaagcggga

SEQ ID NO: 140370 - RNA, 22 nt, Human
ccugggcauaaaucacuccaag

SEQ ID NO: 140371 - RNA, 22 nt, Human
ccugggugaugugcugcccucg

SEQ ID NO: 140372 - RNA, 22 nt, Human
ccugugcuucacucaacaagcc

SEQ ID NO: 140373 - RNA, 22 nt, Human
cgcuuuccaggcacauccucuu

SEQ ID NO: 140374 - RNA, 22 nt, Human
cgcuuugacuuuagaaggccaa

SEQ ID NO: 140375 - RNA, 22 nt, Human
cgggacaauagcagugcugaug

SEQ ID NO: 140376 - RNA, 22 nt, Human
cggagggcccucaggacugggu

SEQ ID NO: 140377 - RNA, 22 nt, Human
cgccgugucuggucuguacguc

SEQ ID NO: 140378 - RNA, 22 nt, Human
cgcugcugucaucgucuacggu

SEQ ID NO: 140379 - RNA, 22 nt, Human
ccugagacucuccugugcagcc

SEQ ID NO: 140380 - RNA, 21 nt, Human
ccugagccuguuuauccagaa

SEQ ID NO: 140381 - RNA, 22 nt, Human
ccugaggcccuggcugugcuga

SEQ ID NO: 140382 - RNA, 21 nt, Human
cgcccggccggaaaccccuuc

SEQ ID NO: 140383 - RNA, 22 nt, Human
cgccgugcagucagcccagaag

SEQ ID NO: 140384 - RNA, 22 nt, Human
cgccgccgccugcccgcgcccc

SEQ ID NO: 140385 - RNA, 22 nt, Human
ccucuggacuugggacagugag

SEQ ID NO: 140386 - RNA, 22 nt, Human
ccugaccauuugccacaugggu

SEQ ID NO: 140387 - RNA, 22 nt, Human
cgaggccgcuucauggcuggca

SEQ ID NO: 140388 - RNA, 22 nt, Human
cgaggagguccaggagcaguag

SEQ ID NO: 140389 - RNA, 22 nt, Human
cgaggcuugcaaggacgaggag

SEQ ID NO: 140390 - RNA, 22 nt, Human
cgagugauuauucuggcugaga

SEQ ID NO: 140391 - RNA, 22 nt, Human
cgcacacaaaugcauacgccag

SEQ ID NO: 140392 - RNA, 22 nt, Human
ccuccugggccuugcucuguga

SEQ ID NO: 140393 - RNA, 19 nt, Human
ccuccguguuaccuguccu

SEQ ID NO: 140394 - RNA, 22 nt, Human
ccuauuuucaaaauuguuuauc

SEQ ID NO: 140395 - RNA, 22 nt, Human
cgaacggcagagagcccguccc

SEQ ID NO: 140396 - RNA, 20 nt, Human
ccucaaccuccuuucucucc

SEQ ID NO: 140397 - RNA, 22 nt, Human
ccguaugacuuuuuguuguugu

SEQ ID NO: 140398 - RNA, 22 nt, Human
ccgugcaguuucucacacacau

SEQ ID NO: 140399 - RNA, 22 nt, Human
ccuacccaccccuccucaucac

SEQ ID NO: 140400 - RNA, 22 nt, Human
cgucauuuguaaaugaucaaga

SEQ ID NO: 140401 - RNA, 17 nt, Human
cgugaggaccaggcagc

SEQ ID NO: 140402 - RNA, 22 nt, Human
cgugcuaccugagcugacagcu

SEQ ID NO: 140403 - RNA, 22 nt, Human
ccuggcccugcugcuugccagc

SEQ ID NO: 140404 - RNA, 21 nt, Human
ccuggagacaaagacagggug

SEQ ID NO: 140405 - RNA, 22 nt, Human
cgggagcagcucuggggcuggg

SEQ ID NO: 140406 - RNA, 22 nt, Human
ccuuggaucugcauaucagcua

SEQ ID NO: 140407 - RNA, 22 nt, Human
cgcacuugugagcgacagggcu

SEQ ID NO: 140408 - RNA, 22 nt, Human
cuagagaaaaagcuuagguacg

SEQ ID NO: 140409 - RNA, 22 nt, Human
cuagaggaacaguuucagguuu

SEQ ID NO: 140410 - RNA, 22 nt, Human
cgagguacuuacccuggucugu

SEQ ID NO: 140411 - RNA, 22 nt, Human
cgagcccacacuccuguccucu

SEQ ID NO: 140412 - RNA, 22 nt, Human
cuaacuuugucuugguaauugc

SEQ ID NO: 140413 - RNA, 19 nt, Human
cuacaguguuuuucuuucc

SEQ ID NO: 140414 - RNA, 22 nt, Human
cucugagcucgugcaguacuuc

SEQ ID NO: 140415 - RNA, 22 nt, Human
cggagguccagucacaaguaac

SEQ ID NO: 140416 - RNA, 22 nt, Human
cggaggcugcuuucuguugcua

SEQ ID NO: 140417 - RNA, 22 nt, Human
cggagcgagaaggggaaagccc

SEQ ID NO: 140418 - RNA, 22 nt, Human
cucuaccugcacaugccugacu

SEQ ID NO: 140419 - RNA, 22 nt, Human
cggagcauacugccuggagaug

SEQ ID NO: 140420 - RNA, 22 nt, Human
cuccuauugaucaguacuauuu

SEQ ID NO: 140421 - RNA, 22 nt, Human
cuccugauuucuaggccuuauc

SEQ ID NO: 140422 - RNA, 22 nt, Human
cuccucguccucuucauccucu

SEQ ID NO: 140423 - RNA, 22 nt, Human
cucaucuucuuccuucuuuucc

SEQ ID NO: 140424 - RNA, 22 nt, Human
cucauugacagagcagcucuac

SEQ ID NO: 140425 - RNA, 22 nt, Human
cuccaacugccacuguacugga

SEQ ID NO: 140426 - RNA, 22 nt, Human
cuccagcucgcgagcucugcuc

SEQ ID NO: 140427 - RNA, 22 nt, Human
cuccagcagaaagggcgagugg

SEQ ID NO: 140428 - RNA, 22 nt, Human
cuccggccuucugacuccccug

SEQ ID NO: 140429 - RNA, 22 nt, Human
cuccaggcccagggccaagagc

SEQ ID NO: 140430 - RNA, 22 nt, Human
cucaaaauccauaaaaucaggu

SEQ ID NO: 140431 - RNA, 22 nt, Human
cucaaauggguuuguagaauau

SEQ ID NO: 140432 - RNA, 22 nt, Human
cgccugucugcauggccacugg

SEQ ID NO: 140433 - RNA, 22 nt, Human
cucaggugagcgagcuaaauua

SEQ ID NO: 140434 - RNA, 22 nt, Human
cgcaucggguagaggagcugga

SEQ ID NO: 140435 - RNA, 22 nt, Human
cuagcacagugcuuggcacaca

SEQ ID NO: 140436 - RNA, 22 nt, Human
cgcauugcaauucaggggauaa

SEQ ID NO: 140437 - RNA, 22 nt, Human
cuagcagaagcuccuugagggu

SEQ ID NO: 140438 - RNA, 22 nt, Human
cgccaguggcagcuggaacagg

SEQ ID NO: 140439 - RNA, 22 nt, Human
cgcccggcugagacgcucgccc

SEQ ID NO: 140440 - RNA, 22 nt, Human
cugauagagcauuagugugaga

SEQ ID NO: 140441 - RNA, 22 nt, Human
cguggcaguagagcuggaacuu

SEQ ID NO: 140442 - RNA, 22 nt, Human
cguggccacaguggagcugagc

SEQ ID NO: 140443 - RNA, 22 nt, Human
cgucauguuauggcucauucua

SEQ ID NO: 140444 - RNA, 21 nt, Human
cgucccggcgugagagagcug

SEQ ID NO: 140445 - RNA, 22 nt, Human
cugagggagacagugcggacua

SEQ ID NO: 140446 - RNA, 22 nt, Human
cugaggcuaauagaauuuucug

SEQ ID NO: 140447 - RNA, 22 nt, Human
cugagcaucaaaugggcaauua

SEQ ID NO: 140448 - RNA, 22 nt, Human
cucugcuuagacaggcuuuaag

SEQ ID NO: 140449 - RNA, 20 nt, Human
cuaaaacaggugucuaguga

SEQ ID NO: 140450 - RNA, 22 nt, Human
cuaaauucuauauccuugcuuc

SEQ ID NO: 140451 - RNA, 22 nt, Human
cuaaauguuuuaucuuccuggc

SEQ ID NO: 140452 - RNA, 22 nt, Human
cuaaagucauacaaggugggag

SEQ ID NO: 140453 - RNA, 22 nt, Human
cuaaagacagcaagacaucauc

SEQ ID NO: 140454 - RNA, 22 nt, Human
cuaaaaauguucuaguaguuca

SEQ ID NO: 140455 - RNA, 22 nt, Human
cugcaguguccgcuugcucagc

SEQ ID NO: 140456 - RNA, 22 nt, Human
cgugucauggcggcgcaggugg

SEQ ID NO: 140457 - RNA, 20 nt, Human
cguguacauuuaugccccug

SEQ ID NO: 140458 - RNA, 22 nt, Human
cgugugcguauguguuuguaug

SEQ ID NO: 140459 - RNA, 22 nt, Human
cgugugugugcgugugcgugug

SEQ ID NO: 140460 - RNA, 22 nt, Human
cguucccuccugccacgggagg

SEQ ID NO: 140461 - RNA, 17 nt, Human
cguuccagaacaaauga

SEQ ID NO: 140462 - RNA, 22 nt, Human
cugcuguuuuccccaccaucuc

SEQ ID NO: 140463 - RNA, 22 nt, Human
cugcugcuugauugcaggaagu

SEQ ID NO: 140464 - RNA, 22 nt, Human
cugcugccagcuuaauacucac

SEQ ID NO: 140465 - RNA, 20 nt, Human
cugcuccauggcaucuuuag

SEQ ID NO: 140466 - RNA, 22 nt, Human
cugcguugaccagacuccuggg

SEQ ID NO: 140467 - RNA, 22 nt, Human
cuaggucagaggacacagcuua

SEQ ID NO: 140468 - RNA, 22 nt, Human
cuaauugcuggcugcuggcaga

SEQ ID NO: 140469 - RNA, 22 nt, Human
cuaauuguaagcuccuugaggg

SEQ ID NO: 140470 - RNA, 22 nt, Human
cuaauaauuuacugagugcuac

SEQ ID NO: 140471 - RNA, 22 nt, Human
cugccaguaucuuuggggcugu

SEQ ID NO: 140472 - RNA, 22 nt, Human
cuacugacugaccauaguuuca

SEQ ID NO: 140473 - RNA, 22 nt, Human
cugcccgcaugcaggaaugcug

SEQ ID NO: 140474 - RNA, 22 nt, Human
cuaccccaggccccucgaugcc

SEQ ID NO: 140475 - RNA, 22 nt, Human
cugcgcagaucugcuguucucu

SEQ ID NO: 140476 - RNA, 22 nt, Human
cugccuuggcccuaguucaugg

SEQ ID NO: 140477 - RNA, 22 nt, Human
cugcgcgagcacugccggcggg

SEQ ID NO: 140478 - RNA, 22 nt, Human
cugccugugcgccaagugcacg

SEQ ID NO: 140479 - RNA, 22 nt, Human
cugccggcugcugcagagaggu

SEQ ID NO: 140480 - RNA, 23 nt, Human
cugagggcuggucugaagucugc

SEQ ID NO: 140481 - RNA, 22 nt, Human
cuuauuagaaagaaaagacaug

SEQ ID NO: 140482 - RNA, 22 nt, Human
cuguucagugcauauguauuga

SEQ ID NO: 140483 - RNA, 21 nt, Human
cugugggaaggccugaggucu

SEQ ID NO: 140484 - RNA, 22 nt, Human
cugugcauguucucuagcugau

SEQ ID NO: 140485 - RNA, 22 nt, Human
cucuuucauucuuagguugccg

SEQ ID NO: 140486 - RNA, 22 nt, Human
cuggugggucacgugugggugg

SEQ ID NO: 140487 - RNA, 22 nt, Human
cugguuacuucagaucaguagu

SEQ ID NO: 140488 - RNA, 22 nt, Human
cucugugggcauauuuguaaaa

SEQ ID NO: 140489 - RNA, 22 nt, Human
cuggcgauugcgagagucgccu

SEQ ID NO: 140490 - RNA, 22 nt, Human
cuggcggugaucccgauggugu

SEQ ID NO: 140491 - RNA, 22 nt, Human
cuggcggcccgaggcagaggag

SEQ ID NO: 140492 - RNA, 22 nt, Human
cuccacccuagagggcccaugc

SEQ ID NO: 140493 - RNA, 22 nt, Human
cuccgcagcugggguuggcgcu

SEQ ID NO: 140494 - RNA, 22 nt, Human
cuccgccuguccugggcccacg

SEQ ID NO: 140495 - RNA, 22 nt, Human
cuggucuugguauucgcagaag

SEQ ID NO: 140496 - RNA, 22 nt, Human
cuggucaauaaucauguaguac

SEQ ID NO: 140497 - RNA, 22 nt, Human
cuggguuuggcugugcuugaau

SEQ ID NO: 140498 - RNA, 22 nt, Human
cuggguaaauauguauuccuga

SEQ ID NO: 140499 - RNA, 22 nt, Human
cugggugggcacccagccuggg

SEQ ID NO: 140500 - RNA, 22 nt, Human
cugggcaugggaacuucaaggc

SEQ ID NO: 140501 - RNA, 22 nt, Human
cucacccaaacuauaucuuuaa

SEQ ID NO: 140502 - RNA, 22 nt, Human
cucaagacacccuggccucuac

SEQ ID NO: 140503 - RNA, 22 nt, Human
cucaugcugcaaauggcuguuu

SEQ ID NO: 140504 - RNA, 22 nt, Human
cuggcaguguccagcucgugau

SEQ ID NO: 140505 - RNA, 22 nt, Human
cucagaugaugucuucagggaa

SEQ ID NO: 140506 - RNA, 22 nt, Human
cucagcaacccacacacggucu

SEQ ID NO: 140507 - RNA, 22 nt, Human
cucagcgagggaaagaggccgc

SEQ ID NO: 140508 - RNA, 22 nt, Human
cucagcgggagucuggccgaac

SEQ ID NO: 140509 - RNA, 22 nt, Human
gaaaaucaugaaaguguguugu

SEQ ID NO: 140510 - RNA, 22 nt, Human
gaaaaucaggauggaugugagg

SEQ ID NO: 140511 - RNA, 22 nt, Human
cugguuuuccaauguuuugacu

SEQ ID NO: 140512 - RNA, 21 nt, Human
gaaaaucuaaugugacaaugc

SEQ ID NO: 140513 - RNA, 22 nt, Human
cugucucugauaagcucgaggg

SEQ ID NO: 140514 - RNA, 19 nt, Human
cuguccacacacucgcuuc

SEQ ID NO: 140515 - RNA, 22 nt, Human
cugucagcaaaucagugucugg

SEQ ID NO: 140516 - RNA, 22 nt, Human
cuggugaagccuucggagaccc

SEQ ID NO: 140517 - RNA, 22 nt, Human
cuggugcuguagccugauugag

SEQ ID NO: 140518 - RNA, 20 nt, Human
cuggugccuucugcgauuua

SEQ ID NO: 140519 - RNA, 22 nt, Human
cuguguuguuugaguagcuuga

SEQ ID NO: 140520 - RNA, 22 nt, Human
cuguguugggauggugcgcgca

SEQ ID NO: 140521 - RNA, 22 nt, Human
cuguuguucacuuugcugguga

SEQ ID NO: 140522 - RNA, 22 nt, Human
gaacuuaauauacaaucaguuc

SEQ ID NO: 140523 - RNA, 22 nt, Human
gaagaggaagaggagccagagc

SEQ ID NO: 140524 - RNA, 22 nt, Human
cugugguuuuauuuauuugaag

SEQ ID NO: 140525 - RNA, 20 nt, Human
gaacauaaauaacucuuuac

SEQ ID NO: 140526 - RNA, 22 nt, Human
gaaaccauggcaaccagguccu

SEQ ID NO: 140527 - RNA, 22 nt, Human
gaaacauuuguugaguacuugc

SEQ ID NO: 140528 - RNA, 22 nt, Human
cugggugagcuggccagagggu

SEQ ID NO: 140529 - RNA, 22 nt, Human
cugggugugugugaacagagau

SEQ ID NO: 140530 - RNA, 22 nt, Human
cuuuuucuugugguuaauaucu

SEQ ID NO: 140531 - RNA, 22 nt, Human
cuuuuggcaucagccucaggaa

SEQ ID NO: 140532 - RNA, 22 nt, Human
cugggaaucuagagggcucauu

SEQ ID NO: 140533 - RNA, 19 nt, Human
cugggacaaugaaagcauc

SEQ ID NO: 140534 - RNA, 22 nt, Human
cugggaugagcuguuuccuggu

SEQ ID NO: 140535 - RNA, 20 nt, Human
cuggaguguagcaguggcug

SEQ ID NO: 140536 - RNA, 22 nt, Human
cuggagcuucaggguucucggg

SEQ ID NO: 140537 - RNA, 22 nt, Human
cuucacugcagucauggcucug

SEQ ID NO: 140538 - RNA, 22 nt, Human
cugauccuauauugguaugagg

SEQ ID NO: 140539 - RNA, 22 nt, Human
cugaugcucuggauguagucaa

SEQ ID NO: 140540 - RNA, 22 nt, Human
cuggcuaaugugcugauagcca

SEQ ID NO: 140541 - RNA, 22 nt, Human
cuggcuguguguuugugcaucu

SEQ ID NO: 140542 - RNA, 22 nt, Human
cuggcgagcugggccuggggga

SEQ ID NO: 140543 - RNA, 19 nt, Human
cuuuuagagggagaggacu

SEQ ID NO: 140544 - RNA, 18 nt, Human
cuuuagcugucaucuuug

SEQ ID NO: 140545 - RNA, 22 nt, Human
cuugucuaguuccuggugaugu

SEQ ID NO: 140546 - RNA, 22 nt, Human
gacacucauauuaagccuauuu

SEQ ID NO: 140547 - RNA, 23 nt, Human
cuuggcuagccacuuccacgcuc

SEQ ID NO: 140548 - RNA, 22 nt, Human
cuugccaguguugcagaagcuc

SEQ ID NO: 140549 - RNA, 22 nt, Human
cuugccagggacucagucaggg

SEQ ID NO: 140550 - RNA, 22 nt, Human
gaauggcagaaugaagcagugu

SEQ ID NO: 140551 - RNA, 22 nt, Human
gaagaugcugcuuguucacggg

SEQ ID NO: 140552 - RNA, 18 nt, Human
gaagcaacaguucugagu

SEQ ID NO: 140553 - RNA, 23 nt, Human
cuucggcgcucgcugggcggagg

SEQ ID NO: 140554 - RNA, 22 nt, Human
cuuccugcaacaccuguguugc

SEQ ID NO: 140555 - RNA, 22 nt, Human
gaaggugcugaaacagaaauuu

SEQ ID NO: 140556 - RNA, 22 nt, Human
cuucucuuccuucucauccuca

SEQ ID NO: 140557 - RNA, 22 nt, Human
cuucucuuggguguggugucuu

SEQ ID NO: 140558 - RNA, 22 nt, Human
gagacugcguggcucugacaca

SEQ ID NO: 140559 - RNA, 22 nt, Human
gagaaauagauucaugguagau

SEQ ID NO: 140560 - RNA, 22 nt, Human
gagaacagauaugaugacuuca

SEQ ID NO: 140561 - RNA, 22 nt, Human
gacuugauugguuugucaaguu

SEQ ID NO: 140562 - RNA, 22 nt, Human
cuuuuugcccuugggcuuccug

SEQ ID NO: 140563 - RNA, 18 nt, Human
gacugccuugaacuauug

SEQ ID NO: 140564 - RNA, 22 nt, Human
gacugacagugguacuguaauu

SEQ ID NO: 140565 - RNA, 22 nt, Human
gacuggaaucucugcuuguuaa

SEQ ID NO: 140566 - RNA, 22 nt, Human
cuuuggauuuuuugcuuuugua

SEQ ID NO: 140567 - RNA, 21 nt, Human
cuuuggcaagggagaagucac

SEQ ID NO: 140568 - RNA, 22 nt, Human
gaccgggcucugcugacggucu

SEQ ID NO: 140569 - RNA, 22 nt, Human
gacccuuugacuugugacauua

SEQ ID NO: 140570 - RNA, 22 nt, Human
gaccugaccucauuagcaaguu

SEQ ID NO: 140571 - RNA, 22 nt, Human
gacagaccucugcugacuggag

SEQ ID NO: 140572 - RNA, 22 nt, Human
gacagcguaucaauugaacaua

SEQ ID NO: 140573 - RNA, 22 nt, Human
cuuuccaugucuucuuucucca

SEQ ID NO: 140574 - RNA, 22 nt, Human
gacagcguguuuugcaugaaca

SEQ ID NO: 140575 - RNA, 22 nt, Human
gagaaugagucagagcuggcug

SEQ ID NO: 140576 - RNA, 22 nt, Human
gagaaguaggaauaucaggagu

SEQ ID NO: 140577 - RNA, 22 nt, Human
gagaacaaggaagagucggcag

SEQ ID NO: 140578 - RNA, 22 nt, Human
gauaggaggaugggaccuguga

SEQ ID NO: 140579 - RNA, 22 nt, Human
gacuucaucagagcguacuguu

SEQ ID NO: 140580 - RNA, 22 nt, Human
gacugucaaauaaaucguuuac

SEQ ID NO: 140581 - RNA, 20 nt, Human
gagugucacacacaaccccu

SEQ ID NO: 140582 - RNA, 22 nt, Human
gaguuauuuuuccuguuuuuua

SEQ ID NO: 140583 - RNA, 22 nt, Human
gacuggucuuuugugauggaug

SEQ ID NO: 140584 - RNA, 22 nt, Human
gaccaggagauuugagcuaggc

SEQ ID NO: 140585 - RNA, 22 nt, Human
gaccacugaaugcacuucuaau

SEQ ID NO: 140586 - RNA, 22 nt, Human
gacccgacaaguaaucagguga

SEQ ID NO: 140587 - RNA, 22 nt, Human
gaguaauuuucuuaaaacauca

SEQ ID NO: 140588 - RNA, 22 nt, Human
gaccagaacuucuagucuaagu

SEQ ID NO: 140589 - RNA, 22 nt, Human
gaguagccucagucugcaagug

SEQ ID NO: 140590 - RNA, 22 nt, Human
gagucuacaugcaggcaauugu

SEQ ID NO: 140591 - RNA, 22 nt, Human
gaguggccugccccagccaggc

SEQ ID NO: 140592 - RNA, 22 nt, Human
gacggagugcgcuugcuguuca

SEQ ID NO: 140593 - RNA, 22 nt, Human
gacggggcagccagcugguggc

SEQ ID NO: 140594 - RNA, 22 nt, Human
gacggaggacaucagcaguguc

SEQ ID NO: 140595 - RNA, 22 nt, Human
gacgacgggccccguggccacc

SEQ ID NO: 140596 - RNA, 22 nt, Human
gaccugcucagcccuguguguu

SEQ ID NO: 140597 - RNA, 22 nt, Human
gacacaacuucccucccacauu

SEQ ID NO: 140598 - RNA, 22 nt, Human
gacacccgccggcgccugccuc

SEQ ID NO: 140599 - RNA, 20 nt, Human
gacaagccacagcucccaga

SEQ ID NO: 140600 - RNA, 22 nt, Human
gacacugccaagugccccgaga

SEQ ID NO: 140601 - RNA, 22 nt, Human
gacaccuucuacugacuaugga

SEQ ID NO: 140602 - RNA, 22 nt, Human
gacaguggagccacguugggag

SEQ ID NO: 140603 - RNA, 22 nt, Human
gagguuggagggcugcccugca

SEQ ID NO: 140604 - RNA, 20 nt, Human
gagguugcucagaguggggu

SEQ ID NO: 140605 - RNA, 22 nt, Human
gaggugcaggggcccgggcugg

SEQ ID NO: 140606 - RNA, 22 nt, Human
gaggugggaggcgggccugcau

SEQ ID NO: 140607 - RNA, 22 nt, Human
gacagcaggaugugaggggaug

SEQ ID NO: 140608 - RNA, 22 nt, Human
gacaacuucaguaaaguagauu

SEQ ID NO: 140609 - RNA, 22 nt, Human
gagggggaaaagggcagcagag

SEQ ID NO: 140610 - RNA, 22 nt, Human
gaggggcucuugggcaugaagg

SEQ ID NO: 140611 - RNA, 22 nt, Human
gaggggcgaggacgcugaagua

SEQ ID NO: 140612 - RNA, 22 nt, Human
gagggcauugucuucuuaguuu

SEQ ID NO: 140613 - RNA, 22 nt, Human
gaggcuugccacuguccauggc

SEQ ID NO: 140614 - RNA, 22 nt, Human
gagggaaaggggccaugauugg

SEQ ID NO: 140615 - RNA, 22 nt, Human
gaauauuuaucucagcugcaga

SEQ ID NO: 140616 - RNA, 22 nt, Human
gaaugacuugcucauucugugu

SEQ ID NO: 140617 - RNA, 22 nt, Human
gaggcuaugucuacgcucagcg

SEQ ID NO: 140618 - RNA, 22 nt, Human
gaaugcacacgugugugcaugc

SEQ ID NO: 140619 - RNA, 22 nt, Human
gaggauuugagggucacuccac

SEQ ID NO: 140620 - RNA, 22 nt, Human
gaggcgcgcugcgagggcgcgg

SEQ ID NO: 140621 - RNA, 22 nt, Human
gaggaggagaagcggcggcgga

SEQ ID NO: 140622 - RNA, 22 nt, Human
gaaguaaugugauugcucaggg

SEQ ID NO: 140623 - RNA, 22 nt, Human
gaggagggagcuggaagcucuu

SEQ ID NO: 140624 - RNA, 22 nt, Human
gaggaagucuuaucuggaugca

SEQ ID NO: 140625 - RNA, 22 nt, Human
gaggacuucaggccuggccagg

SEQ ID NO: 140626 - RNA, 22 nt, Human
gagcuggagaaacacauaagaa

SEQ ID NO: 140627 - RNA, 22 nt, Human
gagcuuuguuccgugguggcac

SEQ ID NO: 140628 - RNA, 22 nt, Human
gagcggcggugagaaguguggg

SEQ ID NO: 140629 - RNA, 22 nt, Human
gaagccaugauaaccagugugg

SEQ ID NO: 140630 - RNA, 22 nt, Human
gagcggcucaguggccauguga

SEQ ID NO: 140631 - RNA, 22 nt, Human
gaagcagguucuucaggaugaa

SEQ ID NO: 140632 - RNA, 22 nt, Human
gaagcaagagggaucaggaucu

SEQ ID NO: 140633 - RNA, 22 nt, Human
gagccgcagcugcguagggucc

SEQ ID NO: 140634 - RNA, 22 nt, Human
gaaaaguuuaaccuuguacauu

SEQ ID NO: 140635 - RNA, 22 nt, Human
gaaaaugcacacauacacaccc

SEQ ID NO: 140636 - RNA, 18 nt, Human
gcugaaauucuaaacaaa

SEQ ID NO: 140637 - RNA, 22 nt, Human
gcucggcuggcucaucucaugu

SEQ ID NO: 140638 - RNA, 22 nt, Human
gcucuagcuggcgcugaccugg

SEQ ID NO: 140639 - RNA, 22 nt, Human
gcucccaauuccuuuuacaauu

SEQ ID NO: 140640 - RNA, 22 nt, Human
gcucaugggcccagagcagccc

SEQ ID NO: 140641 - RNA, 20 nt, Human
gcucaguggagaaaugcacc

SEQ ID NO: 140642 - RNA, 22 nt, Human
gcaucacacgcacauacacaca

SEQ ID NO: 140643 - RNA, 22 nt, Human
gcuagagaagagcccacaccgg

SEQ ID NO: 140644 - RNA, 22 nt, Human
gcaggccgauuuguuagaaguc

SEQ ID NO: 140645 - RNA, 22 nt, Human
gcgguuggacguucgccucggg

SEQ ID NO: 140646 - RNA, 22 nt, Human
gcgguuauggcagagauuacag

SEQ ID NO: 140647 - RNA, 22 nt, Human
gcagguuguuuaaauuaggauu

SEQ ID NO: 140648 - RNA, 22 nt, Human
gcagguggaagcagcagacuca

SEQ ID NO: 140649 - RNA, 22 nt, Human
gcaggucacagcugauuggcca

SEQ ID NO: 140650 - RNA, 22 nt, Human
gcacgugugugagagauaugaa

SEQ ID NO: 140651 - RNA, 22 nt, Human
gcagugccauguggaggaucuc

SEQ ID NO: 140652 - RNA, 22 nt, Human
gcagucauggguagaacucaag

SEQ ID NO: 140653 - RNA, 19 nt, Human
gcgggcucuccaccccauc

SEQ ID NO: 140654 - RNA, 23 nt, Human
gcgggcggagccgggaggcgggg

SEQ ID NO: 140655 - RNA, 22 nt, Human
gcgcugagcuuuucuuauugaa

SEQ ID NO: 140656 - RNA, 22 nt, Human
gcgcgggugagucacgggcgga

SEQ ID NO: 140657 - RNA, 20 nt, Human
gcgcuucccuacgcucugcu

SEQ ID NO: 140658 - RNA, 22 nt, Human
gcagcuuuggagguggaacucu

SEQ ID NO: 140659 - RNA, 22 nt, Human
gcagcagugugggcugaaccua

SEQ ID NO: 140660 - RNA, 22 nt, Human
gcagcauuaccaagacauggca

SEQ ID NO: 140661 - RNA, 21 nt, Human
gcgcgcucgugcucgacgcgc

SEQ ID NO: 140662 - RNA, 22 nt, Human
gcgcgcucugcgaggacacgcu

SEQ ID NO: 140663 - RNA, 22 nt, Human
gcgcgccugccucccgcggugc

SEQ ID NO: 140664 - RNA, 20 nt, Human
gcgcaguuccgggcgcgucu

SEQ ID NO: 140665 - RNA, 22 nt, Human
gccugggguuugcggggcugca

SEQ ID NO: 140666 - RNA, 22 nt, Human
gccugcugggcucuuccugcug

SEQ ID NO: 140667 - RNA, 23 nt, Human
gcacuccgagggcacgugucucu

SEQ ID NO: 140668 - RNA, 22 nt, Human
gcagacuaacuuuugucagccu

SEQ ID NO: 140669 - RNA, 22 nt, Human
gcaauagccuacaugcgucaga

SEQ ID NO: 140670 - RNA, 21 nt, Human
gcacaacucucacauucuucu

SEQ ID NO: 140671 - RNA, 22 nt, Human
gcacagucaacacuuauucacc

SEQ ID NO: 140672 - RNA, 22 nt, Human
gccugccucugacuggggcuga

SEQ ID NO: 140673 - RNA, 22 nt, Human
gccccucuccuugugcaccugc

SEQ ID NO: 140674 - RNA, 22 nt, Human
gcccuggagauggaaguucuga

SEQ ID NO: 140675 - RNA, 22 nt, Human
gcccuguguguuugcacugauu

SEQ ID NO: 140676 - RNA, 22 nt, Human
gaugguggaggaaucgcugaag

SEQ ID NO: 140677 - RNA, 22 nt, Human
gaugucauguuggcagacaguu

SEQ ID NO: 140678 - RNA, 22 nt, Human
gaugucccuggaggggacagga

SEQ ID NO: 140679 - RNA, 22 nt, Human
gaucccccaucuacuaucccca

SEQ ID NO: 140680 - RNA, 22 nt, Human
gaugguagauauagaaagggga

SEQ ID NO: 140681 - RNA, 22 nt, Human
gauggugcaauuaucgugcaug

SEQ ID NO: 140682 - RNA, 22 nt, Human
gccaguuuguuuacugaugguu

SEQ ID NO: 140683 - RNA, 23 nt, Human
gccaucugcugggugccccggcc

SEQ ID NO: 140684 - RNA, 22 nt, Human
gccaucuucggcagccgccugg

SEQ ID NO: 140685 - RNA, 22 nt, Human
gaucuuacucacuucagcuggc

SEQ ID NO: 140686 - RNA, 22 nt, Human
gaucccaguccuacccucauaa

SEQ ID NO: 140687 - RNA, 22 nt, Human
gaucccagaggcggggauagga

SEQ ID NO: 140688 - RNA, 22 nt, Human
gauccagauauuugggcuggua

SEQ ID NO: 140689 - RNA, 22 nt, Human
gaugccggggucguagccgugg

SEQ ID NO: 140690 - RNA, 22 nt, Human
gccaggcggcccaggagauggc

SEQ ID NO: 140691 - RNA, 22 nt, Human
gccaggagaaaaggcgaaugau

SEQ ID NO: 140692 - RNA, 22 nt, Human
gccaggccuggguggagcgcuc

SEQ ID NO: 140693 - RNA, 22 nt, Human
gccaggcagcagcgaggauggu

SEQ ID NO: 140694 - RNA, 22 nt, Human
gcaugcaggaagggcuugggga

SEQ ID NO: 140695 - RNA, 23 nt, Human
gcaucgcaggucuaagauuagcu

SEQ ID NO: 140696 - RNA, 22 nt, Human
gcaucuccugagucagauuuug

SEQ ID NO: 140697 - RNA, 19 nt, Human
gccacccaucauauggagg

SEQ ID NO: 140698 - RNA, 22 nt, Human
gccacucaguuuaggggcaagc

SEQ ID NO: 140699 - RNA, 22 nt, Human
gagucaguuguugcaccacuag

SEQ ID NO: 140700 - RNA, 22 nt, Human
gcaguuugugauguggcaguca

SEQ ID NO: 140701 - RNA, 22 nt, Human
gcagugucacuaguaauagucu

SEQ ID NO: 140702 - RNA, 22 nt, Human
gcagugcugcgacagucgggug

SEQ ID NO: 140703 - RNA, 22 nt, Human
gaguggugagaauacaacggaa

SEQ ID NO: 140704 - RNA, 22 nt, Human
gaguggcaaagagaacaaagau

SEQ ID NO: 140705 - RNA, 21 nt, Human
gcauccucguacucuucaggu

SEQ ID NO: 140706 - RNA, 22 nt, Human
gcauccaaggagcagaagugau

SEQ ID NO: 140707 - RNA, 22 nt, Human
gcauagacaccuuagagcaaua

SEQ ID NO: 140708 - RNA, 19 nt, Human
gagugaggagcaucguuua

SEQ ID NO: 140709 - RNA, 22 nt, Human
gcagugcauggaagggggugug

SEQ ID NO: 140710 - RNA, 22 nt, Human
gcagugacagacaacuguuuga

SEQ ID NO: 140711 - RNA, 22 nt, Human
gcaguauuguguguggucaugg

SEQ ID NO: 140712 - RNA, 22 nt, Human
gcaguaaauugagagucauguu

SEQ ID NO: 140713 - RNA, 22 nt, Human
gcagguccgagagggucgggua

SEQ ID NO: 140714 - RNA, 22 nt, Human
gaucugguuccaggacauugca

SEQ ID NO: 140715 - RNA, 21 nt, Human
gaucgcaaugugggaaucaug

SEQ ID NO: 140716 - RNA, 22 nt, Human
gcaggguaggugacagguaguc

SEQ ID NO: 140717 - RNA, 22 nt, Human
gcagggcucagccgcucccacc

SEQ ID NO: 140718 - RNA, 22 nt, Human
gcaggccuccccugcuggagcu

SEQ ID NO: 140719 - RNA, 22 nt, Human
gcuuucagggucacugucaaca

SEQ ID NO: 140720 - RNA, 22 nt, Human
gcuugggcugaaggccuggguc

SEQ ID NO: 140721 - RNA, 22 nt, Human
gcuugcaucaggggcuggggcc

SEQ ID NO: 140722 - RNA, 20 nt, Human
gcuugcggacagguggcuca

SEQ ID NO: 140723 - RNA, 22 nt, Human
gccgcgggucugggucuggcuc

SEQ ID NO: 140724 - RNA, 22 nt, Human
gcccuuuuaucaacuccuagaa

SEQ ID NO: 140725 - RNA, 22 nt, Human
gcuugaggaacucagacuugag

SEQ ID NO: 140726 - RNA, 22 nt, Human
gcuuuguugauggugagucugu

SEQ ID NO: 140727 - RNA, 22 nt, Human
gcuuuucucccugcuuucuucc

SEQ ID NO: 140728 - RNA, 22 nt, Human
ggaaaagccauauuauaggcaa

SEQ ID NO: 140729 - RNA, 22 nt, Human
ggaaaaugcugaagcaucugaa

SEQ ID NO: 140730 - RNA, 22 nt, Human
gccucaaaaguguuguagaggg

SEQ ID NO: 140731 - RNA, 22 nt, Human
gccuccggagucgcagugucuu

SEQ ID NO: 140732 - RNA, 22 nt, Human
gccuccagaggggacaaaaauu

SEQ ID NO: 140733 - RNA, 22 nt, Human
gccguuccuacucucucugugu

SEQ ID NO: 140734 - RNA, 22 nt, Human
gccuagaagaaugagcgcaggg

SEQ ID NO: 140735 - RNA, 20 nt, Human
gccggggcauaggggccguc

SEQ ID NO: 140736 - RNA, 22 nt, Human
gccggguguuccugggaagaug

SEQ ID NO: 140737 - RNA, 22 nt, Human
gccgggagugcagcgggcgcgc

SEQ ID NO: 140738 - RNA, 17 nt, Human
ggaagaaaaggaucauc

SEQ ID NO: 140739 - RNA, 22 nt, Human
ggaacaguacucggaggccaga

SEQ ID NO: 140740 - RNA, 22 nt, Human
gccugcagccagggaguucucu

SEQ ID NO: 140741 - RNA, 22 nt, Human
gccugcaaagacuuccuucucu

SEQ ID NO: 140742 - RNA, 18 nt, Human
gccugccagccgagggac

SEQ ID NO: 140743 - RNA, 22 nt, Human
gccugcaggaaggugugccugu

SEQ ID NO: 140744 - RNA, 22 nt, Human
ggaaauguguguaagaaaguau

SEQ ID NO: 140745 - RNA, 22 nt, Human
gccugagauuggacauuauuua

SEQ ID NO: 140746 - RNA, 22 nt, Human
gcuuaggcgcuccuuuucacuc

SEQ ID NO: 140747 - RNA, 22 nt, Human
gcuucucacccuuacuaucucu

SEQ ID NO: 140748 - RNA, 22 nt, Human
gcuuccuuagcuuaccaaguau

SEQ ID NO: 140749 - RNA, 22 nt, Human
gccgccgccgccuuuguugcgg

SEQ ID NO: 140750 - RNA, 22 nt, Human
gcuguggcuccaauggugagcc

SEQ ID NO: 140751 - RNA, 22 nt, Human
gcuguggacacagcucucuuca

SEQ ID NO: 140752 - RNA, 22 nt, Human
gcuguguucauccugcccaggu

SEQ ID NO: 140753 - RNA, 18 nt, Human
gcuguccgguagcuggug

SEQ ID NO: 140754 - RNA, 20 nt, Human
gcugugccaugacccucgag

SEQ ID NO: 140755 - RNA, 22 nt, Human
gcuuacuguuccuguuggugcu

SEQ ID NO: 140756 - RNA, 22 nt, Human
gcuguuguugcacggaaggugg

SEQ ID NO: 140757 - RNA, 22 nt, Human
gcuguugagucagacaaguuuu

SEQ ID NO: 140758 - RNA, 22 nt, Human
gcuguugugaggaucagcauau

SEQ ID NO: 140759 - RNA, 22 nt, Human
gcugucaggaacaugccuuggu

SEQ ID NO: 140760 - RNA, 22 nt, Human
gcugucauggacaugucuguuu

SEQ ID NO: 140761 - RNA, 22 nt, Human
gcccugccauugaucggcccag

SEQ ID NO: 140762 - RNA, 22 nt, Human
gcccuggcauuucuauucaugu

SEQ ID NO: 140763 - RNA, 22 nt, Human
gcccuggucguggagggcaaca

SEQ ID NO: 140764 - RNA, 22 nt, Human
gcauugcuauuucuguuagugu

SEQ ID NO: 140765 - RNA, 22 nt, Human
gccccgcgcgcguagcgccgcu

SEQ ID NO: 140766 - RNA, 22 nt, Human
gcccccgccuugcugggccagg

SEQ ID NO: 140767 - RNA, 22 nt, Human
gcugacuauaaggcugcucugu

SEQ ID NO: 140768 - RNA, 22 nt, Human
gcaugguuuccugcaacguucu

SEQ ID NO: 140769 - RNA, 23 nt, Human
gcugagcaccagccauaucuuuu

SEQ ID NO: 140770 - RNA, 22 nt, Human
ggcaguguggauccuggagaag

SEQ ID NO: 140771 - RNA, 22 nt, Human
ggcagucaucacuuauucauca

SEQ ID NO: 140772 - RNA, 22 nt, Human
gcuaguucugccuccccuagug

SEQ ID NO: 140773 - RNA, 19 nt, Human
gcuccugcagcuagagugc

SEQ ID NO: 140774 - RNA, 22 nt, Human
gcgugcauguguguaugcgugu

SEQ ID NO: 140775 - RNA, 22 nt, Human
gcguguauuccagaccuuaacg

SEQ ID NO: 140776 - RNA, 22 nt, Human
gcguagaagaaagcugcugcua

SEQ ID NO: 140777 - RNA, 21 nt, Human
ggcagccuggcaggggcacug

SEQ ID NO: 140778 - RNA, 22 nt, Human
ggcagcgcuuggcugcucgaca

SEQ ID NO: 140779 - RNA, 22 nt, Human
ggcaccuuucaucccaucuaga

SEQ ID NO: 140780 - RNA, 22 nt, Human
ggcacccugcauuggcuugagu

SEQ ID NO: 140781 - RNA, 19 nt, Human
ggaguugccaggagaagga

SEQ ID NO: 140782 - RNA, 22 nt, Human
ggaguuucugucaucccguccc

SEQ ID NO: 140783 - RNA, 22 nt, Human
gcggacaauggaagaugucauu

SEQ ID NO: 140784 - RNA, 22 nt, Human
gcggagaggcagagacuccgcg

SEQ ID NO: 140785 - RNA, 22 nt, Human
gcgcggcgcggguccucggccu

SEQ ID NO: 140786 - RNA, 19 nt, Human
ggacuuaggcagacuaauu

SEQ ID NO: 140787 - RNA, 22 nt, Human
ggaggccgugcugugcugccag

SEQ ID NO: 140788 - RNA, 22 nt, Human
ggagggcuggacguacuagggc

SEQ ID NO: 140789 - RNA, 22 nt, Human
ggagguguguucuguuuuagug

SEQ ID NO: 140790 - RNA, 23 nt, Human
ggacaugucucuggguauuuuga

SEQ ID NO: 140791 - RNA, 22 nt, Human
ggacauuguuguuggauccuug

SEQ ID NO: 140792 - RNA, 22 nt, Human
ggacuugaaguaguuauggccu

SEQ ID NO: 140793 - RNA, 17 nt, Human
ggacuuucugccugucc

SEQ ID NO: 140794 - RNA, 22 nt, Human
gccugggccgggcgcggccccc

SEQ ID NO: 140795 - RNA, 22 nt, Human
gccugggugcugugggguggag

SEQ ID NO: 140796 - RNA, 20 nt, Human
gccugggagaagaucaggga

SEQ ID NO: 140797 - RNA, 22 nt, Human
ggagcaagagugagcaagcaga

SEQ ID NO: 140798 - RNA, 22 nt, Human
ggagauggucacagguaaacau

SEQ ID NO: 140799 - RNA, 22 nt, Human
ggagaugucugugccacgucuc

SEQ ID NO: 140800 - RNA, 22 nt, Human
gggggcgccgccgcucaucuca

SEQ ID NO: 140801 - RNA, 22 nt, Human
ggaggcacugaaaguccuacag

SEQ ID NO: 140802 - RNA, 22 nt, Human
gggugcucauggauaaggcgaa

SEQ ID NO: 140803 - RNA, 22 nt, Human
gggugcucagugccaaggagug

SEQ ID NO: 140804 - RNA, 22 nt, Human
ggaggccagagaagagccaggc

SEQ ID NO: 140805 - RNA, 22 nt, Human
ggagcuaagagaauggacaagg

SEQ ID NO: 140806 - RNA, 22 nt, Human
ggguuuuggggaggaagugagc

SEQ ID NO: 140807 - RNA, 22 nt, Human
gguaagguugggugucagaggg

SEQ ID NO: 140808 - RNA, 22 nt, Human
ggguuuugugauugccucugaa

SEQ ID NO: 140809 - RNA, 22 nt, Human
ggaucagcgagaagggcugaaa

SEQ ID NO: 140810 - RNA, 22 nt, Human
ggaucgauuccaaauguagauc

SEQ ID NO: 140811 - RNA, 22 nt, Human
ggaugaguuguauauaggauuc

SEQ ID NO: 140812 - RNA, 22 nt, Human
ggguuccuuggaacacuguuug

SEQ ID NO: 140813 - RNA, 22 nt, Human
ggguggcaagucuuucugcaac

SEQ ID NO: 140814 - RNA, 22 nt, Human
ggguggugagagaacuuugcag

SEQ ID NO: 140815 - RNA, 22 nt, Human
ggagugaagacagagugaacuu

SEQ ID NO: 140816 - RNA, 22 nt, Human
ggagucguguuugggaucggag

SEQ ID NO: 140817 - RNA, 22 nt, Human
ggaugcagcagagaccuggagu

SEQ ID NO: 140818 - RNA, 23 nt, Human
ggauggacauacguaugcacagg

SEQ ID NO: 140819 - RNA, 22 nt, Human
ggauggugauguacccagucau

SEQ ID NO: 140820 - RNA, 22 nt, Human
ggucaucacugagagcagaucc

SEQ ID NO: 140821 - RNA, 22 nt, Human
ggucaaucaugggucauugucu

SEQ ID NO: 140822 - RNA, 20 nt, Human
ggcagcaaccauaugcuaca

SEQ ID NO: 140823 - RNA, 22 nt, Human
ggcagagcugugcgcccaccca

SEQ ID NO: 140824 - RNA, 22 nt, Human
ggcagagguagcuggaaccagg

SEQ ID NO: 140825 - RNA, 20 nt, Human
ggcagagcuaugucuguugc

SEQ ID NO: 140826 - RNA, 22 nt, Human
ggcacagcgacuaccaucgaaa

SEQ ID NO: 140827 - RNA, 19 nt, Human
ggcacccagagucccccug

SEQ ID NO: 140828 - RNA, 23 nt, Human
ggugagccuuucuaguagucuug

SEQ ID NO: 140829 - RNA, 22 nt, Human
ggugacuucugaaccuggagug

SEQ ID NO: 140830 - RNA, 22 nt, Human
ggucgacuaauguuucauuuca

SEQ ID NO: 140831 - RNA, 22 nt, Human
ggcacaggcugguaccaguuca

SEQ ID NO: 140832 - RNA, 22 nt, Human
ggugucguuucacaugacccag

SEQ ID NO: 140833 - RNA, 22 nt, Human
ggccacgggguuugcugaaacu

SEQ ID NO: 140834 - RNA, 22 nt, Human
ggugcuucgauagguguccaua

SEQ ID NO: 140835 - RNA, 22 nt, Human
gguggcauguaccucacagacu

SEQ ID NO: 140836 - RNA, 22 nt, Human
ggugcuggggaaauuaggguag

SEQ ID NO: 140837 - RNA, 22 nt, Human
ggugaucucagucuagaugguu

SEQ ID NO: 140838 - RNA, 22 nt, Human
gguggccggcaccccacccucg

SEQ ID NO: 140839 - RNA, 22 nt, Human
gguggccuaacaaugguggcaa

SEQ ID NO: 140840 - RNA, 22 nt, Human
ggcaugcaaaugugggugaccu

SEQ ID NO: 140841 - RNA, 21 nt, Human
ggacucguucgccgugccagc

SEQ ID NO: 140842 - RNA, 21 nt, Human
ggacccucagauggcagugag

SEQ ID NO: 140843 - RNA, 22 nt, Human
ggaauaaaaggagguggcgaga

SEQ ID NO: 140844 - RNA, 22 nt, Human
gggccggcuggggcggggcggg

SEQ ID NO: 140845 - RNA, 21 nt, Human
gggccugggccagggccgggu

SEQ ID NO: 140846 - RNA, 22 nt, Human
gggcccggguaggggaagagag

SEQ ID NO: 140847 - RNA, 22 nt, Human
ggaagaggaagaugaggcagca

SEQ ID NO: 140848 - RNA, 22 nt, Human
gggccccgggcgcggcugcggg

SEQ ID NO: 140849 - RNA, 22 nt, Human
gggcagagggcgagcugggaga

SEQ ID NO: 140850 - RNA, 22 nt, Human
gggacugguuguguguggugug

SEQ ID NO: 140851 - RNA, 22 nt, Human
gggagccagcagggcauggagc

SEQ ID NO: 140852 - RNA, 20 nt, Human
gggaucgaguaccuccgggu

SEQ ID NO: 140853 - RNA, 22 nt, Human
gcuugcugaacaggaaccuggc

SEQ ID NO: 140854 - RNA, 22 nt, Human
gcuucuguuaggauguggcuua

SEQ ID NO: 140855 - RNA, 20 nt, Human
gcuugaauuugauggccaga

SEQ ID NO: 140856 - RNA, 22 nt, Human
gggacugcgagauucucaaggg

SEQ ID NO: 140857 - RNA, 18 nt, Human
gcuuggguggcuauguuu

SEQ ID NO: 140858 - RNA, 22 nt, Human
gcuuccgacagagaucacauug

SEQ ID NO: 140859 - RNA, 22 nt, Human
gcuuccuccaucuggggcuugc

SEQ ID NO: 140860 - RNA, 22 nt, Human
gggaacuuugugagacuggaga

SEQ ID NO: 140861 - RNA, 22 nt, Human
gcuucugugagugcagaugcug

SEQ ID NO: 140862 - RNA, 22 nt, Human
gggaaaauguuucugagacaaa

SEQ ID NO: 140863 - RNA, 22 nt, Human
gcuguuucuuuggcaaacugau

SEQ ID NO: 140864 - RNA, 22 nt, Human
gcuguuggaggaguucagugcu

SEQ ID NO: 140865 - RNA, 19 nt, Human
ggcuuugcccuucgcuccg

SEQ ID NO: 140866 - RNA, 19 nt, Human
ggccacacuauuaaaagau

SEQ ID NO: 140867 - RNA, 22 nt, Human
ggccacauuccagagggcugaa

SEQ ID NO: 140868 - RNA, 20 nt, Human
ggcauuuuuuaguugagcuu

SEQ ID NO: 140869 - RNA, 22 nt, Human
ggccaaagagcacaaugaauag

SEQ ID NO: 140870 - RNA, 21 nt, Human
ggccagauucucccauagcug

SEQ ID NO: 140871 - RNA, 22 nt, Human
ggccaccuaagguugugcauca

SEQ ID NO: 140872 - RNA, 22 nt, Human
ggcugugggguccuguggugug

SEQ ID NO: 140873 - RNA, 22 nt, Human
ggcugguggcgggcagcacaga

SEQ ID NO: 140874 - RNA, 22 nt, Human
gucugaggagaggcagcauaac

SEQ ID NO: 140875 - RNA, 22 nt, Human
ggcuuguccuucugguugucuu

SEQ ID NO: 140876 - RNA, 22 nt, Human
ggcuuugggaggaugaggcggu

SEQ ID NO: 140877 - RNA, 20 nt, Human
gugaacuggagaacugaugu

SEQ ID NO: 140878 - RNA, 22 nt, Human
ggcuucaaaacacaugucaaga

SEQ ID NO: 140879 - RNA, 22 nt, Human
gugaucagaagaaccugccgaa

SEQ ID NO: 140880 - RNA, 22 nt, Human
gugacucuacuuaagauuaagc

SEQ ID NO: 140881 - RNA, 22 nt, Human
gggaacuguaguuuacgcugcc

SEQ ID NO: 140882 - RNA, 22 nt, Human
gugaagcacaugggcguugggu

SEQ ID NO: 140883 - RNA, 22 nt, Human
gugaccagacagagucuagccc

SEQ ID NO: 140884 - RNA, 21 nt, Human
gugaccuguuaugcaaaggca

SEQ ID NO: 140885 - RNA, 22 nt, Human
gggaggcagacgcuggagccca

SEQ ID NO: 140886 - RNA, 22 nt, Human
gugccucuaguuuucuccuaaa

SEQ ID NO: 140887 - RNA, 22 nt, Human
gugccgaugaggccuggcauuc

SEQ ID NO: 140888 - RNA, 22 nt, Human
gugccaccagaugcuguugcua

SEQ ID NO: 140889 - RNA, 22 nt, Human
gggauguuuugcaggcaaagaa

SEQ ID NO: 140890 - RNA, 22 nt, Human
gugcucaucuucuguaacuguu

SEQ ID NO: 140891 - RNA, 22 nt, Human
gugcucaagacauuaggaauau

SEQ ID NO: 140892 - RNA, 22 nt, Human
gugccuggugcaggauaaucac

SEQ ID NO: 140893 - RNA, 22 nt, Human
gugcuacacaaauguuaguugu

SEQ ID NO: 140894 - RNA, 20 nt, Human
gugcggcucuaccacucggu

SEQ ID NO: 140895 - RNA, 22 nt, Human
gggcaagaagcuggaagcauuc

SEQ ID NO: 140896 - RNA, 22 nt, Human
gugcugcaaggauggagaggca

SEQ ID NO: 140897 - RNA, 22 nt, Human
gugcugcaugagcaucacguag

SEQ ID NO: 140898 - RNA, 22 nt, Human
gggcacggaaggcgccaggggu

SEQ ID NO: 140899 - RNA, 22 nt, Human
gugcucuagaaauugucagugg

SEQ ID NO: 140900 - RNA, 22 nt, Human
gggacagcuggggguaaagcau

SEQ ID NO: 140901 - RNA, 22 nt, Human
gugauggucgagcgcuuguugu

SEQ ID NO: 140902 - RNA, 22 nt, Human
gugauggggagagcgcagcuuu

SEQ ID NO: 140903 - RNA, 22 nt, Human
gugauuucaaauauagagugag

SEQ ID NO: 140904 - RNA, 22 nt, Human
gugcacuugaucuagacagauu

SEQ ID NO: 140905 - RNA, 22 nt, Human
gugcagcugguggagucugggg

SEQ ID NO: 140906 - RNA, 21 nt, Human
gggagaguagcgguagggagg

SEQ ID NO: 140907 - RNA, 22 nt, Human
gggagaguagcuggaagguucu

SEQ ID NO: 140908 - RNA, 22 nt, Human
gggaggaagaguaggaauuuga

SEQ ID NO: 140909 - RNA, 22 nt, Human
gggagcucaccaugcucugcau

SEQ ID NO: 140910 - RNA, 22 nt, Human
gucuccugcccacccugguccc

SEQ ID NO: 140911 - RNA, 22 nt, Human
gucugcacgugccagggagggg

SEQ ID NO: 140912 - RNA, 22 nt, Human
gucgagcuggaggagcgaaugg

SEQ ID NO: 140913 - RNA, 22 nt, Human
gucgccuaauuaggguauccua

SEQ ID NO: 140914 - RNA, 17 nt, Human
ggcugccaggcaacaua

SEQ ID NO: 140915 - RNA, 22 nt, Human
ggcugcuugauagauaugagua

SEQ ID NO: 140916 - RNA, 20 nt, Human
gucguguauauagcuggggc

SEQ ID NO: 140917 - RNA, 22 nt, Human
ggcugcugcccaccccugcaug

SEQ ID NO: 140918 - RNA, 22 nt, Human
ggcugcuugggcuguuucuuuu

SEQ ID NO: 140919 - RNA, 22 nt, Human
guccaggucauuuaaaaagucc

SEQ ID NO: 140920 - RNA, 22 nt, Human
guccaugugcuaacagugcuua

SEQ ID NO: 140921 - RNA, 22 nt, Human
ggcguccuccucgucugaggcg

SEQ ID NO: 140922 - RNA, 22 nt, Human
ggcgucuugcgggcgguagcgc

SEQ ID NO: 140923 - RNA, 22 nt, Human
ggcuaaggacgggcaaguccca

SEQ ID NO: 140924 - RNA, 22 nt, Human
ggcugcagugcaacucuuucua

SEQ ID NO: 140925 - RNA, 22 nt, Human
ggcugaugacgccugagucuga

SEQ ID NO: 140926 - RNA, 22 nt, Human
ggcuccugggcgucuucgaaca

SEQ ID NO: 140927 - RNA, 22 nt, Human
guccuggagcagcuggaagaug

SEQ ID NO: 140928 - RNA, 22 nt, Human
ggcugcagggaacaggaugggu

SEQ ID NO: 140929 - RNA, 22 nt, Human
guccucgggcucacucccaggg

SEQ ID NO: 140930 - RNA, 22 nt, Human
gucacucuuuuucagcuagcuc

SEQ ID NO: 140931 - RNA, 22 nt, Human
gucacuuuuaagggccuuuucu

SEQ ID NO: 140932 - RNA, 22 nt, Human
gucaggugcaccuccaccaaca

SEQ ID NO: 140933 - RNA, 22 nt, Human
ggcggcaagggaauggagaaga

SEQ ID NO: 140934 - RNA, 22 nt, Human
ggcggcccaggugcuccaggcg

SEQ ID NO: 140935 - RNA, 22 nt, Human
gguuuucacgauccucccuuuu

SEQ ID NO: 140936 - RNA, 22 nt, Human
ggcccgcgcugcuggcgcgcca

SEQ ID NO: 140937 - RNA, 22 nt, Human
guauaaagaugccauacuuacu

SEQ ID NO: 140938 - RNA, 22 nt, Human
ggccagucaaggggauccugaa

SEQ ID NO: 140939 - RNA, 22 nt, Human
ggcgauuggccgggaggaggca

SEQ ID NO: 140940 - RNA, 22 nt, Human
ggcgaggcgggccgcggggucu

SEQ ID NO: 140941 - RNA, 22 nt, Human
ggcgaugaggucuuagaaucua

SEQ ID NO: 140942 - RNA, 22 nt, Human
guauauuuaugagcauuagccu

SEQ ID NO: 140943 - RNA, 22 nt, Human
guaugaguggauagauguaucu

SEQ ID NO: 140944 - RNA, 22 nt, Human
ggcgccauuuuugccuucggag

SEQ ID NO: 140945 - RNA, 22 nt, Human
guuguugucauuagcuguuuaa

SEQ ID NO: 140946 - RNA, 19 nt, Human
ggucugcggggugaccgug

SEQ ID NO: 140947 - RNA, 22 nt, Human
ggucuucauaugccacagaguc

SEQ ID NO: 140948 - RNA, 22 nt, Human
guuuacaacaucuuguccuuca

SEQ ID NO: 140949 - RNA, 22 nt, Human
guuuaucagagagcagaggugg

SEQ ID NO: 140950 - RNA, 22 nt, Human
guuuagauguagauucucuggu

SEQ ID NO: 140951 - RNA, 22 nt, Human
guuucuguguugauugugcccu

SEQ ID NO: 140952 - RNA, 22 nt, Human
guuuccaggcuuugguaugguu

SEQ ID NO: 140953 - RNA, 22 nt, Human
ggugaaggaucccucuuggccu

SEQ ID NO: 140954 - RNA, 22 nt, Human
guuuccaagucucucaacaccc

SEQ ID NO: 140955 - RNA, 22 nt, Human
ggugaguagaaguaguuggcuu

SEQ ID NO: 140956 - RNA, 22 nt, Human
ggugaguaguggaaaugaauga

SEQ ID NO: 140957 - RNA, 22 nt, Human
ggugaggagaaacucugccccu

SEQ ID NO: 140958 - RNA, 22 nt, Human
guugucguucccccugcuuaaa

SEQ ID NO: 140959 - RNA, 22 nt, Human
ggucgagcagcacccguucggc

SEQ ID NO: 140960 - RNA, 22 nt, Human
ggucuagcucggugcuggcgac

SEQ ID NO: 140961 - RNA, 22 nt, Human
guuguugcuauguuauuguuau

SEQ ID NO: 140962 - RNA, 22 nt, Human
gugcuugaguaaaaauagucuu

SEQ ID NO: 140963 - RNA, 22 nt, Human
gugcugggaggcccaggaugga

SEQ ID NO: 140964 - RNA, 22 nt, Human
gugcugucguggaacugggcug

SEQ ID NO: 140965 - RNA, 22 nt, Human
guuggcgaaggaccuggaggag

SEQ ID NO: 140966 - RNA, 22 nt, Human
guugggugccagaggcuucacg

SEQ ID NO: 140967 - RNA, 22 nt, Human
guugggcugaagugugugcuua

SEQ ID NO: 140968 - RNA, 22 nt, Human
uaaaguauucaaguagcuuucu

SEQ ID NO: 140969 - RNA, 22 nt, Human
guaauugcucauauggcaccug

SEQ ID NO: 140970 - RNA, 22 nt, Human
uaaauuagauucccagcgcuau

SEQ ID NO: 140971 - RNA, 22 nt, Human
guaaccacuaugguuauugauu

SEQ ID NO: 140972 - RNA, 22 nt, Human
gguguggcaguggaccugugaa

SEQ ID NO: 140973 - RNA, 22 nt, Human
gguguggguguuaguuugcuua

SEQ ID NO: 140974 - RNA, 21 nt, Human
uaaaagaugacaagacagcuc

SEQ ID NO: 140975 - RNA, 22 nt, Human
gguggucaggagcgcccguugg

SEQ ID NO: 140976 - RNA, 22 nt, Human
gguguacgaagaggcgggaguc

SEQ ID NO: 140977 - RNA, 22 nt, Human
ggugccugggcacggaaagcau

SEQ ID NO: 140978 - RNA, 22 nt, Human
gugacuaugguggagaucagua

SEQ ID NO: 140979 - RNA, 22 nt, Human
gugaaggcaugugugcugugcu

SEQ ID NO: 140980 - RNA, 22 nt, Human
uacuugaaaugggcaucaagag

SEQ ID NO: 140981 - RNA, 22 nt, Human
uaccuagaagagacuuuucugg

SEQ ID NO: 140982 - RNA, 22 nt, Human
uacgugucacugaugaaguuua

SEQ ID NO: 140983 - RNA, 20 nt, Human
uacguguccgaugaucacag

SEQ ID NO: 140984 - RNA, 22 nt, Human
uacagaccaguaguucucagcg

SEQ ID NO: 140985 - RNA, 22 nt, Human
gugaaaauaguaaccuggcuag

SEQ ID NO: 140986 - RNA, 22 nt, Human
gucuggagccacugcugcugcu

SEQ ID NO: 140987 - RNA, 22 nt, Human
gucuggugguggguguagggca

SEQ ID NO: 140988 - RNA, 22 nt, Human
gucgagaacauucauuaugcaa

SEQ ID NO: 140989 - RNA, 22 nt, Human
gucggagcggcugcacaggggg

SEQ ID NO: 140990 - RNA, 22 nt, Human
gucccuggucuaccguggcuuc

SEQ ID NO: 140991 - RNA, 22 nt, Human
uaauauauuuuuuaagggaugu

SEQ ID NO: 140992 - RNA, 22 nt, Human
uaauaucuuuacacauuuucaa

SEQ ID NO: 140993 - RNA, 22 nt, Human
uaauccaaaccaggaauucccu

SEQ ID NO: 140994 - RNA, 22 nt, Human
guccauauuuauccuuaaagua

SEQ ID NO: 140995 - RNA, 22 nt, Human
guccaguaguguuugcaugugg

SEQ ID NO: 140996 - RNA, 22 nt, Human
guccaauguggcaccacagggg

SEQ ID NO: 140997 - RNA, 22 nt, Human
guccuggugccaccugcgggau

SEQ ID NO: 140998 - RNA, 22 nt, Human
uaaugcucauuuggcucugcaa

SEQ ID NO: 140999 - RNA, 22 nt, Human
guccucugggagccuugagccu

SEQ ID NO: 141000 - RNA, 22 nt, Human
guccuguaagauacaaguuuaa

SEQ ID NO: 141001 - RNA, 22 nt, Human
guccuucgcggcugaggccauu

SEQ ID NO: 141002 - RNA, 22 nt, Human
guccuguguaaguacuugcuca

SEQ ID NO: 141003 - RNA, 22 nt, Human
uaauuccacacucccgcaagcg

SEQ ID NO: 141004 - RNA, 22 nt, Human
uaauucuucaauccaguguuca

SEQ ID NO: 141005 - RNA, 22 nt, Human
uaauugagauuucuggcugcuu

SEQ ID NO: 141006 - RNA, 22 nt, Human
guagagagugucuuccagaaau

SEQ ID NO: 141007 - RNA, 22 nt, Human
guagaacucuuuccugcguggg

SEQ ID NO: 141008 - RNA, 22 nt, Human
guagaauggggcucucaaagca

SEQ ID NO: 141009 - RNA, 22 nt, Human
guauucugugugaucaagugau

SEQ ID NO: 141010 - RNA, 22 nt, Human
gucacgucgggacagacugggg

SEQ ID NO: 141011 - RNA, 22 nt, Human
gucaucugagggacgagauuuc

SEQ ID NO: 141012 - RNA, 19 nt, Human
gucagucuuaaguuucagc

SEQ ID NO: 141013 - RNA, 22 nt, Human
uaagugguagaaagagaaaggu

SEQ ID NO: 141014 - RNA, 22 nt, Human
gucagugaaccuucaccaaacc

SEQ ID NO: 141015 - RNA, 22 nt, Human
ucaaccagcuuaucugcaggau

SEQ ID NO: 141016 - RNA, 22 nt, Human
ucaacauguuuuuuaaaagaaa

SEQ ID NO: 141017 - RNA, 20 nt, Human
guugggagaagugucagcug

SEQ ID NO: 141018 - RNA, 22 nt, Human
guugggauugaaggugccucua

SEQ ID NO: 141019 - RNA, 22 nt, Human
guuggugagaguuagggauuua

SEQ ID NO: 141020 - RNA, 22 nt, Human
guuggggccuggagucucuugg

SEQ ID NO: 141021 - RNA, 22 nt, Human
ucaaccucccugcucaccccuc

SEQ ID NO: 141022 - RNA, 22 nt, Human
uauuuuagccaacagaaugaug

SEQ ID NO: 141023 - RNA, 22 nt, Human
guugcggaguguagcgaugcuu

SEQ ID NO: 141024 - RNA, 22 nt, Human
guugcuggggcugaguccccag

SEQ ID NO: 141025 - RNA, 22 nt, Human
guucuucucuuguaauggaauc

SEQ ID NO: 141026 - RNA, 22 nt, Human
uauuuuagaagauuuggagaaa

SEQ ID NO: 141027 - RNA, 22 nt, Human
guucucauugugaugcuuaguu

SEQ ID NO: 141028 - RNA, 22 nt, Human
guucuguucuucacagguuugu

SEQ ID NO: 141029 - RNA, 22 nt, Human
guucaaccaugauuaggaacug

SEQ ID NO: 141030 - RNA, 22 nt, Human
uauucauuuuuauuugugacug

SEQ ID NO: 141031 - RNA, 22 nt, Human
guucggcuuccuaugucaugag

SEQ ID NO: 141032 - RNA, 22 nt, Human
guucuacaacuucgcuugcaga

SEQ ID NO: 141033 - RNA, 17 nt, Human
guucucaaacugacuga

SEQ ID NO: 141034 - RNA, 22 nt, Human
guucuacaugacacucaacauu

SEQ ID NO: 141035 - RNA, 23 nt, Human
gugugccuuuaucuucuguacuc

SEQ ID NO: 141036 - RNA, 21 nt, Human
guguugugagguugguguuag

SEQ ID NO: 141037 - RNA, 22 nt, Human
uauguggcaggugggagaucag

SEQ ID NO: 141038 - RNA, 22 nt, Human
guuagacuugcguggaucauga

SEQ ID NO: 141039 - RNA, 22 nt, Human
guguucccauccacaccaagcc

SEQ ID NO: 141040 - RNA, 22 nt, Human
uaugcuguauucuguauguuag

SEQ ID NO: 141041 - RNA, 22 nt, Human
uauccauaccuucaaguuugcu

SEQ ID NO: 141042 - RNA, 22 nt, Human
uaucuucaauagcccagaugug

SEQ ID NO: 141043 - RNA, 22 nt, Human
guguagugugcuguucaguguu

SEQ ID NO: 141044 - RNA, 22 nt, Human
uaugaaggauacaccucugauu

SEQ ID NO: 141045 - RNA, 22 nt, Human
uaucauuaggagugcugcucgg

SEQ ID NO: 141046 - RNA, 22 nt, Human
guggucaagaccgggaauagga

SEQ ID NO: 141047 - RNA, 22 nt, Human
guggcaaguuuucugacaagga

SEQ ID NO: 141048 - RNA, 22 nt, Human
guggcagagccuugcggcuuug

SEQ ID NO: 141049 - RNA, 20 nt, Human
guggcagugguggcagcagu

SEQ ID NO: 141050 - RNA, 22 nt, Human
guggcauggggagcagcuagaa

SEQ ID NO: 141051 - RNA, 22 nt, Human
guggcagguguacagcucagcu

SEQ ID NO: 141052 - RNA, 22 nt, Human
uaggccugcugaagagcaagcu

SEQ ID NO: 141053 - RNA, 22 nt, Human
guggcuugguauuaaggugcca

SEQ ID NO: 141054 - RNA, 22 nt, Human
guggccugacagaucggaacag

SEQ ID NO: 141055 - RNA, 22 nt, Human
guggcuggguggaacugagucu

SEQ ID NO: 141056 - RNA, 22 nt, Human
uaguggcccagcauuucucaau

SEQ ID NO: 141057 - RNA, 22 nt, Human
uaguggccacugaagugcuaga

SEQ ID NO: 141058 - RNA, 22 nt, Human
guggguauauauaugugugcug

SEQ ID NO: 141059 - RNA, 22 nt, Human
guggguccaaccugugugugug

SEQ ID NO: 141060 - RNA, 22 nt, Human
uagugauuuaagaaaggugacu

SEQ ID NO: 141061 - RNA, 22 nt, Human
uagucggcuaggagggccuucu

SEQ ID NO: 141062 - RNA, 22 nt, Human
gugggcacguccuacugucacu

SEQ ID NO: 141063 - RNA, 22 nt, Human
gugggcagauuaauuucucaau

SEQ ID NO: 141064 - RNA, 22 nt, Human
gugggccaguuccucacaggua

SEQ ID NO: 141065 - RNA, 22 nt, Human
gugggggcagaagcgagugcag

SEQ ID NO: 141066 - RNA, 22 nt, Human
gugggcuuuuuugaaaccugaa

SEQ ID NO: 141067 - RNA, 22 nt, Human
guggagauauuugugauagggg

SEQ ID NO: 141068 - RNA, 22 nt, Human
guggagaagggaccgggaagga

SEQ ID NO: 141069 - RNA, 22 nt, Human
guggaguggguuguacucaggg

SEQ ID NO: 141070 - RNA, 22 nt, Human
uaggaucaugaugguaaggcaa

SEQ ID NO: 141071 - RNA, 22 nt, Human
uaggagcagauggcagcaggug

SEQ ID NO: 141072 - RNA, 22 nt, Human
guggaagauauuucugguccag

SEQ ID NO: 141073 - RNA, 22 nt, Human
guggacuuuggucugugccauc

SEQ ID NO: 141074 - RNA, 22 nt, Human
guggaagggaaaccgcacuggc

SEQ ID NO: 141075 - RNA, 22 nt, Human
gugcuggcaaagagaacaucuu

SEQ ID NO: 141076 - RNA, 22 nt, Human
uagccacagaauucugaguaga

SEQ ID NO: 141077 - RNA, 22 nt, Human
uagccguugggguaacuggaca

SEQ ID NO: 141078 - RNA, 22 nt, Human
uagccucaagagauucagggac

SEQ ID NO: 141079 - RNA, 22 nt, Human
uagccuguuuuuaugagaauuu

SEQ ID NO: 141080 - RNA, 22 nt, Human
uagccacuccgcagcaccgggu

SEQ ID NO: 141081 - RNA, 17 nt, Human
uagccagcuugugauuu

SEQ ID NO: 141082 - RNA, 22 nt, Human
gugagagugguuuauguccaug

SEQ ID NO: 141083 - RNA, 22 nt, Human
uagaacaaacagcauguuugau

SEQ ID NO: 141084 - RNA, 22 nt, Human
uagaacugcucucauacuugcu

SEQ ID NO: 141085 - RNA, 22 nt, Human
uagcugacagcagaagaguauu

SEQ ID NO: 141086 - RNA, 22 nt, Human
uagcuggaggggcaggaugcug

SEQ ID NO: 141087 - RNA, 23 nt, Human
uagcggccaugacgggggucaca

SEQ ID NO: 141088 - RNA, 22 nt, Human
uagcguaugcugugugaugaau

SEQ ID NO: 141089 - RNA, 22 nt, Human
uagcguucuugcaugcuaaccu

SEQ ID NO: 141090 - RNA, 22 nt, Human
uagcgggucacccugcugugaa

SEQ ID NO: 141091 - RNA, 22 nt, Human
uagcuagacacucagggccuca

SEQ ID NO: 141092 - RNA, 22 nt, Human
gugcucgagcugugcgcgcugc

SEQ ID NO: 141093 - RNA, 22 nt, Human
uaacauuucggugacaguggga

SEQ ID NO: 141094 - RNA, 22 nt, Human
uaacauuuaguuuuaagauggu

SEQ ID NO: 141095 - RNA, 22 nt, Human
uaacaguauacuacaucauauu

SEQ ID NO: 141096 - RNA, 22 nt, Human
ucaguguccuucguucuuguug

SEQ ID NO: 141097 - RNA, 22 nt, Human
uaacuguuuugaauauuguggu

SEQ ID NO: 141098 - RNA, 22 nt, Human
uaacucugcuguggaaauggga

SEQ ID NO: 141099 - RNA, 22 nt, Human
uaacaacuuucugguguaacuu

SEQ ID NO: 141100 - RNA, 22 nt, Human
ucagucugcuauagguauuugu

SEQ ID NO: 141101 - RNA, 22 nt, Human
ucagucugguggaugcucauug

SEQ ID NO: 141102 - RNA, 22 nt, Human
ucagguagugguuaaguucugu

SEQ ID NO: 141103 - RNA, 22 nt, Human
guuggguaauuaagcacagaaa

SEQ ID NO: 141104 - RNA, 22 nt, Human
ucaagcuggaaaugaagaaucu

SEQ ID NO: 141105 - RNA, 22 nt, Human
ucagucacugucucagacagga

SEQ ID NO: 141106 - RNA, 22 nt, Human
uaauaguugaaggucaucacua

SEQ ID NO: 141107 - RNA, 22 nt, Human
ucauuuguauucuacaaagcac

SEQ ID NO: 141108 - RNA, 22 nt, Human
uccaagcgcuucuggagcuccu

SEQ ID NO: 141109 - RNA, 22 nt, Human
uccaagacagauaccuagaaga

SEQ ID NO: 141110 - RNA, 23 nt, Human
uacagccaugucgcugauuuaac

SEQ ID NO: 141111 - RNA, 22 nt, Human
ucauggcucuaaagacauagau

SEQ ID NO: 141112 - RNA, 22 nt, Human
ucaugggcaaacuuggggauca

SEQ ID NO: 141113 - RNA, 22 nt, Human
ucaucgauggggagcucuacaa

SEQ ID NO: 141114 - RNA, 22 nt, Human
ucaucggcugucaucuucacgu

SEQ ID NO: 141115 - RNA, 22 nt, Human
uccuugaccuccugacaguaac

SEQ ID NO: 141116 - RNA, 22 nt, Human
uagcuaguugguucuucucugu

SEQ ID NO: 141117 - RNA, 22 nt, Human
uccuggccuuggggagagaagu

SEQ ID NO: 141118 - RNA, 22 nt, Human
uccuggcgugggcuggcugcag

SEQ ID NO: 141119 - RNA, 22 nt, Human
uagcagaacaauagucaaugau

SEQ ID NO: 141120 - RNA, 22 nt, Human
uccugaaggccugaguuccacc

SEQ ID NO: 141121 - RNA, 22 nt, Human
uccucgccgucacgcagccucu

SEQ ID NO: 141122 - RNA, 20 nt, Human
uccgaaucaugacuuugcac

SEQ ID NO: 141123 - RNA, 22 nt, Human
uacuuugucauucuaaccuucc

SEQ ID NO: 141124 - RNA, 22 nt, Human
uccucagcaagacgcuggcagc

SEQ ID NO: 141125 - RNA, 22 nt, Human
uccucaucuuaucaucccaaga

SEQ ID NO: 141126 - RNA, 22 nt, Human
uagaguauuuguuuacuaaguu

SEQ ID NO: 141127 - RNA, 21 nt, Human
uccuaaaggaaauacucaauu

SEQ ID NO: 141128 - RNA, 21 nt, Human
uagaccagcugugcuccucgg

SEQ ID NO: 141129 - RNA, 22 nt, Human
ucccggcaccgggagccccugc

SEQ ID NO: 141130 - RNA, 22 nt, Human
ucccucguuucgaucuuuagaa

SEQ ID NO: 141131 - RNA, 22 nt, Human
ucccugcgugagaaagcacuua

SEQ ID NO: 141132 - RNA, 22 nt, Human
uccccgcuccguagagaaagag

SEQ ID NO: 141133 - RNA, 22 nt, Human
uccacaaagucuaugagaguug

SEQ ID NO: 141134 - RNA, 22 nt, Human
uccagcugugcuccaggaggug

SEQ ID NO: 141135 - RNA, 22 nt, Human
uccaggcagcugcuugaugaua

SEQ ID NO: 141136 - RNA, 22 nt, Human
uccaucaccacagaggacagag

SEQ ID NO: 141137 - RNA, 22 nt, Human
uccaugauauauaugugcacau

SEQ ID NO: 141138 - RNA, 22 nt, Human
uccauggucgauggcugcuggg

SEQ ID NO: 141139 - RNA, 22 nt, Human
uacuagacugagaaucagcuga

SEQ ID NO: 141140 - RNA, 22 nt, Human
uccauguagggagggcuuucaa

SEQ ID NO: 141141 - RNA, 22 nt, Human
uccaggucauucucuccgaccg

SEQ ID NO: 141142 - RNA, 22 nt, Human
ucugcggccggaauucccuuca

SEQ ID NO: 141143 - RNA, 20 nt, Human
uaugcgaagccuuucuggac

SEQ ID NO: 141144 - RNA, 22 nt, Human
ucugcggccuagcgcccggcgc

SEQ ID NO: 141145 - RNA, 22 nt, Human
uaugccaccagucuggaacucu

SEQ ID NO: 141146 - RNA, 22 nt, Human
uaugccaaaaauaaguuuuaug

SEQ ID NO: 141147 - RNA, 22 nt, Human
ucugcacagcucaccucccugg

SEQ ID NO: 141148 - RNA, 22 nt, Human
ucugagugacguccugacagga

SEQ ID NO: 141149 - RNA, 22 nt, Human
uaugaccuuaggaagcaagaag

SEQ ID NO: 141150 - RNA, 22 nt, Human
uaugaggagaacauuccugaac

SEQ ID NO: 141151 - RNA, 20 nt, Human
uaugugcaguuugguuuauc

SEQ ID NO: 141152 - RNA, 22 nt, Human
uaugugugugcguguguuuugc

SEQ ID NO: 141153 - RNA, 21 nt, Human
ucuggccuauaaaguagucgc

SEQ ID NO: 141154 - RNA, 22 nt, Human
ucugcuuuucuuaaggggauca

SEQ ID NO: 141155 - RNA, 22 nt, Human
ucugcuguugaucaugacuagc

SEQ ID NO: 141156 - RNA, 22 nt, Human
uaugggcaagagauaggugguc

SEQ ID NO: 141157 - RNA, 22 nt, Human
ucugcuggugucauuuuugcua

SEQ ID NO: 141158 - RNA, 21 nt, Human
uauucgcauuucugucuuuac

SEQ ID NO: 141159 - RNA, 22 nt, Human
ucuguucagaagaggugaaagu

SEQ ID NO: 141160 - RNA, 22 nt, Human
ucuguucaugucuuuuuaagug

SEQ ID NO: 141161 - RNA, 22 nt, Human
ucuguuguauggcugucuaauu

SEQ ID NO: 141162 - RNA, 22 nt, Human
ucuucacugaagcuuugcaucu

SEQ ID NO: 141163 - RNA, 22 nt, Human
ucuuauugguaaugauggcauu

SEQ ID NO: 141164 - RNA, 22 nt, Human
ucuuauucuuuuaaacaacgca

SEQ ID NO: 141165 - RNA, 22 nt, Human
ucuuacuguccucuguuuuucu

SEQ ID NO: 141166 - RNA, 22 nt, Human
ucugugcuggacugauuucaua

SEQ ID NO: 141167 - RNA, 22 nt, Human
ucuguggcaaacacagugacca

SEQ ID NO: 141168 - RNA, 22 nt, Human
ucuggguuuccuucacaagcac

SEQ ID NO: 141169 - RNA, 22 nt, Human
ucugacuucuuuuauuaucauu

SEQ ID NO: 141170 - RNA, 22 nt, Human
ucugagagcuguagaagccuau

SEQ ID NO: 141171 - RNA, 22 nt, Human
ucucuucggagagaccuuugga

SEQ ID NO: 141172 - RNA, 22 nt, Human
ucucugugaauggcgucaccug

SEQ ID NO: 141173 - RNA, 19 nt, Human
uaucccccauagcagugcg

SEQ ID NO: 141174 - RNA, 22 nt, Human
ucucuuuuuuuaaaacucuaug

SEQ ID NO: 141175 - RNA, 22 nt, Human
ucucuguaguugggcagcugcu

SEQ ID NO: 141176 - RNA, 22 nt, Human
uauauuaaagugcuuugcagug

SEQ ID NO: 141177 - RNA, 20 nt, Human
ucucuaacaugaaugcuauc

SEQ ID NO: 141178 - RNA, 22 nt, Human
uauauauaauguguacagguga

SEQ ID NO: 141179 - RNA, 22 nt, Human
ucucgcuguuccugcuucaggu

SEQ ID NO: 141180 - RNA, 22 nt, Human
uauaaucuugcccauaguauuu

SEQ ID NO: 141181 - RNA, 22 nt, Human
uaguugguggagcgauuugucu

SEQ ID NO: 141182 - RNA, 22 nt, Human
ucgauccaggaaggcugguuua

SEQ ID NO: 141183 - RNA, 22 nt, Human
ucgagcucagcagggaggugcg

SEQ ID NO: 141184 - RNA, 22 nt, Human
uaguuauuucugcacuuaauga

SEQ ID NO: 141185 - RNA, 23 nt, Human
uaguguuauuaauuaguaaggau

SEQ ID NO: 141186 - RNA, 22 nt, Human
uagugucuuccaggacauggua

SEQ ID NO: 141187 - RNA, 18 nt, Human
uaguggguccaagcacau

SEQ ID NO: 141188 - RNA, 22 nt, Human
ucucaaagagcuacuggucuau

SEQ ID NO: 141189 - RNA, 22 nt, Human
ucucaggcuuccuggugcugug

SEQ ID NO: 141190 - RNA, 23 nt, Human
ucucacucauucuccucugucca

SEQ ID NO: 141191 - RNA, 22 nt, Human
ucuauauucuauguucuucuuu

SEQ ID NO: 141192 - RNA, 22 nt, Human
ugauugcucagcuagccucuuu

SEQ ID NO: 141193 - RNA, 22 nt, Human
ugauucacgcuucucuuuaaac

SEQ ID NO: 141194 - RNA, 22 nt, Human
ugauucacagacuucacaaggc

SEQ ID NO: 141195 - RNA, 22 nt, Human
ugaucaacagggcuggaaagag

SEQ ID NO: 141196 - RNA, 20 nt, Human
ucaguuucccuauuagguug

SEQ ID NO: 141197 - RNA, 22 nt, Human
ucauccgcaaccacuuuagccu

SEQ ID NO: 141198 - RNA, 22 nt, Human
ucaucccuuccugcacuauuag

SEQ ID NO: 141199 - RNA, 22 nt, Human
ugaggcuuucacuuggcaaaga

SEQ ID NO: 141200 - RNA, 22 nt, Human
ugaggccaagccuccucugcca

SEQ ID NO: 141201 - RNA, 22 nt, Human
ucauccugucucuguucggaau

SEQ ID NO: 141202 - RNA, 22 nt, Human
ugagugcacaggccacucuuca

SEQ ID NO: 141203 - RNA, 22 nt, Human
ucaugccugcgauugucccugg

SEQ ID NO: 141204 - RNA, 22 nt, Human
ugaggaacaugggagaaauguc

SEQ ID NO: 141205 - RNA, 17 nt, Human
ucaguugugcgagcagc

SEQ ID NO: 141206 - RNA, 22 nt, Human
ucagugugacccuucuauuuuu

SEQ ID NO: 141207 - RNA, 22 nt, Human
ugagcuauuucaccauauagau

SEQ ID NO: 141208 - RNA, 22 nt, Human
ugagccauguucaugaguucau

SEQ ID NO: 141209 - RNA, 20 nt, Human
ucaguggcauaguugcuaag

SEQ ID NO: 141210 - RNA, 22 nt, Human
ucaguggaacacacagaguggg

SEQ ID NO: 141211 - RNA, 22 nt, Human
ugagcaccaggcaccacagcuc

SEQ ID NO: 141212 - RNA, 23 nt, Human
ucagugccaaggagaacuuggug

SEQ ID NO: 141213 - RNA, 22 nt, Human
ucagucauguuuaccagacgua

SEQ ID NO: 141214 - RNA, 22 nt, Human
ugagagaggugaaaugacuuuc

SEQ ID NO: 141215 - RNA, 22 nt, Human
ucaguagcauuuaauguucagu

SEQ ID NO: 141216 - RNA, 22 nt, Human
ucaguauuagugcauuaucagg

SEQ ID NO: 141217 - RNA, 22 nt, Human
ucagucacugugaaaugaauuu

SEQ ID NO: 141218 - RNA, 22 nt, Human
ugagacuugaacuccagugcca

SEQ ID NO: 141219 - RNA, 22 nt, Human
ucaggucacugauaaaguggaa

SEQ ID NO: 141220 - RNA, 22 nt, Human
ugagaauuuaacuugauuagga

SEQ ID NO: 141221 - RNA, 22 nt, Human
ucaggcuagcccagugcuuggg

SEQ ID NO: 141222 - RNA, 22 nt, Human
uccagcuccugaguucacugcu

SEQ ID NO: 141223 - RNA, 22 nt, Human
uccagcacacagguggcucuca

SEQ ID NO: 141224 - RNA, 22 nt, Human
uccagccugaacuuuguccaga

SEQ ID NO: 141225 - RNA, 22 nt, Human
ugauugguauguauguuuguca

SEQ ID NO: 141226 - RNA, 22 nt, Human
uccagagcuguccuacugugag

SEQ ID NO: 141227 - RNA, 22 nt, Human
ucccaaguguuuggcgaggaga

SEQ ID NO: 141228 - RNA, 22 nt, Human
ucccaagugcuccucuggcccc

SEQ ID NO: 141229 - RNA, 20 nt, Human
ugcacggcugugugugugca

SEQ ID NO: 141230 - RNA, 22 nt, Human
uccccaccuaagauacccaucu

SEQ ID NO: 141231 - RNA, 22 nt, Human
ucccagguugaggccuugccug

SEQ ID NO: 141232 - RNA, 22 nt, Human
ucccagccugacagugcaucaa

SEQ ID NO: 141233 - RNA, 22 nt, Human
ugcacacaguucucaggaaaga

SEQ ID NO: 141234 - RNA, 22 nt, Human
ugcaguugcguuugcauuccau

SEQ ID NO: 141235 - RNA, 22 nt, Human
ugcauaugcauguaccuguguu

SEQ ID NO: 141236 - RNA, 22 nt, Human
ugcaggucuggacccccacuuu

SEQ ID NO: 141237 - RNA, 18 nt, Human
uccggaggucagaguaaa

SEQ ID NO: 141238 - RNA, 22 nt, Human
uccggcgaccuccagauguucc

SEQ ID NO: 141239 - RNA, 22 nt, Human
uccgggcagcuccuggagcugu

SEQ ID NO: 141240 - RNA, 22 nt, Human
ucccugccuccuggcagugcca

SEQ ID NO: 141241 - RNA, 21 nt, Human
ucccugcagccccaggccccc

SEQ ID NO: 141242 - RNA, 22 nt, Human
ucccugcaggcauguacucuga

SEQ ID NO: 141243 - RNA, 22 nt, Human
ugcaggaacucgaaaacuauag

SEQ ID NO: 141244 - RNA, 22 nt, Human
uccgacacacgugcucgcagcg

SEQ ID NO: 141245 - RNA, 22 nt, Human
ucgacguuguuuuuucucuguc

SEQ ID NO: 141246 - RNA, 22 nt, Human
ucgacuccauuuuucuugguuc

SEQ ID NO: 141247 - RNA, 22 nt, Human
ugccuggacgacaucacaguga

SEQ ID NO: 141248 - RNA, 21 nt, Human
ugccuggccuuugcuuuuccu

SEQ ID NO: 141249 - RNA, 22 nt, Human
uccuuguuggaauauccuuacc

SEQ ID NO: 141250 - RNA, 17 nt, Human
ugccuucgucuucaguu

SEQ ID NO: 141251 - RNA, 20 nt, Human
ugccuuccgccccgggcacc

SEQ ID NO: 141252 - RNA, 22 nt, Human
ugccucucuggaucugcuguga

SEQ ID NO: 141253 - RNA, 22 nt, Human
uccugcuucaaucugcugcugg

SEQ ID NO: 141254 - RNA, 22 nt, Human
ugcccugaagcugucaauuuug

SEQ ID NO: 141255 - RNA, 22 nt, Human
ugcaugguuauauacuacuagu

SEQ ID NO: 141256 - RNA, 17 nt, Human
ugcaugcgucugugaua

SEQ ID NO: 141257 - RNA, 22 nt, Human
ugcauuuucuaccacacccacu

SEQ ID NO: 141258 - RNA, 22 nt, Human
ugcauuuugaaggaaaaaaaug

SEQ ID NO: 141259 - RNA, 22 nt, Human
uccucaaauccuagccucaucg

SEQ ID NO: 141260 - RNA, 21 nt, Human
uccguucgguuaaaaaggccc

SEQ ID NO: 141261 - RNA, 22 nt, Human
ugcaucugagcacuacggugga

SEQ ID NO: 141262 - RNA, 18 nt, Human
ugcccaccagaagaggga

SEQ ID NO: 141263 - RNA, 22 nt, Human
ugcccacuuugucuccaugcug

SEQ ID NO: 141264 - RNA, 19 nt, Human
ugccccacccucuauccag

SEQ ID NO: 141265 - RNA, 22 nt, Human
ugcccagagccucuuaccucca

SEQ ID NO: 141266 - RNA, 22 nt, Human
ugccaacaggcuugccugaugu

SEQ ID NO: 141267 - RNA, 22 nt, Human
uccuccacuuagcgccacuggg

SEQ ID NO: 141268 - RNA, 22 nt, Human
uccucguccucauccgcgucau

SEQ ID NO: 141269 - RNA, 22 nt, Human
ucuauuguuauccuuuccauuu

SEQ ID NO: 141270 - RNA, 22 nt, Human
ucucaccuagucuuggaggucu

SEQ ID NO: 141271 - RNA, 22 nt, Human
ugcugcggcgcaggcacuccag

SEQ ID NO: 141272 - RNA, 22 nt, Human
ugcugcucaagcugcagcaaaa

SEQ ID NO: 141273 - RNA, 22 nt, Human
ugcgcgccgacggcuccgugac

SEQ ID NO: 141274 - RNA, 22 nt, Human
ugcggaaggcagcgcagggugg

SEQ ID NO: 141275 - RNA, 20 nt, Human
ucgcugcaagggaaauggag

SEQ ID NO: 141276 - RNA, 22 nt, Human
ucgcggccgcuccacaugcaca

SEQ ID NO: 141277 - RNA, 22 nt, Human
ugcggcucaaagggaaggccuu

SEQ ID NO: 141278 - RNA, 23 nt, Human
ucuagcccuaaaaagagagcaga

SEQ ID NO: 141279 - RNA, 22 nt, Human
ucuagagaauuuggaaauuaag

SEQ ID NO: 141280 - RNA, 22 nt, Human
ugcugugcuggcggcagaggcc

SEQ ID NO: 141281 - RNA, 20 nt, Human
ugcuguggguaagcuuuaua

SEQ ID NO: 141282 - RNA, 22 nt, Human
ucuccucuuaaugcacguuucc

SEQ ID NO: 141283 - RNA, 22 nt, Human
ucuccagcugaggccuucuucc

SEQ ID NO: 141284 - RNA, 22 nt, Human
ugcugguuucugaguaaccaca

SEQ ID NO: 141285 - RNA, 18 nt, Human
ucuccgaccccgcggucc

SEQ ID NO: 141286 - RNA, 22 nt, Human
ucuccuaauuacauacuugauu

SEQ ID NO: 141287 - RNA, 20 nt, Human
ugcugggccaucuugcaugc

SEQ ID NO: 141288 - RNA, 22 nt, Human
ugcugggagcugggccucgaca

SEQ ID NO: 141289 - RNA, 22 nt, Human
ugcuggugauuaaauccugaag

SEQ ID NO: 141290 - RNA, 22 nt, Human
ucucagcuggcugggagcccug

SEQ ID NO: 141291 - RNA, 20 nt, Human
ucucauuuugauuucgcauu

SEQ ID NO: 141292 - RNA, 23 nt, Human
ugcuuugauuauuauucccaccu

SEQ ID NO: 141293 - RNA, 22 nt, Human
ucugaaaggagaguagggcaga

SEQ ID NO: 141294 - RNA, 22 nt, Human
ucugaguuaaaauuccagaggu

SEQ ID NO: 141295 - RNA, 22 nt, Human
ucugagucgcucccuggaucca

SEQ ID NO: 141296 - RNA, 22 nt, Human
ucugagcaggaaagagcagaga

SEQ ID NO: 141297 - RNA, 17 nt, Human
ucugaccuuuacuccug

SEQ ID NO: 141298 - RNA, 22 nt, Human
ugcuuguuuuguggcuucagcu

SEQ ID NO: 141299 - RNA, 22 nt, Human
ugcuugugcacacacauguuau

SEQ ID NO: 141300 - RNA, 22 nt, Human
ugcuugacucagcaucggcaau

SEQ ID NO: 141301 - RNA, 20 nt, Human
ucucugccaaccaccuccuc

SEQ ID NO: 141302 - RNA, 22 nt, Human
ucuucaggaaaaccaaaguugu

SEQ ID NO: 141303 - RNA, 20 nt, Human
uggaucgaccucacuuccau

SEQ ID NO: 141304 - RNA, 22 nt, Human
ucuucccgggcaucucugcuca

SEQ ID NO: 141305 - RNA, 22 nt, Human
uggcagugggaagcuggaaguc

SEQ ID NO: 141306 - RNA, 22 nt, Human
ucuucuuacauuaaguugaaac

SEQ ID NO: 141307 - RNA, 22 nt, Human
ucuuccagauacuuccugacuu

SEQ ID NO: 141308 - RNA, 22 nt, Human
uggcagugagauuucucuucug

SEQ ID NO: 141309 - RNA, 22 nt, Human
uggcgugaagcuggaaggcgga

SEQ ID NO: 141310 - RNA, 18 nt, Human
uggcuagaagagcucuca

SEQ ID NO: 141311 - RNA, 22 nt, Human
uggcucaggccuacgacgccuu

SEQ ID NO: 141312 - RNA, 22 nt, Human
uggcggcggggagguaggcaga

SEQ ID NO: 141313 - RNA, 22 nt, Human
uggcgcucacccugcggcccug

SEQ ID NO: 141314 - RNA, 22 nt, Human
uggcgcgcagccugcuggugcu

SEQ ID NO: 141315 - RNA, 22 nt, Human
ucuugcucuguucuaaaggauu

SEQ ID NO: 141316 - RNA, 20 nt, Human
uggcaugaaauuuuccaagc

SEQ ID NO: 141317 - RNA, 22 nt, Human
uggcaucucggugcugguucuu

SEQ ID NO: 141318 - RNA, 22 nt, Human
uggcaguugcaguaacuuguau

SEQ ID NO: 141319 - RNA, 22 nt, Human
ucuucuuauuuuaugaucgcuu

SEQ ID NO: 141320 - RNA, 22 nt, Human
uggccaaauuggccugauguau

SEQ ID NO: 141321 - RNA, 20 nt, Human
uggcccgcgcuccuccugcu

SEQ ID NO: 141322 - RNA, 21 nt, Human
uggcccgagccgggguuggcu

SEQ ID NO: 141323 - RNA, 20 nt, Human
uggccgacccugaggaguug

SEQ ID NO: 141324 - RNA, 17 nt, Human
ucuguguccgcucaguc

SEQ ID NO: 141325 - RNA, 20 nt, Human
ucuguggcagguggcgcuug

SEQ ID NO: 141326 - RNA, 19 nt, Human
ucuguggccuucccugaug

SEQ ID NO: 141327 - RNA, 22 nt, Human
ucuguucacaauuacacacacu

SEQ ID NO: 141328 - RNA, 22 nt, Human
uggauaugaaacaaaacaagag

SEQ ID NO: 141329 - RNA, 20 nt, Human
uggaucaccauccuguugcu

SEQ ID NO: 141330 - RNA, 19 nt, Human
ucuguugcuuuguguccuc

SEQ ID NO: 141331 - RNA, 22 nt, Human
uggaagucuucucucccaugga

SEQ ID NO: 141332 - RNA, 22 nt, Human
ucuggugcacucugauauuuga

SEQ ID NO: 141333 - RNA, 22 nt, Human
uggaagugucagcaggcugguu

SEQ ID NO: 141334 - RNA, 22 nt, Human
ucuggcaguugccgcuucaguc

SEQ ID NO: 141335 - RNA, 22 nt, Human
ucugcgggccuggcucccagcg

SEQ ID NO: 141336 - RNA, 22 nt, Human
ucugaucagaagacaaaugagg

SEQ ID NO: 141337 - RNA, 22 nt, Human
ucugaugaccacaugugggacu

SEQ ID NO: 141338 - RNA, 22 nt, Human
ucugaucuuucauccuaaaugg

SEQ ID NO: 141339 - RNA, 22 nt, Human
ugcaugacugaucuguuuguca

SEQ ID NO: 141340 - RNA, 23 nt, Human
ugcaugagcaucuccaccucagu

SEQ ID NO: 141341 - RNA, 22 nt, Human
ugcaugcagcuggucgggcgcc

SEQ ID NO: 141342 - RNA, 22 nt, Human
ugcaugacaauugccgucaagu

SEQ ID NO: 141343 - RNA, 22 nt, Human
uguggacauuccaaaaggacca

SEQ ID NO: 141344 - RNA, 22 nt, Human
ugcagugcagcuggaaguuggc

SEQ ID NO: 141345 - RNA, 22 nt, Human
ugcagugcagcuggaauaucuu

SEQ ID NO: 141346 - RNA, 22 nt, Human
ugugauugcauugcagauuacu

SEQ ID NO: 141347 - RNA, 22 nt, Human
ugugauugucuucugaaaguca

SEQ ID NO: 141348 - RNA, 22 nt, Human
ugcagcgugaggacagcugagc

SEQ ID NO: 141349 - RNA, 20 nt, Human
ugcagcucccccgcaguuuc

SEQ ID NO: 141350 - RNA, 19 nt, Human
ugcagcuguaugagcuuaa

SEQ ID NO: 141351 - RNA, 18 nt, Human
ugcagcuuugugauuggc

SEQ ID NO: 141352 - RNA, 22 nt, Human
ugcagcuuuugguuucuagaug

SEQ ID NO: 141353 - RNA, 22 nt, Human
ugugcuauuuuugcauaugugu

SEQ ID NO: 141354 - RNA, 22 nt, Human
ugcagcuucucugcaacaggag

SEQ ID NO: 141355 - RNA, 22 nt, Human
uguguggaaaugcuguauaugu

SEQ ID NO: 141356 - RNA, 19 nt, Human
ugccggccgcgggguuccu

SEQ ID NO: 141357 - RNA, 22 nt, Human
ugugucauuugagaggagacga

SEQ ID NO: 141358 - RNA, 22 nt, Human
ugcccugcagacccugcagugu

SEQ ID NO: 141359 - RNA, 22 nt, Human
ugcccagcagggagcuaccugg

SEQ ID NO: 141360 - RNA, 22 nt, Human
uguggccaccagagcugcuauu

SEQ ID NO: 141361 - RNA, 22 nt, Human
ugcauguuuuaagugaagcuga

SEQ ID NO: 141362 - RNA, 22 nt, Human
ugcauguuauuguggcaagaau

SEQ ID NO: 141363 - RNA, 22 nt, Human
ugcauuacuuugauaagcgucu

SEQ ID NO: 141364 - RNA, 22 nt, Human
ugugacaugauggcgucaugua

SEQ ID NO: 141365 - RNA, 22 nt, Human
ugugagucuugcaggucgcuca

SEQ ID NO: 141366 - RNA, 19 nt, Human
ugcagcacuaaaaacuuuc

SEQ ID NO: 141367 - RNA, 19 nt, Human
ugugaagaccucagugcgg

SEQ ID NO: 141368 - RNA, 22 nt, Human
ugucugaauuguaauguugcgu

SEQ ID NO: 141369 - RNA, 21 nt, Human
ugcaaugcauugacagcagca

SEQ ID NO: 141370 - RNA, 22 nt, Human
ugcagacuguuucuugacugaa

SEQ ID NO: 141371 - RNA, 22 nt, Human
ugaugaugccaaaauuuggcau

SEQ ID NO: 141372 - RNA, 22 nt, Human
ugucacagagcgugcaacagaa

SEQ ID NO: 141373 - RNA, 22 nt, Human
ugauuugauuuguuuaugccug

SEQ ID NO: 141374 - RNA, 22 nt, Human
ugcaagugccauggauucaggu

SEQ ID NO: 141375 - RNA, 21 nt, Human
ugucagaaagccugugacuuu

SEQ ID NO: 141376 - RNA, 22 nt, Human
ugucaguuugucaaauacccca

SEQ ID NO: 141377 - RNA, 22 nt, Human
ugaucuuugcuuuuggcuuagu

SEQ ID NO: 141378 - RNA, 19 nt, Human
ugaucuccaguacagacau

SEQ ID NO: 141379 - RNA, 22 nt, Human
ugagguugggaggacugccuaa

SEQ ID NO: 141380 - RNA, 22 nt, Human
ugagucugaagagagaauaagg

SEQ ID NO: 141381 - RNA, 22 nt, Human
ugagcagagcacuugggaacga

SEQ ID NO: 141382 - RNA, 22 nt, Human
ugagccauguucaugagguuca

SEQ ID NO: 141383 - RNA, 22 nt, Human
ugagcagccagucauucaaaaa

SEQ ID NO: 141384 - RNA, 19 nt, Human
ugagauuguaugaggagau

SEQ ID NO: 141385 - RNA, 22 nt, Human
ugguccucacccuacccagcug

SEQ ID NO: 141386 - RNA, 22 nt, Human
uggugcuuuuguggaugcuaac

SEQ ID NO: 141387 - RNA, 22 nt, Human
ugagggaggggaaugugugcag

SEQ ID NO: 141388 - RNA, 22 nt, Human
ugguuagucaugguacugcagc

SEQ ID NO: 141389 - RNA, 22 nt, Human
ugguucuagaugagaugaugag

SEQ ID NO: 141390 - RNA, 22 nt, Human
ugaggaggugcuaccagcgucu

SEQ ID NO: 141391 - RNA, 22 nt, Human
ugguggcaauuuuuggggucaa

SEQ ID NO: 141392 - RNA, 22 nt, Human
ugaggaugaggaagaagaagaa

SEQ ID NO: 141393 - RNA, 22 nt, Human
ugguggccucaguggcuucugu

SEQ ID NO: 141394 - RNA, 22 nt, Human
ugguggcuuuucguagguucac

SEQ ID NO: 141395 - RNA, 22 nt, Human
ugagaacuguuuugguuugggu

SEQ ID NO: 141396 - RNA, 22 nt, Human
ugguaaaugucuaacaaucacu

SEQ ID NO: 141397 - RNA, 22 nt, Human
ugguacaaaaaagauuuuggac

SEQ ID NO: 141398 - RNA, 21 nt, Human
ugguccaaggacucauaccug

SEQ ID NO: 141399 - RNA, 22 nt, Human
ugguccaccgccucauucucug

SEQ ID NO: 141400 - RNA, 22 nt, Human
ugguccaaaccagugcuguggu

SEQ ID NO: 141401 - RNA, 22 nt, Human
ugagacuuggggggcugagggc

SEQ ID NO: 141402 - RNA, 23 nt, Human
ugagacacuggaaggcaagaaaa

SEQ ID NO: 141403 - RNA, 22 nt, Human
ugagaccuaaaccgucuguccu

SEQ ID NO: 141404 - RNA, 22 nt, Human
ugagacagaccuuggaccaugu

SEQ ID NO: 141405 - RNA, 22 nt, Human
uggguuaaaguuugucacugac

SEQ ID NO: 141406 - RNA, 22 nt, Human
uggguguuccuggggugcaagg

SEQ ID NO: 141407 - RNA, 22 nt, Human
ugacucugaugcaguguguuua

SEQ ID NO: 141408 - RNA, 22 nt, Human
ugacguuugcgccgcgcacgac

SEQ ID NO: 141409 - RNA, 22 nt, Human
uggcucaguaaucgagucuccu

SEQ ID NO: 141410 - RNA, 22 nt, Human
ugaaaaaugcuuuaaugcaugu

SEQ ID NO: 141411 - RNA, 22 nt, Human
uggguccaggauucuguguuuc

SEQ ID NO: 141412 - RNA, 21 nt, Human
uggguccuuggucuaguuuuc

SEQ ID NO: 141413 - RNA, 22 nt, Human
uggaaaagaugucuuccugaau

SEQ ID NO: 141414 - RNA, 22 nt, Human
uuacuggaauauaaagauaaga

SEQ ID NO: 141415 - RNA, 22 nt, Human
uuaccuuuucuuguuuacaagu

SEQ ID NO: 141416 - RNA, 22 nt, Human
ugcuuuggcccaacauugaugc

SEQ ID NO: 141417 - RNA, 22 nt, Human
ugcuuucaaaacucagaggaau

SEQ ID NO: 141418 - RNA, 22 nt, Human
uuacuuacagggggucaggcug

SEQ ID NO: 141419 - RNA, 22 nt, Human
uuacuguaggugggugaauuug

SEQ ID NO: 141420 - RNA, 22 nt, Human
uggaaagauuuaaaauaacgag

SEQ ID NO: 141421 - RNA, 22 nt, Human
uggaaaauuuagaaagauuuau

SEQ ID NO: 141422 - RNA, 22 nt, Human
uuagcagacagauggagagaga

SEQ ID NO: 141423 - RNA, 22 nt, Human
uggaacugauuaaaagggcaga

SEQ ID NO: 141424 - RNA, 22 nt, Human
uuagagauuuuauguuaaugua

SEQ ID NO: 141425 - RNA, 22 nt, Human
uuagaguacaggauuguuuuaa

SEQ ID NO: 141426 - RNA, 22 nt, Human
uggacuguucauugauacugga

SEQ ID NO: 141427 - RNA, 22 nt, Human
uggagaugcacgagcaggugga

SEQ ID NO: 141428 - RNA, 21 nt, Human
uggagcagggaggauuugggg

SEQ ID NO: 141429 - RNA, 22 nt, Human
uuaucuguuuuaaugaauaauu

SEQ ID NO: 141430 - RNA, 22 nt, Human
uuauacuucugccagaggacaa

SEQ ID NO: 141431 - RNA, 22 nt, Human
uuauaggugauuaauuuuaacc

SEQ ID NO: 141432 - RNA, 22 nt, Human
uggaaugccgggccaggcuccg

SEQ ID NO: 141433 - RNA, 22 nt, Human
uggaagugggcaucaccaucca

SEQ ID NO: 141434 - RNA, 22 nt, Human
uggaaguggcaggggagacgua

SEQ ID NO: 141435 - RNA, 22 nt, Human
uuagggacagcucuguagguga

SEQ ID NO: 141436 - RNA, 22 nt, Human
uuagccuccaguuuucucauuu

SEQ ID NO: 141437 - RNA, 22 nt, Human
ugcuuagcggugggggcuccau

SEQ ID NO: 141438 - RNA, 22 nt, Human
ugcuucucucuaggaagacgcu

SEQ ID NO: 141439 - RNA, 22 nt, Human
uuaaucagacauucucaaguuu

SEQ ID NO: 141440 - RNA, 22 nt, Human
ugcuguugacuuuguuguucuu

SEQ ID NO: 141441 - RNA, 22 nt, Human
uuaauaaauugugguaccagag

SEQ ID NO: 141442 - RNA, 22 nt, Human
uuaauauuuauugguaaucacu

SEQ ID NO: 141443 - RNA, 22 nt, Human
uuaauauuaagauauugagugg

SEQ ID NO: 141444 - RNA, 22 nt, Human
ugcuuggauuuccaaaugguuu

SEQ ID NO: 141445 - RNA, 22 nt, Human
ugcuuggagaaucagucccagc

SEQ ID NO: 141446 - RNA, 22 nt, Human
ugcuugcuaucuaaguguuuca

SEQ ID NO: 141447 - RNA, 22 nt, Human
ugcuggaguggcacuguguggc

SEQ ID NO: 141448 - RNA, 23 nt, Human
uuaagacuggcugaacuuaguag

SEQ ID NO: 141449 - RNA, 22 nt, Human
ugcugcuguuaucauuuuacca

SEQ ID NO: 141450 - RNA, 22 nt, Human
ugcuggaaggguaguauuaacu

SEQ ID NO: 141451 - RNA, 22 nt, Human
ugcugcuguuuccuacaucuca

SEQ ID NO: 141452 - RNA, 22 nt, Human
ugcugccucccaucccucccga

SEQ ID NO: 141453 - RNA, 22 nt, Human
ugcugcucuucaccauggccuc

SEQ ID NO: 141454 - RNA, 23 nt, Human
ugcugcgggacccgagcgcgcgc

SEQ ID NO: 141455 - RNA, 23 nt, Human
ugcugcuggaguaucuacaaugc

SEQ ID NO: 141456 - RNA, 22 nt, Human
uguuuucaucucucacccagaa

SEQ ID NO: 141457 - RNA, 21 nt, Human
uguuugcuuuuggagcaacug

SEQ ID NO: 141458 - RNA, 22 nt, Human
ugcugcggauauacaggaucug

SEQ ID NO: 141459 - RNA, 22 nt, Human
uguuuagcucugacuaugugau

SEQ ID NO: 141460 - RNA, 22 nt, Human
uguuugagaauuugcugauguu

SEQ ID NO: 141461 - RNA, 22 nt, Human
ugcugaccggccuccccccagc

SEQ ID NO: 141462 - RNA, 22 nt, Human
ugcugcacucacaggaagaguu

SEQ ID NO: 141463 - RNA, 22 nt, Human
ugcucgauuauuucauuuugca

SEQ ID NO: 141464 - RNA, 22 nt, Human
ugcucugguccucccucggcgc

SEQ ID NO: 141465 - RNA, 22 nt, Human
ugcucuguuuuaacucuuucaa

SEQ ID NO: 141466 - RNA, 22 nt, Human
uguuguuguuguuguuguuguu

SEQ ID NO: 141467 - RNA, 22 nt, Human
uguugucaugcagucaguggua

SEQ ID NO: 141468 - RNA, 22 nt, Human
ugccuguguuugggguggggaa

SEQ ID NO: 141469 - RNA, 22 nt, Human
ugccuggugcggagugaguggc

SEQ ID NO: 141470 - RNA, 22 nt, Human
uguguguguguguguaauauau

SEQ ID NO: 141471 - RNA, 23 nt, Human
uguuggcucccagucucccccuc

SEQ ID NO: 141472 - RNA, 21 nt, Human
uguuggccuucauucucuguc

SEQ ID NO: 141473 - RNA, 22 nt, Human
uguuggcagugcuacagucagu

SEQ ID NO: 141474 - RNA, 20 nt, Human
uuccuuaucuguaaagugga

SEQ ID NO: 141475 - RNA, 22 nt, Human
ugggauucugaaaauggauuac

SEQ ID NO: 141476 - RNA, 18 nt, Human
uucgucauggggaucgua

SEQ ID NO: 141477 - RNA, 22 nt, Human
uucgcucuucacacagugcuga

SEQ ID NO: 141478 - RNA, 22 nt, Human
uucggugagcugcgggcgagga

SEQ ID NO: 141479 - RNA, 22 nt, Human
uuccuaagugcugguaugaggc

SEQ ID NO: 141480 - RNA, 22 nt, Human
uggcugggagcuggaacugggc

SEQ ID NO: 141481 - RNA, 22 nt, Human
uggcugaugucuguucuguuau

SEQ ID NO: 141482 - RNA, 22 nt, Human
ugggaaaauagcuauuuugaaa

SEQ ID NO: 141483 - RNA, 22 nt, Human
ugggaaacucuaaacuugagua

SEQ ID NO: 141484 - RNA, 22 nt, Human
uggcugagcugcagcguggcuu

SEQ ID NO: 141485 - RNA, 22 nt, Human
uuccaagcaccaugaaggccuc

SEQ ID NO: 141486 - RNA, 22 nt, Human
uuccaacaugugcuuguguuga

SEQ ID NO: 141487 - RNA, 22 nt, Human
uuccaugccuaagagccugaag

SEQ ID NO: 141488 - RNA, 22 nt, Human
uggagccuugugagaccacaau

SEQ ID NO: 141489 - RNA, 22 nt, Human
uuaugggcgaugcaaaccugau

SEQ ID NO: 141490 - RNA, 22 nt, Human
uuaugucauuugaauuaauuuu

SEQ ID NO: 141491 - RNA, 19 nt, Human
uucugguacauacugccug

SEQ ID NO: 141492 - RNA, 22 nt, Human
uggucaaauccuagauccuuug

SEQ ID NO: 141493 - RNA, 22 nt, Human
uggucacacugcauaacacgca

SEQ ID NO: 141494 - RNA, 22 nt, Human
uucuggagacccagcaacaggg

SEQ ID NO: 141495 - RNA, 22 nt, Human
ugguagcaggugcuaaaggccu

SEQ ID NO: 141496 - RNA, 23 nt, Human
uucugcuucccauagcacuuugu

SEQ ID NO: 141497 - RNA, 22 nt, Human
ugggugccgcaucuugcuguuc

SEQ ID NO: 141498 - RNA, 22 nt, Human
uggguggugaaauggaugggaa

SEQ ID NO: 141499 - RNA, 22 nt, Human
ugggugugcaccuacgaucucu

SEQ ID NO: 141500 - RNA, 22 nt, Human
uucuccucaaaccaucagacau

SEQ ID NO: 141501 - RNA, 20 nt, Human
ugguguccuaugcuugugcu

SEQ ID NO: 141502 - RNA, 22 nt, Human
uucuugcuuccggugcuccagg

SEQ ID NO: 141503 - RNA, 22 nt, Human
ugguuauggaacuggcuauggc

SEQ ID NO: 141504 - RNA, 22 nt, Human
uggucugggaagaucacaauua

SEQ ID NO: 141505 - RNA, 22 nt, Human
uggucggugguguggggaggca

SEQ ID NO: 141506 - RNA, 22 nt, Human
uggucuccucuuaauugccuac

SEQ ID NO: 141507 - RNA, 22 nt, Human
uggugaggacccagauuuuccu

SEQ ID NO: 141508 - RNA, 22 nt, Human
uggugccuuccgagagcuguga

SEQ ID NO: 141509 - RNA, 19 nt, Human
uggugcgcuguuccugagc

SEQ ID NO: 141510 - RNA, 22 nt, Human
uggugcucuugauauauaaggc

SEQ ID NO: 141511 - RNA, 22 nt, Human
uggugcucucgauauauaaggc

SEQ ID NO: 141512 - RNA, 22 nt, Human
ugguugauuaauuuugccaagc

SEQ ID NO: 141513 - RNA, 23 nt, Human
ugguuuucagaagaccuuguuag

SEQ ID NO: 141514 - RNA, 22 nt, Human
ugguuuucuuaauuagcaguca

SEQ ID NO: 141515 - RNA, 22 nt, Human
uguaaucaugguagaggcaaag

SEQ ID NO: 141516 - RNA, 22 nt, Human
uugaagaagucaaaagcugcag

SEQ ID NO: 141517 - RNA, 22 nt, Human
uguagcaauauaucagugcaca

SEQ ID NO: 141518 - RNA, 22 nt, Human
uguagucucagggagcugcuuc

SEQ ID NO: 141519 - RNA, 22 nt, Human
ugucuucauuccccaugaaguc

SEQ ID NO: 141520 - RNA, 22 nt, Human
uugccaggagacaucuggagcc

SEQ ID NO: 141521 - RNA, 21 nt, Human
ugucugcaauuccagggaacc

SEQ ID NO: 141522 - RNA, 22 nt, Human
uugauuccagcguuccaucagc

SEQ ID NO: 141523 - RNA, 22 nt, Human
ugucucuagggcagauagagug

SEQ ID NO: 141524 - RNA, 22 nt, Human
uugaugacuaaagaaagcugcu

SEQ ID NO: 141525 - RNA, 22 nt, Human
ugucagccacggugugaccggc

SEQ ID NO: 141526 - RNA, 22 nt, Human
ugucagacagggcugcagucag

SEQ ID NO: 141527 - RNA, 22 nt, Human
ugucacaccuggcgauaauggg

SEQ ID NO: 141528 - RNA, 22 nt, Human
uugacacauggcuucaauugca

SEQ ID NO: 141529 - RNA, 22 nt, Human
uguaguguuuagucuagugucg

SEQ ID NO: 141530 - RNA, 22 nt, Human
uugaaucauauguaauugacuu

SEQ ID NO: 141531 - RNA, 23 nt, Human
uguauacacccugugcaucuggg

SEQ ID NO: 141532 - RNA, 22 nt, Human
uuguguugaagugguuagggcg

SEQ ID NO: 141533 - RNA, 22 nt, Human
uuguuuaaagaacuucugacuu

SEQ ID NO: 141534 - RNA, 22 nt, Human
uuguuguuguuguuauuuaguu

SEQ ID NO: 141535 - RNA, 22 nt, Human
uuaaugcauguaaaugugcaaa

SEQ ID NO: 141536 - RNA, 22 nt, Human
uuaaucuauuucauauaaggga

SEQ ID NO: 141537 - RNA, 22 nt, Human
uuagaugugaucagcuggcuua

SEQ ID NO: 141538 - RNA, 22 nt, Human
uuuaguugcuuuaguugagcug

SEQ ID NO: 141539 - RNA, 22 nt, Human
uuagucauucccucuugauauu

SEQ ID NO: 141540 - RNA, 22 nt, Human
uuagauaaaucagcccugagua

SEQ ID NO: 141541 - RNA, 22 nt, Human
uuuagagauaaaugcucuccca

SEQ ID NO: 141542 - RNA, 22 nt, Human
uuacaacgcacacagauuucac

SEQ ID NO: 141543 - RNA, 22 nt, Human
uuaauugggugcuuuguaaaua

SEQ ID NO: 141544 - RNA, 22 nt, Human
uuuaauauuacacuuaccuugu

SEQ ID NO: 141545 - RNA, 22 nt, Human
uugugccuuaauauaggcgcug

SEQ ID NO: 141546 - RNA, 22 nt, Human
uuaaaagaauccuguuauccuc

SEQ ID NO: 141547 - RNA, 22 nt, Human
uuguggcaggauggacagcaga

SEQ ID NO: 141548 - RNA, 22 nt, Human
uugucuguacuggcugcaucga

SEQ ID NO: 141549 - RNA, 22 nt, Human
uugucaguggccugaggacaga

SEQ ID NO: 141550 - RNA, 21 nt, Human
uuguccacacacaccaacugc

SEQ ID NO: 141551 - RNA, 22 nt, Human
uguuuguuuuguauuuuuaauu

SEQ ID NO: 141552 - RNA, 22 nt, Human
uugucaugauccuucuguuagg

SEQ ID NO: 141553 - RNA, 22 nt, Human
uugguauucaguuggauuugga

SEQ ID NO: 141554 - RNA, 22 nt, Human
uugguugcugaugagcuuugag

SEQ ID NO: 141555 - RNA, 19 nt, Human
uugguuuguugcuuaggug

SEQ ID NO: 141556 - RNA, 19 nt, Human
uguugugggccacuaacua

SEQ ID NO: 141557 - RNA, 22 nt, Human
uguuguucuuuuucuucuuguu

SEQ ID NO: 141558 - RNA, 22 nt, Human
uuguauguuucugugcacauga

SEQ ID NO: 141559 - RNA, 22 nt, Human
uuggccaaaaaagucauuagaa

SEQ ID NO: 141560 - RNA, 22 nt, Human
uguguuuuucauuuuaaguccu

SEQ ID NO: 141561 - RNA, 22 nt, Human
uuggcacagagcugcagccugg

SEQ ID NO: 141562 - RNA, 22 nt, Human
uguucggaaaagggcaagcuau

SEQ ID NO: 141563 - RNA, 22 nt, Human
uuggggagaagagcuggucagg

SEQ ID NO: 141564 - RNA, 22 nt, Human
uuggccaaggaccuuuuuggag

SEQ ID NO: 141565 - RNA, 22 nt, Human
uguuccacgcguaguuccugcu

SEQ ID NO: 141566 - RNA, 23 nt, Human
uguuccugaugccucguccuguc

SEQ ID NO: 141567 - RNA, 22 nt, Human
uugcggaucuucauggccucag

SEQ ID NO: 141568 - RNA, 22 nt, Human
uugcuaagguuuaacuauugga

SEQ ID NO: 141569 - RNA, 22 nt, Human
ugugucucucuuagguugucug

SEQ ID NO: 141570 - RNA, 22 nt, Human
uucgcggccaggcggggaggcc

SEQ ID NO: 141571 - RNA, 21 nt, Human
uucgaaugggucguugcugcc

SEQ ID NO: 141572 - RNA, 22 nt, Human
uuuuaaaguaauugaagcuugu

SEQ ID NO: 141573 - RNA, 22 nt, Human
uuccuguggggugucaucauag

SEQ ID NO: 141574 - RNA, 22 nt, Human
uuuguuugcuaguauuuuguuu

SEQ ID NO: 141575 - RNA, 22 nt, Human
uuccaaggagagcucgaccuca

SEQ ID NO: 141576 - RNA, 20 nt, Human
uuugugaggccagagaacag

SEQ ID NO: 141577 - RNA, 20 nt, Human
uucaugcagugguugcugug

SEQ ID NO: 141578 - RNA, 18 nt, Human
uuccauuuuucagucuuc

SEQ ID NO: 141579 - RNA, 22 nt, Human
uuuguguuacaguccuagaacu

SEQ ID NO: 141580 - RNA, 23 nt, Human
uuuguugguuuaagaguagcaga

SEQ ID NO: 141581 - RNA, 19 nt, Human
uuuguuguaucagagcuuu

SEQ ID NO: 141582 - RNA, 22 nt, Human
uuuguuguauuaacccagggua

SEQ ID NO: 141583 - RNA, 22 nt, Human
uucccggccgccccccgcucgg

SEQ ID NO: 141584 - RNA, 20 nt, Human
uucaggaccuuccaguccau

SEQ ID NO: 141585 - RNA, 22 nt, Human
uucauaugaauuggguuuuuuu

SEQ ID NO: 141586 - RNA, 22 nt, Human
uucaggucauuuuuagcccuag

SEQ ID NO: 141587 - RNA, 22 nt, Human
uuugcugggaagccuucacucu

SEQ ID NO: 141588 - RNA, 23 nt, Human
uucagcucuccugaagcaucugu

SEQ ID NO: 141589 - RNA, 22 nt, Human
uucagcacuggacagcgagucu

SEQ ID NO: 141590 - RNA, 22 nt, Human
uucagcaagugucucuacuguc

SEQ ID NO: 141591 - RNA, 21 nt, Human
uucaaguucacacucaaaggu

SEQ ID NO: 141592 - RNA, 22 nt, Human
uuaguuaauaaauauugagugu

SEQ ID NO: 141593 - RNA, 22 nt, Human
uuagugaagaagcaucuuuagu

SEQ ID NO: 141594 - RNA, 22 nt, Human
uuagugucugacgcaggcgcca

SEQ ID NO: 141595 - RNA, 22 nt, Human
uucacagugguaaggguuguga

SEQ ID NO: 141596 - RNA, 22 nt, Human
uugaccagaaaaguuaguaauu

SEQ ID NO: 141597 - RNA, 22 nt, Human
uugacguccucgauggggaacu

SEQ ID NO: 141598 - RNA, 22 nt, Human
uugagaugacuuaaaucacugu

SEQ ID NO: 141599 - RNA, 22 nt, Human
uugagcagccauuagcuggggu

SEQ ID NO: 141600 - RNA, 22 nt, Human
uugaugacauuuagcauaauug

SEQ ID NO: 141601 - RNA, 20 nt, Human
uugagccucauggauugucu

SEQ ID NO: 141602 - RNA, 22 nt, Human
uugaauuuagguuuaugugaaa

SEQ ID NO: 141603 - RNA, 22 nt, Human
uuuuucuuugguaacucuuccu

SEQ ID NO: 141604 - RNA, 22 nt, Human
uuuuugcccuaaagaagucauu

SEQ ID NO: 141605 - RNA, 22 nt, Human
uuuugguaguccagaguuuagu

SEQ ID NO: 141606 - RNA, 22 nt, Human
uucuugcuucucugucugccuc

SEQ ID NO: 141607 - RNA, 22 nt, Human
uucuguuuuuauucuaucucug

SEQ ID NO: 141608 - RNA, 22 nt, Human
uuuugguuugaguauuuuuuuu

SEQ ID NO: 141609 - RNA, 22 nt, Human
uuuucugauccuucuaacuuga

SEQ ID NO: 141610 - RNA, 22 nt, Human
uuuucucuuugcuucucuaaaa

SEQ ID NO: 141611 - RNA, 22 nt, Human
uucuggaguuugaagaucaggu

SEQ ID NO: 141612 - RNA, 22 nt, Human
uuuucggggcgacuuagguucu

SEQ ID NO: 141613 - RNA, 22 nt, Human
uucugagccacaguaaggaucu

SEQ ID NO: 141614 - RNA, 23 nt, Human
uuuuccaaaucgacucucuaguu

SEQ ID NO: 141615 - RNA, 22 nt, Human
uuuucauagccagaaacugaaa

SEQ ID NO: 141616 - RNA, 22 nt, Human
uucgucaauaugcagccuguga

SEQ ID NO: 141617 - RNA, 22 nt, Human
uucgucauuaugcagccuguga

SEQ ID NO: 141618 - RNA, 22 nt, Human
uuuuagccagaguuuaucacag

SEQ ID NO: 141619 - RNA, 22 nt, Human
uuuuagagacagcauggagaaa

SEQ ID NO: 141620 - RNA, 22 nt, Human
uugugcucaguuguggucuauu

SEQ ID NO: 141621 - RNA, 23 nt, Human
uugugcggugcuuuggguuuaca

SEQ ID NO: 141622 - RNA, 22 nt, Human
uugugcacauuucauugaccug

SEQ ID NO: 141623 - RNA, 22 nt, Human
uugucagcuagugaugcuguuc

SEQ ID NO: 141624 - RNA, 22 nt, Human
uuggggaugccccuacgggcua

SEQ ID NO: 141625 - RNA, 22 nt, Human
uugguuuuuugguguaucuuau

SEQ ID NO: 141626 - RNA, 22 nt, Human
uuguaauaguguuuuacguugu

SEQ ID NO: 141627 - RNA, 22 nt, Human
uugguuuuauucguauuuguau

SEQ ID NO: 141628 - RNA, 22 nt, Human
uugggauuggugggguggguuu

SEQ ID NO: 141629 - RNA, 21 nt, Human
uuggcuacugcuucagaggga

SEQ ID NO: 141630 - RNA, 22 nt, Human
uugauggaggaaaaguuggaau

SEQ ID NO: 141631 - RNA, 23 nt, Human
uugaucuggaaaauacuuguuug

SEQ ID NO: 141632 - RNA, 22 nt, Human
uugauuggguauaaugacagga

SEQ ID NO: 141633 - RNA, 22 nt, Human
uugauuuccauuguccagcauu

SEQ ID NO: 141634 - RNA, 22 nt, Human
uugauuugcagaagguguagag

SEQ ID NO: 141635 - RNA, 22 nt, Human
uuggauugugaaaguauucucu

SEQ ID NO: 141636 - RNA, 22 nt, Human
uuuauuuuccaugucucuaggu

SEQ ID NO: 141637 - RNA, 22 nt, Human
uuuauucacuuaucaggaacga

SEQ ID NO: 141638 - RNA, 22 nt, Human
uuuagugagugugaaucaaaug

SEQ ID NO: 141639 - RNA, 22 nt, Human
uuuauaagccagacacugcguu

SEQ ID NO: 141640 - RNA, 22 nt, Human
uuuagaugcuguauguuauuuc

SEQ ID NO: 141641 - RNA, 22 nt, Human
uuuaggugucugcucauugaag

SEQ ID NO: 141642 - RNA, 22 nt, Human
uuuagugaagcuuugcauuuca

SEQ ID NO: 141643 - RNA, 20 nt, Human
uuguuagguucaguguuucc

SEQ ID NO: 141644 - RNA, 22 nt, Human
uuuaccugucuguagaacauaa

SEQ ID NO: 141645 - RNA, 22 nt, Human
uuugggcauuuuuaaggaucuu

SEQ ID NO: 141646 - RNA, 22 nt, Human
uuugagaagauaggggaauacu

SEQ ID NO: 141647 - RNA, 22 nt, Human
uuugaagauaaauauggagaaa

SEQ ID NO: 141648 - RNA, 22 nt, Human
uuugaagaccuuaucucuaaau

SEQ ID NO: 141649 - RNA, 22 nt, Human
uuugcuguaaugcaugucagag

SEQ ID NO: 141650 - RNA, 22 nt, Human
uuugcugaaaaaccacuugagu

SEQ ID NO: 141651 - RNA, 22 nt, Human
uuugccggaucugucuccagcu

SEQ ID NO: 141652 - RNA, 19 nt, Human
uuugccugugguucagaag

SEQ ID NO: 141653 - RNA, 22 nt, Human
uuucugggggucgugcuggcug

SEQ ID NO: 141654 - RNA, 22 nt, Human
uuucgggauuucaaagagcaaa

SEQ ID NO: 141655 - RNA, 22 nt, Human
uuucgcuuguucggagugcuuu

SEQ ID NO: 141656 - RNA, 22 nt, Human
uuuccuguccugguacuuggca

SEQ ID NO: 141657 - RNA, 22 nt, Human
uuucuauauucaguuucauaaa

SEQ ID NO: 141658 - RNA, 22 nt, Human
uuucguugcacucauaugguug

SEQ ID NO: 141659 - RNA, 21 nt, Human
uuuccagaggcagccggacuc

SEQ ID NO: 141660 - RNA, 16 nt, Human
uuucacucuagaggua

SEQ ID NO: 141661 - RNA, 22 nt, Human
uuucagguggaaguuuuagaug

SEQ ID NO: 141662 - RNA, 22 nt, Human
uguuggaaucuucuagucuucc

SEQ ID NO: 141663 - RNA, 23 nt, Human
aaaguacuuaaucugcaaaccac

SEQ ID NO: 141664 - RNA, 22 nt, Human
gaaaauaguucaucacaaugau

SEQ ID NO: 141665 - RNA, 22 nt, Human
aagaugcaagcauuuugaacug

SEQ ID NO: 141666 - RNA, 22 nt, Human
gugaaauuguacacucaguacc

SEQ ID NO: 141667 - RNA, 22 nt, Human
aagagaaagggaaaaugguaaa

SEQ ID NO: 141668 - RNA, 22 nt, Human
uuuuuauguaaaauauuaaaag

SEQ ID NO: 141669 - RNA, 22 nt, Human
aacauuuccggccuuuuguucu

SEQ ID NO: 141670 - RNA, 22 nt, Human
agcaagggucucucauggcuug

SEQ ID NO: 141671 - RNA, 22 nt, Human
augugaaagagguguucagugg

SEQ ID NO: 141672 - RNA, 22 nt, Human
uacaaaauucaaauaauguuug

SEQ ID NO: 141673 - RNA, 22 nt, Human
agaaaaggaagcuuagacugua

SEQ ID NO: 141674 - RNA, 22 nt, Human
uugaaaaaaucugaggaggacc

SEQ ID NO: 141675 - RNA, 22 nt, Human
uuuuaaaguaauugaagcuugu

SEQ ID NO: 141676 - RNA, 22 nt, Human
ggcugggaggcggaggcugaga

SEQ ID NO: 141677 - RNA, 18 nt, Human
aaacccacguauucaggc

SEQ ID NO: 141678 - RNA, 22 nt, Human
aaauguauuagccuaugugaga

SEQ ID NO: 141679 - RNA, 22 nt, Human
acuaauuuacagaaauuucuua

SEQ ID NO: 141680 - RNA, 22 nt, Human
ugucuuuagagugaacagaaga

SEQ ID NO: 141681 - RNA, 22 nt, Human
caggaacagcaccaggagcuag

SEQ ID NO: 141682 - RNA, 22 nt, Human
uuuaauuauaucugggcaguua

SEQ ID NO: 141683 - RNA, 22 nt, Human
aguauuuucuuuaguuuguuag

SEQ ID NO: 141684 - RNA, 20 nt, Human
gauuuaacgcugcgucuguc

SEQ ID NO: 141685 - RNA, 22 nt, Human
aggcuuagaugaguucccacau

SEQ ID NO: 141686 - RNA, 22 nt, Human
uucuuugcccauguuuccuaag

SEQ ID NO: 141687 - RNA, 18 nt, Human
acaaaaauagugcuuugg

SEQ ID NO: 141688 - RNA, 22 nt, Human
cucuuucauucuguccuuguuu

SEQ ID NO: 141689 - RNA, 22 nt, Human
ugcccacuuugucuccaugcug

SEQ ID NO: 141690 - RNA, 22 nt, Human
aagccugguuauuugaggaugu

SEQ ID NO: 141691 - RNA, 22 nt, Human
cugaaagacgaggggaagucgg

SEQ ID NO: 141692 - RNA, 22 nt, Human
aggggaggcugcgggcugccgu

SEQ ID NO: 141693 - RNA, 22 nt, Human
aaagaugaaguucagcgaagaa

SEQ ID NO: 141694 - RNA, 22 nt, Human
ucagucacugucucagacagga

SEQ ID NO: 141695 - RNA, 22 nt, Human
aaggaugguaacaguuucauuu

SEQ ID NO: 141696 - RNA, 22 nt, Human
uuuuucugacugcuaacaaaaa

SEQ ID NO: 141697 - RNA, 22 nt, Human
ugugucucucuuagguugucug

SEQ ID NO: 141698 - RNA, 22 nt, Human
gaggacccuuaggucagacaga

SEQ ID NO: 141699 - RNA, 22 nt, Human
cauugcuguuaauugucucuag

SEQ ID NO: 141700 - RNA, 22 nt, Human
uggugcucucgauauauaaggc

SEQ ID NO: 141701 - RNA, 22 nt, Human
guggagaaauauguucagcuuc

SEQ ID NO: 141702 - RNA, 22 nt, Human
uugaguuuacauuguauuagcc

SEQ ID NO: 141703 - RNA, 22 nt, Human
auauaaugcaguaggugauuaa

SEQ ID NO: 141704 - RNA, 22 nt, Human
cugccuggggaaugugaggauu

SEQ ID NO: 141705 - RNA, 19 nt, Human
uuuaaugugugcugcaauc

SEQ ID NO: 141706 - RNA, 22 nt, Human
uaaacugacagugagggagagu

SEQ ID NO: 141707 - RNA, 22 nt, Human
cuggaaaaauggauccugucuu

SEQ ID NO: 141708 - RNA, 22 nt, Human
augcagauguagauucugaaau

SEQ ID NO: 141709 - RNA, 22 nt, Human
agggaaauaggagaagaaagga

SEQ ID NO: 141710 - RNA, 22 nt, Human
guuuaaguuaaaauuuaccugc

SEQ ID NO: 141711 - RNA, 22 nt, Human
gaaagugaauguaacauguuau

SEQ ID NO: 141712 - RNA, 22 nt, Human
augugcauguauguaucauauu

SEQ ID NO: 141713 - RNA, 22 nt, Human
uauuguauuagcucuuggagau

SEQ ID NO: 141714 - RNA, 22 nt, Human
ucugaccccccuugccuccacu

SEQ ID NO: 141715 - RNA, 22 nt, Human
uuuucauagccagaaacugaaa

SEQ ID NO: 141716 - RNA, 22 nt, Human
aguauccauccugcuguuucua

SEQ ID NO: 141717 - RNA, 22 nt, Human
agacuucucuuggcuauauuau

SEQ ID NO: 141718 - RNA, 17 nt, Human
uagccagcuugugauuu

SEQ ID NO: 141719 - RNA, 22 nt, Human
cuuuuucuuaucuuuuucuaug

SEQ ID NO: 141720 - RNA, 22 nt, Human
caagcacaauuucuacauguua

SEQ ID NO: 141721 - RNA, 22 nt, Human
gauacugugggcacucauaaua

SEQ ID NO: 141722 - RNA, 22 nt, Human
ucaguuuaauuggaucuuuuuc

SEQ ID NO: 141723 - RNA, 22 nt, Human
cacagucugagcccagccuugu

SEQ ID NO: 141724 - RNA, 22 nt, Human
uuuugaugaccauucuucuuuu

SEQ ID NO: 141725 - RNA, 22 nt, Human
guggagaaagcuggaaucugag

SEQ ID NO: 141726 - RNA, 22 nt, Human
uguguuuuucauuuuaaguccu

SEQ ID NO: 141727 - RNA, 22 nt, Human
uggucuccucuuaauugccuac

SEQ ID NO: 141728 - RNA, 22 nt, Human
ggaggaggggcggggaggggag

SEQ ID NO: 141729 - RNA, 22 nt, Human
aagugcuggccuacucaaucga

SEQ ID NO: 141730 - RNA, 22 nt, Human
aggacacuuccugaguggacaa

SEQ ID NO: 141731 - RNA, 22 nt, Human
gacuggcucuaucaggauaaau

SEQ ID NO: 141732 - RNA, 22 nt, Human
gcagauaguaggagcuaaucuu

SEQ ID NO: 141733 - RNA, 22 nt, Human
aauguguauguguauauauaug

SEQ ID NO: 141734 - RNA, 22 nt, Human
uuuuauuuguauguugaaugua

SEQ ID NO: 141735 - RNA, 22 nt, Human
cuguccccauugcugucccugg

SEQ ID NO: 141736 - RNA, 22 nt, Human
cacuauguacauaauagcugcu

SEQ ID NO: 141737 - RNA, 22 nt, Human
uucuuuuaauagagauccugug

SEQ ID NO: 141738 - RNA, 23 nt, Human
aagaaugcuucugaagagcugcc

SEQ ID NO: 141739 - RNA, 22 nt, Human
cuucuuuucuacuggccuagaa

SEQ ID NO: 141740 - RNA, 22 nt, Human
cucuaagcuuugguguuucacu

SEQ ID NO: 141741 - RNA, 22 nt, Human
acaucuaugucugaggccuugg

SEQ ID NO: 141742 - RNA, 22 nt, Human
uuauuuaaguauuuauugaagu

SEQ ID NO: 141743 - RNA, 22 nt, Human
cuaaauguuuuaucuuccuggc

SEQ ID NO: 141744 - RNA, 22 nt, Human
uuugcauuaguuuagauuucaa

SEQ ID NO: 141745 - RNA, 22 nt, Human
gcagaugagagugugaucuggg

SEQ ID NO: 141746 - RNA, 19 nt, Human
cugggacaaugaaagcauc

SEQ ID NO: 141747 - RNA, 22 nt, Human
ggagguguguucuguuuuagug

SEQ ID NO: 141748 - RNA, 22 nt, Human
uuugauuuuuugagcaguguau

SEQ ID NO: 141749 - RNA, 22 nt, Human
augagugugugguucuaaauga

SEQ ID NO: 141750 - RNA, 22 nt, Human
auuaaauagcagaagaaagaug

SEQ ID NO: 141751 - RNA, 21 nt, Human
agucaagcugccugcuuggca

SEQ ID NO: 141752 - RNA, 22 nt, Human
cuaaaacuuuuccaaauuaugu

SEQ ID NO: 141753 - RNA, 22 nt, Human
ucucuucacuuguaugcuauca

SEQ ID NO: 141754 - RNA, 22 nt, Human
ugcaugaucucacuuacaggug

SEQ ID NO: 141755 - RNA, 23 nt, Human
gcccagaggccccuggccugagc

SEQ ID NO: 141756 - RNA, 22 nt, Human
uccucagcaaacacuucacucu

SEQ ID NO: 141757 - RNA, 22 nt, Human
caucugcagccucugcauuccc

SEQ ID NO: 141758 - RNA, 23 nt, Human
aaugugaaauugaguuuuuguua

SEQ ID NO: 141759 - RNA, 22 nt, Human
ucacuucuaugaucugucucuu

SEQ ID NO: 141760 - RNA, 22 nt, Human
agccaugcuguuuugccuggga

SEQ ID NO: 141761 - RNA, 21 nt, Human
ggcugcucgugaugaacuuca

SEQ ID NO: 141762 - RNA, 21 nt, Human
ucuguuguguguugaggacuu

SEQ ID NO: 141763 - RNA, 22 nt, Human
uucaguaugcugaaugauuuuu

SEQ ID NO: 141764 - RNA, 22 nt, Human
gcuguguucauccugcccaggu

SEQ ID NO: 141765 - RNA, 22 nt, Human
auauaaugugugcuuuauugaa

SEQ ID NO: 141766 - RNA, 22 nt, Human
auugcaggucguguggaaguga

SEQ ID NO: 141767 - RNA, 22 nt, Human
aagaaaagguaaccgcuuaucu

SEQ ID NO: 141768 - RNA, 22 nt, Human
aaaugcacaauaaaguaaaggc

SEQ ID NO: 141769 - RNA, 22 nt, Human
cuccacagccccuccaguggca

SEQ ID NO: 141770 - RNA, 22 nt, Human
cucuuuucaaaccuguuuaugg

SEQ ID NO: 141771 - RNA, 22 nt, Human
ugaguuuuggaagauguuacag

SEQ ID NO: 141772 - RNA, 22 nt, Human
cagaucacauccauccgucacc

SEQ ID NO: 141773 - RNA, 22 nt, Human
ggagagaacguaaucuaguauu

SEQ ID NO: 141774 - RNA, 22 nt, Human
cuggagaagagguaguauguag

SEQ ID NO: 141775 - RNA, 22 nt, Human
ggaggaugaggguggugguguu

SEQ ID NO: 141776 - RNA, 22 nt, Human
gcaggggguaaggggcagggcu

SEQ ID NO: 141777 - RNA, 22 nt, Human
gucugaggagaggcagcauaac

SEQ ID NO: 141778 - RNA, 22 nt, Human
uuuacaaggcaguuauuuuccu

SEQ ID NO: 141779 - RNA, 22 nt, Human
ggcugguggcgggcagcacaga

SEQ ID NO: 141780 - RNA, 22 nt, Human
gauaagugauucugauucacau

SEQ ID NO: 141781 - RNA, 22 nt, Human
uguaauuugguuagauuucuuu

SEQ ID NO: 141782 - RNA, 22 nt, Human
auuuucauauggguuauuugua

SEQ ID NO: 141783 - RNA, 22 nt, Human
uauuaaaagagaaaaagccacc

SEQ ID NO: 141784 - RNA, 22 nt, Human
ccugcccaucccaccccagcau

SEQ ID NO: 141785 - RNA, 18 nt, Human
uuuuuuguucuguuuugu

SEQ ID NO: 141786 - RNA, 22 nt, Human
caaaggaaagagaaaaagucuu

SEQ ID NO: 141787 - RNA, 22 nt, Human
cagagcugucauuugccaguga

SEQ ID NO: 141788 - RNA, 22 nt, Human
gcccagccucagggcaucagcu

SEQ ID NO: 141789 - RNA, 20 nt, Human
ggacccuggguucuucugag

SEQ ID NO: 141790 - RNA, 22 nt, Human
gcauuuuaauuggggcaguuag

SEQ ID NO: 141791 - RNA, 22 nt, Human
aauguucucuaaucuuucucuu

SEQ ID NO: 141792 - RNA, 22 nt, Human
aaaguuacccaaucucuaugaa

SEQ ID NO: 141793 - RNA, 22 nt, Human
gacagugucccucuggggugga

SEQ ID NO: 141794 - RNA, 22 nt, Human
ugguggccucaguggcuucugu

SEQ ID NO: 141795 - RNA, 22 nt, Human
cagccccagcacuuagcugagu

SEQ ID NO: 141796 - RNA, 22 nt, Human
uauuuuauuuagguuuaguugu

SEQ ID NO: 141797 - RNA, 22 nt, Human
cuucuuaaaguugucacagcug

SEQ ID NO: 141798 - RNA, 22 nt, Human
gcuguggaaaaugggucuccaa

SEQ ID NO: 141799 - RNA, 22 nt, Human
ccugggcauaaaucacuccaag

SEQ ID NO: 141800 - RNA, 22 nt, Human
aaggaaaaccugacugaagaac

SEQ ID NO: 141801 - RNA, 22 nt, Human
ugaguacauuugauuaucagag

SEQ ID NO: 141802 - RNA, 22 nt, Human
ucacuguaggaaucucuaaauu

SEQ ID NO: 141803 - RNA, 22 nt, Human
agaugggacauuugucccuagg

SEQ ID NO: 141804 - RNA, 22 nt, Human
cuccagcagaaagggcgagugg

SEQ ID NO: 141805 - RNA, 22 nt, Human
caaaacauucagagagcucacu

SEQ ID NO: 141806 - RNA, 22 nt, Human
auaguaaauguuaacagcaaca

SEQ ID NO: 141807 - RNA, 22 nt, Human
aauguauuuuuaggcagaauau

SEQ ID NO: 141808 - RNA, 22 nt, Human
ugcuuuuguaucagaguauuca

SEQ ID NO: 141809 - RNA, 22 nt, Human
cugagguccucagagggaaagg

SEQ ID NO: 141810 - RNA, 22 nt, Human
gauaaauaguguuuggggacau

SEQ ID NO: 141811 - RNA, 22 nt, Human
ucccugccuuauuuucauaugc

SEQ ID NO: 141812 - RNA, 22 nt, Human
uggucugggaagaucacaauua

SEQ ID NO: 141813 - RNA, 22 nt, Human
uuuacuuuugguaaggucauuu

SEQ ID NO: 141814 - RNA, 22 nt, Human
cagaccuggaaaacaggcuugc

SEQ ID NO: 141815 - RNA, 22 nt, Human
uuugaagaccuuaucucuaaau

SEQ ID NO: 141816 - RNA, 22 nt, Human
auuagaagagcuuuuuacucuu

SEQ ID NO: 141817 - RNA, 20 nt, Human
ucaguuucccuauuagguug

SEQ ID NO: 141818 - RNA, 22 nt, Human
aguugugagaaugaacacugaa

SEQ ID NO: 141819 - RNA, 22 nt, Human
uuguccacuaagaaagugcccu

SEQ ID NO: 141820 - RNA, 22 nt, Human
gcugucccccaaagaugcuccu

SEQ ID NO: 141821 - RNA, 22 nt, Human
uuuuauguuccugaagcuaucu

SEQ ID NO: 141822 - RNA, 22 nt, Human
ggcugagguguggggaacuaua

SEQ ID NO: 141823 - RNA, 22 nt, Human
ugaguuucuuacucaggagcug

SEQ ID NO: 141824 - RNA, 22 nt, Human
uuuuuauaagauuuaaaaugua

SEQ ID NO: 141825 - RNA, 22 nt, Human
aguaagaaagaaugauaggccu

SEQ ID NO: 141826 - RNA, 22 nt, Human
acaguuuuccuugguauagaac

SEQ ID NO: 141827 - RNA, 22 nt, Human
cccccucuggcuccagucugac

SEQ ID NO: 141828 - RNA, 22 nt, Human
aguauuuuaaaauacauuaucc

SEQ ID NO: 141829 - RNA, 22 nt, Human
aauagcaauuacccuucaacuc

SEQ ID NO: 141830 - RNA, 22 nt, Human
ggcugcagggaacaggaugggu

SEQ ID NO: 141831 - RNA, 22 nt, Human
guuaauaugcaaaacggaugcg

SEQ ID NO: 141832 - RNA, 22 nt, Human
auugugaaugccugucagucuu

SEQ ID NO: 141833 - RNA, 22 nt, Human
ccucaggaauuuauucuucugu

SEQ ID NO: 141834 - RNA, 22 nt, Human
aauggcaauagugcauuaugua

SEQ ID NO: 141835 - RNA, 22 nt, Human
uccacagugguggaauuguuca

SEQ ID NO: 141836 - RNA, 22 nt, Human
aaaacauuuuacugccaucuca

SEQ ID NO: 141837 - RNA, 22 nt, Human
auuuuguugaaacccuuguugu

SEQ ID NO: 141838 - RNA, 23 nt, Human
ucucccagaaguucucggggacu

SEQ ID NO: 141839 - RNA, 22 nt, Human
aaugaaugaaugaaugauuaug

SEQ ID NO: 141840 - RNA, 22 nt, Human
auuuaaaaacugguacaacagg

SEQ ID NO: 141841 - RNA, 22 nt, Human
gcagguuguuuaaauuaggauu

SEQ ID NO: 141842 - RNA, 22 nt, Human
gaaaagaaaggaugguaugugu

SEQ ID NO: 141843 - RNA, 22 nt, Human
ugaaaaauauuuuuagaaauaa

SEQ ID NO: 141844 - RNA, 22 nt, Human
gaaaaagucuuaaaguaaggca

SEQ ID NO: 141845 - RNA, 22 nt, Human
agcaaaauuccaaaaugcuaau

SEQ ID NO: 141846 - RNA, 22 nt, Human
cacaaggagaaauagauauuga

SEQ ID NO: 141847 - RNA, 22 nt, Human
aaaauauaaaggauguggguuu

SEQ ID NO: 141848 - RNA, 19 nt, Human
agcugcugauugguggagg

SEQ ID NO: 141849 - RNA, 22 nt, Human
uauguacauauauguguauaua

SEQ ID NO: 141850 - RNA, 22 nt, Human
agcugcugcaaguggugcuaac

SEQ ID NO: 141851 - RNA, 22 nt, Human
auacauauaugcacauuaauau

SEQ ID NO: 141852 - RNA, 20 nt, Human
caugaugcaaacaguaacgu

SEQ ID NO: 141853 - RNA, 22 nt, Human
ggcagagguagcuggaaccagg

SEQ ID NO: 141854 - RNA, 22 nt, Human
agugccuggcugauggguccug

SEQ ID NO: 141855 - RNA, 22 nt, Human
uuuuaaauaaacuacacugauu

SEQ ID NO: 141856 - RNA, 22 nt, Human
ugcauugccucuauucauuaua

SEQ ID NO: 141857 - RNA, 22 nt, Human
ugcaggaacucgaaaacuauag

SEQ ID NO: 141858 - RNA, 22 nt, Human
uugaacaguuuugucagguuca

SEQ ID NO: 141859 - RNA, 22 nt, Human
guugguggaggcgagagaagaa

SEQ ID NO: 141860 - RNA, 22 nt, Human
auauauacuuugacacauucug

SEQ ID NO: 141861 - RNA, 22 nt, Human
ugcuuuccuucccuauguugag

SEQ ID NO: 141862 - RNA, 22 nt, Human
uauauacuugaaaauugcugag

SEQ ID NO: 141863 - RNA, 22 nt, Human
uuggaguucuucaugcucugua

SEQ ID NO: 141864 - RNA, 22 nt, Human
ucuucacagaugcauauacuuc

SEQ ID NO: 141865 - RNA, 22 nt, Human
aaauggaaguuuguucucagcc

SEQ ID NO: 141866 - RNA, 22 nt, Human
uagucuuuguggucuuuagcua

SEQ ID NO: 141867 - RNA, 22 nt, Human
agugucugcgggcagaggagcg

SEQ ID NO: 141868 - RNA, 20 nt, Human
uggaucaccauccuguugcu

SEQ ID NO: 141869 - RNA, 22 nt, Human
aaucccaguugacagaacuguu

SEQ ID NO: 141870 - RNA, 22 nt, Human
gcauaauauugagaaauuauua

SEQ ID NO: 141871 - RNA, 22 nt, Human
auuguuuugugaaacauaguga

SEQ ID NO: 141872 - RNA, 22 nt, Human
agagauacugcaggccauaaau

SEQ ID NO: 141873 - RNA, 16 nt, Human
acauggcacacaguuu

SEQ ID NO: 141874 - RNA, 22 nt, Human
uaauuucauuuugcaaugaucu

SEQ ID NO: 141875 - RNA, 22 nt, Human
aucaaaauuuucagauacuaca

SEQ ID NO: 141876 - RNA, 22 nt, Human
gaauggcagaaugaagcagugu

SEQ ID NO: 141877 - RNA, 22 nt, Human
caaggggagcugguauggaugg

SEQ ID NO: 141878 - RNA, 22 nt, Human
agacacugacaggguccaugga

SEQ ID NO: 141879 - RNA, 22 nt, Human
gugcucaagacauuaggaauau

SEQ ID NO: 141880 - RNA, 22 nt, Human
uggcugagcugcagcguggcuu

SEQ ID NO: 141881 - RNA, 22 nt, Human
auguuuaauuugaaauuuuauu

SEQ ID NO: 141882 - RNA, 22 nt, Human
ggggaaggaaggggagggcacg

SEQ ID NO: 141883 - RNA, 22 nt, Human
gcaggaaugguacauaccuguu

SEQ ID NO: 141884 - RNA, 22 nt, Human
uguugaaacagcuauugacuuu

SEQ ID NO: 141885 - RNA, 22 nt, Human
cuugcuuuaucugguuucucau

SEQ ID NO: 141886 - RNA, 22 nt, Human
agcggaggaggcggagcaggga

SEQ ID NO: 141887 - RNA, 22 nt, Human
ugccuguguauuuccggccugc

SEQ ID NO: 141888 - RNA, 22 nt, Human
uauauaauacacaaauauguac

SEQ ID NO: 141889 - RNA, 22 nt, Human
accuuaagugauuaugacauau

SEQ ID NO: 141890 - RNA, 19 nt, Human
gaguaaaacuagagagaaa

SEQ ID NO: 141891 - RNA, 22 nt, Human
ugcugccucccaucccucccga

SEQ ID NO: 141892 - RNA, 22 nt, Human
ucagugauccagauauuugagc

SEQ ID NO: 141893 - RNA, 22 nt, Human
uuuauaauuguuauguuaccca

SEQ ID NO: 141894 - RNA, 22 nt, Human
acuuuaaaucuguugcuuagcu

SEQ ID NO: 141895 - RNA, 22 nt, Human
uccucagcaagacgcuggcagc

SEQ ID NO: 141896 - RNA, 20 nt, Human
gagaaugucauuccuuuuuu

SEQ ID NO: 141897 - RNA, 21 nt, Human
ucagccuguccaguguuaacc

SEQ ID NO: 141898 - RNA, 20 nt, Human
ucucugccaaccaccuccuc

SEQ ID NO: 141899 - RNA, 22 nt, Human
uggugcucuugauauauaaggc

SEQ ID NO: 141900 - RNA, 22 nt, Human
uauuuaaagucagcaacuuuuc

SEQ ID NO: 141901 - RNA, 22 nt, Human
uaguauuguguuguuugacagu

SEQ ID NO: 141902 - RNA, 22 nt, Human
gugguggugaggcaaggggugu

SEQ ID NO: 141903 - RNA, 22 nt, Human
aaggugcugaggguccuggcuu

SEQ ID NO: 141904 - RNA, 22 nt, Human
aggggaggcugggcuggggggc

SEQ ID NO: 141905 - RNA, 22 nt, Human
ggaauaauauuacagauacagu

SEQ ID NO: 141906 - RNA, 22 nt, Human
uuucucuuguauuugaaucacu

SEQ ID NO: 141907 - RNA, 22 nt, Human
uuucuauauucaguuucauaaa

SEQ ID NO: 141908 - RNA, 22 nt, Human
gauacuuuguggaauccuggau

SEQ ID NO: 141909 - RNA, 22 nt, Human
cacauuaagcccaagcauagaa

SEQ ID NO: 141910 - RNA, 22 nt, Human
uucuccccacuccucccucuga

SEQ ID NO: 141911 - RNA, 22 nt, Human
cccuguccugcuaggcccuggu

SEQ ID NO: 141912 - RNA, 22 nt, Human
ugcauuuucuaccacacccacu

SEQ ID NO: 141913 - RNA, 22 nt, Human
uuugaauauacuucaaacaaag

SEQ ID NO: 141914 - RNA, 22 nt, Human
uaaaaugcucagauaaauauau

SEQ ID NO: 141915 - RNA, 22 nt, Human
ugaauuuuaacauucugcugga

SEQ ID NO: 141916 - RNA, 22 nt, Human
aggccugaggaccagauaaaug

SEQ ID NO: 141917 - RNA, 22 nt, Human
cucccaucacaauucagggccu

SEQ ID NO: 141918 - RNA, 22 nt, Human
gcuggucuggcaauccucaugg

SEQ ID NO: 141919 - RNA, 22 nt, Human
ugccugucuaucuuugucaucu

SEQ ID NO: 141920 - RNA, 22 nt, Human
auucucauguuaccaaauucua

SEQ ID NO: 141921 - RNA, 22 nt, Human
aaacgcaauuucuugcauguca

SEQ ID NO: 141922 - RNA, 22 nt, Human
augaaaacgugugugugugugu

SEQ ID NO: 141923 - RNA, 22 nt, Human
ggaaggugagugcugugugauu

SEQ ID NO: 141924 - RNA, 22 nt, Human
acugcaggucccaucaccugcg

SEQ ID NO: 141925 - RNA, 22 nt, Human
uguauuuuuucccugaaauaaa

SEQ ID NO: 141926 - RNA, 22 nt, Human
acugcucugugguuggaagccu

SEQ ID NO: 141927 - RNA, 22 nt, Human
gauuuuaaaagauguauaaggu

SEQ ID NO: 141928 - RNA, 21 nt, Human
cuggcucgccaugguucuuuu

SEQ ID NO: 141929 - RNA, 21 nt, Human
ucucauuuuaacacagaguug

SEQ ID NO: 141930 - RNA, 22 nt, Human
aggaaaauggaccagaguuguu

SEQ ID NO: 141931 - RNA, 22 nt, Human
agccacagucuguagccagcuu

SEQ ID NO: 141932 - RNA, 22 nt, Human
ccugcucuaauucauucaugcu

SEQ ID NO: 141933 - RNA, 22 nt, Human
ugguuauauaaggauuaaauac

SEQ ID NO: 141934 - RNA, 22 nt, Human
accugcagguguuuccacacuu

SEQ ID NO: 141935 - RNA, 22 nt, Human
auuguauugcguuugcgaaugu

SEQ ID NO: 141936 - RNA, 19 nt, Human
uuuguuguaucagagcuuu

SEQ ID NO: 141937 - RNA, 22 nt, Human
aguucauaucuacuuuuccauc

SEQ ID NO: 141938 - RNA, 22 nt, Human
ucuccuaauuacauacuugauu

SEQ ID NO: 141939 - RNA, 22 nt, Human
ucccacugucuucucgugcucg

SEQ ID NO: 141940 - RNA, 22 nt, Human
cagaguaaugugauuuccaugu

SEQ ID NO: 141941 - RNA, 22 nt, Human
guaagguuggaugcaaucaacu

SEQ ID NO: 141942 - RNA, 22 nt, Human
ugauuugaaaccuuuggcaaga

SEQ ID NO: 141943 - RNA, 22 nt, Human
gcaacuccuaggcgaggccuuc

SEQ ID NO: 141944 - RNA, 22 nt, Human
uuucaagccucacugcguuuug

SEQ ID NO: 141945 - RNA, 22 nt, Human
ccuguguucguccucaccuugc

SEQ ID NO: 141946 - RNA, 22 nt, Human
caacaaguugauuucacgcugc

SEQ ID NO: 141947 - RNA, 22 nt, Human
uacuuuaauugcaaaaauaaau

SEQ ID NO: 141948 - RNA, 22 nt, Human
agccuucccuuucaacaauuug

SEQ ID NO: 141949 - RNA, 22 nt, Human
gcccuggagauggaaguucuga

SEQ ID NO: 141950 - RNA, 22 nt, Human
gauagaaagagaaucagaacuu

SEQ ID NO: 141951 - RNA, 22 nt, Human
uaaauguugcuugugcugcuca

SEQ ID NO: 141952 - RNA, 22 nt, Human
uuuaguauaguaugugcucaaa

SEQ ID NO: 141953 - RNA, 22 nt, Human
gaaguggggaggagaagacuga

SEQ ID NO: 141954 - RNA, 22 nt, Human
caucaauagguauuugagagac

SEQ ID NO: 141955 - RNA, 22 nt, Human
cauuuuaucagcacacgucacu

SEQ ID NO: 141956 - RNA, 22 nt, Human
uuuuccuucuuccugccuugcc

SEQ ID NO: 141957 - RNA, 22 nt, Human
uucaucuucaaaccccagugcc

SEQ ID NO: 141958 - RNA, 22 nt, Human
aucuucucucucaucaggauca

SEQ ID NO: 141959 - RNA, 22 nt, Human
gggguugauaauuagagaaaug

SEQ ID NO: 141960 - RNA, 22 nt, Human
uugcugccagcgcccugcaggg

SEQ ID NO: 141961 - RNA, 22 nt, Human
uuucagagaaagcccaaagacu

SEQ ID NO: 141962 - RNA, 22 nt, Human
auguaaugucaaucuucagugg

SEQ ID NO: 141963 - RNA, 19 nt, Human
uccaaaauacuuguuacug

SEQ ID NO: 141964 - RNA, 22 nt, Human
gaauggaacauagcaacaucuu

SEQ ID NO: 141965 - RNA, 20 nt, Human
gcauggcuggcugcugucug

SEQ ID NO: 141966 - RNA, 22 nt, Human
auuuucuugucucuguuguagg

SEQ ID NO: 141967 - RNA, 22 nt, Human
aucuuugccuuuaugccucuag

SEQ ID NO: 141968 - RNA, 22 nt, Human
cuguuuuugccugugacaaaaa

SEQ ID NO: 141969 - RNA, 22 nt, Human
uuuaaaauguuuuauuuauuua

SEQ ID NO: 141970 - RNA, 22 nt, Human
aaauauauauaauauauauauu

SEQ ID NO: 141971 - RNA, 22 nt, Human
cuuacauuuguuuaguguuucc

SEQ ID NO: 141972 - RNA, 21 nt, Human
agaugaggauacugaggccua

SEQ ID NO: 141973 - RNA, 22 nt, Human
guauauuuaugagcauuagccu

SEQ ID NO: 141974 - RNA, 22 nt, Human
caggguaguaauuuaauacaag

SEQ ID NO: 141975 - RNA, 19 nt, Human
augaaauagcauuuucuga

SEQ ID NO: 141976 - RNA, 22 nt, Human
caguacugucuuccugauggca

SEQ ID NO: 141977 - RNA, 22 nt, Human
ucgagaccagcuagaaggaagu

SEQ ID NO: 141978 - RNA, 22 nt, Human
cccagccugaucucggccagcu

SEQ ID NO: 141979 - RNA, 22 nt, Human
gagaggaagugccugcucccag

SEQ ID NO: 141980 - RNA, 22 nt, Human
gcccugccauugaucggcccag

SEQ ID NO: 141981 - RNA, 22 nt, Human
ugacuuuucuccucugaaguuu

SEQ ID NO: 141982 - RNA, 23 nt, Human
ggaggcccagaggucggccccac

SEQ ID NO: 141983 - RNA, 22 nt, Human
augcaguuagguaauagucuca

SEQ ID NO: 141984 - RNA, 22 nt, Human
aaaauacuaggaaaauaaauca

SEQ ID NO: 141985 - RNA, 22 nt, Human
agagggagagauuggcaaucag

SEQ ID NO: 141986 - RNA, 22 nt, Human
uuagaauggaaucauuugcauu

SEQ ID NO: 141987 - RNA, 22 nt, Human
uaaaugagcaccucuaguuuug

SEQ ID NO: 141988 - RNA, 22 nt, Human
cacccccaggcuccccuucugg

SEQ ID NO: 141989 - RNA, 22 nt, Human
ucccagccugacagugcaucaa

SEQ ID NO: 141990 - RNA, 22 nt, Human
agaguucuauccagacucaugu

SEQ ID NO: 141991 - RNA, 22 nt, Human
ccagccuucugaugggacccuc

SEQ ID NO: 141992 - RNA, 22 nt, Human
caggggcuuuccuguuuaugga

SEQ ID NO: 141993 - RNA, 22 nt, Human
uaaagugaaguucagaauggcu

SEQ ID NO: 141994 - RNA, 22 nt, Human
ugccuuuuguguuuggcuaauc

SEQ ID NO: 141995 - RNA, 22 nt, Human
auguuagcaucuggcacuaugg

SEQ ID NO: 141996 - RNA, 22 nt, Human
cauccagcuccugggggccacc

SEQ ID NO: 141997 - RNA, 22 nt, Human
acauuuugggagaaaguuguua

SEQ ID NO: 141998 - RNA, 22 nt, Human
ggaaaaauggguggugauauga

SEQ ID NO: 141999 - RNA, 22 nt, Human
cuguguuguuugaguagcuuga

SEQ ID NO: 142000 - RNA, 22 nt, Human
cugcagauguagcugcuuuccu

SEQ ID NO: 142001 - RNA, 20 nt, Human
aagacacuguccccacugga

SEQ ID NO: 142002 - RNA, 22 nt, Human
aauuucuuucagcugcuuuaag

SEQ ID NO: 142003 - RNA, 18 nt, Human
uuccauuuuucagucuuc

SEQ ID NO: 142004 - RNA, 22 nt, Human
uaagauuuuuacaaauagagug

SEQ ID NO: 142005 - RNA, 22 nt, Human
aggcugaagcacacucaugcag

SEQ ID NO: 142006 - RNA, 22 nt, Human
uuucugugguggguaguucaga

SEQ ID NO: 142007 - RNA, 22 nt, Human
ccagugcuuccaggaauacggu

SEQ ID NO: 142008 - RNA, 22 nt, Human
uauuuuuaccuaauuuaugaga

SEQ ID NO: 142009 - RNA, 22 nt, Human
ucagucuucaggacuaugaaaa

SEQ ID NO: 142010 - RNA, 22 nt, Human
cagcacuuccuccgugagcccc

SEQ ID NO: 142011 - RNA, 22 nt, Human
ucccucuccugucugcuucuuu

SEQ ID NO: 142012 - RNA, 22 nt, Human
ugcccugcagacccugcagugu

SEQ ID NO: 142013 - RNA, 20 nt, Human
ggccugagcauggcuggcag

SEQ ID NO: 142014 - RNA, 22 nt, Human
caaaucagaucagagacaggcu

SEQ ID NO: 142015 - RNA, 22 nt, Human
uaugaauauaccacaauuuagg

SEQ ID NO: 142016 - RNA, 22 nt, Human
agguccugucuuaucucuguaa

SEQ ID NO: 142017 - RNA, 22 nt, Human
auaaaguaaugcauauaaugug

SEQ ID NO: 142018 - RNA, 22 nt, Human
uuguguuuaaucuguuccacua

SEQ ID NO: 142019 - RNA, 22 nt, Human
gaugucccuggaggggacagga

SEQ ID NO: 142020 - RNA, 22 nt, Human
uuggaaaagaaauacucauaua

SEQ ID NO: 142021 - RNA, 22 nt, Human
ugcuugaacccaggaaguggag

SEQ ID NO: 142022 - RNA, 22 nt, Human
ccaccccagaaagggaaggcca

SEQ ID NO: 142023 - RNA, 22 nt, Human
auuuaagacuguggugcaguuu

SEQ ID NO: 142024 - RNA, 20 nt, Human
gcagcugacccuagugcuug

SEQ ID NO: 142025 - RNA, 22 nt, Human
uccaaggacuaaauucuagauu

SEQ ID NO: 142026 - RNA, 22 nt, Human
ugagccugaguguguauugaac

SEQ ID NO: 142027 - RNA, 22 nt, Human
guggcagagagcaagugucuga

SEQ ID NO: 142028 - RNA, 22 nt, Human
ugcuucuuuaggauguaguuau

SEQ ID NO: 142029 - RNA, 22 nt, Human
ucuauauucuauguucuucuuu

SEQ ID NO: 142030 - RNA, 22 nt, Human
uuucacauacaguguauaguag

SEQ ID NO: 142031 - RNA, 22 nt, Human
gcugcaggaggugguagggucu

SEQ ID NO: 142032 - RNA, 22 nt, Human
uauaaugucuuuguugaaaucu

SEQ ID NO: 142033 - RNA, 22 nt, Human
uucuuuuaauuucugucugcag

SEQ ID NO: 142034 - RNA, 22 nt, Human
uguuugagaauuugcugauguu

SEQ ID NO: 142035 - RNA, 22 nt, Human
guaggaaaugaauaagguaccu

SEQ ID NO: 142036 - RNA, 21 nt, Human
gaaaaucuaaugugacaaugc

SEQ ID NO: 142037 - RNA, 22 nt, Human
ucaguagcauuuaauguucagu

SEQ ID NO: 142038 - RNA, 22 nt, Human
agugugaguuacaaagugugaa

SEQ ID NO: 142039 - RNA, 22 nt, Human
caggaacucggagcccaucucu

SEQ ID NO: 142040 - RNA, 20 nt, Human
agaaaggaguaaagaagaga

SEQ ID NO: 142041 - RNA, 22 nt, Human
ugcgccccgcgggccuucgggc

SEQ ID NO: 142042 - RNA, 22 nt, Human
uucugaaacauugcuauuuucc

SEQ ID NO: 142043 - RNA, 22 nt, Human
uguuuuguuuagguuuguuuuu

SEQ ID NO: 142044 - RNA, 22 nt, Human
uggcucaguaaucgagucuccu

SEQ ID NO: 142045 - RNA, 22 nt, Human
auagcaguauuaugagauaacu

SEQ ID NO: 142046 - RNA, 22 nt, Human
uggcaaacacaauauggguaca

SEQ ID NO: 142047 - RNA, 22 nt, Human
ucacaggagucaaggaauagua

SEQ ID NO: 142048 - RNA, 22 nt, Human
ucauuuaauuuggaacucagag

SEQ ID NO: 142049 - RNA, 22 nt, Human
ucccugccuccuggcagugcca

SEQ ID NO: 142050 - RNA, 22 nt, Human
cuggaugucugggaggcuuccc

SEQ ID NO: 142051 - RNA, 22 nt, Human
gaaucucuuugucccugaguuu

SEQ ID NO: 142052 - RNA, 22 nt, Human
augugaaauuugggcucuggga

SEQ ID NO: 142053 - RNA, 22 nt, Human
uuuuuuuagaaagaucauaguu

SEQ ID NO: 142054 - RNA, 22 nt, Human
uuugcuuugacuuugggaguau

SEQ ID NO: 142055 - RNA, 22 nt, Human
uuuuagagacagcauggagaaa

SEQ ID NO: 142056 - RNA, 22 nt, Human
ggcccuggggcaggagcagagg

SEQ ID NO: 142057 - RNA, 22 nt, Human
uuaaguccuugguaauuuucuu

SEQ ID NO: 142058 - RNA, 22 nt, Human
auauauguauauacacauauau

SEQ ID NO: 142059 - RNA, 22 nt, Human
guccucugggagccuugagccu

SEQ ID NO: 142060 - RNA, 22 nt, Human
ugcagagagccagcucucucgg

SEQ ID NO: 142061 - RNA, 22 nt, Human
aagaggaauaauaaaaauugca

SEQ ID NO: 142062 - RNA, 22 nt, Human
ugagaaaacaguuuguaauaau

SEQ ID NO: 142063 - RNA, 22 nt, Human
aggaagaagggacagaauuuug

SEQ ID NO: 142064 - RNA, 22 nt, Human
cagguuguucugggcauggagg

SEQ ID NO: 142065 - RNA, 22 nt, Human
agcucugcuucuugggaagaug

SEQ ID NO: 142066 - RNA, 22 nt, Human
aauauuuaccuaccugucaucu

SEQ ID NO: 142067 - RNA, 22 nt, Human
uugcaugauuuaagaauaucug

SEQ ID NO: 142068 - RNA, 22 nt, Human
cauuuagagaagauuacaagga

SEQ ID NO: 142069 - RNA, 22 nt, Human
gugugcacaaucuggcaugugc

SEQ ID NO: 142070 - RNA, 22 nt, Human
uuuaugucaaaaguaaaaugaa

SEQ ID NO: 142071 - RNA, 22 nt, Human
uacauagaauauauaaaugucg

SEQ ID NO: 142072 - RNA, 22 nt, Human
guaaauaucucacgaaugauuc

SEQ ID NO: 142073 - RNA, 22 nt, Human
cucaucuucuuccuucuuuucc

SEQ ID NO: 142074 - RNA, 22 nt, Human
aagaacaacugcuuuaaaagca

SEQ ID NO: 142075 - RNA, 22 nt, Human
uaauauaacugccaguuaaggu

SEQ ID NO: 142076 - RNA, 20 nt, Human
cuuauuuuggagaacuuuuc

SEQ ID NO: 142077 - RNA, 22 nt, Human
aaacugcuuucucugccuuucc

SEQ ID NO: 142078 - RNA, 22 nt, Human
acuauuguccgauuucuuuacu

SEQ ID NO: 142079 - RNA, 22 nt, Human
ggcuggagcaggcugcacagug

SEQ ID NO: 142080 - RNA, 22 nt, Human
uuuagguuguguucuggcaugu

SEQ ID NO: 142081 - RNA, 22 nt, Human
agguuuggaaguggcgauccau

SEQ ID NO: 142082 - RNA, 22 nt, Human
uuguuuuaaaaagaauaacuac

SEQ ID NO: 142083 - RNA, 22 nt, Human
aaauuuauaacuuaaagugaau

SEQ ID NO: 142084 - RNA, 22 nt, Human
ucagauagcaagggauaccugu

SEQ ID NO: 142085 - RNA, 23 nt, Human
ugcugcuggaguaucuacaaugc

SEQ ID NO: 142086 - RNA, 22 nt, Human
ucauuagucuuuaauacauaau

SEQ ID NO: 142087 - RNA, 22 nt, Human
guugggcugaagugugugcuua

SEQ ID NO: 142088 - RNA, 22 nt, Human
aagucuuugagaucggacauag

SEQ ID NO: 142089 - RNA, 22 nt, Human
uaaaaauuagauauguauuuag

SEQ ID NO: 142090 - RNA, 22 nt, Human
aauacagcacucacaccucccu

SEQ ID NO: 142091 - RNA, 22 nt, Human
uuaauauuuauugguaaucacu

SEQ ID NO: 142092 - RNA, 22 nt, Human
guagaaaauagauugucucuug

SEQ ID NO: 142093 - RNA, 22 nt, Human
gcucaaggucacacagggguga

SEQ ID NO: 142094 - RNA, 22 nt, Human
uuaugccuguuaggcagcaucu

SEQ ID NO: 142095 - RNA, 22 nt, Human
gggcugagagcuggaaucugag

SEQ ID NO: 142096 - RNA, 22 nt, Human
uuagucauucccucuugauauu

SEQ ID NO: 142097 - RNA, 22 nt, Human
aacaaagaaaagcuugagguuu

SEQ ID NO: 142098 - RNA, 23 nt, Human
uguaaaacaccguuauugcaccu

SEQ ID NO: 142099 - RNA, 22 nt, Human
cuggccagccucccagguaccc

SEQ ID NO: 142100 - RNA, 22 nt, Human
uagcauaaaguuucuguguggu

SEQ ID NO: 142101 - RNA, 21 nt, Human
aaguuucucccuaauuguugc

SEQ ID NO: 142102 - RNA, 22 nt, Human
gagugggugaaugugcucauaa

SEQ ID NO: 142103 - RNA, 22 nt, Human
uuauuucauguaaaauuuaugu

SEQ ID NO: 142104 - RNA, 22 nt, Human
cuaauaauuuacugagugcuac

SEQ ID NO: 142105 - RNA, 22 nt, Human
aaugcagaugugucuuuaauuu

SEQ ID NO: 142106 - RNA, 23 nt, Human
ucugccuccuaauuguugguguc

SEQ ID NO: 142107 - RNA, 22 nt, Human
gacaacuucaguaaaguagauu

SEQ ID NO: 142108 - RNA, 22 nt, Human
ucaucuuuauaaugcaaguuuu

SEQ ID NO: 142109 - RNA, 22 nt, Human
cagcuggggagagacauggcag

SEQ ID NO: 142110 - RNA, 22 nt, Human
auguuguuuauggguuaucaag

SEQ ID NO: 142111 - RNA, 22 nt, Human
uauuuugaggugaaagaguuug

SEQ ID NO: 142112 - RNA, 22 nt, Human
cuucauccguaccacggccaca

SEQ ID NO: 142113 - RNA, 23 nt, Human
uaaauuuuauucugauaacacag

SEQ ID NO: 142114 - RNA, 22 nt, Human
ucugacuucuuuuauuaucauu

SEQ ID NO: 142115 - RNA, 22 nt, Human
uggacagguacuucacauuauu

SEQ ID NO: 142116 - RNA, 23 nt, Human
ccuagcuuacugucaggugucuu

SEQ ID NO: 142117 - RNA, 22 nt, Human
ugggcagagggugaggaaggcg

SEQ ID NO: 142118 - RNA, 18 nt, Human
gacaaaaguacagacaga

SEQ ID NO: 142119 - RNA, 21 nt, Human
gcuucaauucauccaccucuc

SEQ ID NO: 142120 - RNA, 22 nt, Human
auuugaaaaucuaugaugugca

SEQ ID NO: 142121 - RNA, 22 nt, Human
aaacccaggguuuugucuuccc

SEQ ID NO: 142122 - RNA, 20 nt, Human
aagugcuguuagcugccuga

SEQ ID NO: 142123 - RNA, 22 nt, Human
uuuuaaguauuuucuuuuuuua

SEQ ID NO: 142124 - RNA, 22 nt, Human
ugcuuaaccagccccuucccuu

SEQ ID NO: 142125 - RNA, 19 nt, Human
ugcaagcuuuuucuuguua

SEQ ID NO: 142126 - RNA, 22 nt, Human
uuaaaauuguuaacuuugguga

SEQ ID NO: 142127 - RNA, 22 nt, Human
cuucacaaaauauuucauuaua

SEQ ID NO: 142128 - RNA, 22 nt, Human
caaauacaaauacgggcagcuu

SEQ ID NO: 142129 - RNA, 22 nt, Human
uuccucauuuggcacaucugag

SEQ ID NO: 142130 - RNA, 19 nt, Human
auucuucucuuccugcugu

SEQ ID NO: 142131 - RNA, 22 nt, Human
caaaaaauccauagaaagaggu

SEQ ID NO: 142132 - RNA, 22 nt, Human
auucuuuauuuucuguacuugc

SEQ ID NO: 142133 - RNA, 22 nt, Human
aauuugcuccaaugucaguucu

SEQ ID NO: 142134 - RNA, 18 nt, Human
uguugguguucacucacu

SEQ ID NO: 142135 - RNA, 22 nt, Human
acauaaauagcacugugaauuu

SEQ ID NO: 142136 - RNA, 22 nt, Human
augggucccuggccgcccucgg

SEQ ID NO: 142137 - RNA, 22 nt, Human
gauuaaaggucuugauuauaag

SEQ ID NO: 142138 - RNA, 21 nt, Human
aauuauuugcauuuuucuugu

SEQ ID NO: 142139 - RNA, 21 nt, Human
uccugcagggcagcagagugg

SEQ ID NO: 142140 - RNA, 22 nt, Human
uuuaaauuucugaaucuugagg

SEQ ID NO: 142141 - RNA, 22 nt, Human
gauggcaaugcuagaaauuuag

SEQ ID NO: 142142 - RNA, 22 nt, Human
aggcccugcugaggccucccuc

SEQ ID NO: 142143 - RNA, 22 nt, Human
agaugaugugugucuucagcua

SEQ ID NO: 142144 - RNA, 22 nt, Human
uggucucaaagcaaggaaggaa

SEQ ID NO: 142145 - RNA, 22 nt, Human
uagaaugggaggggaaucaucc

SEQ ID NO: 142146 - RNA, 22 nt, Human
accuugggcccagaccggcacg

SEQ ID NO: 142147 - RNA, 22 nt, Human
gugucccaaagauuagaaauca

SEQ ID NO: 142148 - RNA, 22 nt, Human
aauucuuuguuccucugccaag

SEQ ID NO: 142149 - RNA, 22 nt, Human
aucauguauaugcagcguuugu

SEQ ID NO: 142150 - RNA, 22 nt, Human
uuucuauuuacagugcuaggua

SEQ ID NO: 142151 - RNA, 22 nt, Human
gaggcaggaagggaggguugug

SEQ ID NO: 142152 - RNA, 22 nt, Human
uaaaaucaugacagauugacau

SEQ ID NO: 142153 - RNA, 22 nt, Human
aaaucuuucacauauuuuuuau

SEQ ID NO: 142154 - RNA, 22 nt, Human
guaaauacuaugagauaaugaa

SEQ ID NO: 142155 - RNA, 22 nt, Human
aucuggaacuucucugcauuga

SEQ ID NO: 142156 - RNA, 22 nt, Human
gagggagagaugcuggaccggg

SEQ ID NO: 142157 - RNA, 22 nt, Human
uuuuugaauaagugcaucauca

SEQ ID NO: 142158 - RNA, 17 nt, Human
aguuacugcacuugcca

SEQ ID NO: 142159 - RNA, 22 nt, Human
auggucugcucagucucuugac

SEQ ID NO: 142160 - RNA, 22 nt, Human
cagagcugagucuucaagguug

SEQ ID NO: 142161 - RNA, 19 nt, Human
auacacguguauacauaca

SEQ ID NO: 142162 - RNA, 22 nt, Human
uccuccauguugugcacuugaa

SEQ ID NO: 142163 - RNA, 21 nt, Human
aaguuuuggcuguacaguugu

SEQ ID NO: 142164 - RNA, 22 nt, Human
uuuccccugggaacauugauuc

SEQ ID NO: 142165 - RNA, 22 nt, Human
aauaauuuuuuugugauuaugu

SEQ ID NO: 142166 - RNA, 22 nt, Human
augcaugaucccgguaugugaa

SEQ ID NO: 142167 - RNA, 22 nt, Human
gagucuuuuaagaugucuuacu

SEQ ID NO: 142168 - RNA, 22 nt, Human
cauauacauauacaugcauaca

SEQ ID NO: 142169 - RNA, 22 nt, Human
cucucuccuuagcugcagacca

SEQ ID NO: 142170 - RNA, 23 nt, Human
auaugucaugcaccagcacuuua

SEQ ID NO: 142171 - RNA, 22 nt, Human
uccuucagaggacggcagccag

SEQ ID NO: 142172 - RNA, 22 nt, Human
cgaaaaagaagugcaccauguu

SEQ ID NO: 142173 - RNA, 22 nt, Human
auguuuucuugucuggagaagu

SEQ ID NO: 142174 - RNA, 22 nt, Human
uaauugaacguucauuuuuaau

SEQ ID NO: 142175 - RNA, 23 nt, Human
cagagaaaauagaauaugcugug

SEQ ID NO: 142176 - RNA, 22 nt, Human
ggagacagugacuuagagacug

SEQ ID NO: 142177 - RNA, 22 nt, Human
uggucucuacggaggaaagcug

SEQ ID NO: 142178 - RNA, 22 nt, Human
aucuuugauuuuggcuuuuagg

SEQ ID NO: 142179 - RNA, 22 nt, Human
cucagaauugucaccucaaaaa

SEQ ID NO: 142180 - RNA, 22 nt, Human
ugaagcuaguauuaacucagau

SEQ ID NO: 142181 - RNA, 22 nt, Human
cuucucuuccuucucauccuca

SEQ ID NO: 142182 - RNA, 22 nt, Human
cugugucucccaaggaggguca

SEQ ID NO: 142183 - RNA, 22 nt, Human
cccagaggcugaguugggagca

SEQ ID NO: 142184 - RNA, 22 nt, Human
aauauauaugggugcaugucug

SEQ ID NO: 142185 - RNA, 22 nt, Human
ugucuuucuuucucuugacaga

SEQ ID NO: 142186 - RNA, 22 nt, Human
ccugacucugauuucgcugcau

SEQ ID NO: 142187 - RNA, 22 nt, Human
ugaccucaagcaugcggagggc

SEQ ID NO: 142188 - RNA, 22 nt, Human
acacaacuuuauuaauuuauac

SEQ ID NO: 142189 - RNA, 19 nt, Human
auuuccuggcauauaucac

SEQ ID NO: 142190 - RNA, 22 nt, Human
uuguuauuauuauuuucguucu

SEQ ID NO: 142191 - RNA, 22 nt, Human
guuuugaugugauuucucaugu

SEQ ID NO: 142192 - RNA, 22 nt, Human
aucauuugaacagaauuuguuu

SEQ ID NO: 142193 - RNA, 22 nt, Human
guacauauccuuuacguuuugu

SEQ ID NO: 142194 - RNA, 22 nt, Human
cagaaaacauuguguguauaag

SEQ ID NO: 142195 - RNA, 22 nt, Human
ggugugaauagagccuggagca

SEQ ID NO: 142196 - RNA, 22 nt, Human
uucuggagucuauuuugaaaag

SEQ ID NO: 142197 - RNA, 22 nt, Human
aucacugcaggcauauaggggu

SEQ ID NO: 142198 - RNA, 22 nt, Human
uaaaaguuagcuaggacaaagu

SEQ ID NO: 142199 - RNA, 19 nt, Human
aacaaaauaguucuaguua

SEQ ID NO: 142200 - RNA, 22 nt, Human
cgcugcugucaucgucuacggu

SEQ ID NO: 142201 - RNA, 22 nt, Human
aaauucuuccaggaggaaauac

SEQ ID NO: 142202 - RNA, 22 nt, Human
cuucauuucaggcugaagaaua

SEQ ID NO: 142203 - RNA, 22 nt, Human
uggagagauagucauucuagag

SEQ ID NO: 142204 - RNA, 22 nt, Human
agugaaaacugaaucaccuucc

SEQ ID NO: 142205 - RNA, 22 nt, Human
gucacaaaugauuuagcaauca

SEQ ID NO: 142206 - RNA, 22 nt, Human
uaaaugauaguauugaagguag

SEQ ID NO: 142207 - RNA, 22 nt, Human
uaggcagauuccauauuuuggc

SEQ ID NO: 142208 - RNA, 22 nt, Human
ggugauaaaaagcauuuaaauu

SEQ ID NO: 142209 - RNA, 22 nt, Human
uuuuaaauggcuuuuacuuuuc

SEQ ID NO: 142210 - RNA, 22 nt, Human
aaauguaaacuguauuuauaaa

SEQ ID NO: 142211 - RNA, 22 nt, Human
cuggcaguguccagcucgugau

SEQ ID NO: 142212 - RNA, 23 nt, Human
cugagggcuggucugaagucugc

SEQ ID NO: 142213 - RNA, 22 nt, Human
uggcuucagacuucugcuacgu

SEQ ID NO: 142214 - RNA, 22 nt, Human
uacaaauuguuuugccacaaag

SEQ ID NO: 142215 - RNA, 22 nt, Human
gcugagcaaugcacugccgcau

SEQ ID NO: 142216 - RNA, 22 nt, Human
uaauuuugucacagugacaugc

SEQ ID NO: 142217 - RNA, 22 nt, Human
auguauuuauguauguguuaua

SEQ ID NO: 142218 - RNA, 20 nt, Human
aaaaacaguaaugcugaaga

SEQ ID NO: 142219 - RNA, 22 nt, Human
uucauagaagggaguuuuuccu

SEQ ID NO: 142220 - RNA, 22 nt, Human
uuuuugggccaaauauauuuac

SEQ ID NO: 142221 - RNA, 21 nt, Human
uuucauuaguacaucaauuug

SEQ ID NO: 142222 - RNA, 22 nt, Human
uuauuucaggcauuuguaaaug

SEQ ID NO: 142223 - RNA, 22 nt, Human
uaaaguauucaaguagcuuucu

SEQ ID NO: 142224 - RNA, 22 nt, Human
cugagcugcucccgcugcagcg

SEQ ID NO: 142225 - RNA, 20 nt, Human
uacaauauucccacuuugcu

SEQ ID NO: 142226 - RNA, 19 nt, Human
gauauugagcugagaauuc

SEQ ID NO: 142227 - RNA, 22 nt, Human
cuuacaauuuucuuggacuuuu

SEQ ID NO: 142228 - RNA, 22 nt, Human
cuuuuuuucuccauauuucugg

SEQ ID NO: 142229 - RNA, 22 nt, Human
auguugagaaucucucuucuaa

SEQ ID NO: 142230 - RNA, 22 nt, Human
uccugaggaaauuucaccuagu

SEQ ID NO: 142231 - RNA, 22 nt, Human
aacucugcaaugaaaucauguu

SEQ ID NO: 142232 - RNA, 22 nt, Human
agcaaggguugguuuucugaca

SEQ ID NO: 142233 - RNA, 22 nt, Human
ugcugcuguuuccuacaucuca

SEQ ID NO: 142234 - RNA, 22 nt, Human
aaguuccacuagugacccagaa

SEQ ID NO: 142235 - RNA, 22 nt, Human
uccuugaauugcguccacaaga

SEQ ID NO: 142236 - RNA, 22 nt, Human
ugcauguuuuaagugaagcuga

SEQ ID NO: 142237 - RNA, 22 nt, Human
ugaugaugaagaaauauuauca

SEQ ID NO: 142238 - RNA, 22 nt, Human
agaugaguaaauggagucuucc

SEQ ID NO: 142239 - RNA, 22 nt, Human
auuuuauuuugggaucuuuuua

SEQ ID NO: 142240 - RNA, 22 nt, Human
augccugcugucaggaacucuu

SEQ ID NO: 142241 - RNA, 22 nt, Human
auaaauuugacagcucuucaug

SEQ ID NO: 142242 - RNA, 22 nt, Human
uuagacagagcuccuugagggc

SEQ ID NO: 142243 - RNA, 22 nt, Human
uuuguuuuggugucaugcguga

SEQ ID NO: 142244 - RNA, 22 nt, Human
aaaauaauauuauaccacugcu

SEQ ID NO: 142245 - RNA, 22 nt, Human
aguuucuugaagacugauguuu

SEQ ID NO: 142246 - RNA, 22 nt, Human
uauauauaugcaccacaugugu

SEQ ID NO: 142247 - RNA, 22 nt, Human
gcugccucacuagauagguaug

SEQ ID NO: 142248 - RNA, 20 nt, Human
cucuuuaugagaccacuguc

SEQ ID NO: 142249 - RNA, 22 nt, Human
gcuguugugaggaucagcauau

SEQ ID NO: 142250 - RNA, 20 nt, Human
caacacugcccauuguuugc

SEQ ID NO: 142251 - RNA, 22 nt, Human
acguuuuagccauguaguuucu

SEQ ID NO: 142252 - RNA, 22 nt, Human
ucagacacacaacuucugcuua

SEQ ID NO: 142253 - RNA, 22 nt, Human
auuucauuuuagaaauaagugu

SEQ ID NO: 142254 - RNA, 22 nt, Human
acagacaucaucaacaucuucc

SEQ ID NO: 142255 - RNA, 22 nt, Human
cagagcagaaaccugggugauu

SEQ ID NO: 142256 - RNA, 18 nt, Human
ugauggcuaagagccggg

SEQ ID NO: 142257 - RNA, 22 nt, Human
auguaaauauuuauauaugcau

SEQ ID NO: 142258 - RNA, 22 nt, Human
gcacugagacuuuagauuggag

SEQ ID NO: 142259 - RNA, 22 nt, Human
ugcugcucaagcugcagcaaaa

SEQ ID NO: 142260 - RNA, 22 nt, Human
aagagaaacauauggccagauu

SEQ ID NO: 142261 - RNA, 22 nt, Human
uguuuaaauagaacauacugca

SEQ ID NO: 142262 - RNA, 22 nt, Human
auucaucuguacuucaauaucu

SEQ ID NO: 142263 - RNA, 22 nt, Human
uuauuuaagaucuuaauauaua

SEQ ID NO: 142264 - RNA, 22 nt, Human
ugcaaggcacccacucugcuuu

SEQ ID NO: 142265 - RNA, 22 nt, Human
uuccagcaaagguaguguguua

SEQ ID NO: 142266 - RNA, 22 nt, Human
auuaugaauuguguuacgaaga

SEQ ID NO: 142267 - RNA, 22 nt, Human
gaguauuuaccacuaaaugguu

SEQ ID NO: 142268 - RNA, 21 nt, Human
uuccauggacccugucagugu

SEQ ID NO: 142269 - RNA, 22 nt, Human
gguucaaagccugaugggguug

SEQ ID NO: 142270 - RNA, 22 nt, Human
uacuuaauuuuaaaagcuagau

SEQ ID NO: 142271 - RNA, 22 nt, Human
cucaaaauccauaaaaucaggu

SEQ ID NO: 142272 - RNA, 22 nt, Human
caugauaacacuucuguuuaau

SEQ ID NO: 142273 - RNA, 22 nt, Human
aaagccaagguccauguacuuu

SEQ ID NO: 142274 - RNA, 22 nt, Human
ucccacgugccaucugcucugu

SEQ ID NO: 142275 - RNA, 22 nt, Human
ggcugaggccucuggggaggga

SEQ ID NO: 142276 - RNA, 22 nt, Human
aaaagaaugaugggagcugggu

SEQ ID NO: 142277 - RNA, 22 nt, Human
cagaggagcgaguuggacgcca

SEQ ID NO: 142278 - RNA, 22 nt, Human
guuuuguucaugaacauugggu

SEQ ID NO: 142279 - RNA, 22 nt, Human
uuuuaaaacaugucaaaaugug

SEQ ID NO: 142280 - RNA, 22 nt, Human
aaaacauuuaggguuuuuuuua

SEQ ID NO: 142281 - RNA, 22 nt, Human
uuuuccuuagaaauacauugau

SEQ ID NO: 142282 - RNA, 22 nt, Human
agauggggccugaggacacugu

SEQ ID NO: 142283 - RNA, 22 nt, Human
aguucuuugcucccugcuuuuu

SEQ ID NO: 142284 - RNA, 22 nt, Human
uuugauuaccuggggcccucug

SEQ ID NO: 142285 - RNA, 22 nt, Human
guugauaauuaauagcuuuuga

SEQ ID NO: 142286 - RNA, 22 nt, Human
gagcacugagcuggaauuggag

SEQ ID NO: 142287 - RNA, 22 nt, Human
augccccuuuauauguuaaguc

SEQ ID NO: 142288 - RNA, 22 nt, Human
uaacauuucggugacaguggga

SEQ ID NO: 142289 - RNA, 22 nt, Human
ucauuuuaucaggaauggaauc

SEQ ID NO: 142290 - RNA, 22 nt, Human
ccagaggcuuaugcagcugcug

SEQ ID NO: 142291 - RNA, 22 nt, Human
agagcuauuucuuaaaagcugu

SEQ ID NO: 142292 - RNA, 22 nt, Human
aguaauaaacaacucauuuugg

SEQ ID NO: 142293 - RNA, 22 nt, Human
gucccucauaacuggcaggugu

SEQ ID NO: 142294 - RNA, 22 nt, Human
aaucccaguccuccugggggau

SEQ ID NO: 142295 - RNA, 22 nt, Human
cauaucuuaaacaucaucucug

SEQ ID NO: 142296 - RNA, 22 nt, Human
auauaguacauguauauauaua

SEQ ID NO: 142297 - RNA, 21 nt, Human
acuccagccacugacugucuc

SEQ ID NO: 142298 - RNA, 22 nt, Human
ucccugcugggcgaucuucucu

SEQ ID NO: 142299 - RNA, 22 nt, Human
agagggagcuccaagaucaagg

SEQ ID NO: 142300 - RNA, 22 nt, Human
aauuaacuggguucucagaugc

SEQ ID NO: 142301 - RNA, 22 nt, Human
cgugccugguggagagcgaggg

SEQ ID NO: 142302 - RNA, 22 nt, Human
gcacuguauuuaaauauuuaaa

SEQ ID NO: 142303 - RNA, 22 nt, Human
auuuauuuucccucaaguaccu

SEQ ID NO: 142304 - RNA, 22 nt, Human
uaauucuucaauccaguguuca

SEQ ID NO: 142305 - RNA, 22 nt, Human
guuuaaaagcaaccaacaggcu

SEQ ID NO: 142306 - RNA, 22 nt, Human
uauguauguauguauguauaug

SEQ ID NO: 142307 - RNA, 20 nt, Human
ugcugugugucuacuguggg

SEQ ID NO: 142308 - RNA, 22 nt, Human
aauguaaauaauuguaaaauuu

SEQ ID NO: 142309 - RNA, 22 nt, Human
uuuuccuucugauacuccauuu

SEQ ID NO: 142310 - RNA, 20 nt, Human
agugaguuaucagcuacagu

SEQ ID NO: 142311 - RNA, 21 nt, Human
uucuuugcugcuguuuuugua

SEQ ID NO: 142312 - RNA, 22 nt, Human
acuuugaauuagaauuuugcug

SEQ ID NO: 142313 - RNA, 22 nt, Human
acauuuccaaagaugccaguca

SEQ ID NO: 142314 - RNA, 22 nt, Human
gagaacuguguauucuuuuuca

SEQ ID NO: 142315 - RNA, 22 nt, Human
aaauauauccuucuguccugcc

SEQ ID NO: 142316 - RNA, 22 nt, Human
acaggcugcccgcuccccaccu

SEQ ID NO: 142317 - RNA, 22 nt, Human
cugauaauaaccauuuuaaaau

SEQ ID NO: 142318 - RNA, 22 nt, Human
ugcagacuguuucuugacugaa

SEQ ID NO: 142319 - RNA, 22 nt, Human
aauggcaagccacaugcuuuuc

SEQ ID NO: 142320 - RNA, 22 nt, Human
uugaaaaaugcccagcagacaa

SEQ ID NO: 142321 - RNA, 19 nt, Human
uagagcagcuucagauucc

SEQ ID NO: 142322 - RNA, 22 nt, Human
aauaucuugaguuauaaauuca

SEQ ID NO: 142323 - RNA, 22 nt, Human
uaauaaaaauuuaauucacauu

SEQ ID NO: 142324 - RNA, 22 nt, Human
uaguggaaccuucuaaaugacg

SEQ ID NO: 142325 - RNA, 22 nt, Human
aacugaaguuuucagauuuugc

SEQ ID NO: 142326 - RNA, 22 nt, Human
uauauauacauauagaauaugu

SEQ ID NO: 142327 - RNA, 22 nt, Human
gaacauuucugcagaugucuga

SEQ ID NO: 142328 - RNA, 18 nt, Human
aguaaauguuaaauauug

SEQ ID NO: 142329 - RNA, 22 nt, Human
uuuauuuagguaaacaugaguu

SEQ ID NO: 142330 - RNA, 22 nt, Human
gcaguuaccuauuuuguagaaa

SEQ ID NO: 142331 - RNA, 22 nt, Human
aaugauuuucugcaaacaguga

SEQ ID NO: 142332 - RNA, 22 nt, Human
agguguaauuacucuugcaguu

SEQ ID NO: 142333 - RNA, 22 nt, Human
uauuuuuacuguuugaugauuc

SEQ ID NO: 142334 - RNA, 22 nt, Human
ucaaggaagggguaggaauaau

SEQ ID NO: 142335 - RNA, 22 nt, Human
gcugacuauaaggcugcucugu

SEQ ID NO: 142336 - RNA, 22 nt, Human
uuuauaauuacguaaaauauuu

SEQ ID NO: 142337 - RNA, 22 nt, Human
aagauagaaugauguuggcuca

SEQ ID NO: 142338 - RNA, 22 nt, Human
ccugccugggcucacuugccag

SEQ ID NO: 142339 - RNA, 22 nt, Human
aauucugaggccauuuauuucc

SEQ ID NO: 142340 - RNA, 20 nt, Human
aauaaauauaacccauaauu

SEQ ID NO: 142341 - RNA, 21 nt, Human
uaauaauugggggcagggugg

SEQ ID NO: 142342 - RNA, 22 nt, Human
gagaaaaauuucuuugcugcac

SEQ ID NO: 142343 - RNA, 22 nt, Human
cauuuaucacuugcuaaacaua

SEQ ID NO: 142344 - RNA, 22 nt, Human
gugaaaaauggccaucaggaca

SEQ ID NO: 142345 - RNA, 20 nt, Human
acagagauccucucuuuauc

SEQ ID NO: 142346 - RNA, 22 nt, Human
uuuaaaacagcauuuaaaaggu

SEQ ID NO: 142347 - RNA, 22 nt, Human
cugggacacguugugcuuuaac

SEQ ID NO: 142348 - RNA, 22 nt, Human
uggcaaggccacaggugcaguu

SEQ ID NO: 142349 - RNA, 22 nt, Human
gaauacaagccugccaccugga

SEQ ID NO: 142350 - RNA, 22 nt, Human
aauggaaaaauccacagggaac

SEQ ID NO: 142351 - RNA, 22 nt, Human
auuaauguguaugauauaaauu

SEQ ID NO: 142352 - RNA, 22 nt, Human
gggcaggcuggguggugguccc

SEQ ID NO: 142353 - RNA, 22 nt, Human
cagaaaaaaaugcagacuagca

SEQ ID NO: 142354 - RNA, 22 nt, Human
uguuuuuucccccccuucuaaa

SEQ ID NO: 142355 - RNA, 22 nt, Human
ugaauguggucaggaaauuguu

SEQ ID NO: 142356 - RNA, 22 nt, Human
uaacauuuaguuuuaagauggu

SEQ ID NO: 142357 - RNA, 22 nt, Human
ucuuugcauggacauguguuuu

SEQ ID NO: 142358 - RNA, 22 nt, Human
auuaauaucaauauauuauaug

SEQ ID NO: 142359 - RNA, 22 nt, Human
ugaaaaaugcuuuaaugcaugu

SEQ ID NO: 142360 - RNA, 22 nt, Human
guauuugacaccagugaauggu

SEQ ID NO: 142361 - RNA, 22 nt, Human
acauauaugugcauacaacuau

SEQ ID NO: 142362 - RNA, 22 nt, Human
ucuucuuacauuaaguugaaac

SEQ ID NO: 142363 - RNA, 22 nt, Human
uugaagccaccacuguaaguca

SEQ ID NO: 142364 - RNA, 22 nt, Human
acauggcaugaauaauguguac

SEQ ID NO: 142365 - RNA, 22 nt, Human
cauaaauuuuaccuuguaagug

SEQ ID NO: 142366 - RNA, 22 nt, Human
guuuucuaaaacacauauaagu

SEQ ID NO: 142367 - RNA, 22 nt, Human
gauguuaauauguuucaccaaa

SEQ ID NO: 142368 - RNA, 22 nt, Human
uuaauauuaagauauugagugg

SEQ ID NO: 142369 - RNA, 22 nt, Human
caggaaaauaauggugauggga

SEQ ID NO: 142370 - RNA, 22 nt, Human
aaucaauuauccauuuguuagu

SEQ ID NO: 142371 - RNA, 22 nt, Human
aauuauguugaaauaugagaac

SEQ ID NO: 142372 - RNA, 22 nt, Human
auuuacugagguaaauaaacug

SEQ ID NO: 142373 - RNA, 22 nt, Human
gccugcaggaaggugugccugu

SEQ ID NO: 142374 - RNA, 22 nt, Human
uugaauaguuuuggauagcaua

SEQ ID NO: 142375 - RNA, 22 nt, Human
ucccagaaauccaggcuuaaau

SEQ ID NO: 142376 - RNA, 22 nt, Human
uuucugagccacauauaauuug

SEQ ID NO: 142377 - RNA, 22 nt, Human
cugaguuuuucaaaucugaauu

SEQ ID NO: 142378 - RNA, 22 nt, Human
agagcuagaaggaagcauuucu

SEQ ID NO: 142379 - RNA, 22 nt, Human
aauuacuuuaggaaaacuccuc

SEQ ID NO: 142380 - RNA, 22 nt, Human
cccuccagugucccagugggga

SEQ ID NO: 142381 - RNA, 22 nt, Human
gggaaaaaggaaccuuauuacu

SEQ ID NO: 142382 - RNA, 22 nt, Human
auguuugugauugcugaaaaga

SEQ ID NO: 142383 - RNA, 22 nt, Human
gaaacauuuguugaguacuugc

SEQ ID NO: 142384 - RNA, 22 nt, Human
ucugcagggcccuuggcuccug

SEQ ID NO: 142385 - RNA, 22 nt, Human
gauucuaucauucuguauauua

SEQ ID NO: 142386 - RNA, 22 nt, Human
uuuuaaaagguugcuguuauaa

SEQ ID NO: 142387 - RNA, 22 nt, Human
auguacugacuguacuuuuaaa

SEQ ID NO: 142388 - RNA, 22 nt, Human
uuuugaauaauucagaaacagc

SEQ ID NO: 142389 - RNA, 22 nt, Human
ucuuuaaggggccuuuguguca

SEQ ID NO: 142390 - RNA, 22 nt, Human
ccaugauguugccuacacugcu

SEQ ID NO: 142391 - RNA, 22 nt, Human
ugaauaaucuuggguauuaaua

SEQ ID NO: 142392 - RNA, 22 nt, Human
uuucacuucgaucagaguuuuu

SEQ ID NO: 142393 - RNA, 22 nt, Human
aagaaaagcaucuuuguaguag

SEQ ID NO: 142394 - RNA, 22 nt, Human
uggcccugaaucaaggccagca

SEQ ID NO: 142395 - RNA, 22 nt, Human
cugaggcuaauagaauuuucug

SEQ ID NO: 142396 - RNA, 22 nt, Human
ccaaagaagcaaugagaauagu

SEQ ID NO: 142397 - RNA, 22 nt, Human
gaaaugaaacacacaugcagcu

SEQ ID NO: 142398 - RNA, 22 nt, Human
ucagcaggugcuuuguuuacuc

SEQ ID NO: 142399 - RNA, 18 nt, Human
uauuuacuguguguuacc

SEQ ID NO: 142400 - RNA, 22 nt, Human
cugaucuuaaguaacauuauuu

SEQ ID NO: 142401 - RNA, 22 nt, Human
uguguuguuuggggauguccau

SEQ ID NO: 142402 - RNA, 22 nt, Human
uuguuuaaagaacuucugacuu

SEQ ID NO: 142403 - RNA, 22 nt, Human
caugaugagaguaauaacacag

SEQ ID NO: 142404 - RNA, 22 nt, Human
cuuauuugcccauguuucuuua

SEQ ID NO: 142405 - RNA, 22 nt, Human
uguacuguuuucuaggcaaaaa

SEQ ID NO: 142406 - RNA, 22 nt, Human
cauuuacauaacaguaacgcug

SEQ ID NO: 142407 - RNA, 22 nt, Human
agugcucagggaaugccacuga

SEQ ID NO: 142408 - RNA, 22 nt, Human
aucuuguuagaaggcaguaggu

SEQ ID NO: 142409 - RNA, 22 nt, Human
ugcucuuuguagcugcuuugcu

SEQ ID NO: 142410 - RNA, 22 nt, Human
uuaaaucaggcaucauuucagu

SEQ ID NO: 142411 - RNA, 22 nt, Human
uggcugaggcuuuucuuaaaga

SEQ ID NO: 142412 - RNA, 22 nt, Human
ggaugcugcuccacaucccaca

SEQ ID NO: 142413 - RNA, 22 nt, Human
aaggaaaaaauggcuugugaua

SEQ ID NO: 142414 - RNA, 22 nt, Human
aacucugacgcugucaaauaca

SEQ ID NO: 142415 - RNA, 22 nt, Human
aaaauauuuaucuagcucuuaa

SEQ ID NO: 142416 - RNA, 22 nt, Human
gggaaaaaggaguuagagauaa

SEQ ID NO: 142417 - RNA, 22 nt, Human
auuuucuucauuuugauuguau

SEQ ID NO: 142418 - RNA, 22 nt, Human
aaaaguuguaauauuuccuuua

SEQ ID NO: 142419 - RNA, 22 nt, Human
uuguuguuguuguuauuuaguu

SEQ ID NO: 142420 - RNA, 16 nt, Human
ugccaagggguuaaug

SEQ ID NO: 142421 - RNA, 22 nt, Human
auucuuuucucuaaaugaugaa

SEQ ID NO: 142422 - RNA, 22 nt, Human
augauuaagguacgucauuucu

SEQ ID NO: 142423 - RNA, 22 nt, Human
uugaaaaaauguguuuaaggag

SEQ ID NO: 142424 - RNA, 22 nt, Human
caguaucucuaaaauuacucuu

SEQ ID NO: 142425 - RNA, 18 nt, Human
uuuaauaagccuguuaug

SEQ ID NO: 142426 - RNA, 22 nt, Human
cagaguccugcaccagcuccag

SEQ ID NO: 142427 - RNA, 21 nt, Human
uugugaaaguccaggaacaac

SEQ ID NO: 142428 - RNA, 22 nt, Human
cagcuccagcccaggcagcucc

SEQ ID NO: 142429 - RNA, 22 nt, Human
uucagaauuaucauaauuuuga

SEQ ID NO: 142430 - RNA, 22 nt, Human
uuuaaaccuaucuaagaaauag

SEQ ID NO: 142431 - RNA, 23 nt, Human
uggcaaacgggaauaaaggaauu

SEQ ID NO: 142432 - RNA, 22 nt, Human
uggcuguuggagcuggaagaug

SEQ ID NO: 142433 - RNA, 22 nt, Human
acaaaaauauuguagaagugcu

SEQ ID NO: 142434 - RNA, 22 nt, Human
acucagcaccuagaaagugugc

SEQ ID NO: 142435 - RNA, 22 nt, Human
ggaggagggaguucaggaguau

SEQ ID NO: 142436 - RNA, 22 nt, Human
aacauuuauguuuugaccaagu

SEQ ID NO: 142437 - RNA, 22 nt, Human
guggcaguaaagcuggaaaagu

SEQ ID NO: 142438 - RNA, 22 nt, Human
uuuugauacaaguuguaaaaaa

SEQ ID NO: 142439 - RNA, 22 nt, Human
uugugauuaauaacuuuucucu

SEQ ID NO: 142440 - RNA, 22 nt, Human
uuaaucagacauucucaaguuu

SEQ ID NO: 142441 - RNA, 22 nt, Human
uuuucucuuugcuucucuaaaa

SEQ ID NO: 142442 - RNA, 22 nt, Human
ggcuggggccuguugaagaugc

SEQ ID NO: 142443 - RNA, 22 nt, Human
uugaaagaacaauucugugaug

SEQ ID NO: 142444 - RNA, 22 nt, Human
cuggcuguguguuugugcaucu

SEQ ID NO: 142445 - RNA, 22 nt, Human
aagaaugaaaugaaagaacuaa

SEQ ID NO: 142446 - RNA, 22 nt, Human
ugggcagggauuuggggaaacu

SEQ ID NO: 142447 - RNA, 22 nt, Human
ucugugcuggacugauuucaua

SEQ ID NO: 142448 - RNA, 22 nt, Human
auuaagucugacuggauuguau

SEQ ID NO: 142449 - RNA, 22 nt, Human
uuuugcuucuaguauauuuuuu

SEQ ID NO: 142450 - RNA, 22 nt, Human
gagaaggagcagaaaaucuccu

SEQ ID NO: 142451 - RNA, 22 nt, Human
cucuggcaacgauggugcuuau

SEQ ID NO: 142452 - RNA, 20 nt, Human
accccuccccacuccucgcc

SEQ ID NO: 142453 - RNA, 17 nt, Human
ggaagaaaaggaucauc

SEQ ID NO: 142454 - RNA, 22 nt, Human
uagaccugugggggcagcgggc

SEQ ID NO: 142455 - RNA, 22 nt, Human
agagggagccugcacagcuuuc

SEQ ID NO: 142456 - RNA, 22 nt, Human
acuaaguagaggagugaugauu

SEQ ID NO: 142457 - RNA, 22 nt, Human
uguuaaaaagucccuguuuugu

SEQ ID NO: 142458 - RNA, 22 nt, Human
auuugcauguuuauuucuuaga

SEQ ID NO: 142459 - RNA, 22 nt, Human
ccucucccugcagggcccaggg

SEQ ID NO: 142460 - RNA, 22 nt, Human
cucugcuagaaggucaaucucu

SEQ ID NO: 142461 - RNA, 22 nt, Human
gcugggacacacagucuucuuu

SEQ ID NO: 142462 - RNA, 22 nt, Human
agagaaauguacuagucuaacu

SEQ ID NO: 142463 - RNA, 22 nt, Human
aacuuucuuugcaucuaaguuu

SEQ ID NO: 142464 - RNA, 22 nt, Human
agaauuuguaucuacggugugc

SEQ ID NO: 142465 - RNA, 22 nt, Human
gaaggaaaagacgugcuaagua

SEQ ID NO: 142466 - RNA, 22 nt, Human
aaaggaaacuaugaaucucugg

SEQ ID NO: 142467 - RNA, 22 nt, Human
ccaggcagaggggucuggagca

SEQ ID NO: 142468 - RNA, 22 nt, Human
uaucauuuuacugugacauuuu

SEQ ID NO: 142469 - RNA, 22 nt, Human
cuggguguggugggugcugccg

SEQ ID NO: 142470 - RNA, 22 nt, Human
uuaaugcagguacuguuacaau

SEQ ID NO: 142471 - RNA, 22 nt, Human
guggugguguuggugacaaguu

SEQ ID NO: 142472 - RNA, 22 nt, Human
uuauuuuauaaagagaagacuu

SEQ ID NO: 142473 - RNA, 22 nt, Human
aagaaauagauagaggaauacu

SEQ ID NO: 142474 - RNA, 22 nt, Human
aaaaaguaccacuuggacacuu

SEQ ID NO: 142475 - RNA, 22 nt, Human
uccugcccuguccuugccucug

SEQ ID NO: 142476 - RNA, 22 nt, Human
acccccaggacacugccucuga

SEQ ID NO: 142477 - RNA, 22 nt, Human
aaauauagugacacuuauaguc

SEQ ID NO: 142478 - RNA, 22 nt, Human
uuucaugauuaacuuagugaau

SEQ ID NO: 142479 - RNA, 22 nt, Human
cuucuggaggcugcagaaaaga

SEQ ID NO: 142480 - RNA, 19 nt, Human
ccagaagggcaagcaaagg

SEQ ID NO: 142481 - RNA, 22 nt, Human
cuuccauucugauggcuaauua

SEQ ID NO: 142482 - RNA, 22 nt, Human
caaggaaaacagaugaucaaca

SEQ ID NO: 142483 - RNA, 22 nt, Human
ucaacagaagugauagcuauua

SEQ ID NO: 142484 - RNA, 22 nt, Human
ggaauauaaaucagaugcuccg

SEQ ID NO: 142485 - RNA, 22 nt, Human
ugucacaccucguuuagcauuc

SEQ ID NO: 142486 - RNA, 22 nt, Human
ucuuucucuccagccuggaccu

SEQ ID NO: 142487 - RNA, 22 nt, Human
uuaucaaaaaauaguacuuuga

SEQ ID NO: 142488 - RNA, 22 nt, Human
acauauggcagguugaucaaug

SEQ ID NO: 142489 - RNA, 22 nt, Human
uaacuuuuuauccuguuaaaug

SEQ ID NO: 142490 - RNA, 22 nt, Human
ggggaggguuuggaugagaguc

SEQ ID NO: 142491 - RNA, 22 nt, Human
gaugguggaggaaucgcugaag

SEQ ID NO: 142492 - RNA, 23 nt, Human
auaaugauaaugcuauuuuuugu

SEQ ID NO: 142493 - RNA, 22 nt, Human
ucuuucucauccaaacuaguug

SEQ ID NO: 142494 - RNA, 18 nt, Human
uuauacaauuuuuuuuca

SEQ ID NO: 142495 - RNA, 22 nt, Human
ccccugggcccugagccgcgau

SEQ ID NO: 142496 - RNA, 22 nt, Human
uaaaugcucuuuaaaagugcuu

SEQ ID NO: 142497 - RNA, 22 nt, Human
ggcugcuggaguugggucucuc

SEQ ID NO: 142498 - RNA, 22 nt, Human
acaauaauguuuuuagguuauu

SEQ ID NO: 142499 - RNA, 22 nt, Human
uuuuuuaaucaaguaggaaaca

SEQ ID NO: 142500 - RNA, 20 nt, Human
uccccuccacuuuccuccua

SEQ ID NO: 142501 - RNA, 22 nt, Human
aggcagagaggucuuccuggaa

SEQ ID NO: 142502 - RNA, 22 nt, Human
agauuucaauggauauugcaag

SEQ ID NO: 142503 - RNA, 21 nt, Human
auacaguucagcuuuuacuau

SEQ ID NO: 142504 - RNA, 22 nt, Human
auagauuuuaucagauuuuauc

SEQ ID NO: 142505 - RNA, 22 nt, Human
uucaaaaugcagaauaguuugg

SEQ ID NO: 142506 - RNA, 22 nt, Human
uuacuguguguaaaauaucuuu

SEQ ID NO: 142507 - RNA, 22 nt, Human
ugcuauuuuguuuucaguccau

SEQ ID NO: 142508 - RNA, 23 nt, Human
cauguacacacagcuguacagug

SEQ ID NO: 142509 - RNA, 22 nt, Human
uaauaauuaacagugauggguc

SEQ ID NO: 142510 - RNA, 22 nt, Human
uuuucugauccuucuaacuuga

SEQ ID NO: 142511 - RNA, 22 nt, Human
uccugcucucuccauuccuucc

SEQ ID NO: 142512 - RNA, 22 nt, Human
uguauauguguguagcauguua

SEQ ID NO: 142513 - RNA, 22 nt, Human
uugguuaccuucagaaaugagu

SEQ ID NO: 142514 - RNA, 22 nt, Human
cccagccuuugcuuccugguuc

SEQ ID NO: 142515 - RNA, 22 nt, Human
aacaaaacauuuuacgaauaua

SEQ ID NO: 142516 - RNA, 22 nt, Human
gggauggggagcuggaaagggg

SEQ ID NO: 142517 - RNA, 20 nt, Human
ugcuaucugcucucccuucu

SEQ ID NO: 142518 - RNA, 22 nt, Human
agcagcugagccccagcuguga

SEQ ID NO: 142519 - RNA, 22 nt, Human
guucaaggagcagcuugcuaca

SEQ ID NO: 142520 - RNA, 22 nt, Human
cugggagaugacucagagcagg

SEQ ID NO: 142521 - RNA, 22 nt, Human
ucucccuuuggauuuguuuugg

SEQ ID NO: 142522 - RNA, 22 nt, Human
uuugaaaggagcuuuauccaga

SEQ ID NO: 142523 - RNA, 22 nt, Human
aaauggauaaucaagauaauca

SEQ ID NO: 142524 - RNA, 22 nt, Human
agaacccaaggcccagggaugu

SEQ ID NO: 142525 - RNA, 22 nt, Human
aaauugcauuuuaaagguagau

SEQ ID NO: 142526 - RNA, 22 nt, Human
agaggagaauguaaauuuguca

SEQ ID NO: 142527 - RNA, 22 nt, Human
ggaggcccagaaggaagcccag

SEQ ID NO: 142528 - RNA, 19 nt, Human
aacucugccgaggcaagcc

SEQ ID NO: 142529 - RNA, 22 nt, Human
auuucaacagaguuugaaggca

SEQ ID NO: 142530 - RNA, 22 nt, Human
cuuuuaaucuaauuuuuauauu

SEQ ID NO: 142531 - RNA, 22 nt, Human
aggugcuugcauacugcuugac

SEQ ID NO: 142532 - RNA, 21 nt, Human
gccugcuguucacccugccac

SEQ ID NO: 142533 - RNA, 22 nt, Human
agauaacauguugcagauucug

SEQ ID NO: 142534 - RNA, 22 nt, Human
uuuuagaagcauuuaugagauu

SEQ ID NO: 142535 - RNA, 22 nt, Human
uauccaaaggaacaaucacagc

SEQ ID NO: 142536 - RNA, 22 nt, Human
auuuuuauuugccuaugauaua

SEQ ID NO: 142537 - RNA, 22 nt, Human
uucaacaacuugguucaaaugg

SEQ ID NO: 142538 - RNA, 22 nt, Human
cacugcacuccagccugggcaa

SEQ ID NO: 142539 - RNA, 20 nt, Human
aaagauacuuuuuguaaugg

SEQ ID NO: 142540 - RNA, 22 nt, Human
acuuuuaauaguagauuuuuaa

SEQ ID NO: 142541 - RNA, 22 nt, Human
gaugauaacagcauuucaacug

SEQ ID NO: 142542 - RNA, 22 nt, Human
guuuuuaguuuaaguuuuugca

SEQ ID NO: 142543 - RNA, 22 nt, Human
uuuaugauguagccuagagcug

SEQ ID NO: 142544 - RNA, 22 nt, Human
ccucaucagaaagcagaaagca

SEQ ID NO: 142545 - RNA, 22 nt, Human
cauuccaagaaguaguucugca

SEQ ID NO: 142546 - RNA, 22 nt, Human
cuugcaaugaaggcacacuuau

SEQ ID NO: 142547 - RNA, 22 nt, Human
uguaucuguguguauguguuua

SEQ ID NO: 142548 - RNA, 22 nt, Human
caagaaguugacagccagguga

SEQ ID NO: 142549 - RNA, 16 nt, Human
ugucucuucccaguuc

SEQ ID NO: 142550 - RNA, 22 nt, Human
cagugcucauagcuguuccucc

SEQ ID NO: 142551 - RNA, 22 nt, Human
guaguuuucaugguuagaaaua

SEQ ID NO: 142552 - RNA, 22 nt, Human
uuuaccuuauguaaauaagagu

SEQ ID NO: 142553 - RNA, 22 nt, Human
aaaaggucacuguaaaaugacg

SEQ ID NO: 142554 - RNA, 22 nt, Human
aggaaaaagaagaaaagaauca

SEQ ID NO: 142555 - RNA, 22 nt, Human
gaaaaagagaaggaguucagua

SEQ ID NO: 142556 - RNA, 23 nt, Human
aggcugcagaagaauagggucau

SEQ ID NO: 142557 - RNA, 22 nt, Human
gucuccugcccacccugguccc

SEQ ID NO: 142558 - RNA, 22 nt, Human
aucuuuguaaguaaucaaagcu

SEQ ID NO: 142559 - RNA, 20 nt, Human
guugggagaagugucagcug

SEQ ID NO: 142560 - RNA, 22 nt, Human
cuuuuucuugugguuaauaucu

SEQ ID NO: 142561 - RNA, 22 nt, Human
ccuuuuaagggagacuagagau

SEQ ID NO: 142562 - RNA, 22 nt, Human
acagagggagugacggccaacc

SEQ ID NO: 142563 - RNA, 22 nt, Human
cccagagggcugaggauaugaa

SEQ ID NO: 142564 - RNA, 22 nt, Human
agaauauaguaaauauuuucua

SEQ ID NO: 142565 - RNA, 22 nt, Human
cugccaggagaggccagggccc

SEQ ID NO: 142566 - RNA, 22 nt, Human
aaaauaaccuucauuugcauug

SEQ ID NO: 142567 - RNA, 22 nt, Human
auuuaaagaguaauacaaucca

SEQ ID NO: 142568 - RNA, 22 nt, Human
cgaaggaaucacuuaacacuuu

SEQ ID NO: 142569 - RNA, 22 nt, Human
auacacuucauguuuucaucug

SEQ ID NO: 142570 - RNA, 22 nt, Human
gaggaaaauggaguguaauuaa

SEQ ID NO: 142571 - RNA, 22 nt, Human
aucuucaaggacgccaagaucc

SEQ ID NO: 142572 - RNA, 22 nt, Human
uaugcagauaguuugccauuca

SEQ ID NO: 142573 - RNA, 20 nt, Human
aggaagauccuuucuuuuaa

SEQ ID NO: 142574 - RNA, 22 nt, Human
cucagaagaacaaaggcucuac

SEQ ID NO: 142575 - RNA, 20 nt, Human
cauuccaugcaucuuggucc

SEQ ID NO: 142576 - RNA, 22 nt, Human
acuuagaacagccuaugggaag

SEQ ID NO: 142577 - RNA, 22 nt, Human
gugguccuaggugcucaaguca

SEQ ID NO: 142578 - RNA, 20 nt, Human
uauuucaaugugccaaguuu

SEQ ID NO: 142579 - RNA, 22 nt, Human
ucagucugcuauagguauuugu

SEQ ID NO: 142580 - RNA, 23 nt, Human
gcuuugaaaaugcuuucuuccag

SEQ ID NO: 142581 - RNA, 22 nt, Human
uccagaaaucucuguugauugu

SEQ ID NO: 142582 - RNA, 22 nt, Human
ucuuuaaauucuuaugagugaa

SEQ ID NO: 142583 - RNA, 22 nt, Human
uuacuuaucugaugugauuuuu

SEQ ID NO: 142584 - RNA, 22 nt, Human
aucucccaaauuagccucuuga

SEQ ID NO: 142585 - RNA, 22 nt, Human
cuuaggaaauccuguacucccc

SEQ ID NO: 142586 - RNA, 22 nt, Human
aaugaguucaucugaauucugg

SEQ ID NO: 142587 - RNA, 22 nt, Human
uaaaugaaaggguuuaauuuau

SEQ ID NO: 142588 - RNA, 22 nt, Human
uuuucaaucaaguuuauuuaua

SEQ ID NO: 142589 - RNA, 22 nt, Human
cugcugugcagacagacucucu

SEQ ID NO: 142590 - RNA, 22 nt, Human
uggcgcgcagccugcuggugcu

SEQ ID NO: 142591 - RNA, 22 nt, Human
ugaauuuuggcaauuuucugug

SEQ ID NO: 142592 - RNA, 22 nt, Human
gauuuugcuuuagugaaggaag

SEQ ID NO: 142593 - RNA, 18 nt, Human
uccuuucaccccuucucu

SEQ ID NO: 142594 - RNA, 22 nt, Human
cuucagagugacucagcaucuu

SEQ ID NO: 142595 - RNA, 22 nt, Human
ugcauaagguuaaauuagcaga

SEQ ID NO: 142596 - RNA, 22 nt, Human
gcuuucccaaccuucuugguau

SEQ ID NO: 142597 - RNA, 22 nt, Human
auauuuuacagcucucguugaa

SEQ ID NO: 142598 - RNA, 22 nt, Human
aguaaaugaaagcaauuuuaga

SEQ ID NO: 142599 - RNA, 22 nt, Human
ucacaucugugugauugucauu

SEQ ID NO: 142600 - RNA, 22 nt, Human
uacaacuuacuugaauggcuuu

SEQ ID NO: 142601 - RNA, 22 nt, Human
auuuuugguuauaaaauaguuu

SEQ ID NO: 142602 - RNA, 22 nt, Human
uucucaauggcaacuuguugcu

SEQ ID NO: 142603 - RNA, 22 nt, Human
uuggggagaagagcuggucagg

SEQ ID NO: 142604 - RNA, 22 nt, Human
aaggaaaguuaagguaaacucu

SEQ ID NO: 142605 - RNA, 22 nt, Human
caugccugaucagcggccagca

SEQ ID NO: 142606 - RNA, 22 nt, Human
gccacucaguuuaggggcaagc

SEQ ID NO: 142607 - RNA, 22 nt, Human
cugugaaugguggccacgcguu

SEQ ID NO: 142608 - RNA, 22 nt, Human
uuguuuuaguagaaguuacaug

SEQ ID NO: 142609 - RNA, 22 nt, Human
uuagauaguaaauagcacuaag

SEQ ID NO: 142610 - RNA, 22 nt, Human
gaaauagagacaguaagugucu

SEQ ID NO: 142611 - RNA, 22 nt, Human
aggcuaagugauuagugacaua

SEQ ID NO: 142612 - RNA, 22 nt, Human
ugcugcuguuaucauuuuacca

SEQ ID NO: 142613 - RNA, 22 nt, Human
uaguauuuguaauuaucaaagc

SEQ ID NO: 142614 - RNA, 22 nt, Human
gcuuuuaaauuaucugacaaug

SEQ ID NO: 142615 - RNA, 18 nt, Human
cauuguacaaugcuuuau

SEQ ID NO: 142616 - RNA, 22 nt, Human
aaauauuugaaugguguaagau

SEQ ID NO: 142617 - RNA, 22 nt, Human
uucugaguguugucaccaugug

SEQ ID NO: 142618 - RNA, 22 nt, Human
ccuuugcccugagaaauguucc

SEQ ID NO: 142619 - RNA, 22 nt, Human
ccaggggagagucugagucguu

SEQ ID NO: 142620 - RNA, 22 nt, Human
uguucugauggauuacaugucu

SEQ ID NO: 142621 - RNA, 22 nt, Human
aaugcuuuuugcgaaaugugca

SEQ ID NO: 142622 - RNA, 19 nt, Human
caggucuucuuggaggacu

SEQ ID NO: 142623 - RNA, 22 nt, Human
cuguuacggaggcuuucuaguu

SEQ ID NO: 142624 - RNA, 22 nt, Human
auuuuuuuggucauaugagaua

SEQ ID NO: 142625 - RNA, 22 nt, Human
uggaauuaucugaagugauuug

SEQ ID NO: 142626 - RNA, 22 nt, Human
cucaucagagcccuccucuggc

SEQ ID NO: 142627 - RNA, 22 nt, Human
guuaaaaugauuugugauuuau

SEQ ID NO: 142628 - RNA, 22 nt, Human
uuaauaaauugugguaccagag

SEQ ID NO: 142629 - RNA, 22 nt, Human
uuuuuuuaaguuuugauuuuag

SEQ ID NO: 142630 - RNA, 22 nt, Human
acauuugauauggaguugugua

SEQ ID NO: 142631 - RNA, 22 nt, Human
gaaaaucaggauggaugugagg

SEQ ID NO: 142632 - RNA, 22 nt, Human
gaaagagaugucguuugucuuc

SEQ ID NO: 142633 - RNA, 22 nt, Human
uuuaauauuacacuuaccuugu

SEQ ID NO: 142634 - RNA, 22 nt, Human
aaaauauucuauaucaaagaua

SEQ ID NO: 142635 - RNA, 23 nt, Human
ggccuuuuuaaccgcgagcgaca

SEQ ID NO: 142636 - RNA, 22 nt, Human
aauugcuuucacaaguguuaua

SEQ ID NO: 142637 - RNA, 22 nt, Human
ggcccugcuuccccaguguaca

SEQ ID NO: 142638 - RNA, 22 nt, Human
uuucccuugcgcuugcucuccg

SEQ ID NO: 142639 - RNA, 22 nt, Human
aagacacuuucuaaauagaagu

SEQ ID NO: 142640 - RNA, 22 nt, Human
ggcugcugcccaccccugcaug

SEQ ID NO: 142641 - RNA, 22 nt, Human
cucagugacuuccugcucaauu

SEQ ID NO: 142642 - RNA, 22 nt, Human
ggaaagagaaacaugaacuaga

SEQ ID NO: 142643 - RNA, 20 nt, Human
ugucccuggagagcugcaga

SEQ ID NO: 142644 - RNA, 22 nt, Human
aguuuaaauuguucuaucagaa

SEQ ID NO: 142645 - RNA, 22 nt, Human
cuccagggcuaccagguuuuag

SEQ ID NO: 142646 - RNA, 22 nt, Human
uuuguauuguuuauuucauuuu

SEQ ID NO: 142647 - RNA, 22 nt, Human
uuuuuugucuugaagaaauggu

SEQ ID NO: 142648 - RNA, 22 nt, Human
cuuuaaaaauguauuuuugugg

SEQ ID NO: 142649 - RNA, 22 nt, Human
gagguccaggguggggccugag

SEQ ID NO: 142650 - RNA, 19 nt, Human
ugccccacccucuauccag

SEQ ID NO: 142651 - RNA, 22 nt, Human
aagugaagccaauuuuuuuagg

SEQ ID NO: 142652 - RNA, 22 nt, Human
guggguccaaccugugugugug

SEQ ID NO: 142653 - RNA, 22 nt, Human
cagguugucuaauuccaagggg

SEQ ID NO: 142654 - RNA, 22 nt, Human
gaguucuagauguauuauuaau

SEQ ID NO: 142655 - RNA, 22 nt, Human
aagacagaaaagcagagagagg

SEQ ID NO: 142656 - RNA, 22 nt, Human
cccaggaaugagcaggcagggg

SEQ ID NO: 142657 - RNA, 22 nt, Human
gggcagagggcgagcugggaga

SEQ ID NO: 142658 - RNA, 22 nt, Human
cuaauuguaagcuccuugaggg

SEQ ID NO: 142659 - RNA, 22 nt, Human
gcucccagcuuuuguccacggc

SEQ ID NO: 142660 - RNA, 22 nt, Human
ucccaagugcuccucuggcccc

SEQ ID NO: 142661 - RNA, 22 nt, Human
caauaguaaucaaugcaguuag

SEQ ID NO: 142662 - RNA, 22 nt, Human
ccgagguccugaagcaagggcc

SEQ ID NO: 142663 - RNA, 18 nt, Human
uggcuagaagagcucuca

SEQ ID NO: 142664 - RNA, 22 nt, Human
uguacauuuacaaaagcuuuau

SEQ ID NO: 142665 - RNA, 22 nt, Human
uuugaagaaacagucuuaagag

SEQ ID NO: 142666 - RNA, 22 nt, Human
gccugcugggcucuuccugcug

SEQ ID NO: 142667 - RNA, 23 nt, Human
aaauaauaauuucucuguuggga

SEQ ID NO: 142668 - RNA, 22 nt, Human
cuucauaagauuguugugagga

SEQ ID NO: 142669 - RNA, 22 nt, Human
gcauaacaacagacucuguguu

SEQ ID NO: 142670 - RNA, 22 nt, Human
aagugugugugcgcaugugcau

SEQ ID NO: 142671 - RNA, 17 nt, Human
ucauuucaguaaaucca

SEQ ID NO: 142672 - RNA, 22 nt, Human
aaugaguuuguucuauuauuug

SEQ ID NO: 142673 - RNA, 22 nt, Human
ucaguuacucugauguccugug

SEQ ID NO: 142674 - RNA, 22 nt, Human
caacaagcgcucagagcaaagc

SEQ ID NO: 142675 - RNA, 19 nt, Human
ugcugcaggaauucucaag

SEQ ID NO: 142676 - RNA, 22 nt, Human
cccagcccaucauuccugcaaa

SEQ ID NO: 142677 - RNA, 22 nt, Human
agauggaggaaagcaguuagaa

SEQ ID NO: 142678 - RNA, 22 nt, Human
acuuuauacuagugauaguuug

SEQ ID NO: 142679 - RNA, 22 nt, Human
cagggccaggccucaggggcgc

SEQ ID NO: 142680 - RNA, 22 nt, Human
ucuauuguuauccuuuccauuu

SEQ ID NO: 142681 - RNA, 22 nt, Human
cagagaggagcacaaagugaag

SEQ ID NO: 142682 - RNA, 22 nt, Human
uuuuaauaguauaucuagacac

SEQ ID NO: 142683 - RNA, 22 nt, Human
acaacuuuaauggguuucagcu

SEQ ID NO: 142684 - RNA, 22 nt, Human
auguuguugaacucuuugcaug

SEQ ID NO: 142685 - RNA, 22 nt, Human
cucuauuuuuucaucuuucagg

SEQ ID NO: 142686 - RNA, 22 nt, Human
gugccugcucauucucaauauu

SEQ ID NO: 142687 - RNA, 22 nt, Human
uuacacaugaagguccaauguu

SEQ ID NO: 142688 - RNA, 22 nt, Human
ucucuggacggacauuuaaggu

SEQ ID NO: 142689 - RNA, 22 nt, Human
uggucacgucgggguauugcca

SEQ ID NO: 142690 - RNA, 21 nt, Human
auauuguugggguuuucuuuu

SEQ ID NO: 142691 - RNA, 18 nt, Human
augauaauguuugcauca

SEQ ID NO: 142692 - RNA, 22 nt, Human
gcugcgccgggagccggggccg

SEQ ID NO: 142693 - RNA, 22 nt, Human
ggcagaggaagcuggaaguggg

SEQ ID NO: 142694 - RNA, 22 nt, Human
uauuuuaaaagcauuaauucuu

SEQ ID NO: 142695 - RNA, 22 nt, Human
ccuuuuuagaugugcgaauguu

SEQ ID NO: 142696 - RNA, 22 nt, Human
agggagcagcuagagggggucc

SEQ ID NO: 142697 - RNA, 22 nt, Human
aauaaagcuugaaagcagggaa

SEQ ID NO: 142698 - RNA, 22 nt, Human
uuuucaauuuucauuugcaaga

SEQ ID NO: 142699 - RNA, 22 nt, Human
ucuucagacuguuguucuuuug

SEQ ID NO: 142700 - RNA, 22 nt, Human
aaaguuaauucuuguuuuuuau

SEQ ID NO: 142701 - RNA, 21 nt, Human
ccugcacuucccuccucaagu

SEQ ID NO: 142702 - RNA, 22 nt, Human
uaaguaauugugguuuuugcca

SEQ ID NO: 142703 - RNA, 22 nt, Human
uucaauuacaucagaaucuaaa

SEQ ID NO: 142704 - RNA, 22 nt, Human
ugcacauuucucacaauguaca

SEQ ID NO: 142705 - RNA, 22 nt, Human
aagcucugggacugaggcuccu

SEQ ID NO: 142706 - RNA, 23 nt, Human
uuugcaaauuggacacaaccaca

SEQ ID NO: 142707 - RNA, 22 nt, Human
ugcauuuuuaauuuggaaaaaa

SEQ ID NO: 142708 - RNA, 20 nt, Human
uuuuuuaaauagagcuguug

SEQ ID NO: 142709 - RNA, 22 nt, Human
caaagcuucaucuguuguuuug

SEQ ID NO: 142710 - RNA, 23 nt, Human
uuugaaucauuguggggcuuuug

SEQ ID NO: 142711 - RNA, 22 nt, Human
ggaaaaucaaaccauuuacagu

SEQ ID NO: 142712 - RNA, 22 nt, Human
agucugaguaucucugagccag

SEQ ID NO: 142713 - RNA, 22 nt, Human
ccuggggcucugcacagagcag

SEQ ID NO: 142714 - RNA, 22 nt, Human
ucaagcuggaaaugaagaaucu

SEQ ID NO: 142715 - RNA, 22 nt, Human
gugggugaguggggccgccuga

SEQ ID NO: 142716 - RNA, 22 nt, Human
ccacccugguuacugugccagg

SEQ ID NO: 142717 - RNA, 22 nt, Human
augcuaaucaaacuuucugcag

SEQ ID NO: 142718 - RNA, 22 nt, Human
ucucucucucuuccagcauguu

SEQ ID NO: 142719 - RNA, 22 nt, Human
aagcauuuuagauaaagcauca

SEQ ID NO: 142720 - RNA, 22 nt, Human
cagcccugagagaaccaucuau

SEQ ID NO: 142721 - RNA, 20 nt, Human
auaaauaggauuuucugaca

SEQ ID NO: 142722 - RNA, 22 nt, Human
uuuaacauaugaaagaauauuu

SEQ ID NO: 142723 - RNA, 22 nt, Human
uggaagaaaugguugagccaug

SEQ ID NO: 142724 - RNA, 22 nt, Human
ucaucccuuccugcacuauuag

SEQ ID NO: 142725 - RNA, 22 nt, Human
uccagaaagccguugacuuauu

SEQ ID NO: 142726 - RNA, 22 nt, Human
ccugcuggagucuaguuggucu

SEQ ID NO: 142727 - RNA, 18 nt, Human
ggcugggcugugccccuu

SEQ ID NO: 142728 - RNA, 22 nt, Human
aucuuuuuucacaauuuauuuu

SEQ ID NO: 142729 - RNA, 22 nt, Human
cuuuacauuaauuucuacugau

SEQ ID NO: 142730 - RNA, 23 nt, Human
aggcagaguccuggggcacagcc

SEQ ID NO: 142731 - RNA, 22 nt, Human
cugucucugauaagcucgaggg

SEQ ID NO: 142732 - RNA, 22 nt, Human
uauuuguauugucuuaucacuu

SEQ ID NO: 142733 - RNA, 22 nt, Human
ugguccuuuccauuggagacac

SEQ ID NO: 142734 - RNA, 22 nt, Human
uuauauuuuauuuaauuaaaua

SEQ ID NO: 142735 - RNA, 22 nt, Human
ggcugaugacgccugagucuga

SEQ ID NO: 142736 - RNA, 22 nt, Human
aaggcugaccaguuuacacuuu

SEQ ID NO: 142737 - RNA, 18 nt, Human
cccagaggaaugccugga

SEQ ID NO: 142738 - RNA, 22 nt, Human
ccccagugguugcaacagcaga

SEQ ID NO: 142739 - RNA, 21 nt, Human
ucauccagguccugcuucuuc

SEQ ID NO: 142740 - RNA, 22 nt, Human
agcugcuggcggauguuggacu

SEQ ID NO: 142741 - RNA, 22 nt, Human
gccugcagccagggaguucucu

SEQ ID NO: 142742 - RNA, 22 nt, Human
uagcacauaguaggcacaggcu

SEQ ID NO: 142743 - RNA, 22 nt, Human
acugggcaaggauaugaugggu

SEQ ID NO: 142744 - RNA, 22 nt, Human
caacauuucaaggucuuuagga

SEQ ID NO: 142745 - RNA, 22 nt, Human
gaagcccuggaggggcuggagg

SEQ ID NO: 142746 - RNA, 22 nt, Human
uggcugagugaacauguccauu

SEQ ID NO: 142747 - RNA, 22 nt, Human
guugggaauucggagagaaaua

SEQ ID NO: 142748 - RNA, 22 nt, Human
agccugugacucugugaaacca

SEQ ID NO: 142749 - RNA, 22 nt, Human
cugcuuuggaucucucucugcc

SEQ ID NO: 142750 - RNA, 20 nt, Human
agugauuuguuaguacauug

SEQ ID NO: 142751 - RNA, 20 nt, Human
gggcucugcauccaucagcc

SEQ ID NO: 142752 - RNA, 22 nt, Human
gaaugcacacgugugugcaugc

SEQ ID NO: 142753 - RNA, 22 nt, Human
agcugaugucucaccuguuaga

SEQ ID NO: 142754 - RNA, 22 nt, Human
uaaaguguacaagucauaagua

SEQ ID NO: 142755 - RNA, 22 nt, Human
uauuuuagccaacagaaugaug

SEQ ID NO: 142756 - RNA, 22 nt, Human
gauauuuugugaaaaaacaacu

SEQ ID NO: 142757 - RNA, 22 nt, Human
cagagacuuuugcuccgauucu

SEQ ID NO: 142758 - RNA, 22 nt, Human
aauuaaauguuugguuugagcu

SEQ ID NO: 142759 - RNA, 22 nt, Human
uaacaguauacuacaucauauu

SEQ ID NO: 142760 - RNA, 22 nt, Human
uauuaauugugguuauuguauu

SEQ ID NO: 142761 - RNA, 22 nt, Human
aauggaugauuaaauggaugaa

SEQ ID NO: 142762 - RNA, 19 nt, Human
gcugggauaggauguauuu

SEQ ID NO: 142763 - RNA, 22 nt, Human
gaggaggucaccuggugagcaa

SEQ ID NO: 142764 - RNA, 22 nt, Human
ggccugcucuggcuguggucag

SEQ ID NO: 142765 - RNA, 22 nt, Human
uuuuuaaaagaugauuuaauga

SEQ ID NO: 142766 - RNA, 22 nt, Human
ugaauuuguaggaauucuccau

SEQ ID NO: 142767 - RNA, 22 nt, Human
guugggugccagaggcuucacg

SEQ ID NO: 142768 - RNA, 22 nt, Human
gcuuuucaaguuacaauuagcu

SEQ ID NO: 142769 - RNA, 22 nt, Human
ugcuguugacuuuguuguucuu

SEQ ID NO: 142770 - RNA, 22 nt, Human
aauguacucgaaugauguuaag

SEQ ID NO: 142771 - RNA, 22 nt, Human
uuuuuguaaaugaaguuuuauu

SEQ ID NO: 142772 - RNA, 22 nt, Human
cuuauuagaaagaaaagacaug

SEQ ID NO: 142773 - RNA, 22 nt, Human
uugaggucuguguaggcagcaa

SEQ ID NO: 142774 - RNA, 22 nt, Human
auaaaucaagggcaguauuucc

SEQ ID NO: 142775 - RNA, 22 nt, Human
aaauuaaaguuuuauuuagagc

SEQ ID NO: 142776 - RNA, 22 nt, Human
cuaaauuuuuuagugaaauagg

SEQ ID NO: 142777 - RNA, 22 nt, Human
aaaguuacacgacuauuuaugu

SEQ ID NO: 142778 - RNA, 22 nt, Human
ugcauguuucuguauguuaaug

SEQ ID NO: 142779 - RNA, 22 nt, Human
aauagaguccuguacugaauga

SEQ ID NO: 142780 - RNA, 22 nt, Human
uuuuacaaugcaaauucuugcu

SEQ ID NO: 142781 - RNA, 22 nt, Human
uuuuuucuucucuaucuuaaua

SEQ ID NO: 142782 - RNA, 22 nt, Human
ggcuucuuaacauuuggacacc

SEQ ID NO: 142783 - RNA, 22 nt, Human
gaugugugugcccugggccugc

SEQ ID NO: 142784 - RNA, 22 nt, Human
caaaaauacuugccuguaucug

SEQ ID NO: 142785 - RNA, 22 nt, Human
uuuuuaagguuuguuuauauau

SEQ ID NO: 142786 - RNA, 22 nt, Human
gucccuggucuaccguggcuuc

SEQ ID NO: 142787 - RNA, 22 nt, Human
ugcaaaaguuuuauacacagau

SEQ ID NO: 142788 - RNA, 22 nt, Human
ccacuuugagaagcugaugaaa

SEQ ID NO: 142789 - RNA, 18 nt, Human
uacagauguaugucuaca

SEQ ID NO: 142790 - RNA, 22 nt, Human
guuauuuugucuuguucaugaa

SEQ ID NO: 142791 - RNA, 22 nt, Human
augaguuaaguagcccuucaug

SEQ ID NO: 142792 - RNA, 22 nt, Human
aaguucuuauguucugaugugc

SEQ ID NO: 142793 - RNA, 22 nt, Human
uagcauuucacugaucuucacu

SEQ ID NO: 142794 - RNA, 22 nt, Human
aggcaacagacaggcuugguuc

SEQ ID NO: 142795 - RNA, 22 nt, Human
uuuaauauucucuuugaaggaa

SEQ ID NO: 142796 - RNA, 22 nt, Human
uuucagaaauggcacugaaauc

SEQ ID NO: 142797 - RNA, 22 nt, Human
uucuauaagagaugaauacagu

SEQ ID NO: 142798 - RNA, 22 nt, Human
uuuauguuuguuuuugaaauaa

SEQ ID NO: 142799 - RNA, 22 nt, Human
acagcagguuauuguuauggca

SEQ ID NO: 142800 - RNA, 18 nt, Human
ccuucaucucugcuucuu

SEQ ID NO: 142801 - RNA, 22 nt, Human
uuuuaucagagcuugcagugug

SEQ ID NO: 142802 - RNA, 22 nt, Human
gagcuaagcccuggagaggucg

SEQ ID NO: 142803 - RNA, 22 nt, Human
uaugugaaauggaauauagaaa

SEQ ID NO: 142804 - RNA, 22 nt, Human
aguacuuuuuguucaauugugc

SEQ ID NO: 142805 - RNA, 22 nt, Human
aaucacuuagaacccaggaagu

SEQ ID NO: 142806 - RNA, 22 nt, Human
ggaugaguuguauauaggauuc

SEQ ID NO: 142807 - RNA, 22 nt, Human
gagacugugucugucaagcuag

SEQ ID NO: 142808 - RNA, 22 nt, Human
uccaugcaguagaggcgcuggg

SEQ ID NO: 142809 - RNA, 22 nt, Human
uuaggcuuuauugaaaacaaua

SEQ ID NO: 142810 - RNA, 22 nt, Human
acauuuuaccaucuguggauga

SEQ ID NO: 142811 - RNA, 22 nt, Human
ucagagaaguaggcuaauggug

SEQ ID NO: 142812 - RNA, 22 nt, Human
ucccagguugaggccuugccug

SEQ ID NO: 142813 - RNA, 22 nt, Human
gaggguggggaauagacugcua

SEQ ID NO: 142814 - RNA, 22 nt, Human
auaccaaugaaucccugagaau

SEQ ID NO: 142815 - RNA, 22 nt, Human
uuuaaugucuuggaaaaagacu

SEQ ID NO: 142816 - RNA, 22 nt, Human
aucuaaaacuacgaauacuacc

SEQ ID NO: 142817 - RNA, 22 nt, Human
uacuuaaaacacauuuagcauu

SEQ ID NO: 142818 - RNA, 23 nt, Human
uaagccugugccugcuaccugcu

SEQ ID NO: 142819 - RNA, 22 nt, Human
uccagccugaacuuuguccaga

SEQ ID NO: 142820 - RNA, 22 nt, Human
ucccuucagcuccagcucugcu

SEQ ID NO: 142821 - RNA, 22 nt, Human
agcauucuguggucuucuaugg

SEQ ID NO: 142822 - RNA, 22 nt, Human
cugauguuuaucucaagaguuc

SEQ ID NO: 142823 - RNA, 22 nt, Human
uaguuuuaagcugacauuguuc

SEQ ID NO: 142824 - RNA, 22 nt, Human
ucccuacuccucuggucccucu

SEQ ID NO: 142825 - RNA, 22 nt, Human
acaggggauaggcaggaaggca

SEQ ID NO: 142826 - RNA, 22 nt, Human
gagggaggugacaaggacauag

SEQ ID NO: 142827 - RNA, 22 nt, Human
uaguuauuucugcacuuaauga

SEQ ID NO: 142828 - RNA, 22 nt, Human
agggaccacauccccucugugg

SEQ ID NO: 142829 - RNA, 22 nt, Human
uuguugcaagccuggaaucugg

SEQ ID NO: 142830 - RNA, 22 nt, Human
acucugcaguaaggaauuguuu

SEQ ID NO: 142831 - RNA, 22 nt, Human
auggaagagacaaugcuaucug

SEQ ID NO: 142832 - RNA, 22 nt, Human
guaagaauauacccaggaguca

SEQ ID NO: 142833 - RNA, 20 nt, Human
caggccuucaggauggcugg

SEQ ID NO: 142834 - RNA, 22 nt, Human
uggcacagcuugucauaaacuc

SEQ ID NO: 142835 - RNA, 22 nt, Human
gaauuacagaguuguuaaguca

SEQ ID NO: 142836 - RNA, 22 nt, Human
auuaucugacugaguagucugu

SEQ ID NO: 142837 - RNA, 22 nt, Human
cuauacuuagaacuccauuuuc

SEQ ID NO: 142838 - RNA, 22 nt, Human
uuaacauuguccuuagcagauu

SEQ ID NO: 142839 - RNA, 22 nt, Human
ucuuugcagaauuuaacuuugc

SEQ ID NO: 142840 - RNA, 22 nt, Human
uucugaaccauugagcacugcc

SEQ ID NO: 142841 - RNA, 22 nt, Human
ggcuagggaucuagaccaggac

SEQ ID NO: 142842 - RNA, 20 nt, Human
cugcuccauggcaucuuuag

SEQ ID NO: 142843 - RNA, 22 nt, Human
uacuuacacugaagcaaagaua

SEQ ID NO: 142844 - RNA, 22 nt, Human
gcugcgcugggacgccaccaac

SEQ ID NO: 142845 - RNA, 22 nt, Human
auucccucaagagacccacagc

SEQ ID NO: 142846 - RNA, 22 nt, Human
ugaaauuuuuuggagauaauuu

SEQ ID NO: 142847 - RNA, 22 nt, Human
aguaggauguuuagcccuucuu

SEQ ID NO: 142848 - RNA, 22 nt, Human
acauuauuguguagugugggca

SEQ ID NO: 142849 - RNA, 22 nt, Human
aauuuuauuuuuuccccuagau

SEQ ID NO: 142850 - RNA, 22 nt, Human
gauaauuauaggcuaagccacu

SEQ ID NO: 142851 - RNA, 22 nt, Human
cuucacuaccuacacugccgcu

SEQ ID NO: 142852 - RNA, 22 nt, Human
uuuaaauaguugguuuuuuugc

SEQ ID NO: 142853 - RNA, 22 nt, Human
augcugugccuggaaagcggcu

SEQ ID NO: 142854 - RNA, 22 nt, Human
aaaaaaacuaauuuuaaaugug

SEQ ID NO: 142855 - RNA, 22 nt, Human
aauauuuaaauagaauuacauc

SEQ ID NO: 142856 - RNA, 22 nt, Human
cacugugagugcaagcaggggu

SEQ ID NO: 142857 - RNA, 22 nt, Human
uccacagcagagcacgguaccu

SEQ ID NO: 142858 - RNA, 22 nt, Human
cuuuuuaaaguaaauggcuaga

SEQ ID NO: 142859 - RNA, 22 nt, Human
cagcaugguggagcugcucuuu

SEQ ID NO: 142860 - RNA, 22 nt, Human
gcgccgacccucccugccggac

SEQ ID NO: 142861 - RNA, 22 nt, Human
aaacauaugccuucuuuuguaa

SEQ ID NO: 142862 - RNA, 22 nt, Human
aguucaugugguuuaacuuaau

SEQ ID NO: 142863 - RNA, 22 nt, Human
guacugguuuucuuacucuggc

SEQ ID NO: 142864 - RNA, 22 nt, Human
uauuucaugagugaauaucuag

SEQ ID NO: 142865 - RNA, 22 nt, Human
cuguaaguggugaaauuaguuu

SEQ ID NO: 142866 - RNA, 22 nt, Human
uaacauuagcuuugcucaugca

SEQ ID NO: 142867 - RNA, 22 nt, Human
gcugcccucccagggcaagcuu

SEQ ID NO: 142868 - RNA, 22 nt, Human
uaaaauaccacauauggugcuc

SEQ ID NO: 142869 - RNA, 22 nt, Human
auguuuuauacacauguaucac

SEQ ID NO: 142870 - RNA, 23 nt, Human
gugagaccagagccuauucucag

SEQ ID NO: 142871 - RNA, 22 nt, Human
uugaauuuagguuuaugugaaa

SEQ ID NO: 142872 - RNA, 22 nt, Human
guaguuuuugagcuguaaucuu

SEQ ID NO: 142873 - RNA, 22 nt, Human
aguuuuugccucgaauucugcg

SEQ ID NO: 142874 - RNA, 22 nt, Human
uauaaagaccuuauccuucaua

SEQ ID NO: 142875 - RNA, 22 nt, Human
acaaucuuauuaguaguauaga

SEQ ID NO: 142876 - RNA, 22 nt, Human
acuucauuugaaaugguugaau

SEQ ID NO: 142877 - RNA, 17 nt, Human
auuguuuuuaauuugca

SEQ ID NO: 142878 - RNA, 22 nt, Human
uucuguacuagaucuuaucagu

SEQ ID NO: 142879 - RNA, 20 nt, Human
agguugguuuacuagucugu

SEQ ID NO: 142880 - RNA, 22 nt, Human
uauguauaacuugauaggauga

SEQ ID NO: 142881 - RNA, 22 nt, Human
acauuuuaaaaacaguaccugg

SEQ ID NO: 142882 - RNA, 22 nt, Human
ugcauuuugaaggaaaaaaaug

SEQ ID NO: 142883 - RNA, 23 nt, Human
ccacaugugagcccaccgugccc

SEQ ID NO: 142884 - RNA, 22 nt, Human
uuuggcugucauuugaaaaugu

SEQ ID NO: 142885 - RNA, 22 nt, Human
gccuuuuaaggcagagggagau

SEQ ID NO: 142886 - RNA, 22 nt, Human
uucuaauauuaugauuucuaag

SEQ ID NO: 142887 - RNA, 22 nt, Human
accugcucucccucucgcaguc

SEQ ID NO: 142888 - RNA, 22 nt, Human
auaaauuugccagcauauguuc

SEQ ID NO: 142889 - RNA, 22 nt, Human
ucuuuaagugugugccuccagg

SEQ ID NO: 142890 - RNA, 22 nt, Human
ugauguuucugaagggguuacu

SEQ ID NO: 142891 - RNA, 22 nt, Human
agcugaggccccgcagcagggu

SEQ ID NO: 142892 - RNA, 22 nt, Human
ucuuuucagccagcugguagga

SEQ ID NO: 142893 - RNA, 22 nt, Human
aggguggcuggaguggucuggu

SEQ ID NO: 142894 - RNA, 22 nt, Human
guacauauggcacaugcuauuu

SEQ ID NO: 142895 - RNA, 22 nt, Human
aauggcaaaaguuucggaaauu

SEQ ID NO: 142896 - RNA, 22 nt, Human
gaaaaucaugaaaguguguugu

SEQ ID NO: 142897 - RNA, 22 nt, Human
auguucucagguuguauuuauu

SEQ ID NO: 142898 - RNA, 22 nt, Human
uugugcauuuuguuuuacuuau

SEQ ID NO: 142899 - RNA, 22 nt, Human
aguucaauuguuuuguaaaagu

SEQ ID NO: 142900 - RNA, 22 nt, Human
aggcugccuaugaaggcagaag

SEQ ID NO: 142901 - RNA, 22 nt, Human
ugugccuguugguguagacaua

SEQ ID NO: 142902 - RNA, 22 nt, Human
uaugauuuucaugguagaguua

SEQ ID NO: 142903 - RNA, 22 nt, Human
uauauauaauguguacagguga

SEQ ID NO: 142904 - RNA, 22 nt, Human
ugaaucaaugaauugcacuuca

SEQ ID NO: 142905 - RNA, 22 nt, Human
ccucccaccguaucucaguggc

SEQ ID NO: 142906 - RNA, 22 nt, Human
aauguuguaaauauucuuugag

SEQ ID NO: 142907 - RNA, 22 nt, Human
aggaugagugaagagguaaauu

SEQ ID NO: 142908 - RNA, 20 nt, Human
uggcccgcgcuccuccugcu

SEQ ID NO: 142909 - RNA, 22 nt, Human
aaugaauaaauuuuaaagacag

SEQ ID NO: 142910 - RNA, 22 nt, Human
uaaauuugugaauuagcuauca

SEQ ID NO: 142911 - RNA, 22 nt, Human
agugcuuuauguuguugugcaa

SEQ ID NO: 142912 - RNA, 22 nt, Human
aucccuggccacgaagcugccc

SEQ ID NO: 142913 - RNA, 22 nt, Human
cacauuuuccagaagaaucaga

SEQ ID NO: 142914 - RNA, 22 nt, Human
cuuuucaaacaggacagguccu

SEQ ID NO: 142915 - RNA, 22 nt, Human
agaaacaagcccuagaaguccu

SEQ ID NO: 142916 - RNA, 22 nt, Human
auuuccacaaauuaagauugca

SEQ ID NO: 142917 - RNA, 22 nt, Human
guuguuuuuguuaaaacaguga

SEQ ID NO: 142918 - RNA, 22 nt, Human
aaugguaauauuucauaguugu

SEQ ID NO: 142919 - RNA, 23 nt, Human
cugaaauucagaugcuaaagaua

SEQ ID NO: 142920 - RNA, 22 nt, Human
auugccauaauagagccaugua

SEQ ID NO: 142921 - RNA, 22 nt, Human
gaauacaaauaauaccaaggug

SEQ ID NO: 142922 - RNA, 22 nt, Human
agucuagagcuuuuaucaggcc

SEQ ID NO: 142923 - RNA, 22 nt, Human
uugucucuacagagaguaguag

SEQ ID NO: 142924 - RNA, 22 nt, Human
uuuuuaaaauuaggacggcacg

SEQ ID NO: 142925 - RNA, 22 nt, Human
uucaguuugaauucuguagaac

SEQ ID NO: 142926 - RNA, 22 nt, Human
aauuuuauuagacaggcauaau

SEQ ID NO: 142927 - RNA, 22 nt, Human
ggucucugggacguuggaucgc

SEQ ID NO: 142928 - RNA, 22 nt, Human
aggggaagagugagguuuuggu

SEQ ID NO: 142929 - RNA, 22 nt, Human
ugucccaucacagaggagacua

SEQ ID NO: 142930 - RNA, 23 nt, Human
aggcugccacucagggugaggcu

SEQ ID NO: 142931 - RNA, 22 nt, Human
ccagcaggagacuagcaacaua

SEQ ID NO: 142932 - RNA, 22 nt, Human
acaaggaagaaaacauuacuuu

SEQ ID NO: 142933 - RNA, 22 nt, Human
ucccagaaccuuuuagcuucac

SEQ ID NO: 142934 - RNA, 23 nt, Human
uuucugaguuuuuuaaaagucca

SEQ ID NO: 142935 - RNA, 17 nt, Human
cccugcacccuacucuc

SEQ ID NO: 142936 - RNA, 22 nt, Human
cacaauuuccauugagcagcag

SEQ ID NO: 142937 - RNA, 22 nt, Human
uccccugccccccauccucugg

SEQ ID NO: 142938 - RNA, 22 nt, Human
auguauauauacauguauugua

SEQ ID NO: 142939 - RNA, 20 nt, Human
agcuuucaccaguacuucca

SEQ ID NO: 142940 - RNA, 22 nt, Human
aaguauuccccaaguauucugg

SEQ ID NO: 142941 - RNA, 21 nt, Human
agcaucugaggcaguuuccua

SEQ ID NO: 142942 - RNA, 22 nt, Human
auuaaaaaaagauaaugaguua

SEQ ID NO: 142943 - RNA, 22 nt, Human
augguguaagacuguauuucuu

SEQ ID NO: 142944 - RNA, 22 nt, Human
aauuagaagcuguuagcaaaau

SEQ ID NO: 142945 - RNA, 22 nt, Human
aggccacucagggggccaagau

SEQ ID NO: 142946 - RNA, 22 nt, Human
acauccagcagauuguccagag

SEQ ID NO: 142947 - RNA, 22 nt, Human
ggcagguccugaguccugaggc

SEQ ID NO: 142948 - RNA, 20 nt, Human
uccaguuuuggagacauucu

SEQ ID NO: 142949 - RNA, 22 nt, Human
uaagcuauuccugaagaagguu

SEQ ID NO: 142950 - RNA, 22 nt, Human
uugcugugucauuuguuuaauc

SEQ ID NO: 142951 - RNA, 22 nt, Human
guuuuaaucuccuuauuccuaa

SEQ ID NO: 142952 - RNA, 22 nt, Human
uuuauuuuccaugucucuaggu

SEQ ID NO: 142953 - RNA, 22 nt, Human
cugaaagacagccaggcaaagc

SEQ ID NO: 142954 - RNA, 22 nt, Human
uuuguuugcuaguauuuuguuu

SEQ ID NO: 142955 - RNA, 22 nt, Human
uuuaaugaugucuaugccuguu

SEQ ID NO: 142956 - RNA, 22 nt, Human
aaaaauuucuggugaaaugccu

SEQ ID NO: 142957 - RNA, 22 nt, Human
uuguacuuaaauaugcaaauag

SEQ ID NO: 142958 - RNA, 22 nt, Human
aagauauauaaggaaguucagu

SEQ ID NO: 142959 - RNA, 22 nt, Human
aaaagguuauagcuuugccuug

SEQ ID NO: 142960 - RNA, 22 nt, Human
caauguuuuuccuuccuuaaua

SEQ ID NO: 142961 - RNA, 19 nt, Human
ugaguacuaaugagauuga

SEQ ID NO: 142962 - RNA, 22 nt, Human
aguauuuaguauucuauauuag

SEQ ID NO: 142963 - RNA, 22 nt, Human
ccuggaccgacacaggaaggga

SEQ ID NO: 142964 - RNA, 23 nt, Human
ugcuuugauuauuauucccaccu

SEQ ID NO: 142965 - RNA, 22 nt, Human
aaucacuggcuccucacggcaa

SEQ ID NO: 142966 - RNA, 17 nt, Human
guucucaaacugacuga

SEQ ID NO: 142967 - RNA, 22 nt, Human
gggacaggacuccuggggccug

SEQ ID NO: 142968 - RNA, 23 nt, Human
uccugcagauaagcugguugaca

SEQ ID NO: 142969 - RNA, 21 nt, Human
uucugcuguucaccaccaccc

SEQ ID NO: 142970 - RNA, 22 nt, Human
uggcucagcgcggccuggucuu

SEQ ID NO: 142971 - RNA, 22 nt, Human
accuuuggaggacuagggucau

SEQ ID NO: 142972 - RNA, 19 nt, Human
ugccuggcaccagcuccac

SEQ ID NO: 142973 - RNA, 22 nt, Human
ucccagaacggguucuucccag

SEQ ID NO: 142974 - RNA, 22 nt, Human
uuuguuuccagccuuuugucuu

SEQ ID NO: 142975 - RNA, 22 nt, Human
aaaaccugcaagaugaaaucag

SEQ ID NO: 142976 - RNA, 22 nt, Human
cagaaacacuguauuuagggaa

SEQ ID NO: 142977 - RNA, 22 nt, Human
acuuugugaauagaacuggaug

SEQ ID NO: 142978 - RNA, 22 nt, Human
ucugaguuaaaauuccagaggu

SEQ ID NO: 142979 - RNA, 22 nt, Human
agaagaaugguuugaaagauuu

SEQ ID NO: 142980 - RNA, 22 nt, Human
acuucccacugcagugacugag

SEQ ID NO: 142981 - RNA, 22 nt, Human
ccagcaaguaagucagugucag

SEQ ID NO: 142982 - RNA, 22 nt, Human
agccagcauauauauaguugaa

SEQ ID NO: 142983 - RNA, 22 nt, Human
auaaaaauguuuuuguguggua

SEQ ID NO: 142984 - RNA, 22 nt, Human
guggcuggguggaacugagucu

SEQ ID NO: 142985 - RNA, 22 nt, Human
ggcugugaaguacguugaaggu

SEQ ID NO: 142986 - RNA, 22 nt, Human
gcugggucucucccugguccug

SEQ ID NO: 142987 - RNA, 22 nt, Human
cauaucuccagguucugcugga

SEQ ID NO: 142988 - RNA, 22 nt, Human
cauuuaaccccuugguacugaa

SEQ ID NO: 142989 - RNA, 22 nt, Human
gagcaggucucaguucugccuc

SEQ ID NO: 142990 - RNA, 22 nt, Human
auucauuuuuacaucaccaaua

SEQ ID NO: 142991 - RNA, 22 nt, Human
guuuugugugugugcccacacg

SEQ ID NO: 142992 - RNA, 21 nt, Human
uucuauauugagaauuggcua

SEQ ID NO: 142993 - RNA, 23 nt, Human
uuuuaauaguaugacaugagcug

SEQ ID NO: 142994 - RNA, 22 nt, Human
ugaacuguccuuguugucuaga

SEQ ID NO: 142995 - RNA, 22 nt, Human
auuuuuuuuccugucucuuuca

SEQ ID NO: 142996 - RNA, 22 nt, Human
ggcuagggagacagagggcaug

SEQ ID NO: 142997 - RNA, 22 nt, Human
auauuuuugcagaauuuuucgu

SEQ ID NO: 142998 - RNA, 22 nt, Human
acucauucgccuugcccaaggc

SEQ ID NO: 142999 - RNA, 22 nt, Human
ugagaccuaaaccgucuguccu

SEQ ID NO: 143000 - RNA, 22 nt, Human
uggaugagugaauggauaaauc

SEQ ID NO: 143001 - RNA, 22 nt, Human
cauuugcuuaucacucuucuuu

SEQ ID NO: 143002 - RNA, 22 nt, Human
auuaaaaaugagaguagggauu

SEQ ID NO: 143003 - RNA, 22 nt, Human
auugauuuugugcuuuccuacg

SEQ ID NO: 143004 - RNA, 22 nt, Human
uuuuuauaagagcagcagaguu

SEQ ID NO: 143005 - RNA, 22 nt, Human
cacuguugagcaauguacagug

SEQ ID NO: 143006 - RNA, 22 nt, Human
guuuacaacaucuuguccuuca

SEQ ID NO: 143007 - RNA, 22 nt, Human
uaucuguagucucaugguuccu

SEQ ID NO: 143008 - RNA, 22 nt, Human
ugccaguaauuguccuguagcu

SEQ ID NO: 143009 - RNA, 22 nt, Human
aguucauccucauuuacaagga

SEQ ID NO: 143010 - RNA, 22 nt, Human
uuucuaaaauuacugcagucgg

SEQ ID NO: 143011 - RNA, 22 nt, Human
ccugucugaaggcagggggaug

SEQ ID NO: 143012 - RNA, 22 nt, Human
ccaaagaauuuggaaaaucuga

SEQ ID NO: 143013 - RNA, 22 nt, Human
uuuuuaauuuuaagcuauuugu

SEQ ID NO: 143014 - RNA, 22 nt, Human
aguggagguuacagcuguacau

SEQ ID NO: 143015 - RNA, 21 nt, Human
ccugagucccccagacccugg

SEQ ID NO: 143016 - RNA, 22 nt, Human
agugaagauagagccaggucug

SEQ ID NO: 143017 - RNA, 22 nt, Human
gcccuggucguggagggcaaca

SEQ ID NO: 143018 - RNA, 22 nt, Human
aagacagugacagucacaauug

SEQ ID NO: 143019 - RNA, 22 nt, Human
aagcagaaaaacugagcuccaa

SEQ ID NO: 143020 - RNA, 22 nt, Human
ggugucucagauuguaaaaugu

SEQ ID NO: 143021 - RNA, 22 nt, Human
gccugggcuuccgggacccggg

SEQ ID NO: 143022 - RNA, 22 nt, Human
guauuauauaaccauugguucu

SEQ ID NO: 143023 - RNA, 22 nt, Human
acagucuuggauuccaggaguc

SEQ ID NO: 143024 - RNA, 22 nt, Human
aagccuccgugcugcuggaucu

SEQ ID NO: 143025 - RNA, 22 nt, Human
ggaggccccccaugcagcucca

SEQ ID NO: 143026 - RNA, 22 nt, Human
gaguaaaagaugaggcaguaga

SEQ ID NO: 143027 - RNA, 22 nt, Human
acauuuuuggguugaugucuga

SEQ ID NO: 143028 - RNA, 22 nt, Human
auggagugggaggacaugaagg

SEQ ID NO: 143029 - RNA, 22 nt, Human
uaggucugaggcugcaucuugg

SEQ ID NO: 143030 - RNA, 22 nt, Human
gcugcagggagcuggaaggcuc

SEQ ID NO: 143031 - RNA, 22 nt, Human
cugccacuaccaugcuggauga

SEQ ID NO: 143032 - RNA, 22 nt, Human
aggggaggggaguaucaggauu

SEQ ID NO: 143033 - RNA, 21 nt, Human
ugaagcccugugaggugcuua

SEQ ID NO: 143034 - RNA, 22 nt, Human
ccucuccuugcuccccuuccuu

SEQ ID NO: 143035 - RNA, 22 nt, Human
agaauacaauuguucaguaaua

SEQ ID NO: 143036 - RNA, 22 nt, Human
aagaugcuucaugagaguuggg

SEQ ID NO: 143037 - RNA, 22 nt, Human
uuugauuuuguuuauagugccg

SEQ ID NO: 143038 - RNA, 22 nt, Human
gccugggccgggcgcggccccc

SEQ ID NO: 143039 - RNA, 22 nt, Human
acugcauuaucaccaagaugua

SEQ ID NO: 143040 - RNA, 22 nt, Human
agaguguguggggcugagguca

SEQ ID NO: 143041 - RNA, 23 nt, Human
aggcagcaugcaacaggccauuu

SEQ ID NO: 143042 - RNA, 22 nt, Human
auacuaagcucauuacauuuug

SEQ ID NO: 143043 - RNA, 22 nt, Human
uucuuauuuuucguaaauccug

SEQ ID NO: 143044 - RNA, 22 nt, Human
cauauuaugcauguuguucuuu

SEQ ID NO: 143045 - RNA, 22 nt, Human
aacugguaauuuaguauuacug

SEQ ID NO: 143046 - RNA, 22 nt, Human
aggagaaagaccagccugccga

SEQ ID NO: 143047 - RNA, 22 nt, Human
uuagaaauguccuacuaauaug

SEQ ID NO: 143048 - RNA, 22 nt, Human
ucccaaguguuuggcgaggaga

SEQ ID NO: 143049 - RNA, 22 nt, Human
ucauaaguuguugacuagcaaa

SEQ ID NO: 143050 - RNA, 21 nt, Human
uggguccuuggucuaguuuuc

SEQ ID NO: 143051 - RNA, 22 nt, Mycobacterium leprae
uugugcggguggugucgaugcc

SEQ ID NO: 143052 - RNA, 20 nt, Mycobacterium leprae
cgccacucuaagucaccgac

SEQ ID NO: 143053 - RNA, 22 nt, Mycobacterium leprae
uuccgcuggguggcagugugug

SEQ ID NO: 143054 - RNA, 23 nt, Mycobacterium leprae
gcgacggcuuuggcgaugucugg

SEQ ID NO: 143055 - RNA, 22 nt, Mycobacterium leprae
aucagcaugaacgcggucguca

SEQ ID NO: 143056 - RNA, 22 nt, Mycobacterium leprae
ucgacgcagcgguugggggcaa

SEQ ID NO: 143057 - RNA, 22 nt, Mycobacterium leprae
gaucaguaccgaaagcgcgcag

SEQ ID NO: 143058 - RNA, 22 nt, Mycobacterium leprae
agucgagaucaacguuuugccg

SEQ ID NO: 143059 - RNA, 22 nt, Mycobacterium leprae
ucauccuggaaaacgaaauguu

SEQ ID NO: 143060 - RNA, 22 nt, Mycobacterium leprae
uggcggcguuguugcuggggcu

SEQ ID NO: 143061 - RNA, 22 nt, Mycobacterium leprae
uggacggcaucgcgguauucga

SEQ ID NO: 143062 - RNA, 22 nt, Mycobacterium leprae
accgcucccuuaagcacgguga

SEQ ID NO: 143063 - RNA, 22 nt, Mycobacterium leprae
uaugcgauccaaacugucuuga

SEQ ID NO: 143064 - RNA, 22 nt, Mycobacterium leprae
cgggguuucgucgcgccagcag

SEQ ID NO: 143065 - RNA, 22 nt, Mycobacterium leprae
gccccgucgugugcgaucucgu

SEQ ID NO: 143066 - RNA, 22 nt, Mycobacterium leprae
cggugguggucaauuuccugcu

SEQ ID NO: 143067 - RNA, 22 nt, Mycobacterium leprae
gcacgagcucaggggucaacuc

SEQ ID NO: 143068 - RNA, 22 nt, Mycobacterium leprae
gcagaagcagccgguaugucag

SEQ ID NO: 143069 - RNA, 22 nt, Mycobacterium leprae
aucgccauacucgaggcggcgu

SEQ ID NO: 143070 - RNA, 22 nt, Mycobacterium leprae
ucgauuucgcugaaucuggcaa

SEQ ID NO: 143071 - RNA, 22 nt, Mycobacterium leprae
gcucgguguugcggacuucauc

SEQ ID NO: 143072 - RNA, 20 nt, Mycobacterium leprae
gucguacgcaauucaugcuc

SEQ ID NO: 143073 - RNA, 22 nt, Mycobacterium leprae
acaccacauccuauugggcugc

SEQ ID NO: 143074 - RNA, 22 nt, Mycobacterium leprae
ggcugacaguugcaugagaagg

SEQ ID NO: 143075 - RNA, 22 nt, Mycobacterium leprae
ucgucgguugagucaugccuau

SEQ ID NO: 143076 - RNA, 22 nt, Mycobacterium leprae
cgccgugaccggaucccgauca

SEQ ID NO: 143077 - RNA, 22 nt, Mycobacterium leprae
cagcgccggugcagucaugccg

SEQ ID NO: 143078 - RNA, 22 nt, Mycobacterium leprae
acagucugacauagccuaccgg

SEQ ID NO: 143079 - RNA, 19 nt, Mycobacterium leprae
gccaguacuccaguuguuu

SEQ ID NO: 143080 - RNA, 22 nt, Mycobacterium leprae
ucgacgucgacgagaaguucug

SEQ ID NO: 143081 - RNA, 22 nt, Mycobacterium leprae
acagcggaugcaagcugaugug

SEQ ID NO: 143082 - RNA, 22 nt, Mycobacterium leprae
agcaccgcauuggucaacgugu

SEQ ID NO: 143083 - RNA, 22 nt, Mycobacterium leprae
ugguuggguuacuggcuggcgu

SEQ ID NO: 143084 - RNA, 22 nt, Mycobacterium leprae
ugugggcaucccguauagaugu

SEQ ID NO: 143085 - RNA, 22 nt, Mycobacterium leprae
ugcgguucuguguagccgauag

SEQ ID NO: 143086 - RNA, 22 nt, Mycobacterium leprae
cgauaagcggaugacggugcug

SEQ ID NO: 143087 - RNA, 22 nt, Mycobacterium leprae
gguagacaucgacgcgcacauc

SEQ ID NO: 143088 - RNA, 22 nt, Mycobacterium leprae
accugcuuggcugacgagguuu

SEQ ID NO: 143089 - RNA, 22 nt, Mycobacterium leprae
aggaucgauucgccacaaucug

SEQ ID NO: 143090 - RNA, 22 nt, Mycobacterium leprae
uggccgguccggcaaagccgaa

SEQ ID NO: 143091 - RNA, 22 nt, Mycobacterium leprae
ccgggucgagacggcuuucagg

SEQ ID NO: 143092 - RNA, 22 nt, Mycobacterium leprae
cacaguucgacuccacggccga

SEQ ID NO: 143093 - RNA, 22 nt, Mycobacterium leprae
gugguugcugacagcacugaug

SEQ ID NO: 143094 - RNA, 22 nt, Mycobacterium leprae
gcugggcggauacuagucgggc

SEQ ID NO: 143095 - RNA, 22 nt, Mycobacterium leprae
cggaaacugacgcaccuuggca

SEQ ID NO: 143096 - RNA, 22 nt, Mycobacterium leprae
gugugagcggcgaucagcagua

SEQ ID NO: 143097 - RNA, 22 nt, Mycobacterium leprae
aggcccuccuuggaggugucgg

SEQ ID NO: 143098 - RNA, 20 nt, Mycobacterium leprae
agcagugggcccaguggcuu

SEQ ID NO: 143099 - RNA, 22 nt, Mycobacterium leprae
ucgagcuguucucaacaucuac

SEQ ID NO: 143100 - RNA, 22 nt, Mycobacterium leprae
agcgacaccauagccgccauga

SEQ ID NO: 143101 - RNA, 22 nt, Mycobacterium leprae
uuggugaugcagucgagaauuu

SEQ ID NO: 143102 - RNA, 19 nt, Mycobacterium leprae
gccucagacaucagcagcu

SEQ ID NO: 143103 - RNA, 20 nt, Mycobacterium leprae
acgcccgcgcaguggccgcu

SEQ ID NO: 143104 - RNA, 22 nt, Mycobacterium leprae
accgcccugaucgauggcgaug

SEQ ID NO: 143105 - RNA, 22 nt, Mycobacterium leprae
cccgaucaguggucggccuggc

SEQ ID NO: 143106 - RNA, 22 nt, Mycobacterium leprae
gagauauaccgcaucgacgacg

SEQ ID NO: 143107 - RNA, 22 nt, Mycobacterium leprae
ugacgucagcuaccguccuggu

SEQ ID NO: 143108 - RNA, 22 nt, Mycobacterium leprae
gcaacgugcacgcgcuggugca

SEQ ID NO: 143109 - RNA, 22 nt, Mycobacterium leprae
uuccgcacaccggugcgacugc

SEQ ID NO: 143110 - RNA, 22 nt, Mycobacterium leprae
aucugcugcuagcauugucguu

SEQ ID NO: 143111 - RNA, 21 nt, Mycobacterium leprae
gguggcguugagcgaggacau

SEQ ID NO: 143112 - RNA, 20 nt, Mycobacterium leprae
ucuggacgaccacguuuggu

SEQ ID NO: 143113 - RNA, 22 nt, Mycobacterium leprae
ugccaacgguauuucggcgcga

SEQ ID NO: 143114 - RNA, 22 nt, Mycobacterium leprae
ucggucgacgggugcgcagucc

SEQ ID NO: 143115 - RNA, 22 nt, Mycobacterium leprae
ugacgcgaauggcuaggcugcu

SEQ ID NO: 143116 - RNA, 22 nt, Mycobacterium leprae
aaguucgguuuugucgguaacc

SEQ ID NO: 143117 - RNA, 22 nt, Mycobacterium leprae
cgugguggccgugaucgcgaca

SEQ ID NO: 143118 - RNA, 22 nt, Mycobacterium leprae
uucgcgcagguaacccucgacc

SEQ ID NO: 143119 - RNA, 22 nt, Mycobacterium leprae
ucgccaacggugaacgggccag

SEQ ID NO: 143120 - RNA, 22 nt, Mycobacterium leprae
ccgacugcaagagauauucgac

SEQ ID NO: 143121 - RNA, 22 nt, Mycobacterium leprae
acgaugcgguaccacucgaucg

SEQ ID NO: 143122 - RNA, 22 nt, Mycobacterium leprae
cggcuuguaccugugggccagc

SEQ ID NO: 143123 - RNA, 22 nt, Mycobacterium leprae
accggcucugguggucgccacc

SEQ ID NO: 143124 - RNA, 21 nt, Mycobacterium leprae
ccgcggugcuuagagacgucg

SEQ ID NO: 143125 - RNA, 22 nt, Mycobacterium leprae
caucgaaauccacggcagcaug

SEQ ID NO: 143126 - RNA, 22 nt, Mycobacterium leprae
ucgaacgugaagcgccuggccg

SEQ ID NO: 143127 - RNA, 22 nt, Mycobacterium leprae
guuguccgaugccaagcaaguu

SEQ ID NO: 143128 - RNA, 20 nt, Mycobacterium leprae
aacacugagaauucuaccgc

SEQ ID NO: 143129 - RNA, 22 nt, Mycobacterium leprae
cagccggugguggaaucggugu

SEQ ID NO: 143130 - RNA, 22 nt, Mycobacterium leprae
cagcaccuacgucgacgguauc

SEQ ID NO: 143131 - RNA, 22 nt, Mycobacterium leprae
uggucgguauguugucgucacc

SEQ ID NO: 143132 - RNA, 22 nt, Mycobacterium leprae
ggacugcgcacccgucgaccga

SEQ ID NO: 143133 - RNA, 22 nt, Mycobacterium leprae
uccguugccgggagauagcggc

SEQ ID NO: 143134 - RNA, 22 nt, Mycobacterium leprae
cauccguguugaaggccgcuga

SEQ ID NO: 143135 - RNA, 19 nt, Mycobacterium leprae
ugguccaguuacuggcccc

SEQ ID NO: 143136 - RNA, 22 nt, Mycobacterium leprae
ccggggguggaguuccguaccu

SEQ ID NO: 143137 - RNA, 20 nt, Mycobacterium leprae
aguaccgaaagcgcgcauac

SEQ ID NO: 143138 - RNA, 22 nt, Mycobacterium leprae
cgcguggugaugacggccccgg

SEQ ID NO: 143139 - RNA, 22 nt, Mycobacterium leprae
gcggcgucagcugacaaaggcc

SEQ ID NO: 143140 - RNA, 22 nt, Mycobacterium leprae
acugcgaucgaccuccuuaccu

SEQ ID NO: 143141 - RNA, 22 nt, Mycobacterium leprae
aaaacugugcggcccggccauu

SEQ ID NO: 143142 - RNA, 22 nt, Mycobacterium leprae
uggcaagccuacggaauugggc

SEQ ID NO: 143143 - RNA, 22 nt, Mycobacterium leprae
ucggagaugaucaauaugcccg

SEQ ID NO: 143144 - RNA, 22 nt, Mycobacterium leprae
augcugucgcggagcuccgcgu

SEQ ID NO: 143145 - RNA, 22 nt, Mycobacterium leprae
gguucgugcacauggaaugggu

SEQ ID NO: 143146 - RNA, 22 nt, Mycobacterium leprae
cugguggauacucaacuguuua

SEQ ID NO: 143147 - RNA, 22 nt, Mycobacterium leprae
gccgaccauggcaaucgcauag

SEQ ID NO: 143148 - RNA, 22 nt, Mycobacterium leprae
ccggucggugaauaugguggcu

SEQ ID NO: 143149 - RNA, 22 nt, Mycobacterium leprae
cuggucguuucauugcagcggu

SEQ ID NO: 143150 - RNA, 22 nt, Mycobacterium leprae
ggucaugcgcuaauuguggcgg

SEQ ID NO: 143151 - RNA, 22 nt, Mycobacterium leprae
uugaucagacccgcgauuccgg

SEQ ID NO: 143152 - RNA, 21 nt, Mycobacterium leprae
ucgcuaguuggaugcagucga

SEQ ID NO: 143153 - RNA, 22 nt, Mycobacterium leprae
gagucggugucgaagcagccga

SEQ ID NO: 143154 - RNA, 22 nt, Mycobacterium leprae
cguuaugggguguaccgcaguu

SEQ ID NO: 143155 - RNA, 22 nt, Mycobacterium leprae
ggaggaucuuaugucagcagcu

SEQ ID NO: 143156 - RNA, 20 nt, Mycobacterium leprae
agcccggaucaccgaugcug

SEQ ID NO: 143157 - RNA, 22 nt, Mycobacterium leprae
auuggucgugaucacggugcug

SEQ ID NO: 143158 - RNA, 18 nt, Mycobacterium leprae
ggcagccggugcacuuug

SEQ ID NO: 143159 - RNA, 19 nt, Mycobacterium leprae
gcuggcccaggcaguagcg

SEQ ID NO: 143160 - RNA, 22 nt, Mycobacterium leprae
ugcuucgucaaggcgugaggca

SEQ ID NO: 143161 - RNA, 22 nt, Mycobacterium leprae
aucuugccgcccaucugucgcg

SEQ ID NO: 143162 - RNA, 19 nt, Mycobacterium leprae
ucgaccgccgagcagcuca

SEQ ID NO: 143163 - RNA, 22 nt, Mycobacterium leprae
cuggagacaccguaaccggagu

SEQ ID NO: 143164 - RNA, 22 nt, Mycobacterium leprae
aacucacagcuuuagcugcucu

SEQ ID NO: 143165 - RNA, 22 nt, Mycobacterium leprae
cgcacauggacagcgguucauu

SEQ ID NO: 143166 - RNA, 22 nt, Mycobacterium leprae
gcgcuggugcgcgcaucuugcu

SEQ ID NO: 143167 - RNA, 22 nt, Mycobacterium leprae
aggccguagucgacgacgccga

SEQ ID NO: 143168 - RNA, 23 nt, Mycobacterium leprae
ugaggucuugcaccuggcccggc

SEQ ID NO: 143169 - RNA, 22 nt, Mycobacterium leprae
cgcugggccaggcgcugucaga

SEQ ID NO: 143170 - RNA, 22 nt, Mycobacterium leprae
gguccagcgucagcgcagccau

SEQ ID NO: 143171 - RNA, 22 nt, Mycobacterium leprae
cggcgagauuugucguugcgag

SEQ ID NO: 143172 - RNA, 22 nt, Mycobacterium leprae
uucgggagaggaucagcgcugc

SEQ ID NO: 143173 - RNA, 22 nt, Mycobacterium leprae
ggcgauggcugacgcgaccgug

SEQ ID NO: 143174 - RNA, 22 nt, Mycobacterium leprae
gcagcaggccgccucgacuauc

SEQ ID NO: 143175 - RNA, 22 nt, Mycobacterium leprae
ucgaugaauucgguuuuucuau

SEQ ID NO: 143176 - RNA, 22 nt, Mycobacterium leprae
ccggcaguuggcugcgcagggg

SEQ ID NO: 143177 - RNA, 22 nt, Mycobacterium leprae
ggcgugugguuaaaggggucaa

SEQ ID NO: 143178 - RNA, 22 nt, Mycobacterium leprae
ccgcaaaacagacacggccgcc

SEQ ID NO: 143179 - RNA, 22 nt, Mycobacterium leprae
ucgaugaacaacguuacugcgg

SEQ ID NO: 143180 - RNA, 22 nt, Mycobacterium leprae
gugccaagcgguccugcugcug

SEQ ID NO: 143181 - RNA, 22 nt, Mycobacterium leprae
acccguuggagacugacgcugc

SEQ ID NO: 143182 - RNA, 22 nt, Mycobacterium leprae
ucgaggcgcucaauccggagau

SEQ ID NO: 143183 - RNA, 22 nt, Mycobacterium leprae
ccaccgcugcuugcucugguuc

SEQ ID NO: 143184 - RNA, 22 nt, Mycobacterium leprae
cucggcuggccgucgguguagu

SEQ ID NO: 143185 - RNA, 22 nt, Mycobacterium leprae
cggucuccgacauguccugcua

SEQ ID NO: 143186 - RNA, 19 nt, Mycobacterium leprae
cggauucaucuguaucgcu

SEQ ID NO: 143187 - RNA, 22 nt, Mycobacterium leprae
cgggugacuugcaaucucugga

SEQ ID NO: 143188 - RNA, 22 nt, Mycobacterium leprae
gugugaugcccuauaccaccac

SEQ ID NO: 143189 - RNA, 22 nt, Mycobacterium leprae
guggcggcaaacaagcgcuggc

SEQ ID NO: 143190 - RNA, 22 nt, Mycobacterium leprae
augcgaugguagcggggcuggu

SEQ ID NO: 143191 - RNA, 20 nt, Mycobacterium leprae
cgcuggucacguggauccuc

SEQ ID NO: 143192 - RNA, 22 nt, Mycobacterium leprae
gucauaucgcuguuggcgauca

SEQ ID NO: 143193 - RNA, 22 nt, Mycobacterium leprae
cgcgcuugcgcucaucacuagc

SEQ ID NO: 143194 - RNA, 22 nt, Mycobacterium leprae
cgucauggcggcuauggugucg

SEQ ID NO: 143195 - RNA, 22 nt, Mycobacterium leprae
aucgugguuacaaugcacucgu

SEQ ID NO: 143196 - RNA, 20 nt, Mycobacterium leprae
accguucguuuugacaggug

SEQ ID NO: 143197 - RNA, 22 nt, Mycobacterium leprae
uugucagugacgucagggccgg

SEQ ID NO: 143198 - RNA, 22 nt, Mycobacterium leprae
gcgagugcuugaccagaagcga

SEQ ID NO: 143199 - RNA, 22 nt, Mycobacterium leprae
auggcggcaugcacucgcugug

SEQ ID NO: 143200 - RNA, 22 nt, Mycobacterium leprae
ucgccgcaaaucuagucgucca

SEQ ID NO: 143201 - RNA, 22 nt, Mycobacterium leprae
augguugguggucuggcaggca

SEQ ID NO: 143202 - RNA, 22 nt, Mycobacterium leprae
ucaaucacuucggagcuugauc

SEQ ID NO: 143203 - RNA, 22 nt, Mycobacterium leprae
aacgcauccggaugagacagag

SEQ ID NO: 143204 - RNA, 22 nt, Mycobacterium leprae
aacgcaucaaggucaucgaacg

SEQ ID NO: 143205 - RNA, 22 nt, Mycobacterium leprae
cuucggcgagcaguuagucgaa

SEQ ID NO: 143206 - RNA, 20 nt, Mycobacterium leprae
cacaugucgcaaguagccua

SEQ ID NO: 143207 - RNA, 21 nt, Mycobacterium leprae
auguuggcgucgauuucgaug

SEQ ID NO: 143208 - RNA, 22 nt, Mycobacterium leprae
gaggccgacgugcgcggucugc

SEQ ID NO: 143209 - RNA, 22 nt, Mycobacterium leprae
cugaccgcaaagacuuuccgag

SEQ ID NO: 143210 - RNA, 22 nt, Mycobacterium leprae
gacaauuuuuugcucaugucuc

SEQ ID NO: 143211 - RNA, 22 nt, Mycobacterium leprae
guaugcugucgacgucuucggu

SEQ ID NO: 143212 - RNA, 22 nt, Mycobacterium leprae
agcgccgcugguccagcgguua

SEQ ID NO: 143213 - RNA, 22 nt, Mycobacterium leprae
auggugugacugguccgagcug

SEQ ID NO: 143214 - RNA, 22 nt, Mycobacterium leprae
agggcggaauuccaucgaggua

SEQ ID NO: 143215 - RNA, 22 nt, Mycobacterium leprae
ucgacccaagcugcgggcugcc

SEQ ID NO: 143216 - RNA, 22 nt, Mycobacterium leprae
agcguguuauaauuagccaacg

SEQ ID NO: 143217 - RNA, 22 nt, Mycobacterium leprae
ugaccggugagucgggucgccg

SEQ ID NO: 143218 - RNA, 22 nt, Mycobacterium leprae
agcgacuguacgucgucggugu

SEQ ID NO: 143219 - RNA, 22 nt, Mycobacterium leprae
uucgccgccgggccugucgcag

SEQ ID NO: 143220 - RNA, 20 nt, Mycobacterium leprae
uugccgcccuugaccggugg

SEQ ID NO: 143221 - RNA, 22 nt, Mycobacterium leprae
agcacggucggugucauccagu

SEQ ID NO: 143222 - RNA, 22 nt, Mycobacterium leprae
accucgguggauuucgauacua

SEQ ID NO: 143223 - RNA, 22 nt, Mycobacterium leprae
augccggugacccgcuuugcgg

SEQ ID NO: 143224 - RNA, 22 nt, Mycobacterium leprae
aacgucuuugucugggcguuca

SEQ ID NO: 143225 - RNA, 22 nt, Mycobacterium leprae
accucggcgaucuguaguccaa

SEQ ID NO: 143226 - RNA, 22 nt, Mycobacterium leprae
cgcgucaacacaccggauauau

SEQ ID NO: 143227 - RNA, 22 nt, Mycobacterium leprae
ugaccgcgccggcgacgugcug

SEQ ID NO: 143228 - RNA, 22 nt, Mycobacterium leprae
gucaccgagcaacucaaucgaa

SEQ ID NO: 143229 - RNA, 22 nt, Mycobacterium leprae
gucagccaaguuccuagauuga

SEQ ID NO: 143230 - RNA, 22 nt, Mycobacterium leprae
ccuacgcccgcucaguuaucuu

SEQ ID NO: 143231 - RNA, 22 nt, Mycobacterium leprae
aucuguccauuguugaucgggu

SEQ ID NO: 143232 - RNA, 22 nt, Mycobacterium leprae
acucggcacguaaguugaacag

SEQ ID NO: 143233 - RNA, 22 nt, Mycobacterium leprae
ugguguucguggcugcgcauca

SEQ ID NO: 143234 - RNA, 22 nt, Mycobacterium leprae
gguuucuggcguuuugucagcg

SEQ ID NO: 143235 - RNA, 22 nt, Mycobacterium leprae
ccgaaguugcggugguuccgcg

SEQ ID NO: 143236 - RNA, 22 nt, Mycobacterium leprae
cuugcccgggaucggcgcccac

SEQ ID NO: 143237 - RNA, 22 nt, Mycobacterium leprae
ccacaaacccgucaucgcgcau

SEQ ID NO: 143238 - RNA, 22 nt, Mycobacterium leprae
aucgcccuggccugauugauca

SEQ ID NO: 143239 - RNA, 22 nt, Mycobacterium leprae
ucuccgaccgcugugccaauga

SEQ ID NO: 143240 - RNA, 22 nt, Mycobacterium leprae
accgggaaugcacgaugccuaa

SEQ ID NO: 143241 - RNA, 23 nt, Mycobacterium leprae
cugcccaacccugccuuugccga

SEQ ID NO: 143242 - RNA, 22 nt, Mycobacterium leprae
gcgggcggcgugauauccgccg

SEQ ID NO: 143243 - RNA, 22 nt, Mycobacterium leprae
cguucgagguugccgaugcggu

SEQ ID NO: 143244 - RNA, 22 nt, Mycobacterium leprae
aacgaccgcagauugacuucga

SEQ ID NO: 143245 - RNA, 22 nt, Mycobacterium leprae
gucuggcggccucgucggugua

SEQ ID NO: 143246 - RNA, 22 nt, Mycobacterium leprae
uuucggcggggccaaucagcgu

SEQ ID NO: 143247 - RNA, 21 nt, Mycobacterium leprae
aaccacugucgaccacugcgg

SEQ ID NO: 143248 - RNA, 22 nt, Mycobacterium leprae
ugagggccaaacugacccaggc

SEQ ID NO: 143249 - RNA, 22 nt, Mycobacterium leprae
acccgcgggcgugaugcuguca

SEQ ID NO: 143250 - RNA, 22 nt, Mycobacterium leprae
cguguugugcgguucgaccguu

SEQ ID NO: 143251 - RNA, 22 nt, Mycobacterium leprae
cgauggguuuacggugcauacc

SEQ ID NO: 143252 - RNA, 22 nt, Mycobacterium leprae
gcccucuccugaggacaucgac

SEQ ID NO: 143253 - RNA, 22 nt, Mycobacterium leprae
uuggccacgaaucugugcgcca

SEQ ID NO: 143254 - RNA, 22 nt, Mycobacterium leprae
ccucggcucuauaccgguuugu

SEQ ID NO: 143255 - RNA, 22 nt, Mycobacterium leprae
uucaguacagcgucccggugag

SEQ ID NO: 143256 - RNA, 22 nt, Mycobacterium leprae
ccugggcacaguggaugucgcg

SEQ ID NO: 143257 - RNA, 22 nt, Mycobacterium leprae
gcucgguggagagguaucgaug

SEQ ID NO: 143258 - RNA, 22 nt, Mycobacterium leprae
guggcgaugucggucggucggc

SEQ ID NO: 143259 - RNA, 20 nt, Mycobacterium leprae
ucggcgacguagugauuuuc

SEQ ID NO: 143260 - RNA, 22 nt, Mycobacterium leprae
cuugcgaaccgugccgccgaaa

SEQ ID NO: 143261 - RNA, 22 nt, Mycobacterium leprae
uggccgcuggcggacaguuguc

SEQ ID NO: 143262 - RNA, 22 nt, Mycobacterium leprae
uugcggcgggugguugaccgcg

SEQ ID NO: 143263 - RNA, 22 nt, Mycobacterium leprae
augcgcgcuuucgguacugauc

SEQ ID NO: 143264 - RNA, 22 nt, Mycobacterium leprae
ucagcguguuaucgccuuuggc

SEQ ID NO: 143265 - RNA, 22 nt, Mycobacterium leprae
acggaacgaugcgauagcaacg

SEQ ID NO: 143266 - RNA, 22 nt, Mycobacterium leprae
gauguucuccugauauuucugc

SEQ ID NO: 143267 - RNA, 22 nt, Mycobacterium leprae
ugauggcgguauguaauguugg

SEQ ID NO: 143268 - RNA, 23 nt, Mycobacterium leprae
gauuggccgagacgaugacggug

SEQ ID NO: 143269 - RNA, 22 nt, Mycobacterium leprae
ugccucugccgucaguuugcug

SEQ ID NO: 143270 - RNA, 22 nt, Mycobacterium leprae
gaacugaccgcgaccgucauca

SEQ ID NO: 143271 - RNA, 22 nt, Mycobacterium leprae
gcucggaugggccugcagcgac

SEQ ID NO: 143272 - RNA, 22 nt, Mycobacterium leprae
acugaugcagugagcuuuaccg

SEQ ID NO: 143273 - RNA, 22 nt, Mycobacterium leprae
uggugaccagccagcggcuauu

SEQ ID NO: 143274 - RNA, 22 nt, Mycobacterium leprae
uaucccagugauguggccuucg

SEQ ID NO: 143275 - RNA, 22 nt, Mycobacterium leprae
gcgcgagcgccugcguagguua

SEQ ID NO: 143276 - RNA, 21 nt, Mycobacterium leprae
cgccaccaguagcaccgcugu

SEQ ID NO: 143277 - RNA, 20 nt, Mycobacterium leprae
guucaugagcgucggacauu

SEQ ID NO: 143278 - RNA, 22 nt, Mycobacterium leprae
cgcagaaaaauggucaagaauc

SEQ ID NO: 143279 - RNA, 22 nt, Mycobacterium leprae
uuuuucgccggacagucgcuuc

SEQ ID NO: 143280 - RNA, 22 nt, Mycobacterium leprae
gugcugaguacaacgcagucgu

SEQ ID NO: 143281 - RNA, 19 nt, Mycobacterium leprae
cgccgcggaccugauaggc

SEQ ID NO: 143282 - RNA, 22 nt, Mycobacterium leprae
cgaaggaaugcaggcuucaguc

SEQ ID NO: 143283 - RNA, 22 nt, Mycobacterium leprae
gguagcugcuaaggacaugacg

SEQ ID NO: 143284 - RNA, 20 nt, Mycobacterium leprae
cucggccucgacgcgcgccu

SEQ ID NO: 143285 - RNA, 22 nt, Mycobacterium leprae
uggcggccuuuagugucgguga

SEQ ID NO: 143286 - RNA, 22 nt, Mycobacterium leprae
gcguaggugaccaccgcgaucc

SEQ ID NO: 143287 - RNA, 22 nt, Mycobacterium leprae
cucaccaaaggcuucgcguucu

SEQ ID NO: 143288 - RNA, 22 nt, Mycobacterium leprae
ggucgauggugcggucgcugau

SEQ ID NO: 143289 - RNA, 22 nt, Mycobacterium leprae
uagguagauugucuccaggcag

SEQ ID NO: 143290 - RNA, 22 nt, Mycobacterium leprae
agcgcaucacuucagcgacagg

SEQ ID NO: 143291 - RNA, 22 nt, Mycobacterium leprae
uguuaggucuagcggacauuga

SEQ ID NO: 143292 - RNA, 22 nt, Mycobacterium leprae
gacgaucggauaggugacguac

SEQ ID NO: 143293 - RNA, 22 nt, Mycobacterium leprae
aacgacucgguguaugagcuaa

SEQ ID NO: 143294 - RNA, 22 nt, Mycobacterium leprae
ccgcagcuucgauauaucgaau

SEQ ID NO: 143295 - RNA, 22 nt, Mycobacterium leprae
cucgaugucauccggauagugg

SEQ ID NO: 143296 - RNA, 22 nt, Mycobacterium leprae
aggcuaucguuucggcugcgau

SEQ ID NO: 143297 - RNA, 22 nt, Mycobacterium leprae
aucgacgaccugauuggcgaaa

SEQ ID NO: 143298 - RNA, 22 nt, Mycobacterium leprae
ggugcggacagucaaucgcgug

SEQ ID NO: 143299 - RNA, 22 nt, Mycobacterium leprae
cggucguguaguuuucgcggga

SEQ ID NO: 143300 - RNA, 22 nt, Mycobacterium leprae
ugaugucuguaacauuucugua

SEQ ID NO: 143301 - RNA, 22 nt, Mycobacterium leprae
guggugcugcuagucgacgauu

SEQ ID NO: 143302 - RNA, 22 nt, Mycobacterium leprae
ugaacgcucggccauagacgug

SEQ ID NO: 143303 - RNA, 22 nt, Mycobacterium leprae
uaggcgugguguucggguuggc

SEQ ID NO: 143304 - RNA, 22 nt, Mycobacterium leprae
ugggaugcccgaugcuguuugg

SEQ ID NO: 143305 - RNA, 22 nt, Mycobacterium leprae
cgacgacuuugggggcugaccu

SEQ ID NO: 143306 - RNA, 22 nt, Mycobacterium leprae
uuuggccaacuugaccaucauu

SEQ ID NO: 143307 - RNA, 23 nt, Mycobacterium leprae
ggcugcgugcugauagcgacgcc

SEQ ID NO: 143308 - RNA, 22 nt, Mycobacterium leprae
guccaacggcaugaccgcgccu

SEQ ID NO: 143309 - RNA, 22 nt, Mycobacterium leprae
gagcucugcugguugaguuuug

SEQ ID NO: 143310 - RNA, 22 nt, Mycobacterium leprae
cgauggugcgucggugaucacc

SEQ ID NO: 143311 - RNA, 22 nt, Mycobacterium leprae
uucgggguguucuuuggcaugc

SEQ ID NO: 143312 - RNA, 22 nt, Mycobacterium leprae
caucccguccaguacaccagca

SEQ ID NO: 143313 - RNA, 20 nt, Mycobacterium leprae
cgcugcacaccugcugcugg

SEQ ID NO: 143314 - RNA, 22 nt, Mycobacterium leprae
guugguggcguagugacucgcu

SEQ ID NO: 143315 - RNA, 22 nt, Mycobacterium leprae
augagcacgggaggcuggcgaa

SEQ ID NO: 143316 - RNA, 22 nt, Mycobacterium leprae
acccucgacauccucagcaaug

SEQ ID NO: 143317 - RNA, 22 nt, Mycobacterium leprae
aaugauggucguugccgauaac

SEQ ID NO: 143318 - RNA, 22 nt, Mycobacterium leprae
uguucgcauauaaacauguguu

SEQ ID NO: 143319 - RNA, 22 nt, Mycobacterium leprae
guuugcgguaugcguugcgcca

SEQ ID NO: 143320 - RNA, 22 nt, Mycobacterium leprae
gacgauacgaaaccggucccug

SEQ ID NO: 143321 - RNA, 22 nt, Mycobacterium leprae
ugggacgucccgucacgagcaa

SEQ ID NO: 143322 - RNA, 22 nt, Mycobacterium leprae
cgcggcagguguuugccccgca

SEQ ID NO: 143323 - RNA, 22 nt, Mycobacterium leprae
ugcagcuggccaguucgaaagu

SEQ ID NO: 143324 - RNA, 22 nt, Mycobacterium leprae
ucggccgacauacgcuaccgca

SEQ ID NO: 143325 - RNA, 20 nt, Mycobacterium leprae
gucagcaucccggugguggc

SEQ ID NO: 143326 - RNA, 22 nt, Mycobacterium leprae
cugcgguaucugguccaacgau

SEQ ID NO: 143327 - RNA, 22 nt, Mycobacterium leprae
uuaugcgucauuagcggguacc

SEQ ID NO: 143328 - RNA, 23 nt, Mycobacterium leprae
agcaccggcccggcgcaucggag

SEQ ID NO: 143329 - RNA, 22 nt, Mycobacterium leprae
gcgauggugggaucgcagaagu

SEQ ID NO: 143330 - RNA, 22 nt, Mycobacterium leprae
gccgacgucgaaauccggcggc

SEQ ID NO: 143331 - RNA, 22 nt, Mycobacterium leprae
uucgaccgccgagcugguagcu

SEQ ID NO: 143332 - RNA, 22 nt, Mycobacterium leprae
uugguccgccauggcgcgggug

SEQ ID NO: 143333 - RNA, 19 nt, Mycobacterium leprae
aucgccgacugggcgcggu

SEQ ID NO: 143334 - RNA, 22 nt, Mycobacterium leprae
cugcuuggucaucaccguguuc

SEQ ID NO: 143335 - RNA, 22 nt, Mycobacterium leprae
aggcccagucgcugcugcuguc

SEQ ID NO: 143336 - RNA, 22 nt, Mycobacterium leprae
gccugacgaugauugcgguguu

SEQ ID NO: 143337 - RNA, 22 nt, Mycobacterium leprae
ugccacgaacccguggucgucg

SEQ ID NO: 143338 - RNA, 22 nt, Mycobacterium leprae
guacgcggccagguaucaggaa

SEQ ID NO: 143339 - RNA, 22 nt, Mycobacterium leprae
uggcggucucacggcugcgugu

SEQ ID NO: 143340 - RNA, 22 nt, Mycobacterium leprae
caaucguagauggccgccaagu

SEQ ID NO: 143341 - RNA, 22 nt, Mycobacterium leprae
gacggccgugccuguuugccgc

SEQ ID NO: 143342 - RNA, 22 nt, Mycobacterium leprae
ccaagcugcuccggucggugcu

SEQ ID NO: 143343 - RNA, 22 nt, Mycobacterium leprae
uggcguucaucggggggaguag

SEQ ID NO: 143344 - RNA, 22 nt, Mycobacterium leprae
ucagcgacaacccgguagcaag

SEQ ID NO: 143345 - RNA, 22 nt, Mycobacterium leprae
uggucggggucuaucuggaugc

SEQ ID NO: 143346 - RNA, 22 nt, Mycobacterium leprae
gcggcguggauguguugcuggc

SEQ ID NO: 143347 - RNA, 22 nt, Mycobacterium leprae
guacccgaucgucggcuaccag

SEQ ID NO: 143348 - RNA, 21 nt, Mycobacterium leprae
cacgaacguccuuggugucuu

SEQ ID NO: 143349 - RNA, 22 nt, Mycobacterium leprae
gccgcgauccgguucgccaugu

SEQ ID NO: 143350 - RNA, 22 nt, Mycobacterium leprae
agugauuccuugccuggacguc

SEQ ID NO: 143351 - RNA, 22 nt, Mycobacterium leprae
aagucgaucaccacagggcggu

SEQ ID NO: 143352 - RNA, 20 nt, Mycobacterium leprae
caauccagacggcaaucucg

SEQ ID NO: 143353 - RNA, 22 nt, Mycobacterium leprae
accaccaccagcaucccgcugc

SEQ ID NO: 143354 - RNA, 23 nt, Mycobacterium leprae
gcugucagcgguuacuucgacuc

SEQ ID NO: 143355 - RNA, 22 nt, Mycobacterium leprae
ccgcugcaggcgguuaggcucc

SEQ ID NO: 143356 - RNA, 22 nt, Mycobacterium leprae
cagcagcugaugcuuacgugcu

SEQ ID NO: 143357 - RNA, 22 nt, Mycobacterium leprae
uagcucgaucaugccaggcaag

SEQ ID NO: 143358 - RNA, 22 nt, Mycobacterium leprae
cuggcgauacuguucuugugau

SEQ ID NO: 143359 - RNA, 19 nt, Mycobacterium leprae
cggccagcuucacguucgc

SEQ ID NO: 143360 - RNA, 22 nt, Mycobacterium leprae
ggcgcgguuacuacuggugauu

SEQ ID NO: 143361 - RNA, 22 nt, Mycobacterium leprae
gccugcggugaccgaucuuguc

SEQ ID NO: 143362 - RNA, 22 nt, Mycobacterium leprae
ugugagugugcaggcagcgacg

SEQ ID NO: 143363 - RNA, 22 nt, Mycobacterium leprae
uucgacuuaguggcagguguug

SEQ ID NO: 143364 - RNA, 23 nt, Mycobacterium leprae
ucgcggaaaucaaucgcgcagcc

SEQ ID NO: 143365 - RNA, 22 nt, Mycobacterium leprae
gaggucggagucguaguccgca

SEQ ID NO: 143366 - RNA, 22 nt, Mycobacterium leprae
cucggcaugcucgccgaacuac

SEQ ID NO: 143367 - RNA, 22 nt, Mycobacterium leprae
gccagccagauucuccaucaag

SEQ ID NO: 143368 - RNA, 22 nt, Mycobacterium leprae
ucggcguggugagcaaucuggu

SEQ ID NO: 143369 - RNA, 22 nt, Mycobacterium leprae
agaaagucaggaacccagcgac

SEQ ID NO: 143370 - RNA, 22 nt, Mycobacterium leprae
cgugcgcugucgcuguucaucg

SEQ ID NO: 143371 - RNA, 22 nt, Mycobacterium leprae
aaauguucgaaguaguucgcgg

SEQ ID NO: 143372 - RNA, 22 nt, Mycobacterium leprae
ccuuguccaaacucgaggcgau

SEQ ID NO: 143373 - RNA, 22 nt, Mycobacterium leprae
uugaccgaugcugcugcccgag

SEQ ID NO: 143374 - RNA, 22 nt, Mycobacterium leprae
gugcgaucgucgccuacgcugg

SEQ ID NO: 143375 - RNA, 22 nt, Mycobacterium leprae
agcaacugccgggcuggcgaaa

SEQ ID NO: 143376 - RNA, 22 nt, Mycobacterium leprae
cggacguuugcaccuggugcug

SEQ ID NO: 143377 - RNA, 22 nt, Mycobacterium leprae
augcgucaacacaccggauaua

SEQ ID NO: 143378 - RNA, 22 nt, Mycobacterium leprae
gcgcagucguugaagccguugg

SEQ ID NO: 143379 - RNA, 22 nt, Mycobacterium leprae
cgcaucugagguugcagcgcau

SEQ ID NO: 143380 - RNA, 22 nt, Mycobacterium leprae
aggccaccgccggcgaagccgg

SEQ ID NO: 143381 - RNA, 22 nt, Mycobacterium leprae
aguugcugucgucuuggguggu

SEQ ID NO: 143382 - RNA, 22 nt, Mycobacterium leprae
ggcguugagcacguugugcggg

SEQ ID NO: 143383 - RNA, 22 nt, Mycobacterium leprae
ggguugcauuucaucugucgcg

SEQ ID NO: 143384 - RNA, 22 nt, Mycobacterium leprae
gcgcaggugcggcccggugaua

SEQ ID NO: 143385 - RNA, 22 nt, Mycobacterium leprae
ucccagggggugcucgcugucg

SEQ ID NO: 143386 - RNA, 22 nt, Mycobacterium leprae
gccgaacauccggugcgugucg

SEQ ID NO: 143387 - RNA, 22 nt, Mycobacterium leprae
ggcaaggaagaauucgacacug

SEQ ID NO: 143388 - RNA, 22 nt, Mycobacterium leprae
ugucgaucggaauccgaugcuc

SEQ ID NO: 143389 - RNA, 22 nt, Mycobacterium leprae
gcgcgguuugauaguucgugga

SEQ ID NO: 143390 - RNA, 22 nt, Mycobacterium leprae
cguuggaugcuuggcuuaaagu

SEQ ID NO: 143391 - RNA, 22 nt, Mycobacterium leprae
gucggaaagucuuugcggucag

SEQ ID NO: 143392 - RNA, 22 nt, Mycobacterium leprae
acgcgaccggugaacucgucga

SEQ ID NO: 143393 - RNA, 22 nt, Mycobacterium leprae
guuucaggucuaaguuaacaua

SEQ ID NO: 143394 - RNA, 22 nt, Mycobacterium leprae
uccuacgacccgaucaacaaug

SEQ ID NO: 143395 - RNA, 22 nt, Mycobacterium leprae
uggccaggcgggccguacuggc

SEQ ID NO: 143396 - RNA, 22 nt, Mycobacterium leprae
cgucggugcgaguuuugcguca

SEQ ID NO: 143397 - RNA, 22 nt, Mycobacterium leprae
gcuccaacaggugaagcgccgu

SEQ ID NO: 143398 - RNA, 22 nt, Mycobacterium leprae
gcugucagaauuucgcuacgag

SEQ ID NO: 143399 - RNA, 21 nt, Mycobacterium leprae
ugcggcggccauguggcaggc

SEQ ID NO: 143400 - RNA, 22 nt, Mycobacterium leprae
auguguucaacgggcggcauua

SEQ ID NO: 143401 - RNA, 22 nt, Mycobacterium leprae
ugcuggugccccagucgccaga

SEQ ID NO: 143402 - RNA, 22 nt, Mycobacterium leprae
guugcgcuuccaccucgguacc

SEQ ID NO: 143403 - RNA, 22 nt, Mycobacterium leprae
agcgaucacaccuucgugccga

SEQ ID NO: 143404 - RNA, 22 nt, Mycobacterium leprae
ggcgcgguguuacgguuggucg

SEQ ID NO: 143405 - RNA, 22 nt, Mycobacterium leprae
gcggugacgcuaaaucgcacug

SEQ ID NO: 143406 - RNA, 22 nt, Mycobacterium leprae
uggauaucaaugauguuauuug

SEQ ID NO: 143407 - RNA, 22 nt, Mycobacterium leprae
cgucggugagcucacgccgucg

SEQ ID NO: 143408 - RNA, 22 nt, Mycobacterium leprae
ugucacggcugaagaguucggu

SEQ ID NO: 143409 - RNA, 22 nt, Mycobacterium leprae
uccggcggcgugggugaggacc

SEQ ID NO: 143410 - RNA, 22 nt, Mycobacterium leprae
aaccuuggcaaucgaguuauau

SEQ ID NO: 143411 - RNA, 22 nt, Mycobacterium leprae
cgauggcugcaucgaggucgcg

SEQ ID NO: 143412 - RNA, 22 nt, Mycobacterium leprae
gaggcgaucgucugccgguuca

SEQ ID NO: 143413 - RNA, 20 nt, Mycobacterium leprae
ggcgccucugucggcuucuu

SEQ ID NO: 143414 - RNA, 22 nt, Mycobacterium leprae
acgagugguggucgccaaugcc

SEQ ID NO: 143415 - RNA, 22 nt, Mycobacterium leprae
uugcuggaccgcaugcguggcg

SEQ ID NO: 143416 - RNA, 22 nt, Mycobacterium leprae
agcuugcuuggcuuggccgagg

SEQ ID NO: 143417 - RNA, 22 nt, Mycobacterium leprae
cuucgacgaauugacuaccgag

SEQ ID NO: 143418 - RNA, 22 nt, Mycobacterium leprae
ugggcgguugucgaccugcucg

SEQ ID NO: 143419 - RNA, 22 nt, Mycobacterium leprae
cuggcguggauucgguuccgug

SEQ ID NO: 143420 - RNA, 22 nt, Mycobacterium leprae
cgucgccauggcgaaugacccg

SEQ ID NO: 143421 - RNA, 22 nt, Mycobacterium leprae
ucgugugcuugcaggcagcggc

SEQ ID NO: 143422 - RNA, 22 nt, Mycobacterium leprae
gcagugugcgggucggccaauu

SEQ ID NO: 143423 - RNA, 22 nt, Mycobacterium leprae
auccgguuucgcugcuucguuu

SEQ ID NO: 143424 - RNA, 22 nt, Mycobacterium leprae
cguccgugaugagagcgauccg

SEQ ID NO: 143425 - RNA, 22 nt, Mycobacterium leprae
uggcugcuucggcggucgacuc

SEQ ID NO: 143426 - RNA, 22 nt, Mycobacterium leprae
gcacuuguuugccuagcugggu

SEQ ID NO: 143427 - RNA, 22 nt, Mycobacterium leprae
cagugccgccgaucgguauugg

SEQ ID NO: 143428 - RNA, 22 nt, Mycobacterium leprae
aucuggcggcauacgaucugcc

SEQ ID NO: 143429 - RNA, 22 nt, Mycobacterium leprae
cggcuuccuugucggcgcggau

SEQ ID NO: 143430 - RNA, 22 nt, Mycobacterium leprae
ccuacggcaacuccggcccgcg

SEQ ID NO: 143431 - RNA, 22 nt, Mycobacterium leprae
ucggagucguuaguccagucga

SEQ ID NO: 143432 - RNA, 21 nt, Mycobacterium leprae
ucccggccaccuucgucccgu

SEQ ID NO: 143433 - RNA, 20 nt, Mycobacterium leprae
ccgaccggaagggcaugcac

SEQ ID NO: 143434 - RNA, 22 nt, Mycobacterium leprae
cgggaaucgccuuguucuucag

SEQ ID NO: 143435 - RNA, 22 nt, Mycobacterium leprae
guggccaggcugucggcggacg

SEQ ID NO: 143436 - RNA, 22 nt, Mycobacterium leprae
cggugcgcagaacgucggauga

SEQ ID NO: 143437 - RNA, 22 nt, Mycobacterium leprae
uguccggugacggguuggccac

SEQ ID NO: 143438 - RNA, 22 nt, Mycobacterium leprae
ugccgggugccgcugcgacccc

SEQ ID NO: 143439 - RNA, 22 nt, Mycobacterium leprae
ugcguucgucggcgcggagaau

SEQ ID NO: 143440 - RNA, 21 nt, Mycobacterium leprae
cacuggccgccaugggaauua

SEQ ID NO: 143441 - RNA, 22 nt, Mycobacterium leprae
aggcgaugaagcucgggaggug

SEQ ID NO: 143442 - RNA, 22 nt, Mycobacterium leprae
gacugccucggacgaugagcug

SEQ ID NO: 143443 - RNA, 21 nt, Mycobacterium leprae
aucaccuguagaguguuuuga

SEQ ID NO: 143444 - RNA, 22 nt, Mycobacterium leprae
acugccgcgcuugaucaauguc

SEQ ID NO: 143445 - RNA, 22 nt, Mycobacterium leprae
ucgcaguuacuuuguggccguu

SEQ ID NO: 143446 - RNA, 22 nt, Mycobacterium leprae
ugcucgauaucguguucaguuc

SEQ ID NO: 143447 - RNA, 22 nt, Mycobacterium leprae
gugccgcaagcaccgaagugcg

SEQ ID NO: 143448 - RNA, 22 nt, Mycobacterium leprae
gcucaccugucugauacuggcc

SEQ ID NO: 143449 - RNA, 22 nt, Mycobacterium leprae
gauguccgacgcucaugaacaa

SEQ ID NO: 143450 - RNA, 22 nt, Mycobacterium leprae
gccagcguuugugaacagcugu

SEQ ID NO: 143451 - RNA, 22 nt, Mycobacterium leprae
ucgcuaccuauccgcagaaaaa

SEQ ID NO: 143452 - RNA, 21 nt, Mycobacterium leprae
gacagcggugcuguucaucga

SEQ ID NO: 143453 - RNA, 22 nt, Mycobacterium leprae
gaucgcgcgaugaguuucggga

SEQ ID NO: 143454 - RNA, 22 nt, Mycobacterium leprae
guucgaggcacugucggcguug

SEQ ID NO: 143455 - RNA, 22 nt, Mycobacterium leprae
gguagccgaagucauggaccgg

SEQ ID NO: 143456 - RNA, 22 nt, Mycobacterium leprae
agggcagcgucaucguccucgg

SEQ ID NO: 143457 - RNA, 22 nt, Mycobacterium leprae
gcaucgacuagauacucgggug

SEQ ID NO: 143458 - RNA, 22 nt, Mycobacterium leprae
guugggugaugacgccaaagaa

SEQ ID NO: 143459 - RNA, 22 nt, Mycobacterium leprae
ugcgcacuggcguccagcuggg

SEQ ID NO: 143460 - RNA, 22 nt, Mycobacterium leprae
ugcccguagcuuggguggccgg

SEQ ID NO: 143461 - RNA, 22 nt, Mycobacterium leprae
uagcgauucacuauguugagug

SEQ ID NO: 143462 - RNA, 22 nt, Mycobacterium leprae
agcuggacguuucgacggcaaa

SEQ ID NO: 143463 - RNA, 22 nt, Mycobacterium leprae
cagcaccgaaagaauggccgcu

SEQ ID NO: 143464 - RNA, 22 nt, Mycobacterium leprae
uuggacuuguaauuuggccugu

SEQ ID NO: 143465 - RNA, 22 nt, Mycobacterium leprae
gauguugcucaccgcuaucgug

SEQ ID NO: 143466 - RNA, 22 nt, Mycobacterium leprae
ggcuggucggguucgaggcagc

SEQ ID NO: 143467 - RNA, 22 nt, Mycobacterium leprae
gccgcggccuguugcgcuguac

SEQ ID NO: 143468 - RNA, 22 nt, Mycobacterium leprae
cugaggccggugaaugguccgg

SEQ ID NO: 143469 - RNA, 22 nt, Mycobacterium leprae
cagcugaccgaggcggugcgcc

SEQ ID NO: 143470 - RNA, 22 nt, Mycobacterium leprae
gucagccggguaaacuucgucg

SEQ ID NO: 143471 - RNA, 22 nt, Mycobacterium leprae
ucacuagcaggcgaacggucac

SEQ ID NO: 143472 - RNA, 22 nt, Mycobacterium leprae
cgggaacuuggugacgacgcga

SEQ ID NO: 143473 - RNA, 22 nt, Mycobacterium leprae
caacgcuuacccggccggcggu

SEQ ID NO: 143474 - RNA, 22 nt, Mycobacterium leprae
ggcugggagcggauaucgagca

SEQ ID NO: 143475 - RNA, 22 nt, Mycobacterium leprae
ccgguggucugguugaucgauu

SEQ ID NO: 143476 - RNA, 22 nt, Mycobacterium leprae
augucgguuuugguaacuuucu

SEQ ID NO: 143477 - RNA, 22 nt, Mycobacterium leprae
gggcggccauucugcacgcgau

SEQ ID NO: 143478 - RNA, 22 nt, Mycobacterium leprae
cugcugaguacaacgcagucgu

SEQ ID NO: 143479 - RNA, 22 nt, Mycobacterium leprae
ugcccgccuauccuucgccgau

SEQ ID NO: 143480 - RNA, 22 nt, Mycobacterium leprae
acggugggcaaaccgacgcucu

SEQ ID NO: 143481 - RNA, 23 nt, Mycobacterium leprae
cggcgauguccugguggcaaguc

SEQ ID NO: 143482 - RNA, 18 nt, Mycobacterium leprae
gaucaccuugccuaggga

SEQ ID NO: 143483 - RNA, 22 nt, Mycobacterium leprae
caagaccgaggucaucgggcgg

SEQ ID NO: 143484 - RNA, 22 nt, Mycobacterium leprae
aggucggcgcauugaauagucc

SEQ ID NO: 143485 - RNA, 22 nt, Mycobacterium leprae
cggucagauuucuugugcgccg

SEQ ID NO: 143486 - RNA, 22 nt, Mycobacterium leprae
uggcgcugggugguagcgaugu

SEQ ID NO: 143487 - RNA, 22 nt, Mycobacterium leprae
gaccaccacggucggcaaguug

SEQ ID NO: 143488 - RNA, 22 nt, Mycobacterium leprae
cacgguuugauguggccguuaa

SEQ ID NO: 143489 - RNA, 22 nt, Mycobacterium leprae
agacgcuagaauauacuugaga

SEQ ID NO: 143490 - RNA, 22 nt, Mycobacterium leprae
aacggcuauuggguggcuggcg

SEQ ID NO: 143491 - RNA, 22 nt, Mycobacterium leprae
ucgugcgcugacgaugaucgcc

SEQ ID NO: 143492 - RNA, 20 nt, Mycobacterium leprae
ugugagguaccggcucguuc

SEQ ID NO: 143493 - RNA, 22 nt, Mycobacterium leprae
uaugccaauuuugugcggcgga

SEQ ID NO: 143494 - RNA, 22 nt, Mycobacterium leprae
ucgucuucgguuaacgcguccu

SEQ ID NO: 143495 - RNA, 22 nt, Mycobacterium leprae
cagcccggaugcuuaucaaaaa

SEQ ID NO: 143496 - RNA, 22 nt, Mycobacterium leprae
cgcugcgaggcuuauccaucug

SEQ ID NO: 143497 - RNA, 22 nt, Mycobacterium leprae
ugcgguggggaccaccggagac

SEQ ID NO: 143498 - RNA, 22 nt, Mycobacterium leprae
gcggcgagugagcgaugcuuuu

SEQ ID NO: 143499 - RNA, 22 nt, Mycobacterium leprae
ucgcugcuuauccuggugccga

SEQ ID NO: 143500 - RNA, 22 nt, Mycobacterium leprae
gcacagccgggccucuuguuca

SEQ ID NO: 143501 - RNA, 22 nt, Mycobacterium leprae
aaguugcuguucgugccggugu

SEQ ID NO: 143502 - RNA, 22 nt, Mycobacterium leprae
accggccgcgggauggcguucc

SEQ ID NO: 143503 - RNA, 22 nt, Mycobacterium leprae
gaagcgcugauccucucccgaa

SEQ ID NO: 143504 - RNA, 22 nt, Mycobacterium leprae
cgccagcugcgcgaggugccgg

SEQ ID NO: 143505 - RNA, 22 nt, Mycobacterium leprae
ucaccucgaccauguggaccgg

SEQ ID NO: 143506 - RNA, 22 nt, Mycobacterium leprae
cugggcaccaggccgucgucgg

SEQ ID NO: 143507 - RNA, 22 nt, Mycobacterium leprae
caucgacgucucagugcuugcg

SEQ ID NO: 143508 - RNA, 22 nt, Mycobacterium leprae
ccggaccaucgagcucaaucag

SEQ ID NO: 143509 - RNA, 22 nt, Mycobacterium leprae
cgggcgggaucgacgacgaugu

SEQ ID NO: 143510 - RNA, 22 nt, Mycobacterium leprae
gaggaugaagucgacgagcuac

SEQ ID NO: 143511 - RNA, 22 nt, Mycobacterium leprae
uguaccgcuucgauuaccuggc

SEQ ID NO: 143512 - RNA, 22 nt, Mycobacterium leprae
uucugccguuuugcauaccggg

SEQ ID NO: 143513 - RNA, 22 nt, Mycobacterium leprae
gcugguauucggugucgguuuc

SEQ ID NO: 143514 - RNA, 22 nt, Mycobacterium leprae
uugaaguagaacuugucgggau

SEQ ID NO: 143515 - RNA, 23 nt, Mycobacterium leprae
cgcauucaugauuuuauccgcac

SEQ ID NO: 143516 - RNA, 22 nt, Mycobacterium leprae
ccaugcgauuggcgcagauuuu

SEQ ID NO: 143517 - RNA, 22 nt, Mycobacterium leprae
ucgagagcuacugacgcuucau

SEQ ID NO: 143518 - RNA, 22 nt, Mycobacterium leprae
agcuggcgcacccgucgaccga

SEQ ID NO: 143519 - RNA, 22 nt, Mycobacterium leprae
gccgugucgguaggcuguuguc

SEQ ID NO: 143520 - RNA, 22 nt, Mycobacterium leprae
gagcaugcgcgaaccggucggc

SEQ ID NO: 143521 - RNA, 22 nt, Mycobacterium leprae
uagccgguuacggugcgucuuc

SEQ ID NO: 143522 - RNA, 22 nt, Mycobacterium leprae
gccaaucggaagcgggcugcac

SEQ ID NO: 143523 - RNA, 22 nt, Mycobacterium leprae
uguuugguccagcuuagcguga

SEQ ID NO: 143524 - RNA, 22 nt, Mycobacterium leprae
uacccguggacuagauccggca

SEQ ID NO: 143525 - RNA, 22 nt, Mycobacterium leprae
cgagaugcggauguuuucggug

SEQ ID NO: 143526 - RNA, 22 nt, Mycobacterium leprae
gugcgugggguguugauggcga

SEQ ID NO: 143527 - RNA, 22 nt, Mycobacterium leprae
ugcccgcgucuacgguaagugg

SEQ ID NO: 143528 - RNA, 22 nt, Mycobacterium leprae
ucgggcaucaccucggcgcgcc

SEQ ID NO: 143529 - RNA, 22 nt, Mycobacterium leprae
agauggauaagccucgcagcga

SEQ ID NO: 143530 - RNA, 22 nt, Mycobacterium leprae
cgacaaucaggucauugaucuc

SEQ ID NO: 143531 - RNA, 22 nt, Mycobacterium leprae
ggguugauccgcgcgauggaga

SEQ ID NO: 143532 - RNA, 22 nt, Mycobacterium leprae
gagugguucgaguucgucggcg

SEQ ID NO: 143533 - RNA, 22 nt, Mycobacterium leprae
cagucgcuggcgugcuggauga

SEQ ID NO: 143534 - RNA, 22 nt, Mycobacterium leprae
ugcgguccaagaagccaguguu

SEQ ID NO: 143535 - RNA, 19 nt, Mycobacterium leprae
acgucgacgccagacccgg

SEQ ID NO: 143536 - RNA, 22 nt, Mycobacterium leprae
ggucgggaaccuugcacgcucc

SEQ ID NO: 143537 - RNA, 22 nt, Mycobacterium leprae
gccauggcuucuaccgcagaug

SEQ ID NO: 143538 - RNA, 22 nt, Mycobacterium leprae
caucggcgaguucauugaugac

SEQ ID NO: 143539 - RNA, 22 nt, Mycobacterium leprae
uggcugcguugccggcgaacca

SEQ ID NO: 143540 - RNA, 22 nt, Mycobacterium leprae
auguugacugucgaggaagcca

SEQ ID NO: 143541 - RNA, 22 nt, Mycobacterium leprae
gaugcagccgugcacaugugcg

SEQ ID NO: 143542 - RNA, 22 nt, Mycobacterium leprae
ugacgugucgcgcgugucgccu

SEQ ID NO: 143543 - RNA, 22 nt, Mycobacterium leprae
gcagcuuggcaucgguuuucau

SEQ ID NO: 143544 - RNA, 22 nt, Mycobacterium leprae
agcggcuuggugcauugcugac

SEQ ID NO: 143545 - RNA, 22 nt, Mycobacterium leprae
cgcgugcucaaccuuugacaua

SEQ ID NO: 143546 - RNA, 19 nt, Mycobacterium leprae
acgcgucgagagccagcag

SEQ ID NO: 143547 - RNA, 19 nt, Mycobacterium leprae
acccgcaacugcuugcggu

SEQ ID NO: 143548 - RNA, 22 nt, Mycobacterium leprae
gccgagauagagcaguuggcgg

SEQ ID NO: 143549 - RNA, 22 nt, Mycobacterium leprae
ucagccgcagugacacguaucc

SEQ ID NO: 143550 - RNA, 17 nt, Mycobacterium leprae
agaucgaccggaugucg

SEQ ID NO: 143551 - RNA, 22 nt, Mycobacterium leprae
ggcugaagagcauccaagaccu

SEQ ID NO: 143552 - RNA, 20 nt, Mycobacterium leprae
ugguguacgcgcucaaccag

SEQ ID NO: 143553 - RNA, 22 nt, Mycobacterium leprae
uccaguauuucuacgagucugc

SEQ ID NO: 143554 - RNA, 22 nt, Mycobacterium leprae
ucaccuuucggguagacuugaa

SEQ ID NO: 143555 - RNA, 22 nt, Mycobacterium leprae
acacgccgagcaggucgagcgg

SEQ ID NO: 143556 - RNA, 22 nt, Mycobacterium leprae
gaucggcggcaggucgaaaucg

SEQ ID NO: 143557 - RNA, 22 nt, Mycobacterium leprae
cgcgggaucaccgacauucgcg

SEQ ID NO: 143558 - RNA, 22 nt, Mycobacterium leprae
ggcauugcgaguguaggcgggg

SEQ ID NO: 143559 - RNA, 19 nt, Mycobacterium leprae
ggccgagcgaacgucgagc

SEQ ID NO: 143560 - RNA, 22 nt, Mycobacterium leprae
acuucccaagggcuaugaugug

SEQ ID NO: 143561 - RNA, 22 nt, Mycobacterium leprae
uuggcgccaucggcagcgguca

SEQ ID NO: 143562 - RNA, 22 nt, Mycobacterium leprae
acgcuggcgaauaccaggaaac

SEQ ID NO: 143563 - RNA, 22 nt, Mycobacterium leprae
cgaugguguuuaggugacgggg

SEQ ID NO: 143564 - RNA, 19 nt, Mycobacterium leprae
agucguccuugaucguguc

SEQ ID NO: 143565 - RNA, 20 nt, Mycobacterium leprae
aguucggggucugucgcggu

SEQ ID NO: 143566 - RNA, 22 nt, Mycobacterium leprae
ucuacgaggucgagcgcgccaa

SEQ ID NO: 143567 - RNA, 22 nt, Mycobacterium leprae
gggccucggugcggguaucgau

SEQ ID NO: 143568 - RNA, 22 nt, Mycobacterium leprae
uucgaguugcucucaauagcau

SEQ ID NO: 143569 - RNA, 22 nt, Mycobacterium leprae
ucgccguuaguacucgucgagg

SEQ ID NO: 143570 - RNA, 22 nt, Mycobacterium leprae
aucaccauggucaccaucgccu

SEQ ID NO: 143571 - RNA, 23 nt, Mycobacterium leprae
aggguuugaaguuuggguggcug

SEQ ID NO: 143572 - RNA, 22 nt, Mycobacterium leprae
auugugauuggguccaccgggg

SEQ ID NO: 143573 - RNA, 22 nt, Mycobacterium leprae
caucgcgucgguauugauccgu

SEQ ID NO: 143574 - RNA, 22 nt, Mycobacterium leprae
ugacgaagucaccguggagacg

SEQ ID NO: 143575 - RNA, 22 nt, Mycobacterium leprae
uggaagacgagcucgaugagau

SEQ ID NO: 143576 - RNA, 22 nt, Mycobacterium leprae
uugaugcugcgccgauucggcg

SEQ ID NO: 143577 - RNA, 22 nt, Mycobacterium leprae
uuggcgauugcccgcgaauaug

SEQ ID NO: 143578 - RNA, 22 nt, Mycobacterium leprae
caaucgaucuugacaguguggc

SEQ ID NO: 143579 - RNA, 22 nt, Mycobacterium leprae
aauacgcuggacgcgccgaugu

SEQ ID NO: 143580 - RNA, 22 nt, Mycobacterium leprae
gguccgggaccugcgucccgaa

SEQ ID NO: 143581 - RNA, 20 nt, Mycobacterium leprae
ggcgguguccacggcgaggu

SEQ ID NO: 143582 - RNA, 22 nt, Mycobacterium leprae
cgauauugccuucaggauugua

SEQ ID NO: 143583 - RNA, 22 nt, Mycobacterium leprae
cgugaugucgcuuugcaguucg

SEQ ID NO: 143584 - RNA, 22 nt, Mycobacterium leprae
cguuaucggaacgcgguucggc

SEQ ID NO: 143585 - RNA, 22 nt, Mycobacterium leprae
acaacggcacggaauuccgauc

SEQ ID NO: 143586 - RNA, 22 nt, Mycobacterium leprae
cuugccgguccaccgguaugug

SEQ ID NO: 143587 - RNA, 22 nt, Mycobacterium leprae
uugguaccguccccgggcgcag

SEQ ID NO: 143588 - RNA, 22 nt, Mycobacterium leprae
accgcggaccgaccuggauugc

SEQ ID NO: 143589 - RNA, 22 nt, Mycobacterium leprae
gcggcuguuggucagugggcca

SEQ ID NO: 143590 - RNA, 22 nt, Mycobacterium leprae
guugacuuuuuccggguugccg

SEQ ID NO: 143591 - RNA, 22 nt, Mycobacterium leprae
gcuggacccgacagccgaguua

SEQ ID NO: 143592 - RNA, 22 nt, Mycobacterium leprae
gcaucccaccauaaggugcaag

SEQ ID NO: 143593 - RNA, 22 nt, Mycobacterium leprae
ugacgcggcggcugcugacgag

SEQ ID NO: 143594 - RNA, 17 nt, Mycobacterium leprae
gaggcggugggccaggu

SEQ ID NO: 143595 - RNA, 22 nt, Mycobacterium leprae
auaugggcucagggcaccaucc

SEQ ID NO: 143596 - RNA, 22 nt, Mycobacterium leprae
cgagcugcgcuuccucgagcgu

SEQ ID NO: 143597 - RNA, 22 nt, Mycobacterium leprae
gucacguuucucgcagauggug

SEQ ID NO: 143598 - RNA, 22 nt, Mycobacterium leprae
ggcuggauccgaagugucgacg

SEQ ID NO: 143599 - RNA, 22 nt, Mycobacterium leprae
aagcucugaccauggcacgcga

SEQ ID NO: 143600 - RNA, 23 nt, Mycobacterium leprae
aguucggugucaccugcacauuu

SEQ ID NO: 143601 - RNA, 22 nt, Mycobacterium leprae
cgcucugcacuggaccgacugg

SEQ ID NO: 143602 - RNA, 22 nt, Mycobacterium leprae
aagcugcgggugcacgaacguc

SEQ ID NO: 143603 - RNA, 22 nt, Mycobacterium leprae
gaucugggauguugugcugcaa

SEQ ID NO: 143604 - RNA, 22 nt, Mycobacterium leprae
gauggcuggcgauguucgccga

SEQ ID NO: 143605 - RNA, 22 nt, Mycobacterium leprae
ccgcguguggacuugacgaaua

SEQ ID NO: 143606 - RNA, 22 nt, Mycobacterium leprae
cagugccggccgaaguguuacg

SEQ ID NO: 143607 - RNA, 22 nt, Mycobacterium leprae
uuaccgacgacaccaugcggug

SEQ ID NO: 143608 - RNA, 22 nt, Mycobacterium leprae
cugugggugaucaccgacgcac

SEQ ID NO: 143609 - RNA, 22 nt, Mycobacterium leprae
uccgcgacaaucucgacgucgu

SEQ ID NO: 143610 - RNA, 22 nt, Mycobacterium leprae
ccaccagguaccgagccggucg

SEQ ID NO: 143611 - RNA, 22 nt, Mycobacterium leprae
augcuguucccagcggccgagc

SEQ ID NO: 143612 - RNA, 22 nt, Mycobacterium leprae
uagcgcacuuuuccagccugac

SEQ ID NO: 143613 - RNA, 18 nt, Mycobacterium leprae
auccagcucagccagcuc

SEQ ID NO: 143614 - RNA, 22 nt, Mycobacterium leprae
ucugaucguccugcucgcggua

SEQ ID NO: 143615 - RNA, 22 nt, Mycobacterium leprae
gcccgagcagggugcggguaug

SEQ ID NO: 143616 - RNA, 22 nt, Mycobacterium leprae
aguggucgucaaaaauaugucc

SEQ ID NO: 143617 - RNA, 22 nt, Mycobacterium leprae
uucaccuuguucgcaacguuau

SEQ ID NO: 143618 - RNA, 22 nt, Mycobacterium leprae
ggugaugguauugaugcgcggc

SEQ ID NO: 143619 - RNA, 22 nt, Mycobacterium leprae
ucugccgcacuaggugcucgac

SEQ ID NO: 143620 - RNA, 22 nt, Mycobacterium leprae
gaucgucaguuuuuuugcucau

SEQ ID NO: 143621 - RNA, 22 nt, Mycobacterium leprae
aacacgacccgaucggcggcgg

SEQ ID NO: 143622 - RNA, 22 nt, Mycobacterium leprae
accuccgggauugaauacaugc

SEQ ID NO: 143623 - RNA, 22 nt, Mycobacterium leprae
cgccuaguaaccgcgccagauu

SEQ ID NO: 143624 - RNA, 22 nt, Mycobacterium leprae
aucggcuggacaccuuuguucu

SEQ ID NO: 143625 - RNA, 22 nt, Mycobacterium leprae
ugcugggcaagacccgaugagc

SEQ ID NO: 143626 - RNA, 22 nt, Mycobacterium leprae
caccaucgaugcgcccagggua

SEQ ID NO: 143627 - RNA, 22 nt, Mycobacterium leprae
ucguggucuuugucgucuucag

SEQ ID NO: 143628 - RNA, 22 nt, Mycobacterium leprae
accggauuuccuccgguucugu

SEQ ID NO: 143629 - RNA, 22 nt, Mycobacterium leprae
cgucgccaggcugucgcguuca

SEQ ID NO: 143630 - RNA, 22 nt, Mycobacterium leprae
uugagcucgaugguccggaggu

SEQ ID NO: 143631 - RNA, 22 nt, Mycobacterium leprae
aagcuccgaagugauugaugca

SEQ ID NO: 143632 - RNA, 22 nt, Mycobacterium leprae
ggugcugacugaugcgggucgg

SEQ ID NO: 143633 - RNA, 22 nt, Mycobacterium leprae
cguugaucgauaguacgucggu

SEQ ID NO: 143634 - RNA, 22 nt, Mycobacterium leprae
cguucgaucgcagcgaacacac

SEQ ID NO: 143635 - RNA, 23 nt, Mycobacterium leprae
acacugcuacgugacugcggcgc

SEQ ID NO: 143636 - RNA, 22 nt, Mycobacterium leprae
ucgccucgaguuuggacaaggu

SEQ ID NO: 143637 - RNA, 22 nt, Mycobacterium leprae
uggcgggugcaccugacguggu

SEQ ID NO: 143638 - RNA, 22 nt, Mycobacterium leprae
ucgaucgcuggcgaugucguug

SEQ ID NO: 143639 - RNA, 22 nt, Mycobacterium leprae
acucggcgguccggucaacagc

SEQ ID NO: 143640 - RNA, 22 nt, Mycobacterium leprae
gcuucggucagcuugcaguagg

SEQ ID NO: 143641 - RNA, 22 nt, Mycobacterium leprae
uccgucgcagcucuggcccgau

SEQ ID NO: 143642 - RNA, 22 nt, Mycobacterium leprae
acucgacacucucgaugccgga

SEQ ID NO: 143643 - RNA, 22 nt, Mycobacterium leprae
auugaccaccacuacuaccagu

SEQ ID NO: 143644 - RNA, 22 nt, Mycobacterium leprae
accaccgauaccgauugcgguc

SEQ ID NO: 143645 - RNA, 22 nt, Mycobacterium leprae
ucgacguauucccgccgaccuu

SEQ ID NO: 143646 - RNA, 22 nt, Mycobacterium leprae
cgcuguggcaucagcuacccga

SEQ ID NO: 143647 - RNA, 22 nt, Mycobacterium leprae
gcggugaccacucuuccgccca

SEQ ID NO: 143648 - RNA, 22 nt, Mycobacterium leprae
ggcgccgaucucgcccgguggc

SEQ ID NO: 143649 - RNA, 22 nt, Mycobacterium leprae
acgcaugaauguguugcgcuac

SEQ ID NO: 143650 - RNA, 22 nt, Mycobacterium leprae
cgcgguuguccaacacacacau

SEQ ID NO: 143651 - RNA, 22 nt, Mycobacterium leprae
accgcgcuaagguggcccguuc

SEQ ID NO: 143652 - RNA, 22 nt, Mycobacterium leprae
ugcgagaaauccgacagcgaua

SEQ ID NO: 143653 - RNA, 22 nt, Mycobacterium leprae
cgucucgucgacuacgauuuca

SEQ ID NO: 143654 - RNA, 20 nt, Mycobacterium leprae
ucgcggacauggucugcaag

SEQ ID NO: 143655 - RNA, 22 nt, Mycobacterium leprae
ucgaacuugcugcacaccgugu

SEQ ID NO: 143656 - RNA, 23 nt, Mycobacterium leprae
ugcccgacaucgaucugcaagcu

SEQ ID NO: 143657 - RNA, 20 nt, Mycobacterium leprae
ggucgcucucgguguguggu

SEQ ID NO: 143658 - RNA, 22 nt, Mycobacterium leprae
ucgggguugacgcugguaucgc

SEQ ID NO: 143659 - RNA, 22 nt, Mycobacterium leprae
gaccacggugcuguuagucgga

SEQ ID NO: 143660 - RNA, 22 nt, Mycobacterium leprae
uugguggccgguaccgucccgg

SEQ ID NO: 143661 - RNA, 22 nt, Mycobacterium leprae
cgguuaccagggauggcagugg

SEQ ID NO: 143662 - RNA, 22 nt, Mycobacterium leprae
gugccacagucguugcgcgaua

SEQ ID NO: 143663 - RNA, 22 nt, Mycobacterium leprae
gcgaacgugaagcuggccgcga

SEQ ID NO: 143664 - RNA, 22 nt, Mycobacterium leprae
acaucgaugcguaucccuugac

SEQ ID NO: 143665 - RNA, 22 nt, Mycobacterium leprae
ucggccauuggugcugggcguc

SEQ ID NO: 143666 - RNA, 23 nt, Mycobacterium leprae
ugcugcugaugaucgcauccagc

SEQ ID NO: 143667 - RNA, 22 nt, Mycobacterium leprae
agcgcucaggguuaagggcgag

SEQ ID NO: 143668 - RNA, 16 nt, Mycobacterium leprae
gugguucaccgucgac

SEQ ID NO: 143669 - RNA, 22 nt, Mycobacterium leprae
gcgcugguccugcucgaucaac

SEQ ID NO: 143670 - RNA, 22 nt, Mycobacterium leprae
ccaggcacugcgccacuaugcc

SEQ ID NO: 143671 - RNA, 22 nt, Mycobacterium leprae
ccggucugcuggucggcaucgg

SEQ ID NO: 143672 - RNA, 22 nt, Mycobacterium leprae
gucagcgcuaacagaucggcac

SEQ ID NO: 143673 - RNA, 22 nt, Mycobacterium leprae
uugcgacggcaccuaucauaau

SEQ ID NO: 143674 - RNA, 22 nt, Mycobacterium leprae
aucgguugucggcgaucacugg

SEQ ID NO: 143675 - RNA, 22 nt, Mycobacterium leprae
gggcugaucgcgcuacaggaau

SEQ ID NO: 143676 - RNA, 22 nt, Mycobacterium leprae
agucgauucgauggauccgacg

SEQ ID NO: 143677 - RNA, 19 nt, Mycobacterium leprae
caaugcugagacauaaguu

SEQ ID NO: 143678 - RNA, 22 nt, Mycobacterium leprae
guccaggugagccagcaccgua

SEQ ID NO: 143679 - RNA, 22 nt, Mycobacterium leprae
auguucagaucggcaucgguua

SEQ ID NO: 143680 - RNA, 22 nt, Mycobacterium leprae
gagccuguccgacgccggccgu

SEQ ID NO: 143681 - RNA, 22 nt, Mycobacterium leprae
acccgaucaacaauggacaggc

SEQ ID NO: 143682 - RNA, 22 nt, Mycobacterium leprae
ggauucggcgagaaugcugacc

SEQ ID NO: 143683 - RNA, 22 nt, Mycobacterium leprae
ccacucagcggucagcagcacu

SEQ ID NO: 143684 - RNA, 22 nt, Mycobacterium leprae
aguggugcaucaguggaaagga

SEQ ID NO: 143685 - RNA, 21 nt, Mycobacterium leprae
accgagggcggcaagcgcagc

SEQ ID NO: 143686 - RNA, 21 nt, Mycobacterium leprae
uugcgaucgccacuaguugac

SEQ ID NO: 143687 - RNA, 22 nt, Mycobacterium leprae
ugcggccaggcgcuucacguuc

SEQ ID NO: 143688 - RNA, 22 nt, Mycobacterium leprae
acgguuuuggugcauggcgcag

SEQ ID NO: 143689 - RNA, 22 nt, Mycobacterium leprae
gcggucugcucauggauggugu

SEQ ID NO: 143690 - RNA, 23 nt, Mycobacterium leprae
uccacgagucaacggcguggucg

SEQ ID NO: 143691 - RNA, 23 nt, Mycobacterium leprae
ccguacccggccaugguccggca

SEQ ID NO: 143692 - RNA, 22 nt, Mycobacterium leprae
aucaacgccagacgggugaacg

SEQ ID NO: 143693 - RNA, 22 nt, Mycobacterium leprae
aucgaccgucgguauuccgauu

SEQ ID NO: 143694 - RNA, 22 nt, Mycobacterium leprae
guguugccaacagaaccgacuu

SEQ ID NO: 143695 - RNA, 22 nt, Mycobacterium leprae
ucaggccgaucggcggcgguuc

SEQ ID NO: 143696 - RNA, 22 nt, Mycobacterium leprae
agccgucgcaguauugaucgcg

SEQ ID NO: 143697 - RNA, 22 nt, Mycobacterium leprae
gcgugcuuaccguggugcugau

SEQ ID NO: 143698 - RNA, 22 nt, Mycobacterium leprae
ucgggcugugcgugaccggacg

SEQ ID NO: 143699 - RNA, 23 nt, Mycobacterium leprae
uuguucuccgguggugcgcugcu

SEQ ID NO: 143700 - RNA, 22 nt, Mycobacterium leprae
gccggucggccgcgaacuucgu

SEQ ID NO: 143701 - RNA, 19 nt, Mycobacterium leprae
acccgcucugccagcgccg

SEQ ID NO: 143702 - RNA, 22 nt, Mycobacterium leprae
agcccaccagcuaggcguugga

SEQ ID NO: 143703 - RNA, 22 nt, Mycobacterium leprae
caaugauuucagucaccgccua

SEQ ID NO: 143704 - RNA, 22 nt, Mycobacterium leprae
ucaccgauccugcggcggcaau

SEQ ID NO: 143705 - RNA, 19 nt, Mycobacterium leprae
accgcguagcgaguggguc

SEQ ID NO: 143706 - RNA, 19 nt, Mycobacterium leprae
gucguuggccucggcgacg

SEQ ID NO: 143707 - RNA, 22 nt, Mycobacterium leprae
gagcgaaugugaucacggccac

SEQ ID NO: 143708 - RNA, 22 nt, Mycobacterium leprae
gucggcuaccggauagucgucg

SEQ ID NO: 143709 - RNA, 22 nt, Mycobacterium leprae
gaccaguugggaucgucggguu

SEQ ID NO: 143710 - RNA, 22 nt, Mycobacterium leprae
gaaucgguacuacaagcgacgc

SEQ ID NO: 143711 - RNA, 22 nt, Mycobacterium leprae
ccgcgcaauguuucugcggaag

SEQ ID NO: 143712 - RNA, 22 nt, Mycobacterium leprae
ucuggcgggugguguacucgcg

SEQ ID NO: 143713 - RNA, 22 nt, Mycobacterium leprae
ugcggugcuucguugaaggagc

SEQ ID NO: 143714 - RNA, 18 nt, Mycobacterium leprae
cucccacuucugcuugcu

SEQ ID NO: 143715 - RNA, 22 nt, Mycobacterium leprae
caagggugagugaugagcguga

SEQ ID NO: 143716 - RNA, 22 nt, Mycobacterium leprae
uuguucguggccgaccgccucc

SEQ ID NO: 143717 - RNA, 22 nt, Mycobacterium leprae
ccagcuacgacaggcccgcgaa

SEQ ID NO: 143718 - RNA, 22 nt, Mycobacterium leprae
agaucggcacaguggugaugcu

SEQ ID NO: 143719 - RNA, 22 nt, Mycobacterium leprae
auguccguuucuuaaugcagcc

SEQ ID NO: 143720 - RNA, 22 nt, Mycobacterium leprae
gacgaugaucuccuucuuacgg

SEQ ID NO: 143721 - RNA, 20 nt, Mycobacterium leprae
ggccgauuucgguaucgucc

SEQ ID NO: 143722 - RNA, 22 nt, Mycobacterium leprae
cuuagcgcugaccuguucggcg

SEQ ID NO: 143723 - RNA, 22 nt, Mycobacterium leprae
ucagcgcaaagcuagccguccu

SEQ ID NO: 143724 - RNA, 22 nt, Mycobacterium leprae
gucugauuaguggcgauccuaa

SEQ ID NO: 143725 - RNA, 22 nt, Mycobacterium leprae
ucggcuugaccauagcggccgg

SEQ ID NO: 143726 - RNA, 22 nt, Mycobacterium leprae
ggcgggcagggucaucgccucg

SEQ ID NO: 143727 - RNA, 18 nt, Mycobacterium leprae
accggccagcgcgguucg

SEQ ID NO: 143728 - RNA, 20 nt, Mycobacterium leprae
aguccggucccaaguguuau

SEQ ID NO: 143729 - RNA, 22 nt, Mycobacterium leprae
cuugggaguccuucuuguuggu

SEQ ID NO: 143730 - RNA, 22 nt, Mycobacterium leprae
acuacugccguucauggcuggu

SEQ ID NO: 143731 - RNA, 22 nt, Mycobacterium leprae
gcuuucgaguuuauccaagauc

SEQ ID NO: 143732 - RNA, 18 nt, Mycobacterium leprae
uuccggaagccgaucgau

SEQ ID NO: 143733 - RNA, 22 nt, Mycobacterium leprae
ggcagcaagacagcgagauccg

SEQ ID NO: 143734 - RNA, 22 nt, Mycobacterium leprae
cugcauacccggaugaacguua

SEQ ID NO: 143735 - RNA, 22 nt, Mycobacterium leprae
gccaauuccuacgaugcuccaa

SEQ ID NO: 143736 - RNA, 22 nt, Mycobacterium leprae
cguggugaucccgagcaccgau

SEQ ID NO: 143737 - RNA, 19 nt, Mycobacterium leprae
gcaaaacguugaucucgac

SEQ ID NO: 143738 - RNA, 22 nt, Mycobacterium leprae
cgcggcgguggcguugcacccg

SEQ ID NO: 143739 - RNA, 22 nt, Mycobacterium leprae
ucaagcaggcggucgggguauu

SEQ ID NO: 143740 - RNA, 22 nt, Mycobacterium leprae
ucgggccggugacguggauaug

SEQ ID NO: 143741 - RNA, 22 nt, Mycobacterium leprae
ucgauucuggaaaggcguaguu

SEQ ID NO: 143742 - RNA, 22 nt, Mycobacterium leprae
gucgaggguguagggaccacca

SEQ ID NO: 143743 - RNA, 22 nt, Mycobacterium leprae
ggagacuucgugacuacugaug

SEQ ID NO: 143744 - RNA, 22 nt, Mycobacterium leprae
uagggaucagugccacgucguc

SEQ ID NO: 143745 - RNA, 22 nt, Mycobacterium leprae
acggcaaggcuguuccgguaac

SEQ ID NO: 143746 - RNA, 22 nt, Mycobacterium leprae
cgccggcugccgaccuaguuuu

SEQ ID NO: 143747 - RNA, 17 nt, Mycobacterium leprae
ccagcgcgugcacguug

SEQ ID NO: 143748 - RNA, 22 nt, Mycobacterium leprae
ugagcgcaugcacuguggcgcc

SEQ ID NO: 143749 - RNA, 22 nt, Mycobacterium leprae
gucgguguugcugaugcggacg

SEQ ID NO: 143750 - RNA, 22 nt, Mycobacterium leprae
ugguggcaggcgccgcucagcu

SEQ ID NO: 143751 - RNA, 22 nt, Mycobacterium leprae
uugcaguagccggucguuacca

SEQ ID NO: 143752 - RNA, 22 nt, Mycobacterium leprae
ucgccucagucaaacccaacgg

SEQ ID NO: 143753 - RNA, 20 nt, Mycobacterium leprae
ugaccgcaaagacuuuccga

SEQ ID NO: 143754 - RNA, 22 nt, Mycobacterium leprae
ugcaaaacgucgaucucgacgc

SEQ ID NO: 143755 - RNA, 22 nt, Mycobacterium leprae
cguugggauaggcguuuugcag

SEQ ID NO: 143756 - RNA, 22 nt, Mycobacterium leprae
ccggcugacagugucgcugcug

SEQ ID NO: 143757 - RNA, 22 nt, Mycobacterium leprae
ccgcauagcgaacauugucgcc

SEQ ID NO: 143758 - RNA, 20 nt, Mycobacterium leprae
guugguugaccuuuauccuu

SEQ ID NO: 143759 - RNA, 22 nt, Mycobacterium leprae
gggcaggacccuguugcucgcc

SEQ ID NO: 143760 - RNA, 22 nt, Mycobacterium leprae
gcuuauuugcguuucgcgucgg

SEQ ID NO: 143761 - RNA, 22 nt, Mycobacterium leprae
gccggcgucgugacugucaacg

SEQ ID NO: 143762 - RNA, 22 nt, Mycobacterium leprae
uguugcugaccgccgcucaagu

SEQ ID NO: 143763 - RNA, 22 nt, Mycobacterium leprae
ugcucgaugccgcgcggaaaga

SEQ ID NO: 143764 - RNA, 22 nt, Mycobacterium leprae
cgucggacacaucgagugcaua

SEQ ID NO: 143765 - RNA, 22 nt, Mycobacterium leprae
ucgcugacccagguuggcuacc

SEQ ID NO: 143766 - RNA, 22 nt, Mycobacterium leprae
acccgguugauugcguaggcgg

SEQ ID NO: 143767 - RNA, 22 nt, Mycobacterium leprae
cggccaacagcuucgugggcgg

SEQ ID NO: 143768 - RNA, 22 nt, Mycobacterium leprae
acccgcucggucucggugguga

SEQ ID NO: 143769 - RNA, 22 nt, Mycobacterium leprae
cgaccgcuguuaggacuagcag

SEQ ID NO: 143770 - RNA, 22 nt, Mycobacterium leprae
uggugauggcggucguuuggca

SEQ ID NO: 143771 - RNA, 22 nt, Mycobacterium leprae
acucaaccagauugcucaccac

SEQ ID NO: 143772 - RNA, 22 nt, Mycobacterium leprae
cucuggcugcuaucacggccau

SEQ ID NO: 143773 - RNA, 22 nt, Mycobacterium leprae
acuggggauacugcucacgcgc

SEQ ID NO: 143774 - RNA, 22 nt, Mycobacterium leprae
ucggcgaaggauaggcgggcag

SEQ ID NO: 143775 - RNA, 22 nt, Mycobacterium leprae
caggaucacuaguugcgccgga

SEQ ID NO: 143776 - RNA, 22 nt, Mycobacterium leprae
gugcaacuuaugcuagcgguuu

SEQ ID NO: 143777 - RNA, 21 nt, Mycobacterium leprae
gaaccuugcauugucuagccg

SEQ ID NO: 143778 - RNA, 22 nt, Mycobacterium leprae
agcggaugaagcuggacgcggc

SEQ ID NO: 143779 - RNA, 22 nt, Mycobacterium leprae
cggcggcggugguugaguuguu

SEQ ID NO: 143780 - RNA, 22 nt, Mycobacterium leprae
cgguguguaccggugagucggu

SEQ ID NO: 143781 - RNA, 22 nt, Mycobacterium leprae
cuuucguauugaccggcguuag

SEQ ID NO: 143782 - RNA, 22 nt, Mycobacterium leprae
acgacugcguuguacucagcag

SEQ ID NO: 143783 - RNA, 22 nt, Mycobacterium leprae
aucaccgacgcaccaucggcug

SEQ ID NO: 143784 - RNA, 22 nt, Mycobacterium leprae
uggugcucgucgaacaaccuca

SEQ ID NO: 143785 - RNA, 22 nt, Mycobacterium leprae
cuacggcguaugggcaucagcg

SEQ ID NO: 143786 - RNA, 22 nt, Mycobacterium leprae
gcgucuuuccccugcuugggcg

SEQ ID NO: 143787 - RNA, 22 nt, Mycobacterium leprae
gcaguccguccagcgugacgau

SEQ ID NO: 143788 - RNA, 22 nt, Mycobacterium leprae
uugcgguuuugccgcugcgcga

SEQ ID NO: 143789 - RNA, 22 nt, Mycobacterium leprae
auaucggcgucgccgacguagg

SEQ ID NO: 143790 - RNA, 22 nt, Mycobacterium leprae
ccccggaagcauuguguuagcc

SEQ ID NO: 143791 - RNA, 22 nt, Mycobacterium leprae
gccgcggccauguggcugaccg

SEQ ID NO: 143792 - RNA, 22 nt, Mycobacterium leprae
gcucggcgcccgcuccggccaa

SEQ ID NO: 143793 - RNA, 22 nt, Mycobacterium leprae
gccugguucgccgacgaagcac

SEQ ID NO: 143794 - RNA, 22 nt, Mycobacterium leprae
ggugcaccgcccggcuacauug

SEQ ID NO: 143795 - RNA, 22 nt, Mycobacterium leprae
cagauaacagucacgacaucac

SEQ ID NO: 143796 - RNA, 22 nt, Mycobacterium leprae
guguauccuuuccaguacgcag

SEQ ID NO: 143797 - RNA, 22 nt, Mycobacterium leprae
ucgguauccgggucgggcauug

SEQ ID NO: 143798 - RNA, 22 nt, Mycobacterium leprae
cgcgagaucgaucgugagcugg

SEQ ID NO: 143799 - RNA, 22 nt, Mycobacterium leprae
acggaucaauaccgacgcgaug

SEQ ID NO: 143800 - RNA, 21 nt, Mycobacterium leprae
cguggcacaacagcuggcguc

SEQ ID NO: 143801 - RNA, 19 nt, Mycobacterium leprae
gcccggugcgcaugcagga

SEQ ID NO: 143802 - RNA, 22 nt, Mycobacterium leprae
gucgaauacugugaucucaccc

SEQ ID NO: 143803 - RNA, 22 nt, Mycobacterium leprae
uccgcgcacgccuuuggucgca

SEQ ID NO: 143804 - RNA, 22 nt, Mycobacterium leprae
uucggcuuugccggaccgguuc

SEQ ID NO: 143805 - RNA, 22 nt, Mycobacterium leprae
guagaucauuacccugcugguc

SEQ ID NO: 143806 - RNA, 23 nt, Mycobacterium leprae
acgucgagauagucgccggcugc

SEQ ID NO: 143807 - RNA, 22 nt, Mycobacterium leprae
ugaccuuguauuucgacgggag

SEQ ID NO: 143808 - RNA, 22 nt, Mycobacterium leprae
gucgguaccuaggcggcugcca

SEQ ID NO: 143809 - RNA, 22 nt, Mycobacterium leprae
cggccggaacucgucggaucca

SEQ ID NO: 143810 - RNA, 22 nt, Mycobacterium leprae
gacgacguggcggucaccacag

SEQ ID NO: 143811 - RNA, 22 nt, Mycobacterium leprae
cauccuggcgcauugacgugcc

SEQ ID NO: 143812 - RNA, 22 nt, Mycobacterium leprae
caguaguucaccgcgcugccgu

SEQ ID NO: 143813 - RNA, 22 nt, Mycobacterium leprae
ggugguggugcaaagguuugau

SEQ ID NO: 143814 - RNA, 21 nt, Mycobacterium leprae
uggauccggacagcaauccga

SEQ ID NO: 143815 - RNA, 22 nt, Mycobacterium leprae
ugcugcaucuugguggcuguag

SEQ ID NO: 143816 - RNA, 22 nt, Mycobacterium leprae
aucgccgaacaccgacucaaac

SEQ ID NO: 143817 - RNA, 22 nt, Mycobacterium leprae
ugacuucgcaagcgcguaucga

SEQ ID NO: 143818 - RNA, 22 nt, Mycobacterium leprae
ucgcgagggcgcgugucuguac

SEQ ID NO: 143819 - RNA, 22 nt, Mycobacterium leprae
cgcggauucgccaugaacugac

SEQ ID NO: 143820 - RNA, 22 nt, Mycobacterium leprae
uacggccgguagacccgcuggc

SEQ ID NO: 143821 - RNA, 22 nt, Mycobacterium leprae
acuggucgaugcugaugguugg

SEQ ID NO: 143822 - RNA, 22 nt, Mycobacterium leprae
aauugaccaccacccgggcagc

SEQ ID NO: 143823 - RNA, 22 nt, Mycobacterium leprae
cgagcugcgacuagcugaugcc

SEQ ID NO: 143824 - RNA, 22 nt, Mycobacterium leprae
ccagccacgcugaauggucgcc

SEQ ID NO: 143825 - RNA, 22 nt, Mycobacterium leprae
accggcguccggauugaggaug

SEQ ID NO: 143826 - RNA, 22 nt, Mycobacterium leprae
cgaauucggcuacugggccgau

SEQ ID NO: 143827 - RNA, 19 nt, Mycobacterium leprae
ugcccgucugaucggggua

SEQ ID NO: 143828 - RNA, 22 nt, Mycobacterium leprae
ggacgccgucugugaucuuuag

SEQ ID NO: 143829 - RNA, 22 nt, Mycobacterium leprae
ccggccagaagcgaugcccgua

SEQ ID NO: 143830 - RNA, 22 nt, Mycobacterium leprae
ggcauuggugguucagaccugg

SEQ ID NO: 143831 - RNA, 22 nt, Mycobacterium leprae
ucgugugcggucgucgcagauc

SEQ ID NO: 143832 - RNA, 22 nt, Mycobacterium leprae
gcggagauucgcgcgaugaaug

SEQ ID NO: 143833 - RNA, 22 nt, Mycobacterium leprae
caacaucucggggugcaacuug

SEQ ID NO: 143834 - RNA, 22 nt, Mycobacterium leprae
agcggcccgaugucgcuggaga

SEQ ID NO: 143835 - RNA, 22 nt, Mycobacterium leprae
ugccuggcagcaugcgcuccag

SEQ ID NO: 143836 - RNA, 22 nt, Mycobacterium leprae
agugcugcugaucgucgguguc

SEQ ID NO: 143837 - RNA, 22 nt, Mycobacterium leprae
aacgggcguuggacugcggagc

SEQ ID NO: 143838 - RNA, 22 nt, Mycobacterium leprae
gaucaucgucagcgcacgauuc

SEQ ID NO: 143839 - RNA, 22 nt, Mycobacterium leprae
gggugcgauugccauggucggc

SEQ ID NO: 143840 - RNA, 22 nt, Mycobacterium leprae
ggcgacggugaaauggacgagc

SEQ ID NO: 143841 - RNA, 21 nt, Mycobacterium leprae
gccauccgggucaccccgaag

SEQ ID NO: 143842 - RNA, 22 nt, Mycobacterium leprae
ggcgcggcaucuggaguugcgg

SEQ ID NO: 143843 - RNA, 22 nt, Mycobacterium leprae
agggcgccaaauugggcgugcc

SEQ ID NO: 143844 - RNA, 22 nt, Mycobacterium leprae
gcugcuggaauuccucgaggua

SEQ ID NO: 143845 - RNA, 22 nt, Mycobacterium leprae
cgacgggucggaauaccgcgga

SEQ ID NO: 143846 - RNA, 22 nt, Mycobacterium leprae
cccaggcggcgaucagugcaca

SEQ ID NO: 143847 - RNA, 22 nt, Mycobacterium leprae
gccgaucgacccgcgcgacguc

SEQ ID NO: 143848 - RNA, 22 nt, Mycobacterium leprae
ucggcgucauccgccgaugcca

SEQ ID NO: 143849 - RNA, 22 nt, Mycobacterium leprae
ugcacgugggcagugcccagca

SEQ ID NO: 143850 - RNA, 22 nt, Mycobacterium leprae
cauucuggucucgcgugccaag

SEQ ID NO: 143851 - RNA, 22 nt, Mycobacterium leprae
caccacuguugaggaaggugau

SEQ ID NO: 143852 - RNA, 22 nt, Mycobacterium leprae
acgcacgagaucggggcgggcu

SEQ ID NO: 143853 - RNA, 22 nt, Mycobacterium leprae
gcugcaacgcggucagcaucgc

SEQ ID NO: 143854 - RNA, 22 nt, Mycobacterium leprae
ccagcuugcgugucguguucgu

SEQ ID NO: 143855 - RNA, 22 nt, Mycobacterium leprae
gcgugaguuccaccucgguggu

SEQ ID NO: 143856 - RNA, 22 nt, Mycobacterium leprae
cugucgauguggauuacgacau

SEQ ID NO: 143857 - RNA, 22 nt, Mycobacterium leprae
gcagcgcgcugggguuuucgcu

SEQ ID NO: 143858 - RNA, 22 nt, Mycobacterium leprae
ucgccgagcgccuugcugaggg

SEQ ID NO: 143859 - RNA, 22 nt, Mycobacterium leprae
uugggucauugcugccgccggg

SEQ ID NO: 143860 - RNA, 22 nt, Mycobacterium leprae
ucgucgccuacgcuggguuauc

SEQ ID NO: 143861 - RNA, 19 nt, Mycobacterium leprae
accucggugaucgcgguga

SEQ ID NO: 143862 - RNA, 22 nt, Mycobacterium leprae
uggcagccgugaagacgauguc

SEQ ID NO: 143863 - RNA, 22 nt, Mycobacterium leprae
cgacacgcugaacuuguguugu

SEQ ID NO: 143864 - RNA, 22 nt, Mycobacterium leprae
cgaccugcaggucguuaucgcg

SEQ ID NO: 143865 - RNA, 22 nt, Mycobacterium leprae
ucggaucgauauguacugcgcg

SEQ ID NO: 143866 - RNA, 22 nt, Mycobacterium leprae
acgcucgaaauacgcgcagcug

SEQ ID NO: 143867 - RNA, 22 nt, Mycobacterium leprae
augguggugacucgcuagcccg

SEQ ID NO: 143868 - RNA, 22 nt, Mycobacterium leprae
gggagcuauugaugcgccgagu

SEQ ID NO: 143869 - RNA, 22 nt, Mycobacterium leprae
uuagcguaagacaacgccagcg

SEQ ID NO: 143870 - RNA, 22 nt, Mycobacterium leprae
cagccaggcagcugcuaggcgg

SEQ ID NO: 143871 - RNA, 22 nt, Mycobacterium leprae
gcgcugaucugggugaggauau

SEQ ID NO: 143872 - RNA, 22 nt, Mycobacterium leprae
cucgcggcugccucaucgaugc

SEQ ID NO: 143873 - RNA, 22 nt, Mycobacterium leprae
cgggcggugaccuucccgcgca

SEQ ID NO: 143874 - RNA, 22 nt, Mycobacterium leprae
agcacgacacuucgacgcuggc

SEQ ID NO: 143875 - RNA, 22 nt, Mycobacterium leprae
gaugucgacgacauccuguggc

SEQ ID NO: 143876 - RNA, 22 nt, Mycobacterium leprae
auugauugccauaucacgucca

SEQ ID NO: 143877 - RNA, 22 nt, Mycobacterium leprae
gccccuccgaucugcucggucu

SEQ ID NO: 143878 - RNA, 22 nt, Mycobacterium leprae
cgccucgaguauggcgauccgg

SEQ ID NO: 143879 - RNA, 22 nt, Mycobacterium leprae
acgucgguugaucauggguggu

SEQ ID NO: 143880 - RNA, 21 nt, Mycobacterium leprae
cagcucgagggcuauuggcua

SEQ ID NO: 143881 - RNA, 19 nt, Mycobacterium leprae
cggcuucgaauuauugugc

SEQ ID NO: 143882 - RNA, 22 nt, Mycobacterium leprae
cgggguggucgaccggcauguu

SEQ ID NO: 143883 - RNA, 22 nt, Mycobacterium leprae
uccaccaggcaauggcuugcca

SEQ ID NO: 143884 - RNA, 22 nt, Mycobacterium leprae
ugacgcugaucuugauguugcc

SEQ ID NO: 143885 - RNA, 22 nt, Mycobacterium leprae
ugucgacgcgugucgacugacu

SEQ ID NO: 143886 - RNA, 22 nt, Mycobacterium leprae
gcgacaccaucgugccggaagu

SEQ ID NO: 143887 - RNA, 23 nt, Mycobacterium leprae
uagcuugcugcgcuggcuuauuc

SEQ ID NO: 143888 - RNA, 22 nt, Mycobacterium leprae
cgucggaucggauaucggcguu

SEQ ID NO: 143889 - RNA, 23 nt, Mycobacterium leprae
guaaggauggcgcucugguuggu

SEQ ID NO: 143890 - RNA, 23 nt, Mycobacterium leprae
ucgccagggcuuauaccaucgcg

SEQ ID NO: 143891 - RNA, 22 nt, Mycobacterium leprae
ugaguccguggauugcggccag

SEQ ID NO: 143892 - RNA, 22 nt, Mycobacterium leprae
aacuguuuucuccagcuagcuc

SEQ ID NO: 143893 - RNA, 23 nt, Mycobacterium leprae
ccgcggugcuagccacgaugauc

SEQ ID NO: 143894 - RNA, 22 nt, Mycobacterium leprae
cagcgugguguucugcggcuuu

SEQ ID NO: 143895 - RNA, 22 nt, Mycobacterium leprae
gcauccgguuagcugaccgcgc

SEQ ID NO: 143896 - RNA, 22 nt, Mycobacterium leprae
gcucggcgugaaggacauggug

SEQ ID NO: 143897 - RNA, 22 nt, Mycobacterium leprae
cagcguuacugcaaguugacac

SEQ ID NO: 143898 - RNA, 22 nt, Mycobacterium leprae
agagcacauucugcggacuaua

SEQ ID NO: 143899 - RNA, 21 nt, Mycobacterium leprae
gacacggcguugggugcuagc

SEQ ID NO: 143900 - RNA, 22 nt, Mycobacterium leprae
cgagcauugcaugcucgcguug

SEQ ID NO: 143901 - RNA, 20 nt, Mycobacterium leprae
uguucaugagcgucggacau

SEQ ID NO: 143902 - RNA, 22 nt, Mycobacterium leprae
ucggauucagugcggauccgcc

SEQ ID NO: 143903 - RNA, 22 nt, Mycobacterium leprae
ugguggaaguugguuacggcga

SEQ ID NO: 143904 - RNA, 22 nt, Mycobacterium leprae
acgugcugacauucggcgggcu

SEQ ID NO: 143905 - RNA, 22 nt, Mycobacterium leprae
ccgggucuggcgucgacguaau

SEQ ID NO: 143906 - RNA, 22 nt, Mycobacterium leprae
aucgccgaagcggaacgaugga

SEQ ID NO: 143907 - RNA, 22 nt, Mycobacterium leprae
gacgcggucaaggacugcgacu

SEQ ID NO: 143908 - RNA, 22 nt, Mycobacterium leprae
ucaacguugccgucgacaugcu

SEQ ID NO: 143909 - RNA, 22 nt, Mycobacterium leprae
uauguccugggacuugcuucug

SEQ ID NO: 143910 - RNA, 22 nt, Mycobacterium leprae
aaccgguuguccaucaucgaca

SEQ ID NO: 143911 - RNA, 22 nt, Mycobacterium leprae
gucgcggucuugaacggucuca

SEQ ID NO: 143912 - RNA, 22 nt, Mycobacterium leprae
cgcggagggacgcugggaugau

SEQ ID NO: 143913 - RNA, 22 nt, Mycobacterium leprae
cggaauccuguugacguguuuu

SEQ ID NO: 143914 - RNA, 18 nt, Mycobacterium leprae
gcggucgccgaaggucgg

SEQ ID NO: 143915 - RNA, 22 nt, Mycobacterium leprae
ccccgccaguugcuuggcuaca

SEQ ID NO: 143916 - RNA, 22 nt, Mycobacterium leprae
acuucgccggcggacuucggau

SEQ ID NO: 143917 - RNA, 22 nt, Mycobacterium leprae
uacgacgucgagauugucgcgg

SEQ ID NO: 143918 - RNA, 22 nt, Mycobacterium leprae
gcaugcagcuauuggcgaccau

SEQ ID NO: 143919 - RNA, 22 nt, Mycobacterium leprae
gaguuggccaagcaccgugccg

SEQ ID NO: 143920 - RNA, 17 nt, Mycobacterium leprae
aagauuuaacuguaccg

SEQ ID NO: 143921 - RNA, 22 nt, Mycobacterium leprae
acaucgguguaaugaucagcca

SEQ ID NO: 143922 - RNA, 22 nt, Mycobacterium leprae
acagcacgaucccgucauccag

SEQ ID NO: 143923 - RNA, 22 nt, Mycobacterium leprae
gcagcgagauugcgcaagaacg

SEQ ID NO: 143924 - RNA, 20 nt, Mycobacterium leprae
accagcgccagcaaucuacu

SEQ ID NO: 143925 - RNA, 22 nt, Mycobacterium leprae
uagccugugcaccgcacuguga

SEQ ID NO: 143926 - RNA, 16 nt, Mycobacterium leprae
gagcggugaaucacuu

SEQ ID NO: 143927 - RNA, 22 nt, Mycobacterium leprae
agcaccugcccgacgcggcggg

SEQ ID NO: 143928 - RNA, 22 nt, Mycobacterium leprae
gguggccgcuucgaggugauca

SEQ ID NO: 143929 - RNA, 22 nt, Mycobacterium leprae
uggcggucaagacgguagcugc

SEQ ID NO: 143930 - RNA, 22 nt, Mycobacterium leprae
gagcacccauuucugcagcauc

SEQ ID NO: 143931 - RNA, 22 nt, Mycobacterium leprae
ucgacgucgaucucgauauugu

SEQ ID NO: 143932 - RNA, 22 nt, Mycobacterium leprae
gccggucacggucugggugccg

SEQ ID NO: 143933 - RNA, 21 nt, Mycobacterium leprae
uccgguuguuaugucucgggc

SEQ ID NO: 143934 - RNA, 19 nt, Mycobacterium leprae
uuucgcacagguuccggcg

SEQ ID NO: 143935 - RNA, 22 nt, Mycobacterium leprae
gacgucaucuucuacggcccgg

SEQ ID NO: 143936 - RNA, 22 nt, Mycobacterium leprae
ucauggcggcuauggugucggc

SEQ ID NO: 143937 - RNA, 21 nt, Mycobacterium leprae
auccaucacuucgccgaccac

SEQ ID NO: 143938 - RNA, 23 nt, Mycobacterium leprae
ccacugcauuguaggcgcgggua

SEQ ID NO: 143939 - RNA, 22 nt, Mycobacterium leprae
gguucgagucacagccguacga

SEQ ID NO: 143940 - RNA, 22 nt, Mycobacterium leprae
gucgaucggauuguccgaauug

SEQ ID NO: 143941 - RNA, 22 nt, Mycobacterium leprae
gccgugaucuccccggaccgca

SEQ ID NO: 143942 - RNA, 22 nt, Mycobacterium leprae
agucaccgaguuacugaccgau

SEQ ID NO: 143943 - RNA, 22 nt, Mycobacterium leprae
agccauccuggugagcuuucuu

SEQ ID NO: 143944 - RNA, 22 nt, Mycobacterium leprae
auugggcgaugucgucguugcg

SEQ ID NO: 143945 - RNA, 21 nt, Mycobacterium leprae
ccccggaaccgcccagcacau

SEQ ID NO: 143946 - RNA, 22 nt, Mycobacterium leprae
uuuacccgccuaagcgauuccu

SEQ ID NO: 143947 - RNA, 22 nt, Mycobacterium leprae
ccgggcgacgcuuauuggcugc

SEQ ID NO: 143948 - RNA, 22 nt, Mycobacterium leprae
gugcggccaucaaucagucuac

SEQ ID NO: 143949 - RNA, 22 nt, Mycobacterium leprae
ccuggcgcagucuaaggugguu

SEQ ID NO: 143950 - RNA, 22 nt, Mycobacterium leprae
gucggccaggugaccguagaug

SEQ ID NO: 143951 - RNA, 22 nt, Mycobacterium leprae
accucgcgguggaagaucgcuc

SEQ ID NO: 143952 - RNA, 22 nt, Mycobacterium leprae
gaccggguugaaaagcaucgcu

SEQ ID NO: 143953 - RNA, 22 nt, Mycobacterium leprae
ggcugaucaccgaccgguuguu

SEQ ID NO: 143954 - RNA, 22 nt, Mycobacterium leprae
cgggucgacguuguugggccuu

SEQ ID NO: 143955 - RNA, 22 nt, Mycobacterium leprae
gggucggcauaggcuaccggug

SEQ ID NO: 143956 - RNA, 21 nt, Mycobacterium leprae
cgccgaccaacgggucuuggu

SEQ ID NO: 143957 - RNA, 22 nt, Mycobacterium leprae
aucgguuucuuaccggagucga

SEQ ID NO: 143958 - RNA, 22 nt, Mycobacterium leprae
acaccauccaugagcagaccgc

SEQ ID NO: 143959 - RNA, 22 nt, Mycobacterium leprae
uuggcuguucaacaugggcaug

SEQ ID NO: 143960 - RNA, 22 nt, Mycobacterium leprae
ucagcgguggucggcgagcagc

SEQ ID NO: 143961 - RNA, 22 nt, Mycobacterium leprae
uucgaccuuuuccugcugcgcu

SEQ ID NO: 143962 - RNA, 22 nt, Mycobacterium leprae
cggcggcaccaaucgcgacguc

SEQ ID NO: 143963 - RNA, 20 nt, Mycobacterium leprae
uacgucgaucgcuagcccgg

SEQ ID NO: 143964 - RNA, 22 nt, Mycobacterium leprae
caucggucgcgagguguucgcg

SEQ ID NO: 143965 - RNA, 18 nt, Mycobacterium leprae
cggagagcgucgcgccga

SEQ ID NO: 143966 - RNA, 22 nt, Mycobacterium leprae
cggcgacucacuggcgugagcg

SEQ ID NO: 143967 - RNA, 23 nt, Mycobacterium leprae
accaagcccaucgucaguuugcg

SEQ ID NO: 143968 - RNA, 20 nt, Mycobacterium leprae
cugucgaugcguggaggcgc

SEQ ID NO: 143969 - RNA, 22 nt, Mycobacterium leprae
ucuggcauaguugguugcauga

SEQ ID NO: 143970 - RNA, 22 nt, Mycobacterium leprae
ggugcagucgcuacguuccggu

SEQ ID NO: 143971 - RNA, 22 nt, Mycobacterium leprae
aacggugucgaacgacugcggu

SEQ ID NO: 143972 - RNA, 22 nt, Mycobacterium leprae
ugcgccgcuuagcugguggguu

SEQ ID NO: 143973 - RNA, 22 nt, Mycobacterium leprae
ugaccuguucagcggugcgaau

SEQ ID NO: 143974 - RNA, 22 nt, Mycobacterium leprae
accggcuaccucugaagcgugu

SEQ ID NO: 143975 - RNA, 22 nt, Mycobacterium leprae
gccaccgcgacaucgucgcacc

SEQ ID NO: 143976 - RNA, 22 nt, Mycobacterium leprae
aggcugaccucggucacuacuu

SEQ ID NO: 143977 - RNA, 22 nt, Mycobacterium leprae
gacccgccacagcgacgaugcc

SEQ ID NO: 143978 - RNA, 22 nt, Mycobacterium leprae
ugcccgcgacgacuucgccggg

SEQ ID NO: 143979 - RNA, 23 nt, Mycobacterium leprae
ugggcgaugguuaauguuagcgc

SEQ ID NO: 143980 - RNA, 22 nt, Mycobacterium leprae
accgacuacggaucaccuggca

SEQ ID NO: 143981 - RNA, 22 nt, Mycobacterium leprae
guggcggcuggucccggaauua

SEQ ID NO: 143982 - RNA, 22 nt, Mycobacterium leprae
uucgcugacguggacgugcugg

SEQ ID NO: 143983 - RNA, 20 nt, Mycobacterium leprae
ucggcugugacuagccggcg

SEQ ID NO: 143984 - RNA, 22 nt, Mycobacterium leprae
ccgaggcgcccacaccgcgguu

SEQ ID NO: 143985 - RNA, 22 nt, Mycobacterium leprae
uccggccgacaguggcaagauc

SEQ ID NO: 143986 - RNA, 21 nt, Mycobacterium leprae
ugcuuggccgcaauccggugc

SEQ ID NO: 143987 - RNA, 22 nt, Mycobacterium leprae
cauccaguuuuccaccgguggu

SEQ ID NO: 143988 - RNA, 22 nt, Mycobacterium leprae
gacuggccuggucguagcgucg

SEQ ID NO: 143989 - RNA, 22 nt, Mycobacterium leprae
ggccaauucuuccgcuauguug

SEQ ID NO: 143990 - RNA, 22 nt, Mycobacterium leprae
ugaccgauccgggcgccgcguc

SEQ ID NO: 143991 - RNA, 22 nt, Mycobacterium leprae
augcugccauuagcugaugcag

SEQ ID NO: 143992 - RNA, 22 nt, Mycobacterium leprae
ggccgggcgcagucggaggcuc

SEQ ID NO: 143993 - RNA, 22 nt, Mycobacterium leprae
auaccuggaacgguucggcugu

SEQ ID NO: 143994 - RNA, 22 nt, Mycobacterium leprae
agucgguaucggcagcgucgaa

SEQ ID NO: 143995 - RNA, 22 nt, Mycobacterium leprae
gccgcugugcacgcgucguggu

SEQ ID NO: 143996 - RNA, 22 nt, Mycobacterium leprae
cgucggucgugacacgcgccgc

SEQ ID NO: 143997 - RNA, 22 nt, Mycobacterium leprae
aucuuggagaacccggccuggu

SEQ ID NO: 143998 - RNA, 22 nt, Mycobacterium leprae
cgucaucgacugccuugccguu

SEQ ID NO: 143999 - RNA, 19 nt, Mycobacterium leprae
uggugcgccagcuuuuucc

SEQ ID NO: 144000 - RNA, 22 nt, Mycobacterium leprae
gaggcgaugaaggcgcugacgg

SEQ ID NO: 144001 - RNA, 22 nt, Mycobacterium leprae
ucggcaccggccaggucauggu

SEQ ID NO: 144002 - RNA, 22 nt, Mycobacterium leprae
cuaguugacgaagaucggugcg

SEQ ID NO: 144003 - RNA, 17 nt, Mycobacterium leprae
aguguuggcggcggcau

SEQ ID NO: 144004 - RNA, 22 nt, Mycobacterium leprae
uccuggugugcaguaucgggcg

SEQ ID NO: 144005 - RNA, 22 nt, Mycobacterium leprae
cgccugauagcggcuuuuagca

SEQ ID NO: 144006 - RNA, 22 nt, Mycobacterium leprae
uccuggugcucaggcucggccu

SEQ ID NO: 144007 - RNA, 22 nt, Mycobacterium leprae
uggaaacgccgugguugaaguc

SEQ ID NO: 144008 - RNA, 20 nt, Mycobacterium leprae
cgauggcaucgucgcggcuc

SEQ ID NO: 144009 - RNA, 22 nt, Mycobacterium leprae
caacgugcuugcgguggccaac

SEQ ID NO: 144010 - RNA, 19 nt, Mycobacterium leprae
aucagcgaccgcaccaucg

SEQ ID NO: 144011 - RNA, 19 nt, Mycobacterium leprae
ucagccacauggccgcggc

SEQ ID NO: 144012 - RNA, 22 nt, Mycobacterium leprae
gugauggauuggaugaccggug

SEQ ID NO: 144013 - RNA, 23 nt, Mycobacterium leprae
uuaucagaacccagcgugagacg

SEQ ID NO: 144014 - RNA, 22 nt, Mycobacterium leprae
gaccuggucuuugacacuguga

SEQ ID NO: 144015 - RNA, 22 nt, Mycobacterium leprae
auucuguuguggacgggaguga

SEQ ID NO: 144016 - RNA, 22 nt, Mycobacterium leprae
agcggucauacugcgcuggcuc

SEQ ID NO: 144017 - RNA, 22 nt, Mycobacterium leprae
caccaacagccgcaccuagaug

SEQ ID NO: 144018 - RNA, 22 nt, Mycobacterium leprae
cagccccgaggcagcucguugg

SEQ ID NO: 144019 - RNA, 22 nt, Mycobacterium leprae
ggccaucaucaccccggcguug

SEQ ID NO: 144020 - RNA, 21 nt, Mycobacterium leprae
uucagugaaccacgccauggc

SEQ ID NO: 144021 - RNA, 22 nt, Mycobacterium leprae
ucgggugauuaugcuuagcagg

SEQ ID NO: 144022 - RNA, 22 nt, Mycobacterium leprae
cgucgaugaugaugucgcuggg

SEQ ID NO: 144023 - RNA, 22 nt, Mycobacterium leprae
ugccggucgggucuugguuaac

SEQ ID NO: 144024 - RNA, 23 nt, Mycobacterium leprae
gcacuugacagcaugcuugacug

SEQ ID NO: 144025 - RNA, 22 nt, Mycobacterium leprae
ccgcggucgacacagcugcaac

SEQ ID NO: 144026 - RNA, 22 nt, Mycobacterium leprae
uagcaaggccauggcgccgacc

SEQ ID NO: 144027 - RNA, 22 nt, Mycobacterium leprae
acgcuugcuucccucgauuggc

SEQ ID NO: 144028 - RNA, 18 nt, Mycobacterium leprae
cccgucaagccgucgucu

SEQ ID NO: 144029 - RNA, 22 nt, Mycobacterium leprae
cgggaacaccagugcaucgaug

SEQ ID NO: 144030 - RNA, 22 nt, Mycobacterium leprae
aggcuuggcuccgugaugcuua

SEQ ID NO: 144031 - RNA, 22 nt, Mycobacterium leprae
aggugugguuaggcgacaccgc

SEQ ID NO: 144032 - RNA, 22 nt, Mycobacterium leprae
gcauccuggggccucgcccgau

SEQ ID NO: 144033 - RNA, 22 nt, Mycobacterium leprae
gcuaucguugucgaugcccgug

SEQ ID NO: 144034 - RNA, 22 nt, Mycobacterium leprae
aucgucaggucccccgacggca

SEQ ID NO: 144035 - RNA, 23 nt, Mycobacterium leprae
augaccuggcccaucgcccaagc

SEQ ID NO: 144036 - RNA, 22 nt, Mycobacterium leprae
acguccuguugcgguaccgccc

SEQ ID NO: 144037 - RNA, 22 nt, Mycobacterium leprae
uaugaagugucuccugccauua

SEQ ID NO: 144038 - RNA, 22 nt, Mycobacterium leprae
ccgccgacgagaucaagacggu

SEQ ID NO: 144039 - RNA, 22 nt, Mycobacterium leprae
gaucgcugcgguugguauuguc

SEQ ID NO: 144040 - RNA, 22 nt, Mycobacterium leprae
gcgcagcgugaagucggggcgg

SEQ ID NO: 144041 - RNA, 22 nt, Mycobacterium leprae
acagaucgaacucgacgcggcc

SEQ ID NO: 144042 - RNA, 22 nt, Mycobacterium leprae
cugccaccagguacggucgucg

SEQ ID NO: 144043 - RNA, 22 nt, Mycobacterium leprae
acgggcaccgaucacaauguug

SEQ ID NO: 144044 - RNA, 20 nt, Mycobacterium leprae
ugcgucgacggguguugccg

SEQ ID NO: 144045 - RNA, 22 nt, Mycobacterium leprae
cagcgcugaucucgcaggcgac

SEQ ID NO: 144046 - RNA, 22 nt, Mycobacterium leprae
guuggcauaguuagaaccgaag

SEQ ID NO: 144047 - RNA, 22 nt, Mycobacterium leprae
cgcgcggaucacggccguuucc

SEQ ID NO: 144048 - RNA, 22 nt, Mycobacterium leprae
agcgaaacgcgcgacgauuguu

SEQ ID NO: 144049 - RNA, 22 nt, Mycobacterium leprae
cugggccgcaagaucccgucug

SEQ ID NO: 144050 - RNA, 22 nt, Mycobacterium leprae
uuggcggugagcuugccguggu

SEQ ID NO: 144051 - RNA, 22 nt, Mycobacterium leprae
acagcgacauucuucagggcau

SEQ ID NO: 144052 - RNA, 22 nt, Mycobacterium leprae
ucgaacgauugucuucuugcca

SEQ ID NO: 144053 - RNA, 22 nt, Mycobacterium leprae
acggcgagggcagguagucgau

SEQ ID NO: 144054 - RNA, 22 nt, Mycobacterium leprae
gacugguguucuuggcgaauuc

SEQ ID NO: 144055 - RNA, 22 nt, Mycobacterium leprae
ugcgggugauaucgaccucgac

SEQ ID NO: 144056 - RNA, 22 nt, Mycobacterium leprae
uggugcgcaaucacguugccga

SEQ ID NO: 144057 - RNA, 22 nt, Mycobacterium leprae
uccaaaacuaaguugaucccug

SEQ ID NO: 144058 - RNA, 22 nt, Mycobacterium leprae
gcgacgcugugcuauuggcuuc

SEQ ID NO: 144059 - RNA, 22 nt, Mycobacterium leprae
ccagcggcucagucuuggcggc

SEQ ID NO: 144060 - RNA, 22 nt, Mycobacterium leprae
ugacagugcgaggucugggcua

SEQ ID NO: 144061 - RNA, 22 nt, Mycobacterium leprae
caccgcggucgcggcugcaauc

SEQ ID NO: 144062 - RNA, 22 nt, Mycobacterium leprae
uaccgcggugauuuuugcaccc

SEQ ID NO: 144063 - RNA, 22 nt, Mycobacterium leprae
augcuguguuucaaccguauug

SEQ ID NO: 144064 - RNA, 20 nt, Mycobacterium leprae
uccucaucaaucauacgcgc

SEQ ID NO: 144065 - RNA, 22 nt, Mycobacterium leprae
gcugcugucggccaacauugac

SEQ ID NO: 144066 - RNA, 22 nt, Mycobacterium leprae
auagcgcgucgucaccggcaug

SEQ ID NO: 144067 - RNA, 22 nt, Mycobacterium leprae
uccguuguuugucaucgacgaa

SEQ ID NO: 144068 - RNA, 22 nt, Mycobacterium leprae
auagucuaucgugccguccgcg

SEQ ID NO: 144069 - RNA, 22 nt, Mycobacterium leprae
cuggcuggauauccgcagccug

SEQ ID NO: 144070 - RNA, 22 nt, Mycobacterium leprae
ucgaaaucgacgccaacaugua

SEQ ID NO: 144071 - RNA, 22 nt, Mycobacterium leprae
gauguacgaaggucgaccgcag

SEQ ID NO: 144072 - RNA, 20 nt, Mycobacterium leprae
ucuauuaagauuaacguggc

SEQ ID NO: 144073 - RNA, 22 nt, Mycobacterium leprae
guuggcgaucucaccgcgggcg

SEQ ID NO: 144074 - RNA, 22 nt, Mycobacterium leprae
ccagcggggcgugcaacgcggu

SEQ ID NO: 144075 - RNA, 22 nt, Mycobacterium leprae
gcguuggcuuccugaucgcggc

SEQ ID NO: 144076 - RNA, 22 nt, Mycobacterium leprae
cgaugcaggccaucacuaccgg

SEQ ID NO: 144077 - RNA, 22 nt, Mycobacterium leprae
cggcaugagcugaucgcagucg

SEQ ID NO: 144078 - RNA, 22 nt, Mycobacterium leprae
agcuugacaucgggugguuuca

SEQ ID NO: 144079 - RNA, 22 nt, Mycobacterium leprae
uccaugcugccguggauuucga

SEQ ID NO: 144080 - RNA, 22 nt, Mycobacterium leprae
ccaggacguucaucgcauccac

SEQ ID NO: 144081 - RNA, 22 nt, Mycobacterium leprae
gcacugcaccauugacgauuag

SEQ ID NO: 144082 - RNA, 22 nt, Mycobacterium leprae
guuugucacgauuccugcuagc

SEQ ID NO: 144083 - RNA, 22 nt, Mycobacterium leprae
gacggaugcguucgcggguuac

SEQ ID NO: 144084 - RNA, 22 nt, Mycobacterium leprae
guaucgcuguagcgcuucuccu

SEQ ID NO: 144085 - RNA, 22 nt, Mycobacterium leprae
cugguuuugguccuggggcagg

SEQ ID NO: 144086 - RNA, 22 nt, Mycobacterium leprae
gaugugucgguuggauauucgg

SEQ ID NO: 144087 - RNA, 22 nt, Mycobacterium leprae
ucggugucuacgucaacgcccu

SEQ ID NO: 144088 - RNA, 22 nt, Mycobacterium leprae
aucggaaucaaggguccggcag

SEQ ID NO: 144089 - RNA, 22 nt, Mycobacterium leprae
gcaccggccggucaaacgcacc

SEQ ID NO: 144090 - RNA, 22 nt, Mycobacterium leprae
uuguugcuuaacuggauaacga

SEQ ID NO: 144091 - RNA, 18 nt, Mycobacterium leprae
ugcggcgaaggugguacc

SEQ ID NO: 144092 - RNA, 22 nt, Mycobacterium leprae
augccguagcuucaauacuaaa

SEQ ID NO: 144093 - RNA, 22 nt, Mycobacterium leprae
ggcauugaggccgcuuacggug

SEQ ID NO: 144094 - RNA, 22 nt, Mycobacterium leprae
agguaaucccggacugaccgca

SEQ ID NO: 144095 - RNA, 22 nt, Mycobacterium leprae
ggugaacugcucggcugcuucg

SEQ ID NO: 144096 - RNA, 22 nt, Mycobacterium leprae
ugcaucgccggcaugaccacuu

SEQ ID NO: 144097 - RNA, 22 nt, Mycobacterium leprae
cgagacgaccuguugugguguc

SEQ ID NO: 144098 - RNA, 22 nt, Mycobacterium leprae
ucagcggugucagacaccgagu

SEQ ID NO: 144099 - RNA, 22 nt, Mycobacterium leprae
caccugcaacgcacgugucuug

SEQ ID NO: 144100 - RNA, 22 nt, Mycobacterium leprae
gccuuaggugcggugccagguu

SEQ ID NO: 144101 - RNA, 19 nt, Mycobacterium leprae
gcuucgccgaggcguuccg

SEQ ID NO: 144102 - RNA, 20 nt, Mycobacterium leprae
ucucaaacugcucaacacgu

SEQ ID NO: 144103 - RNA, 22 nt, Mycobacterium leprae
ucucaauuugcugggauuguuc

SEQ ID NO: 144104 - RNA, 22 nt, Mycobacterium leprae
guuguugugauaaccgcauaga

SEQ ID NO: 144105 - RNA, 22 nt, Mycobacterium leprae
aacccgaauuugcagcaggucc

SEQ ID NO: 144106 - RNA, 22 nt, Mycobacterium leprae
ccuggcugauccaauccggcag

SEQ ID NO: 144107 - RNA, 20 nt, Mycobacterium leprae
cguugcgcgauaaucuucgc

SEQ ID NO: 144108 - RNA, 22 nt, Mycobacterium leprae
cucgcggcuagguaggcuuuca

SEQ ID NO: 144109 - RNA, 22 nt, Mycobacterium leprae
gccacgcuggcuugcaccgcgg

SEQ ID NO: 144110 - RNA, 22 nt, Mycobacterium leprae
ucgcgcaggccuggucuuugac

SEQ ID NO: 144111 - RNA, 22 nt, Mycobacterium leprae
ugcgcuacuucgcuggaucgcc

SEQ ID NO: 144112 - RNA, 22 nt, Mycobacterium leprae
cgcgaugguauaagcccuggcg

SEQ ID NO: 144113 - RNA, 21 nt, Mycobacterium leprae
gcacuucgucgauuaccagca

SEQ ID NO: 144114 - RNA, 22 nt, Mycobacterium leprae
gaugcaucggcgaucguggcgu

SEQ ID NO: 144115 - RNA, 22 nt, Mycobacterium leprae
gcggcgcuggugccgcguaccu

SEQ ID NO: 144116 - RNA, 22 nt, Mycobacterium leprae
uaaugacccaaguuaagucuuc

SEQ ID NO: 144117 - RNA, 22 nt, Mycobacterium leprae
gucggcgagcgugccggggugc

SEQ ID NO: 144118 - RNA, 22 nt, Mycobacterium leprae
uggaagccaaccugcggcuggu

SEQ ID NO: 144119 - RNA, 19 nt, Mycobacterium leprae
cguggcggccguccgguca

SEQ ID NO: 144120 - RNA, 22 nt, Mycobacterium leprae
cucguucgaugcgugcgugcaa

SEQ ID NO: 144121 - RNA, 22 nt, Mycobacterium leprae
uccgauggcgcugucgcggaua

SEQ ID NO: 144122 - RNA, 22 nt, Mycobacterium leprae
ggugcaucauuccggugucgac

SEQ ID NO: 144123 - RNA, 22 nt, Mycobacterium leprae
gcucgcacaugucgcgucccuc

SEQ ID NO: 144124 - RNA, 22 nt, Mycobacterium leprae
gugcgcgaucguggauagcgau

SEQ ID NO: 144125 - RNA, 22 nt, Mycobacterium leprae
ugaucgccgcaccauugggcga

SEQ ID NO: 144126 - RNA, 22 nt, Mycobacterium leprae
ggaucgauuuuugaugggcgca

SEQ ID NO: 144127 - RNA, 22 nt, Mycobacterium leprae
ggggcaacacagugacccauuc

SEQ ID NO: 144128 - RNA, 22 nt, Mycobacterium leprae
cccagguguugcuagcgcaggu

SEQ ID NO: 144129 - RNA, 22 nt, Mycobacterium leprae
auccgguuuggcucccggcugg

SEQ ID NO: 144130 - RNA, 22 nt, Mycobacterium leprae
ccggcagugucguuggugcuua

SEQ ID NO: 144131 - RNA, 22 nt, Mycobacterium leprae
ucggcaguguguucuuuguuaa

SEQ ID NO: 144132 - RNA, 22 nt, Mycobacterium leprae
cgucgggcagaugcacaaccuc

SEQ ID NO: 144133 - RNA, 22 nt, Mycobacterium leprae
gccgaacuagccacacgcgcgc

SEQ ID NO: 144134 - RNA, 22 nt, Mycobacterium leprae
ggcgaccaucacgacgggguca

SEQ ID NO: 144135 - RNA, 22 nt, Mycobacterium leprae
aucuuggauaaacucgaaagcc

SEQ ID NO: 144136 - RNA, 22 nt, Mycobacterium leprae
acucggcgcaucaauagcuccc

SEQ ID NO: 144137 - RNA, 22 nt, Mycobacterium leprae
augcgcgcgucgggcauguggu

SEQ ID NO: 144138 - RNA, 22 nt, Mycobacterium leprae
uccggcgagaaacgcucggugc

SEQ ID NO: 144139 - RNA, 22 nt, Mycobacterium leprae
uuucgucgacgagucagcuggg

SEQ ID NO: 144140 - RNA, 22 nt, Mycobacterium leprae
ggcagcugaacgucgauaugcc

SEQ ID NO: 144141 - RNA, 22 nt, Mycobacterium leprae
uagcgguaguggcgcacggagg

SEQ ID NO: 144142 - RNA, 22 nt, Mycobacterium leprae
aaacaacgucguaguggccgcc

SEQ ID NO: 144143 - RNA, 22 nt, Mycobacterium leprae
augguugagaucucgacggaua

SEQ ID NO: 144144 - RNA, 22 nt, Mycobacterium leprae
caccacgugguagacacacgga

SEQ ID NO: 144145 - RNA, 22 nt, Mycobacterium leprae
ucgagauggucaccggucggau

SEQ ID NO: 144146 - RNA, 22 nt, Mycobacterium leprae
ccgcacaccaucaugcggauuu

SEQ ID NO: 144147 - RNA, 22 nt, Mycobacterium leprae
cgggaaguggccgcagcgguag

SEQ ID NO: 144148 - RNA, 22 nt, Mycobacterium leprae
uacauugugaucgguugcccgu

SEQ ID NO: 144149 - RNA, 22 nt, Mycobacterium leprae
cuugccgaggucggagugguua

SEQ ID NO: 144150 - RNA, 22 nt, Mycobacterium leprae
auuagcgggugggugucaacuu

SEQ ID NO: 144151 - RNA, 22 nt, Mycobacterium leprae
gauuggugauguagccgauguc

SEQ ID NO: 144152 - RNA, 22 nt, Mycobacterium leprae
uugaucaaguacaccgacgagg

SEQ ID NO: 144153 - RNA, 20 nt, Mycobacterium leprae
gcacccgagcuucaucgccu

SEQ ID NO: 144154 - RNA, 22 nt, Mycobacterium leprae
cuccgccgucuuuggcuguguu

SEQ ID NO: 144155 - RNA, 22 nt, Mycobacterium leprae
uugaccgcaacacgaucggcua

SEQ ID NO: 144156 - RNA, 22 nt, Mycobacterium leprae
ggcggcggugaugccggguuug

SEQ ID NO: 144157 - RNA, 22 nt, Mycobacterium leprae
cugccgcguuuccaugccucgu

SEQ ID NO: 144158 - RNA, 22 nt, Mycobacterium leprae
ccgcacauguugcggcauuccu

SEQ ID NO: 144159 - RNA, 22 nt, Mycobacterium leprae
gcaugcagcgacauugaccggc

SEQ ID NO: 144160 - RNA, 22 nt, Mycobacterium leprae
cgguuagacguuaacggguaug

SEQ ID NO: 144161 - RNA, 22 nt, Mycobacterium leprae
uguugccauaucgucuaauccg

SEQ ID NO: 144162 - RNA, 22 nt, Mycobacterium leprae
ccgcggcgauucugguguucau

SEQ ID NO: 144163 - RNA, 23 nt, Mycobacterium leprae
ccgaccaaguggugguuuaccag

SEQ ID NO: 144164 - RNA, 22 nt, Mycobacterium leprae
agcaucgaucgucgccacccgc

SEQ ID NO: 144165 - RNA, 22 nt, Mycobacterium leprae
ugcgcgacaucgaggcugacca

SEQ ID NO: 144166 - RNA, 22 nt, Mycobacterium leprae
ugccgcuauccugugccgcaug

SEQ ID NO: 144167 - RNA, 22 nt, Mycobacterium leprae
guacugcgcgcuuucgguacug

SEQ ID NO: 144168 - RNA, 22 nt, Mycobacterium leprae
gugacgaccccguugcgguuca

SEQ ID NO: 144169 - RNA, 22 nt, Mycobacterium leprae
agccggcuugcugcgcucgauc

SEQ ID NO: 144170 - RNA, 22 nt, Mycobacterium leprae
acguuugccuuuaggacaggcu

SEQ ID NO: 144171 - RNA, 22 nt, Mycobacterium leprae
cgccggcugcggucaagucgac

SEQ ID NO: 144172 - RNA, 22 nt, Mycobacterium leprae
cugucgaugguguugccucauc

SEQ ID NO: 144173 - RNA, 21 nt, Mycobacterium leprae
gccaaauugcagaucucgagc

SEQ ID NO: 144174 - RNA, 22 nt, Mycobacterium leprae
accgggaucgggucagcaguca

SEQ ID NO: 144175 - RNA, 22 nt, Mycobacterium leprae
ucaccgcagaucacucggucca

SEQ ID NO: 144176 - RNA, 22 nt, Mycobacterium leprae
gggcgaugcuagucggcuacgg

SEQ ID NO: 144177 - RNA, 22 nt, Mycobacterium leprae
caucgauuuggugucgauggac

SEQ ID NO: 144178 - RNA, 17 nt, Mycobacterium leprae
auaguggugcgcggauc

SEQ ID NO: 144179 - RNA, 22 nt, Mycobacterium leprae
uuuaucacccgaagcgcuugca

SEQ ID NO: 144180 - RNA, 22 nt, Mycobacterium leprae
ccgagcggcuacgguccaucag

SEQ ID NO: 144181 - RNA, 22 nt, Mycobacterium leprae
ugcaguuggcggucugacgucu

SEQ ID NO: 144182 - RNA, 22 nt, Mycobacterium leprae
ccgguacucggaauggcggcag

SEQ ID NO: 144183 - RNA, 22 nt, Mycobacterium leprae
ccugugcuggccgacugcacuc

SEQ ID NO: 144184 - RNA, 22 nt, Mycobacterium leprae
gugacgauggguaggacgcucg

SEQ ID NO: 144185 - RNA, 22 nt, Mycobacterium leprae
gcugacgguaauacuggcccgc

SEQ ID NO: 144186 - RNA, 22 nt, Mycobacterium leprae
cgguacgguuauaucuugcauc

SEQ ID NO: 144187 - RNA, 22 nt, Mycobacterium leprae
gccauacgccacgguggcgauc

SEQ ID NO: 144188 - RNA, 22 nt, Mycobacterium leprae
uuccgacauuuuucggacgaug

SEQ ID NO: 144189 - RNA, 22 nt, Mycobacterium leprae
acuucucgauaacggcauccga

SEQ ID NO: 144190 - RNA, 22 nt, Mycobacterium leprae
ugcugcuuggcgccaucggaca

SEQ ID NO: 144191 - RNA, 22 nt, Mycobacterium leprae
caaugucgauaccgcgcagugc

SEQ ID NO: 144192 - RNA, 22 nt, Mycobacterium leprae
cgcgucgcaguauccauacucg

SEQ ID NO: 144193 - RNA, 22 nt, Mycobacterium leprae
ggugccgcguucagucgcaaca

SEQ ID NO: 144194 - RNA, 22 nt, Mycobacterium leprae
aucgguggggcggcugucuugg

SEQ ID NO: 144195 - RNA, 22 nt, Mycobacterium leprae
ccagcgggaugcuggugguggu

SEQ ID NO: 144196 - RNA, 22 nt, Mycobacterium leprae
gacaugacggugcgacuguugu

SEQ ID NO: 144197 - RNA, 22 nt, Mycobacterium leprae
uccgggucguauccgggucagu

SEQ ID NO: 144198 - RNA, 22 nt, Mycobacterium leprae
gcggaacaauagaguuggacac

SEQ ID NO: 144199 - RNA, 22 nt, Mycobacterium leprae
uaggcgcugcguagccauucga

SEQ ID NO: 144200 - RNA, 22 nt, Mycobacterium leprae
aucgcuguauucuauaacgccg

SEQ ID NO: 144201 - RNA, 22 nt, Mycobacterium leprae
ugcagaugacgaugguggugcg

SEQ ID NO: 144202 - RNA, 22 nt, Mycobacterium leprae
aggcgaugcuggauucucaggc

SEQ ID NO: 144203 - RNA, 22 nt, Mycobacterium leprae
gaugcuguuagcgauccugucg

SEQ ID NO: 144204 - RNA, 22 nt, Mycobacterium leprae
auugcucgcgaacuuuuuccgu

SEQ ID NO: 144205 - RNA, 22 nt, Mycobacterium leprae
cuuccgcaaggggggccauguc

SEQ ID NO: 144206 - RNA, 22 nt, Mycobacterium leprae
ucucgucaguucgacggcagcu

SEQ ID NO: 144207 - RNA, 22 nt, Mycobacterium leprae
agcgagucaucacaaucgauuu

SEQ ID NO: 144208 - RNA, 22 nt, Mycobacterium leprae
aaugcgaugcgcugcugguuga

SEQ ID NO: 144209 - RNA, 22 nt, Mycobacterium leprae
ggccggcgugcgacagcugaug

SEQ ID NO: 144210 - RNA, 22 nt, Mycobacterium leprae
accaaaccaccgagauccgguc

SEQ ID NO: 144211 - RNA, 22 nt, Mycobacterium leprae
ugucaaggaugccaucgagugu

SEQ ID NO: 144212 - RNA, 22 nt, Mycobacterium leprae
ugugcugguagugcauggcgau

SEQ ID NO: 144213 - RNA, 22 nt, Mycobacterium leprae
ccacguuguuggaucugcgggc

SEQ ID NO: 144214 - RNA, 22 nt, Mycobacterium leprae
cuggccaguacggcccgccugg

SEQ ID NO: 144215 - RNA, 22 nt, Mycobacterium leprae
cagcgggaaugaugcccgccgc

SEQ ID NO: 144216 - RNA, 22 nt, Mycobacterium leprae
gcggcgaucugggcuggccgug

SEQ ID NO: 144217 - RNA, 22 nt, Mycobacterium leprae
uagccagugaucgccgcccuga

SEQ ID NO: 144218 - RNA, 21 nt, Mycobacterium leprae
acgugcuguucuggcgagagg

SEQ ID NO: 144219 - RNA, 22 nt, Mycobacterium leprae
ugcucgccggggugucggcuca

SEQ ID NO: 144220 - RNA, 22 nt, Mycobacterium leprae
agggucugcuugaucugaugca

SEQ ID NO: 144221 - RNA, 22 nt, Mycobacterium leprae
accagccagcacaaacgcguac

SEQ ID NO: 144222 - RNA, 22 nt, Mycobacterium leprae
cgucggcgguaggguaccagcc

SEQ ID NO: 144223 - RNA, 22 nt, Mycobacterium leprae
cgagauggaaacugggucaggu

SEQ ID NO: 144224 - RNA, 22 nt, Mycobacterium leprae
ucaucaugaccaucagcguguu

SEQ ID NO: 144225 - RNA, 22 nt, Mycobacterium leprae
gccgacgucuggcugcuacugu

SEQ ID NO: 144226 - RNA, 22 nt, Mycobacterium leprae
ccaguacggcccgccuggccag

SEQ ID NO: 144227 - RNA, 23 nt, Mycobacterium leprae
cgcgcuugucuaagucuucauuc

SEQ ID NO: 144228 - RNA, 22 nt, Mycobacterium leprae
gcgaugcguugaccggcuauga

SEQ ID NO: 144229 - RNA, 23 nt, Mycobacterium leprae
ugcaggaugaauucgaagcacuc

SEQ ID NO: 144230 - RNA, 19 nt, Mycobacterium leprae
ucguagcgaaacucagccu

SEQ ID NO: 144231 - RNA, 22 nt, Mycobacterium leprae
augacguugugcuucgcaacca

SEQ ID NO: 144232 - RNA, 22 nt, Mycobacterium leprae
gcguggcggcacucugcgccau

SEQ ID NO: 144233 - RNA, 22 nt, Mycobacterium leprae
uggcugcugugguaccaccccg

SEQ ID NO: 144234 - RNA, 23 nt, Mycobacterium leprae
ggaccgauauaccguuaaucaga

SEQ ID NO: 144235 - RNA, 22 nt, Mycobacterium leprae
ggcauucgcgucaaucgcagca

SEQ ID NO: 144236 - RNA, 22 nt, Mycobacterium leprae
ccguugcaguaguucuuagcag

SEQ ID NO: 144237 - RNA, 23 nt, Mycobacterium leprae
accagcccgaaaucagucagggu

SEQ ID NO: 144238 - RNA, 22 nt, Mycobacterium leprae
ugcgauuuggcuuuggccggug

SEQ ID NO: 144239 - RNA, 23 nt, Mycobacterium leprae
cggggcucaaacuucugcgcugc

SEQ ID NO: 144240 - RNA, 22 nt, Mycobacterium leprae
agugugguccggggucggcuag

SEQ ID NO: 144241 - RNA, 22 nt, Mycobacterium leprae
guguucggcucaguacgccgua

SEQ ID NO: 144242 - RNA, 22 nt, Mycobacterium leprae
agguaauggucgagauugcaaa

SEQ ID NO: 144243 - RNA, 22 nt, Mycobacterium leprae
agaucgaucacgucgugcuggu

SEQ ID NO: 144244 - RNA, 22 nt, Mycobacterium leprae
uggccaccgcaagcacguuguc

SEQ ID NO: 144245 - RNA, 22 nt, Mycobacterium leprae
cccugcucaguagucggacccg

SEQ ID NO: 144246 - RNA, 22 nt, Mycobacterium leprae
ggcgaugaggaagcgcugcgga

SEQ ID NO: 144247 - RNA, 22 nt, Mycobacterium leprae
agucaguuccuuagcgaugccg

SEQ ID NO: 144248 - RNA, 22 nt, Mycobacterium leprae
gaguggucaguuugccgguguc

SEQ ID NO: 144249 - RNA, 22 nt, Mycobacterium leprae
ggacgugccgacggcgaccagu

SEQ ID NO: 144250 - RNA, 23 nt, Mycobacterium leprae
uggcaggaugccuuaacggcguu

SEQ ID NO: 144251 - RNA, 22 nt, Mycobacterium leprae
uugaggaucagguucagcuggc

SEQ ID NO: 144252 - RNA, 19 nt, Mycobacterium leprae
gucgcacuguuccgagcug

SEQ ID NO: 144253 - RNA, 23 nt, Mycobacterium leprae
ugucaacacuauccccauugcgc

SEQ ID NO: 144254 - RNA, 22 nt, Mycobacterium leprae
ucaaccgagucggucgcgucac

SEQ ID NO: 144255 - RNA, 22 nt, Mycobacterium leprae
uuaccucgauggaauuccgccc

SEQ ID NO: 144256 - RNA, 22 nt, Mycobacterium leprae
cgaugcguggguagguggugca

SEQ ID NO: 144257 - RNA, 22 nt, Mycobacterium leprae
guuaucggcaacgaccaucauu

SEQ ID NO: 144258 - RNA, 22 nt, Mycobacterium leprae
gucgagaucgacguuuugcaag

SEQ ID NO: 144259 - RNA, 22 nt, Mycobacterium leprae
accuugguguugaugccgauuc

SEQ ID NO: 144260 - RNA, 22 nt, Mycobacterium leprae
uggcacuaauggaggaccgcgc

SEQ ID NO: 144261 - RNA, 21 nt, Mycobacterium leprae
aacuccacaucuagcguuguc

SEQ ID NO: 144262 - RNA, 22 nt, Mycobacterium leprae
gacgaucguucgcccgugcgcu

SEQ ID NO: 144263 - RNA, 22 nt, Mycobacterium leprae
ucuccgguaucaaagcccagcg

SEQ ID NO: 144264 - RNA, 22 nt, Mycobacterium leprae
ucgcccggugucaaucgcgguc

SEQ ID NO: 144265 - RNA, 22 nt, Mycobacterium leprae
gcccgcuagcguuugccgagcu

SEQ ID NO: 144266 - RNA, 22 nt, Mycobacterium leprae
gccgcaguggucgacagugguu

SEQ ID NO: 144267 - RNA, 22 nt, Mycobacterium leprae
accgacgucgcgauuggugccg

SEQ ID NO: 144268 - RNA, 23 nt, Mycobacterium leprae
ugguuucguggcccagcagccgc

SEQ ID NO: 144269 - RNA, 23 nt, Mycobacterium leprae
uacagaccggugauuacggcacc

SEQ ID NO: 144270 - RNA, 22 nt, Mycobacterium leprae
gguagauugccugcgcgucgug

SEQ ID NO: 144271 - RNA, 22 nt, Mycobacterium leprae
gacugaauuguaucgcgaucuc

SEQ ID NO: 144272 - RNA, 18 nt, Mycobacterium leprae
cggccagcgagagcagca

SEQ ID NO: 144273 - RNA, 22 nt, Mycobacterium leprae
acggauuuggcuugcugggagu

SEQ ID NO: 144274 - RNA, 22 nt, Mycobacterium leprae
guauuugggaacucuggugacu

SEQ ID NO: 144275 - RNA, 22 nt, Mycobacterium leprae
cggugccauugcaguggucacc

SEQ ID NO: 144276 - RNA, 22 nt, Mycobacterium leprae
gcuaccgguaucacagugacga

SEQ ID NO: 144277 - RNA, 23 nt, Mycobacterium leprae
cugcucaggaugacggacgacgg

SEQ ID NO: 144278 - RNA, 21 nt, Mycobacterium leprae
cgucgcugaucgcgagucugc

SEQ ID NO: 144279 - RNA, 22 nt, Mycobacterium leprae
ugaacgcgacagccuggcgacg

SEQ ID NO: 144280 - RNA, 22 nt, Mycobacterium leprae
accaacaugcucgacgguggcg

SEQ ID NO: 144281 - RNA, 22 nt, Mycobacterium leprae
cggcgccgacggugucguuguu

SEQ ID NO: 144282 - RNA, 22 nt, Mycobacterium leprae
uggucacugaagcagcgccgca

SEQ ID NO: 144283 - RNA, 22 nt, Mycobacterium leprae
ucgccgacacugcugauggauc

SEQ ID NO: 144284 - RNA, 21 nt, Mycobacterium leprae
ugcaaaacgucaaucucgacg

SEQ ID NO: 144285 - RNA, 22 nt, Mycobacterium leprae
cacaccuuggccgcaucggugu

SEQ ID NO: 144286 - RNA, 22 nt, Mycobacterium leprae
guggcuaguggcaucggacaac

SEQ ID NO: 144287 - RNA, 22 nt, Mycobacterium leprae
ggccgucguuguucaccaacaa

SEQ ID NO: 144288 - RNA, 22 nt, Mycobacterium leprae
ggacaaugucugggaucucacg

SEQ ID NO: 144289 - RNA, 21 nt, Mycobacterium leprae
uuuagccgauugccggccgga

SEQ ID NO: 144290 - RNA, 22 nt, Mycobacterium leprae
gcucaacguaaaucucauguag

SEQ ID NO: 144291 - RNA, 22 nt, Mycobacterium leprae
aucgaacgcugguggcugcucg

SEQ ID NO: 144292 - RNA, 22 nt, Mycobacterium leprae
ggcagcauuuucgucgaucucc

SEQ ID NO: 144293 - RNA, 22 nt, Mycobacterium leprae
uggccggaccgugcgagcuacg

SEQ ID NO: 144294 - RNA, 22 nt, Mycobacterium leprae
ccgcuugaucgagggugugcug

SEQ ID NO: 144295 - RNA, 22 nt, Mycobacterium leprae
acucuugcguccacaucgcguu

SEQ ID NO: 144296 - RNA, 22 nt, Mycobacterium leprae
cgccagguugaucaacggggac

SEQ ID NO: 144297 - RNA, 22 nt, Mycobacterium leprae
gagcagcagcacggaugcgucu

SEQ ID NO: 144298 - RNA, 22 nt, Mycobacterium leprae
cuaugaaaccaaccgaacaacu

SEQ ID NO: 144299 - RNA, 22 nt, Mycobacterium leprae
uucgagaacuucguguguuugu

SEQ ID NO: 144300 - RNA, 22 nt, Mycobacterium leprae
caggaaacauagaagcgaacaa

SEQ ID NO: 144301 - RNA, 22 nt, Mycobacterium leprae
gugaccggugcaaugaucgcag

SEQ ID NO: 144302 - RNA, 22 nt, Mycobacterium leprae
gaucgcgcucuaagcaggauua

SEQ ID NO: 144303 - RNA, 22 nt, Mycobacterium leprae
accacggccucggcgccugcuu

SEQ ID NO: 144304 - RNA, 22 nt, Mycobacterium leprae
ucgcguugagccucucaauggg

SEQ ID NO: 144305 - RNA, 22 nt, Mycobacterium leprae
gaguccucuacguggaacagug

SEQ ID NO: 144306 - RNA, 22 nt, Mycobacterium leprae
gugcgccgggaugaacgauguu

SEQ ID NO: 144307 - RNA, 22 nt, Mycobacterium leprae
acucuagguguucaaugcuccc

SEQ ID NO: 144308 - RNA, 22 nt, Mycobacterium leprae
gugguucgucgugauuacguug

SEQ ID NO: 144309 - RNA, 22 nt, Mycobacterium leprae
gcggcaacucgcgcagugacgu

SEQ ID NO: 144310 - RNA, 22 nt, Mycobacterium leprae
augaccuuguuggaacuuucgg

SEQ ID NO: 144311 - RNA, 22 nt, Mycobacterium leprae
acugccgucggugcuggugcau

SEQ ID NO: 144312 - RNA, 22 nt, Mycobacterium leprae
gguuuugcccguugcggguggg

SEQ ID NO: 144313 - RNA, 22 nt, Mycobacterium leprae
ucgguugcucgaaggugccuga

SEQ ID NO: 144314 - RNA, 22 nt, Mycobacterium leprae
ugacauacagcugcaugccgau

SEQ ID NO: 144315 - RNA, 22 nt, Mycobacterium leprae
ucgccaaguuagcucgguuagu

SEQ ID NO: 144316 - RNA, 22 nt, Mycobacterium leprae
caucgucuggggcgcggcagcu

SEQ ID NO: 144317 - RNA, 22 nt, Mycobacterium leprae
agucagugacucgagcgauaca

SEQ ID NO: 144318 - RNA, 22 nt, Mycobacterium leprae
uucggcagcaugccgaucguau

SEQ ID NO: 144319 - RNA, 22 nt, Mycobacterium leprae
ugacguugacaaauugguugug

SEQ ID NO: 144320 - RNA, 22 nt, Mycobacterium leprae
gcgaguauggauacugcgacgc

SEQ ID NO: 144321 - RNA, 22 nt, Mycobacterium leprae
ccgauccgcgacuucggcugaa

SEQ ID NO: 144322 - RNA, 22 nt, Mycobacterium leprae
cggccuggcggagauccagcug

SEQ ID NO: 144323 - RNA, 22 nt, Mycobacterium leprae
guggagaccaacuuccuuccgc

SEQ ID NO: 144324 - RNA, 22 nt, Mycobacterium leprae
ugccgccgggacgcgucaccau

SEQ ID NO: 144325 - RNA, 22 nt, Mycobacterium leprae
gaucaccaaccagucaccgccc

SEQ ID NO: 144326 - RNA, 22 nt, Mycobacterium leprae
cuucgcugugcuugcgaccgcc

SEQ ID NO: 144327 - RNA, 22 nt, Mycobacterium leprae
aucucgcccuuuucucgugugu

SEQ ID NO: 144328 - RNA, 22 nt, Mycobacterium leprae
acaugcucgacagccugucgag

SEQ ID NO: 144329 - RNA, 22 nt, Mycobacterium leprae
cuuaagaaucggcuugcgacgg

SEQ ID NO: 144330 - RNA, 19 nt, Mycobacterium leprae
gcggugacugaucgcggug

SEQ ID NO: 144331 - RNA, 22 nt, Mycobacterium leprae
ggaacaacuauugucgauuggg

SEQ ID NO: 144332 - RNA, 22 nt, Mycobacterium leprae
ccaggauguucaucagcaucac

SEQ ID NO: 144333 - RNA, 22 nt, Mycobacterium leprae
accggucgcggcaauccuuucg

SEQ ID NO: 144334 - RNA, 22 nt, Mycobacterium leprae
ucguuuucugugcacaccucau

SEQ ID NO: 144335 - RNA, 21 nt, Mycobacterium leprae
cgucgcaguauccauacccgc

SEQ ID NO: 144336 - RNA, 22 nt, Mycobacterium leprae
ccgauguccgagcucgacacau

SEQ ID NO: 144337 - RNA, 22 nt, Mycobacterium leprae
gcugaucucuaaggacgccacg

SEQ ID NO: 144338 - RNA, 22 nt, Mycobacterium leprae
cgaugucgcuuuguuugccauc

SEQ ID NO: 144339 - RNA, 22 nt, Mycobacterium leprae
uucgcccaugccgggucauuga

SEQ ID NO: 144340 - RNA, 23 nt, Mycobacterium leprae
ucgcccugauacuggcccccgac

SEQ ID NO: 144341 - RNA, 22 nt, Mycobacterium leprae
ucugccaaguuguccaggcugc

SEQ ID NO: 144342 - RNA, 22 nt, Mycobacterium leprae
cccgcgacgucguaaucgaagu

SEQ ID NO: 144343 - RNA, 22 nt, Mycobacterium leprae
gccgccucagccggugcgcacu

SEQ ID NO: 144344 - RNA, 23 nt, Mycobacterium leprae
uguguugcaacuaagucccggag

SEQ ID NO: 144345 - RNA, 22 nt, Mycobacterium leprae
ccaccggacgcuguugauuggu

SEQ ID NO: 144346 - RNA, 21 nt, Mycobacterium leprae
ggugcggcguucugagauuga

SEQ ID NO: 144347 - RNA, 22 nt, Mycobacterium leprae
ucgggcaguggcgagucguaga

SEQ ID NO: 144348 - RNA, 22 nt, Mycobacterium leprae
gccaggcgggccguacuggcca

SEQ ID NO: 144349 - RNA, 22 nt, Mycobacterium leprae
gcaggcgaauauaaaauucuaa

SEQ ID NO: 144350 - RNA, 22 nt, Mycobacterium leprae
gcgucgccgacacugcugaugg

SEQ ID NO: 144351 - RNA, 22 nt, Mycobacterium leprae
acguugaccaccuggcgcacaa

SEQ ID NO: 144352 - RNA, 18 nt, Mycobacterium leprae
uggaggucaucugcugcu

SEQ ID NO: 144353 - RNA, 22 nt, Mycobacterium leprae
ucgacacugcagagcaccgugg

SEQ ID NO: 144354 - RNA, 22 nt, Mycobacterium leprae
ccgcagucguucgacaccguuu

SEQ ID NO: 144355 - RNA, 22 nt, Mycobacterium leprae
accgggugacaucgagccuguc

SEQ ID NO: 144356 - RNA, 22 nt, Mycobacterium leprae
agugggcgacaucugagugauc

SEQ ID NO: 144357 - RNA, 22 nt, Mycobacterium leprae
uggaucgggaucuggugcucua

SEQ ID NO: 144358 - RNA, 22 nt, Mycobacterium leprae
uggcuguucccaggugcagggc

SEQ ID NO: 144359 - RNA, 22 nt, Mycobacterium leprae
uucgcgaucgccgccgucagcu

SEQ ID NO: 144360 - RNA, 22 nt, Mycobacterium leprae
uccggucacuucaucaucccgg

SEQ ID NO: 144361 - RNA, 23 nt, Mycobacterium leprae
acgaucucuucggcaucggucag

SEQ ID NO: 144362 - RNA, 22 nt, Mycobacterium leprae
gcgucgcuguuugccgaguaca

SEQ ID NO: 144363 - RNA, 22 nt, Mycobacterium leprae
gauggcgcgucuucggugcggu

SEQ ID NO: 144364 - RNA, 22 nt, Mycobacterium leprae
uuccgguagcauguugugcugg

SEQ ID NO: 144365 - RNA, 22 nt, Mycobacterium leprae
ggcugcaguuccgugccguugu

SEQ ID NO: 144366 - RNA, 22 nt, Mycobacterium leprae
ugcuggcucaauugugugaugu

SEQ ID NO: 144367 - RNA, 23 nt, Mycobacterium leprae
ucggucgacgggugcgccagcuc

SEQ ID NO: 144368 - RNA, 22 nt, Mycobacterium leprae
acggugucuuccuaucacggug

SEQ ID NO: 144369 - RNA, 22 nt, Mycobacterium leprae
cgacaccauagccgccaugacg

SEQ ID NO: 144370 - RNA, 22 nt, Mycobacterium leprae
acugggcagaucauaucgauuu

SEQ ID NO: 144371 - RNA, 22 nt, Mycobacterium leprae
gugcggugccaccucgauguug

SEQ ID NO: 144372 - RNA, 22 nt, Mycobacterium leprae
accagcuaucuggcugggucga

SEQ ID NO: 144373 - RNA, 22 nt, Mycobacterium leprae
gaacaccgucuugaucucgucg

SEQ ID NO: 144374 - RNA, 22 nt, Mycobacterium leprae
aguucuuggccgaccucguacu

SEQ ID NO: 144375 - RNA, 22 nt, Mycobacterium leprae
gaugcccgguacguaucuucga

SEQ ID NO: 144376 - RNA, 22 nt, Mycobacterium leprae
gcgggcgucaucuugaucgcgg

SEQ ID NO: 144377 - RNA, 22 nt, Mycobacterium leprae
ugccagugaccgaguuccgccu

SEQ ID NO: 144378 - RNA, 22 nt, Mycobacterium leprae
ugaugucgggucggugaaguau

SEQ ID NO: 144379 - RNA, 22 nt, Mycobacterium leprae
uuuuguguggacguguucuccc

SEQ ID NO: 144380 - RNA, 22 nt, Mycobacterium leprae
gcugcagugacggcacucugga

SEQ ID NO: 144381 - RNA, 21 nt, Mycobacterium leprae
ucaccgucaaucaggucgucg

SEQ ID NO: 144382 - RNA, 22 nt, Mycobacterium leprae
cugcugcugacacgccguuccg

SEQ ID NO: 144383 - RNA, 22 nt, Mycobacterium leprae
auguccgacgcucaugaacagu

SEQ ID NO: 144384 - RNA, 22 nt, Mycobacterium leprae
caggucagcuccauccuggccg

SEQ ID NO: 144385 - RNA, 22 nt, Mycobacterium leprae
agcuggccgagguugacagugc

SEQ ID NO: 144386 - RNA, 22 nt, Mycobacterium leprae
guuguggggccgucauggcggg

SEQ ID NO: 144387 - RNA, 22 nt, Mycobacterium leprae
gcacaguuaaggucguguagag

SEQ ID NO: 144388 - RNA, 22 nt, Mycobacterium leprae
caacgccaucagacggauguac

SEQ ID NO: 144389 - RNA, 22 nt, Mycobacterium leprae
guccaaguuuuucgacugcaag

SEQ ID NO: 144390 - RNA, 22 nt, Mycobacterium leprae
ucgaggcgugugcucagcguuc

SEQ ID NO: 144391 - RNA, 22 nt, Mycobacterium leprae
ugcggcuuucguucgggaaguu

SEQ ID NO: 144392 - RNA, 22 nt, Mycobacterium leprae
ucggucgccgauuugauggcgc

SEQ ID NO: 144393 - RNA, 22 nt, Mycobacterium leprae
gcuugcuucagcgccgaccgca

SEQ ID NO: 144394 - RNA, 22 nt, Mycobacterium leprae
cggugcugaaguggcguuggcu

SEQ ID NO: 144395 - RNA, 22 nt, Mycobacterium leprae
gcgaugauuuagcaccgaucgg

SEQ ID NO: 144396 - RNA, 22 nt, Mycobacterium leprae
uuguuugucguuucugcaguag

SEQ ID NO: 144397 - RNA, 22 nt, Mycobacterium leprae
agcugcguuggaccggauugcu

SEQ ID NO: 144398 - RNA, 22 nt, Mycobacterium leprae
acgcuaucgucacgcuggacgg

SEQ ID NO: 144399 - RNA, 22 nt, Mycobacterium leprae
cacaacggcgucgucgguguaa

SEQ ID NO: 144400 - RNA, 22 nt, Mycobacterium leprae
ugcugaugucgaagacaaugua

SEQ ID NO: 144401 - RNA, 22 nt, Mycobacterium leprae
aguaccgcgaauagccggguac

SEQ ID NO: 144402 - RNA, 22 nt, Mycobacterium leprae
ccgguggucacgccuaccccgu

SEQ ID NO: 144403 - RNA, 19 nt, Mycobacterium leprae
ucgggcggcgacgauucca

SEQ ID NO: 144404 - RNA, 22 nt, Mycobacterium leprae
agcagcguaacauugcugguuu

SEQ ID NO: 144405 - RNA, 22 nt, Mycobacterium leprae
gguggcuuugaucgacgccgga

SEQ ID NO: 144406 - RNA, 21 nt, Mycobacterium leprae
aucuucgcgguggugcuguug

SEQ ID NO: 144407 - RNA, 22 nt, Mycobacterium leprae
ugauaucuauacgcgaccaggu

SEQ ID NO: 144408 - RNA, 22 nt, Mycobacterium leprae
acucgccgacgcagugggacua

SEQ ID NO: 144409 - RNA, 22 nt, Mycobacterium leprae
acggaccagcgcaccgccgucu

SEQ ID NO: 144410 - RNA, 22 nt, Mycobacterium leprae
ggcacgccaaguucggcaccgu

SEQ ID NO: 144411 - RNA, 22 nt, Mycobacterium leprae
uggcugugguucgugguucggc

SEQ ID NO: 144412 - RNA, 22 nt, Mycobacterium leprae
ucggucgugcuauccggaaugg

SEQ ID NO: 144413 - RNA, 22 nt, Mycobacterium leprae
uucuugacuugcuugcgcguau

SEQ ID NO: 144414 - RNA, 22 nt, Mycobacterium leprae
aggauaucgacccggcguggcu

SEQ ID NO: 144415 - RNA, 22 nt, Mycobacterium leprae
augcucaugguguugaugcuaa

SEQ ID NO: 144416 - RNA, 22 nt, Mycobacterium leprae
aucggcuaaugaacugcucgcc

SEQ ID NO: 144417 - RNA, 22 nt, Mycobacterium leprae
ucgguguggugcaucgcaggca

SEQ ID NO: 144418 - RNA, 22 nt, Mycobacterium leprae
agcuuugucaaugucgcgguag

SEQ ID NO: 144419 - RNA, 22 nt, Mycobacterium leprae
auccaccgcggcgcuggcugca

SEQ ID NO: 144420 - RNA, 22 nt, Mycobacterium leprae
augggaaaguacccgacgaucc

SEQ ID NO: 144421 - RNA, 22 nt, Mycobacterium leprae
uggucagcaccgcccuagucgg

SEQ ID NO: 144422 - RNA, 22 nt, Mycobacterium leprae
gcggcggugaggauggccgagu

SEQ ID NO: 144423 - RNA, 22 nt, Mycobacterium leprae
cggucgacuucaucgacggugu

SEQ ID NO: 144424 - RNA, 22 nt, Mycobacterium leprae
gcccacaacgcaacugagccga

SEQ ID NO: 144425 - RNA, 22 nt, Mycobacterium leprae
uuuggcugggaauguggucgcu

SEQ ID NO: 144426 - RNA, 22 nt, Mycobacterium leprae
acgacugcguuguacucagcac

SEQ ID NO: 144427 - RNA, 22 nt, Mycobacterium leprae
ugcugggcagccugugcggugu

SEQ ID NO: 144428 - RNA, 22 nt, Mycobacterium leprae
gccgguugccgauucugaaagg

SEQ ID NO: 144429 - RNA, 20 nt, Mycobacterium leprae
augcuucgaauagcucaucg

SEQ ID NO: 144430 - RNA, 22 nt, Mycobacterium leprae
cggugcccgcgaucggaugcgg

SEQ ID NO: 144431 - RNA, 22 nt, Mycobacterium leprae
uggcagaugaaaucauagucag

SEQ ID NO: 144432 - RNA, 21 nt, Mycobacterium leprae
agccgccguggggcugccggu

SEQ ID NO: 144433 - RNA, 22 nt, Mycobacterium leprae
ugacagaacgggggcaccagau

SEQ ID NO: 144434 - RNA, 22 nt, Mycobacterium leprae
gaucggcgaucgcugaccaugu

SEQ ID NO: 144435 - RNA, 22 nt, Mycobacterium leprae
gcugcugggcgcgauaccacga

SEQ ID NO: 144436 - RNA, 22 nt, Mycobacterium leprae
cugcggauuucuggaacuucgc

SEQ ID NO: 144437 - RNA, 22 nt, Mycobacterium leprae
gcggguauggauacugcgacgg

SEQ ID NO: 144438 - RNA, 22 nt, Mycobacterium leprae
gugcagauugugggcgauccgu

SEQ ID NO: 144439 - RNA, 22 nt, Mycobacterium leprae
ucugcaguucauuccgcagauu

SEQ ID NO: 144440 - RNA, 22 nt, Mycobacterium leprae
uugccgaugauuacaucauccg

SEQ ID NO: 144441 - RNA, 22 nt, Mycobacterium leprae
cucggcgaagugagcgagggau

SEQ ID NO: 144442 - RNA, 19 nt, Mycobacterium leprae
ggagaacuccgagacuucc

SEQ ID NO: 144443 - RNA, 22 nt, Mycobacterium leprae
ugcagccgcgaccgcggugggc

SEQ ID NO: 144444 - RNA, 22 nt, Mycobacterium leprae
ccgggcuagcgaucgacguaac

SEQ ID NO: 144445 - RNA, 22 nt, Mycobacterium leprae
ucggaaagucuuugcggucagg

SEQ ID NO: 144446 - RNA, 21 nt, Mycobacterium leprae
cggcaaaauccuucgcgccgc

SEQ ID NO: 144447 - RNA, 22 nt, Mycobacterium leprae
ugcggcauggaaaucgcuguug

SEQ ID NO: 144448 - RNA, 21 nt, Mycobacterium leprae
uggaugacgcguggcugcggc

SEQ ID NO: 144449 - RNA, 22 nt, Mycobacterium leprae
agaggccgccgaaccaggugag

SEQ ID NO: 144450 - RNA, 22 nt, Mycobacterium leprae
ucggcgaacaucgccagccagg

SEQ ID NO: 144451 - RNA, 22 nt, Mycobacterium leprae
uggccacggugauuggugaggu

SEQ ID NO: 144452 - RNA, 22 nt, Mycobacterium leprae
cgauggcgucgaugugcguggu

SEQ ID NO: 144453 - RNA, 22 nt, Mycobacterium leprae
ggcaucgcgauugcugggcggc

SEQ ID NO: 144454 - RNA, 19 nt, Mycobacterium leprae
gaugugaucggugaucucc

SEQ ID NO: 144455 - RNA, 17 nt, Mycobacterium leprae
ucagcacuaagaguccc

SEQ ID NO: 144456 - RNA, 22 nt, Mycobacterium leprae
gcuguguuuaaaggagccgcgg

SEQ ID NO: 144457 - RNA, 22 nt, Mycobacterium leprae
gacgcuagcccaguugcgcgcg

SEQ ID NO: 144458 - RNA, 20 nt, Mycobacterium leprae
ucgccgugggcgggucugga

SEQ ID NO: 144459 - RNA, 22 nt, Mycobacterium leprae
gcgcacuagaagacaagucggg

SEQ ID NO: 144460 - RNA, 22 nt, Mycobacterium leprae
uucgacuggcucaacuaugaag

SEQ ID NO: 144461 - RNA, 22 nt, Mycobacterium leprae
gcuggucggcuuggugguuugu

SEQ ID NO: 144462 - RNA, 22 nt, Mycobacterium leprae
ucgcacuggggggagcgcucgu

SEQ ID NO: 144463 - RNA, 22 nt, Mycobacterium leprae
ugcugccgguauagaggcaaug

SEQ ID NO: 144464 - RNA, 22 nt, Mycobacterium leprae
cuaguucggcgccgagcguguc

SEQ ID NO: 144465 - RNA, 20 nt, Mycobacterium leprae
ugcugccgugcucgacuugg

SEQ ID NO: 144466 - RNA, 22 nt, Mycobacterium leprae
ugacagcagugcaccgcugugc

SEQ ID NO: 144467 - RNA, 22 nt, Mycobacterium leprae
acuaugccaaaaggcuguauag

SEQ ID NO: 144468 - RNA, 20 nt, Mycobacterium leprae
gcuggacauaaaggcucucc

SEQ ID NO: 144469 - RNA, 22 nt, Mycobacterium leprae
gccagguucgccaggcaggacg

SEQ ID NO: 144470 - RNA, 22 nt, Mycobacterium leprae
uuugaugaugucgcauucgcug

SEQ ID NO: 144471 - RNA, 22 nt, Mycobacterium leprae
ucgccgaauucaucggccugga

SEQ ID NO: 144472 - RNA, 22 nt, Mycobacterium leprae
uuggucgggugcuccuggucag

SEQ ID NO: 144473 - RNA, 20 nt, Mycobacterium leprae
accgaaagugugcucgaccc

SEQ ID NO: 144474 - RNA, 22 nt, Mycobacterium leprae
accauguccaaggcgcucggca

SEQ ID NO: 144475 - RNA, 22 nt, Mycobacterium leprae
gccugccaacacgcugcggcag

SEQ ID NO: 144476 - RNA, 22 nt, Mycobacterium leprae
agcuugcccaagacaaaccgcg

SEQ ID NO: 144477 - RNA, 19 nt, Mycobacterium leprae
cucggugagguggacggca

SEQ ID NO: 144478 - RNA, 22 nt, Mycobacterium leprae
aaauguucgaaguaguucgcgg

SEQ ID NO: 144479 - RNA, 22 nt, Mycobacterium leprae
aaugugaacgugcaagaagcga

SEQ ID NO: 144480 - RNA, 22 nt, Mycobacterium leprae
agucagugacucgagcgauaca

SEQ ID NO: 144481 - RNA, 22 nt, Mycobacterium leprae
agugauuccuugccuggacguc

SEQ ID NO: 144482 - RNA, 22 nt, Mycobacterium leprae
agugcugcugaucgucgguguc

SEQ ID NO: 144483 - RNA, 22 nt, Mycobacterium leprae
auauugucggcgaguuugaucc

SEQ ID NO: 144484 - RNA, 21 nt, Mycobacterium leprae
auccaguuacacgccgaccac

SEQ ID NO: 144485 - RNA, 18 nt, Mycobacterium leprae
auccagcucagccagcuc

SEQ ID NO: 144486 - RNA, 22 nt, Mycobacterium leprae
augccauugcuggaccuaaucc

SEQ ID NO: 144487 - RNA, 22 nt, Mycobacterium leprae
augcuguguuucaaccguauug

SEQ ID NO: 144488 - RNA, 22 nt, Mycobacterium leprae
augguaugugguguugagacau

SEQ ID NO: 144489 - RNA, 22 nt, Mycobacterium leprae
auguauuggugcaaguguccug

SEQ ID NO: 144490 - RNA, 22 nt, Mycobacterium leprae
augucacuucccgugccgauuu

SEQ ID NO: 144491 - RNA, 22 nt, Mycobacterium leprae
auguucagaucggcaucgguua

SEQ ID NO: 144492 - RNA, 22 nt, Mycobacterium leprae
augugguuggcagcgcuggaaa

SEQ ID NO: 144493 - RNA, 22 nt, Mycobacterium leprae
augugugaauuuaacauguuga

SEQ ID NO: 144494 - RNA, 22 nt, Mycobacterium leprae
cagccaggcagcugcuaggcgg

SEQ ID NO: 144495 - RNA, 22 nt, Mycobacterium leprae
caggauuacgcauguuagucgc

SEQ ID NO: 144496 - RNA, 20 nt, Mycobacterium leprae
caauccagacggcaaucucg

SEQ ID NO: 144497 - RNA, 22 nt, Mycobacterium leprae
caacaucucggggugcaacuug

SEQ ID NO: 144498 - RNA, 22 nt, Mycobacterium leprae
caaugucagaauaggaugccau

SEQ ID NO: 144499 - RNA, 20 nt, Mycobacterium leprae
cacaugucgcaaguagccua

SEQ ID NO: 144500 - RNA, 22 nt, Mycobacterium leprae
ugucaaggaugccaucgagugu

SEQ ID NO: 144501 - RNA, 22 nt, Mycobacterium leprae
uggcugcguugccggcgaacca

SEQ ID NO: 144502 - RNA, 22 nt, Mycobacterium leprae
uggcugugguucgugguucggc

SEQ ID NO: 144503 - RNA, 22 nt, Mycobacterium leprae
uggcuguucccaggugcagggc

SEQ ID NO: 144504 - RNA, 22 nt, Mycobacterium leprae
uggcuuuuggcugaaacugacc

SEQ ID NO: 144505 - RNA, 22 nt, Mycobacterium leprae
ugggaaaaugggcuucgucuuc

SEQ ID NO: 144506 - RNA, 23 nt, Mycobacterium leprae
ugaggucuugcaccuggcccggc

SEQ ID NO: 144507 - RNA, 22 nt, Mycobacterium leprae
ugauaucuauacgcgaccaggu

SEQ ID NO: 144508 - RNA, 22 nt, Mycobacterium leprae
ugaugauuggcauggcagugaa

SEQ ID NO: 144509 - RNA, 22 nt, Mycobacterium leprae
ugauggcgguauguaauguugg

SEQ ID NO: 144510 - RNA, 22 nt, Mycobacterium leprae
ucugccaaguuguccaggcugc

SEQ ID NO: 144511 - RNA, 20 nt, Mycobacterium leprae
ucuauuaagauuaacguggc

SEQ ID NO: 144512 - RNA, 22 nt, Mycobacterium leprae
uccuggggaauguggcuugacg

SEQ ID NO: 144513 - RNA, 21 nt, Mycobacterium leprae
uaaugcccuucgagggggaua

SEQ ID NO: 144514 - RNA, 22 nt, Mycobacterium leprae
uaaugcccuucgagggggauag

SEQ ID NO: 144515 - RNA, 23 nt, Mycobacterium leprae
uaugaguucggacuggcccugcc

SEQ ID NO: 144516 - RNA, 22 nt, Mycobacterium leprae
gggguugcuggauugcccuggu

SEQ ID NO: 144517 - RNA, 22 nt, Mycobacterium leprae
gggugaaaccgaguguuaguau

SEQ ID NO: 144518 - RNA, 22 nt, Mycobacterium leprae
gggugcuaacuggugucauccg

SEQ ID NO: 144519 - RNA, 22 nt, Mycobacterium leprae
ggguugauccgcgcgauggaga

SEQ ID NO: 144520 - RNA, 22 nt, Mycobacterium leprae
ggguugcauuucaucugucgcg

SEQ ID NO: 144521 - RNA, 22 nt, Mycobacterium leprae
gguaaugauugcguaacaacca

SEQ ID NO: 144522 - RNA, 22 nt, Mycobacterium leprae
gugcugaguacaacgcagucgu

SEQ ID NO: 144523 - RNA, 22 nt, Mycobacterium leprae
ggcgggcagggucaucgccucg

SEQ ID NO: 144524 - RNA, 22 nt, Mycobacterium leprae
gggagcucaaguucuuuggcua

SEQ ID NO: 144525 - RNA, 22 nt, Mycobacterium leprae
gggcugaucgcgcuacaggaau

SEQ ID NO: 144526 - RNA, 22 nt, Mycobacterium leprae
gcccacaacgcaacugagccga

SEQ ID NO: 144527 - RNA, 22 nt, Mycobacterium leprae
gccagccagauucuccaucaag

SEQ ID NO: 144528 - RNA, 22 nt, Mycobacterium leprae
gcaguuucggauucgccgggac

SEQ ID NO: 144529 - RNA, 22 nt, Mycobacterium leprae
gcagcaggccgccucgacuauc

SEQ ID NO: 144530 - RNA, 22 nt, Mycobacterium leprae
gccccgucgugugcgaucucgu

SEQ ID NO: 144531 - RNA, 22 nt, Mycobacterium leprae
gccccuccgaucugcucggucu

SEQ ID NO: 144532 - RNA, 20 nt, Mycobacterium leprae
gcuggacauaaaggcucucc

SEQ ID NO: 144533 - RNA, 22 nt, Mycobacterium leprae
gcugcuggaauuccucgaggua

SEQ ID NO: 144534 - RNA, 22 nt, Mycobacterium leprae
gaaaugacucucccggaaccga

SEQ ID NO: 144535 - RNA, 22 nt, Mycobacterium leprae
cuuuugaagcugcuggcugagg

SEQ ID NO: 144536 - RNA, 19 nt, Mycobacterium leprae
gaaaagugugauuuauuga

SEQ ID NO: 144537 - RNA, 22 nt, Mycobacterium leprae
gaaaaugacgaugucgccgggc

SEQ ID NO: 144538 - RNA, 22 nt, Mycobacterium leprae
cgugguggccgugaucgcgaca

SEQ ID NO: 144539 - RNA, 22 nt, Mycobacterium leprae
cugaggcugugcugccgcgcga

SEQ ID NO: 144540 - RNA, 22 nt, Mycobacterium leprae
cucgaugucauccggauagugg

SEQ ID NO: 144541 - RNA, 20 nt, Mycobacterium leprae
cgccacucuaagucaccgac

SEQ ID NO: 144542 - RNA, 18 nt, Mycobacterium leprae
caggggcuucgaugcggu

SEQ ID NO: 144543 - RNA, 22 nt, Mycobacterium leprae
cgaaggaaugcaggcuucaguc

SEQ ID NO: 144544 - RNA, 22 nt, Mycobacterium leprae
cgaccugcaggucguuaucgcg

SEQ ID NO: 144545 - RNA, 22 nt, Mycobacterium leprae
cgagcugcgcuuccucgagcgu

SEQ ID NO: 144546 - RNA, 22 nt, Mycobacterium leprae
ugugcugguagugcauggcgau

SEQ ID NO: 144547 - RNA, 22 nt, Mycobacterium leprae
uguuuuucuagauaagcaccaa

SEQ ID NO: 144548 - RNA, 22 nt, Mycobacterium leprae
aaugcuaugauaauuuggcuga

SEQ ID NO: 144549 - RNA, 22 nt, Mycobacterium leprae
agccauccuggugagcuuucuu

SEQ ID NO: 144550 - RNA, 22 nt, Mycobacterium leprae
agcccaccagcuaggcguugga

SEQ ID NO: 144551 - RNA, 22 nt, Mycobacterium leprae
uuggacuuguaauuuggccugu

SEQ ID NO: 144552 - RNA, 22 nt, Mycobacterium leprae
uugguggccgguaccgucccgg

SEQ ID NO: 144553 - RNA, 20 nt, Mycobacterium leprae
uucaucuugcaagucccggu

SEQ ID NO: 144554 - RNA, 22 nt, Mycobacterium leprae
uucagacuaguaauuagaguua

SEQ ID NO: 144555 - RNA, 22 nt, Mycobacterium leprae
uucugagugauccgcacgaugg

SEQ ID NO: 144556 - RNA, 22 nt, Mycobacterium leprae
uucuuauaaauccauucuguuu

SEQ ID NO: 144557 - RNA, 22 nt, Mycobacterium leprae
uucuugacuugcuugcgcguau

SEQ ID NO: 144558 - RNA, 22 nt, Mycobacterium leprae
ugggcuaugugguucauucugg

SEQ ID NO: 144559 - RNA, 19 nt, Mycobacterium leprae
ugguccaguuacuggcccc

SEQ ID NO: 144560 - RNA, 22 nt, Mycobacterium leprae
uggugcucgucgaacaaccuca

SEQ ID NO: 144561 - RNA, 22 nt, Mycobacterium leprae
ugguggcaggcgccgcucagcu

SEQ ID NO: 144562 - RNA, 22 nt, Mycobacterium leprae
ucacucccauucgugcugacgc

SEQ ID NO: 144563 - RNA, 17 nt, Mycobacterium leprae
ucagcacuaagaguccc

SEQ ID NO: 144564 - RNA, 22 nt, Mycobacterium leprae
ucuuuugacuugucauguucau

SEQ ID NO: 144565 - RNA, 22 nt, Mycobacterium leprae
ucgggcaguggcgagucguaga

SEQ ID NO: 144566 - RNA, 22 nt, Mycobacterium leprae
ugccuggcagcaugcgcuccag

SEQ ID NO: 144567 - RNA, 22 nt, Mycobacterium leprae
ugcgcacuggcguccagcuggg

SEQ ID NO: 144568 - RNA, 22 nt, Mycobacterium leprae
ugcugaugucgaagacaaugua

SEQ ID NO: 144569 - RNA, 23 nt, Mycobacterium leprae
ugcugcugaugaucgcauccagc

SEQ ID NO: 144570 - RNA, 22 nt, Mycobacterium leprae
ugcuggcucaauugugugaugu

SEQ ID NO: 144571 - RNA, 21 nt, Mycobacterium leprae
ugaccuagauaugaccugagc

SEQ ID NO: 144572 - RNA, 22 nt, Mycobacterium leprae
ugaacugacuacgcucagagcg

SEQ ID NO: 144573 - RNA, 22 nt, Mycobacterium leprae
ugcagaugacgaugguggugcg

SEQ ID NO: 144574 - RNA, 19 nt, Mycobacterium leprae
ugccucguuaggugagggu

SEQ ID NO: 144575 - RNA, 22 nt, Mycobacterium leprae
guuugguuuuucaggcuauucu

SEQ ID NO: 144576 - RNA, 22 nt, Mycobacterium leprae
guuuuauuuaacuagacaucca

SEQ ID NO: 144577 - RNA, 22 nt, Mycobacterium leprae
guugguggcguagugacucgcu

SEQ ID NO: 144578 - RNA, 22 nt, Mycobacterium leprae
guguggugaguugcucacaaag

SEQ ID NO: 144579 - RNA, 23 nt, Mycobacterium leprae
gguggucuacguggucaaaguac

SEQ ID NO: 144580 - RNA, 22 nt, Mycobacterium leprae
ggugguggugcaaagguuugau

SEQ ID NO: 144581 - RNA, 22 nt, Mycobacterium leprae
ggugcaccgcccggcuacauug

SEQ ID NO: 144582 - RNA, 22 nt, Mycobacterium leprae
ggaacaacuauugucgauuggg

SEQ ID NO: 144583 - RNA, 22 nt, Mycobacterium leprae
ggaagaauggcuaccacgucga

SEQ ID NO: 144584 - RNA, 22 nt, Mycobacterium leprae
cccugcucaguagucggacccg

SEQ ID NO: 144585 - RNA, 22 nt, Mycobacterium leprae
cugcugcugacacgccguuccg

SEQ ID NO: 144586 - RNA, 22 nt, Mycobacterium leprae
ccugugcuggccgacugcacuc

SEQ ID NO: 144587 - RNA, 22 nt, Mycobacterium leprae
ccaggguuuuguuguggcucgc

SEQ ID NO: 144588 - RNA, 22 nt, Mycobacterium leprae
ccagccacgcugaauggucgcc

SEQ ID NO: 144589 - RNA, 22 nt, Mycobacterium leprae
ccagcuugcgugucguguucgu

SEQ ID NO: 144590 - RNA, 22 nt, Mycobacterium leprae
ccacaucuggcagaagagcugu

SEQ ID NO: 144591 - RNA, 22 nt, Mycobacterium leprae
ccaagcugcuccggucggugcu

SEQ ID NO: 144592 - RNA, 19 nt, Mycobacterium leprae
caugaugacguaccuaguc

SEQ ID NO: 144593 - RNA, 22 nt, Mycobacterium leprae
gaggaugaagucgacgagcuac

SEQ ID NO: 144594 - RNA, 22 nt, Mycobacterium leprae
cugguuuugguccuggggcagg

SEQ ID NO: 144595 - RNA, 22 nt, Mycobacterium leprae
gacugccucggacgaugagcug

SEQ ID NO: 144596 - RNA, 22 nt, Mycobacterium leprae
cuggccaguacggcccgccugg

SEQ ID NO: 144597 - RNA, 22 nt, Mycobacterium leprae
gcggcuguuggucagugggcca

SEQ ID NO: 144598 - RNA, 22 nt, Mycobacterium leprae
gcagauugcccacuuuggcacg

SEQ ID NO: 144599 - RNA, 19 nt, Human
ggaacgcugggcuccccuc

SEQ ID NO: 144600 - RNA, 22 nt, Human
uuuuccuucuuccugccuugcc

SEQ ID NO: 144601 - RNA, 22 nt, Human
gggggacagugugccuggugug

SEQ ID NO: 144602 - RNA, 22 nt, Human
auuuauuuucccucaaguaccu

SEQ ID NO: 144603 - RNA, 18 nt, Human
auucauuugcguuuggcu

SEQ ID NO: 144604 - RNA, 22 nt, Human
ugguugauuaauuuugccaagc

SEQ ID NO: 144605 - RNA, 22 nt, Human
aucucccaaauuagccucuuga

SEQ ID NO: 144606 - RNA, 22 nt, Human
aaaacauuuaggguuuuuuuua

SEQ ID NO: 144607 - RNA, 22 nt, Human
ccaggcagaggggucuggagca

SEQ ID NO: 144608 - RNA, 22 nt, Human
ugcaaaaguuuuauacacagau

SEQ ID NO: 144609 - RNA, 22 nt, Human
aaggugcugaggguccuggcuu

SEQ ID NO: 144610 - RNA, 22 nt, Human
acuuugaauuagaauuuugcug

SEQ ID NO: 144611 - RNA, 22 nt, Human
cuccucccagcccaggcgccac

SEQ ID NO: 144612 - RNA, 22 nt, Human
gguagacugagcuccuugagga

SEQ ID NO: 144613 - RNA, 23 nt, Human
cauuugauccucacaauaaaugg

SEQ ID NO: 144614 - RNA, 22 nt, Human
ugcauguuuuaagugaagcuga

SEQ ID NO: 144615 - RNA, 22 nt, Human
auggugaugaugaugaugauaa

SEQ ID NO: 144616 - RNA, 22 nt, Human
aauguaaauaauuguaaaauuu

SEQ ID NO: 144617 - RNA, 22 nt, Human
cuccaugagccaggagggcuac

SEQ ID NO: 144618 - RNA, 22 nt, Human
uuauuuaagaucuuaauauaua

SEQ ID NO: 144619 - RNA, 20 nt, Human
uggguucaguuguuucuggc

SEQ ID NO: 144620 - RNA, 22 nt, Human
ucagagaaguaggcuaauggug

SEQ ID NO: 144621 - RNA, 22 nt, Human
acuuuaaaucuguugcuuagcu

SEQ ID NO: 144622 - RNA, 22 nt, Human
agggcaggguuggugcuggugc

SEQ ID NO: 144623 - RNA, 22 nt, Human
gcacauauuuagaucuugaugu

SEQ ID NO: 144624 - RNA, 20 nt, Human
uggcccgcgcuccuccugcu

SEQ ID NO: 144625 - RNA, 22 nt, Human
gaauauuuaucucagcugcaga

SEQ ID NO: 144626 - RNA, 22 nt, Human
cacccccaggcuccccuucugg

SEQ ID NO: 144627 - RNA, 22 nt, Human
uaaaaugcucagauaaauauau

SEQ ID NO: 144628 - RNA, 22 nt, Human
agaauuuguaucuacggugugc

SEQ ID NO: 144629 - RNA, 22 nt, Human
ggggcaucguugauugcauggu

SEQ ID NO: 144630 - RNA, 22 nt, Human
uuuuccuuagaaauacauugau

SEQ ID NO: 144631 - RNA, 22 nt, Human
uugcuuucuuuguagguuuucc

SEQ ID NO: 144632 - RNA, 22 nt, Human
uuuuaaaacaugucaaaaugug

SEQ ID NO: 144633 - RNA, 22 nt, Human
ccagccuucugaugggacccuc

SEQ ID NO: 144634 - RNA, 21 nt, Human
uuccuggaggcagaaacguga

SEQ ID NO: 144635 - RNA, 22 nt, Human
gcagaggcugccgugggcagga

SEQ ID NO: 144636 - RNA, 22 nt, Human
ccuuuuuagaugugcgaauguu

SEQ ID NO: 144637 - RNA, 22 nt, Human
caugaugagaguaauaacacag

SEQ ID NO: 144638 - RNA, 22 nt, Human
uuaugccuguuaggcagcaucu

SEQ ID NO: 144639 - RNA, 22 nt, Human
ggagaggaaguuuaaagaauug

SEQ ID NO: 144640 - RNA, 22 nt, Human
uaguggaaccuucuaaaugacg

SEQ ID NO: 144641 - RNA, 22 nt, Human
cuggaugucugggaggcuuccc

SEQ ID NO: 144642 - RNA, 22 nt, Human
uuucuauauucaguuucauaaa

SEQ ID NO: 144643 - RNA, 20 nt, Human
gugaacuggagaacugaugu

SEQ ID NO: 144644 - RNA, 22 nt, Human
acuauuguccgauuucuuuacu

SEQ ID NO: 144645 - RNA, 22 nt, Human
uuacuguguguaaaauaucuuu

SEQ ID NO: 144646 - RNA, 21 nt, Human
uugugaaaguccaggaacaac

SEQ ID NO: 144647 - RNA, 22 nt, Human
uuuagguuguguucuggcaugu

SEQ ID NO: 144648 - RNA, 22 nt, Human
agguuuggaaguggcgauccau

SEQ ID NO: 144649 - RNA, 22 nt, Human
agaaaaggaagcuuagacugua

SEQ ID NO: 144650 - RNA, 22 nt, Human
cagaaaaaaaugcagacuagca

SEQ ID NO: 144651 - RNA, 22 nt, Human
caauguuuuuccuuccuuaaua

SEQ ID NO: 144652 - RNA, 22 nt, Human
ggcuggggccuguugaagaugc

SEQ ID NO: 144653 - RNA, 22 nt, Human
uuuaaugucuuggaaaaagacu

SEQ ID NO: 144654 - RNA, 22 nt, Human
ugaggaggugggcacacagagu

SEQ ID NO: 144655 - RNA, 20 nt, Human
agguugguuuacuagucugu

SEQ ID NO: 144656 - RNA, 22 nt, Human
uuacuuucugggauaucaaaug

SEQ ID NO: 144657 - RNA, 22 nt, Human
uccucccugcacucagugaagu

SEQ ID NO: 144658 - RNA, 22 nt, Human
aagaggaggcuggaauccuaaa

SEQ ID NO: 144659 - RNA, 22 nt, Human
gggggaggcucggcgccgcggu

SEQ ID NO: 144660 - RNA, 22 nt, Human
aagccugguuauuugaggaugu

SEQ ID NO: 144661 - RNA, 22 nt, Human
cuggccagccucccagguaccc

SEQ ID NO: 144662 - RNA, 22 nt, Human
aaacccaggguuuugucuuccc

SEQ ID NO: 144663 - RNA, 22 nt, Human
gaaccauuuaauggagaugcuc

SEQ ID NO: 144664 - RNA, 22 nt, Human
acagcugagaugcuacuugugg

SEQ ID NO: 144665 - RNA, 22 nt, Human
cugcagagaccuaggucagguu

SEQ ID NO: 144666 - RNA, 22 nt, Human
ggagguggagcuggaaguucca

SEQ ID NO: 144667 - RNA, 22 nt, Human
uuggugaugcccaccuuuucau

SEQ ID NO: 144668 - RNA, 22 nt, Human
uuuauaauuacguaaaauauuu

SEQ ID NO: 144669 - RNA, 22 nt, Human
gaaagugaauguaacauguuau

SEQ ID NO: 144670 - RNA, 22 nt, Human
gggggagcuacaggucccuugg

SEQ ID NO: 144671 - RNA, 22 nt, Human
uuuauguugagcaaaauaccac

SEQ ID NO: 144672 - RNA, 22 nt, Human
gagggggaaaagggcagcagag

SEQ ID NO: 144673 - RNA, 22 nt, Human
augaggguggggaaugggccau

SEQ ID NO: 144674 - RNA, 22 nt, Human
gugucacuuucaggagcucuaa

SEQ ID NO: 144675 - RNA, 22 nt, Human
ggggaaggaaggggagggcacg

SEQ ID NO: 144676 - RNA, 22 nt, Human
uggacagguacuucacauuauu

SEQ ID NO: 144677 - RNA, 22 nt, Human
aaugcagaugugucuuuaauuu

SEQ ID NO: 144678 - RNA, 22 nt, Human
ucugaauauguuuaucaucucu

SEQ ID NO: 144679 - RNA, 22 nt, Human
aguauuuaguauucuauauuag

SEQ ID NO: 144680 - RNA, 22 nt, Human
gauuugucuauauucaaauaug

SEQ ID NO: 144681 - RNA, 22 nt, Human
agugagaguauuaaugugaacu

SEQ ID NO: 144682 - RNA, 22 nt, Human
uuuuacaaugcaaauucuugcu

SEQ ID NO: 144683 - RNA, 22 nt, Human
cccagccuuugcuuccugguuc

SEQ ID NO: 144684 - RNA, 22 nt, Human
agaggagaauguaaauuuguca

SEQ ID NO: 144685 - RNA, 22 nt, Human
cuuauuagaaagaaaagacaug

SEQ ID NO: 144686 - RNA, 22 nt, Human
caauggagccaagaggaggaaa

SEQ ID NO: 144687 - RNA, 22 nt, Human
auucuuuauuuucuguacuugc

SEQ ID NO: 144688 - RNA, 22 nt, Human
uugaccagaaaaguuaguaauu

SEQ ID NO: 144689 - RNA, 22 nt, Human
uuaucaaaaaauaguacuuuga

SEQ ID NO: 144690 - RNA, 22 nt, Human
auuuuuuuuccugucucuuuca

SEQ ID NO: 144691 - RNA, 22 nt, Human
cauuuuccucugcugguguuca

SEQ ID NO: 144692 - RNA, 22 nt, Human
gaaagagaugucguuugucuuc

SEQ ID NO: 144693 - RNA, 22 nt, Human
aaucauaacaaaagcaauuaua

SEQ ID NO: 144694 - RNA, 22 nt, Human
aguaauaaacaacucauuuugg

SEQ ID NO: 144695 - RNA, 22 nt, Human
ucugagugacguccugacagga

SEQ ID NO: 144696 - RNA, 19 nt, Human
uggaggcacuaacaaacuc

SEQ ID NO: 144697 - RNA, 22 nt, Human
aaaguuacacgacuauuuaugu

SEQ ID NO: 144698 - RNA, 22 nt, Human
guagucauugggucugugguca

SEQ ID NO: 144699 - RNA, 22 nt, Human
gugaaaaauggccaucaggaca

SEQ ID NO: 144700 - RNA, 22 nt, Human
aaauauauccuucuguccugcc

SEQ ID NO: 144701 - RNA, 22 nt, Human
cucccaucacaauucagggccu

SEQ ID NO: 144702 - RNA, 22 nt, Human
uaaaaucaugacagauugacau

SEQ ID NO: 144703 - RNA, 22 nt, Human
uggaaaauuuagaaagauuuau

SEQ ID NO: 144704 - RNA, 22 nt, Human
uggucucaaagcaaggaaggaa

SEQ ID NO: 144705 - RNA, 22 nt, Human
gauuaaaggucuugauuauaag

SEQ ID NO: 144706 - RNA, 22 nt, Human
aagacagugacagucacaauug

SEQ ID NO: 144707 - RNA, 22 nt, Human
gaaguaaaacaguaacuuuguu

SEQ ID NO: 144708 - RNA, 22 nt, Human
aacccugaacuuaguucuagga

SEQ ID NO: 144709 - RNA, 22 nt, Human
ugcuugaacccaggaaguggag

SEQ ID NO: 144710 - RNA, 22 nt, Human
gggaaaaaggaaccuuauuacu

SEQ ID NO: 144711 - RNA, 22 nt, Human
guguugaugugucuguauucua

SEQ ID NO: 144712 - RNA, 22 nt, Human
agagagggaugguguccagaga

SEQ ID NO: 144713 - RNA, 22 nt, Human
cacuauguacauaauagcugcu

SEQ ID NO: 144714 - RNA, 22 nt, Human
acaauaauguuuuuagguuauu

SEQ ID NO: 144715 - RNA, 23 nt, Human
agagggaagagcuuagaugggga

SEQ ID NO: 144716 - RNA, 22 nt, Human
acuggguuguuugucucaugag

SEQ ID NO: 144717 - RNA, 22 nt, Human
auugcaggucguguggaaguga

SEQ ID NO: 144718 - RNA, 22 nt, Human
agacacugacaggguccaugga

SEQ ID NO: 144719 - RNA, 22 nt, Human
uccucagcaaacacuucacucu

SEQ ID NO: 144720 - RNA, 22 nt, Human
uaccuggauaaauguacaaccg

SEQ ID NO: 144721 - RNA, 22 nt, Human
guugagaaucucuagcuuagga

SEQ ID NO: 144722 - RNA, 22 nt, Human
cagcuucacuuaaaacaugcaa

SEQ ID NO: 144723 - RNA, 22 nt, Human
auuuucuucauuuugauuguau

SEQ ID NO: 144724 - RNA, 22 nt, Human
aaucaauuauccauuuguuagu

SEQ ID NO: 144725 - RNA, 22 nt, Human
auguuugugauugcugaaaaga

SEQ ID NO: 144726 - RNA, 23 nt, Human
acgggaggcggggcagggcugag

SEQ ID NO: 144727 - RNA, 22 nt, Human
gagagaggggaagagaagcucu

SEQ ID NO: 144728 - RNA, 22 nt, Human
auagaagugaaaagggaugacu

SEQ ID NO: 144729 - RNA, 22 nt, Human
auuucacucuuaauugcuuccu

SEQ ID NO: 144730 - RNA, 22 nt, Human
gccugagauuggacauuauuua

SEQ ID NO: 144731 - RNA, 22 nt, Human
agugaggggagaaugaggugga

SEQ ID NO: 144732 - RNA, 22 nt, Human
ugaauucaaacuuuuuaacaag

SEQ ID NO: 144733 - RNA, 22 nt, Human
ucaguggaacacacagaguggg

SEQ ID NO: 144734 - RNA, 22 nt, Human
ucuugugguggaucccucauuu

SEQ ID NO: 144735 - RNA, 22 nt, Human
aaggggaggccugcgcuuucgg

SEQ ID NO: 144736 - RNA, 22 nt, Human
ucagggaggagaggcaggggga

SEQ ID NO: 144737 - RNA, 22 nt, Human
agcagggagacagugcagcauu

SEQ ID NO: 144738 - RNA, 22 nt, Human
auggagggguuguugcuugagu

SEQ ID NO: 144739 - RNA, 22 nt, Human
aauuucuuucagcugcuuuaag

SEQ ID NO: 144740 - RNA, 22 nt, Human
auuuuauuuugggaucuuuuua

SEQ ID NO: 144741 - RNA, 22 nt, Human
acuucccacugcagugacugag

SEQ ID NO: 144742 - RNA, 22 nt, Human
aguaggauguuuagcccuucuu

SEQ ID NO: 144743 - RNA, 22 nt, Human
cccagccugaucucggccagcu

SEQ ID NO: 144744 - RNA, 22 nt, Human
augggagggagcagugaguguu

SEQ ID NO: 144745 - RNA, 22 nt, Human
aauggaaaaagaacuguuuaaa

SEQ ID NO: 144746 - RNA, 22 nt, Human
guuuggguggcuagagaaagaa

SEQ ID NO: 144747 - RNA, 22 nt, Human
ucaguagcauuuaauguucagu

SEQ ID NO: 144748 - RNA, 22 nt, Human
aauuuuauuuuuuccccuagau

SEQ ID NO: 144749 - RNA, 22 nt, Human
gcaucacacgcacauacacaca

SEQ ID NO: 144750 - RNA, 19 nt, Human
gaguaaaacuagagagaaa

SEQ ID NO: 144751 - RNA, 21 nt, Human
gaaaaucuaaugugacaaugc

SEQ ID NO: 144752 - RNA, 22 nt, Human
aaggaaaaaauggcuugugaua

SEQ ID NO: 144753 - RNA, 20 nt, Human
aaccuauuguaauauucuaa

SEQ ID NO: 144754 - RNA, 22 nt, Human
uuaggggcuuaggcagaguuug

SEQ ID NO: 144755 - RNA, 22 nt, Human
aacucugcaaugaaaucauguu

SEQ ID NO: 144756 - RNA, 22 nt, Human
auucauucugaccucaagagaa

SEQ ID NO: 144757 - RNA, 22 nt, Human
ggcuagggaucuagaccaggac

SEQ ID NO: 144758 - RNA, 22 nt, Human
augaguuaaguagcccuucaug

SEQ ID NO: 144759 - RNA, 22 nt, Human
augaacugcaguauaaacuugg

SEQ ID NO: 144760 - RNA, 22 nt, Human
uuaaaauuguuaacuuugguga

SEQ ID NO: 144761 - RNA, 23 nt, Human
guuauugcuggugcuggccagcc

SEQ ID NO: 144762 - RNA, 22 nt, Human
gaaaaagucuuaaaguaaggca

SEQ ID NO: 144763 - RNA, 22 nt, Human
ucagccuugguuuugguguugg

SEQ ID NO: 144764 - RNA, 22 nt, Human
uuucagaaauggcacugaaauc

SEQ ID NO: 144765 - RNA, 22 nt, Human
uucuguguauggaagaaugucc

SEQ ID NO: 144766 - RNA, 22 nt, Human
uugaagccaccacuguaaguca

SEQ ID NO: 144767 - RNA, 23 nt, Human
uggcaaacgggaauaaaggaauu

SEQ ID NO: 144768 - RNA, 22 nt, Human
cauccagcuccugggggccacc

SEQ ID NO: 144769 - RNA, 22 nt, Human
augcugugccuggaaagcggcu

SEQ ID NO: 144770 - RNA, 21 nt, Human
guucuuaguuauauucucaau

SEQ ID NO: 144771 - RNA, 22 nt, Human
cacugugagugcaagcaggggu

SEQ ID NO: 144772 - RNA, 18 nt, Human
ucagaggagauaccuaaa

SEQ ID NO: 144773 - RNA, 22 nt, Human
acgugugugugcacguguguau

SEQ ID NO: 144774 - RNA, 22 nt, Human
gcauucuugucaguggggucag

SEQ ID NO: 144775 - RNA, 22 nt, Human
aggcuccucugggggccccgga

SEQ ID NO: 144776 - RNA, 22 nt, Human
ugagguuacauuaggaauaacc

SEQ ID NO: 144777 - RNA, 22 nt, Human
uuuauguuuguuuuugaaauaa

SEQ ID NO: 144778 - RNA, 22 nt, Human
caggggcuuuccuguuuaugga

SEQ ID NO: 144779 - RNA, 22 nt, Human
cugggggacagagagaggcggu

SEQ ID NO: 144780 - RNA, 20 nt, Human
gaacauaaauaacucuuuac

SEQ ID NO: 144781 - RNA, 22 nt, Human
auuuuguugaaacccuuguugu

SEQ ID NO: 144782 - RNA, 22 nt, Human
gauaauuauaggcuaagccacu

SEQ ID NO: 144783 - RNA, 22 nt, Human
ccccauuugaagauugggggua

SEQ ID NO: 144784 - RNA, 17 nt, Human
agcagcuggguugaucu

SEQ ID NO: 144785 - RNA, 22 nt, Human
ggaugaguuguauauaggauuc

SEQ ID NO: 144786 - RNA, 22 nt, Human
ugcaugaucucacuuacaggug

SEQ ID NO: 144787 - RNA, 22 nt, Human
uaaaauaccacauauggugcuc

SEQ ID NO: 144788 - RNA, 22 nt, Human
uagguggaaccauaugaaauuu

SEQ ID NO: 144789 - RNA, 22 nt, Human
gcgccgacccucccugccggac

SEQ ID NO: 144790 - RNA, 19 nt, Human
agggagagucccaagagaa

SEQ ID NO: 144791 - RNA, 22 nt, Human
caugccucuguuuuaguuguug

SEQ ID NO: 144792 - RNA, 22 nt, Human
agcauucuguggucuucuaugg

SEQ ID NO: 144793 - RNA, 22 nt, Human
aggcaguggagcuggaauaggc

SEQ ID NO: 144794 - RNA, 22 nt, Human
uucagguuuuuaaguucugccu

SEQ ID NO: 144795 - RNA, 22 nt, Human
caagcagauauuuuagucaaga

SEQ ID NO: 144796 - RNA, 22 nt, Human
uacuuaaaacacauuuagcauu

SEQ ID NO: 144797 - RNA, 22 nt, Human
uucuugucuuuguuauguagga

SEQ ID NO: 144798 - RNA, 22 nt, Human
ucuuuaagugugugccuccagg

SEQ ID NO: 144799 - RNA, 22 nt, Human
cucugcuuguaucacauuugcu

SEQ ID NO: 144800 - RNA, 22 nt, Human
uugaauuuagguuuaugugaaa

SEQ ID NO: 144801 - RNA, 22 nt, Human
cuaaauucuauauccuugcuuc

SEQ ID NO: 144802 - RNA, 22 nt, Human
uuuuugggccaaauauauuuac

SEQ ID NO: 144803 - RNA, 22 nt, Human
uuaaaagaauccuguuauccuc

SEQ ID NO: 144804 - RNA, 22 nt, Human
acauuuuaccaucuguggauga

SEQ ID NO: 144805 - RNA, 22 nt, Human
guggaagauauuucugguccag

SEQ ID NO: 144806 - RNA, 22 nt, Human
ugcugcucaagcugcagcaaaa

SEQ ID NO: 144807 - RNA, 22 nt, Human
gagaacuguguauucuuuuuca

SEQ ID NO: 144808 - RNA, 22 nt, Human
cuccuuugagcaaaucuuugau

SEQ ID NO: 144809 - RNA, 22 nt, Human
ggacggggagcuggaaagggga

SEQ ID NO: 144810 - RNA, 22 nt, Human
ggcucacuguaccugccgccgc

SEQ ID NO: 144811 - RNA, 22 nt, Human
cuguggcuaggaagcuguggga

SEQ ID NO: 144812 - RNA, 22 nt, Human
cugcagauguagcugcuuuccu

SEQ ID NO: 144813 - RNA, 22 nt, Human
uacccauuuugguucuugaugc

SEQ ID NO: 144814 - RNA, 22 nt, Human
cagcacugcccuaccccuccac

SEQ ID NO: 144815 - RNA, 22 nt, Human
ugaauuuguaggaauucuccau

SEQ ID NO: 144816 - RNA, 20 nt, Human
cuggaguguagcaguggcug

SEQ ID NO: 144817 - RNA, 22 nt, Human
auggagugggaggacaugaagg

SEQ ID NO: 144818 - RNA, 22 nt, Human
accuccauggcccacaucuagu

SEQ ID NO: 144819 - RNA, 22 nt, Human
cagaaacacuguauuuagggaa

SEQ ID NO: 144820 - RNA, 22 nt, Human
ugaguacauuugauuaucagag

SEQ ID NO: 144821 - RNA, 22 nt, Human
acuuugugaauagaacuggaug

SEQ ID NO: 144822 - RNA, 22 nt, Human
gaggugauuccucccauguaau

SEQ ID NO: 144823 - RNA, 22 nt, Human
auguaaugucaaucuucagugg

SEQ ID NO: 144824 - RNA, 22 nt, Human
uggugcucuugauauauaaggc

SEQ ID NO: 144825 - RNA, 22 nt, Human
ggcagagguagcuggaaccagg

SEQ ID NO: 144826 - RNA, 22 nt, Human
uggcucaggccuacgacgccuu

SEQ ID NO: 144827 - RNA, 22 nt, Human
ggcagucuuucccuugagcucu

SEQ ID NO: 144828 - RNA, 17 nt, Human
ucuguguccgcucaguc

SEQ ID NO: 144829 - RNA, 22 nt, Human
uacucauuggagaauuacgagg

SEQ ID NO: 144830 - RNA, 19 nt, Human
ggaggguguccucaguguc

SEQ ID NO: 144831 - RNA, 22 nt, Human
auaaaucaagggcaguauuucc

SEQ ID NO: 144832 - RNA, 22 nt, Human
aggggaggggaguaucaggauu

SEQ ID NO: 144833 - RNA, 22 nt, Human
gauaaauaguguuuggggacau

SEQ ID NO: 144834 - RNA, 22 nt, Human
uauuuuauuuagguuuaguugu

SEQ ID NO: 144835 - RNA, 21 nt, Human
agaugaggauacugaggccua

SEQ ID NO: 144836 - RNA, 22 nt, Human
uaauauaacugccaguuaaggu

SEQ ID NO: 144837 - RNA, 22 nt, Human
ucagucacugucucagacagga

SEQ ID NO: 144838 - RNA, 22 nt, Human
agaggggaaggaugugauguga

SEQ ID NO: 144839 - RNA, 22 nt, Human
uucuuauuuuucguaaauccug

SEQ ID NO: 144840 - RNA, 22 nt, Human
uagggaggguuugggguggagg

SEQ ID NO: 144841 - RNA, 22 nt, Human
cagccccagcacuuagcugagu

SEQ ID NO: 144842 - RNA, 22 nt, Human
agcagagggucaguuuuuuagu

SEQ ID NO: 144843 - RNA, 23 nt, Human
ucucccagaaguucucggggacu

SEQ ID NO: 144844 - RNA, 22 nt, Human
ggggaggugugcaggacaccuc

SEQ ID NO: 144845 - RNA, 22 nt, Human
uuucuaaaauuacugcagucgg

SEQ ID NO: 144846 - RNA, 22 nt, Human
uuuuuauguaaaauauuaaaag

SEQ ID NO: 144847 - RNA, 22 nt, Human
aagccucaugccagauccaggu

SEQ ID NO: 144848 - RNA, 22 nt, Human
uagacugugagcuccuugaggg

SEQ ID NO: 144849 - RNA, 22 nt, Human
uacagaccaguaguucucagcg

SEQ ID NO: 144850 - RNA, 22 nt, Human
gucugcagcacugugcacgguc

SEQ ID NO: 144851 - RNA, 19 nt, Human
ccaguuuuuuaauauucaa

SEQ ID NO: 144852 - RNA, 22 nt, Human
auguucucagguuguauuuauu

SEQ ID NO: 144853 - RNA, 22 nt, Human
agagggagcuccaagaucaagg

SEQ ID NO: 144854 - RNA, 22 nt, Human
aggggaggcugggcuggggggc

SEQ ID NO: 144855 - RNA, 22 nt, Human
gugcccaguugaggccaggacu

SEQ ID NO: 144856 - RNA, 22 nt, Human
aggaaaguugcuuguagugcug

SEQ ID NO: 144857 - RNA, 22 nt, Human
uggggcauacgugaaauaauuu

SEQ ID NO: 144858 - RNA, 22 nt, Human
aaauagauuugacuacuuggug

SEQ ID NO: 144859 - RNA, 22 nt, Human
uucagcaagugucucuacuguc

SEQ ID NO: 144860 - RNA, 22 nt, Human
aggguggcuggaguggucuggu

SEQ ID NO: 144861 - RNA, 22 nt, Human
gcagagcugucuaagucacuuc

SEQ ID NO: 144862 - RNA, 22 nt, Human
aauuagaagcuguuagcaaaau

SEQ ID NO: 144863 - RNA, 20 nt, Human
uucucugcagcaggcggccc

SEQ ID NO: 144864 - RNA, 22 nt, Human
uggugcucucgauauauaaggc

SEQ ID NO: 144865 - RNA, 22 nt, Human
uccaggagucagacagauggug

SEQ ID NO: 144866 - RNA, 22 nt, Human
aaaucauagccaugaacauuug

SEQ ID NO: 144867 - RNA, 22 nt, Human
acaggcugcccgcuccccaccu

SEQ ID NO: 144868 - RNA, 22 nt, Human
gcucagcuggagagggacgggu

SEQ ID NO: 144869 - RNA, 22 nt, Human
uauuuuuuuaacauuuauugua

SEQ ID NO: 144870 - RNA, 22 nt, Human
uaauucuucaauccaguguuca

SEQ ID NO: 144871 - RNA, 22 nt, Human
cacaauuuccauugagcagcag

SEQ ID NO: 144872 - RNA, 22 nt, Human
aaggaugguaacaguuucauuu

SEQ ID NO: 144873 - RNA, 17 nt, Human
cccugcacccuacucuc

SEQ ID NO: 144874 - RNA, 22 nt, Human
uacauuugauuuuugcuucuuu

SEQ ID NO: 144875 - RNA, 22 nt, Human
ugucuuuagagugaacagaaga

SEQ ID NO: 144876 - RNA, 18 nt, Human
aaacccacguauucaggc

SEQ ID NO: 144877 - RNA, 18 nt, Human
acaaaaauagugcuuugg

SEQ ID NO: 144878 - RNA, 22 nt, Human
agggagucuggccgucggcugg

SEQ ID NO: 144879 - RNA, 22 nt, Human
auauauguauauacacauauau

SEQ ID NO: 144880 - RNA, 22 nt, Human
agcaaaauuccaaaaugcuaau

SEQ ID NO: 144881 - RNA, 22 nt, Human
aguggagguuacagcuguacau

SEQ ID NO: 144882 - RNA, 22 nt, Human
uauuaaaagagaaaaagccacc

SEQ ID NO: 144883 - RNA, 22 nt, Human
uugaguuuacauuguauuagcc

SEQ ID NO: 144884 - RNA, 22 nt, Human
aagacagaaaagcagagagagg

SEQ ID NO: 144885 - RNA, 22 nt, Human
aagaggcuacagcccugugucu

SEQ ID NO: 144886 - RNA, 22 nt, Human
agucauuugucauuuuuuugag

SEQ ID NO: 144887 - RNA, 22 nt, Human
caaaaauacuugccuguaucug

SEQ ID NO: 144888 - RNA, 22 nt, Human
aguauuuuaaaauacauuaucc

SEQ ID NO: 144889 - RNA, 22 nt, Human
cuguguguauaauguuugauaa

SEQ ID NO: 144890 - RNA, 22 nt, Human
uaagugcuagaauuccagguuu

SEQ ID NO: 144891 - RNA, 22 nt, Human
ccaggcuccccaggaggcccuu

SEQ ID NO: 144892 - RNA, 22 nt, Human
aguucauccucauuuacaagga

SEQ ID NO: 144893 - RNA, 22 nt, Human
cuucuucaucuuuuggaggaac

SEQ ID NO: 144894 - RNA, 22 nt, Human
uuuuauuuguauguugaaugua

SEQ ID NO: 144895 - RNA, 22 nt, Human
uuucugagccacauauaauuug

SEQ ID NO: 144896 - RNA, 22 nt, Human
gucuuucuuuuacauauuugug

SEQ ID NO: 144897 - RNA, 22 nt, Human
cagagcagaaaccugggugauu

SEQ ID NO: 144898 - RNA, 22 nt, Human
aagucauuaucucuucuaaucu

SEQ ID NO: 144899 - RNA, 22 nt, Human
aauuuuauuagacaggcauaau

SEQ ID NO: 144900 - RNA, 22 nt, Human
uacaaaauucaaauaauguuug

SEQ ID NO: 144901 - RNA, 22 nt, Human
caguggacacuuccucuacaau

SEQ ID NO: 144902 - RNA, 22 nt, Human
cggggaggagccagcggaggau

SEQ ID NO: 144903 - RNA, 22 nt, Human
uggagagauagucauucuagag

SEQ ID NO: 144904 - RNA, 22 nt, Human
ugaaguuuagaaaaagugccuu

SEQ ID NO: 144905 - RNA, 22 nt, Human
uuuaaauuucugaaucuugagg

SEQ ID NO: 144906 - RNA, 22 nt, Human
aaacugcuuucucugccuuucc

SEQ ID NO: 144907 - RNA, 22 nt, Human
agggaccacauccccucugugg

SEQ ID NO: 144908 - RNA, 20 nt, Human
ugggauggaaucaccugcac

SEQ ID NO: 144909 - RNA, 22 nt, Human
ugagggauuucuggccuuaacu

SEQ ID NO: 144910 - RNA, 22 nt, Human
aagggaggguaggaagagggag

SEQ ID NO: 144911 - RNA, 20 nt, Human
caggccuucaggauggcugg

SEQ ID NO: 144912 - RNA, 22 nt, Human
ugagaaaacaguuuguaauaau

SEQ ID NO: 144913 - RNA, 19 nt, Human
agggaggcaagagaaaugu

SEQ ID NO: 144914 - RNA, 22 nt, Human
aaauauagugacacuuauaguc

SEQ ID NO: 144915 - RNA, 22 nt, Human
gggcuguggggccugcagaagg

SEQ ID NO: 144916 - RNA, 22 nt, Human
gcagaugagagugugaucuggg

SEQ ID NO: 144917 - RNA, 20 nt, Human
agugauuuguuaguacauug

SEQ ID NO: 144918 - RNA, 22 nt, Human
caggaggaggccgggaggaagc

SEQ ID NO: 144919 - RNA, 22 nt, Human
uucagaauguacugauagaaca

SEQ ID NO: 144920 - RNA, 22 nt, Human
uugaaagaacaauucugugaug

SEQ ID NO: 144921 - RNA, 22 nt, Human
gauggcaaugcuagaaauuuag

SEQ ID NO: 144922 - RNA, 22 nt, Human
ugcagagagccagcucucucgg

SEQ ID NO: 144923 - RNA, 19 nt, Human
ugccccacccucuauccag

SEQ ID NO: 144924 - RNA, 22 nt, Human
uuucucuuguauuugaaucacu

SEQ ID NO: 144925 - RNA, 22 nt, Human
auguuuucauuuagaagcuaau

SEQ ID NO: 144926 - RNA, 20 nt, Human
guugggagaagugucagcug

SEQ ID NO: 144927 - RNA, 22 nt, Human
acauuuugggagaaaguuguua

SEQ ID NO: 144928 - RNA, 22 nt, Human
cuucuuucuuuucuucuucucu

SEQ ID NO: 144929 - RNA, 22 nt, Human
ugagauuuagaacuggauuuca

SEQ ID NO: 144930 - RNA, 22 nt, Human
uguuggaaucuucuagucuucc

SEQ ID NO: 144931 - RNA, 22 nt, Human
uggagggaagcaaacacuagau

SEQ ID NO: 144932 - RNA, 22 nt, Human
agugccaucuuuaacuguccca

SEQ ID NO: 144933 - RNA, 22 nt, Human
uugcacgucacccuucccaccu

SEQ ID NO: 144934 - RNA, 23 nt, Human
caggggacaggugaccugggcuc

SEQ ID NO: 144935 - RNA, 22 nt, Human
aggcagagaggucuuccuggaa

SEQ ID NO: 144936 - RNA, 22 nt, Human
aauuugcuccaaugucaguucu

SEQ ID NO: 144937 - RNA, 21 nt, Human
uugauuuagcagaucuagcug

SEQ ID NO: 144938 - RNA, 19 nt, Human
caggucuucuuggaggacu

SEQ ID NO: 144939 - RNA, 22 nt, Human
ggagguguguucuguuuuagug

SEQ ID NO: 144940 - RNA, 18 nt, Human
ggcugggcugugccccuu

SEQ ID NO: 144941 - RNA, 22 nt, Human
uugguuuacucuggggauaucu

SEQ ID NO: 144942 - RNA, 22 nt, Human
gacuggggcauuagaguagcuu

SEQ ID NO: 144943 - RNA, 22 nt, Human
cauaaauuuuaccuuguaagug

SEQ ID NO: 144944 - RNA, 23 nt, Human
cugaaauucagaugcuaaagaua

SEQ ID NO: 144945 - RNA, 22 nt, Human
auauuuuacagcucucguugaa

SEQ ID NO: 144946 - RNA, 22 nt, Human
uggcagcauuuuuuccagaaca

SEQ ID NO: 144947 - RNA, 22 nt, Human
uuuuuucuucucuaucuuaaua

SEQ ID NO: 144948 - RNA, 22 nt, Human
guccccugcguguucauccugg

SEQ ID NO: 144949 - RNA, 22 nt, Human
ggaaggggagcuggaaagggua

SEQ ID NO: 144950 - RNA, 22 nt, Human
uugucucuacagagaguaguag

SEQ ID NO: 144951 - RNA, 22 nt, Human
uauauaauacacaaauauguac

SEQ ID NO: 144952 - RNA, 22 nt, Human
aaugaauaaauuuuaaagacag

SEQ ID NO: 144953 - RNA, 20 nt, Human
uuguacuuaugugagaagga

SEQ ID NO: 144954 - RNA, 22 nt, Human
uccaugaguuuuuuaguuucac

SEQ ID NO: 144955 - RNA, 22 nt, Human
aucuggaacuucucugcauuga

SEQ ID NO: 144956 - RNA, 22 nt, Human
uucuguacuagaucuuaucagu

SEQ ID NO: 144957 - RNA, 22 nt, Human
augagugugugguucuaaauga

SEQ ID NO: 144958 - RNA, 22 nt, Human
guguucuuuguagaggaucuug

SEQ ID NO: 144959 - RNA, 18 nt, Human
ccuucaucucugcuucuu

SEQ ID NO: 144960 - RNA, 22 nt, Human
cugccacuaccaugcuggauga

SEQ ID NO: 144961 - RNA, 22 nt, Human
agggcaguuaugaaugucucca

SEQ ID NO: 144962 - RNA, 22 nt, Human
guuuuucuuugauuuagaacca

SEQ ID NO: 144963 - RNA, 22 nt, Human
aauacagcacucacaccucccu

SEQ ID NO: 144964 - RNA, 22 nt, Human
gagcagcucgagaaggaagcag

SEQ ID NO: 144965 - RNA, 22 nt, Human
auagaaauagacaaugcaaaga

SEQ ID NO: 144966 - RNA, 22 nt, Human
cagcagaggagguggcagcacc

SEQ ID NO: 144967 - RNA, 21 nt, Human
gggagugaguaaugauggggg

SEQ ID NO: 144968 - RNA, 22 nt, Human
cuugcuuuaucugguuucucau

SEQ ID NO: 144969 - RNA, 22 nt, Human
ugguggagucugggggaggcuu

SEQ ID NO: 144970 - RNA, 22 nt, Human
gggagggucugagagcugcacc

SEQ ID NO: 144971 - RNA, 22 nt, Human
agugaaaacugaaucaccuucc

SEQ ID NO: 144972 - RNA, 22 nt, Human
cuuuuuuucuccauauuucugg

SEQ ID NO: 144973 - RNA, 22 nt, Human
ucgagcucagcagggaggugcg

SEQ ID NO: 144974 - RNA, 20 nt, Human
ucugugugccaucaccuaac

SEQ ID NO: 144975 - RNA, 22 nt, Human
auuauacauuaggagauugauu

SEQ ID NO: 144976 - RNA, 22 nt, Human
uuguuuuaguagaaguuacaug

SEQ ID NO: 144977 - RNA, 22 nt, Human
acauaaaccccccuuccccagg

SEQ ID NO: 144978 - RNA, 22 nt, Human
cuaaaacuuuuccaaauuaugu

SEQ ID NO: 144979 - RNA, 22 nt, Human
uuuggcugucauuugaaaaugu

SEQ ID NO: 144980 - RNA, 22 nt, Human
caacaagcgcucagagcaaagc

SEQ ID NO: 144981 - RNA, 22 nt, Human
guuaaaaugauuugugauuuau

SEQ ID NO: 144982 - RNA, 22 nt, Human
ugaguuuuggaagauguuacag

SEQ ID NO: 144983 - RNA, 22 nt, Human
auuaaaaaugagaguagggauu

SEQ ID NO: 144984 - RNA, 22 nt, Human
gcuggaaauaacuuguguagaa

SEQ ID NO: 144985 - RNA, 22 nt, Human
cagcucuggcuauugaggacca

SEQ ID NO: 144986 - RNA, 22 nt, Human
agagauacugcaggccauaaau

SEQ ID NO: 144987 - RNA, 22 nt, Human
ugugucucucuuagguugucug

SEQ ID NO: 144988 - RNA, 22 nt, Human
gauuuucauuauagcuaguuuc

SEQ ID NO: 144989 - RNA, 23 nt, Human
aggcagcaugcaacaggccauuu

SEQ ID NO: 144990 - RNA, 22 nt, Human
aagugauuuucccaccaucuac

SEQ ID NO: 144991 - RNA, 22 nt, Human
agagggagagaccuccgugccu

SEQ ID NO: 144992 - RNA, 22 nt, Human
ggcagagcugugcgcccaccca

SEQ ID NO: 144993 - RNA, 22 nt, Human
ugcuagggcaggaggugaggag

SEQ ID NO: 144994 - RNA, 22 nt, Human
uggggcugguaccguaauauau

SEQ ID NO: 144995 - RNA, 22 nt, Human
uuuuauaauacccuugacuaau

SEQ ID NO: 144996 - RNA, 22 nt, Human
auguaugagagauucuuuuauu

SEQ ID NO: 144997 - RNA, 22 nt, Human
caaaaaauccauagaaagaggu

SEQ ID NO: 144998 - RNA, 22 nt, Human
cagcuggggagagacauggcag

SEQ ID NO: 144999 - RNA, 20 nt, Human
gggcucugcauccaucagcc

SEQ ID NO: 145000 - RNA, 22 nt, Human
gccucucuggcaaagcggugau

SEQ ID NO: 145001 - RNA, 22 nt, Human
gggcugagagcuggaaucugag

SEQ ID NO: 145002 - RNA, 22 nt, Human
uacaacuuacuugaauggcuuu

SEQ ID NO: 145003 - RNA, 22 nt, Human
gaggcaggcggggcccaggugg

SEQ ID NO: 145004 - RNA, 22 nt, Human
uuauuuaaguauuuauugaagu

SEQ ID NO: 145005 - RNA, 22 nt, Human
ucaggagaguguucaguggagg

SEQ ID NO: 145006 - RNA, 22 nt, Human
uguuuuuuagagugauacuuuu

SEQ ID NO: 145007 - RNA, 22 nt, Human
aaacgcaauuucuugcauguca

SEQ ID NO: 145008 - RNA, 22 nt, Human
caagcacaauuucuacauguua

SEQ ID NO: 145009 - RNA, 22 nt, Human
ccugcccaucccaccccagcau

SEQ ID NO: 145010 - RNA, 22 nt, Human
ucaccauguuuucauaggaaca

SEQ ID NO: 145011 - RNA, 22 nt, Human
gcaggggguaaggggcagggcu

SEQ ID NO: 145012 - RNA, 22 nt, Human
aaucaaauuucuugugguuguu

SEQ ID NO: 145013 - RNA, 22 nt, Human
ugauguuucugaagggguuacu

SEQ ID NO: 145014 - RNA, 22 nt, Human
ucuccucucugaucuugcuccg

SEQ ID NO: 145015 - RNA, 22 nt, Human
agugugaguuacaaagugugaa

SEQ ID NO: 145016 - RNA, 22 nt, Human
caaaacauucagagagcucacu

SEQ ID NO: 145017 - RNA, 22 nt, Human
gugucccaaagauuagaaauca

SEQ ID NO: 145018 - RNA, 22 nt, Human
uguuuagcucugacuaugugau

SEQ ID NO: 145019 - RNA, 22 nt, Human
uggagccuugugagaccacaau

SEQ ID NO: 145020 - RNA, 22 nt, Human
acaaucuuauuaguaguauaga

SEQ ID NO: 145021 - RNA, 22 nt, Human
ugcauucugaacguaaauguga

SEQ ID NO: 145022 - RNA, 22 nt, Human
caaauacaaauacgggcagcuu

SEQ ID NO: 145023 - RNA, 22 nt, Human
ccagggcuggaggaggucagga

SEQ ID NO: 145024 - RNA, 22 nt, Human
uuugauuaccuggggcccucug

SEQ ID NO: 145025 - RNA, 22 nt, Human
cagcuccaucuugcuuauacca

SEQ ID NO: 145026 - RNA, 22 nt, Human
cagcuuguucugaccugugauu

SEQ ID NO: 145027 - RNA, 22 nt, Human
uuuguuugcuaguauuuuguuu

SEQ ID NO: 145028 - RNA, 22 nt, Human
aaaauacuaggaaaauaaauca

SEQ ID NO: 145029 - RNA, 22 nt, Human
uaucauuuuacugugacauuuu

SEQ ID NO: 145030 - RNA, 22 nt, Human
cucuguguguuugugugugugu

SEQ ID NO: 145031 - RNA, 22 nt, Human
cguggaggucgcauauuccucu

SEQ ID NO: 145032 - RNA, 18 nt, Human
cccagaggaaugccugga

SEQ ID NO: 145033 - RNA, 22 nt, Human
acauccagcagauuguccagag

SEQ ID NO: 145034 - RNA, 22 nt, Human
ggaggccagagaagagccaggc

SEQ ID NO: 145035 - RNA, 19 nt, Human
auacacguguauacauaca

SEQ ID NO: 145036 - RNA, 22 nt, Human
uauuaauugugguuauuguauu

SEQ ID NO: 145037 - RNA, 22 nt, Human
ucuuuaaggggccuuuguguca

SEQ ID NO: 145038 - RNA, 22 nt, Human
cuuuaaaaauguauuuuugugg

SEQ ID NO: 145039 - RNA, 22 nt, Human
ggagggagugcaggcaggcaga

SEQ ID NO: 145040 - RNA, 22 nt, Human
auuuuuauuugccuaugauaua

SEQ ID NO: 145041 - RNA, 22 nt, Human
auugacagaaaauuggauggca

SEQ ID NO: 145042 - RNA, 22 nt, Human
aguggcuguuccaggugaggac

SEQ ID NO: 145043 - RNA, 22 nt, Human
gccaggagaaaaggcgaaugau

SEQ ID NO: 145044 - RNA, 22 nt, Human
agcgcucauuuuccuccugcuc

SEQ ID NO: 145045 - RNA, 22 nt, Human
uuaggcuuuauugaaaacaaua

SEQ ID NO: 145046 - RNA, 22 nt, Human
cugggaguugacgaggcuugua

SEQ ID NO: 145047 - RNA, 22 nt, Human
aaauauuugaaugguguaagau

SEQ ID NO: 145048 - RNA, 22 nt, Human
ggccugcuaccagcugugaccu

SEQ ID NO: 145049 - RNA, 22 nt, Human
cauauacauauacaugcauaca

SEQ ID NO: 145050 - RNA, 22 nt, Human
aaaugcuuuaauugaguucaug

SEQ ID NO: 145051 - RNA, 22 nt, Human
gacuggcucuaucaggauaaau

SEQ ID NO: 145052 - RNA, 22 nt, Human
ugcaggaacucgaaaacuauag

SEQ ID NO: 145053 - RNA, 22 nt, Human
uuguuuaaagaacuucugacuu

SEQ ID NO: 145054 - RNA, 22 nt, Human
ccagggagggccacagggccau

SEQ ID NO: 145055 - RNA, 22 nt, Human
agaguucuauccagacucaugu

SEQ ID NO: 145056 - RNA, 22 nt, Human
uuuguauuguuuauuucauuuu

SEQ ID NO: 145057 - RNA, 22 nt, Human
caacauuucaaggucuuuagga

SEQ ID NO: 145058 - RNA, 20 nt, Human
uuggagaucacguguccagg

SEQ ID NO: 145059 - RNA, 22 nt, Human
uaauagauagggagaguugcug

SEQ ID NO: 145060 - RNA, 22 nt, Human
uuuuucugacugcuaacaaaaa

SEQ ID NO: 145061 - RNA, 22 nt, Human
guugggugccagaggcuucacg

SEQ ID NO: 145062 - RNA, 22 nt, Human
guauuauauaaccauugguucu

SEQ ID NO: 145063 - RNA, 22 nt, Human
ggcagggacugggauauggaga

SEQ ID NO: 145064 - RNA, 17 nt, Human
agggaaguagggugggc

SEQ ID NO: 145065 - RNA, 22 nt, Human
guugggcugaagugugugcuua

SEQ ID NO: 145066 - RNA, 22 nt, Human
gaaaagaaaggaugguaugugu

SEQ ID NO: 145067 - RNA, 22 nt, Human
auagagcuggggaagaagcugg

SEQ ID NO: 145068 - RNA, 22 nt, Human
guauaaauaucuauauuguuac

SEQ ID NO: 145069 - RNA, 22 nt, Human
uucauuuccauuuuauagauaa

SEQ ID NO: 145070 - RNA, 22 nt, Human
cuaauaauuuacugagugcuac

SEQ ID NO: 145071 - RNA, 22 nt, Human
ggagcucacuacgaaauaagcu

SEQ ID NO: 145072 - RNA, 23 nt, Human
gcccagaggccccuggccugagc

SEQ ID NO: 145073 - RNA, 22 nt, Human
ccauuuggccauucaguuguuc

SEQ ID NO: 145074 - RNA, 22 nt, Human
gugugucucaguugcuccgaag

SEQ ID NO: 145075 - RNA, 21 nt, Human
aggugaaggcgagggggacag

SEQ ID NO: 145076 - RNA, 22 nt, Human
gagcaggucucaguucugccuc

SEQ ID NO: 145077 - RNA, 22 nt, Human
uccaugcaguagaggcgcuggg

SEQ ID NO: 145078 - RNA, 22 nt, Human
ggcuucuuaacauuuggacacc

SEQ ID NO: 145079 - RNA, 19 nt, Human
gagcaugacuggccuugca

SEQ ID NO: 145080 - RNA, 22 nt, Human
uauuuuagccaacagaaugaug

SEQ ID NO: 145081 - RNA, 22 nt, Human
cuggguuuggcugugcuugaau

SEQ ID NO: 145082 - RNA, 22 nt, Human
agauuuucuuuuccaucuuugu

SEQ ID NO: 145083 - RNA, 22 nt, Human
ugaggaagugguuguaugguuu

SEQ ID NO: 145084 - RNA, 22 nt, Human
aauggcaaaaguuucggaaauu

SEQ ID NO: 145085 - RNA, 22 nt, Human
gaggaggagacggaggccuggg

SEQ ID NO: 145086 - RNA, 22 nt, Human
uacagucauaagguuucucucc

SEQ ID NO: 145087 - RNA, 22 nt, Human
gggagcuggagcuggaagacuc

SEQ ID NO: 145088 - RNA, 22 nt, Human
ucuccuaauuacauacuugauu

SEQ ID NO: 145089 - RNA, 22 nt, Human
ccaccccagaaagggaaggcca

SEQ ID NO: 145090 - RNA, 22 nt, Human
ggcuggagcaggcugcacagug

SEQ ID NO: 145091 - RNA, 22 nt, Human
ugcagacuguuucuugacugaa

SEQ ID NO: 145092 - RNA, 22 nt, Human
uuuaaaacagcauuuaaaaggu

SEQ ID NO: 145093 - RNA, 22 nt, Human
aauagaguccuguacugaauga

SEQ ID NO: 145094 - RNA, 22 nt, Human
uagugcuucauucuauugguuu

SEQ ID NO: 145095 - RNA, 22 nt, Human
uucugaguguugucaccaugug

SEQ ID NO: 145096 - RNA, 22 nt, Human
uucuggccagggaagagggguc

SEQ ID NO: 145097 - RNA, 22 nt, Human
cagagagcguccauccggugcc

SEQ ID NO: 145098 - RNA, 19 nt, Human
cugggacaaugaaagcauc

SEQ ID NO: 145099 - RNA, 16 nt, Human
acauggcacacaguuu

SEQ ID NO: 145100 - RNA, 22 nt, Human
aggauggaaguaacuggauaau

SEQ ID NO: 145101 - RNA, 22 nt, Human
gaaauagagacaguaagugucu

SEQ ID NO: 145102 - RNA, 22 nt, Human
gauauauuucaaauucuuuugc

SEQ ID NO: 145103 - RNA, 20 nt, Human
agucacagacccucagguag

SEQ ID NO: 145104 - RNA, 22 nt, Human
auggagggcagccccacuaaag

SEQ ID NO: 145105 - RNA, 22 nt, Human
ugaagcuaguauuaacucagau

SEQ ID NO: 145106 - RNA, 22 nt, Human
ugcucacugcuuguguucaguu

SEQ ID NO: 145107 - RNA, 22 nt, Human
uccaggaggacugagggggcug

SEQ ID NO: 145108 - RNA, 22 nt, Human
ucacaggagucaaggaauagua

SEQ ID NO: 145109 - RNA, 22 nt, Human
ucaaauaugggccagaggaaau

SEQ ID NO: 145110 - RNA, 20 nt, Human
uucacagaggacucagguca

SEQ ID NO: 145111 - RNA, 22 nt, Human
gcauaauauugagaaauuauua

SEQ ID NO: 145112 - RNA, 22 nt, Human
ugcuuuuguaucagaguauuca

SEQ ID NO: 145113 - RNA, 22 nt, Human
uggcagccugcgugaaggagcu

SEQ ID NO: 145114 - RNA, 22 nt, Human
guaugucuuaggguucaguaac

SEQ ID NO: 145115 - RNA, 22 nt, Human
aauaauuuuuuugugauuaugu

SEQ ID NO: 145116 - RNA, 22 nt, Human
gggccaaggggagcuggaaggg

SEQ ID NO: 145117 - RNA, 22 nt, Human
ggaggucagcuggaggggaggc

SEQ ID NO: 145118 - RNA, 22 nt, Human
guuuuuaguuuaaguuuuugca

SEQ ID NO: 145119 - RNA, 22 nt, Human
ucagucugcuauagguauuugu

SEQ ID NO: 145120 - RNA, 22 nt, Human
cccuguccuucccuccaucuga

SEQ ID NO: 145121 - RNA, 22 nt, Human
gaggaaaauggaguguaauuaa

SEQ ID NO: 145122 - RNA, 22 nt, Human
uaaaugcucuuuaaaagugcuu

SEQ ID NO: 145123 - RNA, 22 nt, Human
acuuuuccuggguagcuccugg

SEQ ID NO: 145124 - RNA, 22 nt, Human
uggcagcucauuuggaaaugga

SEQ ID NO: 145125 - RNA, 22 nt, Human
auacauauaugcacauuaauau

SEQ ID NO: 145126 - RNA, 22 nt, Human
uagaccugugggggcagcgggc

SEQ ID NO: 145127 - RNA, 22 nt, Human
gcacauaugcuguaagcacaug

SEQ ID NO: 145128 - RNA, 22 nt, Human
ugagggaugccucuccuuccgg

SEQ ID NO: 145129 - RNA, 22 nt, Human
ccuuugcccugagaaauguucc

SEQ ID NO: 145130 - RNA, 22 nt, Human
ucaccuuuugaauugcuguugu

SEQ ID NO: 145131 - RNA, 22 nt, Human
uuuuaauccucuugguaucuua

SEQ ID NO: 145132 - RNA, 22 nt, Human
agagggcaggcugguugggguc

SEQ ID NO: 145133 - RNA, 22 nt, Human
uuuaauauuacacuuaccuugu

SEQ ID NO: 145134 - RNA, 22 nt, Human
uguaaauucuauacacuuaaaa

SEQ ID NO: 145135 - RNA, 22 nt, Human
uuccuguggggugucaucauag

SEQ ID NO: 145136 - RNA, 22 nt, Human
gcaggaaugguacauaccuguu

SEQ ID NO: 145137 - RNA, 22 nt, Human
gguggggacuuggggucagcgg

SEQ ID NO: 145138 - RNA, 22 nt, Human
aaugcuuuuugcgaaaugugca

SEQ ID NO: 145139 - RNA, 23 nt, Human
ccagcugugccuggcccaggagc

SEQ ID NO: 145140 - RNA, 22 nt, Human
auaccaaugaaucccugagaau

SEQ ID NO: 145141 - RNA, 22 nt, Human
uuuaaaauguuuuauuuauuua

SEQ ID NO: 145142 - RNA, 22 nt, Human
ugcuuucagauaucuguuucaa

SEQ ID NO: 145143 - RNA, 22 nt, Human
ucaguauuagugcauuaucagg

SEQ ID NO: 145144 - RNA, 22 nt, Human
guugguggaggcgagagaagaa

SEQ ID NO: 145145 - RNA, 22 nt, Human
acuuuauacuagugauaguuug

SEQ ID NO: 145146 - RNA, 22 nt, Human
aucacacaccuguuaaauugug

SEQ ID NO: 145147 - RNA, 22 nt, Human
agccccaauuacagcugugcug

SEQ ID NO: 145148 - RNA, 22 nt, Human
aaggugggacugagaggggaca

SEQ ID NO: 145149 - RNA, 22 nt, Human
uggcaaggccacaggugcaguu

SEQ ID NO: 145150 - RNA, 22 nt, Human
auucuuuucucuaaaugaugaa

SEQ ID NO: 145151 - RNA, 22 nt, Human
gaaucucuuugucccugaguuu

SEQ ID NO: 145152 - RNA, 22 nt, Human
aauaaugguuugauucucacau

SEQ ID NO: 145153 - RNA, 22 nt, Human
gccugcugggcucuuccugcug

SEQ ID NO: 145154 - RNA, 22 nt, Human
ugaagacaguuuuacucaugag

SEQ ID NO: 145155 - RNA, 22 nt, Human
cucucugcugucuuucgggaaa

SEQ ID NO: 145156 - RNA, 22 nt, Human
aggaagaagggacagaauuuug

SEQ ID NO: 145157 - RNA, 22 nt, Human
cagguggauggcgagcccugca

SEQ ID NO: 145158 - RNA, 20 nt, Human
gagaaugucauuccuuuuuu

SEQ ID NO: 145159 - RNA, 22 nt, Human
gaauacaaauaauaccaaggug

SEQ ID NO: 145160 - RNA, 22 nt, Human
uuuaaaccuaucuaagaaauag

SEQ ID NO: 145161 - RNA, 18 nt, Human
ggccucagccuggccgga

SEQ ID NO: 145162 - RNA, 22 nt, Human
uggcacagcuugucauaaacuc

SEQ ID NO: 145163 - RNA, 22 nt, Human
cugcaucacagcaggaggcaca

SEQ ID NO: 145164 - RNA, 22 nt, Human
cauaggcucuucagagaacuga

SEQ ID NO: 145165 - RNA, 23 nt, Human
uccuccccaccuuuguccccucc

SEQ ID NO: 145166 - RNA, 22 nt, Human
uuguuauuauuauuuucguucu

SEQ ID NO: 145167 - RNA, 19 nt, Human
auuuccuggcauauaucac

SEQ ID NO: 145168 - RNA, 22 nt, Human
agugucugcgggcagaggagcg

SEQ ID NO: 145169 - RNA, 21 nt, Human
aaguuuuggcuguacaguugu

SEQ ID NO: 145170 - RNA, 22 nt, Human
ggcugguggcgggcagcacaga

SEQ ID NO: 145171 - RNA, 22 nt, Human
uucacaauuuuaaaaaguggaa

SEQ ID NO: 145172 - RNA, 22 nt, Human
gaaggcagucuggggagcagcc

SEQ ID NO: 145173 - RNA, 22 nt, Human
uaacauuagcuuugcucaugca

SEQ ID NO: 145174 - RNA, 22 nt, Human
uggcgcgcagccugcuggugcu

SEQ ID NO: 145175 - RNA, 22 nt, Human
cgaaggaaucacuuaacacuuu

SEQ ID NO: 145176 - RNA, 22 nt, Human
agacuucucuuggcuauauuau

SEQ ID NO: 145177 - RNA, 21 nt, Human
gcagcucaggauauagacuug

SEQ ID NO: 145178 - RNA, 22 nt, Human
uaacaguauacuacaucauauu

SEQ ID NO: 145179 - RNA, 22 nt, Human
gucccucauaacuggcaggugu

SEQ ID NO: 145180 - RNA, 22 nt, Human
aguuuccacuggagacacugug

SEQ ID NO: 145181 - RNA, 22 nt, Human
ggcugggaggcggaggcugaga

SEQ ID NO: 145182 - RNA, 22 nt, Human
acucugcaguaaggaauuguuu

SEQ ID NO: 145183 - RNA, 22 nt, Human
aucauguauauuuuugcuauua

SEQ ID NO: 145184 - RNA, 22 nt, Human
aagagugaguagcuugguuggu

SEQ ID NO: 145185 - RNA, 22 nt, Human
augaggaacagcaagaauauuu

SEQ ID NO: 145186 - RNA, 22 nt, Human
uuaacauuguccuuagcagauu

SEQ ID NO: 145187 - RNA, 22 nt, Human
auggaagagacaaugcuaucug

SEQ ID NO: 145188 - RNA, 22 nt, Human
aacgagcugggggggccggggg

SEQ ID NO: 145189 - RNA, 22 nt, Human
acagagggagugacggccaacc

SEQ ID NO: 145190 - RNA, 22 nt, Human
gugggugaguggggccgccuga

SEQ ID NO: 145191 - RNA, 21 nt, Human
ucagccuguccaguguuaacc

SEQ ID NO: 145192 - RNA, 22 nt, Human
uccacagcagagcacgguaccu

SEQ ID NO: 145193 - RNA, 22 nt, Human
gggaggcagacgcuggagccca

SEQ ID NO: 145194 - RNA, 22 nt, Human
uguaucuguguguauguguuua

SEQ ID NO: 145195 - RNA, 22 nt, Human
ggugucuuugauguugggcuga

SEQ ID NO: 145196 - RNA, 22 nt, Human
agggggaauccugcuuauggau

SEQ ID NO: 145197 - RNA, 22 nt, Human
cauuuaucacuugcuaaacaua

SEQ ID NO: 145198 - RNA, 22 nt, Human
aagagaaacauauggccagauu

SEQ ID NO: 145199 - RNA, 22 nt, Human
cagaucacauccauccgucacc

SEQ ID NO: 145200 - RNA, 22 nt, Human
augauuaagguacgucauuucu

SEQ ID NO: 145201 - RNA, 22 nt, Human
aggcaggggagcuggaagggua

SEQ ID NO: 145202 - RNA, 22 nt, Human
ggaaggugagugcugugugauu

SEQ ID NO: 145203 - RNA, 22 nt, Human
ucaguuacucugauguccugug

SEQ ID NO: 145204 - RNA, 22 nt, Human
auguacugacuguacuuuuaaa

SEQ ID NO: 145205 - RNA, 22 nt, Human
aauuauuauguggaagacgacg

SEQ ID NO: 145206 - RNA, 22 nt, Human
cuccugcuuuuucuucuuccga

SEQ ID NO: 145207 - RNA, 22 nt, Human
auuuucauauggguuauuugua

SEQ ID NO: 145208 - RNA, 22 nt, Human
uuuguuaugguuggaagcagga

SEQ ID NO: 145209 - RNA, 22 nt, Human
cagaguaaugugauuuccaugu

SEQ ID NO: 145210 - RNA, 22 nt, Human
gugauggucgagcgcuuguugu

SEQ ID NO: 145211 - RNA, 20 nt, Human
ggagagggaaaggcuguacu

SEQ ID NO: 145212 - RNA, 20 nt, Human
agaaggagagaugaggcaaa

SEQ ID NO: 145213 - RNA, 22 nt, Human
guuuugaugugauuucucaugu

SEQ ID NO: 145214 - RNA, 22 nt, Human
caauaccucuuggugauugggc

SEQ ID NO: 145215 - RNA, 20 nt, Human
cauuccaugcaucuuggucc

SEQ ID NO: 145216 - RNA, 20 nt, Human
uucacagaucucuaacugag

SEQ ID NO: 145217 - RNA, 22 nt, Human
uauuuugaggugaaagaguuug

SEQ ID NO: 145218 - RNA, 22 nt, Human
uuccucauuuggcacaucugag

SEQ ID NO: 145219 - RNA, 22 nt, Human
uggucucuacggaggaaagcug

SEQ ID NO: 145220 - RNA, 22 nt, Human
gcuuucagggucacugucaaca

SEQ ID NO: 145221 - RNA, 22 nt, Human
uguacauuuacaaaagcuuuau

SEQ ID NO: 145222 - RNA, 22 nt, Human
uauauauaauguguacagguga

SEQ ID NO: 145223 - RNA, 22 nt, Human
cagcaugguggagcugcucuuu

SEQ ID NO: 145224 - RNA, 22 nt, Human
aggcaguguggagggcuguugc

SEQ ID NO: 145225 - RNA, 22 nt, Human
cugagguccucagagggaaagg

SEQ ID NO: 145226 - RNA, 22 nt, Human
aggguggaggacaggccaguga

SEQ ID NO: 145227 - RNA, 21 nt, Human
auuggcagaucucuggauugu

SEQ ID NO: 145228 - RNA, 22 nt, Human
uuggugauguagcagcaauugu

SEQ ID NO: 145229 - RNA, 22 nt, Human
cagacagaaggcuccuugaggu

SEQ ID NO: 145230 - RNA, 22 nt, Human
auuagugguguauuuggcacua

SEQ ID NO: 145231 - RNA, 22 nt, Human
agaucugucaccauccuggagc

SEQ ID NO: 145232 - RNA, 22 nt, Human
cauuugcuuaucacucuucuuu

SEQ ID NO: 145233 - RNA, 22 nt, Human
ccuaggcuggcugucuucaggu

SEQ ID NO: 145234 - RNA, 22 nt, Human
guggguauauauaugugugcug

SEQ ID NO: 145235 - RNA, 22 nt, Human
uucacccuucucuggcuuucag

SEQ ID NO: 145236 - RNA, 20 nt, Human
ucuugucuggcagccuggag

SEQ ID NO: 145237 - RNA, 22 nt, Human
uaauaauuaacagugauggguc

SEQ ID NO: 145238 - RNA, 22 nt, Human
ggcugcagggaacaggaugggu

SEQ ID NO: 145239 - RNA, 22 nt, Human
uaaaugaaaggguuuaauuuau

SEQ ID NO: 145240 - RNA, 22 nt, Human
gcucagccuuuuguucuauuca

SEQ ID NO: 145241 - RNA, 22 nt, Human
ugucuuucuuucucuugacaga

SEQ ID NO: 145242 - RNA, 22 nt, Human
ggaggcccagaaggaagcccag

SEQ ID NO: 145243 - RNA, 22 nt, Human
uuccacaugaucauuguaauaa

SEQ ID NO: 145244 - RNA, 22 nt, Human
gaauucuaguucuguaucucug

SEQ ID NO: 145245 - RNA, 22 nt, Human
uugucaggaacuaugauuaugc

SEQ ID NO: 145246 - RNA, 22 nt, Human
ccagaggcuuaugcagcugcug

SEQ ID NO: 145247 - RNA, 22 nt, Human
uuuaugauguagccuagagcug

SEQ ID NO: 145248 - RNA, 22 nt, Human
ggaggccgugcugugcugccag

SEQ ID NO: 145249 - RNA, 22 nt, Human
ccaaggcuguggggcugugcag

SEQ ID NO: 145250 - RNA, 22 nt, Human
cugaaagacagccaggcaaagc

SEQ ID NO: 145251 - RNA, 22 nt, Human
cagcuguggagauggggugcau

SEQ ID NO: 145252 - RNA, 22 nt, Human
uugauagauuuuagaggcaggc

SEQ ID NO: 145253 - RNA, 20 nt, Human
cagagacaagagggaaggga

SEQ ID NO: 145254 - RNA, 22 nt, Human
gugguuuagccuucauuaaccu

SEQ ID NO: 145255 - RNA, 20 nt, Human
ugccagagagcucauacccu

SEQ ID NO: 145256 - RNA, 22 nt, Human
gcagguggaagcagcagacuca

SEQ ID NO: 145257 - RNA, 21 nt, Human
uccccugugccuggcauacag

SEQ ID NO: 145258 - RNA, 22 nt, Human
aacacuguaucagucuucaaua

SEQ ID NO: 145259 - RNA, 22 nt, Human
caaauguuugguggcauuuugu

SEQ ID NO: 145260 - RNA, 22 nt, Human
uuauuuuuguaacacuguauag

SEQ ID NO: 145261 - RNA, 22 nt, Human
aggugcuugcauacugcuugac

SEQ ID NO: 145262 - RNA, 22 nt, Human
uaaaugauaguauugaagguag

SEQ ID NO: 145263 - RNA, 22 nt, Human
uuuuccuucugauacuccauuu

SEQ ID NO: 145264 - RNA, 22 nt, Human
cugugucucccaaggaggguca

SEQ ID NO: 145265 - RNA, 22 nt, Human
cuccuugguuccggcguuggag

SEQ ID NO: 145266 - RNA, 22 nt, Human
ugggggagggagaguugauggg

SEQ ID NO: 145267 - RNA, 22 nt, Human
ucuuucugaugggaagggucaa

SEQ ID NO: 145268 - RNA, 22 nt, Human
ccacccugguuacugugccagg

SEQ ID NO: 145269 - RNA, 22 nt, Human
aaaguuacccaaucucuaugaa

SEQ ID NO: 145270 - RNA, 22 nt, Human
ggaggggaguuugccucugggg

SEQ ID NO: 145271 - RNA, 22 nt, Human
auagauuuuaucagauuuuauc

SEQ ID NO: 145272 - RNA, 22 nt, Human
ugagagggagacagcucuagca

SEQ ID NO: 145273 - RNA, 22 nt, Human
aaaauaaccuucauuugcauug

SEQ ID NO: 145274 - RNA, 22 nt, Human
aagaacaacugcuuuaaaagca

SEQ ID NO: 145275 - RNA, 22 nt, Human
cgugccugguggagagcgaggg

SEQ ID NO: 145276 - RNA, 22 nt, Human
guucaaucucucaugcauuuuc

SEQ ID NO: 145277 - RNA, 22 nt, Human
guuuauuucuuaucaucacuau

SEQ ID NO: 145278 - RNA, 22 nt, Human
uacugcaguuccugcugucucc

SEQ ID NO: 145279 - RNA, 22 nt, Human
uaguauuuguaauuaucaaagc

SEQ ID NO: 145280 - RNA, 22 nt, Human
ggagugaguauguucugaugca

SEQ ID NO: 145281 - RNA, 22 nt, Human
cccaggaaugagcaggcagggg

SEQ ID NO: 145282 - RNA, 17 nt, Human
ucauuucaguaaaucca

SEQ ID NO: 145283 - RNA, 22 nt, Human
uuggaagagagauggggagaga

SEQ ID NO: 145284 - RNA, 22 nt, Human
uuauuucaggcauuuguaaaug

SEQ ID NO: 145285 - RNA, 21 nt, Human
ugcuuucugugcuuuuucugc

SEQ ID NO: 145286 - RNA, 22 nt, Human
guauugauuguuuuaaaagauu

SEQ ID NO: 145287 - RNA, 22 nt, Human
uccugagaagcacuuaauacac

SEQ ID NO: 145288 - RNA, 23 nt, Human
gcuuugaaaaugcuuucuuccag

SEQ ID NO: 145289 - RNA, 22 nt, Human
ugggggaggaggagacagacug

SEQ ID NO: 145290 - RNA, 22 nt, Human
agauggggccugaggacacugu

SEQ ID NO: 145291 - RNA, 22 nt, Human
auacuaagcucauuacauuuug

SEQ ID NO: 145292 - RNA, 22 nt, Human
cccagaggcugaguugggagca

SEQ ID NO: 145293 - RNA, 22 nt, Human
uucugaaccauugagcacugcc

SEQ ID NO: 145294 - RNA, 22 nt, Human
ugaugaugaagaaauauuauca

SEQ ID NO: 145295 - RNA, 21 nt, Human
agucaagcugccugcuuggca

SEQ ID NO: 145296 - RNA, 20 nt, Human
auaaauaggauuuucugaca

SEQ ID NO: 145297 - RNA, 22 nt, Human
gaaacauuuguugaguacuugc

SEQ ID NO: 145298 - RNA, 22 nt, Human
aacacuaaaggucaguuagaag

SEQ ID NO: 145299 - RNA, 22 nt, Human
acaacuuuaauggguuucagcu

SEQ ID NO: 145300 - RNA, 22 nt, Human
uggaagcccagaaggaagcaga

SEQ ID NO: 145301 - RNA, 22 nt, Human
uuauuaauacaugcaccugcau

SEQ ID NO: 145302 - RNA, 22 nt, Human
ugcuucuuuaggauguaguuau

SEQ ID NO: 145303 - RNA, 22 nt, Human
agggcugggcuuggcaggcugg

SEQ ID NO: 145304 - RNA, 22 nt, Human
aucuucaaggacgccaagaucc

SEQ ID NO: 145305 - RNA, 22 nt, Human
aaaauaauauuauaccacugcu

SEQ ID NO: 145306 - RNA, 23 nt, Human
uccugcagauaagcugguugaca

SEQ ID NO: 145307 - RNA, 22 nt, Human
auucuacucuuuaaauaugaaa

SEQ ID NO: 145308 - RNA, 22 nt, Human
uuguuguuguuguuauuuaguu

SEQ ID NO: 145309 - RNA, 22 nt, Human
augggagggugaggaggcagcu

SEQ ID NO: 145310 - RNA, 22 nt, Human
guacauauggcacaugcuauuu

SEQ ID NO: 145311 - RNA, 22 nt, Human
aucucacuucugucauguggca

SEQ ID NO: 145312 - RNA, 22 nt, Human
ccucccaccguaucucaguggc

SEQ ID NO: 145313 - RNA, 19 nt, Human
ugccuggcaccagcuccac

SEQ ID NO: 145314 - RNA, 22 nt, Human
auauuuuugcagaauuuuucgu

SEQ ID NO: 145315 - RNA, 22 nt, Human
gagaggaagugccugcucccag

SEQ ID NO: 145316 - RNA, 22 nt, Human
ucgagaccagcuagaaggaagu

SEQ ID NO: 145317 - RNA, 22 nt, Human
caguacugucuuccugauggca

SEQ ID NO: 145318 - RNA, 22 nt, Human
aagaaauacagaaauggcagua

SEQ ID NO: 145319 - RNA, 22 nt, Human
aaagaugaaguucagcgaagaa

SEQ ID NO: 145320 - RNA, 22 nt, Human
gguuuucacgauccucccuuuu

SEQ ID NO: 145321 - RNA, 22 nt, Human
aaugauuuucugcaaacaguga

SEQ ID NO: 145322 - RNA, 21 nt, Human
ucauccagguccugcuucuuc

SEQ ID NO: 145323 - RNA, 20 nt, Human
acccagaguccuccccgcgc

SEQ ID NO: 145324 - RNA, 17 nt, Human
guucucaaacugacuga

SEQ ID NO: 145325 - RNA, 22 nt, Human
cuagcacagugcuuggcacaca

SEQ ID NO: 145326 - RNA, 22 nt, Human
aauaaagcuugaaagcagggaa

SEQ ID NO: 145327 - RNA, 22 nt, Human
uucuauaagagaugaauacagu

SEQ ID NO: 145328 - RNA, 22 nt, Human
gugcugggaggcccaggaugga

SEQ ID NO: 145329 - RNA, 22 nt, Human
aggggaggcugcgggcugccgu

SEQ ID NO: 145330 - RNA, 22 nt, Human
caaaucuguuaauuucaaguug

SEQ ID NO: 145331 - RNA, 21 nt, Human
ugaagcccugugaggugcuua

SEQ ID NO: 145332 - RNA, 22 nt, Human
uucuccaccugcuccucccacc

SEQ ID NO: 145333 - RNA, 22 nt, Human
uuuuagaagcauuuaugagauu

SEQ ID NO: 145334 - RNA, 22 nt, Human
uccugggcuugcucuuuccauu

SEQ ID NO: 145335 - RNA, 22 nt, Human
gcuguguaugaugcaggcaccu

SEQ ID NO: 145336 - RNA, 22 nt, Human
uugaaaaaauguguuuaaggag

SEQ ID NO: 145337 - RNA, 22 nt, Human
ugguccaccgccucauucucug

SEQ ID NO: 145338 - RNA, 22 nt, Human
gauguuaauauguuucaccaaa

SEQ ID NO: 145339 - RNA, 22 nt, Human
aauaucuugaguuauaaauuca

SEQ ID NO: 145340 - RNA, 22 nt, Human
agcccagguggagugugugggg

SEQ ID NO: 145341 - RNA, 22 nt, Human
guuauuuugucuuguucaugaa

SEQ ID NO: 145342 - RNA, 22 nt, Human
aaaaggucacuguaaaaugacg

SEQ ID NO: 145343 - RNA, 22 nt, Human
ggagccucuaaacaguuaucaa

SEQ ID NO: 145344 - RNA, 22 nt, Human
cuggaagcgucggaggaagggc

SEQ ID NO: 145345 - RNA, 22 nt, Human
uuuuuaauuuuaagcuauuugu

SEQ ID NO: 145346 - RNA, 22 nt, Human
aaaagguuauagcuuugccuug

SEQ ID NO: 145347 - RNA, 22 nt, Human
uauguauguauguauguauaug

SEQ ID NO: 145348 - RNA, 22 nt, Human
acauuccugaagguaaugagaa

SEQ ID NO: 145349 - RNA, 22 nt, Human
uuuacaaggcaguuauuuuccu

SEQ ID NO: 145350 - RNA, 22 nt, Human
gucccagaggacagggucacau

SEQ ID NO: 145351 - RNA, 22 nt, Human
ucccagaaccuuuuagcuucac

SEQ ID NO: 145352 - RNA, 22 nt, Human
uucauagaagggaguuuuuccu

SEQ ID NO: 145353 - RNA, 22 nt, Human
auucauuuuuacaucaccaaua

SEQ ID NO: 145354 - RNA, 22 nt, Human
uugccaggggacaucuggagcc

SEQ ID NO: 145355 - RNA, 21 nt, Human
uuuuucuccagaguuuccacu

SEQ ID NO: 145356 - RNA, 22 nt, Human
aaggagaggagucauugggaua

SEQ ID NO: 145357 - RNA, 22 nt, Human
ugcccacuucaaaaucuucauu

SEQ ID NO: 145358 - RNA, 22 nt, Human
guggaggguuugcaaugugcag

SEQ ID NO: 145359 - RNA, 22 nt, Human
gcccagccucagggcaucagcu

SEQ ID NO: 145360 - RNA, 22 nt, Human
gaggcucagagggacuuucaag

SEQ ID NO: 145361 - RNA, 22 nt, Human
ugaggaggugcuaccagcgucu

SEQ ID NO: 145362 - RNA, 22 nt, Human
uggggcuggccaggaggagucu

SEQ ID NO: 145363 - RNA, 22 nt, Human
ugagauguaauguaguacuuug

SEQ ID NO: 145364 - RNA, 22 nt, Human
auucauauagcgcuuacagccu

SEQ ID NO: 145365 - RNA, 22 nt, Human
aaagccaagguccauguacuuu

SEQ ID NO: 145366 - RNA, 22 nt, Human
cagcuccagcccaggcagcucc

SEQ ID NO: 145367 - RNA, 22 nt, Human
aauugcuuucacaaguguuaua

SEQ ID NO: 145368 - RNA, 21 nt, Human
agcaucugaggcaguuuccua

SEQ ID NO: 145369 - RNA, 22 nt, Human
uguacuguuuucuaggcaaaaa

SEQ ID NO: 145370 - RNA, 22 nt, Human
ggccagcuuugagcugcaggaa

SEQ ID NO: 145371 - RNA, 22 nt, Human
agagcuccaggguuuuguagug

SEQ ID NO: 145372 - RNA, 22 nt, Human
ucugcaugccucaggaggccug

SEQ ID NO: 145373 - RNA, 22 nt, Human
ucccaaguguuuggcgaggaga

SEQ ID NO: 145374 - RNA, 22 nt, Human
aagccuccgugcugcuggaucu

SEQ ID NO: 145375 - RNA, 22 nt, Human
aaucacuuagaacccaggaagu

SEQ ID NO: 145376 - RNA, 22 nt, Human
uuuugauacaaguuguaaaaaa

SEQ ID NO: 145377 - RNA, 22 nt, Human
aggcucagcaucugauucauau

SEQ ID NO: 145378 - RNA, 22 nt, Human
gggagaguagcuggaagguucu

SEQ ID NO: 145379 - RNA, 21 nt, Human
uucuauauugagaauuggcua

SEQ ID NO: 145380 - RNA, 22 nt, Human
cugccaggagaggccagggccc

SEQ ID NO: 145381 - RNA, 22 nt, Human
uccuugaauugcguccacaaga

SEQ ID NO: 145382 - RNA, 22 nt, Human
gggacaggacuccuggggccug

SEQ ID NO: 145383 - RNA, 22 nt, Human
cagggcaucucugaaucuucac

SEQ ID NO: 145384 - RNA, 22 nt, Human
ucuguuucaggggucuggaaug

SEQ ID NO: 145385 - RNA, 22 nt, Human
ugaacauuuuugcuugcagcuu

SEQ ID NO: 145386 - RNA, 22 nt, Human
gagcacugagcuggaauuggag

SEQ ID NO: 145387 - RNA, 22 nt, Human
caauccccaggucccagaacag

SEQ ID NO: 145388 - RNA, 21 nt, Human
ucucauuuuaacacagaguug

SEQ ID NO: 145389 - RNA, 22 nt, Human
ugcucuuuguagcugcuuugcu

SEQ ID NO: 145390 - RNA, 22 nt, Human
aagggagagggagaagguggga

SEQ ID NO: 145391 - RNA, 23 nt, Human
agggcacugaagcuggaauuggg

SEQ ID NO: 145392 - RNA, 21 nt, Human
ccugcacuucccuccucaagu

SEQ ID NO: 145393 - RNA, 22 nt, Human
guaagguuggaugcaaucaacu

SEQ ID NO: 145394 - RNA, 22 nt, Human
gaauuacagaguuguuaaguca

SEQ ID NO: 145395 - RNA, 22 nt, Human
caacaaguugauuucacgcugc

SEQ ID NO: 145396 - RNA, 22 nt, Human
ugauauaaaagauucuuauuga

SEQ ID NO: 145397 - RNA, 22 nt, Human
aagaaaagguaaccgcuuaucu

SEQ ID NO: 145398 - RNA, 22 nt, Human
gauacugugggcacucauaaua

SEQ ID NO: 145399 - RNA, 22 nt, Human
uaucuguagucucaugguuccu

SEQ ID NO: 145400 - RNA, 22 nt, Human
guaagaauauacccaggaguca

SEQ ID NO: 145401 - RNA, 22 nt, Human
ucuucaucucuaaaaugggaac

SEQ ID NO: 145402 - RNA, 22 nt, Human
uugggauucugucagugugugu

SEQ ID NO: 145403 - RNA, 22 nt, Human
aacuuucuuugcaucuaaguuu

SEQ ID NO: 145404 - RNA, 22 nt, Human
ggcucccccauggcugacagac

SEQ ID NO: 145405 - RNA, 22 nt, Human
accugagauuuuuacucaguaa

SEQ ID NO: 145406 - RNA, 22 nt, Human
caaauuuuuauuuaccaucugc

SEQ ID NO: 145407 - RNA, 20 nt, Human
uacaauauucccacuuugcu

SEQ ID NO: 145408 - RNA, 22 nt, Human
auuucauuuuagaaauaagugu

SEQ ID NO: 145409 - RNA, 22 nt, Human
uggcaaacacaauauggguaca

SEQ ID NO: 145410 - RNA, 22 nt, Human
ugcauuuugaaggaaaaaaaug

SEQ ID NO: 145411 - RNA, 22 nt, Human
aguuuuugccucgaauucugcg

SEQ ID NO: 145412 - RNA, 23 nt, Human
ucagaccaaccucuugcuggaac

SEQ ID NO: 145413 - RNA, 22 nt, Human
ucacuucuaugaucugucucuu

SEQ ID NO: 145414 - RNA, 22 nt, Human
aaaauauucuauaucaaagaua

SEQ ID NO: 145415 - RNA, 21 nt, Human
uccaggagcacgggacuagga

SEQ ID NO: 145416 - RNA, 22 nt, Human
cucugugucugauucugggaag

SEQ ID NO: 145417 - RNA, 22 nt, Human
cuucucuuggguguggugucuu

SEQ ID NO: 145418 - RNA, 22 nt, Human
ccugccagaaaagagggaguuc

SEQ ID NO: 145419 - RNA, 22 nt, Human
aaauuuauaacuuaaagugaau

SEQ ID NO: 145420 - RNA, 22 nt, Human
uuuucaauuuucauuugcaaga

SEQ ID NO: 145421 - RNA, 22 nt, Human
aguacuuuuuguucaauugugc

SEQ ID NO: 145422 - RNA, 22 nt, Human
gugcagcugggcgcugaccuuc

SEQ ID NO: 145423 - RNA, 22 nt, Human
ugucacagagcgugcaacagaa

SEQ ID NO: 145424 - RNA, 22 nt, Human
uuuuaaauggcuuuuacuuuuc

SEQ ID NO: 145425 - RNA, 22 nt, Human
guccuguguaaguacuugcuca

SEQ ID NO: 145426 - RNA, 22 nt, Human
uuaaguccuugguaauuuucuu

SEQ ID NO: 145427 - RNA, 22 nt, Human
uuuaaauaguugguuuuuuugc

SEQ ID NO: 145428 - RNA, 22 nt, Human
aggggcugugucauuuguccua

SEQ ID NO: 145429 - RNA, 22 nt, Human
uaauuauuaauuuuagguugcu

SEQ ID NO: 145430 - RNA, 22 nt, Human
ggcugugaaguacguugaaggu

SEQ ID NO: 145431 - RNA, 22 nt, Human
acucauucgccuugcccaaggc

SEQ ID NO: 145432 - RNA, 22 nt, Human
auucaucuguacuucaauaucu

SEQ ID NO: 145433 - RNA, 22 nt, Human
auauuugucuguuuuaguggca

SEQ ID NO: 145434 - RNA, 22 nt, Human
caguagcuuuuugcagacaaga

SEQ ID NO: 145435 - RNA, 22 nt, Human
aguucaugugguuuaacuuaau

SEQ ID NO: 145436 - RNA, 22 nt, Human
cauggcggcgcucucccugccu

SEQ ID NO: 145437 - RNA, 22 nt, Human
caaggaaaacagaugaucaaca

SEQ ID NO: 145438 - RNA, 22 nt, Human
aaggcuguuugagcacuggagc

SEQ ID NO: 145439 - RNA, 22 nt, Human
gcucugaacugucaugaauugg

SEQ ID NO: 145440 - RNA, 22 nt, Human
ucccuugacauuacuugggagg

SEQ ID NO: 145441 - RNA, 22 nt, Human
gggcagagagcuggaacuccuu

SEQ ID NO: 145442 - RNA, 22 nt, Human
uucacuguucuuagagaagacc

SEQ ID NO: 145443 - RNA, 22 nt, Human
aacugcauaagcuucgggaccu

SEQ ID NO: 145444 - RNA, 22 nt, Human
uggguauauauguugcuacaga

SEQ ID NO: 145445 - RNA, 22 nt, Human
ugguuauauaaggauuaaauac

SEQ ID NO: 145446 - RNA, 22 nt, Human
ugaauuagagugaaggaaagcu

SEQ ID NO: 145447 - RNA, 22 nt, Human
uauguauaacuugauaggauga

SEQ ID NO: 145448 - RNA, 21 nt, Human
gggagaguagcgguagggagg

SEQ ID NO: 145449 - RNA, 22 nt, Human
gaaaacccuguauguagcguuu

SEQ ID NO: 145450 - RNA, 22 nt, Human
ccaggcucaccuggagccccug

SEQ ID NO: 145451 - RNA, 22 nt, Human
gcuggccugcgagggcaggcug

SEQ ID NO: 145452 - RNA, 22 nt, Human
aucauuugaacagaauuuguuu

SEQ ID NO: 145453 - RNA, 22 nt, Human
aacauuuauguuuugaccaagu

SEQ ID NO: 145454 - RNA, 22 nt, Human
cuucauuucaggcugaagaaua

SEQ ID NO: 145455 - RNA, 22 nt, Human
cagcucugcugggaggaugcag

SEQ ID NO: 145456 - RNA, 22 nt, Human
cagacagaguuguuucuucucc

SEQ ID NO: 145457 - RNA, 22 nt, Human
uaggaagagauuuucacauggc

SEQ ID NO: 145458 - RNA, 22 nt, Human
aucaaaauuuucagauacuaca

SEQ ID NO: 145459 - RNA, 22 nt, Human
agggaguuccgaucugugcacc

SEQ ID NO: 145460 - RNA, 22 nt, Human
cauaucuccagguucugcugga

SEQ ID NO: 145461 - RNA, 22 nt, Human
gaggagcugggucagggagaca

SEQ ID NO: 145462 - RNA, 22 nt, Human
uucacauucauuucuuauguuu

SEQ ID NO: 145463 - RNA, 22 nt, Human
aguuucuugaagacugauguuu

SEQ ID NO: 145464 - RNA, 22 nt, Human
auuaagucugacuggauuguau

SEQ ID NO: 145465 - RNA, 22 nt, Human
cuucauaagauuguugugagga

SEQ ID NO: 145466 - RNA, 22 nt, Human
uaauuccacacucccgcaagcg

SEQ ID NO: 145467 - RNA, 22 nt, Human
aagugugugugcgcaugugcau

SEQ ID NO: 145468 - RNA, 22 nt, Human
ucccuguggauuaaggagaugu

SEQ ID NO: 145469 - RNA, 22 nt, Human
aagcugccugggaggaagggcu

SEQ ID NO: 145470 - RNA, 19 nt, Human
uccaccgcgugcaccucua

SEQ ID NO: 145471 - RNA, 22 nt, Human
agaggcaggcagcagagaagau

SEQ ID NO: 145472 - RNA, 22 nt, Human
uuggggagaagagcuggucagg

SEQ ID NO: 145473 - RNA, 22 nt, Human
ccaugauguugccuacacugcu

SEQ ID NO: 145474 - RNA, 22 nt, Human
agucauuugaggcaugauuaug

SEQ ID NO: 145475 - RNA, 18 nt, Human
ggugagggagcuggaagc

SEQ ID NO: 145476 - RNA, 22 nt, Human
accuugggcccagaccggcacg

SEQ ID NO: 145477 - RNA, 22 nt, Human
ugcuuggauuuccaaaugguuu

SEQ ID NO: 145478 - RNA, 22 nt, Human
uuuucugauccuucuaacuuga

SEQ ID NO: 145479 - RNA, 22 nt, Human
uuuugaauaauucagaaacagc

SEQ ID NO: 145480 - RNA, 22 nt, Human
uuuuuauaagagcagcagaguu

SEQ ID NO: 145481 - RNA, 22 nt, Human
uuaaaucaggcaucauuucagu

SEQ ID NO: 145482 - RNA, 22 nt, Human
agaagaaugguuugaaagauuu

SEQ ID NO: 145483 - RNA, 21 nt, Human
aacaaaagggaagaacagcug

SEQ ID NO: 145484 - RNA, 22 nt, Human
agaggcagagcugggguuugac

SEQ ID NO: 145485 - RNA, 20 nt, Human
uggagggaggaggggcccaa

SEQ ID NO: 145486 - RNA, 22 nt, Human
aauggcaauagugcauuaugua

SEQ ID NO: 145487 - RNA, 22 nt, Human
ggagacagauggcgucucaguu

SEQ ID NO: 145488 - RNA, 22 nt, Human
uugcugccagcgcccugcaggg

SEQ ID NO: 145489 - RNA, 22 nt, Human
auuaaauagcagaagaaagaug

SEQ ID NO: 145490 - RNA, 22 nt, Human
ucccagaacggguucuucccag

SEQ ID NO: 145491 - RNA, 22 nt, Human
auuaauaucaauauauuauaug

SEQ ID NO: 145492 - RNA, 22 nt, Human
cuaaaaauguucuaguaguuca

SEQ ID NO: 145493 - RNA, 22 nt, Human
uguuuucuuuccccuucuuuuc

SEQ ID NO: 145494 - RNA, 22 nt, Human
guacuugauucauuauugcauu

SEQ ID NO: 145495 - RNA, 19 nt, Human
auucuucucuuccugcugu

SEQ ID NO: 145496 - RNA, 22 nt, Human
uucuguuuauaauuugcaguug

SEQ ID NO: 145497 - RNA, 22 nt, Human
augugaaagagguguucagugg

SEQ ID NO: 145498 - RNA, 22 nt, Human
uggagccugauggauaggaacg

SEQ ID NO: 145499 - RNA, 22 nt, Human
acagcucaggcccaucaacccc

SEQ ID NO: 145500 - RNA, 22 nt, Human
ugagggaguguggauacaguag

SEQ ID NO: 145501 - RNA, 22 nt, Human
ggaggaagagaccagggggcuu

SEQ ID NO: 145502 - RNA, 22 nt, Human
aaaauauuuaucuagcucuuaa

SEQ ID NO: 145503 - RNA, 22 nt, Human
uuuucucuuugcuucucuaaaa

SEQ ID NO: 145504 - RNA, 22 nt, Human
uugguuaccuucagaaaugagu

SEQ ID NO: 145505 - RNA, 22 nt, Human
ccauagucacuuguccucuuuu

SEQ ID NO: 145506 - RNA, 23 nt, Human
ugccaggaagaaugaccucugcu

SEQ ID NO: 145507 - RNA, 22 nt, Human
caggagagucucugucuguacu

SEQ ID NO: 145508 - RNA, 22 nt, Human
gaggagagcuggccagguuucu

SEQ ID NO: 145509 - RNA, 22 nt, Human
uuuugaugaccauucuucuuuu

SEQ ID NO: 145510 - RNA, 20 nt, Human
aauaaauauaacccauaauu

SEQ ID NO: 145511 - RNA, 22 nt, Human
aggcagaugggagcuggaaguu

SEQ ID NO: 145512 - RNA, 22 nt, Human
ugcuuggagaaucagucccagc

SEQ ID NO: 145513 - RNA, 22 nt, Human
ucccagaaauccaggcuuaaau

SEQ ID NO: 145514 - RNA, 22 nt, Human
uuauuuuauaaagagaagacuu

SEQ ID NO: 145515 - RNA, 22 nt, Human
ucuaaaaauuagaaauuagguc

SEQ ID NO: 145516 - RNA, 22 nt, Human
gagggugguggcggccggcacc

SEQ ID NO: 145517 - RNA, 22 nt, Human
acuuuuaauaguagauuuuuaa

SEQ ID NO: 145518 - RNA, 22 nt, Human
auuuacugagguaaauaaacug

SEQ ID NO: 145519 - RNA, 22 nt, Human
gcuguggacacagcucucuuca

SEQ ID NO: 145520 - RNA, 22 nt, Human
auaaauuugacagcucuucaug

SEQ ID NO: 145521 - RNA, 22 nt, Human
auuuuugguuauaaaauaguuu

SEQ ID NO: 145522 - RNA, 22 nt, Human
uacaggaggaugugcagccagg

SEQ ID NO: 145523 - RNA, 22 nt, Human
gugaucagaagaaccugccgaa

SEQ ID NO: 145524 - RNA, 22 nt, Human
ggcuagggagacagagggcaug

SEQ ID NO: 145525 - RNA, 22 nt, Human
aggauagacuucagaaggcaua

SEQ ID NO: 145526 - RNA, 22 nt, Human
ugcuuguuuuguggcuucagcu

SEQ ID NO: 145527 - RNA, 22 nt, Human
cuauacuuagaacuccauuuuc

SEQ ID NO: 145528 - RNA, 22 nt, Human
agcggccucgcugccugcucag

SEQ ID NO: 145529 - RNA, 23 nt, Human
aggcugccacucagggugaggcu

SEQ ID NO: 145530 - RNA, 22 nt, Human
ucucuucacuuguaugcuauca

SEQ ID NO: 145531 - RNA, 22 nt, Human
uuaauauuaagauauugagugg

SEQ ID NO: 145532 - RNA, 22 nt, Human
auagggaggcggagggagcugg

SEQ ID NO: 145533 - RNA, 22 nt, Human
aaguuccacuagugacccagaa

SEQ ID NO: 145534 - RNA, 22 nt, Human
cagagcugucauuugccaguga

SEQ ID NO: 145535 - RNA, 22 nt, Human
gauuuugcuuuagugaaggaag

SEQ ID NO: 145536 - RNA, 22 nt, Human
ugggauggacuuuagagaaucg

SEQ ID NO: 145537 - RNA, 22 nt, Human
uacagcuuccucuaugguggcc

SEQ ID NO: 145538 - RNA, 22 nt, Human
uaaaguguacaagucauaagua

SEQ ID NO: 145539 - RNA, 22 nt, Human
cuuuuuaaaguaaauggcuaga

SEQ ID NO: 145540 - RNA, 22 nt, Human
uugcaugauuuaagaauaucug

SEQ ID NO: 145541 - RNA, 22 nt, Human
uuuuuuuagaaagaucauaguu

SEQ ID NO: 145542 - RNA, 22 nt, Human
gcaguaaauugagagucauguu

SEQ ID NO: 145543 - RNA, 22 nt, Human
guuuugugugugugcccacacg

SEQ ID NO: 145544 - RNA, 22 nt, Human
cacuguugagcaauguacagug

SEQ ID NO: 145545 - RNA, 22 nt, Human
ugucuuugaccuuaagaaguuu

SEQ ID NO: 145546 - RNA, 22 nt, Human
aggcugccuaugaaggcagaag

SEQ ID NO: 145547 - RNA, 22 nt, Human
ggugugaauagagccuggagca

SEQ ID NO: 145548 - RNA, 22 nt, Human
uugaauaguuuuggauagcaua

SEQ ID NO: 145549 - RNA, 21 nt, Human
gccugcuguucacccugccac

SEQ ID NO: 145550 - RNA, 22 nt, Human
gggagcugagcuggaagagaau

SEQ ID NO: 145551 - RNA, 22 nt, Human
ggugaguagaaguaguuggcuu

SEQ ID NO: 145552 - RNA, 22 nt, Human
cagugcucauagcuguuccucc

SEQ ID NO: 145553 - RNA, 22 nt, Human
guuuuguagucuggagacuguc

SEQ ID NO: 145554 - RNA, 22 nt, Human
cguuuugaguagauagccauau

SEQ ID NO: 145555 - RNA, 22 nt, Human
aggaggaggacucgccaggcca

SEQ ID NO: 145556 - RNA, 22 nt, Human
uccuuucaaauuuauuugacau

SEQ ID NO: 145557 - RNA, 22 nt, Human
aauuacuuuaggaaaacuccuc

SEQ ID NO: 145558 - RNA, 23 nt, Human
cauguacacacagcuguacagug

SEQ ID NO: 145559 - RNA, 22 nt, Human
uacaagcucuuguagggggaaa

SEQ ID NO: 145560 - RNA, 22 nt, Human
caggaacucggagcccaucucu

SEQ ID NO: 145561 - RNA, 20 nt, Human
uauuucaaugugccaaguuu

SEQ ID NO: 145562 - RNA, 22 nt, Human
caggaaaauaauggugauggga

SEQ ID NO: 145563 - RNA, 22 nt, Human
uuuauugcuaugucuugauugu

SEQ ID NO: 145564 - RNA, 22 nt, Human
gagggaggugacaaggacauag

SEQ ID NO: 145565 - RNA, 20 nt, Human
uuccccauaaaaauguucca

SEQ ID NO: 145566 - RNA, 22 nt, Human
ugaaaaauauuuuuagaaauaa

SEQ ID NO: 145567 - RNA, 22 nt, Human
cuucuuuuggggaugaaaaugg

SEQ ID NO: 145568 - RNA, 22 nt, Human
ccucaucagaaagcagaaagca

SEQ ID NO: 145569 - RNA, 22 nt, Human
cccuccagugucccagugggga

SEQ ID NO: 145570 - RNA, 22 nt, Human
accuuuggaggacuagggucau

SEQ ID NO: 145571 - RNA, 22 nt, Human
ccucaggaauuuauucuucugu

SEQ ID NO: 145572 - RNA, 22 nt, Human
auguugagaaucucucuucuaa

SEQ ID NO: 145573 - RNA, 22 nt, Human
uaagcuauuccugaagaagguu

SEQ ID NO: 145574 - RNA, 22 nt, Human
agucaccuacagcucaugcuuc

SEQ ID NO: 145575 - RNA, 22 nt, Human
ugaggagggcuagagucuccug

SEQ ID NO: 145576 - RNA, 23 nt, Human
aguggaggucgggguggggagac

SEQ ID NO: 145577 - RNA, 22 nt, Human
uuagaaauguccuacuaauaug

SEQ ID NO: 145578 - RNA, 19 nt, Human
ccagaagggcaagcaaagg

SEQ ID NO: 145579 - RNA, 22 nt, Human
auuuuuucaugugugguugaga

SEQ ID NO: 145580 - RNA, 22 nt, Human
uccuccauguugugcacuugaa

SEQ ID NO: 145581 - RNA, 22 nt, Human
aggaaauaggaccagacaaagc

SEQ ID NO: 145582 - RNA, 22 nt, Human
aauuuaauugguuuuuacuugu

SEQ ID NO: 145583 - RNA, 18 nt, Human
uucucucuggauaguagu

SEQ ID NO: 145584 - RNA, 22 nt, Human
uggagucuugcuuugggagugc

SEQ ID NO: 145585 - RNA, 22 nt, Human
uuugauuuuguuuauagugccg

SEQ ID NO: 145586 - RNA, 22 nt, Human
aauauuuaaauagaauuacauc

SEQ ID NO: 145587 - RNA, 23 nt, Human
aaugugaaauugaguuuuuguua

SEQ ID NO: 145588 - RNA, 22 nt, Human
cugguacuggaggaguucagag

SEQ ID NO: 145589 - RNA, 22 nt, Human
ggagagaacguaaucuaguauu

SEQ ID NO: 145590 - RNA, 22 nt, Human
gccugggccgggcgcggccccc

SEQ ID NO: 145591 - RNA, 22 nt, Human
gcuguggagaagcugccuaugg

SEQ ID NO: 145592 - RNA, 22 nt, Human
ucagcaggugcuuuguuuacuc

SEQ ID NO: 145593 - RNA, 22 nt, Human
acuggagcccguggaggcgcag

SEQ ID NO: 145594 - RNA, 19 nt, Human
agauggcaaaaugcaaaga

SEQ ID NO: 145595 - RNA, 22 nt, Human
uggcucagcgcggccuggucuu

SEQ ID NO: 145596 - RNA, 22 nt, Human
aaauauuaaugaugaagguagu

SEQ ID NO: 145597 - RNA, 22 nt, Human
caggaacagcaccaggagcuag

SEQ ID NO: 145598 - RNA, 22 nt, Human
ccagaugggggcugugggaggg

SEQ ID NO: 145599 - RNA, 22 nt, Human
auaaauuugccagcauauguuc

SEQ ID NO: 145600 - RNA, 20 nt, Human
aaagauacuuuuuguaaugg

SEQ ID NO: 145601 - RNA, 22 nt, Human
auguuagcaucuggcacuaugg

SEQ ID NO: 145602 - RNA, 22 nt, Human
auauuauuaaaauagauggaua

SEQ ID NO: 145603 - RNA, 21 nt, Human
aaguuucucccuaauuguugc

SEQ ID NO: 145604 - RNA, 22 nt, Human
aaaguaaagccuauuuaauaau

SEQ ID NO: 145605 - RNA, 22 nt, Human
ugagaccuaaaccgucuguccu

SEQ ID NO: 145606 - RNA, 22 nt, Human
uuguccacuaagaaagugcccu

SEQ ID NO: 145607 - RNA, 22 nt, Human
acugcauuaucaccaagaugua

SEQ ID NO: 145608 - RNA, 22 nt, Human
cuuuucauuucauggaauacaa

SEQ ID NO: 145609 - RNA, 22 nt, Human
auaaaaauguuuuuguguggua

SEQ ID NO: 145610 - RNA, 19 nt, Human
uagaggagaauggcaaaga

SEQ ID NO: 145611 - RNA, 22 nt, Human
auguaaauauuuauauaugcau

SEQ ID NO: 145612 - RNA, 22 nt, Human
uggccccauuuuucuggagccu

SEQ ID NO: 145613 - RNA, 22 nt, Human
gaaggaaaagacgugcuaagua

SEQ ID NO: 145614 - RNA, 22 nt, Human
uauuuuuaccuaauuuaugaga

SEQ ID NO: 145615 - RNA, 21 nt, Human
cuauaaaaaugguucuuugcg

SEQ ID NO: 145616 - RNA, 22 nt, Human
uccuucagaggacggcagccag

SEQ ID NO: 145617 - RNA, 22 nt, Human
gaauuagacggcaucacauggg

SEQ ID NO: 145618 - RNA, 20 nt, Human
aaaaacaguaaugcugaaga

SEQ ID NO: 145619 - RNA, 22 nt, Human
uguugaagcaccucugucuuuc

SEQ ID NO: 145620 - RNA, 23 nt, Human
aagaaugcuucugaagagcugcc

SEQ ID NO: 145621 - RNA, 22 nt, Human
gggcaagaagcuggaagcauuc

SEQ ID NO: 145622 - RNA, 22 nt, Human
uuuauuuuccaugucucuaggu

SEQ ID NO: 145623 - RNA, 22 nt, Human
auucuccucaaaacaucugcug

SEQ ID NO: 145624 - RNA, 22 nt, Human
gaggucagugugggggcaaggg

SEQ ID NO: 145625 - RNA, 22 nt, Human
uuuugcuucuaguauauuuuuu

SEQ ID NO: 145626 - RNA, 22 nt, Human
uauguuaaauguuugauguuua

SEQ ID NO: 145627 - RNA, 22 nt, Human
uuguugcaagccuggaaucugg

SEQ ID NO: 145628 - RNA, 22 nt, Human
uggaugccuugggggaggagga

SEQ ID NO: 145629 - RNA, 22 nt, Human
ggugucucagauuguaaaaugu

SEQ ID NO: 145630 - RNA, 22 nt, Human
uuuauaaacacaagaugggcuc

SEQ ID NO: 145631 - RNA, 22 nt, Human
gugguggggaguuggauggaag

SEQ ID NO: 145632 - RNA, 22 nt, Human
agguuaggaggggagugccaca

SEQ ID NO: 145633 - RNA, 22 nt, Human
agugaagauagagccaggucug

SEQ ID NO: 145634 - RNA, 22 nt, Human
ucugcagggcccuuggcuccug

SEQ ID NO: 145635 - RNA, 22 nt, Human
uaguuauuucugcacuuaauga

SEQ ID NO: 145636 - RNA, 22 nt, Human
uuuguacuuucuaauguauuua

SEQ ID NO: 145637 - RNA, 22 nt, Human
ugcauaagguuaaauuagcaga

SEQ ID NO: 145638 - RNA, 22 nt, Human
uuugcaggaaauguacugaaug

SEQ ID NO: 145639 - RNA, 22 nt, Human
gcugcagggagcuggaaggcuc

SEQ ID NO: 145640 - RNA, 22 nt, Human
ggcaaggaagaaagcagaaguu

SEQ ID NO: 145641 - RNA, 22 nt, Human
cuuauucuucuggacuuggagu

SEQ ID NO: 145642 - RNA, 23 nt, Human
ucugccuccuaauuguugguguc

SEQ ID NO: 145643 - RNA, 22 nt, Human
gcacugagacuuuagauuggag

SEQ ID NO: 145644 - RNA, 22 nt, Human
cuuaggaaauccuguacucccc

SEQ ID NO: 145645 - RNA, 22 nt, Human
ggaagcucaauacuuuccucuu

SEQ ID NO: 145646 - RNA, 22 nt, Human
auucuucauguugaagcuguca

SEQ ID NO: 145647 - RNA, 21 nt, Human
ggcugcucgugaugaacuuca

SEQ ID NO: 145648 - RNA, 22 nt, Human
aacugguaauuuaguauuacug

SEQ ID NO: 145649 - RNA, 22 nt, Human
cagaaaacauuguguguauaag

SEQ ID NO: 145650 - RNA, 22 nt, Human
guuuaaaagcaaccaacaggcu

SEQ ID NO: 145651 - RNA, 22 nt, Human
aauauauaugggugcaugucug

SEQ ID NO: 145652 - RNA, 22 nt, Human
uuuuaaaagguugcuguuauaa

SEQ ID NO: 145653 - RNA, 18 nt, Human
guucaagcauuuugcucu

SEQ ID NO: 145654 - RNA, 22 nt, Human
gauuuuaaaagauguauaaggu

SEQ ID NO: 145655 - RNA, 22 nt, Human
ggagagcuagugagcuggaggu

SEQ ID NO: 145656 - RNA, 22 nt, Human
agauggaguccugaagccagaa

SEQ ID NO: 145657 - RNA, 22 nt, Human
cuuuuucuuaucuuuuucuaug

SEQ ID NO: 145658 - RNA, 22 nt, Human
gggggcugugugcccgcucccc

SEQ ID NO: 145659 - RNA, 22 nt, Human
gccuuuuaaggcagagggagau

SEQ ID NO: 145660 - RNA, 22 nt, Human
aucuuugauuuuggcuuuuagg

SEQ ID NO: 145661 - RNA, 22 nt, Human
acuguugagggaagcagaugaa

SEQ ID NO: 145662 - RNA, 22 nt, Human
guuuuguucaugaacauugggu

SEQ ID NO: 145663 - RNA, 22 nt, Human
cuguggcugcgcccugggggag

SEQ ID NO: 145664 - RNA, 22 nt, Human
uuaaugcagguacuguuacaau

SEQ ID NO: 145665 - RNA, 22 nt, Human
gaaggagaggauugugaggcug

SEQ ID NO: 145666 - RNA, 22 nt, Human
ugaaaaaugcuuuaaugcaugu

SEQ ID NO: 145667 - RNA, 22 nt, Human
aaaacauuuuacugccaucuca

SEQ ID NO: 145668 - RNA, 22 nt, Human
ucucugaccuccaccccaggag

SEQ ID NO: 145669 - RNA, 22 nt, Human
aaugaaugaaugaaugauuaug

SEQ ID NO: 145670 - RNA, 22 nt, Human
auuuaaaaacugguacaacagg

SEQ ID NO: 145671 - RNA, 22 nt, Human
agucuagagcuuuuaucaggcc

SEQ ID NO: 145672 - RNA, 22 nt, Human
ggggaggguuuggaugagaguc

SEQ ID NO: 145673 - RNA, 20 nt, Human
agcuuucaccaguacuucca

SEQ ID NO: 145674 - RNA, 22 nt, Human
uaauaaaaauuuaauucacauu

SEQ ID NO: 145675 - RNA, 22 nt, Human
uagugcuuaaaacagaauuuuc

SEQ ID NO: 145676 - RNA, 22 nt, Human
caacuucugcuuucuuccuugc

SEQ ID NO: 145677 - RNA, 22 nt, Human
aaucccaguccuccugggggau

SEQ ID NO: 145678 - RNA, 22 nt, Human
ugaguucugacugagcaugggg

SEQ ID NO: 145679 - RNA, 22 nt, Human
ucaguuuaauuggaucuuuuuc

SEQ ID NO: 145680 - RNA, 22 nt, Human
cugauaauaaccauuuuaaaau

SEQ ID NO: 145681 - RNA, 22 nt, Human
aguugugagaaugaacacugaa

SEQ ID NO: 145682 - RNA, 22 nt, Human
guuuacaacaucuuguccuuca

SEQ ID NO: 145683 - RNA, 22 nt, Human
gauaagugauucugauucacau

SEQ ID NO: 145684 - RNA, 20 nt, Human
cuuauuuuggagaacuuuuc

SEQ ID NO: 145685 - RNA, 22 nt, Human
acucagcaccuagaaagugugc

SEQ ID NO: 145686 - RNA, 22 nt, Human
cugggaggagacaggggauggg

SEQ ID NO: 145687 - RNA, 22 nt, Human
auggaguguggccaggcaguaa

SEQ ID NO: 145688 - RNA, 22 nt, Human
cuuucucucaaacacacauaca

SEQ ID NO: 145689 - RNA, 22 nt, Human
ugggaggcugugggaauggguc

SEQ ID NO: 145690 - RNA, 22 nt, Human
uuuuagagacagcauggagaaa

SEQ ID NO: 145691 - RNA, 22 nt, Human
cuccagggcuaccagguuuuag

SEQ ID NO: 145692 - RNA, 22 nt, Human
guaaauacuaugagauaaugaa

SEQ ID NO: 145693 - RNA, 22 nt, Human
uguuaaaaagucccuguuuugu

SEQ ID NO: 145694 - RNA, 22 nt, Human
ccugccugggcucacuugccag

SEQ ID NO: 145695 - RNA, 22 nt, Human
acauuuuaaaaacaguaccugg

SEQ ID NO: 145696 - RNA, 22 nt, Human
auauaguacauguauauauaua

SEQ ID NO: 145697 - RNA, 23 nt, Human
aaaguacuuaaucugcaaaccac

SEQ ID NO: 145698 - RNA, 22 nt, Human
cucuugugucaccauggauaaa

SEQ ID NO: 145699 - RNA, 22 nt, Human
agcucugauccuuuaaaggaga

SEQ ID NO: 145700 - RNA, 21 nt, Human
uaauaauugggggcagggugg

SEQ ID NO: 145701 - RNA, 22 nt, Human
aauagcaauuacccuucaacuc

SEQ ID NO: 145702 - RNA, 22 nt, Human
uguucugauggauuacaugucu

SEQ ID NO: 145703 - RNA, 22 nt, Human
uauuuuuacuguuugaugauuc

SEQ ID NO: 145704 - RNA, 22 nt, Human
uaggauauuuuagaaugguaca

SEQ ID NO: 145705 - RNA, 17 nt, Human
auucaugaacauguccu

SEQ ID NO: 145706 - RNA, 22 nt, Human
ugagagguagaacuuguagugu

SEQ ID NO: 145707 - RNA, 22 nt, Human
uucuucuucuuccucauccuca

SEQ ID NO: 145708 - RNA, 22 nt, Human
aauucuuuguuccucugccaag

SEQ ID NO: 145709 - RNA, 22 nt, Human
aaauuuuguugaaaaauauuuu

SEQ ID NO: 145710 - RNA, 22 nt, Human
acucugaaaggcuacaaaugcu

SEQ ID NO: 145711 - RNA, 22 nt, Human
aaauucuuccaggaggaaauac

SEQ ID NO: 145712 - RNA, 22 nt, Human
uggggcuccuccuggcaggagg

SEQ ID NO: 145713 - RNA, 22 nt, Human
cuucuuaaaguugucacagcug

SEQ ID NO: 145714 - RNA, 22 nt, Human
guauauuuaugagcauuagccu

SEQ ID NO: 145715 - RNA, 22 nt, Human
cauuauucaggcuuuggaauuu

SEQ ID NO: 145716 - RNA, 22 nt, Human
gggggcagguuccaggccagcu

SEQ ID NO: 145717 - RNA, 22 nt, Human
caagaaaaaacaugaugagugu

SEQ ID NO: 145718 - RNA, 22 nt, Human
cuguccauuuucgugccuccuu

SEQ ID NO: 145719 - RNA, 20 nt, Human
ugcugugugucuacuguggg

SEQ ID NO: 145720 - RNA, 22 nt, Human
ugaaauuuuuuggagauaauuu

SEQ ID NO: 145721 - RNA, 22 nt, Human
aaggaaaaccugacugaagaac

SEQ ID NO: 145722 - RNA, 22 nt, Human
caagggcagaggcagggccccg

SEQ ID NO: 145723 - RNA, 22 nt, Human
augugugugcgagcgugugugu

SEQ ID NO: 145724 - RNA, 22 nt, Human
uauauauacauauagaauaugu

SEQ ID NO: 145725 - RNA, 22 nt, Human
gcauuuuaauuggggcaguuag

SEQ ID NO: 145726 - RNA, 22 nt, Human
augcuaaucaaacuuucugcag

SEQ ID NO: 145727 - RNA, 22 nt, Human
ucccagguugaggccuugccug

SEQ ID NO: 145728 - RNA, 22 nt, Human
ccagcaaguaagucagugucag

SEQ ID NO: 145729 - RNA, 21 nt, Human
uccugcagggcagcagagugg

SEQ ID NO: 145730 - RNA, 22 nt, Human
ucagucucuggggcuucuguuu

SEQ ID NO: 145731 - RNA, 17 nt, Human
ccacuagauagguugug

SEQ ID NO: 145732 - RNA, 22 nt, Human
ccugaguucuuauuuccaguca

SEQ ID NO: 145733 - RNA, 22 nt, Human
auugugaaugccugucagucuu

SEQ ID NO: 145734 - RNA, 22 nt, Human
gggaaaaaggaguuagagauaa

SEQ ID NO: 145735 - RNA, 22 nt, Human
agcugaggccccgcagcagggu

SEQ ID NO: 145736 - RNA, 22 nt, Human
gagggagagaugcuggaccggg

SEQ ID NO: 145737 - RNA, 22 nt, Human
guuuucuuguuaauuuugaacg

SEQ ID NO: 145738 - RNA, 22 nt, Human
cuuccauucugauggcuaauua

SEQ ID NO: 145739 - RNA, 22 nt, Human
uucauggauuugugaaauuuag

SEQ ID NO: 145740 - RNA, 22 nt, Human
ugaauaaucuuggguauuaaua

SEQ ID NO: 145741 - RNA, 22 nt, Human
ugaccucaagcaugcggagggc

SEQ ID NO: 145742 - RNA, 22 nt, Human
ugaggggaggggagaaaauggu

SEQ ID NO: 145743 - RNA, 21 nt, Human
ccgaggagugcggggagcccc

SEQ ID NO: 145744 - RNA, 20 nt, Human
ucauucagaaucaguaugca

SEQ ID NO: 145745 - RNA, 22 nt, Human
aagaguggagcuggaaaguggg

SEQ ID NO: 145746 - RNA, 22 nt, Human
uuuaccuuauguaaauaagagu

SEQ ID NO: 145747 - RNA, 22 nt, Human
cugggagaugacucagagcagg

SEQ ID NO: 145748 - RNA, 22 nt, Human
aggauggauagcaaggaagccg

SEQ ID NO: 145749 - RNA, 21 nt, Human
uggcaggcagcuggaagcuug

SEQ ID NO: 145750 - RNA, 22 nt, Human
uggaagugggcaucaccaucca

SEQ ID NO: 145751 - RNA, 22 nt, Human
auguuccaugacuaugcaugaa

SEQ ID NO: 145752 - RNA, 22 nt, Human
gaauaagaauccacuucuggca

SEQ ID NO: 145753 - RNA, 22 nt, Human
aagaaaagcaucuuuguaguag

SEQ ID NO: 145754 - RNA, 22 nt, Human
ccugacucugauuucgcugcau

SEQ ID NO: 145755 - RNA, 22 nt, Human
aaaggaaacuaugaaucucugg

SEQ ID NO: 145756 - RNA, 22 nt, Human
guggaaggaauuaacagacuag

SEQ ID NO: 145757 - RNA, 22 nt, Human
agguguaauuacucuugcaguu

SEQ ID NO: 145758 - RNA, 22 nt, Human
gcugggacacacagucuucuuu

SEQ ID NO: 145759 - RNA, 22 nt, Human
ucauaagucucauauaugucca

SEQ ID NO: 145760 - RNA, 22 nt, Human
uuaaucagacauucucaaguuu

SEQ ID NO: 145761 - RNA, 22 nt, Human
uguugaaacagcuauugacuuu

SEQ ID NO: 145762 - RNA, 23 nt, Human
uugcuuuugccccaaaagaguua

SEQ ID NO: 145763 - RNA, 22 nt, Human
auuuccacaaauuaagauugca

SEQ ID NO: 145764 - RNA, 22 nt, Human
ucagcucucucuuggugaucuc

SEQ ID NO: 145765 - RNA, 22 nt, Human
cuccacagccccuccaguggca

SEQ ID NO: 145766 - RNA, 22 nt, Human
gaggggaacaggcauucuuaag

SEQ ID NO: 145767 - RNA, 22 nt, Human
aggaaaaagaagaaaagaauca

SEQ ID NO: 145768 - RNA, 22 nt, Human
gcugucccccaaagaugcuccu

SEQ ID NO: 145769 - RNA, 22 nt, Human
aaaauauaaaggauguggguuu

SEQ ID NO: 145770 - RNA, 22 nt, Human
uugggaacaggcuucccacugg

SEQ ID NO: 145771 - RNA, 22 nt, Human
ugggcagggagcuggaaccaca

SEQ ID NO: 145772 - RNA, 22 nt, Human
auuugcuuguucaccaguacuu

SEQ ID NO: 145773 - RNA, 22 nt, Human
aaauagucagaaaucaacgugc

SEQ ID NO: 145774 - RNA, 22 nt, Human
ggagacagugacuuagagacug

SEQ ID NO: 145775 - RNA, 22 nt, Human
uuuuuauaagauuuaaaaugua

SEQ ID NO: 145776 - RNA, 22 nt, Human
uccagccugaacuuuguccaga

SEQ ID NO: 145777 - RNA, 22 nt, Human
uugcaagcccugaagggcugga

SEQ ID NO: 145778 - RNA, 22 nt, Human
ggcagggaauucagagggaagg

SEQ ID NO: 145779 - RNA, 22 nt, Human
uucacugugauguuuaagagaa

SEQ ID NO: 145780 - RNA, 22 nt, Human
aucuucuuucaucagccccuca

SEQ ID NO: 145781 - RNA, 22 nt, Human
cacugcacuccagccugggcaa

SEQ ID NO: 145782 - RNA, 22 nt, Human
uauaagaaaagucauuaucaaa

SEQ ID NO: 145783 - RNA, 17 nt, Human
aguuacugcacuugcca

SEQ ID NO: 145784 - RNA, 22 nt, Human
ucauacuuuuuugacccuugug

SEQ ID NO: 145785 - RNA, 22 nt, Human
uuugaagaccuuaucucuaaau

SEQ ID NO: 145786 - RNA, 22 nt, Human
cagaggagcgaguuggacgcca

SEQ ID NO: 145787 - RNA, 22 nt, Human
ugggccaaaugucugcauaagu

SEQ ID NO: 145788 - RNA, 22 nt, Human
ccuucugcuggucaucccagug

SEQ ID NO: 145789 - RNA, 22 nt, Human
gagggcugccacguugggcgag

SEQ ID NO: 145790 - RNA, 21 nt, Human
uuucauuaguacaucaauuug

SEQ ID NO: 145791 - RNA, 22 nt, Human
aucauguauaugcagcguuugu

SEQ ID NO: 145792 - RNA, 22 nt, Human
cuccagcagaaagggcgagugg

SEQ ID NO: 145793 - RNA, 22 nt, Human
uggggagacauggaguaaaaga

SEQ ID NO: 145794 - RNA, 22 nt, Human
auuucaacagaguuugaaggca

SEQ ID NO: 145795 - RNA, 22 nt, Human
auguauauauacauguauugua

SEQ ID NO: 145796 - RNA, 22 nt, Human
ucccaagugcuccucuggcccc

SEQ ID NO: 145797 - RNA, 22 nt, Human
aagauauauaaggaaguucagu

SEQ ID NO: 145798 - RNA, 22 nt, Human
ccagcaggagacuagcaacaua

SEQ ID NO: 145799 - RNA, 22 nt, Human
uuuguuuuggugucaugcguga

SEQ ID NO: 145800 - RNA, 22 nt, Human
auuuaaagaguaauacaaucca

SEQ ID NO: 145801 - RNA, 22 nt, Human
ucagacacacaacuucugcuua

SEQ ID NO: 145802 - RNA, 22 nt, Human
cagggcagaguuaagaugcugg

SEQ ID NO: 145803 - RNA, 22 nt, Human
caagaaguugacagccagguga

SEQ ID NO: 145804 - RNA, 22 nt, Human
guggugguguuggugacaaguu

SEQ ID NO: 145805 - RNA, 22 nt, Human
uaauauauuuuuuaagggaugu

SEQ ID NO: 145806 - RNA, 22 nt, Human
gcccuagaguugagagcaccca

SEQ ID NO: 145807 - RNA, 22 nt, Human
cgaggagguccaggagcaguag

SEQ ID NO: 145808 - RNA, 22 nt, Human
uuacuuaucugaugugauuuuu

SEQ ID NO: 145809 - RNA, 22 nt, Human
cccagagggcugaggauaugaa

SEQ ID NO: 145810 - RNA, 20 nt, Human
acagagauccucucuuuauc

SEQ ID NO: 145811 - RNA, 22 nt, Human
ucagcucacaauguugagaaag

SEQ ID NO: 145812 - RNA, 18 nt, Human
uuuaauaagccuguuaug

SEQ ID NO: 145813 - RNA, 17 nt, Human
augcccagggcucccug

SEQ ID NO: 145814 - RNA, 22 nt, Human
cugaguuuuucaaaucugaauu

SEQ ID NO: 145815 - RNA, 22 nt, Human
cuggaaaaauggauccugucuu

SEQ ID NO: 145816 - RNA, 22 nt, Human
cuucuuuucuacuggccuagaa

SEQ ID NO: 145817 - RNA, 22 nt, Human
uucuggagucuauuuugaaaag

SEQ ID NO: 145818 - RNA, 22 nt, Human
aauguugaaccuuuuuggccug

SEQ ID NO: 145819 - RNA, 22 nt, Human
ccugggccuaaacaaacaagag

SEQ ID NO: 145820 - RNA, 23 nt, Human
uggaaguugagagucugcuuugu

SEQ ID NO: 145821 - RNA, 22 nt, Human
ucugaggacagugcugugccug

SEQ ID NO: 145822 - RNA, 22 nt, Human
uguguuguuggggauguuuuca

SEQ ID NO: 145823 - RNA, 22 nt, Human
auauguuaugccauuuucaagg

SEQ ID NO: 145824 - RNA, 22 nt, Human
auuaugaauuguguuacgaaga

SEQ ID NO: 145825 - RNA, 22 nt, Human
ccuccuuuccuguuuuccugag

SEQ ID NO: 145826 - RNA, 22 nt, Human
ucucaaagagcuacuggucuau

SEQ ID NO: 145827 - RNA, 22 nt, Human
uuugcauuaguuuagauuucaa

SEQ ID NO: 145828 - RNA, 22 nt, Human
uaguucugaauagcauugaaga

SEQ ID NO: 145829 - RNA, 22 nt, Human
acugcaggucccaucaccugcg

SEQ ID NO: 145830 - RNA, 22 nt, Human
ugccuaguuuaaaucauuuucu

SEQ ID NO: 145831 - RNA, 22 nt, Human
guucuucagcccucagguccua

SEQ ID NO: 145832 - RNA, 22 nt, Human
ucauuuuaucaggaauggaauc

SEQ ID NO: 145833 - RNA, 22 nt, Human
augaaaacgugugugugugugu

SEQ ID NO: 145834 - RNA, 22 nt, Human
guggcaguaaagcuggaaaagu

SEQ ID NO: 145835 - RNA, 22 nt, Human
aggugagaacguggaggggcgg

SEQ ID NO: 145836 - RNA, 22 nt, Human
aggcauauaguguuuaaaaaaa

SEQ ID NO: 145837 - RNA, 22 nt, Human
ucaccaugcccuucucugcucu

SEQ ID NO: 145838 - RNA, 20 nt, Human
ucacuguaauugccuacauu

SEQ ID NO: 145839 - RNA, 20 nt, Human
uccaguuuuggagacauucu

SEQ ID NO: 145840 - RNA, 21 nt, Human
auauuguugggguuuucuuuu

SEQ ID NO: 145841 - RNA, 22 nt, Human
aggccacucagggggccaagau

SEQ ID NO: 145842 - RNA, 22 nt, Human
ugcaaggcacccacucugcuuu

SEQ ID NO: 145843 - RNA, 20 nt, Human
gauuuaacgcugcgucuguc

SEQ ID NO: 145844 - RNA, 22 nt, Human
acugaacuaaagaaaugggcaa

SEQ ID NO: 145845 - RNA, 22 nt, Human
ggaggaggggcggggaggggag

SEQ ID NO: 145846 - RNA, 22 nt, Human
gaugauaacagcauuucaacug

SEQ ID NO: 145847 - RNA, 22 nt, Human
uuuauuuagguaaacaugaguu

SEQ ID NO: 145848 - RNA, 22 nt, Human
gugaaauuguacacucaguacc

SEQ ID NO: 145849 - RNA, 17 nt, Human
uuagagcuacauguuga

SEQ ID NO: 145850 - RNA, 22 nt, Human
acagcagguuauuguuauggca

SEQ ID NO: 145851 - RNA, 22 nt, Human
cacugguugccucuuucuguuc

SEQ ID NO: 145852 - RNA, 22 nt, Human
uagcauuucacugaucuucacu

SEQ ID NO: 145853 - RNA, 22 nt, Human
guggauggagcuggaagccauu

SEQ ID NO: 145854 - RNA, 22 nt, Human
uccucagcaagacgcuggcagc

SEQ ID NO: 145855 - RNA, 22 nt, Human
ggggcucauuugcaggggggag

SEQ ID NO: 145856 - RNA, 22 nt, Human
aucuaaaacuacgaauacuacc

SEQ ID NO: 145857 - RNA, 22 nt, Human
gccugggcuuccgggacccggg

SEQ ID NO: 145858 - RNA, 22 nt, Human
guuuccaggcuuugguaugguu

SEQ ID NO: 145859 - RNA, 22 nt, Human
uuucuugugauuuugaugaacu

SEQ ID NO: 145860 - RNA, 22 nt, Human
aaagggagauaaaguaauuuua

SEQ ID NO: 145861 - RNA, 18 nt, Human
uuccauuuuucagucuuc

SEQ ID NO: 145862 - RNA, 19 nt, Human
ugcagcuguaugagcuuaa

SEQ ID NO: 145863 - RNA, 22 nt, Human
uucucugcgcuccggcccaguu

SEQ ID NO: 145864 - RNA, 22 nt, Human
uaaaggcaaacucuccaaggau

SEQ ID NO: 145865 - RNA, 22 nt, Human
uucuugugugaauauaauuaca

SEQ ID NO: 145866 - RNA, 22 nt, Human
ggaaauauaagcaguuugugug

SEQ ID NO: 145867 - RNA, 22 nt, Human
gcagggcucagccgcucccacc

SEQ ID NO: 145868 - RNA, 22 nt, Human
cucuauuuuuucaucuuucagg

SEQ ID NO: 145869 - RNA, 22 nt, Human
augguguaagacuguauuucuu

SEQ ID NO: 145870 - RNA, 22 nt, Human
ucugcccaggaggucccauggg

SEQ ID NO: 145871 - RNA, 22 nt, Human
aaauauauauaauauauauauu

SEQ ID NO: 145872 - RNA, 21 nt, Human
acugggcuagccugacuucug

SEQ ID NO: 145873 - RNA, 22 nt, Human
aaacccuagcguuguuuauuga

SEQ ID NO: 145874 - RNA, 19 nt, Human
acugggaugggcagugcca

SEQ ID NO: 145875 - RNA, 22 nt, Human
auguguguaugacugaaucuau

SEQ ID NO: 145876 - RNA, 22 nt, Human
uggaagggguuacgcagcagga

SEQ ID NO: 145877 - RNA, 22 nt, Human
uuuaaucaguugguaauauuga

SEQ ID NO: 145878 - RNA, 22 nt, Human
ugugaagaauuaaugugaauca

SEQ ID NO: 145879 - RNA, 22 nt, Human
ggcugggagguggcgaggaggc

SEQ ID NO: 145880 - RNA, 22 nt, Human
aaauguaaacuguauuuauaaa

SEQ ID NO: 145881 - RNA, 22 nt, Human
agacuccuucuaagaccucauu

SEQ ID NO: 145882 - RNA, 23 nt, Human
gugagaccagagccuauucucag

SEQ ID NO: 145883 - RNA, 22 nt, Human
gaggagggagcuggaagcucuu

SEQ ID NO: 145884 - RNA, 22 nt, Human
cgggaggcggagcuccgcgggg

SEQ ID NO: 145885 - RNA, 22 nt, Human
uggguucaaauccugguuccac

SEQ ID NO: 145886 - RNA, 23 nt, Human
aaggugaagccaccaggugagga

SEQ ID NO: 145887 - RNA, 22 nt, Human
caaagccuggggagaguaagga

SEQ ID NO: 145888 - RNA, 22 nt, Human
ugagggucgcaagcaccaggcc

SEQ ID NO: 145889 - RNA, 23 nt, Human
uauuuuccccuguaauauguauu

SEQ ID NO: 145890 - RNA, 22 nt, Human
aucuuuguaaguaaucaaagcu

SEQ ID NO: 145891 - RNA, 20 nt, Human
auggaaacacgcagccccaa

SEQ ID NO: 145892 - RNA, 22 nt, Human
gaggaggagaagcggcggcgga

SEQ ID NO: 145893 - RNA, 22 nt, Human
uggaaggggagcuggaaagggg

SEQ ID NO: 145894 - RNA, 22 nt, Human
uaagaaacauuuuuaugacagu

SEQ ID NO: 145895 - RNA, 22 nt, Human
auacacuucauguuuucaucug

SEQ ID NO: 145896 - RNA, 22 nt, Human
aauaauacaauuggugucaugu

SEQ ID NO: 145897 - RNA, 22 nt, Human
ggcagggagagcaugcugauaa

SEQ ID NO: 145898 - RNA, 22 nt, Human
aggagaaagaccagccugccga

SEQ ID NO: 145899 - RNA, 22 nt, Human
agcggaggaggcggagcaggga

SEQ ID NO: 145900 - RNA, 21 nt, Human
uuccauggacccugucagugu

SEQ ID NO: 145901 - RNA, 22 nt, Human
caggccccagggacugggcgcu

SEQ ID NO: 145902 - RNA, 22 nt, Human
guuuucuaaaacacauauaagu

SEQ ID NO: 145903 - RNA, 22 nt, Human
aaacauaugccuucuuuuguaa

SEQ ID NO: 145904 - RNA, 22 nt, Human
uggggggacagauggagaggac

SEQ ID NO: 145905 - RNA, 22 nt, Human
uucugaaacauugcuauuuucc

SEQ ID NO: 145906 - RNA, 22 nt, Human
uucugcuuuaaagcucauguuu

SEQ ID NO: 145907 - RNA, 22 nt, Human
auaaauucuaugauggauuggg

SEQ ID NO: 145908 - RNA, 22 nt, Human
agggcucacuacaacccuggga

SEQ ID NO: 145909 - RNA, 22 nt, Human
auauauguauauaugugugugu

SEQ ID NO: 145910 - RNA, 22 nt, Human
uguguuguuuggggauguccau

SEQ ID NO: 145911 - RNA, 22 nt, Human
ugguucuagaugagaugaugag

SEQ ID NO: 145912 - RNA, 22 nt, Human
uuccgcuuucaauggcuuggcu

SEQ ID NO: 145913 - RNA, 22 nt, Human
ggaggaugaggguggugguguu

SEQ ID NO: 145914 - RNA, 22 nt, Human
ugaacuguccuuguugucuaga

SEQ ID NO: 145915 - RNA, 22 nt, Human
gcaggagggggccuggagccca

SEQ ID NO: 145916 - RNA, 22 nt, Human
agccacagucuguagccagcuu

SEQ ID NO: 145917 - RNA, 21 nt, Human
gcagcaugagaaagccccaaa

SEQ ID NO: 145918 - RNA, 22 nt, Human
cuucagagugacucagcaucuu

SEQ ID NO: 145919 - RNA, 22 nt, Human
uuauaagugccucuuuauuuuc

SEQ ID NO: 145920 - RNA, 22 nt, Human
ggcugugguggacgcgggaaac

SEQ ID NO: 145921 - RNA, 23 nt, Human
uaagccugugccugcuaccugcu

SEQ ID NO: 145922 - RNA, 22 nt, Human
uauauauaugcaccacaugugu

SEQ ID NO: 145923 - RNA, 22 nt, Human
ggaagcuguugugagugcagca

SEQ ID NO: 145924 - RNA, 22 nt, Human
cucagcgagggaaagaggccgc

SEQ ID NO: 145925 - RNA, 20 nt, Human
gacaugagggagcaaagagc

SEQ ID NO: 145926 - RNA, 22 nt, Human
auuuuucuuucacauuuucuua

SEQ ID NO: 145927 - RNA, 22 nt, Human
gcauccaaggagcagaagugau

SEQ ID NO: 145928 - RNA, 22 nt, Human
gcugcccucccagggcaagcuu

SEQ ID NO: 145929 - RNA, 22 nt, Human
uccagggaggggcggcaggggu

SEQ ID NO: 145930 - RNA, 22 nt, Human
agggaggagggacagaaagagg

SEQ ID NO: 145931 - RNA, 22 nt, Human
auuauugcaagcagugaaggga

SEQ ID NO: 145932 - RNA, 22 nt, Human
gagggagugggcccgugggcac

SEQ ID NO: 145933 - RNA, 22 nt, Human
ugcaaauuuuuuuauuuuuccu

SEQ ID NO: 145934 - RNA, 20 nt, Human
cuccuccccucggccccacc

SEQ ID NO: 145935 - RNA, 22 nt, Human
agaauacaauuguucaguaaua

SEQ ID NO: 145936 - RNA, 20 nt, Human
ccugggcuccaggagccccg

SEQ ID NO: 145937 - RNA, 22 nt, Human
uuuuauaaaaccuguuugaccu

SEQ ID NO: 145938 - RNA, 22 nt, Human
gaguaaaagaugaggcaguaga

SEQ ID NO: 145939 - RNA, 22 nt, Human
agucacuguuuaaucuagcuaa

SEQ ID NO: 145940 - RNA, 22 nt, Human
guugauaauuaauagcuuuuga

SEQ ID NO: 145941 - RNA, 22 nt, Human
gaggguggggaauagacugcua

SEQ ID NO: 145942 - RNA, 22 nt, Human
gagaaaaauuucuuugcugcac

SEQ ID NO: 145943 - RNA, 23 nt, Human
aaguggugacugugcuacugaga

SEQ ID NO: 145944 - RNA, 22 nt, Human
aaggaaaguuaagguaaacucu

SEQ ID NO: 145945 - RNA, 22 nt, Human
ugcauguuucuguauguuaaug

SEQ ID NO: 145946 - RNA, 22 nt, Human
acuuagaacagccuaugggaag

SEQ ID NO: 145947 - RNA, 22 nt, Human
aucuguuccccuaugcucucua

SEQ ID NO: 145948 - RNA, 23 nt, Human
aggcugcagaagaauagggucau

SEQ ID NO: 145949 - RNA, 22 nt, Human
uggcuucagacuucugcuacgu

SEQ ID NO: 145950 - RNA, 18 nt, Human
aggcuggggaucacaggg

SEQ ID NO: 145951 - RNA, 22 nt, Human
uaacauuuaguuuuaagauggu

SEQ ID NO: 145952 - RNA, 22 nt, Human
cugugaaugguggccacgcguu

SEQ ID NO: 145953 - RNA, 22 nt, Human
aguuuaaauuguucuaucagaa

SEQ ID NO: 145954 - RNA, 22 nt, Human
cucaucagagcccuccucuggc

SEQ ID NO: 145955 - RNA, 20 nt, Human
ccuuguggaugucuuuuuug

SEQ ID NO: 145956 - RNA, 22 nt, Human
cuauuaauggccaggagucaug

SEQ ID NO: 145957 - RNA, 22 nt, Human
aagcucagcugguggugauugc

SEQ ID NO: 145958 - RNA, 22 nt, Human
ggcaagcacugggugucuuagc

SEQ ID NO: 145959 - RNA, 22 nt, Human
augcuuucucuucuauuucuca

SEQ ID NO: 145960 - RNA, 22 nt, Human
caugccugaucagcggccagca

SEQ ID NO: 145961 - RNA, 22 nt, Human
auaguaaauguuaacagcaaca

SEQ ID NO: 145962 - RNA, 22 nt, Human
agggaggcccagcagacuggcg

SEQ ID NO: 145963 - RNA, 22 nt, Human
agagacaggguuuugucguguu

SEQ ID NO: 145964 - RNA, 22 nt, Human
aauuaaauguuugguuugagcu

SEQ ID NO: 145965 - RNA, 22 nt, Human
uuauuuuuaggaauguagaggu

SEQ ID NO: 145966 - RNA, 22 nt, Human
uggucugggaagaucacaauua

SEQ ID NO: 145967 - RNA, 22 nt, Human
auuagaagagcuuuuuacucuu

SEQ ID NO: 145968 - RNA, 22 nt, Human
gguggcagaggaggcgggagag

SEQ ID NO: 145969 - RNA, 22 nt, Human
aauguuguaaauauucuuugag

SEQ ID NO: 145970 - RNA, 22 nt, Human
uguugucaugcagucaguggua

SEQ ID NO: 145971 - RNA, 22 nt, Human
acauggcaugaauaauguguac

SEQ ID NO: 145972 - RNA, 22 nt, Human
uauauacuugaaaauugcugag

SEQ ID NO: 145973 - RNA, 22 nt, Human
aauggcaagccacaugcuuuuc

SEQ ID NO: 145974 - RNA, 22 nt, Human
ugucccaucacagaggagacua

SEQ ID NO: 145975 - RNA, 22 nt, Human
auuauaauucauuaggcuuagu

SEQ ID NO: 145976 - RNA, 18 nt, Human
gacaaaaguacagacaga

SEQ ID NO: 145977 - RNA, 22 nt, Human
guggagaaauauguucagcuuc

SEQ ID NO: 145978 - RNA, 22 nt, Human
cagcuucaugacaaacaguuuu

SEQ ID NO: 145979 - RNA, 22 nt, Human
aggcuuagaugaguucccacau

SEQ ID NO: 145980 - RNA, 22 nt, Human
ugcccacuuugucuccaugcug

SEQ ID NO: 145981 - RNA, 22 nt, Human
caggcagggagcuggaaaggau

SEQ ID NO: 145982 - RNA, 22 nt, Human
agcaggaggguuuuguagaguc

SEQ ID NO: 145983 - RNA, 22 nt, Human
auaaaacagaucaggagaauga

SEQ ID NO: 145984 - RNA, 22 nt, Human
agcaagggucucucauggcuug

SEQ ID NO: 145985 - RNA, 22 nt, Human
agaaacaagcccuagaaguccu

SEQ ID NO: 145986 - RNA, 22 nt, Human
gaggacccuuaggucagacaga

SEQ ID NO: 145987 - RNA, 22 nt, Human
ugugucuuuggcgaugucugga

SEQ ID NO: 145988 - RNA, 22 nt, Human
aagagaggcccaaguggcuggc

SEQ ID NO: 145989 - RNA, 22 nt, Human
gaaaauaguucaucacaaugau

SEQ ID NO: 145990 - RNA, 20 nt, Human
aggggcuguaguuagaugac

SEQ ID NO: 145991 - RNA, 22 nt, Human
cucacugucagcugcagggcuu

SEQ ID NO: 145992 - RNA, 22 nt, Human
guggagaaagcuggaaucugag

SEQ ID NO: 145993 - RNA, 21 nt, Human
acuccagccacugacugucuc

SEQ ID NO: 145994 - RNA, 22 nt, Human
cauuuacauaacaguaacgcug

SEQ ID NO: 145995 - RNA, 22 nt, Human
uuuuuggacccaucuucuuuuu

SEQ ID NO: 145996 - RNA, 22 nt, Human
uugugcauuuuguuuuacuuau

SEQ ID NO: 145997 - RNA, 22 nt, Human
aaauguuugguggauaaaagga

SEQ ID NO: 145998 - RNA, 22 nt, Human
ggagggaggggugggagaugga

SEQ ID NO: 145999 - RNA, 22 nt, Human
ugcuuaaccagccccuucccuu

SEQ ID NO: 146000 - RNA, 22 nt, Human
aaauguauuagccuaugugaga

SEQ ID NO: 146001 - RNA, 22 nt, Human
gagguagaggaaaagauuauca

SEQ ID NO: 146002 - RNA, 23 nt, Human
uuucugaguuuuuuaaaagucca

SEQ ID NO: 146003 - RNA, 22 nt, Human
cagaccagaaggaagccgacaa

SEQ ID NO: 146004 - RNA, 22 nt, Human
ugucuuuuaaaaauguguaaaa

SEQ ID NO: 146005 - RNA, 22 nt, Human
uugaaaaaaucugaggaggacc

SEQ ID NO: 146006 - RNA, 22 nt, Human
auuaaaaaaagauaaugaguua

SEQ ID NO: 146007 - RNA, 20 nt, Human
uaguggaccuugaaggccuc

SEQ ID NO: 146008 - RNA, 22 nt, Human
agcagcugagccccagcuguga

SEQ ID NO: 146009 - RNA, 22 nt, Human
cucuaagcuuugguguuucacu

SEQ ID NO: 146010 - RNA, 22 nt, Human
uccagaaaucucuguugauugu

SEQ ID NO: 146011 - RNA, 22 nt, Human
uauuguauuagcucuuggagau

SEQ ID NO: 146012 - RNA, 22 nt, Human
gugcucaagacauuaggaauau

SEQ ID NO: 146013 - RNA, 22 nt, Human
uuucaugauuaacuuagugaau

SEQ ID NO: 146014 - RNA, 22 nt, Human
gagcagcugagcuggaaugaga

SEQ ID NO: 146015 - RNA, 23 nt, Human
gccaaacugcccguucucucugc

SEQ ID NO: 146016 - RNA, 22 nt, Human
cuguuaauugugaauuuuacau

SEQ ID NO: 146017 - RNA, 22 nt, Human
gcuguugugaggaucagcauau

SEQ ID NO: 146018 - RNA, 23 nt, Human
uguaaaacaccguuauugcaccu

SEQ ID NO: 146019 - RNA, 23 nt, Human
cuuauauaaucauuagaaaccau

SEQ ID NO: 146020 - RNA, 23 nt, Human
uuuuccaaaucgacucucuaguu

SEQ ID NO: 146021 - RNA, 22 nt, Human
ugaaucaaugaauugcacuuca

SEQ ID NO: 146022 - RNA, 22 nt, Human
cugcugugcagacagacucucu

SEQ ID NO: 146023 - RNA, 22 nt, Human
aguucaauuguuuuguaaaagu

SEQ ID NO: 146024 - RNA, 19 nt, Human
gcugggauaggauguauuu

SEQ ID NO: 146025 - RNA, 22 nt, Human
uuuuuuuccaguuauucauuuu

SEQ ID NO: 146026 - RNA, 18 nt, Human
acucugaagcuaagucac

SEQ ID NO: 146027 - RNA, 22 nt, Human
guuuauucuuuuauuugugaga

SEQ ID NO: 146028 - RNA, 22 nt, Human
gccagggcucgagcaggccagc

SEQ ID NO: 146029 - RNA, 22 nt, Human
auuuucuugucucuguuguagg

SEQ ID NO: 146030 - RNA, 22 nt, Human
ugaauaaauaaacuuuuacuac

SEQ ID NO: 146031 - RNA, 22 nt, Human
auccugugggguauugcugcau

SEQ ID NO: 146032 - RNA, 22 nt, Human
auguuguugaacucuuugcaug

SEQ ID NO: 146033 - RNA, 19 nt, Human
agcaucuccacagaaaaag

SEQ ID NO: 146034 - RNA, 21 nt, Human
uucugcuguucaccaccaccc

SEQ ID NO: 146035 - RNA, 22 nt, Human
auuuuuuuggucauaugagaua

SEQ ID NO: 146036 - RNA, 22 nt, Human
uaaauuugugaauuagcuauca

SEQ ID NO: 146037 - RNA, 22 nt, Human
agauauuauuuucuauuuauca

SEQ ID NO: 146038 - RNA, 22 nt, Human
ugugugcuaguuuugucaguau

SEQ ID NO: 146039 - RNA, 22 nt, Human
auuuauuugaagagccauugca

SEQ ID NO: 146040 - RNA, 22 nt, Human
ucaccauguacaugaagggcgg

SEQ ID NO: 146041 - RNA, 22 nt, Human
guggcaaguuuucugacaagga

SEQ ID NO: 146042 - RNA, 22 nt, Human
uguauauguguguagcauguua

SEQ ID NO: 146043 - RNA, 22 nt, Human
agggcaguuuuacugaaaggug

SEQ ID NO: 146044 - RNA, 22 nt, Human
aagaaggaaggcaagagauggg

SEQ ID NO: 146045 - RNA, 22 nt, Human
gaggcuugccacuguccauggc

SEQ ID NO: 146046 - RNA, 22 nt, Human
acauauaugugcauacaacuau

SEQ ID NO: 146047 - RNA, 22 nt, Human
uuuuuaaaauuaggacggcacg

SEQ ID NO: 146048 - RNA, 22 nt, Human
augaaaacggaccagagcuauu

SEQ ID NO: 146049 - RNA, 22 nt, Human
auaccuauagcagacugagacu

SEQ ID NO: 146050 - RNA, 17 nt, Human
uagccagcuugugauuu

SEQ ID NO: 146051 - RNA, 19 nt, Human
agcucaggcccaucguccc

SEQ ID NO: 146052 - RNA, 22 nt, Human
ugucacagugcacagcuaagaa

SEQ ID NO: 146053 - RNA, 22 nt, Human
cacauuuuccagaagaaucaga

SEQ ID NO: 146054 - RNA, 22 nt, Human
gugccugcucauucucaauauu

SEQ ID NO: 146055 - RNA, 22 nt, Human
uaaagcacucaaaauuguagcu

SEQ ID NO: 146056 - RNA, 22 nt, Human
cauggcaggugcagauucugug

SEQ ID NO: 146057 - RNA, 22 nt, Human
uccagaaagccguugacuuauu

SEQ ID NO: 146058 - RNA, 22 nt, Human
uuuaacauaugaaagaauauuu

SEQ ID NO: 146059 - RNA, 22 nt, Human
ccagggaggucauagugcuggu

SEQ ID NO: 146060 - RNA, 22 nt, Human
aggccagggacaaugaggcaga

SEQ ID NO: 146061 - RNA, 22 nt, Human
aagaaauagauagaggaauacu

SEQ ID NO: 146062 - RNA, 22 nt, Human
ucucccaaaucuuucuagcaca

SEQ ID NO: 146063 - RNA, 22 nt, Human
auuauucaaggugaggguaaaa

SEQ ID NO: 146064 - RNA, 22 nt, Human
uuaauauuuauugguaaucacu

SEQ ID NO: 146065 - RNA, 23 nt, Human
uuugaaucauuguggggcuuuug

SEQ ID NO: 146066 - RNA, 22 nt, Human
cuuuuucuugugguuaauaucu

SEQ ID NO: 146067 - RNA, 22 nt, Human
auuaucugacugaguagucugu

SEQ ID NO: 146068 - RNA, 22 nt, Human
augcccagaacccccuggaugg

SEQ ID NO: 146069 - RNA, 22 nt, Human
auuuuugguuucaccugcacgc

SEQ ID NO: 146070 - RNA, 22 nt, Human
uuccucauucuggggcauguug

SEQ ID NO: 146071 - RNA, 22 nt, Human
auacaugacucacacauucugc

SEQ ID NO: 146072 - RNA, 22 nt, Human
uuauauuuuauuuaauuaaaua

SEQ ID NO: 146073 - RNA, 22 nt, Human
uaaagugaaguucagaauggcu

SEQ ID NO: 146074 - RNA, 22 nt, Human
gcucccaauuccuuuuacaauu

SEQ ID NO: 146075 - RNA, 22 nt, Human
cagagaggagcacaaagugaag

SEQ ID NO: 146076 - RNA, 22 nt, Human
guacugguuuucuuacucuggc

SEQ ID NO: 146077 - RNA, 22 nt, Human
cucugcuagaaggucaaucucu

SEQ ID NO: 146078 - RNA, 23 nt, Human
uaaauuuuauucugauaacacag

SEQ ID NO: 146079 - RNA, 22 nt, Human
agauucucccuccuggcgcugu

SEQ ID NO: 146080 - RNA, 23 nt, Human
aaauaauaauuucucuguuggga

SEQ ID NO: 146081 - RNA, 22 nt, Human
aggcaguguguagcuggaagag

SEQ ID NO: 146082 - RNA, 22 nt, Human
ccagcugcugcaccgugcaugg

SEQ ID NO: 146083 - RNA, 22 nt, Human
cauauuaugcauguuguucuuu

SEQ ID NO: 146084 - RNA, 22 nt, Human
cagacagagcucacaagucuuu

SEQ ID NO: 146085 - RNA, 22 nt, Human
uuuucauagccagaaacugaaa

SEQ ID NO: 146086 - RNA, 22 nt, Human
uauuuuaaaagcauuaauucuu

SEQ ID NO: 146087 - RNA, 22 nt, Human
gccacucaguuuaggggcaagc

SEQ ID NO: 146088 - RNA, 23 nt, Human
ucucacucauucuccucugucca

SEQ ID NO: 146089 - RNA, 22 nt, Human
ucuucaugaaauugauugcuua

SEQ ID NO: 146090 - RNA, 22 nt, Human
uggcaagcuguuggcagauagc

SEQ ID NO: 146091 - RNA, 22 nt, Human
ugggcagggauuuggggaaacu

SEQ ID NO: 146092 - RNA, 22 nt, Human
uguuccucuuagucuuaugugu

SEQ ID NO: 146093 - RNA, 22 nt, Human
uguauuuuuucccugaaauaaa

SEQ ID NO: 146094 - RNA, 22 nt, Human
ugcauuuucuaccacacccacu

SEQ ID NO: 146095 - RNA, 22 nt, Human
acucacuguuuugaaauugaac

SEQ ID NO: 146096 - RNA, 22 nt, Human
gaggagcuucagaggaaucuua

SEQ ID NO: 146097 - RNA, 22 nt, Human
acuucauuugaaaugguugaau

SEQ ID NO: 146098 - RNA, 22 nt, Human
uaaaaauuagauauguauuuag

SEQ ID NO: 146099 - RNA, 22 nt, Human
aauguguauguguauauauaug

SEQ ID NO: 146100 - RNA, 20 nt, Human
ugcagcucccccgcaguuuc

SEQ ID NO: 146101 - RNA, 22 nt, Human
auauucaaugaggucauauaag

SEQ ID NO: 146102 - RNA, 22 nt, Human
cggcugcagcggagcaggcugg

SEQ ID NO: 146103 - RNA, 22 nt, Human
cagguugucuaauuccaagggg

SEQ ID NO: 146104 - RNA, 22 nt, Human
ccagcugggucccugcuggggc

SEQ ID NO: 146105 - RNA, 22 nt, Human
uguaauuugguuagauuucuuu

SEQ ID NO: 146106 - RNA, 22 nt, Human
gaguucuagauguauuauuaau

SEQ ID NO: 146107 - RNA, 21 nt, Human
ugagcccaaagcuguauuggu

SEQ ID NO: 146108 - RNA, 22 nt, Human
gucagacucuggggccccaggc

SEQ ID NO: 146109 - RNA, 22 nt, Human
aggcugggaaguguguccugag

SEQ ID NO: 146110 - RNA, 23 nt, Human
ggccuuuuuaaccgcgagcgaca

SEQ ID NO: 146111 - RNA, 22 nt, Human
agaguguagugaaaagagauua

SEQ ID NO: 146112 - RNA, 22 nt, Human
aaaugcacaauaaaguaaaggc

SEQ ID NO: 146113 - RNA, 22 nt, Human
uuuguuuccagccuuuugucuu

SEQ ID NO: 146114 - RNA, 22 nt, Human
uacaaagugauuuuggaauuga

SEQ ID NO: 146115 - RNA, 22 nt, Human
acauauggcagguugaucaaug

SEQ ID NO: 146116 - RNA, 22 nt, Human
uuuuguuuacauuaaauuuuga

SEQ ID NO: 146117 - RNA, 22 nt, Human
aagaggaggacgguucccagaa

SEQ ID NO: 146118 - RNA, 22 nt, Human
gcauaacaacagacucuguguu

SEQ ID NO: 146119 - RNA, 21 nt, Human
caguucuaagugucaucuuuu

SEQ ID NO: 146120 - RNA, 20 nt, Human
caacacugcccauuguuugc

SEQ ID NO: 146121 - RNA, 22 nt, Human
gacggaggacaucagcaguguc

SEQ ID NO: 146122 - RNA, 22 nt, Human
cacagcuggggaagcugaggcc

SEQ ID NO: 146123 - RNA, 22 nt, Human
auuuaagacuguggugcaguuu

SEQ ID NO: 146124 - RNA, 22 nt, Human
gaggggacugucuggcuccgag

SEQ ID NO: 146125 - RNA, 22 nt, Human
cuggguguggugggugcugccg

SEQ ID NO: 146126 - RNA, 22 nt, Human
uaggcaaguggaccagagguuu

SEQ ID NO: 146127 - RNA, 22 nt, Human
gggagggaggagccccggccau

SEQ ID NO: 146128 - RNA, 22 nt, Human
agagacuguaaugagagguaca

SEQ ID NO: 146129 - RNA, 22 nt, Human
gccugggguuugcggggcugca

SEQ ID NO: 146130 - RNA, 18 nt, Human
uguugguguucacucacu

SEQ ID NO: 146131 - RNA, 22 nt, Human
gcagggcucuggagucaggcug

SEQ ID NO: 146132 - RNA, 22 nt, Human
aaauggaaguuuguucucagcc

SEQ ID NO: 146133 - RNA, 22 nt, Human
aguggcugugaaauacauggga

SEQ ID NO: 146134 - RNA, 22 nt, Human
auaaaguaaugcauauaaugug

SEQ ID NO: 146135 - RNA, 22 nt, Human
agcagggagaccaucucuuccu

SEQ ID NO: 146136 - RNA, 22 nt, Human
ccugcuggagucuaguuggucu

SEQ ID NO: 146137 - RNA, 22 nt, Human
aggacacuuccugaguggacaa

SEQ ID NO: 146138 - RNA, 22 nt, Human
acuaaguagaggagugaugauu

SEQ ID NO: 146139 - RNA, 22 nt, Human
aacaaaacauuuuacgaauaua

SEQ ID NO: 146140 - RNA, 22 nt, Human
uuuuuaaaagaugauuuaauga

SEQ ID NO: 146141 - RNA, 22 nt, Human
ugaguuucuuacucaggagcug

SEQ ID NO: 146142 - RNA, 22 nt, Human
ccaaagaauuuggaaaaucuga

SEQ ID NO: 146143 - RNA, 22 nt, Human
uuauaucagaaggugagauuga

SEQ ID NO: 146144 - RNA, 22 nt, Human
ggcagguccugaguccugaggc

SEQ ID NO: 146145 - RNA, 22 nt, Human
augcggcugugggggaauggga

SEQ ID NO: 146146 - RNA, 22 nt, Human
cagcuucuccauucuucuggcu

SEQ ID NO: 146147 - RNA, 22 nt, Human
ucugacuucuuuuauuaucauu

SEQ ID NO: 146148 - RNA, 22 nt, Human
uuuaugucaaaaguaaaaugaa

SEQ ID NO: 146149 - RNA, 22 nt, Human
cuuuacauuaauuucuacugau

SEQ ID NO: 146150 - RNA, 22 nt, Human
uauuuccugcguuucugugagc

SEQ ID NO: 146151 - RNA, 22 nt, Human
cccauuuuuuggauguguggau

SEQ ID NO: 146152 - RNA, 22 nt, Human
agcucugcuucuugggaagaug

SEQ ID NO: 146153 - RNA, 22 nt, Human
auaaaagcacaauagaguuaug

SEQ ID NO: 146154 - RNA, 22 nt, Human
agucccugauggacuggaugag

SEQ ID NO: 146155 - RNA, 22 nt, Human
ucacuguaggaaucucuaaauu

SEQ ID NO: 146156 - RNA, 22 nt, Human
aaaaaaacuaauuuuaaaugug

SEQ ID NO: 146157 - RNA, 22 nt, Human
ggagaggaggugagaggaagua

SEQ ID NO: 146158 - RNA, 22 nt, Human
aaucccaguugacagaacuguu

SEQ ID NO: 146159 - RNA, 22 nt, Human
cagguuguucugggcauggagg

SEQ ID NO: 146160 - RNA, 22 nt, Human
ggaaagagaaacaugaacuaga

SEQ ID NO: 146161 - RNA, 22 nt, Human
gaaaaagagaaggaguucagua

SEQ ID NO: 146162 - RNA, 19 nt, Human
agagucuccacuccacuug

SEQ ID NO: 146163 - RNA, 22 nt, Human
ccauuucacaucccugacaugu

SEQ ID NO: 146164 - RNA, 22 nt, Human
uaggucugaggcugcaucuugg

SEQ ID NO: 146165 - RNA, 22 nt, Human
ucugaguuaaaauuccagaggu

SEQ ID NO: 146166 - RNA, 22 nt, Human
gauacuuuguggaauccuggau

SEQ ID NO: 146167 - RNA, 22 nt, Human
uaagggagcagaagcugugaaa

SEQ ID NO: 146168 - RNA, 22 nt, Human
gcaggcaggauucagagauaca

SEQ ID NO: 146169 - RNA, 22 nt, Human
aaauguuucauucuauuuuuag

SEQ ID NO: 146170 - RNA, 22 nt, Human
cauuuagagaagauuacaagga

SEQ ID NO: 146171 - RNA, 22 nt, Human
gagaaggagcagaaaaucuccu

SEQ ID NO: 146172 - RNA, 22 nt, Human
gccugcagccagggaguucucu

SEQ ID NO: 146173 - RNA, 22 nt, Human
cauuuuaucagcacacgucacu

SEQ ID NO: 146174 - RNA, 22 nt, Human
cucuuuucaaaccuguuuaugg

SEQ ID NO: 146175 - RNA, 22 nt, Human
ucauaaguuguugacuagcaaa

SEQ ID NO: 146176 - RNA, 22 nt, Human
auguuuaauuugaaauuuuauu

SEQ ID NO: 146177 - RNA, 22 nt, Human
gcagguuguuuaaauuaggauu

SEQ ID NO: 146178 - RNA, 22 nt, Human
auuucauaaaaacuuuaccuga

SEQ ID NO: 146179 - RNA, 22 nt, Human
uauuucuagggcaugaaaauaa

SEQ ID NO: 146180 - RNA, 22 nt, Human
uauucuucaacuuuucuccucu

SEQ ID NO: 146181 - RNA, 22 nt, Human
ucucuggacggacauuuaaggu

SEQ ID NO: 146182 - RNA, 22 nt, Human
augugcauguauguaucauauu

SEQ ID NO: 146183 - RNA, 22 nt, Human
auugaaauuaauuucugcuuuc

SEQ ID NO: 146184 - RNA, 22 nt, Human
acagagcucccagccaucuccu

SEQ ID NO: 146185 - RNA, 22 nt, Human
ucuucagacuguuguucuuuug

SEQ ID NO: 146186 - RNA, 22 nt, Human
gcugcgccgggagccggggccg

SEQ ID NO: 146187 - RNA, 22 nt, Human
uucucaauggcaacuuguugcu

SEQ ID NO: 146188 - RNA, 22 nt, Human
gcccugucagcucucauggaca

SEQ ID NO: 146189 - RNA, 22 nt, Human
guacauauccuuuacguuuugu

SEQ ID NO: 146190 - RNA, 22 nt, Human
gaagcccuggaggggcuggagg

SEQ ID NO: 146191 - RNA, 22 nt, Human
uucuagcucauggugacagauc

SEQ ID NO: 146192 - RNA, 22 nt, Human
agagcuauuucuuaaaagcugu

SEQ ID NO: 146193 - RNA, 22 nt, Human
uuagucauucccucuugauauu

SEQ ID NO: 146194 - RNA, 22 nt, Human
ggcagaggaagcuggaaguggg

SEQ ID NO: 146195 - RNA, 16 nt, Human
gaauuccauugcucug

SEQ ID NO: 146196 - RNA, 22 nt, Human
gaggagagaaauguuuucugug

SEQ ID NO: 146197 - RNA, 20 nt, Human
uuuuuuaaauagagcuguug

SEQ ID NO: 146198 - RNA, 22 nt, Human
cccuguccugcuaggcccuggu

SEQ ID NO: 146199 - RNA, 22 nt, Human
ugucacagggauaccauggggc

SEQ ID NO: 146200 - RNA, 22 nt, Human
uagcacauaguaggcacaggcu

SEQ ID NO: 146201 - RNA, 22 nt, Human
cuccccuuauuccucaacauga

SEQ ID NO: 146202 - RNA, 22 nt, Human
uuuuaucagagcuugcagugug

SEQ ID NO: 146203 - RNA, 22 nt, Human
agccugugacucugugaaacca

SEQ ID NO: 146204 - RNA, 22 nt, Human
gagacugugucugucaagcuag

SEQ ID NO: 146205 - RNA, 22 nt, Human
uugcagagaacuaaagggagua

SEQ ID NO: 146206 - RNA, 22 nt, Human
cgaaaaagaagugcaccauguu

SEQ ID NO: 146207 - RNA, 22 nt, Human
ggaggagggaguucaggaguau

SEQ ID NO: 146208 - RNA, 22 nt, Human
cuuacauuuguuuaguguuucc

SEQ ID NO: 146209 - RNA, 20 nt, Human
gcauggcuggcugcugucug

SEQ ID NO: 146210 - RNA, 22 nt, Human
cucuuucauucuguccuuguuu

SEQ ID NO: 146211 - RNA, 22 nt, Human
agaacccaaggcccagggaugu

SEQ ID NO: 146212 - RNA, 22 nt, Human
gcuguggaaaaugggucuccaa

SEQ ID NO: 146213 - RNA, 22 nt, Human
gauucuaucauucuguauauua

SEQ ID NO: 146214 - RNA, 22 nt, Human
cuguuuuugccugugacaaaaa

SEQ ID NO: 146215 - RNA, 22 nt, Human
uuuuuuaaucaaguaggaaaca

SEQ ID NO: 146216 - RNA, 22 nt, Human
ugaggcaguucuuacuuguauu

SEQ ID NO: 146217 - RNA, 22 nt, Human
gagccucaggguuuuguugaca

SEQ ID NO: 146218 - RNA, 22 nt, Human
uauguacauauauguguauaua

SEQ ID NO: 146219 - RNA, 22 nt, Human
ggaaaaauggguggugauauga

SEQ ID NO: 146220 - RNA, 22 nt, Human
cugguuuauuucauaguuuguu

SEQ ID NO: 146221 - RNA, 22 nt, Human
aguaagaaagaaugauaggccu

SEQ ID NO: 146222 - RNA, 22 nt, Human
cagcacuuccuccgugagcccc

SEQ ID NO: 146223 - RNA, 22 nt, Human
auggucugcucagucucuugac

SEQ ID NO: 146224 - RNA, 22 nt, Human
gacaacuucaguaaaguagauu

SEQ ID NO: 146225 - RNA, 22 nt, Human
cugacacagccauuguccuugu

SEQ ID NO: 146226 - RNA, 22 nt, Human
uucaaacaguguagaauauaug

SEQ ID NO: 146227 - RNA, 22 nt, Human
aaagccauaucuauucuauucu

SEQ ID NO: 146228 - RNA, 22 nt, Human
ugccagcuccgaggagcugcag

SEQ ID NO: 146229 - RNA, 22 nt, Human
auccuagacuccuaugccccaa

SEQ ID NO: 146230 - RNA, 22 nt, Human
auuuuuuuaggcugucagccgc

SEQ ID NO: 146231 - RNA, 22 nt, Human
uuuuuaagguuuguuuauauau

SEQ ID NO: 146232 - RNA, 22 nt, Human
gcaacuccuaggcgaggccuuc

SEQ ID NO: 146233 - RNA, 22 nt, Human
caguggagaccugccugcugga

SEQ ID NO: 146234 - RNA, 22 nt, Human
uggucacgucgggguauugcca

SEQ ID NO: 146235 - RNA, 20 nt, Human
uggaucaccauccuguugcu

SEQ ID NO: 146236 - RNA, 22 nt, Human
uugaauaaggcauaaagauacu

SEQ ID NO: 146237 - RNA, 22 nt, Human
agggagcagcuagagggggucc

SEQ ID NO: 146238 - RNA, 22 nt, Human
cuucccaucaagcuggaggaug

SEQ ID NO: 146239 - RNA, 22 nt, Human
uguuuaaauagaacauacugca

SEQ ID NO: 146240 - RNA, 22 nt, Human
ucccauauuauggggaaaaacu

SEQ ID NO: 146241 - RNA, 22 nt, Human
uuucuauuuacagugcuaggua

SEQ ID NO: 146242 - RNA, 22 nt, Human
acccccaggacacugccucuga

SEQ ID NO: 146243 - RNA, 22 nt, Human
gggauggggagcuggaaagggg

SEQ ID NO: 146244 - RNA, 22 nt, Human
cauuuaaccccuugguacugaa

SEQ ID NO: 146245 - RNA, 22 nt, Human
gcuucuguuaggauguggcuua

SEQ ID NO: 146246 - RNA, 22 nt, Human
auauauacuuugacacauucug

SEQ ID NO: 146247 - RNA, 22 nt, Human
ucuucacagaugcauauacuuc

SEQ ID NO: 146248 - RNA, 22 nt, Human
auacaucuuaacgcgcucuugg

SEQ ID NO: 146249 - RNA, 22 nt, Human
agguggucccaauggcugggca

SEQ ID NO: 146250 - RNA, 22 nt, Human
uuucagagaaagcccaaagacu

SEQ ID NO: 146251 - RNA, 22 nt, Human
ucccagccugacagugcaucaa

SEQ ID NO: 146252 - RNA, 19 nt, Human
aacucugccgaggcaagcc

SEQ ID NO: 146253 - RNA, 22 nt, Human
aagagaggaaagggugugaggu

SEQ ID NO: 146254 - RNA, 22 nt, Human
ucacaucugugugauugucauu

SEQ ID NO: 146255 - RNA, 22 nt, Human
ucacuguuucaccgucugaagg

SEQ ID NO: 146256 - RNA, 22 nt, Human
cuggagaacucugugcuucacu

SEQ ID NO: 146257 - RNA, 23 nt, Human
cagagaaaauagaauaugcugug

SEQ ID NO: 146258 - RNA, 22 nt, Human
auuuccagcagcauauuugucu

SEQ ID NO: 146259 - RNA, 22 nt, Human
gaauuagguaauagaacuagua

SEQ ID NO: 146260 - RNA, 22 nt, Human
cuucucuuccuucucauccuca

SEQ ID NO: 146261 - RNA, 22 nt, Human
gcacucugggucaucugcugcc

SEQ ID NO: 146262 - RNA, 22 nt, Human
ggcuguggcagcuggaaguggu

SEQ ID NO: 146263 - RNA, 22 nt, Human
uuugauuuuuugagcaguguau

SEQ ID NO: 146264 - RNA, 22 nt, Human
gaggaggucaccuggugagcaa

SEQ ID NO: 146265 - RNA, 22 nt, Human
uggccaaauuggccugauguau

SEQ ID NO: 146266 - RNA, 22 nt, Human
cuacuucucccuagaucagaaa

SEQ ID NO: 146267 - RNA, 22 nt, Human
ugcauugccucuauucauuaua

SEQ ID NO: 146268 - RNA, 22 nt, Human
uagcauaaaguuucuguguggu

SEQ ID NO: 146269 - RNA, 19 nt, Human
acuggggcaggcugggcuu

SEQ ID NO: 146270 - RNA, 22 nt, Human
aaaaaguaccacuuggacacuu

SEQ ID NO: 146271 - RNA, 22 nt, Human
uuuaucaggccaucuuaugucu

SEQ ID NO: 146272 - RNA, 22 nt, Human
auggauggaagcagccugaacu

SEQ ID NO: 146273 - RNA, 22 nt, Human
aaauuaaaguuuuauuuagagc

SEQ ID NO: 146274 - RNA, 22 nt, Human
cagaccuggaaaacaggcuugc

SEQ ID NO: 146275 - RNA, 22 nt, Human
uaauugaacguucauuuuuaau

SEQ ID NO: 146276 - RNA, 22 nt, Human
cugaaagacgaggggaagucgg

SEQ ID NO: 146277 - RNA, 22 nt, Human
uuuuuuuaaguuuugauuuuag

SEQ ID NO: 146278 - RNA, 22 nt, Human
aaugaguuuguucuauuauuug

SEQ ID NO: 146279 - RNA, 22 nt, Human
gugugugucuacuuucaucucu

SEQ ID NO: 146280 - RNA, 22 nt, Human
ugcugccucccaucccucccga

SEQ ID NO: 146281 - RNA, 22 nt, Human
cacugcaaccuccaccucccgg

SEQ ID NO: 146282 - RNA, 22 nt, Human
aaauggauaaucaagauaauca

SEQ ID NO: 146283 - RNA, 22 nt, Human
cccccucuggcuccagucugac

SEQ ID NO: 146284 - RNA, 22 nt, Human
gcucccagcuuuuguccacggc

SEQ ID NO: 146285 - RNA, 22 nt, Human
ggcucccgugggaugguggagc

SEQ ID NO: 146286 - RNA, 19 nt, Human
gauauugagcugagaauuc

SEQ ID NO: 146287 - RNA, 22 nt, Human
accugcucucccucucgcaguc

SEQ ID NO: 146288 - RNA, 22 nt, Human
aauguucucuaaucuuucucuu

SEQ ID NO: 146289 - RNA, 22 nt, Human
uucccugugcaguauguuccaa

SEQ ID NO: 146290 - RNA, 19 nt, Human
uuccucaggugugaguuag

SEQ ID NO: 146291 - RNA, 22 nt, Human
gccaguggucagugggagggug

SEQ ID NO: 146292 - RNA, 20 nt, Human
cucuuuaugagaccacuguc

SEQ ID NO: 146293 - RNA, 22 nt, Human
gaggcaggaagggaggguugug

SEQ ID NO: 146294 - RNA, 22 nt, Human
cagggagguuggauuggggccu

SEQ ID NO: 146295 - RNA, 22 nt, Human
auuguuuugugaaacauaguga

SEQ ID NO: 146296 - RNA, 22 nt, Human
agaguacagaagcauuucagau

SEQ ID NO: 146297 - RNA, 21 nt, Human
aucagaggacaucucagggcc

SEQ ID NO: 146298 - RNA, 22 nt, Human
cagagguagaaguagauguuug

SEQ ID NO: 146299 - RNA, 22 nt, Human
ccucccuucccggcauggcucu

SEQ ID NO: 146300 - RNA, 22 nt, Human
uacuuuaauugcaaaaauaaau

SEQ ID NO: 146301 - RNA, 22 nt, Human
cuugcaaugaaggcacacuuau

SEQ ID NO: 146302 - RNA, 22 nt, Human
agcaaggguugguuuucugaca

SEQ ID NO: 146303 - RNA, 22 nt, Human
gagaggugaagcuaauuaauuu

SEQ ID NO: 146304 - RNA, 22 nt, Human
augccugcugucaggaacucuu

SEQ ID NO: 146305 - RNA, 23 nt, Human
uuugcaaauuggacacaaccaca

SEQ ID NO: 146306 - RNA, 22 nt, Human
aauuauguugaaauaugagaac

SEQ ID NO: 146307 - RNA, 22 nt, Human
agggcugcugcuccgggcccag

SEQ ID NO: 146308 - RNA, 22 nt, Human
uggaagaaaugguugagccaug

SEQ ID NO: 146309 - RNA, 22 nt, Human
ugcagaggagcuggaaggcugg

SEQ ID NO: 146310 - RNA, 22 nt, Human
cagaguccugcaccagcuccag

SEQ ID NO: 146311 - RNA, 22 nt, Human
uugcaucagcaggcauaauugg

SEQ ID NO: 146312 - RNA, 22 nt, Human
uugaaaaaugcccagcagacaa

SEQ ID NO: 146313 - RNA, 22 nt, Human
guaaauaucucacgaaugauuc

SEQ ID NO: 146314 - RNA, 22 nt, Human
cagagacuuuugcuccgauucu

SEQ ID NO: 146315 - RNA, 22 nt, Human
gcuggucuggcaauccucaugg

SEQ ID NO: 146316 - RNA, 22 nt, Human
cucaaaauccauaaaaucaggu

SEQ ID NO: 146317 - RNA, 22 nt, Human
agcuuucuauauaugaguugcu

SEQ ID NO: 146318 - RNA, 22 nt, Human
uucuuuucuucccuguuuauua

SEQ ID NO: 146319 - RNA, 22 nt, Human
agaaccaauacuacagcaagua

SEQ ID NO: 146320 - RNA, 22 nt, Human
cuaauuguaagcuccuugaggg

SEQ ID NO: 146321 - RNA, 22 nt, Human
agauaacauguugcagauucug

SEQ ID NO: 146322 - RNA, 22 nt, Human
auguuuucuugucuggagaagu

SEQ ID NO: 146323 - RNA, 22 nt, Human
aagugagaugggagucagagga

SEQ ID NO: 146324 - RNA, 22 nt, Human
aggccccacaaacucgccuuug

SEQ ID NO: 146325 - RNA, 22 nt, Human
ggcuccaggguaccccuggaug

SEQ ID NO: 146326 - RNA, 22 nt, Human
aggcaggcucaaugcccagucu

SEQ ID NO: 146327 - RNA, 22 nt, Human
uuucucuuucaaucugcaguac

SEQ ID NO: 146328 - RNA, 22 nt, Human
cuuggggauuuuaaagaccucu

SEQ ID NO: 146329 - RNA, 20 nt, Human
ggcagagcuaugucuguugc

SEQ ID NO: 146330 - RNA, 22 nt, Human
gaauuccaggugagagaaggua

SEQ ID NO: 146331 - RNA, 22 nt, Human
gcucucuggccugggaggagga

SEQ ID NO: 146332 - RNA, 22 nt, Human
gaaugcacacgugugugcaugc

SEQ ID NO: 146333 - RNA, 22 nt, Human
aagcucuuuccacuaaaccacu

SEQ ID NO: 146334 - RNA, 22 nt, Human
cggggcuggcguuagggaggca

SEQ ID NO: 146335 - RNA, 22 nt, Human
aggggcugagaguuugaugugg

SEQ ID NO: 146336 - RNA, 22 nt, Human
caaaacccaagugcuauugcaa

SEQ ID NO: 146337 - RNA, 22 nt, Human
aacugaaguuuucagauuuugc

SEQ ID NO: 146338 - RNA, 22 nt, Human
uccuuuauuuaugggcagugua

SEQ ID NO: 146339 - RNA, 22 nt, Human
cagggggacuuguuagguuuua

SEQ ID NO: 146340 - RNA, 22 nt, Human
ucccacgugccaucugcucugu

SEQ ID NO: 146341 - RNA, 20 nt, Human
caugaugcaaacaguaacgu

SEQ ID NO: 146342 - RNA, 22 nt, Human
aagaggaauaauaaaaauugca

SEQ ID NO: 146343 - RNA, 22 nt, Human
cagggccaggccucaggggcgc

SEQ ID NO: 146344 - RNA, 22 nt, Human
aggggauggagcuggaaggcag

SEQ ID NO: 146345 - RNA, 22 nt, Human
agagggagagauuggcaaucag

SEQ ID NO: 146346 - RNA, 22 nt, Human
gucacuuugcuugcgaugcucc

SEQ ID NO: 146347 - RNA, 22 nt, Human
agugcucagggaaugccacuga

SEQ ID NO: 146348 - RNA, 22 nt, Human
gcucagagaaaacuggggcuug

SEQ ID NO: 146349 - RNA, 22 nt, Human
gggagggggauucuggcgagaa

SEQ ID NO: 146350 - RNA, 22 nt, Human
ugauucacagacuucacaaggc

SEQ ID NO: 146351 - RNA, 22 nt, Human
gaggaggcuggagaggccagga

SEQ ID NO: 146352 - RNA, 22 nt, Human
auuugcauguuuauuucuuaga

SEQ ID NO: 146353 - RNA, 22 nt, Human
uacuuacacugaagcaaagaua

SEQ ID NO: 146354 - RNA, 22 nt, Human
gucucacuucauuuucuuagcc

SEQ ID NO: 146355 - RNA, 22 nt, Human
uauaaugucuuuguugaaaucu

SEQ ID NO: 146356 - RNA, 22 nt, Human
uucuaauauuaugauuucuaag

SEQ ID NO: 146357 - RNA, 22 nt, Human
uuugaagaaacagucuuaagag

SEQ ID NO: 146358 - RNA, 22 nt, Human
cauuagggucuuuagacagcuc

SEQ ID NO: 146359 - RNA, 22 nt, Human
ucauuuaauuuggaacucagag

SEQ ID NO: 146360 - RNA, 22 nt, Human
augugaaauuugggcucuggga

SEQ ID NO: 146361 - RNA, 22 nt, Human
guuguuuuuguuaaaacaguga

SEQ ID NO: 146362 - RNA, 23 nt, Human
uggguuucagugccaaugcugcc

SEQ ID NO: 146363 - RNA, 22 nt, Human
uggacacugguggauauggaau

SEQ ID NO: 146364 - RNA, 22 nt, Human
uuuauucuuugcuagguuccau

SEQ ID NO: 146365 - RNA, 22 nt, Human
cugucucugauaagcucgaggg

SEQ ID NO: 146366 - RNA, 22 nt, Human
aggaggcaaaugagagggcuca

SEQ ID NO: 146367 - RNA, 22 nt, Human
auagcaguauuaugagauaacu

SEQ ID NO: 146368 - RNA, 22 nt, Human
cuuacaauuuucuuggacuuuu

SEQ ID NO: 146369 - RNA, 22 nt, Human
ugagggagggggagccguucua

SEQ ID NO: 146370 - RNA, 22 nt, Human
uacuuaauuuuaaaagcuagau

SEQ ID NO: 146371 - RNA, 22 nt, Human
ccacuuugagaagcugaugaaa

SEQ ID NO: 146372 - RNA, 22 nt, Human
cauccagggguacccuggagcc

SEQ ID NO: 146373 - RNA, 22 nt, Human
aguucauaucuacuuuuccauc

SEQ ID NO: 146374 - RNA, 22 nt, Human
ucacuuccuugcagcuguagaa

SEQ ID NO: 146375 - RNA, 22 nt, Human
uucaugucuuugauucugauaa

SEQ ID NO: 146376 - RNA, 22 nt, Human
gugguggugaggcaaggggugu

SEQ ID NO: 146377 - RNA, 22 nt, Human
caaagcuucaucuguuguuuug

SEQ ID NO: 146378 - RNA, 22 nt, Human
uucuucuuuccuauaauuaauu

SEQ ID NO: 146379 - RNA, 22 nt, Human
ccccauggaaaacccaccuagg

SEQ ID NO: 146380 - RNA, 22 nt, Human
guucuucagauuccauuucagu

SEQ ID NO: 146381 - RNA, 22 nt, Human
uuuuuguaaaugaaguuuuauu

SEQ ID NO: 146382 - RNA, 22 nt, Human
aggaaaauggaccagaguuguu

SEQ ID NO: 146383 - RNA, 22 nt, Human
aagagaaagggaaaaugguaaa

SEQ ID NO: 146384 - RNA, 17 nt, Human
ggaagaaaaggaucauc

SEQ ID NO: 146385 - RNA, 22 nt, Human
cuucuggaggcugcagaaaaga

SEQ ID NO: 146386 - RNA, 22 nt, Human
uaugggcaagagauaggugguc

SEQ ID NO: 146387 - RNA, 22 nt, Human
cuucauccguaccacggccaca

SEQ ID NO: 146388 - RNA, 22 nt, Human
uuuaauuauaucugggcaguua

SEQ ID NO: 146389 - RNA, 22 nt, Human
caggggcuccaggugagccugg

SEQ ID NO: 146390 - RNA, 22 nt, Human
agagggagccugcacagcuuuc

SEQ ID NO: 146391 - RNA, 22 nt, Human
ggggagggcugagcacgguuga

SEQ ID NO: 146392 - RNA, 22 nt, Human
aucuugaaacauauaugcauuu

SEQ ID NO: 146393 - RNA, 22 nt, Human
gcugcaggaggugguagggucu

SEQ ID NO: 146394 - RNA, 22 nt, Human
uccagcugugcuccaggaggug

SEQ ID NO: 146395 - RNA, 22 nt, Human
uuucuaaaaccagaguuuauaa

SEQ ID NO: 146396 - RNA, 22 nt, Human
uauauuaaagugcuuugcagug

SEQ ID NO: 146397 - RNA, 22 nt, Human
ucccugcugggcgaucuucucu

SEQ ID NO: 146398 - RNA, 20 nt, Human
uggcccagcacgacgaggac

SEQ ID NO: 146399 - RNA, 22 nt, Human
uuucacuucgaucagaguuuuu

SEQ ID NO: 146400 - RNA, 22 nt, Human
ggcucagaggagcuggaacggu

SEQ ID NO: 146401 - RNA, 22 nt, Human
uggaaggugauucucugguuaa

SEQ ID NO: 146402 - RNA, 22 nt, Human
accugcagguguuuccacacuu

SEQ ID NO: 146403 - RNA, 22 nt, Human
gggucagggaggccccaccaug

SEQ ID NO: 146404 - RNA, 22 nt, Human
acugucuuguuguaugugagcu

SEQ ID NO: 146405 - RNA, 17 nt, Human
ucuccuggcucuaucag

SEQ ID NO: 146406 - RNA, 22 nt, Human
uugccaggagacaucuggagcc

SEQ ID NO: 146407 - RNA, 22 nt, Human
gucuugugaagacggcagaaag

SEQ ID NO: 146408 - RNA, 22 nt, Human
gcuggggaucgaaggcagagcc

SEQ ID NO: 146409 - RNA, 22 nt, Human
aauguacucgaaugauguuaag

SEQ ID NO: 146410 - RNA, 22 nt, Human
gcaguuaccuauuuuguagaaa

SEQ ID NO: 146411 - RNA, 22 nt, Human
aaaucuuucacauauuuuuuau

SEQ ID NO: 146412 - RNA, 22 nt, Human
ugguggaggugggggguauuuu

SEQ ID NO: 146413 - RNA, 22 nt, Human
uucaauuacaucagaaucuaaa

SEQ ID NO: 146414 - RNA, 19 nt, Human
ucaggaggucgaccuggca

SEQ ID NO: 146415 - RNA, 22 nt, Human
uuauauuaaaaaucgcuaacag

SEQ ID NO: 146416 - RNA, 22 nt, Human
uaggauugguguauguagguuu

SEQ ID NO: 146417 - RNA, 22 nt, Human
uuucuggacuaaagggagagau

SEQ ID NO: 146418 - RNA, 22 nt, Human
auauuucuacaggcugauuuua

SEQ ID NO: 146419 - RNA, 22 nt, Human
aggggagggcuggccuuuggau

SEQ ID NO: 146420 - RNA, 22 nt, Human
cauuuugguaauguucguuugc

SEQ ID NO: 146421 - RNA, 22 nt, Human
ucaacagaagugauagcuauua

SEQ ID NO: 146422 - RNA, 22 nt, Human
aaacccauauaccagcugugcu

SEQ ID NO: 146423 - RNA, 22 nt, Human
ugccuuuuguguuuggcuaauc

SEQ ID NO: 146424 - RNA, 22 nt, Human
guagaaaauagauugucucuug

SEQ ID NO: 146425 - RNA, 22 nt, Human
ggcagggagagcgccgccaugc

SEQ ID NO: 146426 - RNA, 22 nt, Human
gcugcccauugcucucccacuc

SEQ ID NO: 146427 - RNA, 22 nt, Human
ucccuucccaccccugccuuuu

SEQ ID NO: 146428 - RNA, 22 nt, Human
cugccucucaugccugcuugcu

SEQ ID NO: 146429 - RNA, 22 nt, Human
gaggccagcacccagaugcaug

SEQ ID NO: 146430 - RNA, 20 nt, Human
accccuccccacuccucgcc

SEQ ID NO: 146431 - RNA, 22 nt, Human
aauucugaggccauuuauuucc

SEQ ID NO: 146432 - RNA, 22 nt, Human
aagcucugggacugaggcuccu

SEQ ID NO: 146433 - RNA, 22 nt, Human
aaauauugaauuugaggaugua

SEQ ID NO: 146434 - RNA, 22 nt, Human
gaauggcagaaugaagcagugu

SEQ ID NO: 146435 - RNA, 22 nt, Human
uaguuucuucaacugucccagc

SEQ ID NO: 146436 - RNA, 22 nt, Human
agucacuguucugucaugucaa

SEQ ID NO: 146437 - RNA, 22 nt, Human
ugaauguggucaggaaauuguu

SEQ ID NO: 146438 - RNA, 22 nt, Human
aaaaguuguaauauuuccuuua

SEQ ID NO: 146439 - RNA, 22 nt, Human
aauuuauccuuuugcuaaagca

SEQ ID NO: 146440 - RNA, 22 nt, Human
uggaggcccagcugggggccgg

SEQ ID NO: 146441 - RNA, 22 nt, Human
agauuucaauggauauugcaag

SEQ ID NO: 146442 - RNA, 22 nt, Human
uuuccuaggaaaugauugaagu

SEQ ID NO: 146443 - RNA, 21 nt, Human
auacaguucagcuuuuacuau

SEQ ID NO: 146444 - RNA, 22 nt, Human
aauauuuugggacugaggaauu

SEQ ID NO: 146445 - RNA, 22 nt, Human
cugggacacguugugcuuuaac

SEQ ID NO: 146446 - RNA, 22 nt, Human
auuugaaaaucuaugaugugca

SEQ ID NO: 146447 - RNA, 22 nt, Human
ggacauaguugcuauggagagu

SEQ ID NO: 146448 - RNA, 22 nt, Human
cccuuuuuuauggaguuggcca

SEQ ID NO: 146449 - RNA, 22 nt, Human
gcuuuucaaguuacaauuagcu

SEQ ID NO: 146450 - RNA, 22 nt, Human
gcacuguauuuaaauauuuaaa

SEQ ID NO: 146451 - RNA, 22 nt, Human
uucaaaaugcagaauaguuugg

SEQ ID NO: 146452 - RNA, 22 nt, Human
augcaugaucccgguaugugaa

SEQ ID NO: 146453 - RNA, 22 nt, Human
accaggaguuuugaccaggggc

SEQ ID NO: 146454 - RNA, 20 nt, Human
aagacacuguccccacugga

SEQ ID NO: 146455 - RNA, 22 nt, Human
cuauguuucagauauauauaua

SEQ ID NO: 146456 - RNA, 22 nt, Human
agauggaggaaagcaguuagaa

SEQ ID NO: 146457 - RNA, 22 nt, Human
ucucucucucuuccagcauguu

SEQ ID NO: 146458 - RNA, 22 nt, Human
uuuucaaucaaguuuauuuaua

SEQ ID NO: 146459 - RNA, 22 nt, Human
uuauuucauguaaaauuuaugu

SEQ ID NO: 146460 - RNA, 22 nt, Human
agaugaugugugucuucagcua

SEQ ID NO: 146461 - RNA, 22 nt, Human
uuccagcaaagguaguguguua

SEQ ID NO: 146462 - RNA, 22 nt, Human
cuguuucucugccugcacacau

SEQ ID NO: 146463 - RNA, 22 nt, Human
gaagaaggaagaucaugcuuga

SEQ ID NO: 146464 - RNA, 22 nt, Human
guucuacaugacacucaacauu

SEQ ID NO: 146465 - RNA, 22 nt, Human
gggagguaaugggggugcaggg

SEQ ID NO: 146466 - RNA, 22 nt, Human
aggcaacagacaggcuugguuc

SEQ ID NO: 146467 - RNA, 19 nt, Human
uccuacaugagacagagag

SEQ ID NO: 146468 - RNA, 22 nt, Human
agauuaagcauuauaauuauaa

SEQ ID NO: 146469 - RNA, 22 nt, Human
ggcagaggagcuggaaacaugg

SEQ ID NO: 146470 - RNA, 22 nt, Human
cucagaauugucaccucaaaaa

SEQ ID NO: 146471 - RNA, 22 nt, Human
agccagcauauauauaguugaa

SEQ ID NO: 146472 - RNA, 19 nt, Human
uccaaaauacuuguuacug

SEQ ID NO: 146473 - RNA, 22 nt, Human
uuggaaaagaaauacucauaua

SEQ ID NO: 146474 - RNA, 21 nt, Human
aggcuuggaucuagacaggcc

SEQ ID NO: 146475 - RNA, 22 nt, Human
gaugucccuggaggggacagga

SEQ ID NO: 146476 - RNA, 22 nt, Human
aagacacuuucuaaauagaagu

SEQ ID NO: 146477 - RNA, 22 nt, Human
uguuuuguuuagguuuguuuuu

SEQ ID NO: 146478 - RNA, 22 nt, Human
uaguuuuaagcugacauuguuc

SEQ ID NO: 146479 - RNA, 19 nt, Human
ugguggaggugcaccugac

SEQ ID NO: 146480 - RNA, 22 nt, Human
uaugugaaauggaauauagaaa

SEQ ID NO: 146481 - RNA, 22 nt, Human
agucugugguccucuguaucuc

SEQ ID NO: 146482 - RNA, 22 nt, Human
ugagggaggggaaugugugcag

SEQ ID NO: 146483 - RNA, 22 nt, Human
aguaggaauucaaagagacaaa

SEQ ID NO: 146484 - RNA, 22 nt, Human
ucuauuguuauccuuuccauuu

SEQ ID NO: 146485 - RNA, 22 nt, Human
uaugaauauaccacaauuuagg

SEQ ID NO: 146486 - RNA, 22 nt, Human
agaugggacauuugucccuagg

SEQ ID NO: 146487 - RNA, 22 nt, Human
uuuuuuuuacuccggacagcuc

SEQ ID NO: 146488 - RNA, 20 nt, Human
ucagugggaaagugagagug

SEQ ID NO: 146489 - RNA, 22 nt, Human
ucgcccagguuggagugcagug

SEQ ID NO: 146490 - RNA, 22 nt, Human
aggcgaagggaccagacgguag

SEQ ID NO: 146491 - RNA, 22 nt, Human
uggaguuuuaaucuguacagaa

SEQ ID NO: 146492 - RNA, 22 nt, Human
ucucucugcuguccagcguuau

SEQ ID NO: 146493 - RNA, 22 nt, Human
gggagccucccacugggggaag

SEQ ID NO: 146494 - RNA, 22 nt, Human
guaggaaaugaauaagguaccu

SEQ ID NO: 146495 - RNA, 18 nt, Human
uucaggcucuugcaugaa

SEQ ID NO: 146496 - RNA, 17 nt, Human
ccagcugcucccucaga

SEQ ID NO: 146497 - RNA, 22 nt, Human
gagaacagauaugaugacuuca

SEQ ID NO: 146498 - RNA, 22 nt, Human
uauuucaugagugaauaucuag

SEQ ID NO: 146499 - RNA, 22 nt, Human
auucccucaagagacccacagc

SEQ ID NO: 146500 - RNA, 22 nt, Human
aauggaaaaauccacagggaac

SEQ ID NO: 146501 - RNA, 22 nt, Human
uuuauaauuguuauguuaccca

SEQ ID NO: 146502 - RNA, 22 nt, Human
uaauuuugucacagugacaugc

SEQ ID NO: 146503 - RNA, 22 nt, Human
ccagucuuggugucuguagcac

SEQ ID NO: 146504 - RNA, 22 nt, Human
cuaaaccaauauauuuucuucc

SEQ ID NO: 146505 - RNA, 22 nt, Human
gaauagauuagaaagaguaugu

SEQ ID NO: 146506 - RNA, 22 nt, Human
auggcagcggagcuggaaauga

SEQ ID NO: 146507 - RNA, 17 nt, Human
auuguuuuuaauuugca

SEQ ID NO: 146508 - RNA, 21 nt, Human
uccauucuuggugguucugca

SEQ ID NO: 146509 - RNA, 22 nt, Human
uugugugugcccaccuguggcc

SEQ ID NO: 146510 - RNA, 22 nt, Human
uggcucaguaaucgagucuccu

SEQ ID NO: 146511 - RNA, 22 nt, Human
aauauuuaccuaccugucaucu

SEQ ID NO: 146512 - RNA, 22 nt, Human
ucagucacugugaaaugaauuu

SEQ ID NO: 146513 - RNA, 22 nt, Human
cuguuacggaggcuuucuaguu

SEQ ID NO: 146514 - RNA, 22 nt, Human
cuuggcuccuucacagggagau

SEQ ID NO: 146515 - RNA, 22 nt, Human
aaacagcugcaguacacggccu

SEQ ID NO: 146516 - RNA, 22 nt, Human
uguagggaggaaggguuggaaa

SEQ ID NO: 146517 - RNA, 22 nt, Human
uuggaagacagccgucuuuauu

SEQ ID NO: 146518 - RNA, 22 nt, Human
ugcgccccgcgggccuucgggc

SEQ ID NO: 146519 - RNA, 22 nt, Human
gcugcgcugggacgccaccaac

SEQ ID NO: 146520 - RNA, 22 nt, Human
uggcaggggaaaagggguggga

SEQ ID NO: 146521 - RNA, 22 nt, Human
acacaggacacaaaagucacca

SEQ ID NO: 146522 - RNA, 22 nt, Human
gaauacaagccugccaccugga

SEQ ID NO: 146523 - RNA, 22 nt, Human
uucacugugauugggguggauu

SEQ ID NO: 146524 - RNA, 22 nt, Human
aucacuagaguuacauugccag

SEQ ID NO: 146525 - RNA, 22 nt, Human
aaggucuucgaaccuuauguua

SEQ ID NO: 146526 - RNA, 22 nt, Human
gccugcaggaaggugugccugu

SEQ ID NO: 146527 - RNA, 22 nt, Mycobacterium tuberculosis CDC1551
ugugauggagugaucggcagcc

SEQ ID NO: 146528 - RNA, 22 nt, Mycobacterium tuberculosis CDC1551
uguguacuaccggguucgcgcg

SEQ ID NO: 146529 - RNA, 21 nt, Mycobacterium tuberculosis CDC1551
cgagcucgcggcccagaguuc

SEQ ID NO: 146530 - RNA, 22 nt, Mycobacterium tuberculosis CDC1551
cgaggccgacgaaagguugccg

SEQ ID NO: 146531 - RNA, 23 nt, Mycobacterium tuberculosis CDC1551
cauccugcuggugcggaccggca

SEQ ID NO: 146532 - RNA, 22 nt, Mycobacterium tuberculosis CDC1551
cgaaggucucgacguacugcgc

SEQ ID NO: 146533 - RNA, 22 nt, Mycobacterium tuberculosis CDC1551
caggggcucgauccggccgggc

SEQ ID NO: 146534 - RNA, 21 nt, Mycobacterium tuberculosis CDC1551
cgccccagaugcacgcucggc

SEQ ID NO: 146535 - RNA, 23 nt, Mycobacterium tuberculosis CDC1551
cgagggcuuuagugucugcucgc

SEQ ID NO: 146536 - RNA, 22 nt, Mycobacterium tuberculosis CDC1551
cgauccucgcaccgcucgccgc

SEQ ID NO: 146537 - RNA, 22 nt, Mycobacterium tuberculosis CDC1551
cguggaauuucuucgccauggg

SEQ ID NO: 146538 - RNA, 22 nt, Mycobacterium tuberculosis CDC1551
cggucaccaucucgcagacaua

SEQ ID NO: 146539 - RNA, 22 nt, Mycobacterium tuberculosis CDC1551
cgggucuauggguggaugcucg

SEQ ID NO: 146540 - RNA, 22 nt, Mycobacterium tuberculosis CDC1551
cgguggugaccgccgcgacguc

SEQ ID NO: 146541 - RNA, 22 nt, Mycobacterium tuberculosis CDC1551
cugcccuggcuggccaugggcg

SEQ ID NO: 146542 - RNA, 18 nt, Mycobacterium tuberculosis CDC1551
cuccuuggacuacggcug

SEQ ID NO: 146543 - RNA, 22 nt, Mycobacterium tuberculosis CDC1551
cucagcaucgccgagcucgagc

SEQ ID NO: 146544 - RNA, 22 nt, Mycobacterium tuberculosis CDC1551
gaagcugcugggccaguucgug

SEQ ID NO: 146545 - RNA, 22 nt, Mycobacterium tuberculosis CDC1551
cuugcugguaugccgggccacc

SEQ ID NO: 146546 - RNA, 22 nt, Mycobacterium tuberculosis CDC1551
cuugggcguuugcguucgccgc

SEQ ID NO: 146547 - RNA, 22 nt, Mycobacterium tuberculosis CDC1551
gcugagacaugacgugccucac

SEQ ID NO: 146548 - RNA, 22 nt, Mycobacterium tuberculosis CDC1551
gcuguccuguggcgcccgcagc

SEQ ID NO: 146549 - RNA, 22 nt, Mycobacterium tuberculosis CDC1551
gcccgaggaggacaugaggcgc

SEQ ID NO: 146550 - RNA, 22 nt, Mycobacterium tuberculosis CDC1551
gccgagggugaaucucacgacg

SEQ ID NO: 146551 - RNA, 22 nt, Mycobacterium tuberculosis CDC1551
gccgcaccgacuaccaccgacu

SEQ ID NO: 146552 - RNA, 22 nt, Mycobacterium tuberculosis CDC1551
gcugccccgcgagcuggugcug

SEQ ID NO: 146553 - RNA, 22 nt, Mycobacterium tuberculosis CDC1551
ggcaacuccgggguggccagca

SEQ ID NO: 146554 - RNA, 22 nt, Mycobacterium tuberculosis CDC1551
ggcccggcaccggucaucguca

SEQ ID NO: 146555 - RNA, 22 nt, Mycobacterium tuberculosis CDC1551
ggccgcugucggucacguagac

SEQ ID NO: 146556 - RNA, 22 nt, Mycobacterium tuberculosis CDC1551
ggccgaaacaccgcgcgaaggg

SEQ ID NO: 146557 - RNA, 22 nt, Mycobacterium tuberculosis CDC1551
ggcgagcagacacagagucgca

SEQ ID NO: 146558 - RNA, 22 nt, Mycobacterium tuberculosis CDC1551
ggcgagagggagggccaugugg

SEQ ID NO: 146559 - RNA, 22 nt, Mycobacterium tuberculosis CDC1551
ggcgagcuugcggugcaguaug

SEQ ID NO: 146560 - RNA, 22 nt, Mycobacterium tuberculosis CDC1551
gcagcagguucaccacguaugc

SEQ ID NO: 146561 - RNA, 22 nt, Mycobacterium tuberculosis CDC1551
gacuccagccguucacguucga

SEQ ID NO: 146562 - RNA, 22 nt, Mycobacterium tuberculosis CDC1551
gacgaggucuggggucagcuga

SEQ ID NO: 146563 - RNA, 22 nt, Mycobacterium tuberculosis CDC1551
gacgccgaguaccgcgcgaugu

SEQ ID NO: 146564 - RNA, 22 nt, Mycobacterium tuberculosis CDC1551
gcaggcagugucaugccgccga

SEQ ID NO: 146565 - RNA, 22 nt, Mycobacterium tuberculosis CDC1551
gaccaugucgcggcguagccgu

SEQ ID NO: 146566 - RNA, 22 nt, Mycobacterium tuberculosis CDC1551
gccccggugcguuugugugcuu

SEQ ID NO: 146567 - RNA, 18 nt, Mycobacterium tuberculosis CDC1551
gcccuggacagguucacc

SEQ ID NO: 146568 - RNA, 22 nt, Mycobacterium tuberculosis CDC1551
gccgaacgugaagccagggcga

SEQ ID NO: 146569 - RNA, 22 nt, Mycobacterium tuberculosis CDC1551
gccagguugacguugguuucgg

SEQ ID NO: 146570 - RNA, 22 nt, Mycobacterium tuberculosis CDC1551
gccaggcuggugucggcggugg

SEQ ID NO: 146571 - RNA, 22 nt, Mycobacterium tuberculosis CDC1551
gcccaaggaaugcccccagguc

SEQ ID NO: 146572 - RNA, 21 nt, Mycobacterium tuberculosis CDC1551
gccauauaccagaucgcuggg

SEQ ID NO: 146573 - RNA, 21 nt, Mycobacterium tuberculosis CDC1551
gggcugguuccaacgacagug

SEQ ID NO: 146574 - RNA, 22 nt, Mycobacterium tuberculosis CDC1551
gggcggcauccaugucgagauu

SEQ ID NO: 146575 - RNA, 22 nt, Mycobacterium tuberculosis CDC1551
gggaguacgcgggccaggugcg

SEQ ID NO: 146576 - RNA, 22 nt, Mycobacterium tuberculosis CDC1551
gggcgagcagacgcagaaucgc

SEQ ID NO: 146577 - RNA, 22 nt, Mycobacterium tuberculosis CDC1551
ggcucacgauguagucgauccg

SEQ ID NO: 146578 - RNA, 22 nt, Mycobacterium tuberculosis CDC1551
ggcucaggucgauacccgaggg

SEQ ID NO: 146579 - RNA, 22 nt, Mycobacterium tuberculosis CDC1551
ggcuccagccgcgucagcagcg

SEQ ID NO: 146580 - RNA, 22 nt, Mycobacterium tuberculosis CDC1551
gugcagguucguacuggcaugc

SEQ ID NO: 146581 - RNA, 22 nt, Mycobacterium tuberculosis CDC1551
guggugggaaccgcuccagggc

SEQ ID NO: 146582 - RNA, 22 nt, Mycobacterium tuberculosis CDC1551
gugguggcgcaauucgaccagg

SEQ ID NO: 146583 - RNA, 22 nt, Mycobacterium tuberculosis CDC1551
gugggcagaugggugauacgca

SEQ ID NO: 146584 - RNA, 22 nt, Mycobacterium tuberculosis CDC1551
gugggugaaagugaaaggccgg

SEQ ID NO: 146585 - RNA, 22 nt, Mycobacterium tuberculosis CDC1551
guggcagccagcgccuccggga

SEQ ID NO: 146586 - RNA, 22 nt, Mycobacterium tuberculosis CDC1551
guggaggcagggaugaagcucg

SEQ ID NO: 146587 - RNA, 22 nt, Mycobacterium tuberculosis CDC1551
ggguggugaaguuggcggccgg

SEQ ID NO: 146588 - RNA, 22 nt, Mycobacterium tuberculosis CDC1551
ggucagcacgcaugugcggugg

SEQ ID NO: 146589 - RNA, 22 nt, Mycobacterium tuberculosis CDC1551
gggugguggucgccaacgccga

SEQ ID NO: 146590 - RNA, 22 nt, Mycobacterium tuberculosis CDC1551
uauguucaauaaaucauuaugu

SEQ ID NO: 146591 - RNA, 19 nt, Mycobacterium tuberculosis CDC1551
ucagcuguacucgaugaau

SEQ ID NO: 146592 - RNA, 22 nt, Mycobacterium tuberculosis CDC1551
ucaggcugggcgaaccugggca

SEQ ID NO: 146593 - RNA, 22 nt, Mycobacterium tuberculosis CDC1551
ucagcuguguccgcacaaccgg

SEQ ID NO: 146594 - RNA, 22 nt, Mycobacterium tuberculosis CDC1551
uaagugaaugccgugccguccg

SEQ ID NO: 146595 - RNA, 22 nt, Mycobacterium tuberculosis CDC1551
gugguggucuccagcgcgcucg

SEQ ID NO: 146596 - RNA, 22 nt, Mycobacterium tuberculosis CDC1551
gugguggugagcaccaacggug

SEQ ID NO: 146597 - RNA, 22 nt, Mycobacterium tuberculosis CDC1551
uaaccgcuacaaaugaaguugg

SEQ ID NO: 146598 - RNA, 22 nt, Mycobacterium tuberculosis CDC1551
ucucagacaucuugggcgccac

SEQ ID NO: 146599 - RNA, 22 nt, Mycobacterium tuberculosis CDC1551
ugacucugcguccagcaggcgg

SEQ ID NO: 146600 - RNA, 22 nt, Mycobacterium tuberculosis CDC1551
ucugugcgcgguuugugcacag

SEQ ID NO: 146601 - RNA, 23 nt, Mycobacterium tuberculosis CDC1551
ucccaggugccauacgagcugaa

SEQ ID NO: 146602 - RNA, 22 nt, Mycobacterium tuberculosis CDC1551
uccgggccggcuuugccgccgu

SEQ ID NO: 146603 - RNA, 22 nt, Mycobacterium tuberculosis CDC1551
ucagguacgcgucagcagauug

SEQ ID NO: 146604 - RNA, 22 nt, Mycobacterium tuberculosis CDC1551
ugcacuccgacccgccgacguu

SEQ ID NO: 146605 - RNA, 22 nt, Mycobacterium tuberculosis CDC1551
uggccaccgcagugggugugau

SEQ ID NO: 146606 - RNA, 22 nt, Mycobacterium tuberculosis CDC1551
uggcagcaaucggguauccgau

SEQ ID NO: 146607 - RNA, 22 nt, Mycobacterium tuberculosis CDC1551
ugaucucacccgaaguuguguc

SEQ ID NO: 146608 - RNA, 22 nt, Mycobacterium tuberculosis CDC1551
ugagggcaucgucggucgccgg

SEQ ID NO: 146609 - RNA, 22 nt, Mycobacterium tuberculosis CDC1551
ugaggaggaugaguuugcccuc

SEQ ID NO: 146610 - RNA, 22 nt, Mycobacterium tuberculosis CDC1551
ugagacccccgucgaagucuag

SEQ ID NO: 146611 - RNA, 22 nt, Mycobacterium tuberculosis CDC1551
uggcuggucggaccgucagcga

SEQ ID NO: 146612 - RNA, 22 nt, Mycobacterium tuberculosis CDC1551
ugguuucccgugaggugaucgc

SEQ ID NO: 146613 - RNA, 22 nt, Mycobacterium tuberculosis CDC1551
ugggacagcuggaaguuaucgg

SEQ ID NO: 146614 - RNA, 22 nt, Mycobacterium tuberculosis CDC1551
uggcgagcagacgcaaaagccc

SEQ ID NO: 146615 - RNA, 22 nt, Mycobacterium tuberculosis CDC1551
uggcgcgcggaucgacgacagg

SEQ ID NO: 146616 - RNA, 22 nt, Mycobacterium tuberculosis CDC1551
uggcucagcgggucaacgaggc

SEQ ID NO: 146617 - RNA, 22 nt, Mycobacterium tuberculosis CDC1551
ugucgcgcaagcucuccggcac

SEQ ID NO: 146618 - RNA, 22 nt, Mycobacterium tuberculosis CDC1551
ugucccgcacucgauccgcaag

SEQ ID NO: 146619 - RNA, 22 nt, Mycobacterium tuberculosis CDC1551
caauguuucgacgggcaccaaa

SEQ ID NO: 146620 - RNA, 22 nt, Mycobacterium tuberculosis CDC1551
caccugccgaucgcacagguug

SEQ ID NO: 146621 - RNA, 20 nt, Mycobacterium tuberculosis CDC1551
cacuccuggcuggauucggc

SEQ ID NO: 146622 - RNA, 22 nt, Mycobacterium tuberculosis CDC1551
cacgccugcgcgacauggacgc

SEQ ID NO: 146623 - RNA, 22 nt, Mycobacterium tuberculosis CDC1551
cacgagcguaaccccagugcga

SEQ ID NO: 146624 - RNA, 22 nt, Mycobacterium tuberculosis CDC1551
caacugcccgagucgcagcgcc

SEQ ID NO: 146625 - RNA, 22 nt, Mycobacterium tuberculosis CDC1551
caagaccagguacguggaccau

SEQ ID NO: 146626 - RNA, 22 nt, Mycobacterium tuberculosis CDC1551
caaguaguaggcgagaucaccg

SEQ ID NO: 146627 - RNA, 22 nt, Mycobacterium tuberculosis CDC1551
cacaccgcgaugacuccggcga

SEQ ID NO: 146628 - RNA, 22 nt, Mycobacterium tuberculosis CDC1551
caggaggugcugcgggaggcga

SEQ ID NO: 146629 - RNA, 22 nt, Mycobacterium tuberculosis CDC1551
cagcugcuccgugacuacggcu

SEQ ID NO: 146630 - RNA, 22 nt, Mycobacterium tuberculosis CDC1551
caggacgguuagugcugauggg

SEQ ID NO: 146631 - RNA, 22 nt, Mycobacterium tuberculosis CDC1551
cagcguugucucggcgaacacc

SEQ ID NO: 146632 - RNA, 22 nt, Mycobacterium tuberculosis CDC1551
cagcaaaagccauucauuucua

SEQ ID NO: 146633 - RNA, 21 nt, Mycobacterium tuberculosis CDC1551
auuugcaacgcaacggcgugc

SEQ ID NO: 146634 - RNA, 22 nt, Mycobacterium tuberculosis CDC1551
auugcgagccacgcagguugaa

SEQ ID NO: 146635 - RNA, 22 nt, Mycobacterium tuberculosis CDC1551
auggccaaccucccgacuggua

SEQ ID NO: 146636 - RNA, 22 nt, Mycobacterium tuberculosis CDC1551
augaggcgauuuugcgucugcu

SEQ ID NO: 146637 - RNA, 23 nt, Mycobacterium tuberculosis CDC1551
augacgggauucugcuucgcaaa

SEQ ID NO: 146638 - RNA, 22 nt, Mycobacterium tuberculosis CDC1551
aucugcagguuccuggguugac

SEQ ID NO: 146639 - RNA, 22 nt, Mycobacterium tuberculosis CDC1551
aucucuguagguggugggugcg

SEQ ID NO: 146640 - RNA, 22 nt, Mycobacterium tuberculosis CDC1551
aucgcuugccgaugccgucggu

SEQ ID NO: 146641 - RNA, 22 nt, Mycobacterium tuberculosis CDC1551
aucuuguaggucaccgugaacg

SEQ ID NO: 146642 - RNA, 22 nt, Mycobacterium tuberculosis CDC1551
auccaugagcagcucgccgccg

SEQ ID NO: 146643 - RNA, 22 nt, Mycobacterium tuberculosis CDC1551
aucaacacgcugcuguuguaca

SEQ ID NO: 146644 - RNA, 22 nt, Mycobacterium tuberculosis CDC1551
aggucugucggaccuggccgcg

SEQ ID NO: 146645 - RNA, 22 nt, Mycobacterium tuberculosis CDC1551
agguagagcagcaucagcgcgu

SEQ ID NO: 146646 - RNA, 22 nt, Mycobacterium tuberculosis CDC1551
agggcgagcguuuggccgggca

SEQ ID NO: 146647 - RNA, 22 nt, Mycobacterium tuberculosis CDC1551
agguagacgugucccgcauggg

SEQ ID NO: 146648 - RNA, 22 nt, Mycobacterium tuberculosis CDC1551
acaccaaggccgucagcuuggc

SEQ ID NO: 146649 - RNA, 22 nt, Mycobacterium tuberculosis CDC1551
acaccaagcgcccgcagcuugc

SEQ ID NO: 146650 - RNA, 22 nt, Mycobacterium tuberculosis CDC1551
acagacgcagaaucgcaucaaa

SEQ ID NO: 146651 - RNA, 22 nt, Mycobacterium tuberculosis CDC1551
acuggccagcccgcacaaccac

SEQ ID NO: 146652 - RNA, 22 nt, Mycobacterium tuberculosis CDC1551
acugucccgagcgcaccaggaa

SEQ ID NO: 146653 - RNA, 22 nt, Mycobacterium tuberculosis CDC1551
acugcuuuccugucugggcggc

SEQ ID NO: 146654 - RNA, 22 nt, Mycobacterium tuberculosis CDC1551
aacacuaugcagcauuugggau

SEQ ID NO: 146655 - RNA, 21 nt, Mycobacterium tuberculosis CDC1551
aagcguccggcgaugaauuga

SEQ ID NO: 146656 - RNA, 22 nt, Mycobacterium tuberculosis CDC1551
aaggcgagcgacgucuuucccg

SEQ ID NO: 146657 - RNA, 21 nt, Mycobacterium tuberculosis CDC1551
aagcugugggucgaggagucu

SEQ ID NO: 146658 - RNA, 22 nt, Mycobacterium tuberculosis CDC1551
aaggugaacucacggcgagguu

SEQ ID NO: 146659 - RNA, 22 nt, Mycobacterium tuberculosis CDC1551
aaguccagcagaucgaucucgc

SEQ ID NO: 146660 - RNA, 22 nt, Mycobacterium tuberculosis CDC1551
aaguaguaaugugcgagcugag

SEQ ID NO: 146661 - RNA, 22 nt, Mycobacterium tuberculosis CDC1551
gcagaugauccucggcggugau

SEQ ID NO: 146662 - RNA, 22 nt, Mycobacterium tuberculosis CDC1551
gcagagccgaucguccuguugc

SEQ ID NO: 146663 - RNA, 22 nt, Mycobacterium tuberculosis CDC1551
gcagacucuuggucaugggcug

SEQ ID NO: 146664 - RNA, 22 nt, Mycobacterium tuberculosis CDC1551
gcaccccagagcacugauacgc

SEQ ID NO: 146665 - RNA, 21 nt, Mycobacterium tuberculosis CDC1551
gcacacuggaagccagcacgc

SEQ ID NO: 146666 - RNA, 22 nt, Mycobacterium tuberculosis CDC1551
gcacggguucguugcugugcau

SEQ ID NO: 146667 - RNA, 20 nt, Mycobacterium tuberculosis CDC1551
gaugaugaucguguaugcga

SEQ ID NO: 146668 - RNA, 22 nt, Mycobacterium tuberculosis CDC1551
gauguagguucgggcucaugga

SEQ ID NO: 146669 - RNA, 22 nt, Mycobacterium tuberculosis CDC1551
gcggccaacgaggcagcggcgg

SEQ ID NO: 146670 - RNA, 21 nt, Mycobacterium tuberculosis CDC1551
gcgcagcaucucagccagugc

SEQ ID NO: 146671 - RNA, 22 nt, Mycobacterium tuberculosis CDC1551
gcgcagcagcgacaggguggcg

SEQ ID NO: 146672 - RNA, 20 nt, Mycobacterium tuberculosis CDC1551
gccugcagaacguugaucuc

SEQ ID NO: 146673 - RNA, 22 nt, Mycobacterium tuberculosis CDC1551
gccuggacuccgcuuuuggcac

SEQ ID NO: 146674 - RNA, 22 nt, Mycobacterium tuberculosis CDC1551
gcgaaacacgggaucgggcgag

SEQ ID NO: 146675 - RNA, 21 nt, Mycobacterium tuberculosis CDC1551
gcgagcucgucauggucuuuc

SEQ ID NO: 146676 - RNA, 22 nt, Mycobacterium tuberculosis CDC1551
cuggcuugccuccugccgcgac

SEQ ID NO: 146677 - RNA, 22 nt, Mycobacterium tuberculosis CDC1551
cuggguucgacccaguccaagc

SEQ ID NO: 146678 - RNA, 22 nt, Mycobacterium tuberculosis CDC1551
gagcggauuuuucgcaccggga

SEQ ID NO: 146679 - RNA, 22 nt, Mycobacterium tuberculosis CDC1551
gagcaugggcguggacguuguc

SEQ ID NO: 146680 - RNA, 22 nt, Mycobacterium tuberculosis CDC1551
gaggccagcucggccagcugga

SEQ ID NO: 146681 - RNA, 23 nt, Mycobacterium tuberculosis CDC1551
gaggcgcuggcagcggcccgguu

SEQ ID NO: 146682 - RNA, 22 nt, Mycobacterium tuberculosis CDC1551
gaggagguguaccggguagagg

SEQ ID NO: 146683 - RNA, 22 nt, Mycobacterium tuberculosis CDC1551
gaggagaugcuagaggcaacga

SEQ ID NO: 146684 - RNA, 22 nt, Mycobacterium tuberculosis CDC1551
gagcuggguccaccggcguuug

SEQ ID NO: 146685 - RNA, 22 nt, Mycobacterium tuberculosis CDC1551
gaggugaugagggcggcgagua

SEQ ID NO: 146686 - RNA, 22 nt, Mycobacterium tuberculosis CDC1551
gaggguagacggggcgagcaug

SEQ ID NO: 146687 - RNA, 22 nt, Mycobacterium tuberculosis CDC1551
gagguguccgacgaaccugguu

SEQ ID NO: 146688 - RNA, 22 nt, Mycobacterium tuberculosis CDC1551
gagguuuggcggggcgugaccu

SEQ ID NO: 146689 - RNA, 22 nt, Mycobacterium tuberculosis CDC1551
gagggacuuaugcgucugcuag

SEQ ID NO: 146690 - RNA, 22 nt, Mycobacterium tuberculosis CDC1551
gaggggauuuugcgucugcuca

SEQ ID NO: 146691 - RNA, 22 nt, Mycobacterium tuberculosis CDC1551
caugcaucggaagaaccggcau

SEQ ID NO: 146692 - RNA, 22 nt, Mycobacterium tuberculosis CDC1551
aggccgaguucgucaugcagcu

SEQ ID NO: 146693 - RNA, 22 nt, Mycobacterium tuberculosis CDC1551
ccaagcucuggauggccugccg

SEQ ID NO: 146694 - RNA, 22 nt, Mycobacterium tuberculosis CDC1551
cauuggcaccggaaaucgccgg

SEQ ID NO: 146695 - RNA, 22 nt, Mycobacterium tuberculosis CDC1551
cauggucacuggcugugacuga

SEQ ID NO: 146696 - RNA, 22 nt, Mycobacterium tuberculosis CDC1551
ccagcgggugccggugguggac

SEQ ID NO: 146697 - RNA, 22 nt, Mycobacterium tuberculosis CDC1551
ccagcucaucgccguagcugag

SEQ ID NO: 146698 - RNA, 22 nt, Mycobacterium tuberculosis CDC1551
ccaccgccacggccagcaccgc

SEQ ID NO: 146699 - RNA, 22 nt, Mycobacterium tuberculosis CDC1551
ccaugagcacccggauggccug

SEQ ID NO: 146700 - RNA, 22 nt, Mycobacterium tuberculosis CDC1551
ccaggcucagcgggguaacauc

SEQ ID NO: 146701 - RNA, 22 nt, Mycobacterium tuberculosis CDC1551
ccaugggccggguucuugacca

SEQ ID NO: 146702 - RNA, 22 nt, Mycobacterium tuberculosis CDC1551
cccagcaccugccaggacgggc

SEQ ID NO: 146703 - RNA, 22 nt, Mycobacterium tuberculosis CDC1551
cccagcaccgaccagugccggc

SEQ ID NO: 146704 - RNA, 22 nt, Mycobacterium tuberculosis CDC1551
cccagccaggguaaggccuuug

SEQ ID NO: 146705 - RNA, 22 nt, Mycobacterium tuberculosis CDC1551
cgcugggcgaugaagcgcuggg

SEQ ID NO: 146706 - RNA, 22 nt, Mycobacterium tuberculosis CDC1551
cgggcagcgucgggauaaucgg

SEQ ID NO: 146707 - RNA, 22 nt, Mycobacterium tuberculosis CDC1551
cggcaagcccgggcucgccgga

SEQ ID NO: 146708 - RNA, 22 nt, Mycobacterium tuberculosis CDC1551
cccuggugguccgaucguucau

SEQ ID NO: 146709 - RNA, 22 nt, Mycobacterium tuberculosis CDC1551
ccccguccgaagugaugcccgc

SEQ ID NO: 146710 - RNA, 22 nt, Mycobacterium tuberculosis CDC1551
ccgcccaggcucccgcucgacg

SEQ ID NO: 146711 - RNA, 22 nt, Mycobacterium tuberculosis CDC1551
ccgcccggcugcgcgagcuggg

SEQ ID NO: 146712 - RNA, 22 nt, Mycobacterium tuberculosis CDC1551
ccuccugcgccuggcgcaccga

SEQ ID NO: 146713 - RNA, 22 nt, Mycobacterium tuberculosis CDC1551
ccucuagguccgaugguggcga

SEQ ID NO: 146714 - RNA, 22 nt, Mycobacterium tuberculosis CDC1551
gcuuuuaugacugcucggcggg

SEQ ID NO: 146715 - RNA, 22 nt, Mycobacterium tuberculosis CDC1551
ggaggugcccacaagguagagg

SEQ ID NO: 146716 - RNA, 19 nt, Mycobacterium tuberculosis CDC1551
ggagugcccggugccggcg

SEQ ID NO: 146717 - RNA, 22 nt, Mycobacterium tuberculosis CDC1551
gcucaugucgccguagaccggg

SEQ ID NO: 146718 - RNA, 22 nt, Mycobacterium tuberculosis CDC1551
gcguggucggaugcaggccagc

SEQ ID NO: 146719 - RNA, 22 nt, Mycobacterium tuberculosis CDC1551
gcgucgucagauucacagucag

SEQ ID NO: 146720 - RNA, 22 nt, Mycobacterium tuberculosis CDC1551
ggugcuuuugcgucugcucggc

SEQ ID NO: 146721 - RNA, 22 nt, Mycobacterium tuberculosis CDC1551
ggugaugguggaggcagccgac

SEQ ID NO: 146722 - RNA, 22 nt, Mycobacterium tuberculosis CDC1551
gguggcgcacaucgccgugcac

SEQ ID NO: 146723 - RNA, 19 nt, Mycobacterium tuberculosis CDC1551
gguggcggucgcugcgcug

SEQ ID NO: 146724 - RNA, 22 nt, Mycobacterium tuberculosis CDC1551
gguggcagcggguccggcgacu

SEQ ID NO: 146725 - RNA, 22 nt, Mycobacterium tuberculosis CDC1551
ggaguucaaugccacggcgucg

SEQ ID NO: 146726 - RNA, 22 nt, Mycobacterium tuberculosis CDC1551
gguccgaaggcuucggcaagcc

SEQ ID NO: 146727 - RNA, 22 nt, Mycobacterium tuberculosis CDC1551
gguggugccgguacgccaaugc

SEQ ID NO: 146728 - RNA, 22 nt, Mycobacterium tuberculosis CDC1551
ggugguggccaccgcagugggu

SEQ ID NO: 146729 - RNA, 22 nt, Mycobacterium tuberculosis CDC1551
gguggagggacucgagaauguc

SEQ ID NO: 146730 - RNA, 22 nt, Mycobacterium tuberculosis CDC1551
guuacaggucaccacguagcgg

SEQ ID NO: 146731 - RNA, 22 nt, Mycobacterium tuberculosis CDC1551
gugguggugaguuugagaucgg

SEQ ID NO: 146732 - RNA, 22 nt, Mycobacterium tuberculosis CDC1551
guugaucagcuuguugagcugc

SEQ ID NO: 146733 - RNA, 22 nt, Mycobacterium tuberculosis CDC1551
gucauugcgucauuuccuucga

SEQ ID NO: 146734 - RNA, 22 nt, Mycobacterium tuberculosis CDC1551
gucgcuggugggaucgcagcgc

SEQ ID NO: 146735 - RNA, 22 nt, Mycobacterium tuberculosis CDC1551
guuugguugccuaccgcguggg

SEQ ID NO: 146736 - RNA, 22 nt, Mycobacterium tuberculosis CDC1551
guugugaacggaaccgccggga

SEQ ID NO: 146737 - RNA, 22 nt, Mycobacterium tuberculosis CDC1551
guuucgggcgauuuugcgucug

SEQ ID NO: 146738 - RNA, 22 nt, Mycobacterium tuberculosis CDC1551
ugccgcagauacccggcuagac

SEQ ID NO: 146739 - RNA, 22 nt, Mycobacterium tuberculosis CDC1551
ugcagcugcgaccguucguucu

SEQ ID NO: 146740 - RNA, 22 nt, Mycobacterium tuberculosis CDC1551
ugacccaggcgccggucggugu

SEQ ID NO: 146741 - RNA, 22 nt, Mycobacterium tuberculosis CDC1551
ugacauauaucaaagagauguu

SEQ ID NO: 146742 - RNA, 21 nt, Mycobacterium tuberculosis CDC1551
ugacccacugggccgagucgg

SEQ ID NO: 146743 - RNA, 22 nt, Mycobacterium tuberculosis CDC1551
ugcugcccaaagaacagcgagc

SEQ ID NO: 146744 - RNA, 22 nt, Mycobacterium tuberculosis CDC1551
uggagcuccuuucgcugccgca

SEQ ID NO: 146745 - RNA, 22 nt, Mycobacterium tuberculosis CDC1551
ugcgccagcgccucccgcagga

SEQ ID NO: 146746 - RNA, 22 nt, Mycobacterium tuberculosis CDC1551
ucggugacggacugcacagcga

SEQ ID NO: 146747 - RNA, 18 nt, Mycobacterium tuberculosis CDC1551
ucgugggcgcgccgccaa

SEQ ID NO: 146748 - RNA, 22 nt, Mycobacterium tuberculosis CDC1551
ucgguggcgccgacaugccggu

SEQ ID NO: 146749 - RNA, 22 nt, Mycobacterium tuberculosis CDC1551
ucuuucccuccagaucggugcg

SEQ ID NO: 146750 - RNA, 22 nt, Mycobacterium tuberculosis CDC1551
ucuugcgguccagcuugagcuc

SEQ ID NO: 146751 - RNA, 22 nt, Mycobacterium tuberculosis CDC1551
ucggggacuucugcgucugcuc

SEQ ID NO: 146752 - RNA, 22 nt, Mycobacterium tuberculosis CDC1551
ucggccucccaugcggcgaucu

SEQ ID NO: 146753 - RNA, 23 nt, Mycobacterium tuberculosis CDC1551
ucgcugucccgaggucacgcuuu

SEQ ID NO: 146754 - RNA, 22 nt, Mycobacterium tuberculosis CDC1551
ucggagaccucgccggaccucg

SEQ ID NO: 146755 - RNA, 22 nt, Mycobacterium tuberculosis CDC1551
ucgcccagcgagugcgccuggu

SEQ ID NO: 146756 - RNA, 22 nt, Mycobacterium tuberculosis CDC1551
ucgcccaggugcaggcucgcgu

SEQ ID NO: 146757 - RNA, 22 nt, Mycobacterium tuberculosis CDC1551
ucgaaacccagccaccucuugg

SEQ ID NO: 146758 - RNA, 22 nt, Mycobacterium tuberculosis CDC1551
ucgccagcaccaccugguuggg

SEQ ID NO: 146759 - RNA, 22 nt, Mycobacterium tuberculosis CDC1551
ucaccgccgcgguuggugcgca

SEQ ID NO: 146760 - RNA, 22 nt, Mycobacterium tuberculosis CDC1551
uccuuuccgucgaugcggaagc

SEQ ID NO: 146761 - RNA, 22 nt, Mycobacterium tuberculosis CDC1551
ucagcgucgaugaccaugucga

SEQ ID NO: 146762 - RNA, 18 nt, Mycobacterium tuberculosis CDC1551
ucagcgaucggggugcgg

SEQ ID NO: 146763 - RNA, 22 nt, Mycobacterium tuberculosis CDC1551
uagguaaauaaauccguguuug

SEQ ID NO: 146764 - RNA, 22 nt, Mycobacterium tuberculosis CDC1551
ugguggcuagcaaggucuuccc

SEQ ID NO: 146765 - RNA, 22 nt, Mycobacterium tuberculosis CDC1551
ugguggcugugucgaccgggaa

SEQ ID NO: 146766 - RNA, 22 nt, Mycobacterium tuberculosis CDC1551
ugguggcuguuguugcgccggc

SEQ ID NO: 146767 - RNA, 22 nt, Mycobacterium tuberculosis CDC1551
uggucggcggucauacccgcgg

SEQ ID NO: 146768 - RNA, 23 nt, Mycobacterium tuberculosis CDC1551
ugguggacgcagagucaacggau

SEQ ID NO: 146769 - RNA, 18 nt, Mycobacterium tuberculosis CDC1551
uggugcaccuuguuuggg

SEQ ID NO: 146770 - RNA, 23 nt, Mycobacterium tuberculosis CDC1551
ugguggucaccccgacgacgcuc

SEQ ID NO: 146771 - RNA, 23 nt, Mycobacterium tuberculosis CDC1551
ugguggucgacaugucggccagc

SEQ ID NO: 146772 - RNA, 22 nt, Mycobacterium tuberculosis CDC1551
ugggccuccugagcagcggcuu

SEQ ID NO: 146773 - RNA, 22 nt, Mycobacterium tuberculosis CDC1551
ugggaugguuuucagcgcccga

SEQ ID NO: 146774 - RNA, 22 nt, Mycobacterium tuberculosis CDC1551
ugggcagcggucaaggggccca

SEQ ID NO: 146775 - RNA, 22 nt, Mycobacterium tuberculosis CDC1551
ugggcugcugcgccgcaucggc

SEQ ID NO: 146776 - RNA, 22 nt, Mycobacterium tuberculosis CDC1551
ugggcugaacaggacggccgcc

SEQ ID NO: 146777 - RNA, 22 nt, Mycobacterium tuberculosis CDC1551
uucaggcuacgguagcggugcg

SEQ ID NO: 146778 - RNA, 22 nt, Mycobacterium tuberculosis CDC1551
uugucgccgucucgguccagcu

SEQ ID NO: 146779 - RNA, 22 nt, Mycobacterium tuberculosis CDC1551
uuguugcuuucgguagugcugg

SEQ ID NO: 146780 - RNA, 22 nt, Mycobacterium tuberculosis CDC1551
uugguguccgccgacgccaagu

SEQ ID NO: 146781 - RNA, 22 nt, Mycobacterium tuberculosis CDC1551
uugcgcaggggcaugucagcgu

SEQ ID NO: 146782 - RNA, 22 nt, Mycobacterium tuberculosis CDC1551
uugcggcaaugccggcaggccg

SEQ ID NO: 146783 - RNA, 22 nt, Mycobacterium tuberculosis CDC1551
uugccgggacuuuuuguguggc

SEQ ID NO: 146784 - RNA, 22 nt, Mycobacterium tuberculosis CDC1551
uugccugcggugcugccggcgg

SEQ ID NO: 146785 - RNA, 22 nt, Mycobacterium tuberculosis CDC1551
uugauauuaccgauggaauguc

SEQ ID NO: 146786 - RNA, 22 nt, Mycobacterium tuberculosis CDC1551
uugaggaucagguucagcuggc

SEQ ID NO: 146787 - RNA, 21 nt, Mycobacterium tuberculosis CDC1551
uuccggcccggguccagcgac

SEQ ID NO: 146788 - RNA, 22 nt, Mycobacterium tuberculosis CDC1551
uugacgucagcgccgcccgguc

SEQ ID NO: 146789 - RNA, 20 nt, Mycobacterium tuberculosis CDC1551
uuucugagcggcucaugacg

SEQ ID NO: 146790 - RNA, 22 nt, Mycobacterium tuberculosis CDC1551
uuugguacggaacguaggcaga

SEQ ID NO: 146791 - RNA, 22 nt, Mycobacterium tuberculosis CDC1551
agcccaccggugcuguaggcga

SEQ ID NO: 146792 - RNA, 23 nt, Mycobacterium tuberculosis CDC1551
agccccagcaauaucgccgacau

SEQ ID NO: 146793 - RNA, 22 nt, Mycobacterium tuberculosis CDC1551
agccaagccguaguccucgacg

SEQ ID NO: 146794 - RNA, 22 nt, Mycobacterium tuberculosis CDC1551
agccccagucgcuuugucucga

SEQ ID NO: 146795 - RNA, 22 nt, Mycobacterium tuberculosis CDC1551
agcacugcuuucugagcucgag

SEQ ID NO: 146796 - RNA, 22 nt, Mycobacterium tuberculosis CDC1551
agcagcugcuucauggugacua

SEQ ID NO: 146797 - RNA, 22 nt, Mycobacterium tuberculosis CDC1551
agcuggucgacacuggccgaaa

SEQ ID NO: 146798 - RNA, 22 nt, Mycobacterium tuberculosis CDC1551
agcuguccgacaaaguauccga

SEQ ID NO: 146799 - RNA, 22 nt, Mycobacterium tuberculosis CDC1551
aggaucacacuggccugcucaa

SEQ ID NO: 146800 - RNA, 22 nt, Mycobacterium tuberculosis CDC1551
aaugccagcgcgaagaccgcca

SEQ ID NO: 146801 - RNA, 22 nt, Mycobacterium tuberculosis CDC1551
aauccggccugugucgggucgu

SEQ ID NO: 146802 - RNA, 22 nt, Mycobacterium tuberculosis CDC1551
acgcagaggacuagcacgucga

SEQ ID NO: 146803 - RNA, 22 nt, Mycobacterium tuberculosis CDC1551
acgagcguaacggcacugcgaa

SEQ ID NO: 146804 - RNA, 19 nt, Mycobacterium tuberculosis CDC1551
acccaggccgucacuucga

SEQ ID NO: 146805 - RNA, 22 nt, Mycobacterium tuberculosis CDC1551
accucauugaacgacauggguu

SEQ ID NO: 146806 - RNA, 22 nt, Mycobacterium tuberculosis CDC1551
accgcgccgccaaugcagcguc

SEQ ID NO: 146807 - RNA, 20 nt, Human
aaaaacaguaaugcugaaga

SEQ ID NO: 146808 - RNA, 22 nt, Human
aaacagcugcaguacacggccu

SEQ ID NO: 146809 - RNA, 22 nt, Human
aaacccaggguuuugucuuccc

SEQ ID NO: 146810 - RNA, 22 nt, Human
aaacacacaacauauuuuggaa

SEQ ID NO: 146811 - RNA, 22 nt, Human
aaagacagccuguuggcuuucu

SEQ ID NO: 146812 - RNA, 22 nt, Human
aagccuccgugcugcuggaucu

SEQ ID NO: 146813 - RNA, 22 nt, Human
aagccuguugacagcugucagu

SEQ ID NO: 146814 - RNA, 22 nt, Human
aagccugguuauuugaggaugu

SEQ ID NO: 146815 - RNA, 22 nt, Human
aagcagugacucucagaggcag

SEQ ID NO: 146816 - RNA, 22 nt, Human
aagcagacugggccauaaggaa

SEQ ID NO: 146817 - RNA, 22 nt, Human
aaggaucuuucuuuuuaccauu

SEQ ID NO: 146818 - RNA, 20 nt, Human
aaggaggcuuaaaguuagaa

SEQ ID NO: 146819 - RNA, 22 nt, Human
aaggaguggugaagucagaugu

SEQ ID NO: 146820 - RNA, 22 nt, Human
aaggagcuuucauuacagccuu

SEQ ID NO: 146821 - RNA, 18 nt, Human
aaggaggaaugaauagca

SEQ ID NO: 146822 - RNA, 22 nt, Human
aaggcuuguugucacgcucuug

SEQ ID NO: 146823 - RNA, 22 nt, Human
aaggcgauuuaaagauguuagg

SEQ ID NO: 146824 - RNA, 22 nt, Human
aaggcggcggcggcggcugcgg

SEQ ID NO: 146825 - RNA, 22 nt, Human
aaggcgccacagugauugcaaa

SEQ ID NO: 146826 - RNA, 22 nt, Human
aaggcgguuccgguucgcggcg

SEQ ID NO: 146827 - RNA, 22 nt, Human
aaggcgaggggcacagcugaga

SEQ ID NO: 146828 - RNA, 22 nt, Human
aaggcagagggaaaacgggaau

SEQ ID NO: 146829 - RNA, 22 nt, Human
aaggcacuugcccagagcugca

SEQ ID NO: 146830 - RNA, 22 nt, Human
aagggaaacagccaggcccugu

SEQ ID NO: 146831 - RNA, 23 nt, Human
aagggcgauuaacauucgcucga

SEQ ID NO: 146832 - RNA, 22 nt, Human
aagggaaguuugacacuuuuua

SEQ ID NO: 146833 - RNA, 22 nt, Human
aagggccuccuggggagccugg

SEQ ID NO: 146834 - RNA, 22 nt, Human
aaggggggcaccugcaugcccg

SEQ ID NO: 146835 - RNA, 22 nt, Human
aaggugcauuaguuuggagggg

SEQ ID NO: 146836 - RNA, 22 nt, Human
aaggugcugaggguccuggcuu

SEQ ID NO: 146837 - RNA, 22 nt, Human
aaggucuucgaaccuuauguua

SEQ ID NO: 146838 - RNA, 22 nt, Human
aagguccuguagccacagagcc

SEQ ID NO: 146839 - RNA, 23 nt, Human
aaguggucaucuaucccaugguu

SEQ ID NO: 146840 - RNA, 22 nt, Human
aaguggugagacccugcugaaa

SEQ ID NO: 146841 - RNA, 22 nt, Human
aaguggcaggggaaggguugga

SEQ ID NO: 146842 - RNA, 22 nt, Human
aaguggcccuaauugggccaaa

SEQ ID NO: 146843 - RNA, 17 nt, Human
aagugggcaaagugaga

SEQ ID NO: 146844 - RNA, 22 nt, Human
aaggugccacuucccucagacu

SEQ ID NO: 146845 - RNA, 22 nt, Human
aaucugaccguggagaucucca

SEQ ID NO: 146846 - RNA, 22 nt, Human
aaucuugggacagggacacuau

SEQ ID NO: 146847 - RNA, 22 nt, Human
aaucaugguacaaguaagcacg

SEQ ID NO: 146848 - RNA, 22 nt, Human
aaucgacuguagagacuuggcg

SEQ ID NO: 146849 - RNA, 22 nt, Human
aaucucguuaugaagaugguug

SEQ ID NO: 146850 - RNA, 22 nt, Human
aaucugacaaaauauuuccagu

SEQ ID NO: 146851 - RNA, 22 nt, Human
aaugccuucauuggcgaagugc

SEQ ID NO: 146852 - RNA, 22 nt, Human
aaugacaguggcacagucacuu

SEQ ID NO: 146853 - RNA, 22 nt, Human
aauucaacagucaguuaucuca

SEQ ID NO: 146854 - RNA, 22 nt, Human
aauucagguuauauuugcaacu

SEQ ID NO: 146855 - RNA, 22 nt, Human
aauucaggacaaauguuuucaa

SEQ ID NO: 146856 - RNA, 22 nt, Human
aaugcgcagaguggugugugca

SEQ ID NO: 146857 - RNA, 22 nt, Human
aauggcaagccacaugcuuuuc

SEQ ID NO: 146858 - RNA, 22 nt, Human
aauggcaauagugcauuaugua

SEQ ID NO: 146859 - RNA, 22 nt, Human
aauggcaaaaguuucggaaauu

SEQ ID NO: 146860 - RNA, 22 nt, Human
aaugguggaugucuguucugac

SEQ ID NO: 146861 - RNA, 22 nt, Human
aacgcugugcacuggguccagg

SEQ ID NO: 146862 - RNA, 22 nt, Human
aacgcaacaacuggagcuguag

SEQ ID NO: 146863 - RNA, 22 nt, Human
aacuggguuuaucuaaugugua

SEQ ID NO: 146864 - RNA, 22 nt, Human
aacugcauaagcuucgggaccu

SEQ ID NO: 146865 - RNA, 22 nt, Human
aacgugcuuuacaaaugaccuu

SEQ ID NO: 146866 - RNA, 19 nt, Human
aacucugccgaggcaagcc

SEQ ID NO: 146867 - RNA, 22 nt, Human
aacucgaugcaauucacuuugu

SEQ ID NO: 146868 - RNA, 22 nt, Human
aacucaggagagaguaacaggg

SEQ ID NO: 146869 - RNA, 22 nt, Human
aacuuaacucugcaauccagcu

SEQ ID NO: 146870 - RNA, 22 nt, Human
aacugggugauucaggcuguuu

SEQ ID NO: 146871 - RNA, 22 nt, Human
aagaaagaucugaaagaagcga

SEQ ID NO: 146872 - RNA, 22 nt, Human
aagaaaggcacaagaaagaaaa

SEQ ID NO: 146873 - RNA, 20 nt, Human
aacuuugagugcaugacuuu

SEQ ID NO: 146874 - RNA, 22 nt, Human
aagaagcuacugucacuaucag

SEQ ID NO: 146875 - RNA, 21 nt, Human
aagagcgccgggcagggcuga

SEQ ID NO: 146876 - RNA, 22 nt, Human
aagaagguugaaugacuacuuu

SEQ ID NO: 146877 - RNA, 22 nt, Human
aagaggaauaauaaaaauugca

SEQ ID NO: 146878 - RNA, 22 nt, Human
aagaggcagcuugguaggcauc

SEQ ID NO: 146879 - RNA, 22 nt, Human
aagacccuaccccuggagagga

SEQ ID NO: 146880 - RNA, 22 nt, Human
aagaugcuucaugagaguuggg

SEQ ID NO: 146881 - RNA, 21 nt, Human
aagacguaguuggguggacca

SEQ ID NO: 146882 - RNA, 22 nt, Human
aagcacagggacucaggaccgg

SEQ ID NO: 146883 - RNA, 22 nt, Human
aagagcuuguuaugcugcucuu

SEQ ID NO: 146884 - RNA, 22 nt, Human
aagccagccaguuccagcagcu

SEQ ID NO: 146885 - RNA, 22 nt, Human
aagccgagggaggugauggaga

SEQ ID NO: 146886 - RNA, 22 nt, Human
aagcagcauaugacagcaucca

SEQ ID NO: 146887 - RNA, 21 nt, Human
aagcagcugcagaauuucagu

SEQ ID NO: 146888 - RNA, 22 nt, Human
aagcaguuuagucaucgggauu

SEQ ID NO: 146889 - RNA, 22 nt, Human
aaccagaagucaucagagcuga

SEQ ID NO: 146890 - RNA, 22 nt, Human
aaccaggcgagagagcggucag

SEQ ID NO: 146891 - RNA, 22 nt, Human
aaccucgggcugcacuuggcac

SEQ ID NO: 146892 - RNA, 22 nt, Human
aacccaagacaagcacuggcca

SEQ ID NO: 146893 - RNA, 22 nt, Human
aacagggcaguuccuuauagug

SEQ ID NO: 146894 - RNA, 22 nt, Human
aacgagcugggggggccggggg

SEQ ID NO: 146895 - RNA, 22 nt, Human
aacgauuugaguuaguuuuuag

SEQ ID NO: 146896 - RNA, 22 nt, Human
aacgaugauaaauuguucucug

SEQ ID NO: 146897 - RNA, 22 nt, Human
aaccauggauuucaguucaccu

SEQ ID NO: 146898 - RNA, 22 nt, Human
aacgccgggacucgcagggagc

SEQ ID NO: 146899 - RNA, 22 nt, Human
aacccuguuguguacaugcaua

SEQ ID NO: 146900 - RNA, 22 nt, Human
aacgcagagaguaaugcugaac

SEQ ID NO: 146901 - RNA, 22 nt, Human
aaccuaagaacagcaggcuccu

SEQ ID NO: 146902 - RNA, 22 nt, Human
aaccugaggguagacaaguuca

SEQ ID NO: 146903 - RNA, 22 nt, Human
aaccugagggcaggaccccaua

SEQ ID NO: 146904 - RNA, 22 nt, Human
aacuacucugggguggcagguu

SEQ ID NO: 146905 - RNA, 22 nt, Human
aacacugaaaugucuuaagauu

SEQ ID NO: 146906 - RNA, 22 nt, Human
aaauugucuuuaaucaggucau

SEQ ID NO: 146907 - RNA, 22 nt, Human
aacacuguaucagucuucaaua

SEQ ID NO: 146908 - RNA, 22 nt, Human
aacaucaaaggaagaaugauau

SEQ ID NO: 146909 - RNA, 22 nt, Human
aacagguucaucuuggaagcag

SEQ ID NO: 146910 - RNA, 22 nt, Human
aaauggaaguuuguucucagcc

SEQ ID NO: 146911 - RNA, 22 nt, Human
agguggugacgaugcuccguac

SEQ ID NO: 146912 - RNA, 22 nt, Human
aggugggcuuagaaaucuguau

SEQ ID NO: 146913 - RNA, 22 nt, Human
agguggggacuccaccgaugcu

SEQ ID NO: 146914 - RNA, 21 nt, Human
aggugaaggcgagggggacag

SEQ ID NO: 146915 - RNA, 22 nt, Human
aggucuugcggaagauauggcu

SEQ ID NO: 146916 - RNA, 22 nt, Human
aggugcccucucuggcuccucc

SEQ ID NO: 146917 - RNA, 22 nt, Human
aggugcauuuacuuggggcccu

SEQ ID NO: 146918 - RNA, 22 nt, Human
aggugugcacccggucgcuucc

SEQ ID NO: 146919 - RNA, 16 nt, Human
aggugugugguagaua

SEQ ID NO: 146920 - RNA, 18 nt, Human
agguguguuucuaggagc

SEQ ID NO: 146921 - RNA, 22 nt, Human
agguuuuagagagccaggaugu

SEQ ID NO: 146922 - RNA, 21 nt, Human
aguagucgauucaggagaagu

SEQ ID NO: 146923 - RNA, 21 nt, Human
aguaccugugugccugugugu

SEQ ID NO: 146924 - RNA, 22 nt, Human
aguaucgcuuuguaucaugagg

SEQ ID NO: 146925 - RNA, 19 nt, Human
aguauuggcagguccugua

SEQ ID NO: 146926 - RNA, 21 nt, Human
agucaagcugccugcuuggca

SEQ ID NO: 146927 - RNA, 22 nt, Human
agucacuguucugucaugucaa

SEQ ID NO: 146928 - RNA, 22 nt, Human
agucagcuugucucuaggguug

SEQ ID NO: 146929 - RNA, 22 nt, Human
agucagaaggugucagaucuug

SEQ ID NO: 146930 - RNA, 22 nt, Human
agucaagguggaccagaaaaau

SEQ ID NO: 146931 - RNA, 22 nt, Human
agucaccuacagcucaugcuuc

SEQ ID NO: 146932 - RNA, 22 nt, Human
agucaggggaucuagacuugaa

SEQ ID NO: 146933 - RNA, 22 nt, Human
agucaacauuugagaugcaaug

SEQ ID NO: 146934 - RNA, 22 nt, Human
agucggguugcagacacauccu

SEQ ID NO: 146935 - RNA, 22 nt, Human
aguccauccagaaaacaaagcu

SEQ ID NO: 146936 - RNA, 22 nt, Human
aguccagggcuuagucagcggg

SEQ ID NO: 146937 - RNA, 22 nt, Human
agucagcuuggaacuuuuuucc

SEQ ID NO: 146938 - RNA, 22 nt, Human
agucccugauggacuggaugag

SEQ ID NO: 146939 - RNA, 22 nt, Human
agucggggagcgugaccagaga

SEQ ID NO: 146940 - RNA, 22 nt, Human
aguccucagauauggagaucug

SEQ ID NO: 146941 - RNA, 22 nt, Human
agucugugguccucuguaucuc

SEQ ID NO: 146942 - RNA, 22 nt, Human
agucuuuguuccugggaccuga

SEQ ID NO: 146943 - RNA, 22 nt, Human
agucucccauaggcuaaguauu

SEQ ID NO: 146944 - RNA, 22 nt, Human
agucugaaccagauggcaaggu

SEQ ID NO: 146945 - RNA, 22 nt, Human
agucuagagcuuuuaucaggcc

SEQ ID NO: 146946 - RNA, 22 nt, Human
aggugcacugguacaggcuuca

SEQ ID NO: 146947 - RNA, 22 nt, Human
aggucguauaguuaccuccuug

SEQ ID NO: 146948 - RNA, 22 nt, Human
aggucggcuuuuuuccuuucac

SEQ ID NO: 146949 - RNA, 22 nt, Human
aggguuccugaaaaguauguca

SEQ ID NO: 146950 - RNA, 22 nt, Human
agggggcuccugcaggccccca

SEQ ID NO: 146951 - RNA, 22 nt, Human
agggggccuauucuuggacugc

SEQ ID NO: 146952 - RNA, 22 nt, Human
agggggccucucccgcggcgcc

SEQ ID NO: 146953 - RNA, 22 nt, Human
aggggcagaggaugauggaaga

SEQ ID NO: 146954 - RNA, 22 nt, Human
aggguguuugggagcagaggau

SEQ ID NO: 146955 - RNA, 22 nt, Human
aggguggcuggaguggucuggu

SEQ ID NO: 146956 - RNA, 22 nt, Human
aggguggcacucugggggcucc

SEQ ID NO: 146957 - RNA, 20 nt, Human
aggggcuguaguuagaugac

SEQ ID NO: 146958 - RNA, 22 nt, Human
agggggcaugaaauaaaggaaa

SEQ ID NO: 146959 - RNA, 22 nt, Human
aggggcuuguggaguugcuggu

SEQ ID NO: 146960 - RNA, 22 nt, Human
aggggaguuauuagacagggag

SEQ ID NO: 146961 - RNA, 22 nt, Human
agggcucacuacaacccuggga

SEQ ID NO: 146962 - RNA, 22 nt, Human
agggcgugguggugcuggagca

SEQ ID NO: 146963 - RNA, 22 nt, Human
agggaugugcagggcuugccau

SEQ ID NO: 146964 - RNA, 22 nt, Human
agggagcugcucugcuuccgug

SEQ ID NO: 146965 - RNA, 22 nt, Human
agggagcagcuagagggggucc

SEQ ID NO: 146966 - RNA, 22 nt, Human
agggccggggagggcugugggg

SEQ ID NO: 146967 - RNA, 22 nt, Human
agggcccauagaucgucagcuu

SEQ ID NO: 146968 - RNA, 22 nt, Human
agggcggucccugagacucucc

SEQ ID NO: 146969 - RNA, 22 nt, Human
agggcugggcuuggcaggcugg

SEQ ID NO: 146970 - RNA, 23 nt, Human
aggcugcagaagaauagggucau

SEQ ID NO: 146971 - RNA, 22 nt, Human
aggcggguuuaggacaaugcuu

SEQ ID NO: 146972 - RNA, 23 nt, Human
aggcugccacucagggugaggcu

SEQ ID NO: 146973 - RNA, 22 nt, Human
aggcgagcgcggccggugcccc

SEQ ID NO: 146974 - RNA, 22 nt, Human
aggcgguuggcuuugucugggu

SEQ ID NO: 146975 - RNA, 21 nt, Human
aggcuuggaucuagacaggcc

SEQ ID NO: 146976 - RNA, 22 nt, Human
aggcuucauuacagugguucaa

SEQ ID NO: 146977 - RNA, 22 nt, Human
agggacccucagcuuggauguc

SEQ ID NO: 146978 - RNA, 22 nt, Human
agggaccgugagcuccuugggg

SEQ ID NO: 146979 - RNA, 22 nt, Human
agggacuugugucuguguuuuu

SEQ ID NO: 146980 - RNA, 22 nt, Human
agggaugcaguaaaaacuguag

SEQ ID NO: 146981 - RNA, 22 nt, Human
aggccugcccuuggggagccuu

SEQ ID NO: 146982 - RNA, 22 nt, Human
aggccugcuccucuucucaucc

SEQ ID NO: 146983 - RNA, 22 nt, Human
aggcgaagggaccagacgguag

SEQ ID NO: 146984 - RNA, 22 nt, Human
aggccgguggaggagguggagg

SEQ ID NO: 146985 - RNA, 22 nt, Human
aggccugaggaccagauaaaug

SEQ ID NO: 146986 - RNA, 22 nt, Human
aggccgcuggggcagcgcccga

SEQ ID NO: 146987 - RNA, 22 nt, Human
aggcccucucggucccccgccg

SEQ ID NO: 146988 - RNA, 22 nt, Human
aggcugccuaugaaggcagaag

SEQ ID NO: 146989 - RNA, 22 nt, Human
aggcugaagcacacucaugcag

SEQ ID NO: 146990 - RNA, 22 nt, Human
aggcguggcuucugcuggguug

SEQ ID NO: 146991 - RNA, 22 nt, Human
aggauggaaguaacuggauaau

SEQ ID NO: 146992 - RNA, 22 nt, Human
aggauauguccuuuuuuucccc

SEQ ID NO: 146993 - RNA, 16 nt, Human
aggagcagaaagcagu

SEQ ID NO: 146994 - RNA, 19 nt, Human
aggagacuacuucuugcug

SEQ ID NO: 146995 - RNA, 22 nt, Human
aggagcccaaagcacuuggcug

SEQ ID NO: 146996 - RNA, 22 nt, Human
aggagguagggugugaaacagc

SEQ ID NO: 146997 - RNA, 22 nt, Human
aggagggcggggcuaaaaggga

SEQ ID NO: 146998 - RNA, 22 nt, Human
aggaggcguuugcuaaacgggc

SEQ ID NO: 146999 - RNA, 22 nt, Human
aggccccacaaacucgccuuug

SEQ ID NO: 147000 - RNA, 22 nt, Human
aggcccagcaccagcggucuuc

SEQ ID NO: 147001 - RNA, 22 nt, Human
aggcccugcugaggccucccuc

SEQ ID NO: 147002 - RNA, 18 nt, Human
agcaguugucucucucca

SEQ ID NO: 147003 - RNA, 22 nt, Human
agcaguucucugucuagcuaga

SEQ ID NO: 147004 - RNA, 21 nt, Human
agcagucugcggccggugcgg

SEQ ID NO: 147005 - RNA, 18 nt, Human
agcagugcggaucauuuu

SEQ ID NO: 147006 - RNA, 19 nt, Human
agcaguggagccaugccug

SEQ ID NO: 147007 - RNA, 22 nt, Human
agcaggccuuucaccucugucc

SEQ ID NO: 147008 - RNA, 22 nt, Human
agcaggaggguuuuguagaguc

SEQ ID NO: 147009 - RNA, 22 nt, Human
agcagggagaccaucucuuccu

SEQ ID NO: 147010 - RNA, 22 nt, Human
agcaggacuugcugagcccucc

SEQ ID NO: 147011 - RNA, 22 nt, Human
agcaggaaggcuagaagcagga

SEQ ID NO: 147012 - RNA, 22 nt, Human
agcaggagaaagaguaugggcu

SEQ ID NO: 147013 - RNA, 22 nt, Human
agcagccgccgccgccgcgcac

SEQ ID NO: 147014 - RNA, 19 nt, Human
agcagccaucgaccaugga

SEQ ID NO: 147015 - RNA, 22 nt, Human
agcaggaggagagccuggcggu

SEQ ID NO: 147016 - RNA, 22 nt, Human
agcaucggacggagcaccugcu

SEQ ID NO: 147017 - RNA, 22 nt, Human
agcaggucagugguaaucaaaa

SEQ ID NO: 147018 - RNA, 22 nt, Human
agcagggugugggugugagugu

SEQ ID NO: 147019 - RNA, 22 nt, Human
agcaggauggaguaacgugaaa

SEQ ID NO: 147020 - RNA, 22 nt, Human
agccacacuuagucacaaagau

SEQ ID NO: 147021 - RNA, 19 nt, Human
agcagugaaaucuggugag

SEQ ID NO: 147022 - RNA, 22 nt, Human
agcaguugcuuuguauauuaaa

SEQ ID NO: 147023 - RNA, 22 nt, Human
agccuggagcaggcucugcucu

SEQ ID NO: 147024 - RNA, 22 nt, Human
agccugggucgagagacgagaa

SEQ ID NO: 147025 - RNA, 22 nt, Human
agcccugaccuguccuguucug

SEQ ID NO: 147026 - RNA, 22 nt, Human
agccauggaggaugugcagcau

SEQ ID NO: 147027 - RNA, 22 nt, Human
agccgcgcagccucauuaagga

SEQ ID NO: 147028 - RNA, 22 nt, Human
agccugugcuguguuugcucca

SEQ ID NO: 147029 - RNA, 22 nt, Human
agccuguuacuguccugugcca

SEQ ID NO: 147030 - RNA, 22 nt, Human
agcgcccguugagucgcgcggu

SEQ ID NO: 147031 - RNA, 22 nt, Human
agcgacuugacagacauguccu

SEQ ID NO: 147032 - RNA, 22 nt, Human
agcgagccugugcacuucuaac

SEQ ID NO: 147033 - RNA, 22 nt, Human
agccuugcaugauuucauucau

SEQ ID NO: 147034 - RNA, 22 nt, Human
agcgaaaagaauggaguggagu

SEQ ID NO: 147035 - RNA, 19 nt, Human
agcggccgccgcgggcgcc

SEQ ID NO: 147036 - RNA, 22 nt, Human
agcggcgcgucuccgagcugga

SEQ ID NO: 147037 - RNA, 22 nt, Human
agcggcaagguguauguggcag

SEQ ID NO: 147038 - RNA, 22 nt, Human
agcggcaggaagcgcgcaagcg

SEQ ID NO: 147039 - RNA, 22 nt, Human
agcgggucaugucggccgccca

SEQ ID NO: 147040 - RNA, 22 nt, Human
agcggccucgcugccugcucag

SEQ ID NO: 147041 - RNA, 22 nt, Human
agcggcucaggccccgugggcu

SEQ ID NO: 147042 - RNA, 22 nt, Human
agcggugacauccuucugugcu

SEQ ID NO: 147043 - RNA, 22 nt, Human
agcgcaguuaccgcgcggggcu

SEQ ID NO: 147044 - RNA, 22 nt, Human
agcgcuguguucccgugggcau

SEQ ID NO: 147045 - RNA, 22 nt, Human
agcggaggaggcggagcaggga

SEQ ID NO: 147046 - RNA, 22 nt, Human
agcgcucauuuuccuccugcuc

SEQ ID NO: 147047 - RNA, 22 nt, Human
agcgcggccuuacacccagggg

SEQ ID NO: 147048 - RNA, 22 nt, Human
agcgccgcugugauuggugagg

SEQ ID NO: 147049 - RNA, 19 nt, Human
agcucaggcccaucguccc

SEQ ID NO: 147050 - RNA, 22 nt, Human
agcgucaugugaccagcgcgcc

SEQ ID NO: 147051 - RNA, 22 nt, Human
agcguucuguuccaugcuaaca

SEQ ID NO: 147052 - RNA, 22 nt, Human
agcguacuugaggcuuggggcc

SEQ ID NO: 147053 - RNA, 22 nt, Human
agcucugcuucuugggaagaug

SEQ ID NO: 147054 - RNA, 19 nt, Human
agcuccucaccucucgcgg

SEQ ID NO: 147055 - RNA, 22 nt, Human
agcucggcuguccugugccccu

SEQ ID NO: 147056 - RNA, 22 nt, Human
agcugacagugcauggagggac

SEQ ID NO: 147057 - RNA, 22 nt, Human
agcugagccagacagguaagca

SEQ ID NO: 147058 - RNA, 22 nt, Human
agcuccugcgcacggugcacac

SEQ ID NO: 147059 - RNA, 22 nt, Human
agcucuguugcggucacaggag

SEQ ID NO: 147060 - RNA, 22 nt, Human
agcugcugcaaguggugcuaac

SEQ ID NO: 147061 - RNA, 19 nt, Human
agcugcugauugguggagg

SEQ ID NO: 147062 - RNA, 22 nt, Human
agcugcuggcggauguuggacu

SEQ ID NO: 147063 - RNA, 22 nt, Human
agcugaccugauugcuuuucag

SEQ ID NO: 147064 - RNA, 22 nt, Human
agcugcauucguaucauauugu

SEQ ID NO: 147065 - RNA, 22 nt, Human
agcugcauguauauucuuaaca

SEQ ID NO: 147066 - RNA, 22 nt, Human
agcucuucugacucuaggcuca

SEQ ID NO: 147067 - RNA, 22 nt, Human
agcucuuccuccauucuggcca

SEQ ID NO: 147068 - RNA, 22 nt, Human
agcucugugcaggcagaggcau

SEQ ID NO: 147069 - RNA, 22 nt, Human
agcuugaugaaagugggugcuc

SEQ ID NO: 147070 - RNA, 22 nt, Human
agcuugauggauugcugaggca

SEQ ID NO: 147071 - RNA, 20 nt, Human
agcuggcccccgguggccug

SEQ ID NO: 147072 - RNA, 22 nt, Human
agcuggauuaaucacagugacu

SEQ ID NO: 147073 - RNA, 22 nt, Human
agcugcuuuacuggucggcugg

SEQ ID NO: 147074 - RNA, 22 nt, Human
agcugaggccccgcagcagggu

SEQ ID NO: 147075 - RNA, 22 nt, Human
agcugcuaagcugcauaacuua

SEQ ID NO: 147076 - RNA, 22 nt, Human
agcuuugucccaagugcucugg

SEQ ID NO: 147077 - RNA, 22 nt, Human
aggacagagggaccagagccca

SEQ ID NO: 147078 - RNA, 22 nt, Human
aggacacuuccugaguggacaa

SEQ ID NO: 147079 - RNA, 22 nt, Human
aggacuguauacucuaggugaa

SEQ ID NO: 147080 - RNA, 22 nt, Human
aggacucagcgucugucucccg

SEQ ID NO: 147081 - RNA, 22 nt, Human
aggacuggucucuuuucuccaa

SEQ ID NO: 147082 - RNA, 22 nt, Human
aggagacaguuuggacguguag

SEQ ID NO: 147083 - RNA, 23 nt, Human
aggaagucugacacuacagcguu

SEQ ID NO: 147084 - RNA, 22 nt, Human
aggaagccuggaguccugccca

SEQ ID NO: 147085 - RNA, 22 nt, Human
agcuggaaucucggcaaagcgu

SEQ ID NO: 147086 - RNA, 22 nt, Human
aggaaauaguuuagucccaaaa

SEQ ID NO: 147087 - RNA, 22 nt, Human
aggaaauaagggcacuucagau

SEQ ID NO: 147088 - RNA, 22 nt, Human
agcugugccuauucguggcaag

SEQ ID NO: 147089 - RNA, 22 nt, Human
agcuucccaggagaucuccgcc

SEQ ID NO: 147090 - RNA, 22 nt, Human
agcuucuucugccuugucccug

SEQ ID NO: 147091 - RNA, 22 nt, Human
agcuguugaccuucccuuucag

SEQ ID NO: 147092 - RNA, 22 nt, Human
aggaagagcuggaccagaggac

SEQ ID NO: 147093 - RNA, 22 nt, Human
agcuuggcaagcacuguuugag

SEQ ID NO: 147094 - RNA, 22 nt, Human
agcuugcccuuguaccagccag

SEQ ID NO: 147095 - RNA, 22 nt, Human
acuaauuuacagaaauuucuua

SEQ ID NO: 147096 - RNA, 22 nt, Human
acugaggaagccugucaucauc

SEQ ID NO: 147097 - RNA, 18 nt, Human
acugagcccaggacacac

SEQ ID NO: 147098 - RNA, 22 nt, Human
acuggauucucuuacacagaug

SEQ ID NO: 147099 - RNA, 22 nt, Human
acuggauuuugugguguaucuu

SEQ ID NO: 147100 - RNA, 22 nt, Human
acugcaggucccaucaccugcg

SEQ ID NO: 147101 - RNA, 23 nt, Human
acuggauuguucuugggcgcuga

SEQ ID NO: 147102 - RNA, 20 nt, Human
acugcaagagacagaugaaa

SEQ ID NO: 147103 - RNA, 22 nt, Human
acugcacuccagcccgagcaac

SEQ ID NO: 147104 - RNA, 19 nt, Human
acugggaugggcagugcca

SEQ ID NO: 147105 - RNA, 22 nt, Human
acuggggaggucuggauggauc

SEQ ID NO: 147106 - RNA, 22 nt, Human
acuggggauugguucuucaaca

SEQ ID NO: 147107 - RNA, 22 nt, Human
acugggacuguaugugcuggac

SEQ ID NO: 147108 - RNA, 21 nt, Human
acugggcuagccugacuucug

SEQ ID NO: 147109 - RNA, 22 nt, Human
acugggcaaggauaugaugggu

SEQ ID NO: 147110 - RNA, 22 nt, Human
acuggggcaggaaaguaugcug

SEQ ID NO: 147111 - RNA, 22 nt, Human
acuggcauuccuaggggagggg

SEQ ID NO: 147112 - RNA, 22 nt, Human
acuggcgucugucuccccugcc

SEQ ID NO: 147113 - RNA, 19 nt, Human
acuggggcaggcugggcuu

SEQ ID NO: 147114 - RNA, 22 nt, Human
acuggguuguuugucucaugag

SEQ ID NO: 147115 - RNA, 22 nt, Human
acugucauuaaugaauguaaua

SEQ ID NO: 147116 - RNA, 22 nt, Human
acuggugcucuggccaccgcug

SEQ ID NO: 147117 - RNA, 18 nt, Human
acuguggcucagaguugc

SEQ ID NO: 147118 - RNA, 22 nt, Human
acugugcccccucuacugcuga

SEQ ID NO: 147119 - RNA, 22 nt, Human
acuguccucgaaguaccugugc

SEQ ID NO: 147120 - RNA, 22 nt, Human
acuguggcugcuacccuggcuc

SEQ ID NO: 147121 - RNA, 22 nt, Human
acuguugugaauaaugaaaugc

SEQ ID NO: 147122 - RNA, 22 nt, Human
acuugguccacaguaagugcuu

SEQ ID NO: 147123 - RNA, 22 nt, Human
acuuugucuugaucaaaggugu

SEQ ID NO: 147124 - RNA, 22 nt, Human
acuugcaucuuagagacucacc

SEQ ID NO: 147125 - RNA, 22 nt, Human
agaagcauaagggcuuugccag

SEQ ID NO: 147126 - RNA, 21 nt, Human
agaagcggucgaaucgcagac

SEQ ID NO: 147127 - RNA, 22 nt, Human
agaacaggaggaagccagcucc

SEQ ID NO: 147128 - RNA, 22 nt, Human
acuuuuccuggguagcuccugg

SEQ ID NO: 147129 - RNA, 20 nt, Human
agaaggagagaugaggcaaa

SEQ ID NO: 147130 - RNA, 22 nt, Human
agaaggcagaaaagcuuuacaa

SEQ ID NO: 147131 - RNA, 22 nt, Human
agaaucaggaagacagccuggc

SEQ ID NO: 147132 - RNA, 22 nt, Human
agaaucugcauuuuaacaagau

SEQ ID NO: 147133 - RNA, 22 nt, Human
agacagcggugcaauaaauggu

SEQ ID NO: 147134 - RNA, 22 nt, Human
agaccauagugauguuuacguc

SEQ ID NO: 147135 - RNA, 22 nt, Human
agaccauguuauccuucauuuu

SEQ ID NO: 147136 - RNA, 22 nt, Human
agacuguuccgucagacucagu

SEQ ID NO: 147137 - RNA, 19 nt, Human
agacccaguuuucuagugu

SEQ ID NO: 147138 - RNA, 22 nt, Human
agaccccugcuggggcugcugu

SEQ ID NO: 147139 - RNA, 22 nt, Human
agaccccuguggugaugguggu

SEQ ID NO: 147140 - RNA, 22 nt, Human
agacccugauucugcuggcggu

SEQ ID NO: 147141 - RNA, 22 nt, Human
agaccguguguggguugcggug

SEQ ID NO: 147142 - RNA, 22 nt, Human
agacuugguaacuagugaagaa

SEQ ID NO: 147143 - RNA, 22 nt, Human
agacuucucuuggcuauauuau

SEQ ID NO: 147144 - RNA, 22 nt, Human
agacgggacagacuuuugagug

SEQ ID NO: 147145 - RNA, 21 nt, Human
agacuucuacuaucuuaugac

SEQ ID NO: 147146 - RNA, 22 nt, Human
agacucuggcaugcuaacuagu

SEQ ID NO: 147147 - RNA, 22 nt, Human
agacucacuucuuucucguauu

SEQ ID NO: 147148 - RNA, 22 nt, Human
agacuucucuaacuugaggacc

SEQ ID NO: 147149 - RNA, 22 nt, Human
agagaaccauggcauccaggua

SEQ ID NO: 147150 - RNA, 22 nt, Human
agagacaggguuuugucguguu

SEQ ID NO: 147151 - RNA, 22 nt, Human
agagaccugaaugaguugaaca

SEQ ID NO: 147152 - RNA, 22 nt, Human
agagcagaggcauggccguggg

SEQ ID NO: 147153 - RNA, 23 nt, Human
agaggccaacuucuugccccucc

SEQ ID NO: 147154 - RNA, 21 nt, Human
agaggacuuuuuugauguuuu

SEQ ID NO: 147155 - RNA, 22 nt, Human
agaggagaauguaaauuuguca

SEQ ID NO: 147156 - RNA, 22 nt, Human
agaggcacccaguuaagcugca

SEQ ID NO: 147157 - RNA, 22 nt, Human
agaggcagagcugggguuugac

SEQ ID NO: 147158 - RNA, 22 nt, Human
agagcagauggagcuggaagag

SEQ ID NO: 147159 - RNA, 22 nt, Human
agagcagcaaucuuugaaauua

SEQ ID NO: 147160 - RNA, 22 nt, Human
agaggaauuauugaguuagauu

SEQ ID NO: 147161 - RNA, 22 nt, Human
acccuacggacuugacugggcg

SEQ ID NO: 147162 - RNA, 22 nt, Human
acccgguuuucccagcaccucc

SEQ ID NO: 147163 - RNA, 22 nt, Human
acccggccuacucagugcccag

SEQ ID NO: 147164 - RNA, 22 nt, Human
acccugacggugggcagcuuga

SEQ ID NO: 147165 - RNA, 22 nt, Human
accuauuguccagagccaggcc

SEQ ID NO: 147166 - RNA, 22 nt, Human
accgugcccauucauuuacaaa

SEQ ID NO: 147167 - RNA, 22 nt, Human
accggucucaccaaacgcccca

SEQ ID NO: 147168 - RNA, 22 nt, Human
accgguucccaucuggagaguu

SEQ ID NO: 147169 - RNA, 22 nt, Human
acccccaggacacugccucuga

SEQ ID NO: 147170 - RNA, 22 nt, Human
accccgugucccugaggguccu

SEQ ID NO: 147171 - RNA, 22 nt, Human
acccaucauuagucuuucagga

SEQ ID NO: 147172 - RNA, 19 nt, Human
acccaugcucuguggacuu

SEQ ID NO: 147173 - RNA, 23 nt, Human
accgccgcugccgccgcccccgc

SEQ ID NO: 147174 - RNA, 22 nt, Human
accgcuggcacuggggacgggg

SEQ ID NO: 147175 - RNA, 22 nt, Human
accgagcaggguguuugcgcac

SEQ ID NO: 147176 - RNA, 22 nt, Human
accgauguggaaaauuucauuu

SEQ ID NO: 147177 - RNA, 22 nt, Human
accgauuucaaauggugcuaga

SEQ ID NO: 147178 - RNA, 22 nt, Human
accugaccagguggcuucccaa

SEQ ID NO: 147179 - RNA, 22 nt, Human
accgggcagcucugccccugcc

SEQ ID NO: 147180 - RNA, 21 nt, Human
accgucaguacuaguauugac

SEQ ID NO: 147181 - RNA, 22 nt, Human
accuggcccugggucuccugac

SEQ ID NO: 147182 - RNA, 21 nt, Human
accugguuuacugaucccagg

SEQ ID NO: 147183 - RNA, 23 nt, Human
accuggucccaugggugggccug

SEQ ID NO: 147184 - RNA, 22 nt, Human
accuggacucugaucacuuuug

SEQ ID NO: 147185 - RNA, 22 nt, Human
accugaucugagaaguggaggg

SEQ ID NO: 147186 - RNA, 22 nt, Human
accucccgacggcgcgggagaa

SEQ ID NO: 147187 - RNA, 23 nt, Human
accuccuuguugaguggggguga

SEQ ID NO: 147188 - RNA, 22 nt, Human
accucagauuguggcuccgcug

SEQ ID NO: 147189 - RNA, 22 nt, Human
accgucagguuagaaugagcac

SEQ ID NO: 147190 - RNA, 22 nt, Human
accuucugaccucucggacuuc

SEQ ID NO: 147191 - RNA, 22 nt, Human
accuugauggagugaugaauga

SEQ ID NO: 147192 - RNA, 22 nt, Human
accugguuucuuacccaagaga

SEQ ID NO: 147193 - RNA, 22 nt, Human
acgaggauuuccuuagaugaaa

SEQ ID NO: 147194 - RNA, 23 nt, Human
acgaccuugcccucauuccaaag

SEQ ID NO: 147195 - RNA, 21 nt, Human
accuggugaugaaugggaggc

SEQ ID NO: 147196 - RNA, 22 nt, Human
accugguaaccugccugacuaa

SEQ ID NO: 147197 - RNA, 22 nt, Human
accuggauauuuucaguugcau

SEQ ID NO: 147198 - RNA, 22 nt, Human
accugcucucccucucgcaguc

SEQ ID NO: 147199 - RNA, 22 nt, Human
accuggaccugccaccuaugag

SEQ ID NO: 147200 - RNA, 22 nt, Human
accugcagguguuuccacacuu

SEQ ID NO: 147201 - RNA, 19 nt, Human
accuguucaaccucgugcu

SEQ ID NO: 147202 - RNA, 22 nt, Human
acggcuugaacgcgccuguggg

SEQ ID NO: 147203 - RNA, 22 nt, Human
acggcggguuccgggccagccc

SEQ ID NO: 147204 - RNA, 22 nt, Human
acggagggagagagggaggaga

SEQ ID NO: 147205 - RNA, 22 nt, Human
acgcacuuuaugcuuuuaacaa

SEQ ID NO: 147206 - RNA, 22 nt, Human
acgauacaaucauauaguaccu

SEQ ID NO: 147207 - RNA, 22 nt, Human
acgauaacaauaguagcaugua

SEQ ID NO: 147208 - RNA, 20 nt, Human
acgaacauauugcaggguuu

SEQ ID NO: 147209 - RNA, 22 nt, Human
accuugggcccagaccggcacg

SEQ ID NO: 147210 - RNA, 22 nt, Human
acgugaccuuauuugaaaaaug

SEQ ID NO: 147211 - RNA, 22 nt, Human
acgggugcuuguucccgcugcu

SEQ ID NO: 147212 - RNA, 22 nt, Human
acgggggagucuuuuacaucau

SEQ ID NO: 147213 - RNA, 22 nt, Human
acgggugugauuccuuuugugu

SEQ ID NO: 147214 - RNA, 22 nt, Human
acguagggauuccucgucucau

SEQ ID NO: 147215 - RNA, 22 nt, Human
acgguuuggggaggaggauccc

SEQ ID NO: 147216 - RNA, 22 nt, Human
acgguguuucucguucaggguu

SEQ ID NO: 147217 - RNA, 21 nt, Human
acauguacacauguaugcaca

SEQ ID NO: 147218 - RNA, 22 nt, Human
acaugguguggcacuaggggcu

SEQ ID NO: 147219 - RNA, 22 nt, Human
acaugggggugggacggcagag

SEQ ID NO: 147220 - RNA, 22 nt, Human
acaucacuugguuaaugugguc

SEQ ID NO: 147221 - RNA, 22 nt, Human
acauggggaaaaaggccugcuc

SEQ ID NO: 147222 - RNA, 21 nt, Human
aauucccagaaacagcacaag

SEQ ID NO: 147223 - RNA, 22 nt, Human
acaugaggaacucaggagucac

SEQ ID NO: 147224 - RNA, 22 nt, Human
acauguuuacaaaccucaagcc

SEQ ID NO: 147225 - RNA, 22 nt, Human
acauccaguaucagaagcauca

SEQ ID NO: 147226 - RNA, 22 nt, Human
acaucuucuauggagguucgga

SEQ ID NO: 147227 - RNA, 22 nt, Human
acaugcacagcaagggugagag

SEQ ID NO: 147228 - RNA, 22 nt, Human
acaugaguuacuuccgauuccc

SEQ ID NO: 147229 - RNA, 20 nt, Human
acauggagaagcgagguagg

SEQ ID NO: 147230 - RNA, 22 nt, Human
acauuuccaaagaugccaguca

SEQ ID NO: 147231 - RNA, 22 nt, Human
acaugcuuucuagguccuucug

SEQ ID NO: 147232 - RNA, 22 nt, Human
acauggaccucagauccuggcc

SEQ ID NO: 147233 - RNA, 22 nt, Human
accacguccugguggcuguugg

SEQ ID NO: 147234 - RNA, 22 nt, Human
accaccacugacaccagcucgg

SEQ ID NO: 147235 - RNA, 22 nt, Human
accagccacacacauuagucac

SEQ ID NO: 147236 - RNA, 22 nt, Human
accagccacccugccgcguccg

SEQ ID NO: 147237 - RNA, 22 nt, Human
accagguugagacuucggcuuu

SEQ ID NO: 147238 - RNA, 22 nt, Human
accaggcagcaccaaagccggu

SEQ ID NO: 147239 - RNA, 22 nt, Human
accccuuaaauuuguuguuuaa

SEQ ID NO: 147240 - RNA, 22 nt, Human
accccuacugaaauuuccuggu

SEQ ID NO: 147241 - RNA, 20 nt, Human
accccuccccacuccucgcc

SEQ ID NO: 147242 - RNA, 22 nt, Human
accaccacauaguaggcacuua

SEQ ID NO: 147243 - RNA, 22 nt, Human
acccauggcucucugggaugcu

SEQ ID NO: 147244 - RNA, 22 nt, Human
accccagcucugagccacacca

SEQ ID NO: 147245 - RNA, 22 nt, Human
acccagauauccaggccucugc

SEQ ID NO: 147246 - RNA, 20 nt, Human
acccaaagcucagcgugucc

SEQ ID NO: 147247 - RNA, 19 nt, Human
accauggguguguuaagaa

SEQ ID NO: 147248 - RNA, 22 nt, Human
accauccaggugagggagaccu

SEQ ID NO: 147249 - RNA, 22 nt, Human
accaugacugucacauuauuau

SEQ ID NO: 147250 - RNA, 22 nt, Human
accauccaaaagcuuuucauca

SEQ ID NO: 147251 - RNA, 22 nt, Human
accaggguacuucuaggugggg

SEQ ID NO: 147252 - RNA, 22 nt, Human
accaguucuauguagauaauga

SEQ ID NO: 147253 - RNA, 22 nt, Human
accaguuuuuugaccaugggug

SEQ ID NO: 147254 - RNA, 22 nt, Human
acauuuuguuuauggaaaagau

SEQ ID NO: 147255 - RNA, 22 nt, Human
accaauguuuuauagaaaugcc

SEQ ID NO: 147256 - RNA, 22 nt, Human
accaauguucaaccuugacugc

SEQ ID NO: 147257 - RNA, 20 nt, Human
acccagaguccuccccgcgc

SEQ ID NO: 147258 - RNA, 21 nt, Human
acccagaauggagccaagccu

SEQ ID NO: 147259 - RNA, 22 nt, Human
accaacacgucugaguauuucc

SEQ ID NO: 147260 - RNA, 19 nt, Human
accaaacaguggacggagc

SEQ ID NO: 147261 - RNA, 22 nt, Human
accaacuuuccaaagugccugg

SEQ ID NO: 147262 - RNA, 22 nt, Human
acauggguuaaagaagauggaa

SEQ ID NO: 147263 - RNA, 22 nt, Human
acauguggaggaggcgagggua

SEQ ID NO: 147264 - RNA, 22 nt, Human
accagcgcguuuucaguuucau

SEQ ID NO: 147265 - RNA, 22 nt, Human
accaggaguuuugaccaggggc

SEQ ID NO: 147266 - RNA, 22 nt, Human
acauugguauuaguguggcuga

SEQ ID NO: 147267 - RNA, 17 nt, Human
accaggggcagcacugc

SEQ ID NO: 147268 - RNA, 22 nt, Human
acauuuugggagaaaguuguua

SEQ ID NO: 147269 - RNA, 22 nt, Human
cccagcugaacuugcauuccaa

SEQ ID NO: 147270 - RNA, 22 nt, Human
cccagggguugaggccguaggg

SEQ ID NO: 147271 - RNA, 22 nt, Human
cccagcuuugcggacccgggag

SEQ ID NO: 147272 - RNA, 22 nt, Human
ccagcagaagcucccgcugggu

SEQ ID NO: 147273 - RNA, 22 nt, Human
ccagcaggagacuagcaacaua

SEQ ID NO: 147274 - RNA, 22 nt, Human
cccauuuuuuggauguguggau

SEQ ID NO: 147275 - RNA, 22 nt, Human
ccagaugggggcugugggaggg

SEQ ID NO: 147276 - RNA, 22 nt, Human
ccagcaaguaagucagugucag

SEQ ID NO: 147277 - RNA, 22 nt, Human
cccagcaccauaacucaggccu

SEQ ID NO: 147278 - RNA, 22 nt, Human
cccagcccaucauuccugcaaa

SEQ ID NO: 147279 - RNA, 22 nt, Human
cccagccgaaugcucccuuccc

SEQ ID NO: 147280 - RNA, 20 nt, Human
caucaacaccuugucagccu

SEQ ID NO: 147281 - RNA, 22 nt, Human
cccgggccgagucuuccagcga

SEQ ID NO: 147282 - RNA, 22 nt, Human
cccgaggagagguccaggcccu

SEQ ID NO: 147283 - RNA, 22 nt, Human
ccaggcuaggaccgauuucccu

SEQ ID NO: 147284 - RNA, 22 nt, Human
ccaggcucaccuggagccccug

SEQ ID NO: 147285 - RNA, 22 nt, Human
ccagggagggccacagggccau

SEQ ID NO: 147286 - RNA, 22 nt, Human
cccgcucaccccacuccaccag

SEQ ID NO: 147287 - RNA, 22 nt, Human
cccggagcagucgggcuccggg

SEQ ID NO: 147288 - RNA, 22 nt, Human
ccaggaguccgugggucuugag

SEQ ID NO: 147289 - RNA, 22 nt, Human
ccagccacugacugauuuaaaa

SEQ ID NO: 147290 - RNA, 22 nt, Human
ccagccugagcuugcugcccuc

SEQ ID NO: 147291 - RNA, 22 nt, Human
ccccagugguugcaacagcaga

SEQ ID NO: 147292 - RNA, 22 nt, Human
ccccaguuucaccuaccccgcc

SEQ ID NO: 147293 - RNA, 22 nt, Human
ccccauggaaaacccaccuagg

SEQ ID NO: 147294 - RNA, 22 nt, Human
cccccauccccugaaggagcug

SEQ ID NO: 147295 - RNA, 22 nt, Human
ccccguggcugggggacagagc

SEQ ID NO: 147296 - RNA, 23 nt, Human
ccccugcauggcaccacauuccc

SEQ ID NO: 147297 - RNA, 22 nt, Human
ccccugcucagggaggagaccg

SEQ ID NO: 147298 - RNA, 22 nt, Human
ccccugggcccugagccgcgau

SEQ ID NO: 147299 - RNA, 22 nt, Human
ccagcugcugcaccgugcaugg

SEQ ID NO: 147300 - RNA, 22 nt, Human
ccagcugggucccugcuggggc

SEQ ID NO: 147301 - RNA, 22 nt, Human
ccauuucacaucccugacaugu

SEQ ID NO: 147302 - RNA, 22 nt, Human
ccaugugaccugugucaguugc

SEQ ID NO: 147303 - RNA, 22 nt, Human
cccacccuacugcuacccagga

SEQ ID NO: 147304 - RNA, 22 nt, Human
ccauuuuccuguauggacucga

SEQ ID NO: 147305 - RNA, 22 nt, Human
ccgccccaggcccugagccaag

SEQ ID NO: 147306 - RNA, 18 nt, Human
cccaccugcccagguuca

SEQ ID NO: 147307 - RNA, 22 nt, Human
cccaaccagaaauugacagaga

SEQ ID NO: 147308 - RNA, 19 nt, Human
ccgagcagauugauguuuc

SEQ ID NO: 147309 - RNA, 22 nt, Human
ccgaggaguagggugucuacgg

SEQ ID NO: 147310 - RNA, 21 nt, Human
ccgaggagugcggggagcccc

SEQ ID NO: 147311 - RNA, 22 nt, Human
ccgcaccgucugccauacacgc

SEQ ID NO: 147312 - RNA, 22 nt, Human
ccgaaccacacgacagugcuca

SEQ ID NO: 147313 - RNA, 21 nt, Human
ccgacggcgcagaugccggcc

SEQ ID NO: 147314 - RNA, 22 nt, Human
cccuuugucaguagucuuagug

SEQ ID NO: 147315 - RNA, 22 nt, Human
cccugauaaaucagcaccucag

SEQ ID NO: 147316 - RNA, 22 nt, Human
ccaggggagagucugagucguu

SEQ ID NO: 147317 - RNA, 17 nt, Human
cccugcacccuacucuc

SEQ ID NO: 147318 - RNA, 22 nt, Human
ccagguuggccaccuucacggg

SEQ ID NO: 147319 - RNA, 22 nt, Human
ccaguccacgucaagaagaggu

SEQ ID NO: 147320 - RNA, 22 nt, Human
ccagggucggcaucagcguggg

SEQ ID NO: 147321 - RNA, 22 nt, Human
ccagguggacggcgaguacagg

SEQ ID NO: 147322 - RNA, 22 nt, Human
cccgggucugugugaaauucca

SEQ ID NO: 147323 - RNA, 22 nt, Human
cccgguggagaugugggacagg

SEQ ID NO: 147324 - RNA, 22 nt, Human
ccagggcugcugccugggcugg

SEQ ID NO: 147325 - RNA, 22 nt, Human
ccagggcuggaccagugcuugg

SEQ ID NO: 147326 - RNA, 22 nt, Human
cccuggacuccauuuucccgua

SEQ ID NO: 147327 - RNA, 22 nt, Human
cccuggcucaggcagcuuuguu

SEQ ID NO: 147328 - RNA, 22 nt, Human
cccugggccccgaacugcugag

SEQ ID NO: 147329 - RNA, 22 nt, Human
cccugcuuccucuucuguuugu

SEQ ID NO: 147330 - RNA, 17 nt, Human
cccugcauugauccuca

SEQ ID NO: 147331 - RNA, 22 nt, Human
ccagucugccggcccggccccu

SEQ ID NO: 147332 - RNA, 22 nt, Human
cccugcacuguguggacucugg

SEQ ID NO: 147333 - RNA, 22 nt, Human
ccaguguguuuuucucugacuc

SEQ ID NO: 147334 - RNA, 22 nt, Human
ccagugcaguacaaaccuuagu

SEQ ID NO: 147335 - RNA, 22 nt, Human
cccaggucgucagcaguguggu

SEQ ID NO: 147336 - RNA, 22 nt, Human
ccgguguggguuucucgguagu

SEQ ID NO: 147337 - RNA, 22 nt, Human
ccguccgcuccuccagccgcug

SEQ ID NO: 147338 - RNA, 22 nt, Human
cccaguuguuccuauucuucuu

SEQ ID NO: 147339 - RNA, 22 nt, Human
cccaugacucucauucacaguc

SEQ ID NO: 147340 - RNA, 22 nt, Human
cccaggcuggggcuccuccagc

SEQ ID NO: 147341 - RNA, 20 nt, Human
ccccagcauccuuuucaucu

SEQ ID NO: 147342 - RNA, 22 nt, Human
ccccaguuccugucaaggguaa

SEQ ID NO: 147343 - RNA, 22 nt, Human
ccccacaugaauacaguguagu

SEQ ID NO: 147344 - RNA, 22 nt, Human
ccccaggcagcccuccaggagc

SEQ ID NO: 147345 - RNA, 22 nt, Human
ccgugggugggguacgggcugg

SEQ ID NO: 147346 - RNA, 21 nt, Human
ccccuguggagcacauguggc

SEQ ID NO: 147347 - RNA, 22 nt, Human
ccuacccaccccuccucaucac

SEQ ID NO: 147348 - RNA, 22 nt, Human
ccuacccucaagggccuggggg

SEQ ID NO: 147349 - RNA, 22 nt, Human
ccgcggcugcgcggugccccuc

SEQ ID NO: 147350 - RNA, 22 nt, Human
ccgcggcuguaguggaggugga

SEQ ID NO: 147351 - RNA, 22 nt, Human
ccgcggcagaggcgggggcgcc

SEQ ID NO: 147352 - RNA, 22 nt, Human
ccgcgggcagggcuucaccuuu

SEQ ID NO: 147353 - RNA, 22 nt, Human
ccgcucgggugcagagggcaga

SEQ ID NO: 147354 - RNA, 22 nt, Human
cccagaccagagugccuggacg

SEQ ID NO: 147355 - RNA, 22 nt, Human
cccagaaugauucagcgacagu

SEQ ID NO: 147356 - RNA, 22 nt, Human
cccacgccuucuuucuucaaau

SEQ ID NO: 147357 - RNA, 19 nt, Human
cccagaggaaugccuggaa

SEQ ID NO: 147358 - RNA, 22 nt, Human
cccagaggcugaguugggagca

SEQ ID NO: 147359 - RNA, 18 nt, Human
cccagaggaaugccugga

SEQ ID NO: 147360 - RNA, 22 nt, Human
cccagagacuuuguccgacgac

SEQ ID NO: 147361 - RNA, 22 nt, Human
ccgcuggaagcgaguggugggc

SEQ ID NO: 147362 - RNA, 22 nt, Human
cccagccuuugcuuccugguuc

SEQ ID NO: 147363 - RNA, 22 nt, Human
cccagccugaucucggccagcu

SEQ ID NO: 147364 - RNA, 22 nt, Human
cccagcucuggaagguggggga

SEQ ID NO: 147365 - RNA, 22 nt, Human
ccggcugcugaggcggccccgg

SEQ ID NO: 147366 - RNA, 22 nt, Human
ccgggcggcauccagccguucc

SEQ ID NO: 147367 - RNA, 22 nt, Human
cccagccgcuguggucuagggu

SEQ ID NO: 147368 - RNA, 22 nt, Human
ccggcggaaacauggcggcgcc

SEQ ID NO: 147369 - RNA, 22 nt, Human
ccggauuugggagccaccaggg

SEQ ID NO: 147370 - RNA, 22 nt, Human
ccggcggguggagcaugcgcgg

SEQ ID NO: 147371 - RNA, 22 nt, Human
ccggcugagccucgccgcggcc

SEQ ID NO: 147372 - RNA, 22 nt, Human
ccggguccagugggcacugggc

SEQ ID NO: 147373 - RNA, 22 nt, Human
ccgggcuuccuuagagcaagau

SEQ ID NO: 147374 - RNA, 22 nt, Human
cccaggccguguaaucagcagc

SEQ ID NO: 147375 - RNA, 22 nt, Human
cccagcuggcaaaggcguccuu

SEQ ID NO: 147376 - RNA, 22 nt, Human
cccagcgccugcccuccgccgc

SEQ ID NO: 147377 - RNA, 22 nt, Human
cccggcucggcuucuuccccac

SEQ ID NO: 147378 - RNA, 22 nt, Human
cccggcgccucguuuccuaguc

SEQ ID NO: 147379 - RNA, 22 nt, Human
cccgcuaaaucaguucugaguc

SEQ ID NO: 147380 - RNA, 22 nt, Human
ccucgcucauggauucugccug

SEQ ID NO: 147381 - RNA, 22 nt, Human
cccgaaaauuguuguacugcag

SEQ ID NO: 147382 - RNA, 22 nt, Human
cccgacuccuccugguaccuaa

SEQ ID NO: 147383 - RNA, 22 nt, Human
cccgccggccacaccggccgcc

SEQ ID NO: 147384 - RNA, 19 nt, Human
cccgauggagacuuagcag

SEQ ID NO: 147385 - RNA, 22 nt, Human
ccuccacgaggggucuucucuu

SEQ ID NO: 147386 - RNA, 22 nt, Human
cccuccgccagugcccgccccg

SEQ ID NO: 147387 - RNA, 22 nt, Human
cccguggugggaugacaccaug

SEQ ID NO: 147388 - RNA, 19 nt, Human
cccucggcuucugguuacu

SEQ ID NO: 147389 - RNA, 23 nt, Human
cccucgcuccucgguuccccugu

SEQ ID NO: 147390 - RNA, 22 nt, Human
ccucuccucugugcagacugcc

SEQ ID NO: 147391 - RNA, 22 nt, Human
cccgguugggguuccagggcgc

SEQ ID NO: 147392 - RNA, 23 nt, Human
cccgggaagugcugcuuaucugg

SEQ ID NO: 147393 - RNA, 22 nt, Human
cccgggcucuggcagaggcggu

SEQ ID NO: 147394 - RNA, 22 nt, Human
ccucggacuugggugggcuccu

SEQ ID NO: 147395 - RNA, 22 nt, Human
ccugaccauuugccacaugggu

SEQ ID NO: 147396 - RNA, 22 nt, Human
cccugaggcccacaagucccag

SEQ ID NO: 147397 - RNA, 20 nt, Human
ccucucugcaugcucccuga

SEQ ID NO: 147398 - RNA, 22 nt, Human
cccuccagugucccagugggga

SEQ ID NO: 147399 - RNA, 20 nt, Human
cccuggaaugagaugcauau

SEQ ID NO: 147400 - RNA, 20 nt, Human
cccuggcuggcaucuggacu

SEQ ID NO: 147401 - RNA, 22 nt, Human
cccuggucucugacuugauccu

SEQ ID NO: 147402 - RNA, 22 nt, Human
cccugggucagagcgacuucuc

SEQ ID NO: 147403 - RNA, 22 nt, Human
cccuguccugcuaggcccuggu

SEQ ID NO: 147404 - RNA, 21 nt, Human
ccugagucccccagacccugg

SEQ ID NO: 147405 - RNA, 22 nt, Human
ccugagccgagcgcucuuucuc

SEQ ID NO: 147406 - RNA, 21 nt, Human
ccugagccuguuuauccagaa

SEQ ID NO: 147407 - RNA, 22 nt, Human
ccugccagccugccaucccaca

SEQ ID NO: 147408 - RNA, 22 nt, Human
ccugccagaaaagagggaguuc

SEQ ID NO: 147409 - RNA, 22 nt, Human
ccugcugagccuggugggcagc

SEQ ID NO: 147410 - RNA, 22 nt, Human
ccugcaguagagguugguaggg

SEQ ID NO: 147411 - RNA, 18 nt, Human
ccugcguggauguccucu

SEQ ID NO: 147412 - RNA, 21 nt, Human
ccugcacuucccuccucaagu

SEQ ID NO: 147413 - RNA, 22 nt, Human
ccugcacuaccuggggcugcug

SEQ ID NO: 147414 - RNA, 21 nt, Human
cccuugccugcacuccucggc

SEQ ID NO: 147415 - RNA, 22 nt, Human
cgcauugcaauucaggggauaa

SEQ ID NO: 147416 - RNA, 22 nt, Human
cgcaucggguagaggagcugga

SEQ ID NO: 147417 - RNA, 22 nt, Human
cgcacuggagcuggaacgaguc

SEQ ID NO: 147418 - RNA, 22 nt, Human
cgagcccacacuccuguccucu

SEQ ID NO: 147419 - RNA, 22 nt, Human
cgagcccaacccucccguccuc

SEQ ID NO: 147420 - RNA, 23 nt, Human
cgagagccugcaggaccuucgga

SEQ ID NO: 147421 - RNA, 22 nt, Human
ccucaucagaaagcagaaagca

SEQ ID NO: 147422 - RNA, 19 nt, Human
cgacauggguaaugggaga

SEQ ID NO: 147423 - RNA, 19 nt, Human
ccucggggucugaagucag

SEQ ID NO: 147424 - RNA, 22 nt, Human
cgacgacaggcgcccgaggagg

SEQ ID NO: 147425 - RNA, 22 nt, Human
ccucucccugcagggcccaggg

SEQ ID NO: 147426 - RNA, 22 nt, Human
ccucgugcgauaguuaugucag

SEQ ID NO: 147427 - RNA, 22 nt, Human
ccgccacggggcaugggaggca

SEQ ID NO: 147428 - RNA, 22 nt, Human
ccgccucucgcucccagcuugc

SEQ ID NO: 147429 - RNA, 22 nt, Human
ccgcagggcccggcgggcucag

SEQ ID NO: 147430 - RNA, 22 nt, Human
ccgcagucugcaaucucccugg

SEQ ID NO: 147431 - RNA, 22 nt, Human
ccugcugcugaugcuguuucac

SEQ ID NO: 147432 - RNA, 22 nt, Human
ccgagguccugaagcaagggcc

SEQ ID NO: 147433 - RNA, 22 nt, Human
cggaagcacuagacacugacac

SEQ ID NO: 147434 - RNA, 22 nt, Human
ccugauauggugucauuuaaac

SEQ ID NO: 147435 - RNA, 22 nt, Human
cgcucggugagccaguggcgga

SEQ ID NO: 147436 - RNA, 22 nt, Human
cgcucggcuuucccuccgccgg

SEQ ID NO: 147437 - RNA, 22 nt, Human
cgcgggcuugggcaccugcgga

SEQ ID NO: 147438 - RNA, 22 nt, Human
ccugacagcgugucccuggccc

SEQ ID NO: 147439 - RNA, 22 nt, Human
ccugaagaugguugauccccuu

SEQ ID NO: 147440 - RNA, 22 nt, Human
ccugcucccccugcaagccuug

SEQ ID NO: 147441 - RNA, 22 nt, Human
ccugcaugacuuugucagaccu

SEQ ID NO: 147442 - RNA, 22 nt, Human
ccugcaguuuuuccaugauaca

SEQ ID NO: 147443 - RNA, 22 nt, Human
ccugcccaucccaccccagcau

SEQ ID NO: 147444 - RNA, 22 nt, Human
cggcggcgaaccgaccugggug

SEQ ID NO: 147445 - RNA, 22 nt, Human
cggcgcugguacaguggaagag

SEQ ID NO: 147446 - RNA, 22 nt, Human
cggccuuugcccgucauucugg

SEQ ID NO: 147447 - RNA, 22 nt, Human
ccugcuggagucuaguuggucu

SEQ ID NO: 147448 - RNA, 19 nt, Human
ccugcugaagugaugcagc

SEQ ID NO: 147449 - RNA, 22 nt, Human
cggcuacccaugucauauucgu

SEQ ID NO: 147450 - RNA, 20 nt, Human
ccugggcuccaggagccccg

SEQ ID NO: 147451 - RNA, 22 nt, Human
ccuggguccucacaaucccagg

SEQ ID NO: 147452 - RNA, 22 nt, Human
ccugggcauaaaucacuccaag

SEQ ID NO: 147453 - RNA, 22 nt, Human
ccugggugaugugcugcccucg

SEQ ID NO: 147454 - RNA, 22 nt, Human
cggggcggcgagcgggccgggc

SEQ ID NO: 147455 - RNA, 22 nt, Human
cgggcccaggcaggggcucccc

SEQ ID NO: 147456 - RNA, 22 nt, Human
cggggucuggaguuguggugug

SEQ ID NO: 147457 - RNA, 22 nt, Human
ccuguuuguucauguacuguga

SEQ ID NO: 147458 - RNA, 22 nt, Human
ccuguguucguccucaccuugc

SEQ ID NO: 147459 - RNA, 22 nt, Human
cggggcgggcgugggaggugga

SEQ ID NO: 147460 - RNA, 22 nt, Human
ccuuccaguucuugguuguaau

SEQ ID NO: 147461 - RNA, 22 nt, Human
cgggguguggggcgguagugug

SEQ ID NO: 147462 - RNA, 22 nt, Human
cggggugugacggugcgggccu

SEQ ID NO: 147463 - RNA, 18 nt, Human
ccuucaucucugcuucuu

SEQ ID NO: 147464 - RNA, 22 nt, Human
cggugccccuagcgcgccgccc

SEQ ID NO: 147465 - RNA, 22 nt, Human
cggucggagagaaugaccugga

SEQ ID NO: 147466 - RNA, 22 nt, Human
cgggucgagugcuguaguucga

SEQ ID NO: 147467 - RNA, 22 nt, Human
ccuucccagacggcucagcugu

SEQ ID NO: 147468 - RNA, 19 nt, Human
cggugaagagaguuuagau

SEQ ID NO: 147469 - RNA, 22 nt, Human
cgugcaggagcuggagguccga

SEQ ID NO: 147470 - RNA, 22 nt, Human
cguugguggguguguggucgga

SEQ ID NO: 147471 - RNA, 22 nt, Human
cguucccuccugccacgggagg

SEQ ID NO: 147472 - RNA, 20 nt, Human
cguugccagcccggcccggg

SEQ ID NO: 147473 - RNA, 22 nt, Human
cgacagauuauuuugugacugc

SEQ ID NO: 147474 - RNA, 22 nt, Human
cuaagaaggaggaaaagugcca

SEQ ID NO: 147475 - RNA, 22 nt, Human
cuaauugcuggcugcuggcaga

SEQ ID NO: 147476 - RNA, 22 nt, Human
cgaccccugaaaauggcagcca

SEQ ID NO: 147477 - RNA, 22 nt, Human
cgacuacuaacuacuguagaaa

SEQ ID NO: 147478 - RNA, 22 nt, Human
cgccuggccccgcagcgcuugu

SEQ ID NO: 147479 - RNA, 22 nt, Human
cucaggaaaauauugaagaagu

SEQ ID NO: 147480 - RNA, 22 nt, Human
cgcugcagcggcugagucccgc

SEQ ID NO: 147481 - RNA, 22 nt, Human
cucacugucagcugcagggcuu

SEQ ID NO: 147482 - RNA, 22 nt, Human
cuauugguaucacacugauuuc

SEQ ID NO: 147483 - RNA, 22 nt, Human
cuccagggcuaccagguuuuag

SEQ ID NO: 147484 - RNA, 22 nt, Human
cuccaggcccagggccaagagc

SEQ ID NO: 147485 - RNA, 22 nt, Human
cuccagucccuccuugcccagc

SEQ ID NO: 147486 - RNA, 22 nt, Human
cuccuggagcagcaggcgcagg

SEQ ID NO: 147487 - RNA, 22 nt, Human
cuccugcuuuuucuucuuccga

SEQ ID NO: 147488 - RNA, 22 nt, Human
cgcuucauugugggggccccca

SEQ ID NO: 147489 - RNA, 22 nt, Human
cucggcccuggucuuacgggac

SEQ ID NO: 147490 - RNA, 22 nt, Human
cucccgagccuuacucuguucc

SEQ ID NO: 147491 - RNA, 22 nt, Human
cucguccugguuuaaguguccu

SEQ ID NO: 147492 - RNA, 22 nt, Human
cucggggcguggcaguagcaug

SEQ ID NO: 147493 - RNA, 22 nt, Human
cuccuugguuccggcguuggag

SEQ ID NO: 147494 - RNA, 22 nt, Human
cucugcuuguaucacauuugcu

SEQ ID NO: 147495 - RNA, 22 nt, Human
cucuggcaacgauggugcuuau

SEQ ID NO: 147496 - RNA, 19 nt, Human
cucuggcuccugggcugcc

SEQ ID NO: 147497 - RNA, 22 nt, Human
cucuguggucugaagccuguga

SEQ ID NO: 147498 - RNA, 22 nt, Human
cggcgccccgcgcgggcggcuc

SEQ ID NO: 147499 - RNA, 22 nt, Human
cucuugacagcuuuaguaucau

SEQ ID NO: 147500 - RNA, 22 nt, Human
cgggcuccaagcuuucacccca

SEQ ID NO: 147501 - RNA, 22 nt, Human
cggggcaaggggggcuggugga

SEQ ID NO: 147502 - RNA, 22 nt, Human
cgggagcagcucuggggcuggg

SEQ ID NO: 147503 - RNA, 22 nt, Human
cggcuucucgggucggauuccg

SEQ ID NO: 147504 - RNA, 20 nt, Human
cgggacacucaagcucuggg

SEQ ID NO: 147505 - RNA, 22 nt, Human
cgggagagacagaggaggcgcc

SEQ ID NO: 147506 - RNA, 22 nt, Human
cggggcuccgaagagcucgguu

SEQ ID NO: 147507 - RNA, 22 nt, Human
cggggaggagccagcggaggau

SEQ ID NO: 147508 - RNA, 22 nt, Human
cggggcucugcacaggccagga

SEQ ID NO: 147509 - RNA, 22 nt, Human
cugaagaaagaaaauggccauc

SEQ ID NO: 147510 - RNA, 22 nt, Human
cugaaagcaaaguaauucuuaa

SEQ ID NO: 147511 - RNA, 22 nt, Human
cgguccugcucuuccucccguu

SEQ ID NO: 147512 - RNA, 22 nt, Human
cggguccuucugucuucucugg

SEQ ID NO: 147513 - RNA, 22 nt, Human
cgggucgcacaggagaaaggcg

SEQ ID NO: 147514 - RNA, 19 nt, Human
cggugcugauuggugcagu

SEQ ID NO: 147515 - RNA, 22 nt, Human
cggggcuggcguuagggaggca

SEQ ID NO: 147516 - RNA, 19 nt, Human
cggggcuugguggguucuc

SEQ ID NO: 147517 - RNA, 22 nt, Human
cggggccccccagugaaccucu

SEQ ID NO: 147518 - RNA, 20 nt, Human
cugaauaccacagagccauc

SEQ ID NO: 147519 - RNA, 22 nt, Human
cugaaucaaaugacuuagccau

SEQ ID NO: 147520 - RNA, 22 nt, Human
cugaaggcuuugaauggaauga

SEQ ID NO: 147521 - RNA, 22 nt, Human
cugaauucuuguugucggagca

SEQ ID NO: 147522 - RNA, 19 nt, Human
cuuugugguuuucagaacu

SEQ ID NO: 147523 - RNA, 21 nt, Human
cuuugccuccagcagccgcag

SEQ ID NO: 147524 - RNA, 22 nt, Human
cuggcagcucugagucccuucu

SEQ ID NO: 147525 - RNA, 22 nt, Human
cuggcaguguccagcucgugau

SEQ ID NO: 147526 - RNA, 22 nt, Human
cuggccagccucccagguaccc

SEQ ID NO: 147527 - RNA, 22 nt, Human
cuggcccugucagcacagaauc

SEQ ID NO: 147528 - RNA, 22 nt, Human
cugugcuguuagcgauuuuuaa

SEQ ID NO: 147529 - RNA, 22 nt, Human
cuguggcugcgcccugggggag

SEQ ID NO: 147530 - RNA, 22 nt, Human
cuguggcuaggaagcuguggga

SEQ ID NO: 147531 - RNA, 22 nt, Human
cuguggaguccuggggaaugga

SEQ ID NO: 147532 - RNA, 22 nt, Human
cugugucucccaaggaggguca

SEQ ID NO: 147533 - RNA, 22 nt, Human
gaacugggguagggguagcuuu

SEQ ID NO: 147534 - RNA, 22 nt, Human
cuguuucuuugcugucagagag

SEQ ID NO: 147535 - RNA, 22 nt, Human
cuguuucucugccugcacacau

SEQ ID NO: 147536 - RNA, 22 nt, Human
cuguuguguuauuugcagugca

SEQ ID NO: 147537 - RNA, 22 nt, Human
cuguucuccacuccugacuucu

SEQ ID NO: 147538 - RNA, 22 nt, Human
cuguucagugcauauguauuga

SEQ ID NO: 147539 - RNA, 22 nt, Human
cuuauuugcccauguuucuuua

SEQ ID NO: 147540 - RNA, 22 nt, Human
cuucacugcagucauggcucug

SEQ ID NO: 147541 - RNA, 22 nt, Human
cuucagcgucgucaguguugcu

SEQ ID NO: 147542 - RNA, 22 nt, Human
cuucacuccuggagugaguuuc

SEQ ID NO: 147543 - RNA, 22 nt, Human
gaagccaacacgugggagggag

SEQ ID NO: 147544 - RNA, 22 nt, Human
cuucucuuugacaguugggugu

SEQ ID NO: 147545 - RNA, 22 nt, Human
cuucccugucuacaacccugcc

SEQ ID NO: 147546 - RNA, 22 nt, Human
cuucuucaucuuuuggaggaac

SEQ ID NO: 147547 - RNA, 22 nt, Human
gaaggcaguaaauggcuguuuu

SEQ ID NO: 147548 - RNA, 22 nt, Human
gaaggagaggauugugaggcug

SEQ ID NO: 147549 - RNA, 22 nt, Human
gaaggaagcugucuggaugugu

SEQ ID NO: 147550 - RNA, 22 nt, Human
gaagcuucucaacugguggaau

SEQ ID NO: 147551 - RNA, 22 nt, Human
gaagcccuggaggggcuggagg

SEQ ID NO: 147552 - RNA, 19 nt, Human
cuucaguguucaccuggcc

SEQ ID NO: 147553 - RNA, 22 nt, Human
gaauacaagccugccaccugga

SEQ ID NO: 147554 - RNA, 22 nt, Human
cuucuuugacucacugguacgc

SEQ ID NO: 147555 - RNA, 22 nt, Human
cuucuugggaggggcggagcuc

SEQ ID NO: 147556 - RNA, 22 nt, Human
cuucuucuagaagauggggaag

SEQ ID NO: 147557 - RNA, 22 nt, Human
cuugcugggagagcuuuagaga

SEQ ID NO: 147558 - RNA, 21 nt, Human
cuuggagacucuuggccacau

SEQ ID NO: 147559 - RNA, 22 nt, Human
cuugcuuuaucugguuucucau

SEQ ID NO: 147560 - RNA, 22 nt, Human
cuuggcacauuuuguucuucug

SEQ ID NO: 147561 - RNA, 22 nt, Human
cuuggugagcuccuggcgcagc

SEQ ID NO: 147562 - RNA, 22 nt, Human
cuuggugcgaagagucagggga

SEQ ID NO: 147563 - RNA, 22 nt, Human
gacgacgggccccguggccacc

SEQ ID NO: 147564 - RNA, 22 nt, Human
gacggaggacaucagcaguguc

SEQ ID NO: 147565 - RNA, 22 nt, Human
gacggagugcgcuugcuguuca

SEQ ID NO: 147566 - RNA, 20 nt, Human
gacgaacuagaacaguggua

SEQ ID NO: 147567 - RNA, 20 nt, Human
gacaugagggagcaaagagc

SEQ ID NO: 147568 - RNA, 22 nt, Human
gaccaggagauuugagcuaggc

SEQ ID NO: 147569 - RNA, 22 nt, Human
gacccgacaaguaaucagguga

SEQ ID NO: 147570 - RNA, 22 nt, Human
gacccggauguuguacucgagg

SEQ ID NO: 147571 - RNA, 22 nt, Human
gacaucuguccauggcacugga

SEQ ID NO: 147572 - RNA, 22 nt, Human
gacauugaauugaauccagauu

SEQ ID NO: 147573 - RNA, 22 nt, Human
gacuggggcauuagaguagcuu

SEQ ID NO: 147574 - RNA, 22 nt, Human
gacuggguaaagcuuauccaaa

SEQ ID NO: 147575 - RNA, 23 nt, Human
gacuucacacucucaaccacugc

SEQ ID NO: 147576 - RNA, 22 nt, Human
gacuucuuaaagaggugaggaa

SEQ ID NO: 147577 - RNA, 20 nt, Human
gacuucaauuucuaucuuuu

SEQ ID NO: 147578 - RNA, 22 nt, Human
gagaagugaauaacgaagcagg

SEQ ID NO: 147579 - RNA, 22 nt, Human
gaaaccauggcaaccagguccu

SEQ ID NO: 147580 - RNA, 22 nt, Human
gaaagcauucuggaggggcaga

SEQ ID NO: 147581 - RNA, 22 nt, Human
gagaggcugagcaguccggguu

SEQ ID NO: 147582 - RNA, 18 nt, Human
gagaggcauuuagcugau

SEQ ID NO: 147583 - RNA, 22 nt, Human
gagagcaaaccuguguuuggag

SEQ ID NO: 147584 - RNA, 22 nt, Human
gaaauagagacaguaagugucu

SEQ ID NO: 147585 - RNA, 22 nt, Human
gagauuguggcagcagcuguuu

SEQ ID NO: 147586 - RNA, 22 nt, Human
gaacaaaagauagcccaaacau

SEQ ID NO: 147587 - RNA, 22 nt, Human
gagauggauuuuuuugccaguc

SEQ ID NO: 147588 - RNA, 22 nt, Human
gagaucuguguuugcugaagcu

SEQ ID NO: 147589 - RNA, 22 nt, Human
gaaccauuuaauggagaugcuc

SEQ ID NO: 147590 - RNA, 22 nt, Human
gaaccuggcagcccuauaucug

SEQ ID NO: 147591 - RNA, 22 nt, Human
gagcagccugaggauucugcuc

SEQ ID NO: 147592 - RNA, 22 nt, Human
gagcagcucgagaaggaagcag

SEQ ID NO: 147593 - RNA, 22 nt, Human
gagcagacugcacaguucuugc

SEQ ID NO: 147594 - RNA, 22 nt, Human
gagcacauguggagagucuggg

SEQ ID NO: 147595 - RNA, 22 nt, Human
gaacaugaguuuuaugguauuu

SEQ ID NO: 147596 - RNA, 22 nt, Human
gagcaguuagggaccgcaggcu

SEQ ID NO: 147597 - RNA, 22 nt, Human
gagcagucuuugaaaggcacca

SEQ ID NO: 147598 - RNA, 22 nt, Human
gaagaaggaagaucaugcuuga

SEQ ID NO: 147599 - RNA, 22 nt, Human
gaagaugacaucggaucugucu

SEQ ID NO: 147600 - RNA, 22 nt, Human
gaagaugcugcuuguucacggg

SEQ ID NO: 147601 - RNA, 22 nt, Human
gagcaggcuggcagggccaggg

SEQ ID NO: 147602 - RNA, 22 nt, Human
gagcagggagaggcagagaggc

SEQ ID NO: 147603 - RNA, 22 nt, Human
cuuccauucugauggcuaauua

SEQ ID NO: 147604 - RNA, 22 nt, Human
cuucaguuaguuucaugugagc

SEQ ID NO: 147605 - RNA, 22 nt, Human
cuucauccguaccacggccaca

SEQ ID NO: 147606 - RNA, 22 nt, Human
cugccaguaucuuuggggcugu

SEQ ID NO: 147607 - RNA, 22 nt, Human
cugccaggagaggccagggccc

SEQ ID NO: 147608 - RNA, 22 nt, Human
cuucuaauucuuauguaagcuu

SEQ ID NO: 147609 - RNA, 22 nt, Human
cugccacuaccaugcuggauga

SEQ ID NO: 147610 - RNA, 22 nt, Human
cugcagauguagcugcuuuccu

SEQ ID NO: 147611 - RNA, 22 nt, Human
cuucucuugugauguuagcgga

SEQ ID NO: 147612 - RNA, 22 nt, Human
cuucuguguggauacagucccu

SEQ ID NO: 147613 - RNA, 22 nt, Human
cuucuguggaauagguuugaca

SEQ ID NO: 147614 - RNA, 22 nt, Human
cuugcagccuggagcucagccu

SEQ ID NO: 147615 - RNA, 20 nt, Human
cuugaguucagagcugucau

SEQ ID NO: 147616 - RNA, 22 nt, Human
cugccugugcgccaagugcacg

SEQ ID NO: 147617 - RNA, 22 nt, Human
cugcccugcagcuccacggacu

SEQ ID NO: 147618 - RNA, 22 nt, Human
cugcccauggcuccuggcugug

SEQ ID NO: 147619 - RNA, 22 nt, Human
cugcccgcaugcaggaaugcug

SEQ ID NO: 147620 - RNA, 22 nt, Human
cugcuuguguugcucagaguca

SEQ ID NO: 147621 - RNA, 22 nt, Human
cuggaaaaauggauccugucuu

SEQ ID NO: 147622 - RNA, 22 nt, Human
cuggaagcgucggaggaagggc

SEQ ID NO: 147623 - RNA, 22 nt, Human
cuggacucuuuguuuaguucug

SEQ ID NO: 147624 - RNA, 22 nt, Human
cuggaugagcuucgugcgcacg

SEQ ID NO: 147625 - RNA, 22 nt, Human
cuuucauuuuugggcaucugag

SEQ ID NO: 147626 - RNA, 22 nt, Human
cuggagaagagguaguauguag

SEQ ID NO: 147627 - RNA, 22 nt, Human
cugcugucuuuauuucacugcu

SEQ ID NO: 147628 - RNA, 22 nt, Human
cugcuggugcugcccacacggu

SEQ ID NO: 147629 - RNA, 22 nt, Human
cugcugcuugauugcaggaagu

SEQ ID NO: 147630 - RNA, 22 nt, Human
cuugggacucccuguagcagug

SEQ ID NO: 147631 - RNA, 22 nt, Human
cuugucuaguuccuggugaugu

SEQ ID NO: 147632 - RNA, 22 nt, Human
cugcuugaugaggaaaggauug

SEQ ID NO: 147633 - RNA, 22 nt, Human
cugcgcgagcacugccggcggg

SEQ ID NO: 147634 - RNA, 22 nt, Human
cugcgguucuguuuaguggcga

SEQ ID NO: 147635 - RNA, 22 nt, Human
cugcucugagaggcucuuccua

SEQ ID NO: 147636 - RNA, 22 nt, Human
cuugcuguccgaugggucugua

SEQ ID NO: 147637 - RNA, 22 nt, Human
cuuggcauguucaucugcuugg

SEQ ID NO: 147638 - RNA, 22 nt, Human
cuuggcaaaguggcaaaauuag

SEQ ID NO: 147639 - RNA, 22 nt, Human
cuuggcacccaucuuuccaccu

SEQ ID NO: 147640 - RNA, 22 nt, Human
cucuggggaagugcacucgcug

SEQ ID NO: 147641 - RNA, 17 nt, Human
cucugggucuccugcuu

SEQ ID NO: 147642 - RNA, 18 nt, Human
cucuggacagcaggcauc

SEQ ID NO: 147643 - RNA, 22 nt, Human
cucugcccacaguccccgagga

SEQ ID NO: 147644 - RNA, 22 nt, Human
cucugagcucgugcaguacuuc

SEQ ID NO: 147645 - RNA, 20 nt, Human
cuggugccuucugcgauuua

SEQ ID NO: 147646 - RNA, 22 nt, Human
cuguggaaugcaguugcgagca

SEQ ID NO: 147647 - RNA, 22 nt, Human
cugugcuucgagggcuccccgc

SEQ ID NO: 147648 - RNA, 22 nt, Human
cugugcuugcugugcuggggcc

SEQ ID NO: 147649 - RNA, 22 nt, Human
cuguggguggcugugccccagg

SEQ ID NO: 147650 - RNA, 22 nt, Human
cugugguuucuaugggccuuga

SEQ ID NO: 147651 - RNA, 22 nt, Human
cugugguuuuauuuauuugaag

SEQ ID NO: 147652 - RNA, 22 nt, Human
cugugcauaugucuugaggucu

SEQ ID NO: 147653 - RNA, 22 nt, Human
cugugugcagggcacaauggaa

SEQ ID NO: 147654 - RNA, 22 nt, Human
cuguguguauaauguuugauaa

SEQ ID NO: 147655 - RNA, 22 nt, Human
cuguguggccuaaguggagaca

SEQ ID NO: 147656 - RNA, 22 nt, Human
cugugugugcacacguguaugg

SEQ ID NO: 147657 - RNA, 22 nt, Human
cugaaggacacgugaggagcca

SEQ ID NO: 147658 - RNA, 22 nt, Human
cugaccgugccgcgguacugcu

SEQ ID NO: 147659 - RNA, 22 nt, Human
cugaccucuaaguaacagagaa

SEQ ID NO: 147660 - RNA, 22 nt, Human
cugaccugugagcuaugccggc

SEQ ID NO: 147661 - RNA, 20 nt, Human
cugaccagcagccugucucc

SEQ ID NO: 147662 - RNA, 22 nt, Human
cugaaucugccuccgaggguuu

SEQ ID NO: 147663 - RNA, 22 nt, Human
cuguuuggaugccauggucaag

SEQ ID NO: 147664 - RNA, 22 nt, Human
cugacugaggaucaguucauca

SEQ ID NO: 147665 - RNA, 22 nt, Human
cugagcggugagggcauacagc

SEQ ID NO: 147666 - RNA, 22 nt, Human
cuucaacuucuguuuuaaggaa

SEQ ID NO: 147667 - RNA, 22 nt, Human
cuucacuaccuacacugccgcu

SEQ ID NO: 147668 - RNA, 22 nt, Human
cugagcuuuucucugcuucuua

SEQ ID NO: 147669 - RNA, 21 nt, Human
cucauuccccgucccggcccc

SEQ ID NO: 147670 - RNA, 22 nt, Human
cuggcgagcugggccuggggga

SEQ ID NO: 147671 - RNA, 22 nt, Human
cuccagcucgcgagcucugcuc

SEQ ID NO: 147672 - RNA, 22 nt, Human
cuccccacucaacucccagacc

SEQ ID NO: 147673 - RNA, 22 nt, Human
cugggaaucuagagggcucauu

SEQ ID NO: 147674 - RNA, 21 nt, Human
cugggaacccgaccaaggccu

SEQ ID NO: 147675 - RNA, 22 nt, Human
cuccggggacgcagucgccgcc

SEQ ID NO: 147676 - RNA, 22 nt, Human
cuggggccccagcucggccccu

SEQ ID NO: 147677 - RNA, 22 nt, Human
cucggagggcaaguacuggcug

SEQ ID NO: 147678 - RNA, 22 nt, Human
cucgccugacucggaugggcug

SEQ ID NO: 147679 - RNA, 22 nt, Human
cuccuuuuugggaccgugcagc

SEQ ID NO: 147680 - RNA, 22 nt, Human
cugggacccagcccaagucuuu

SEQ ID NO: 147681 - RNA, 22 nt, Human
cuccuuccuccgcccuuccucg

SEQ ID NO: 147682 - RNA, 20 nt, Human
cuggaguguagcaguggcug

SEQ ID NO: 147683 - RNA, 22 nt, Human
cuggaucgccccgaugugcccc

SEQ ID NO: 147684 - RNA, 22 nt, Human
cuggccugugggcugucuccgg

SEQ ID NO: 147685 - RNA, 22 nt, Human
cuggccaggugggggguagugg

SEQ ID NO: 147686 - RNA, 22 nt, Human
cugagaucaugggucagguggu

SEQ ID NO: 147687 - RNA, 22 nt, Human
cuggaaagauuuacacggggaa

SEQ ID NO: 147688 - RNA, 22 nt, Human
cuggagaucaguuggacaacag

SEQ ID NO: 147689 - RNA, 23 nt, Human
cuggacauucgcaaaguucaucu

SEQ ID NO: 147690 - RNA, 22 nt, Human
cagagaugaggcuggcgugguu

SEQ ID NO: 147691 - RNA, 18 nt, Human
cacgcaacuguaaaaccc

SEQ ID NO: 147692 - RNA, 22 nt, Human
caauugcuuccuucuguaagua

SEQ ID NO: 147693 - RNA, 22 nt, Human
cagaucacauccauccgucacc

SEQ ID NO: 147694 - RNA, 22 nt, Human
cagaucacucugggcggcggga

SEQ ID NO: 147695 - RNA, 22 nt, Human
cagaggcugagcugcgggauga

SEQ ID NO: 147696 - RNA, 21 nt, Human
cagagcuuuggagacggagga

SEQ ID NO: 147697 - RNA, 22 nt, Human
cagcucgaauaauggagaacug

SEQ ID NO: 147698 - RNA, 22 nt, Human
cagcuccagcccaggcagcucc

SEQ ID NO: 147699 - RNA, 22 nt, Human
cagcuggaggagcagcuuccag

SEQ ID NO: 147700 - RNA, 22 nt, Human
cagcugcgcagcgccgggccug

SEQ ID NO: 147701 - RNA, 22 nt, Human
cagcucuccacccuccugguuc

SEQ ID NO: 147702 - RNA, 22 nt, Human
cagauacaacagcaggaaugaa

SEQ ID NO: 147703 - RNA, 22 nt, Human
cagaguccugcaccagcuccag

SEQ ID NO: 147704 - RNA, 22 nt, Human
cagcccaucaaggggauccuga

SEQ ID NO: 147705 - RNA, 22 nt, Human
cagccccagcacuuagcugagu

SEQ ID NO: 147706 - RNA, 22 nt, Human
cagcccaggcucagauguuggg

SEQ ID NO: 147707 - RNA, 22 nt, Human
cagcaugcaaguccagaugugg

SEQ ID NO: 147708 - RNA, 22 nt, Human
cagcauggagacaaagugggca

SEQ ID NO: 147709 - RNA, 22 nt, Human
cagaccagaaggaagccgacaa

SEQ ID NO: 147710 - RNA, 22 nt, Human
cagacacgucccuguugaccug

SEQ ID NO: 147711 - RNA, 22 nt, Human
cagcagccuccccggccgaccu

SEQ ID NO: 147712 - RNA, 22 nt, Human
cagcacuuccuccgugagcccc

SEQ ID NO: 147713 - RNA, 21 nt, Human
cagcagaugccagggucucug

SEQ ID NO: 147714 - RNA, 22 nt, Human
cagcagaugacuauuggagcug

SEQ ID NO: 147715 - RNA, 22 nt, Human
cagcacugcccuaccccuccac

SEQ ID NO: 147716 - RNA, 22 nt, Human
cagauguuugaaugcuuaccac

SEQ ID NO: 147717 - RNA, 22 nt, Human
cagccuacaucagaauaccaau

SEQ ID NO: 147718 - RNA, 22 nt, Human
cagcuuguucugaccugugauu

SEQ ID NO: 147719 - RNA, 22 nt, Human
cagcccuguugcgcuuccggcg

SEQ ID NO: 147720 - RNA, 22 nt, Human
cagcuuaccucccacagcucuc

SEQ ID NO: 147721 - RNA, 22 nt, Human
cagcuguggagauggggugcau

SEQ ID NO: 147722 - RNA, 22 nt, Human
cagcuugcccugauguggaaga

SEQ ID NO: 147723 - RNA, 22 nt, Human
cagggcuugaaucaaggaaguc

SEQ ID NO: 147724 - RNA, 22 nt, Human
cagggccagggcuauggugaag

SEQ ID NO: 147725 - RNA, 22 nt, Human
cagggcagaguuaagaugcugg

SEQ ID NO: 147726 - RNA, 22 nt, Human
cagggcaucucugaaucuucac

SEQ ID NO: 147727 - RNA, 22 nt, Human
cagggcuuuuuccuccucuuug

SEQ ID NO: 147728 - RNA, 22 nt, Human
caggggcuuuccuguuuaugga

SEQ ID NO: 147729 - RNA, 19 nt, Human
caggggcuuaugcgaccuc

SEQ ID NO: 147730 - RNA, 22 nt, Human
caggguaccaagcuucgcccuc

SEQ ID NO: 147731 - RNA, 22 nt, Human
cagguaguuagaaugaccagga

SEQ ID NO: 147732 - RNA, 22 nt, Human
caggcagggcugccuucugcuu

SEQ ID NO: 147733 - RNA, 22 nt, Human
caggaggaaaguuccacucaac

SEQ ID NO: 147734 - RNA, 22 nt, Human
caggccacagcuaaagaggauu

SEQ ID NO: 147735 - RNA, 22 nt, Human
caggcagggagcuggaaaggau

SEQ ID NO: 147736 - RNA, 22 nt, Human
cagcucugcugggaggaugcag

SEQ ID NO: 147737 - RNA, 22 nt, Human
caggagagucucugucuguacu

SEQ ID NO: 147738 - RNA, 20 nt, Human
cagugcccguggaaaagaug

SEQ ID NO: 147739 - RNA, 23 nt, Human
cagucgacugugcccucccgagc

SEQ ID NO: 147740 - RNA, 22 nt, Human
cagugcuccugccccugcccuu

SEQ ID NO: 147741 - RNA, 22 nt, Human
caguggaugucucauaguguga

SEQ ID NO: 147742 - RNA, 22 nt, Human
caguucacggcugguaugaauu

SEQ ID NO: 147743 - RNA, 22 nt, Human
caguguuuagcacagugcuugg

SEQ ID NO: 147744 - RNA, 20 nt, Human
caugaugcaaacaguaacgu

SEQ ID NO: 147745 - RNA, 22 nt, Human
caugcagcagaauaaugacuau

SEQ ID NO: 147746 - RNA, 22 nt, Human
caugcgucugcauuggguggug

SEQ ID NO: 147747 - RNA, 22 nt, Human
cauggcacuuuugugucuaaau

SEQ ID NO: 147748 - RNA, 22 nt, Human
caugcuggcacugaccagccua

SEQ ID NO: 147749 - RNA, 22 nt, Human
caugggcucuucuggacugcac

SEQ ID NO: 147750 - RNA, 19 nt, Human
cauggcgguaaagaggcug

SEQ ID NO: 147751 - RNA, 22 nt, Human
cauggccaaagaauuauauuuu

SEQ ID NO: 147752 - RNA, 22 nt, Human
caugguaccuagccucauggau

SEQ ID NO: 147753 - RNA, 22 nt, Human
cauggcaggugcagauucugug

SEQ ID NO: 147754 - RNA, 22 nt, Human
cagguugucuaauuccaagggg

SEQ ID NO: 147755 - RNA, 22 nt, Human
cagguuguucugggcauggagg

SEQ ID NO: 147756 - RNA, 19 nt, Human
caggucuucuuggaggacu

SEQ ID NO: 147757 - RNA, 22 nt, Human
caggucauaacuaugcaugaac

SEQ ID NO: 147758 - RNA, 22 nt, Human
cauacauguuagcaguagccuu

SEQ ID NO: 147759 - RNA, 22 nt, Human
cagggugaagaugcgccuccug

SEQ ID NO: 147760 - RNA, 22 nt, Human
caggggucccccggcucccugg

SEQ ID NO: 147761 - RNA, 20 nt, Human
cagguugcugcccccgccuc

SEQ ID NO: 147762 - RNA, 22 nt, Human
cagguuucuggaugcagcccca

SEQ ID NO: 147763 - RNA, 22 nt, Human
caucccaacaggugaucuggua

SEQ ID NO: 147764 - RNA, 22 nt, Human
cauccagcuccugggggccacc

SEQ ID NO: 147765 - RNA, 22 nt, Human
caggcgcauggugagcagauga

SEQ ID NO: 147766 - RNA, 22 nt, Human
cagggacgugagccaugucagu

SEQ ID NO: 147767 - RNA, 22 nt, Human
cagggagcggggagaucucggg

SEQ ID NO: 147768 - RNA, 22 nt, Human
cagggccaggccucaggggcgc

SEQ ID NO: 147769 - RNA, 22 nt, Human
cagggcacaguuauggaggugg

SEQ ID NO: 147770 - RNA, 22 nt, Human
caggggaagccagcugccaugu

SEQ ID NO: 147771 - RNA, 22 nt, Human
caggcaggagaaaaggcgcggg

SEQ ID NO: 147772 - RNA, 22 nt, Human
caggccagcuggaggggcagcu

SEQ ID NO: 147773 - RNA, 22 nt, Human
caggcagagagggcagugugga

SEQ ID NO: 147774 - RNA, 22 nt, Human
caggucagcacuuggaggugca

SEQ ID NO: 147775 - RNA, 22 nt, Human
cagggggcccagcugggagggg

SEQ ID NO: 147776 - RNA, 22 nt, Human
caguacugucuuccugauggca

SEQ ID NO: 147777 - RNA, 22 nt, Human
auuucagcagcccauguuugga

SEQ ID NO: 147778 - RNA, 22 nt, Human
auuuggaaacaugcugaccaug

SEQ ID NO: 147779 - RNA, 22 nt, Human
auuuggaaggcguuucucugua

SEQ ID NO: 147780 - RNA, 21 nt, Human
auuuguggugcaauuguggua

SEQ ID NO: 147781 - RNA, 22 nt, Human
auuuuugguuucaccugcacgc

SEQ ID NO: 147782 - RNA, 22 nt, Human
auuuuacuaugauaguugagaa

SEQ ID NO: 147783 - RNA, 18 nt, Human
auuuguggggguuauaga

SEQ ID NO: 147784 - RNA, 22 nt, Human
caaagaagagauuuacagagcu

SEQ ID NO: 147785 - RNA, 22 nt, Human
caacaagcgcucagagcaaagc

SEQ ID NO: 147786 - RNA, 17 nt, Human
caaccaggaaaggaggg

SEQ ID NO: 147787 - RNA, 22 nt, Human
caacguggauucuuccaggggc

SEQ ID NO: 147788 - RNA, 22 nt, Human
caacauuucaaggucuuuagga

SEQ ID NO: 147789 - RNA, 22 nt, Human
caacaaguugauuucacgcugc

SEQ ID NO: 147790 - RNA, 20 nt, Human
cacagcugacgaguauccaa

SEQ ID NO: 147791 - RNA, 22 nt, Human
caagaaccuagcgaucagguaa

SEQ ID NO: 147792 - RNA, 22 nt, Human
cacagcaggcagaacgugggca

SEQ ID NO: 147793 - RNA, 22 nt, Human
cacacagguaagccucuuucaa

SEQ ID NO: 147794 - RNA, 22 nt, Human
cacaucucagggcuacaggcag

SEQ ID NO: 147795 - RNA, 22 nt, Human
caagcagauauuuuagucaaga

SEQ ID NO: 147796 - RNA, 22 nt, Human
caagaugcaagaccagucaggc

SEQ ID NO: 147797 - RNA, 22 nt, Human
cacaucugaaggcggcucuagg

SEQ ID NO: 147798 - RNA, 22 nt, Human
caagggcagaggcagggccccg

SEQ ID NO: 147799 - RNA, 22 nt, Human
caccaucagacuucugggcagg

SEQ ID NO: 147800 - RNA, 22 nt, Human
caccacuuggcccugagguccu

SEQ ID NO: 147801 - RNA, 22 nt, Human
caaggucagacagccaggacag

SEQ ID NO: 147802 - RNA, 22 nt, Human
caagguuucgaguucccaacca

SEQ ID NO: 147803 - RNA, 22 nt, Human
cacccugacuggcccugcagga

SEQ ID NO: 147804 - RNA, 22 nt, Human
caccgaacuuugcaaaugcaau

SEQ ID NO: 147805 - RNA, 22 nt, Human
caccuuccgcccacugaccgcc

SEQ ID NO: 147806 - RNA, 22 nt, Human
caccuggaggcagcaccgggcu

SEQ ID NO: 147807 - RNA, 22 nt, Human
cacccccaggcuccccuucugg

SEQ ID NO: 147808 - RNA, 22 nt, Human
caccccauccccucccaauucc

SEQ ID NO: 147809 - RNA, 22 nt, Human
caaguaugagaaagcuauuacc

SEQ ID NO: 147810 - RNA, 22 nt, Human
caaaugcaguggucgugcugga

SEQ ID NO: 147811 - RNA, 20 nt, Human
caauguuggcaguauagagc

SEQ ID NO: 147812 - RNA, 22 nt, Human
caaugcacauggacaucaggcu

SEQ ID NO: 147813 - RNA, 22 nt, Human
caaauacguuuggcuggagcac

SEQ ID NO: 147814 - RNA, 22 nt, Human
cacacaccagaaagccugggac

SEQ ID NO: 147815 - RNA, 22 nt, Human
cacaacaaaaaauaaguaugag

SEQ ID NO: 147816 - RNA, 22 nt, Human
caacuucuauucagucugcagu

SEQ ID NO: 147817 - RNA, 22 nt, Human
caagcgcgccgcuuccuuccgc

SEQ ID NO: 147818 - RNA, 22 nt, Human
caagagguaugagccgggauga

SEQ ID NO: 147819 - RNA, 22 nt, Human
caaggaaaugucagaaaggcaa

SEQ ID NO: 147820 - RNA, 22 nt, Human
caaggaaaacagaugaucaaca

SEQ ID NO: 147821 - RNA, 22 nt, Human
caaaacauucagagagcucacu

SEQ ID NO: 147822 - RNA, 22 nt, Human
caagaaguugacagccagguga

SEQ ID NO: 147823 - RNA, 22 nt, Human
caagagcucccagaccugggca

SEQ ID NO: 147824 - RNA, 22 nt, Human
caagguugugacccaaugacca

SEQ ID NO: 147825 - RNA, 22 nt, Human
caaggaagguugguugaaggua

SEQ ID NO: 147826 - RNA, 22 nt, Human
caaagccuggggagaguaagga

SEQ ID NO: 147827 - RNA, 22 nt, Human
caauaccucuuggugauugggc

SEQ ID NO: 147828 - RNA, 22 nt, Human
augguugggggaugucagcagg

SEQ ID NO: 147829 - RNA, 22 nt, Human
augguugccugagauaagacug

SEQ ID NO: 147830 - RNA, 22 nt, Human
auguaccgccuuggagaaaugc

SEQ ID NO: 147831 - RNA, 22 nt, Human
auggcuguguuguuccucugaa

SEQ ID NO: 147832 - RNA, 22 nt, Human
auggcaucuucgguuggacugc

SEQ ID NO: 147833 - RNA, 19 nt, Human
augggaagcggccagcgga

SEQ ID NO: 147834 - RNA, 22 nt, Human
auggcuucugucuuggaaauuu

SEQ ID NO: 147835 - RNA, 22 nt, Human
augcuuucucuucuauuucuca

SEQ ID NO: 147836 - RNA, 22 nt, Human
augugggguaggaggggggaau

SEQ ID NO: 147837 - RNA, 22 nt, Human
augugugugcgagcgugugugu

SEQ ID NO: 147838 - RNA, 22 nt, Human
auguguguaugugugcauguau

SEQ ID NO: 147839 - RNA, 19 nt, Human
auguucugaauuacuguaa

SEQ ID NO: 147840 - RNA, 22 nt, Human
augugaaauuugggcucuggga

SEQ ID NO: 147841 - RNA, 22 nt, Human
augugauacuccuucuagugga

SEQ ID NO: 147842 - RNA, 20 nt, Human
augucaggaagggagucagg

SEQ ID NO: 147843 - RNA, 22 nt, Human
auguucccaaaaucccuguaga

SEQ ID NO: 147844 - RNA, 22 nt, Human
auucaagauaagggucugggag

SEQ ID NO: 147845 - RNA, 22 nt, Human
auguuccuuaaugugcuuguag

SEQ ID NO: 147846 - RNA, 22 nt, Human
auguucucagguuguauuuauu

SEQ ID NO: 147847 - RNA, 19 nt, Human
augcacgugaaaugcauuu

SEQ ID NO: 147848 - RNA, 22 nt, Human
augcgcugugcacacucuuaac

SEQ ID NO: 147849 - RNA, 22 nt, Human
augccugggcuuuaggguucuc

SEQ ID NO: 147850 - RNA, 22 nt, Human
augcaggcuaagaguaaagacg

SEQ ID NO: 147851 - RNA, 22 nt, Human
augcucggcuuucuuucuuucu

SEQ ID NO: 147852 - RNA, 22 nt, Human
augcagcggucagaggaacuca

SEQ ID NO: 147853 - RNA, 22 nt, Human
augcagauguagauucugaaau

SEQ ID NO: 147854 - RNA, 22 nt, Human
augccgggguggcuccagcacc

SEQ ID NO: 147855 - RNA, 22 nt, Human
augcaccugucuuuuaaggaua

SEQ ID NO: 147856 - RNA, 22 nt, Human
augaucacagugucagucauua

SEQ ID NO: 147857 - RNA, 21 nt, Human
augcgcgguggagugagcgaa

SEQ ID NO: 147858 - RNA, 22 nt, Human
augcggcugugggggaauggga

SEQ ID NO: 147859 - RNA, 22 nt, Human
augccugcugucaggaacucuu

SEQ ID NO: 147860 - RNA, 22 nt, Human
augcuugaaaguuauuucauuu

SEQ ID NO: 147861 - RNA, 22 nt, Human
augcuugcccauguuucugaag

SEQ ID NO: 147862 - RNA, 22 nt, Human
augcugcuuguccauuuauuug

SEQ ID NO: 147863 - RNA, 18 nt, Human
augcugacacaaugugga

SEQ ID NO: 147864 - RNA, 22 nt, Human
auggccuuucucaguggugcuu

SEQ ID NO: 147865 - RNA, 22 nt, Human
auggccuguuuccucugaaaga

SEQ ID NO: 147866 - RNA, 22 nt, Human
augcugugccuggaaagcggcu

SEQ ID NO: 147867 - RNA, 22 nt, Human
auggccugaagcuaaccccccu

SEQ ID NO: 147868 - RNA, 22 nt, Human
augcugacaacaaagaaggaag

SEQ ID NO: 147869 - RNA, 22 nt, Human
auggagugggaggacaugaagg

SEQ ID NO: 147870 - RNA, 22 nt, Human
aucugcuguaguuggugccagu

SEQ ID NO: 147871 - RNA, 22 nt, Human
aucugcugcuccuucuucuugc

SEQ ID NO: 147872 - RNA, 22 nt, Human
aucucaaagauaugcugguaaa

SEQ ID NO: 147873 - RNA, 22 nt, Human
aucuagguuuggaagauagagu

SEQ ID NO: 147874 - RNA, 22 nt, Human
augaggaacagcaagaauauuu

SEQ ID NO: 147875 - RNA, 22 nt, Human
aucuucucucucaucaggauca

SEQ ID NO: 147876 - RNA, 22 nt, Human
aucugucagaccuuggucacag

SEQ ID NO: 147877 - RNA, 22 nt, Human
augauucuaccaaugccaucuu

SEQ ID NO: 147878 - RNA, 22 nt, Human
aucucagacucuccggguuccg

SEQ ID NO: 147879 - RNA, 22 nt, Human
augauuuguuaacagacuuaau

SEQ ID NO: 147880 - RNA, 22 nt, Human
augagcucuaaguacaugccca

SEQ ID NO: 147881 - RNA, 22 nt, Human
augaccauccagaaguccagcu

SEQ ID NO: 147882 - RNA, 22 nt, Human
augauggagaacaaagaaaauc

SEQ ID NO: 147883 - RNA, 22 nt, Human
augaggagucaaggagucggag

SEQ ID NO: 147884 - RNA, 22 nt, Human
aucaacucacagugugcuggca

SEQ ID NO: 147885 - RNA, 20 nt, Human
aucaagugucuugccaggca

SEQ ID NO: 147886 - RNA, 22 nt, Human
aucaacacuguuggcggggacc

SEQ ID NO: 147887 - RNA, 22 nt, Human
aucaaguuauuaaguagcuuuc

SEQ ID NO: 147888 - RNA, 22 nt, Human
aucauccuagaaggaagcuagg

SEQ ID NO: 147889 - RNA, 22 nt, Human
aucagcucuugaugccuuucuu

SEQ ID NO: 147890 - RNA, 22 nt, Human
aucagagcuaguacuugcaggu

SEQ ID NO: 147891 - RNA, 22 nt, Human
aucaagacaaaggaaaggcuaa

SEQ ID NO: 147892 - RNA, 22 nt, Human
aucacuagaguuacauugccag

SEQ ID NO: 147893 - RNA, 22 nt, Human
aucaugggauagugggacgagc

SEQ ID NO: 147894 - RNA, 17 nt, Human
aucagaggauaggacaa

SEQ ID NO: 147895 - RNA, 19 nt, Human
aucagcaguuuugccugga

SEQ ID NO: 147896 - RNA, 21 nt, Human
aucagaggacaucucagggcc

SEQ ID NO: 147897 - RNA, 22 nt, Human
auccacccugcaggccaacucu

SEQ ID NO: 147898 - RNA, 22 nt, Human
auccacggucaauuccccaucc

SEQ ID NO: 147899 - RNA, 22 nt, Human
auccaggggucugaauggauau

SEQ ID NO: 147900 - RNA, 22 nt, Human
auccagaaguauuuuggguacu

SEQ ID NO: 147901 - RNA, 22 nt, Human
auccaggguuggggucacgagu

SEQ ID NO: 147902 - RNA, 20 nt, Human
auccuggucuuuggaagcuu

SEQ ID NO: 147903 - RNA, 19 nt, Human
auccuugcucacucacuga

SEQ ID NO: 147904 - RNA, 22 nt, Human
auccgugagcgagcgagcaccc

SEQ ID NO: 147905 - RNA, 22 nt, Human
auccuaagacgugugguuugag

SEQ ID NO: 147906 - RNA, 22 nt, Human
auccucaaggaauuaaauaggg

SEQ ID NO: 147907 - RNA, 20 nt, Human
aucaugugcacugcugacag

SEQ ID NO: 147908 - RNA, 22 nt, Human
aucaugugacuagguuuggcca

SEQ ID NO: 147909 - RNA, 18 nt, Human
auccccagucccuggaau

SEQ ID NO: 147910 - RNA, 22 nt, Human
aucccuggccacgaagcugccc

SEQ ID NO: 147911 - RNA, 22 nt, Human
aucagugcacgcgaugggcaga

SEQ ID NO: 147912 - RNA, 22 nt, Human
aucauaccaguuuccaucagga

SEQ ID NO: 147913 - RNA, 20 nt, Human
aucaggagucgcggggagag

SEQ ID NO: 147914 - RNA, 22 nt, Human
aucauugcuaguaaggaucuug

SEQ ID NO: 147915 - RNA, 23 nt, Human
auccacauucuaguccuuuaugc

SEQ ID NO: 147916 - RNA, 22 nt, Human
aucaugcgguuaaggagugugu

SEQ ID NO: 147917 - RNA, 22 nt, Human
aucaucuaaaauuggcucagau

SEQ ID NO: 147918 - RNA, 22 nt, Human
aucaucccuuucucccagugaa

SEQ ID NO: 147919 - RNA, 21 nt, Human
agugagauuuaugccugguuc

SEQ ID NO: 147920 - RNA, 22 nt, Human
auaccaaugacaggaguuaggg

SEQ ID NO: 147921 - RNA, 22 nt, Human
auagaagguaaugccccaaggg

SEQ ID NO: 147922 - RNA, 22 nt, Human
auagaguguguguuauguguga

SEQ ID NO: 147923 - RNA, 20 nt, Human
auagaguggugugucacauu

SEQ ID NO: 147924 - RNA, 22 nt, Human
auacuacaucacagccaagaag

SEQ ID NO: 147925 - RNA, 22 nt, Human
auauuugcccccaugcccuggc

SEQ ID NO: 147926 - RNA, 22 nt, Human
auauccugguucuaucaaaagg

SEQ ID NO: 147927 - RNA, 22 nt, Human
auauggugauuuuaugcaggaa

SEQ ID NO: 147928 - RNA, 22 nt, Human
uuuuuggacccaucuucuuuuu

SEQ ID NO: 147929 - RNA, 22 nt, Human
uuuuuugguuuggggauuauuu

SEQ ID NO: 147930 - RNA, 22 nt, Human
uuuguugguugcacuggugggu

SEQ ID NO: 147931 - RNA, 22 nt, Human
uuuguugaauggcaggauuuua

SEQ ID NO: 147932 - RNA, 22 nt, Human
uuuuacgucuuugcugccucgu

SEQ ID NO: 147933 - RNA, 22 nt, Human
uuuucuguuuaugaaauugugu

SEQ ID NO: 147934 - RNA, 22 nt, Human
uuuucuucggugcuggguugau

SEQ ID NO: 147935 - RNA, 22 nt, Human
uuuugccuauuguaucaucgua

SEQ ID NO: 147936 - RNA, 22 nt, Human
uuuucuacaaaucuggacuuuu

SEQ ID NO: 147937 - RNA, 22 nt, Human
uuuucucacugagagccuugau

SEQ ID NO: 147938 - RNA, 22 nt, Human
uuuucuacaaucacucuggaag

SEQ ID NO: 147939 - RNA, 22 nt, Human
uuuuguggacugugagggugca

SEQ ID NO: 147940 - RNA, 22 nt, Human
uuuuggauugcuaacucagggu

SEQ ID NO: 147941 - RNA, 20 nt, Human
uucugcucuagagucuagaa

SEQ ID NO: 147942 - RNA, 17 nt, Human
uucugcucaggaacaga

SEQ ID NO: 147943 - RNA, 20 nt, Human
uucugcagcagguguugaag

SEQ ID NO: 147944 - RNA, 22 nt, Human
uucugaugccuggguugcuucu

SEQ ID NO: 147945 - RNA, 22 nt, Human
uucucugcgcuccggcccaguu

SEQ ID NO: 147946 - RNA, 22 nt, Human
uucucuggggacugucucuauu

SEQ ID NO: 147947 - RNA, 22 nt, Human
uucugggguaagcacugaggau

SEQ ID NO: 147948 - RNA, 22 nt, Human
uucuggucucucugaccuagga

SEQ ID NO: 147949 - RNA, 22 nt, Human
uucuggugauuugccucuuuag

SEQ ID NO: 147950 - RNA, 21 nt, Human
uucugcuguucaccaccaccc

SEQ ID NO: 147951 - RNA, 22 nt, Human
uucuggccagggaagagggguc

SEQ ID NO: 147952 - RNA, 22 nt, Human
uuuugaugaccauucuucuuuu

SEQ ID NO: 147953 - RNA, 19 nt, Human
uucugcucaguaacacccu

SEQ ID NO: 147954 - RNA, 20 nt, Human
uuccccauaaaaauguucca

SEQ ID NO: 147955 - RNA, 22 nt, Human
uucccccuuuuuuguguugucu

SEQ ID NO: 147956 - RNA, 22 nt, Human
uugaggcugaucacuccuauaa

SEQ ID NO: 147957 - RNA, 19 nt, Human
uugaauguuugauagucuc

SEQ ID NO: 147958 - RNA, 22 nt, Human
uugaaucauauguaauugacuu

SEQ ID NO: 147959 - RNA, 22 nt, Human
uuguccacuaagaaagugcccu

SEQ ID NO: 147960 - RNA, 22 nt, Human
uuggucagaugugucuccuccu

SEQ ID NO: 147961 - RNA, 22 nt, Human
uuguacccaccuuggggccuca

SEQ ID NO: 147962 - RNA, 22 nt, Human
uuguacaaauaggaaccucuga

SEQ ID NO: 147963 - RNA, 22 nt, Human
uuggcaggcugcauguuuaugu

SEQ ID NO: 147964 - RNA, 22 nt, Human
uuggcagagaacagaaugauuu

SEQ ID NO: 147965 - RNA, 22 nt, Human
uuggcaaaaauacuguaggccu

SEQ ID NO: 147966 - RNA, 22 nt, Human
uuggcacagagcugcagccugg

SEQ ID NO: 147967 - RNA, 22 nt, Human
uugggggccuccuguuccccca

SEQ ID NO: 147968 - RNA, 22 nt, Human
uuggggccggcgcggaggaggg

SEQ ID NO: 147969 - RNA, 22 nt, Human
uuggggcugcguguuuccaugu

SEQ ID NO: 147970 - RNA, 22 nt, Human
uugugacaauacagcauggaga

SEQ ID NO: 147971 - RNA, 22 nt, Human
uuguuuacuugagcugcacucu

SEQ ID NO: 147972 - RNA, 22 nt, Human
uuguuugcacuuuagagacugu

SEQ ID NO: 147973 - RNA, 22 nt, Human
uugcuggaguagaaaacuuaac

SEQ ID NO: 147974 - RNA, 22 nt, Human
uugcugggauucauugaagggu

SEQ ID NO: 147975 - RNA, 22 nt, Human
uugcugagcugaaccagccacc

SEQ ID NO: 147976 - RNA, 22 nt, Human
uugcugaggcuggggagaggug

SEQ ID NO: 147977 - RNA, 22 nt, Human
uugcuugcggccuuugugccuu

SEQ ID NO: 147978 - RNA, 22 nt, Human
uugcuugaacccaggaagugga

SEQ ID NO: 147979 - RNA, 22 nt, Human
uuggagaaagcugcaggcucug

SEQ ID NO: 147980 - RNA, 22 nt, Human
uuggacugggauggccgaggcu

SEQ ID NO: 147981 - RNA, 22 nt, Human
uuggaaaagaaauacucauaua

SEQ ID NO: 147982 - RNA, 22 nt, Human
uuggaaaugcauuuguuauuau

SEQ ID NO: 147983 - RNA, 20 nt, Human
uugcggccuaacagccccuu

SEQ ID NO: 147984 - RNA, 22 nt, Human
uugcggauguccacgucacacu

SEQ ID NO: 147985 - RNA, 18 nt, Human
uugcucucucugggggca

SEQ ID NO: 147986 - RNA, 22 nt, Human
uugccaggggacaucuggagcc

SEQ ID NO: 147987 - RNA, 22 nt, Human
uugcggaucuucauggccucag

SEQ ID NO: 147988 - RNA, 22 nt, Human
uugccucuaauuagcucuguga

SEQ ID NO: 147989 - RNA, 22 nt, Human
uugcagcuguugcaaagucucu

SEQ ID NO: 147990 - RNA, 22 nt, Human
uugauuuggaauuuuuagagcu

SEQ ID NO: 147991 - RNA, 20 nt, Human
uugcaaagugaauagcaauu

SEQ ID NO: 147992 - RNA, 22 nt, Human
uugauuuggcguuuuccuccug

SEQ ID NO: 147993 - RNA, 17 nt, Human
uuugugauggcagaugc

SEQ ID NO: 147994 - RNA, 22 nt, Human
uuuguggugagcagggaacguc

SEQ ID NO: 147995 - RNA, 22 nt, Human
uuugugguuuugagagaguugc

SEQ ID NO: 147996 - RNA, 22 nt, Human
uuccagguggcuuuccuggggg

SEQ ID NO: 147997 - RNA, 22 nt, Human
uuccaugccuaagagccugaag

SEQ ID NO: 147998 - RNA, 22 nt, Human
uuccccaccagagacagagcug

SEQ ID NO: 147999 - RNA, 22 nt, Human
uuccccgagccuggggaagcug

SEQ ID NO: 148000 - RNA, 22 nt, Human
uuugguguuuucaggaauauac

SEQ ID NO: 148001 - RNA, 20 nt, Human
uuugguuggcuaggggaagc

SEQ ID NO: 148002 - RNA, 22 nt, Human
uuuggugauuuuuaaucccccu

SEQ ID NO: 148003 - RNA, 22 nt, Human
uuugauuuuguuuauagugccg

SEQ ID NO: 148004 - RNA, 22 nt, Human
uucauccucuuuaucuaccugu

SEQ ID NO: 148005 - RNA, 22 nt, Human
uuuggguuaguuuuccaaucuu

SEQ ID NO: 148006 - RNA, 22 nt, Human
uuugggcauuuuuaaggaucuu

SEQ ID NO: 148007 - RNA, 22 nt, Human
uucauacucuucccugggcaaa

SEQ ID NO: 148008 - RNA, 22 nt, Human
uucaaacacugugcaauugggu

SEQ ID NO: 148009 - RNA, 22 nt, Human
uucacagugguaaggguuguga

SEQ ID NO: 148010 - RNA, 22 nt, Human
uuucugggggucgugcuggcug

SEQ ID NO: 148011 - RNA, 22 nt, Human
uuucugugguggguaguucaga

SEQ ID NO: 148012 - RNA, 22 nt, Human
uuucuuccuucuugaucauuug

SEQ ID NO: 148013 - RNA, 22 nt, Human
uuucucugggugaugagguggc

SEQ ID NO: 148014 - RNA, 19 nt, Human
uuucacaaagagagcguga

SEQ ID NO: 148015 - RNA, 22 nt, Human
uuagagaauagacuuuacccug

SEQ ID NO: 148016 - RNA, 22 nt, Human
uguuugagaauuugcugauguu

SEQ ID NO: 148017 - RNA, 21 nt, Human
uguuugcuuuuggagcaacug

SEQ ID NO: 148018 - RNA, 22 nt, Human
uguuugaugugcacgugugugu

SEQ ID NO: 148019 - RNA, 22 nt, Human
uuguaugcugggaagcgggagg

SEQ ID NO: 148020 - RNA, 22 nt, Human
uuaccgagaacaugacuggaau

SEQ ID NO: 148021 - RNA, 20 nt, Human
uuauccccauucuuguucuc

SEQ ID NO: 148022 - RNA, 22 nt, Human
uguggcaauauggaauguguuu

SEQ ID NO: 148023 - RNA, 22 nt, Human
uugcugccagcgcccugcaggg

SEQ ID NO: 148024 - RNA, 22 nt, Human
uugcugcgcugaccuccaguga

SEQ ID NO: 148025 - RNA, 21 nt, Human
uugcuggagcaauguaaauca

SEQ ID NO: 148026 - RNA, 22 nt, Human
uguggccaccagagcugcuauu

SEQ ID NO: 148027 - RNA, 22 nt, Human
ugugggaggaugggccccuaga

SEQ ID NO: 148028 - RNA, 21 nt, Human
uguggccauuugaaaacaggg

SEQ ID NO: 148029 - RNA, 22 nt, Human
uugcugguggcucugauuucau

SEQ ID NO: 148030 - RNA, 22 nt, Human
ugugggaucauggaucagggcc

SEQ ID NO: 148031 - RNA, 22 nt, Human
uugcugugucauuuguuuaauc

SEQ ID NO: 148032 - RNA, 22 nt, Human
ugugcuugucguggagccaggc

SEQ ID NO: 148033 - RNA, 22 nt, Human
uugcucuuaccauuauguguga

SEQ ID NO: 148034 - RNA, 22 nt, Human
ugugcuggcuucugugagcuga

SEQ ID NO: 148035 - RNA, 22 nt, Human
ugugcuugucuguuuugauugu

SEQ ID NO: 148036 - RNA, 22 nt, Human
ugugcgucuguguacagaugug

SEQ ID NO: 148037 - RNA, 22 nt, Human
ugugcgcgugugcuuugugugu

SEQ ID NO: 148038 - RNA, 20 nt, Human
uugcucucuuguguugaugu

SEQ ID NO: 148039 - RNA, 22 nt, Human
ugugcaucuggaggcaauguuu

SEQ ID NO: 148040 - RNA, 22 nt, Human
ugugguuggggucagauaggga

SEQ ID NO: 148041 - RNA, 22 nt, Human
uuggaaauguagaaaagcagau

SEQ ID NO: 148042 - RNA, 22 nt, Human
uuggaggucucugugguggugg

SEQ ID NO: 148043 - RNA, 22 nt, Human
uuggaggcagagucuugcugag

SEQ ID NO: 148044 - RNA, 22 nt, Human
uguguggaggugggugaugucu

SEQ ID NO: 148045 - RNA, 22 nt, Human
ugugugguaaugagagauccaa

SEQ ID NO: 148046 - RNA, 22 nt, Human
uuggauguccucuguggaguau

SEQ ID NO: 148047 - RNA, 23 nt, Human
uugcuugagcccaggaaguggag

SEQ ID NO: 148048 - RNA, 22 nt, Human
ugugggcugcuguuuccuugua

SEQ ID NO: 148049 - RNA, 22 nt, Human
uguggguggucagcgugugaug

SEQ ID NO: 148050 - RNA, 22 nt, Human
uuggcuguguugaaaacgugga

SEQ ID NO: 148051 - RNA, 22 nt, Human
uuggccguuucacugggcaguu

SEQ ID NO: 148052 - RNA, 22 nt, Human
uuggccugcuccagaacaaggg

SEQ ID NO: 148053 - RNA, 22 nt, Human
uugggcuagaaacaacgugggu

SEQ ID NO: 148054 - RNA, 22 nt, Human
uuggggaauuuggggccguccg

SEQ ID NO: 148055 - RNA, 22 nt, Human
uuggggaaaaagaccuaaugac

SEQ ID NO: 148056 - RNA, 22 nt, Human
uguucuucaaacucaguuccac

SEQ ID NO: 148057 - RNA, 22 nt, Human
uguugaucucuuuccaaauucu

SEQ ID NO: 148058 - RNA, 18 nt, Human
uguugguguucacucacu

SEQ ID NO: 148059 - RNA, 22 nt, Human
uguuggugcacugaaaggcagg

SEQ ID NO: 148060 - RNA, 22 nt, Human
uugguuccauuuuaccagcucu

SEQ ID NO: 148061 - RNA, 22 nt, Human
uuguagccaugucacaagcaca

SEQ ID NO: 148062 - RNA, 19 nt, Human
uuggugaagguucacugac

SEQ ID NO: 148063 - RNA, 22 nt, Human
uuggugauugggaauggauggg

SEQ ID NO: 148064 - RNA, 21 nt, Human
uguuggccuucauucucuguc

SEQ ID NO: 148065 - RNA, 22 nt, Human
uguuggcagugcuacagucagu

SEQ ID NO: 148066 - RNA, 22 nt, Human
uuggugaugaaagugcugcgcu

SEQ ID NO: 148067 - RNA, 22 nt, Human
uuggugaugcccaccuuuucau

SEQ ID NO: 148068 - RNA, 21 nt, Human
ugucagaaagccugugacuuu

SEQ ID NO: 148069 - RNA, 22 nt, Human
ugucacggccggguggcaccga

SEQ ID NO: 148070 - RNA, 23 nt, Human
ugucacugcggaguggccugcag

SEQ ID NO: 148071 - RNA, 22 nt, Human
uugauggaggaaaaguuggaau

SEQ ID NO: 148072 - RNA, 22 nt, Human
uguaucucugacacagucucac

SEQ ID NO: 148073 - RNA, 22 nt, Human
uguagaccuuugaaugggaaau

SEQ ID NO: 148074 - RNA, 22 nt, Human
ugucaccucauacaguaccuca

SEQ ID NO: 148075 - RNA, 21 nt, Human
uguccucggaucaguccacaa

SEQ ID NO: 148076 - RNA, 22 nt, Human
uugcaagcccugaagggcugga

SEQ ID NO: 148077 - RNA, 19 nt, Human
ugugaagaccucagugcgg

SEQ ID NO: 148078 - RNA, 22 nt, Human
ugugcagaaggagguucuccgg

SEQ ID NO: 148079 - RNA, 22 nt, Human
uugccuagugguagugacuguu

SEQ ID NO: 148080 - RNA, 22 nt, Human
ugugagucuugcaggucgcuca

SEQ ID NO: 148081 - RNA, 22 nt, Human
ugugagcugccacuucuaaucu

SEQ ID NO: 148082 - RNA, 22 nt, Human
ugugacugaaaaugauugagug

SEQ ID NO: 148083 - RNA, 22 nt, Human
uugcagauuucuuguccccauu

SEQ ID NO: 148084 - RNA, 22 nt, Human
ugugacaugauggcgucaugua

SEQ ID NO: 148085 - RNA, 22 nt, Human
ugguugugcuucuuugccucag

SEQ ID NO: 148086 - RNA, 22 nt, Human
ugguugguuaaugugcccauuu

SEQ ID NO: 148087 - RNA, 22 nt, Human
uucuuugcccauguuuccuaag

SEQ ID NO: 148088 - RNA, 18 nt, Human
ugguuggugggggugaag

SEQ ID NO: 148089 - RNA, 22 nt, Human
uugaacucagcuacugguuggu

SEQ ID NO: 148090 - RNA, 22 nt, Human
ugguggagucugggggaggcuu

SEQ ID NO: 148091 - RNA, 22 nt, Human
ugguggcuuuucguagguucac

SEQ ID NO: 148092 - RNA, 19 nt, Human
ugguggaggugcaccugac

SEQ ID NO: 148093 - RNA, 22 nt, Human
ugguggcaauuuuuggggucaa

SEQ ID NO: 148094 - RNA, 22 nt, Human
uggugcaggauuuauuuaacua

SEQ ID NO: 148095 - RNA, 23 nt, Human
uggugcagcgcaggccggguggc

SEQ ID NO: 148096 - RNA, 22 nt, Human
uggugcagacaggagccccgcu

SEQ ID NO: 148097 - RNA, 22 nt, Human
ugcucagaagacuuacugguua

SEQ ID NO: 148098 - RNA, 22 nt, Human
ugcucacugcuuguguucaguu

SEQ ID NO: 148099 - RNA, 22 nt, Human
ugcuauccagacacauaugauc

SEQ ID NO: 148100 - RNA, 22 nt, Human
uggaggagaacugauuuggcuu

SEQ ID NO: 148101 - RNA, 22 nt, Human
uuauuggcagcuccugcacaug

SEQ ID NO: 148102 - RNA, 22 nt, Human
uggaggcccagcugggggccgg

SEQ ID NO: 148103 - RNA, 22 nt, Human
uggagguagcugacuccagccc

SEQ ID NO: 148104 - RNA, 22 nt, Human
uggaguguuggucccacugagg

SEQ ID NO: 148105 - RNA, 22 nt, Human
uucaacaacuugguucaaaugg

SEQ ID NO: 148106 - RNA, 22 nt, Human
uucaacacaaguugugcaguaa

SEQ ID NO: 148107 - RNA, 22 nt, Human
uggaucaugcgaggccuccccu

SEQ ID NO: 148108 - RNA, 20 nt, Human
uggaucgaccucacuuccau

SEQ ID NO: 148109 - RNA, 20 nt, Human
uggaucaccauccuguugcu

SEQ ID NO: 148110 - RNA, 22 nt, Human
uggaucuugaugcuccaagagu

SEQ ID NO: 148111 - RNA, 22 nt, Human
uggaugacaaccauuggaagag

SEQ ID NO: 148112 - RNA, 20 nt, Human
uucacagaggacucagguca

SEQ ID NO: 148113 - RNA, 23 nt, Human
uucaccaaugcuguccaaguacc

SEQ ID NO: 148114 - RNA, 20 nt, Human
uggaugacuucaggcagccu

SEQ ID NO: 148115 - RNA, 22 nt, Human
uggaugccauuugauuaaggcu

SEQ ID NO: 148116 - RNA, 22 nt, Human
uggaugcuccaaguagaccuua

SEQ ID NO: 148117 - RNA, 22 nt, Human
uggcaaggccacaggugcaguu

SEQ ID NO: 148118 - RNA, 22 nt, Human
uucacccaaaucaagcuggccu

SEQ ID NO: 148119 - RNA, 22 nt, Human
uggcacguuggauugggaguuc

SEQ ID NO: 148120 - RNA, 22 nt, Human
uggcacaguuaaaguuguagaa

SEQ ID NO: 148121 - RNA, 18 nt, Human
uucaggcucuugcaugaa

SEQ ID NO: 148122 - RNA, 22 nt, Human
uucagcacuggacagcgagucu

SEQ ID NO: 148123 - RNA, 23 nt, Human
uucagcucuccugaagcaucugu

SEQ ID NO: 148124 - RNA, 22 nt, Human
uucagcauaggcugcucuucaa

SEQ ID NO: 148125 - RNA, 20 nt, Human
uggcaugaaauuuuccaagc

SEQ ID NO: 148126 - RNA, 22 nt, Human
uggcaucacagacaaggcagca

SEQ ID NO: 148127 - RNA, 22 nt, Human
uggcaucuggugauauggacua

SEQ ID NO: 148128 - RNA, 22 nt, Human
uggcaucucggugcugguucuu

SEQ ID NO: 148129 - RNA, 22 nt, Human
uucagaccucaaauccacaugc

SEQ ID NO: 148130 - RNA, 22 nt, Human
uggcgcgcucgcucucgcugag

SEQ ID NO: 148131 - RNA, 22 nt, Human
uggcgacuggaauuaaucuuuu

SEQ ID NO: 148132 - RNA, 22 nt, Human
uggccuucagcucuggggugca

SEQ ID NO: 148133 - RNA, 22 nt, Human
uggcggcggggagguaggcaga

SEQ ID NO: 148134 - RNA, 22 nt, Human
uggcgugaagcuggaaggcgga

SEQ ID NO: 148135 - RNA, 22 nt, Human
uggcucacaggaggcagaggug

SEQ ID NO: 148136 - RNA, 22 nt, Human
uggcucagcgcggccuggucuu

SEQ ID NO: 148137 - RNA, 22 nt, Human
uggcucaguaaucgagucuccu

SEQ ID NO: 148138 - RNA, 22 nt, Human
uggcucacuuccguggagaggu

SEQ ID NO: 148139 - RNA, 22 nt, Human
uggcucuucucaagcauuggcu

SEQ ID NO: 148140 - RNA, 22 nt, Human
uuccagaacaauguggacguau

SEQ ID NO: 148141 - RNA, 22 nt, Human
uuccagucugggcucuucacug

SEQ ID NO: 148142 - RNA, 16 nt, Human
uggcuuccaguucucu

SEQ ID NO: 148143 - RNA, 22 nt, Human
uggcuucugguuuauccuuaua

SEQ ID NO: 148144 - RNA, 22 nt, Human
uggcccugaaucaaggccagca

SEQ ID NO: 148145 - RNA, 20 nt, Human
uggccgacccugaggaguug

SEQ ID NO: 148146 - RNA, 22 nt, Human
uggccgaugagcaugcgcugau

SEQ ID NO: 148147 - RNA, 23 nt, Human
uggccguccccugacucucuggc

SEQ ID NO: 148148 - RNA, 22 nt, Human
uucauagggagcaucuaccuau

SEQ ID NO: 148149 - RNA, 22 nt, Human
uucaucuucaaaccccagugcc

SEQ ID NO: 148150 - RNA, 22 nt, Human
uucaugcgcuuuucaggagugu

SEQ ID NO: 148151 - RNA, 20 nt, Human
uggcccgcgcuccuccugcu

SEQ ID NO: 148152 - RNA, 22 nt, Human
uucaggucauuuuuagcccuag

SEQ ID NO: 148153 - RNA, 22 nt, Human
uggcccauccggcuccuccuug

SEQ ID NO: 148154 - RNA, 22 nt, Human
uggcccaagggaggcuuggccu

SEQ ID NO: 148155 - RNA, 22 nt, Human
uggccaaucagcugugaccugc

SEQ ID NO: 148156 - RNA, 22 nt, Human
uucaguguuagaauuccaagaa

SEQ ID NO: 148157 - RNA, 22 nt, Human
uucaguuccucuuuugggcucu

SEQ ID NO: 148158 - RNA, 22 nt, Human
uggccaugagaaucuuugcugu

SEQ ID NO: 148159 - RNA, 20 nt, Human
uuccucaaaagucugaugcu

SEQ ID NO: 148160 - RNA, 22 nt, Human
ugggauucucagaaacacagag

SEQ ID NO: 148161 - RNA, 22 nt, Human
ugggcacacugaaucugcuauu

SEQ ID NO: 148162 - RNA, 22 nt, Human
ugggcagggauuuggggaaacu

SEQ ID NO: 148163 - RNA, 21 nt, Human
uggggaugcauugcagaggca

SEQ ID NO: 148164 - RNA, 22 nt, Human
uuccauuccauaucagguacag

SEQ ID NO: 148165 - RNA, 22 nt, Human
uggcuucuggccaggcacagga

SEQ ID NO: 148166 - RNA, 22 nt, Human
uucccagggaucucuaguauuu

SEQ ID NO: 148167 - RNA, 22 nt, Human
uggcuugacaucaauacuuauu

SEQ ID NO: 148168 - RNA, 22 nt, Human
ugggucagauugagccccuggu

SEQ ID NO: 148169 - RNA, 22 nt, Human
uggggugccccccucgguuugc

SEQ ID NO: 148170 - RNA, 20 nt, Human
uucucugcagcaggcggccc

SEQ ID NO: 148171 - RNA, 22 nt, Human
uucguucagcgcuugcgcaugc

SEQ ID NO: 148172 - RNA, 18 nt, Human
ugggggacgcuuuuuuuc

SEQ ID NO: 148173 - RNA, 22 nt, Human
uggggcuuggcucacagaagcu

SEQ ID NO: 148174 - RNA, 22 nt, Human
uggggcuuucgcggagcgucgg

SEQ ID NO: 148175 - RNA, 22 nt, Human
ugggggagggagaguugauggg

SEQ ID NO: 148176 - RNA, 22 nt, Human
ugggggauucaucucagagcgu

SEQ ID NO: 148177 - RNA, 22 nt, Human
ugggggcacccagccgaugagg

SEQ ID NO: 148178 - RNA, 22 nt, Human
ugcauugccauagcagggggau

SEQ ID NO: 148179 - RNA, 22 nt, Human
ugcagguggcagcggggcacca

SEQ ID NO: 148180 - RNA, 22 nt, Human
ugcaggguuucaauacacagga

SEQ ID NO: 148181 - RNA, 22 nt, Human
ugcaggucuggacccccacuuu

SEQ ID NO: 148182 - RNA, 18 nt, Human
ugcaggggaggggugaua

SEQ ID NO: 148183 - RNA, 22 nt, Human
ugugccuagauuccaugcacuc

SEQ ID NO: 148184 - RNA, 22 nt, Human
uguggcucugaugucauaaagg

SEQ ID NO: 148185 - RNA, 22 nt, Human
ugugccuguugguguagacaua

SEQ ID NO: 148186 - RNA, 22 nt, Human
ugcaggagcccaggaauacuau

SEQ ID NO: 148187 - RNA, 22 nt, Human
ugcaggagaaaguacggagcgu

SEQ ID NO: 148188 - RNA, 22 nt, Human
ugcacugccuuucuuggcauga

SEQ ID NO: 148189 - RNA, 20 nt, Human
ugcacggcugugugugugca

SEQ ID NO: 148190 - RNA, 19 nt, Human
ugcacucauggagggucug

SEQ ID NO: 148191 - RNA, 22 nt, Human
ugucuucauuccccaugaaguc

SEQ ID NO: 148192 - RNA, 22 nt, Human
uguggugacuugagcuuccuaa

SEQ ID NO: 148193 - RNA, 22 nt, Human
ugugguuuguaagcaaagcaaa

SEQ ID NO: 148194 - RNA, 22 nt, Human
uguggugcucagggaggauggg

SEQ ID NO: 148195 - RNA, 22 nt, Human
ugugugggcgaagacagccuuu

SEQ ID NO: 148196 - RNA, 22 nt, Human
uguguauguauguauguaugua

SEQ ID NO: 148197 - RNA, 22 nt, Human
ugccucucuggaucugcuguga

SEQ ID NO: 148198 - RNA, 22 nt, Human
ugugggcguggguuggggaggg

SEQ ID NO: 148199 - RNA, 18 nt, Human
ugcccaccagaagaggga

SEQ ID NO: 148200 - RNA, 22 nt, Human
ugccaucuuugccccuauuuua

SEQ ID NO: 148201 - RNA, 22 nt, Human
ugccaugguuguacaguagcag

SEQ ID NO: 148202 - RNA, 22 nt, Human
ugccaacaggcuugccugaugu

SEQ ID NO: 148203 - RNA, 16 nt, Human
ugccaagggguuaaug

SEQ ID NO: 148204 - RNA, 22 nt, Human
ugcauuugcaauggguacacaa

SEQ ID NO: 148205 - RNA, 22 nt, Human
uguucaguuugcuaucauaauc

SEQ ID NO: 148206 - RNA, 22 nt, Human
uguuccggucuaucgugucaau

SEQ ID NO: 148207 - RNA, 22 nt, Human
uguucccgaugacaggaccagg

SEQ ID NO: 148208 - RNA, 22 nt, Human
ugcgccaggacacccguggcgg

SEQ ID NO: 148209 - RNA, 19 nt, Human
ugccuggcaccagcuccac

SEQ ID NO: 148210 - RNA, 20 nt, Human
ugccugagcgcagcuccagg

SEQ ID NO: 148211 - RNA, 22 nt, Human
uguguguguguguguguuugug

SEQ ID NO: 148212 - RNA, 23 nt, Human
ugugugugugugugugugugugu

SEQ ID NO: 148213 - RNA, 22 nt, Human
uguguguguuguaugaaauuuu

SEQ ID NO: 148214 - RNA, 22 nt, Human
uguguguucauccccucaacau

SEQ ID NO: 148215 - RNA, 19 nt, Human
uguguguguuuuguuugaa

SEQ ID NO: 148216 - RNA, 19 nt, Human
uguguuccauccaccaccc

SEQ ID NO: 148217 - RNA, 22 nt, Human
ugccuucugccaaggacggugc

SEQ ID NO: 148218 - RNA, 17 nt, Human
ugccuucgucuucaguu

SEQ ID NO: 148219 - RNA, 22 nt, Human
ugcuagccacuauuguaaguau

SEQ ID NO: 148220 - RNA, 19 nt, Human
uguugcagcuugaucggua

SEQ ID NO: 148221 - RNA, 22 nt, Human
ugcguggauuuaggagugaggg

SEQ ID NO: 148222 - RNA, 22 nt, Human
ugcuaaguacauuccaggacuu

SEQ ID NO: 148223 - RNA, 21 nt, Human
ugcuaagugucacaugucugc

SEQ ID NO: 148224 - RNA, 22 nt, Human
ugcggugcgcccgggcgagugc

SEQ ID NO: 148225 - RNA, 19 nt, Human
uguucuacuugcuaguauu

SEQ ID NO: 148226 - RNA, 19 nt, Human
ugcgggcugcggucagggc

SEQ ID NO: 148227 - RNA, 22 nt, Human
ugcggcucaaagggaaggccuu

SEQ ID NO: 148228 - RNA, 22 nt, Human
uguuccuuuuguuguuuuguuu

SEQ ID NO: 148229 - RNA, 22 nt, Human
ugagccugaguguguauugaac

SEQ ID NO: 148230 - RNA, 22 nt, Human
uggugaggacccagauuuuccu

SEQ ID NO: 148231 - RNA, 20 nt, Human
ugggguucccuuuagggcuu

SEQ ID NO: 148232 - RNA, 22 nt, Human
ugacauccuacaccccuggguc

SEQ ID NO: 148233 - RNA, 23 nt, Human
uggggucaaggcugccuuggggu

SEQ ID NO: 148234 - RNA, 22 nt, Human
ugggggguuuagaaucugcccu

SEQ ID NO: 148235 - RNA, 20 nt, Human
ugggggugcccaucuccccu

SEQ ID NO: 148236 - RNA, 22 nt, Human
uggggucuggcauaugguagau

SEQ ID NO: 148237 - RNA, 22 nt, Human
ugacaucagacugugagaagag

SEQ ID NO: 148238 - RNA, 22 nt, Human
uggugcccguggaaagagggag

SEQ ID NO: 148239 - RNA, 22 nt, Human
ugaggcaguucuuacuuguauu

SEQ ID NO: 148240 - RNA, 22 nt, Human
ugaggccaagccuccucugcca

SEQ ID NO: 148241 - RNA, 22 nt, Human
ugguggaggugggggguauuuu

SEQ ID NO: 148242 - RNA, 22 nt, Human
ugaggaagugguuguaugguuu

SEQ ID NO: 148243 - RNA, 22 nt, Human
ugaggaacaugggagaaauguc

SEQ ID NO: 148244 - RNA, 23 nt, Human
ugaggucuuggaaguucuguuug

SEQ ID NO: 148245 - RNA, 22 nt, Human
ugguugcaguggugcuuauaca

SEQ ID NO: 148246 - RNA, 22 nt, Human
ugaguucugacugagcaugggg

SEQ ID NO: 148247 - RNA, 22 nt, Human
ugaguugcagucaauauugcaa

SEQ ID NO: 148248 - RNA, 22 nt, Human
ugaucauguucuccaaaagcgu

SEQ ID NO: 148249 - RNA, 22 nt, Human
ugaguuucuuacucaggagcug

SEQ ID NO: 148250 - RNA, 22 nt, Human
ugaugaugaagaaauauuauca

SEQ ID NO: 148251 - RNA, 22 nt, Human
ugaugaugauacauuucuucag

SEQ ID NO: 148252 - RNA, 22 nt, Human
ugauggaucuguuggcggguuu

SEQ ID NO: 148253 - RNA, 22 nt, Human
uguagcaauauaucagugcaca

SEQ ID NO: 148254 - RNA, 22 nt, Human
ugauggugagaugucccguguu

SEQ ID NO: 148255 - RNA, 22 nt, Human
ugauucacagacuucacaaggc

SEQ ID NO: 148256 - RNA, 22 nt, Human
ugauguggaucuauaacuguaa

SEQ ID NO: 148257 - RNA, 22 nt, Human
ugauuuguuuaaauugcucguu

SEQ ID NO: 148258 - RNA, 22 nt, Human
ugauugcucagcuagccucuuu

SEQ ID NO: 148259 - RNA, 22 nt, Human
ugauugcucgacacucugcuug

SEQ ID NO: 148260 - RNA, 22 nt, Human
ugcacccacuuagcugaaguuc

SEQ ID NO: 148261 - RNA, 22 nt, Human
ugcaaggcacccacucugcuuu

SEQ ID NO: 148262 - RNA, 16 nt, Human
ugcaccgggaacacug

SEQ ID NO: 148263 - RNA, 18 nt, Human
ugcacccuaagggcccca

SEQ ID NO: 148264 - RNA, 23 nt, Human
ugucugccuaucaugugaaggac

SEQ ID NO: 148265 - RNA, 22 nt, Human
ugaaauugaguaccucuuuaua

SEQ ID NO: 148266 - RNA, 22 nt, Human
uggcuugagcugggcccaccug

SEQ ID NO: 148267 - RNA, 22 nt, Human
uggcuucagacuucugcuacgu

SEQ ID NO: 148268 - RNA, 22 nt, Human
uggcuguuggagcuggaagaug

SEQ ID NO: 148269 - RNA, 22 nt, Human
uggcugggagcuggaacugggc

SEQ ID NO: 148270 - RNA, 22 nt, Human
uggcugagugaacauguccauu

SEQ ID NO: 148271 - RNA, 22 nt, Human
uggccucuuucuucccuuugac

SEQ ID NO: 148272 - RNA, 23 nt, Human
uggcucugagcuuccugguggcc

SEQ ID NO: 148273 - RNA, 22 nt, Human
uggcugagcugcagcguggcuu

SEQ ID NO: 148274 - RNA, 22 nt, Human
uggcggcuggacuggggggcca

SEQ ID NO: 148275 - RNA, 22 nt, Human
uggccugauuuugcuaagagaa

SEQ ID NO: 148276 - RNA, 22 nt, Human
ugaaccgcuucauggugccugu

SEQ ID NO: 148277 - RNA, 22 nt, Human
ugaaccuaacauuucuggcagu

SEQ ID NO: 148278 - RNA, 22 nt, Human
ugaaccgacaggggaagauugu

SEQ ID NO: 148279 - RNA, 22 nt, Human
ugggaaacucuaaacuugagua

SEQ ID NO: 148280 - RNA, 22 nt, Human
uggcuuuuuucuccccuuggau

SEQ ID NO: 148281 - RNA, 18 nt, Human
ugggacucugacuugguu

SEQ ID NO: 148282 - RNA, 22 nt, Human
ugggagccuuccacugggggaa

SEQ ID NO: 148283 - RNA, 22 nt, Human
ugggauauagaauuggcagagu

SEQ ID NO: 148284 - RNA, 21 nt, Human
ugaagcccugugaggugcuua

SEQ ID NO: 148285 - RNA, 22 nt, Human
ugggccucuguuuccucaucug

SEQ ID NO: 148286 - RNA, 22 nt, Human
ugggcuguuucuuaaggauaug

SEQ ID NO: 148287 - RNA, 22 nt, Human
uggggagcucagcaccaucagu

SEQ ID NO: 148288 - RNA, 22 nt, Human
uggggacucacugacuaucuug

SEQ ID NO: 148289 - RNA, 22 nt, Human
uggggaauguaauucuuuggcu

SEQ ID NO: 148290 - RNA, 22 nt, Human
uggggagucccaacgguggaag

SEQ ID NO: 148291 - RNA, 22 nt, Human
ugggccgugagacgucucuggg

SEQ ID NO: 148292 - RNA, 22 nt, Human
ugggcccaucauugcugugggc

SEQ ID NO: 148293 - RNA, 23 nt, Human
ugggccucuccacccuuuucugu

SEQ ID NO: 148294 - RNA, 22 nt, Human
ugggcagggagcuggaaccaca

SEQ ID NO: 148295 - RNA, 22 nt, Human
ugggccacguggagucuguagg

SEQ ID NO: 148296 - RNA, 22 nt, Human
ugggcaguccagcuggaaacgg

SEQ ID NO: 148297 - RNA, 22 nt, Human
ugaagcuaguauuaacucagau

SEQ ID NO: 148298 - RNA, 22 nt, Human
ugaaggaggugaauccaugcau

SEQ ID NO: 148299 - RNA, 22 nt, Human
ugaaggccagggauuugcagcc

SEQ ID NO: 148300 - RNA, 22 nt, Human
ugggaggcugugggaauggguc

SEQ ID NO: 148301 - RNA, 22 nt, Human
ugggauggacuuuagagaaucg

SEQ ID NO: 148302 - RNA, 20 nt, Human
ugggauggaaucaccugcac

SEQ ID NO: 148303 - RNA, 22 nt, Human
uggggcugguaccguaauauau

SEQ ID NO: 148304 - RNA, 22 nt, Human
uggggcuggccaggaggagucu

SEQ ID NO: 148305 - RNA, 22 nt, Human
uggggcuauggcccgaccacgu

SEQ ID NO: 148306 - RNA, 22 nt, Human
uggggcgcaggcccagcgggcu

SEQ ID NO: 148307 - RNA, 22 nt, Human
ugggggaggaggagacagacug

SEQ ID NO: 148308 - RNA, 22 nt, Human
ugaaucugagccugcgcaaagu

SEQ ID NO: 148309 - RNA, 22 nt, Human
ugacacacagggggauggaguu

SEQ ID NO: 148310 - RNA, 17 nt, Human
ugacagcuaaggggcuu

SEQ ID NO: 148311 - RNA, 22 nt, Human
ugaauguguacacgauuguuug

SEQ ID NO: 148312 - RNA, 22 nt, Human
ugaauuacacugggaucagggc

SEQ ID NO: 148313 - RNA, 22 nt, Human
ugaauguggucaggaaauuguu

SEQ ID NO: 148314 - RNA, 22 nt, Human
ugaauuuguaggaauucuccau

SEQ ID NO: 148315 - RNA, 22 nt, Human
uggcagaaugaagacuggggcc

SEQ ID NO: 148316 - RNA, 22 nt, Human
uggcacugcccugucucggugg

SEQ ID NO: 148317 - RNA, 22 nt, Human
uggcagcauuuuuuccagaaca

SEQ ID NO: 148318 - RNA, 22 nt, Human
uggcacugaagcuggaaagccu

SEQ ID NO: 148319 - RNA, 22 nt, Human
uggauuguuuacaucaugucug

SEQ ID NO: 148320 - RNA, 22 nt, Human
uggcacaggcagaaggugccgc

SEQ ID NO: 148321 - RNA, 22 nt, Human
uggcacagcuugucauaaacuc

SEQ ID NO: 148322 - RNA, 22 nt, Human
uggauucucuguagccugguuc

SEQ ID NO: 148323 - RNA, 18 nt, Human
uggcaaugccaaaggcuu

SEQ ID NO: 148324 - RNA, 22 nt, Human
ucuuauucuuuuaaacaacgca

SEQ ID NO: 148325 - RNA, 22 nt, Human
uggaugagugaauggauaaauc

SEQ ID NO: 148326 - RNA, 22 nt, Human
uggaguuuuaaucuguacagaa

SEQ ID NO: 148327 - RNA, 22 nt, Human
uggauauagcugaggugucuug

SEQ ID NO: 148328 - RNA, 22 nt, Human
uggaugccuugggggaggagga

SEQ ID NO: 148329 - RNA, 19 nt, Human
uggaggcggguggcccaga

SEQ ID NO: 148330 - RNA, 21 nt, Human
uggaggcguaaucacuguuga

SEQ ID NO: 148331 - RNA, 22 nt, Human
ucuguucucuuguucugacggu

SEQ ID NO: 148332 - RNA, 18 nt, Human
uggcaugcuuugauacau

SEQ ID NO: 148333 - RNA, 20 nt, Human
uggcaugcucucuuuuuagg

SEQ ID NO: 148334 - RNA, 22 nt, Human
uggcagccucugguccuuaguu

SEQ ID NO: 148335 - RNA, 22 nt, Human
uggcagcucauuuggaaaugga

SEQ ID NO: 148336 - RNA, 22 nt, Human
uggcagccugcgugaaggagcu

SEQ ID NO: 148337 - RNA, 22 nt, Human
uggcaggggaaaagggguggga

SEQ ID NO: 148338 - RNA, 21 nt, Human
uggcaggcagcuggaagcuug

SEQ ID NO: 148339 - RNA, 22 nt, Human
uggccagucuuagcugugccug

SEQ ID NO: 148340 - RNA, 20 nt, Human
uggcccagcacgacgaggac

SEQ ID NO: 148341 - RNA, 22 nt, Human
uggcccaucagggcaccugaga

SEQ ID NO: 148342 - RNA, 22 nt, Human
uggccccauuuuucuggagccu

SEQ ID NO: 148343 - RNA, 22 nt, Human
uggccucauggccuuaucuggg

SEQ ID NO: 148344 - RNA, 22 nt, Human
uggcccagaucucugaccuuga

SEQ ID NO: 148345 - RNA, 22 nt, Human
ucuuggucccugagcucuuuca

SEQ ID NO: 148346 - RNA, 17 nt, Human
ucugccaguuuuagaau

SEQ ID NO: 148347 - RNA, 22 nt, Human
ucugcccaggaggucccauggg

SEQ ID NO: 148348 - RNA, 22 nt, Human
ucugcccguucaaauccuuguu

SEQ ID NO: 148349 - RNA, 23 nt, Human
ucugccuccuaauuguugguguc

SEQ ID NO: 148350 - RNA, 22 nt, Human
uggaacuuccucacuuucccuc

SEQ ID NO: 148351 - RNA, 22 nt, Human
uggaacugguuugcuucagacu

SEQ ID NO: 148352 - RNA, 22 nt, Human
uggaagaagcuacaagcgguga

SEQ ID NO: 148353 - RNA, 22 nt, Human
ugcugccucugaauggagcagu

SEQ ID NO: 148354 - RNA, 22 nt, Human
ugcugccucccaucccucccga

SEQ ID NO: 148355 - RNA, 17 nt, Human
ucugcagaggcaaaccu

SEQ ID NO: 148356 - RNA, 21 nt, Human
ucuagaccuugggcagucacu

SEQ ID NO: 148357 - RNA, 22 nt, Human
ucuaccuucagaaugugggguu

SEQ ID NO: 148358 - RNA, 22 nt, Human
uggaaauagauguaggaaauug

SEQ ID NO: 148359 - RNA, 22 nt, Human
uggaauuaucugaagugauuug

SEQ ID NO: 148360 - RNA, 22 nt, Human
uggaaugaaagaaaaauuguag

SEQ ID NO: 148361 - RNA, 22 nt, Human
uggaaggggccaggcgcggagu

SEQ ID NO: 148362 - RNA, 22 nt, Human
uggaaggggagcuggaaagggg

SEQ ID NO: 148363 - RNA, 22 nt, Human
ucuggggaugagugaugucgua

SEQ ID NO: 148364 - RNA, 22 nt, Human
uggaaggaaauguguaucauaa

SEQ ID NO: 148365 - RNA, 22 nt, Human
ucugggccacccgccuccaggg

SEQ ID NO: 148366 - RNA, 22 nt, Human
uggagagcaaugaggggcaggc

SEQ ID NO: 148367 - RNA, 21 nt, Human
uggagcagggaggauuugggg

SEQ ID NO: 148368 - RNA, 19 nt, Human
uggaggcacuaacaaacuc

SEQ ID NO: 148369 - RNA, 22 nt, Human
uggaggaggaugcauuuguugu

SEQ ID NO: 148370 - RNA, 22 nt, Human
uggagcuggcuuguggaaguug

SEQ ID NO: 148371 - RNA, 22 nt, Human
uggagcugguucuggggaagcu

SEQ ID NO: 148372 - RNA, 22 nt, Human
ucugugugugcauguguguaua

SEQ ID NO: 148373 - RNA, 22 nt, Human
uggaggaggagaacuuggcacu

SEQ ID NO: 148374 - RNA, 23 nt, Human
ugcucgccuucaggacuugggcu

SEQ ID NO: 148375 - RNA, 21 nt, Human
ucgggcggcggcugaggcggc

SEQ ID NO: 148376 - RNA, 22 nt, Human
ugcucgggcuccuuugagugag

SEQ ID NO: 148377 - RNA, 22 nt, Human
ucgggcgaauguuguuuuucuc

SEQ ID NO: 148378 - RNA, 22 nt, Human
ucgggcccggcucccgacgccc

SEQ ID NO: 148379 - RNA, 22 nt, Human
ucgggaggaggcggagcucguu

SEQ ID NO: 148380 - RNA, 22 nt, Human
ugcucugguccucccucggcgc

SEQ ID NO: 148381 - RNA, 22 nt, Human
ucggguguguguguuggguaug

SEQ ID NO: 148382 - RNA, 22 nt, Human
ugcugaccggccuccccccagc

SEQ ID NO: 148383 - RNA, 22 nt, Human
ucgucaaaguaaugucauagca

SEQ ID NO: 148384 - RNA, 22 nt, Human
ugcugcacuuauggcucugagg

SEQ ID NO: 148385 - RNA, 22 nt, Human
ugcugcacucacaggaagaguu

SEQ ID NO: 148386 - RNA, 22 nt, Human
ucgggggucgggcggcggucca

SEQ ID NO: 148387 - RNA, 22 nt, Human
ucguccaauaaccugccagcgc

SEQ ID NO: 148388 - RNA, 22 nt, Human
ucgugagugcugucaccugcug

SEQ ID NO: 148389 - RNA, 22 nt, Human
ucguggaugaagaauagaggcc

SEQ ID NO: 148390 - RNA, 22 nt, Human
ugcucgauuauuucauuuugca

SEQ ID NO: 148391 - RNA, 22 nt, Human
ucggcgaccugucauggaccaa

SEQ ID NO: 148392 - RNA, 20 nt, Human
ugcuccaggaacacuggccg

SEQ ID NO: 148393 - RNA, 22 nt, Human
ucgaggagagucgccagcugcu

SEQ ID NO: 148394 - RNA, 22 nt, Human
ucgccccccgccucacccucgg

SEQ ID NO: 148395 - RNA, 22 nt, Human
ucgcccagguuggagugcagug

SEQ ID NO: 148396 - RNA, 22 nt, Human
ucgauccaggaaggcugguuua

SEQ ID NO: 148397 - RNA, 22 nt, Human
ucgagcgcucccugugcucucg

SEQ ID NO: 148398 - RNA, 22 nt, Human
ugcggugcagcccugcccucuc

SEQ ID NO: 148399 - RNA, 21 nt, Human
ugcguaugucuuguauuacuc

SEQ ID NO: 148400 - RNA, 22 nt, Human
ugcgucccagcauguagggcag

SEQ ID NO: 148401 - RNA, 22 nt, Human
ugcguugaggaccgcgagggcg

SEQ ID NO: 148402 - RNA, 22 nt, Human
ugccgccgugggucccgacgcg

SEQ ID NO: 148403 - RNA, 22 nt, Human
ugccgcaggaggggcgauuucu

SEQ ID NO: 148404 - RNA, 22 nt, Human
ugccgcuuucuggcccucaguc

SEQ ID NO: 148405 - RNA, 19 nt, Human
ugccggccgcgggguuccu

SEQ ID NO: 148406 - RNA, 22 nt, Human
ugccuguguauuuccggccugc

SEQ ID NO: 148407 - RNA, 22 nt, Human
uccugaaggccugaguuccacc

SEQ ID NO: 148408 - RNA, 22 nt, Human
uccugggcuugcucuuuccauu

SEQ ID NO: 148409 - RNA, 22 nt, Human
ugcccuuucuccagugaccauu

SEQ ID NO: 148410 - RNA, 22 nt, Human
ugccaucaugucagauuuggga

SEQ ID NO: 148411 - RNA, 22 nt, Human
uccucuuguguguuccgguacc

SEQ ID NO: 148412 - RNA, 22 nt, Human
uccguugaggcugccaggcgag

SEQ ID NO: 148413 - RNA, 22 nt, Human
ugcaugcagcuggucgggcgcc

SEQ ID NO: 148414 - RNA, 22 nt, Human
ugcaugaucucacuuacaggug

SEQ ID NO: 148415 - RNA, 22 nt, Human
ucccuuuuuaauugugucccug

SEQ ID NO: 148416 - RNA, 22 nt, Human
ucccuuuuagccccgcccuccu

SEQ ID NO: 148417 - RNA, 22 nt, Human
ugccagugugccuuccgcucac

SEQ ID NO: 148418 - RNA, 22 nt, Human
ugccaguaauuguccuguagcu

SEQ ID NO: 148419 - RNA, 20 nt, Human
ugccagagagcucauacccu

SEQ ID NO: 148420 - RNA, 22 nt, Human
ugccagauuaugucuccagggc

SEQ ID NO: 148421 - RNA, 22 nt, Human
ucaggcgcucuucguggcugcc

SEQ ID NO: 148422 - RNA, 22 nt, Human
ugagggucgcaagcaccaggcc

SEQ ID NO: 148423 - RNA, 22 nt, Human
ugagguguuugugcaccaucug

SEQ ID NO: 148424 - RNA, 22 nt, Human
ugaguugucacaacgucacaag

SEQ ID NO: 148425 - RNA, 22 nt, Human
ugagugugugucuuggguaccg

SEQ ID NO: 148426 - RNA, 22 nt, Human
ucauccugaagaaccugcuucc

SEQ ID NO: 148427 - RNA, 22 nt, Human
ugagugggaggugggaagggua

SEQ ID NO: 148428 - RNA, 23 nt, Human
ucauugcucaagauaaugguuga

SEQ ID NO: 148429 - RNA, 22 nt, Human
ugaugaucaugcagguugguuu

SEQ ID NO: 148430 - RNA, 17 nt, Human
ucauuucaguaaaucca

SEQ ID NO: 148431 - RNA, 22 nt, Human
ugaugcuagaacuuccaagaua

SEQ ID NO: 148432 - RNA, 22 nt, Human
uccaagcgcuucuggagcuccu

SEQ ID NO: 148433 - RNA, 22 nt, Human
uccaagacagauaccuagaaga

SEQ ID NO: 148434 - RNA, 22 nt, Human
uccaaguuugagacugagagug

SEQ ID NO: 148435 - RNA, 22 nt, Human
ugaugccauaguaaaauuugcu

SEQ ID NO: 148436 - RNA, 22 nt, Human
uccagguccuacuggcccauag

SEQ ID NO: 148437 - RNA, 22 nt, Human
uccagguggcuuuccuggggga

SEQ ID NO: 148438 - RNA, 22 nt, Human
uccaggucgggggugggccggc

SEQ ID NO: 148439 - RNA, 22 nt, Human
uccagugguggcucccggaccu

SEQ ID NO: 148440 - RNA, 22 nt, Human
ugcaaaaguuuuauacacagau

SEQ ID NO: 148441 - RNA, 22 nt, Human
uccauacuggccucuuucccag

SEQ ID NO: 148442 - RNA, 22 nt, Human
uccaucaccacagaggacagag

SEQ ID NO: 148443 - RNA, 22 nt, Human
uccaugauauauaugugcacau

SEQ ID NO: 148444 - RNA, 18 nt, Human
uccauccucugcucuuca

SEQ ID NO: 148445 - RNA, 22 nt, Human
uccacgggagcgucggucucgg

SEQ ID NO: 148446 - RNA, 22 nt, Human
uccaccaccaucacagucagac

SEQ ID NO: 148447 - RNA, 22 nt, Human
uccaccugucccugcuuccugc

SEQ ID NO: 148448 - RNA, 22 nt, Human
uccaccacgaaacugcagcugc

SEQ ID NO: 148449 - RNA, 22 nt, Human
uccacagcagagcacgguaccu

SEQ ID NO: 148450 - RNA, 22 nt, Human
ugauucacgcuucucuuuaaac

SEQ ID NO: 148451 - RNA, 22 nt, Human
uccagggaggggcggcaggggu

SEQ ID NO: 148452 - RNA, 22 nt, Human
uccauucccugacagccucuuu

SEQ ID NO: 148453 - RNA, 21 nt, Human
ugcaaugcauugacagcagca

SEQ ID NO: 148454 - RNA, 22 nt, Human
uccccggagucccuggccaggg

SEQ ID NO: 148455 - RNA, 22 nt, Human
ugcagcaucuccuugugccaug

SEQ ID NO: 148456 - RNA, 19 nt, Human
ugcagcuguaugagcuuaa

SEQ ID NO: 148457 - RNA, 22 nt, Human
ugcagcgugaggacagcugagc

SEQ ID NO: 148458 - RNA, 22 nt, Human
ugcacgcgcccuucgauggccc

SEQ ID NO: 148459 - RNA, 22 nt, Human
ugcacgcacuugcucuccagcg

SEQ ID NO: 148460 - RNA, 22 nt, Human
uagugcuuaaaacagaauuuuc

SEQ ID NO: 148461 - RNA, 22 nt, Human
ucuacuccaucugccagggcuu

SEQ ID NO: 148462 - RNA, 22 nt, Human
uagugggguccacuuccuucac

SEQ ID NO: 148463 - RNA, 22 nt, Human
uaguggcccagcauuucucaau

SEQ ID NO: 148464 - RNA, 22 nt, Human
ucuuccagauacuuccugacuu

SEQ ID NO: 148465 - RNA, 22 nt, Human
ucuugcuguagcuguuucuucu

SEQ ID NO: 148466 - RNA, 22 nt, Human
ucuugccccugcuuuggaacaa

SEQ ID NO: 148467 - RNA, 22 nt, Human
ucuugcuguggcagaucuggag

SEQ ID NO: 148468 - RNA, 22 nt, Human
ucuugggcaguccucuacuggu

SEQ ID NO: 148469 - RNA, 22 nt, Human
ugaacuggauuugugagcuccu

SEQ ID NO: 148470 - RNA, 22 nt, Human
ugaacuucccauguacagacug

SEQ ID NO: 148471 - RNA, 22 nt, Human
uauuuuggcuccugagcucuga

SEQ ID NO: 148472 - RNA, 21 nt, Human
ugaacaccaggagaaaucggu

SEQ ID NO: 148473 - RNA, 22 nt, Human
ugaaccaugaauuacaggagca

SEQ ID NO: 148474 - RNA, 22 nt, Human
ugaaccugagggcaaagggaca

SEQ ID NO: 148475 - RNA, 22 nt, Human
ugaagccacacuagcuuguccu

SEQ ID NO: 148476 - RNA, 21 nt, Human
ugaagccuagagaauugggga

SEQ ID NO: 148477 - RNA, 22 nt, Human
ugaagacaguuuuacucaugag

SEQ ID NO: 148478 - RNA, 22 nt, Human
ucaaaggcuugugguucuggga

SEQ ID NO: 148479 - RNA, 18 nt, Human
uauuugugugugugugug

SEQ ID NO: 148480 - RNA, 22 nt, Human
ugaaagccuacagcucacuguu

SEQ ID NO: 148481 - RNA, 22 nt, Human
uauuuuggaugcauugagaugc

SEQ ID NO: 148482 - RNA, 22 nt, Human
ucaagagauauaugcugguuua

SEQ ID NO: 148483 - RNA, 22 nt, Human
ugaagguggcuugcagcuaguc

SEQ ID NO: 148484 - RNA, 22 nt, Human
ucaagggaccaagcauucauua

SEQ ID NO: 148485 - RNA, 21 nt, Human
ucaaguccuggcuuugcucuu

SEQ ID NO: 148486 - RNA, 19 nt, Human
ucacggucaaccagagccu

SEQ ID NO: 148487 - RNA, 22 nt, Human
ucaccugccuggguggucaccu

SEQ ID NO: 148488 - RNA, 22 nt, Human
ucacuggauucauguuucuuua

SEQ ID NO: 148489 - RNA, 22 nt, Human
ucacuggaaaacaaauguuuua

SEQ ID NO: 148490 - RNA, 22 nt, Human
ucacauggauuaacucauuuau

SEQ ID NO: 148491 - RNA, 22 nt, Human
ucaccaugcccuucucugcucu

SEQ ID NO: 148492 - RNA, 22 nt, Human
ucacaugcucaccuaagccaca

SEQ ID NO: 148493 - RNA, 22 nt, Human
ucacccuguggcuauaaggcaa

SEQ ID NO: 148494 - RNA, 22 nt, Human
ugaaugcuacccugcuggcucu

SEQ ID NO: 148495 - RNA, 22 nt, Human
ugaaugaguucaccgcucaguu

SEQ ID NO: 148496 - RNA, 22 nt, Human
ugacagugugcccggagguuag

SEQ ID NO: 148497 - RNA, 22 nt, Human
ugacagucacagcagaaacucg

SEQ ID NO: 148498 - RNA, 21 nt, Human
ucagaaucguuccagguagau

SEQ ID NO: 148499 - RNA, 22 nt, Human
ucagaaggagagacagcgugga

SEQ ID NO: 148500 - RNA, 22 nt, Human
ugacaguuugacugcaaccuuu

SEQ ID NO: 148501 - RNA, 22 nt, Human
ucagagugagcuggggcugcuu

SEQ ID NO: 148502 - RNA, 22 nt, Human
ucagacacacaacuucugcuua

SEQ ID NO: 148503 - RNA, 23 nt, Human
ucagaccaaccucuugcuggaac

SEQ ID NO: 148504 - RNA, 22 nt, Human
ucacuguuucaccgucugaagg

SEQ ID NO: 148505 - RNA, 22 nt, Human
ugacaagagaccccuccgcagg

SEQ ID NO: 148506 - RNA, 22 nt, Human
ucacuguugccacggugauaau

SEQ ID NO: 148507 - RNA, 22 nt, Human
ucacuuccuugcagcuguagaa

SEQ ID NO: 148508 - RNA, 22 nt, Human
ucagaacuaacuuugcugaacc

SEQ ID NO: 148509 - RNA, 22 nt, Human
ucaggaggucugcugcggggug

SEQ ID NO: 148510 - RNA, 22 nt, Human
ugacugguauuuguaaaccaua

SEQ ID NO: 148511 - RNA, 19 nt, Human
ugacuggguucuaggcagg

SEQ ID NO: 148512 - RNA, 22 nt, Human
ucagcugggagaaaguuuuagg

SEQ ID NO: 148513 - RNA, 22 nt, Human
ucagcguuaguuuuucaucuaa

SEQ ID NO: 148514 - RNA, 22 nt, Human
ucagauggucauucacuagggu

SEQ ID NO: 148515 - RNA, 22 nt, Human
ugaccuacauuuauagcuguca

SEQ ID NO: 148516 - RNA, 22 nt, Human
ugaccgucagcugucuuccauu

SEQ ID NO: 148517 - RNA, 22 nt, Human
ugaccuccuaagugacagaauu

SEQ ID NO: 148518 - RNA, 22 nt, Human
ugacgcauggccagcucugucu

SEQ ID NO: 148519 - RNA, 23 nt, Human
ucagccgcuggcgaguccacugg

SEQ ID NO: 148520 - RNA, 21 nt, Human
ucagccuguccaguguuaacc

SEQ ID NO: 148521 - RNA, 22 nt, Human
ugacguuugcgccgcgcacgac

SEQ ID NO: 148522 - RNA, 22 nt, Human
ucagcaggugcuuuguuuacuc

SEQ ID NO: 148523 - RNA, 22 nt, Human
gugcucaagacauuaggaauau

SEQ ID NO: 148524 - RNA, 22 nt, Human
guguccaugugggugcucuccu

SEQ ID NO: 148525 - RNA, 22 nt, Human
guguccaaagguaggaggaggg

SEQ ID NO: 148526 - RNA, 22 nt, Human
gugugaguggcuaagugugccu

SEQ ID NO: 148527 - RNA, 22 nt, Human
gugugguguuaagcaaauuaau

SEQ ID NO: 148528 - RNA, 22 nt, Human
uauaugcacucagguguaugug

SEQ ID NO: 148529 - RNA, 22 nt, Human
guguguggacgucugagcccag

SEQ ID NO: 148530 - RNA, 22 nt, Human
uaugggaaggauuugucuuuca

SEQ ID NO: 148531 - RNA, 23 nt, Human
guuaccgaccugauucggcagcc

SEQ ID NO: 148532 - RNA, 21 nt, Human
guuaccacugaugcaacagga

SEQ ID NO: 148533 - RNA, 22 nt, Human
uaugggcaagagauaggugguc

SEQ ID NO: 148534 - RNA, 22 nt, Human
guuccgcugcaaggccaggaaa

SEQ ID NO: 148535 - RNA, 22 nt, Human
guuccgcggccucgcgcugagc

SEQ ID NO: 148536 - RNA, 21 nt, Human
guugugaccaugggaguugcu

SEQ ID NO: 148537 - RNA, 22 nt, Human
guuguugucauuagcuguuuaa

SEQ ID NO: 148538 - RNA, 22 nt, Human
ucaccaggauugggcuguaggc

SEQ ID NO: 148539 - RNA, 22 nt, Human
ucacagauguuauccugaggau

SEQ ID NO: 148540 - RNA, 22 nt, Human
ucaaguccuuggcauaggauaa

SEQ ID NO: 148541 - RNA, 22 nt, Human
ucaccuggagagcuugcuaaua

SEQ ID NO: 148542 - RNA, 22 nt, Human
guuugagcaaucccucuauccc

SEQ ID NO: 148543 - RNA, 22 nt, Human
ucaccccagccuuaugacucag

SEQ ID NO: 148544 - RNA, 22 nt, Human
ucacccagacugucugacucuu

SEQ ID NO: 148545 - RNA, 22 nt, Human
ucaccgucucaguacggaggga

SEQ ID NO: 148546 - RNA, 22 nt, Human
ucaccauguacaugaagggcgg

SEQ ID NO: 148547 - RNA, 22 nt, Human
ucacugccuagggcuacugugc

SEQ ID NO: 148548 - RNA, 23 nt, Human
ucacugccaagaaaaguuacaga

SEQ ID NO: 148549 - RNA, 22 nt, Human
ucacucgccuuuucguucgccg

SEQ ID NO: 148550 - RNA, 23 nt, Human
ucacuucucuuacccucucucug

SEQ ID NO: 148551 - RNA, 22 nt, Human
ucacuucuaugaucugucucuu

SEQ ID NO: 148552 - RNA, 22 nt, Human
ucagagccagacacacagcaga

SEQ ID NO: 148553 - RNA, 18 nt, Human
ucagaggagauaccuaaa

SEQ ID NO: 148554 - RNA, 22 nt, Human
ucagagagagagaggcggaaga

SEQ ID NO: 148555 - RNA, 21 nt, Human
ucagaccaacucuuguauccu

SEQ ID NO: 148556 - RNA, 22 nt, Human
ucagaagguacugaagacaugg

SEQ ID NO: 148557 - RNA, 22 nt, Human
ucagaaacuaaauguggauuug

SEQ ID NO: 148558 - RNA, 22 nt, Human
ucagcaguuaagcuucccugcc

SEQ ID NO: 148559 - RNA, 19 nt, Human
ucagcagauuuugcaaaca

SEQ ID NO: 148560 - RNA, 22 nt, Human
ucagcacagcugcuuuuacuuc

SEQ ID NO: 148561 - RNA, 22 nt, Human
ucagcgucuccaaaagagcccg

SEQ ID NO: 148562 - RNA, 22 nt, Human
ucagcguuggccuccuccaggg

SEQ ID NO: 148563 - RNA, 22 nt, Human
ucagcuucaucuugagcccaca

SEQ ID NO: 148564 - RNA, 22 nt, Human
ucagcucucucuuggugaucuc

SEQ ID NO: 148565 - RNA, 20 nt, Human
uacaaggauguucaucagag

SEQ ID NO: 148566 - RNA, 22 nt, Human
uccaacuuaauugggaagauua

SEQ ID NO: 148567 - RNA, 22 nt, Human
ucauucucucguauucgcgaau

SEQ ID NO: 148568 - RNA, 22 nt, Human
ucaucagccaaagaguccuuca

SEQ ID NO: 148569 - RNA, 22 nt, Human
ucaucauccuuuuuugaagagu

SEQ ID NO: 148570 - RNA, 22 nt, Human
uaagagcagacacaaccugaga

SEQ ID NO: 148571 - RNA, 22 nt, Human
uaagaggucugaaacgguggga

SEQ ID NO: 148572 - RNA, 22 nt, Human
uaagaaaggggaaguuccucuu

SEQ ID NO: 148573 - RNA, 22 nt, Human
ucauccgcaaccacuuuagccu

SEQ ID NO: 148574 - RNA, 22 nt, Human
uacaccuuaagccgcggcuccc

SEQ ID NO: 148575 - RNA, 22 nt, Human
uacagaccaguaguucucagcg

SEQ ID NO: 148576 - RNA, 22 nt, Human
uccaccuaagucuccgggagcu

SEQ ID NO: 148577 - RNA, 21 nt, Human
uacaucaguuuucuuggcuca

SEQ ID NO: 148578 - RNA, 22 nt, Human
uacacacacaugcauguacgug

SEQ ID NO: 148579 - RNA, 22 nt, Human
uccacagggaugccugcggcuu

SEQ ID NO: 148580 - RNA, 22 nt, Human
uccagaaaucucuguugauugu

SEQ ID NO: 148581 - RNA, 22 nt, Human
uccagcacacagguggcucuca

SEQ ID NO: 148582 - RNA, 22 nt, Human
uacugguguauuucuucuuauu

SEQ ID NO: 148583 - RNA, 22 nt, Human
uacugggugagcugggcuggga

SEQ ID NO: 148584 - RNA, 22 nt, Human
uacucuggaguugagaugcgag

SEQ ID NO: 148585 - RNA, 22 nt, Human
ucccacagcuuccuagccacag

SEQ ID NO: 148586 - RNA, 22 nt, Human
ucccacugucuucucgugcucg

SEQ ID NO: 148587 - RNA, 22 nt, Human
uccagugaacaucauggcucca

SEQ ID NO: 148588 - RNA, 22 nt, Human
uccagguuuggcuuuauaacuu

SEQ ID NO: 148589 - RNA, 22 nt, Human
uccaguggcaccuuggcccuca

SEQ ID NO: 148590 - RNA, 20 nt, Human
uccaguuuuggagacauucu

SEQ ID NO: 148591 - RNA, 22 nt, Human
uacucauuggagaauuacgagg

SEQ ID NO: 148592 - RNA, 22 nt, Human
uccagguucaguucaucaucua

SEQ ID NO: 148593 - RNA, 20 nt, Human
uaccuccccagcagucauga

SEQ ID NO: 148594 - RNA, 20 nt, Human
uacccgcagcugggucuggc

SEQ ID NO: 148595 - RNA, 22 nt, Human
uaccgaagcugcuuuugcaugu

SEQ ID NO: 148596 - RNA, 22 nt, Human
ucgcggccgcuccacaugcaca

SEQ ID NO: 148597 - RNA, 22 nt, Human
ucgcuauuauuuuagguucuca

SEQ ID NO: 148598 - RNA, 22 nt, Human
ucgccuccucccagaucaacaa

SEQ ID NO: 148599 - RNA, 22 nt, Human
ucgccauguacaugaagggcgg

SEQ ID NO: 148600 - RNA, 22 nt, Human
ucgaugcuggcgcagguuucac

SEQ ID NO: 148601 - RNA, 22 nt, Human
ucgagcacaccagacuugcaga

SEQ ID NO: 148602 - RNA, 22 nt, Human
ucgagauguuuguuguggugau

SEQ ID NO: 148603 - RNA, 22 nt, Human
ucgaaugccaacaccgaaguuu

SEQ ID NO: 148604 - RNA, 22 nt, Human
ucgacuccauuuuucuugguuc

SEQ ID NO: 148605 - RNA, 22 nt, Human
uaggccugcugaagagcaagcu

SEQ ID NO: 148606 - RNA, 22 nt, Human
uaggcaguagcuuuggauguca

SEQ ID NO: 148607 - RNA, 22 nt, Human
ucgcuguguccuuuucacuuau

SEQ ID NO: 148608 - RNA, 22 nt, Human
uaggggguuuuucuagagauug

SEQ ID NO: 148609 - RNA, 22 nt, Human
ucggcuccucccuggaaagggg

SEQ ID NO: 148610 - RNA, 22 nt, Human
ucggauuggggaugggugggag

SEQ ID NO: 148611 - RNA, 22 nt, Human
ucggccggagggggcgggcgca

SEQ ID NO: 148612 - RNA, 23 nt, Human
ucgucgucagccacuaccucccc

SEQ ID NO: 148613 - RNA, 22 nt, Human
ucgggccacauccacacaucca

SEQ ID NO: 148614 - RNA, 22 nt, Human
ucgggggaaccggcccgggccu

SEQ ID NO: 148615 - RNA, 22 nt, Human
ucgggacccccgcccgggcccg

SEQ ID NO: 148616 - RNA, 22 nt, Human
uaggucuuggagguggggcugg

SEQ ID NO: 148617 - RNA, 22 nt, Human
uagucggcuaggagggccuucu

SEQ ID NO: 148618 - RNA, 22 nt, Human
ucguguuggaacugcuuuguaa

SEQ ID NO: 148619 - RNA, 19 nt, Human
uccuugacuguauucagag

SEQ ID NO: 148620 - RNA, 17 nt, Human
uagccagcuugugauuu

SEQ ID NO: 148621 - RNA, 22 nt, Human
uagcccgugaggaggggcugug

SEQ ID NO: 148622 - RNA, 22 nt, Human
uagccguugggguaacuggaca

SEQ ID NO: 148623 - RNA, 22 nt, Human
uccucuucucuagagccggaau

SEQ ID NO: 148624 - RNA, 23 nt, Human
uccugcagauaagcugguugaca

SEQ ID NO: 148625 - RNA, 21 nt, Human
uccugcagggcagcagagugg

SEQ ID NO: 148626 - RNA, 22 nt, Human
uagcaggaggcaguuccucgcu

SEQ ID NO: 148627 - RNA, 22 nt, Human
uccugcaugcuagugagugcuu

SEQ ID NO: 148628 - RNA, 22 nt, Human
uccuaccucaaaaggcaccagc

SEQ ID NO: 148629 - RNA, 22 nt, Human
uccuacccccuucuccagcucc

SEQ ID NO: 148630 - RNA, 22 nt, Human
uccucugagguccucucggcca

SEQ ID NO: 148631 - RNA, 22 nt, Human
uccucuccaggugagccgaaau

SEQ ID NO: 148632 - RNA, 18 nt, Human
uccggaggucagaguaaa

SEQ ID NO: 148633 - RNA, 22 nt, Human
uagaccugugggggcagcgggc

SEQ ID NO: 148634 - RNA, 22 nt, Human
uagaggaccacagggugcagag

SEQ ID NO: 148635 - RNA, 22 nt, Human
uagagcccucuggccacguugc

SEQ ID NO: 148636 - RNA, 22 nt, Human
ucccagucuagagccggauugg

SEQ ID NO: 148637 - RNA, 22 nt, Human
ucccagccugacagugcaucaa

SEQ ID NO: 148638 - RNA, 22 nt, Human
ucccagcaggcaccgcuucugc

SEQ ID NO: 148639 - RNA, 22 nt, Human
uagaggccagggugucuugagu

SEQ ID NO: 148640 - RNA, 22 nt, Human
gugauuucaaauauagagugag

SEQ ID NO: 148641 - RNA, 22 nt, Human
uagagcucaagaagcaaaagcu

SEQ ID NO: 148642 - RNA, 22 nt, Human
gugaugugugaaggucugcagg

SEQ ID NO: 148643 - RNA, 22 nt, Human
uagacuggaagcuccuugaggc

SEQ ID NO: 148644 - RNA, 17 nt, Human
gugagcugagucaggac

SEQ ID NO: 148645 - RNA, 19 nt, Human
uaccagguuggagaggccc

SEQ ID NO: 148646 - RNA, 22 nt, Human
gugaucagaagaaccugccgaa

SEQ ID NO: 148647 - RNA, 22 nt, Human
uagaaugggaggggaaucaucc

SEQ ID NO: 148648 - RNA, 19 nt, Human
gugcacugucacuuugcuc

SEQ ID NO: 148649 - RNA, 22 nt, Human
gugcagcugggcgcugaccuuc

SEQ ID NO: 148650 - RNA, 22 nt, Human
gugcagcugguggagucugggg

SEQ ID NO: 148651 - RNA, 22 nt, Human
uagaggccguagguggcugguu

SEQ ID NO: 148652 - RNA, 22 nt, Human
gugcacuugaucuagacagauu

SEQ ID NO: 148653 - RNA, 22 nt, Human
uagaucucugccuuguucagag

SEQ ID NO: 148654 - RNA, 22 nt, Human
uagcagcacuauuuguuguagu

SEQ ID NO: 148655 - RNA, 22 nt, Human
uagcaggagagaaguuuuaagu

SEQ ID NO: 148656 - RNA, 22 nt, Human
gugccuggugcaggauaaucac

SEQ ID NO: 148657 - RNA, 20 nt, Human
gugcggcucuaccacucggu

SEQ ID NO: 148658 - RNA, 22 nt, Human
gugaagcacaugggcguugggu

SEQ ID NO: 148659 - RNA, 22 nt, Human
gugaagcaagggucaccugugg

SEQ ID NO: 148660 - RNA, 22 nt, Human
uacugcaguuccugcugucucc

SEQ ID NO: 148661 - RNA, 22 nt, Human
uacugccauuauccugcugaaa

SEQ ID NO: 148662 - RNA, 22 nt, Human
uacaggaggaugugcagccagg

SEQ ID NO: 148663 - RNA, 23 nt, Human
uacagccaugucgcugauuuaac

SEQ ID NO: 148664 - RNA, 19 nt, Human
uacccggauagccagguag

SEQ ID NO: 148665 - RNA, 22 nt, Human
uaccaugggucaguuggguuug

SEQ ID NO: 148666 - RNA, 20 nt, Human
uaccaucauuggcaaaccuc

SEQ ID NO: 148667 - RNA, 22 nt, Human
gucugcccuuggccugggacuu

SEQ ID NO: 148668 - RNA, 22 nt, Human
gucugccagauucugcuggauc

SEQ ID NO: 148669 - RNA, 21 nt, Human
uacaagaccggauucgggccc

SEQ ID NO: 148670 - RNA, 22 nt, Human
gucugcagcacugugcacgguc

SEQ ID NO: 148671 - RNA, 22 nt, Human
gucuccugcccacccugguccc

SEQ ID NO: 148672 - RNA, 22 nt, Human
gucaggaugagggaugaggagu

SEQ ID NO: 148673 - RNA, 22 nt, Human
gucuaccuucuuucucaacugg

SEQ ID NO: 148674 - RNA, 22 nt, Human
guugcuggggcugaguccccag

SEQ ID NO: 148675 - RNA, 20 nt, Human
ggucagccaagaaguuaccu

SEQ ID NO: 148676 - RNA, 22 nt, Human
ggucauacaaggcacuggugau

SEQ ID NO: 148677 - RNA, 22 nt, Human
ggucaaucaugggucauugucu

SEQ ID NO: 148678 - RNA, 22 nt, Human
gguggcuugcugguaggugugc

SEQ ID NO: 148679 - RNA, 22 nt, Human
gguggccggcaccccacccucg

SEQ ID NO: 148680 - RNA, 22 nt, Human
gguggcagaggaggcgggagag

SEQ ID NO: 148681 - RNA, 22 nt, Human
gguugggauuauccaaggcaga

SEQ ID NO: 148682 - RNA, 21 nt, Human
gguuucugcaaaccuuguaca

SEQ ID NO: 148683 - RNA, 23 nt, Human
gguuggcuguacccaggcucccu

SEQ ID NO: 148684 - RNA, 22 nt, Human
gguucuggaaaagaaagcaaag

SEQ ID NO: 148685 - RNA, 22 nt, Human
gguugcggaccagcugggcugc

SEQ ID NO: 148686 - RNA, 22 nt, Human
gguugccuuugcaguuggauca

SEQ ID NO: 148687 - RNA, 22 nt, Human
uaaagaagaaaaggcuucaggc

SEQ ID NO: 148688 - RNA, 22 nt, Human
gucacaaaugauuuagcaauca

SEQ ID NO: 148689 - RNA, 22 nt, Human
gucaccgguuuuuagguaaaca

SEQ ID NO: 148690 - RNA, 22 nt, Human
gucagacucuggggccccaggc

SEQ ID NO: 148691 - RNA, 23 nt, Human
gucaccuccccuugccuucuccc

SEQ ID NO: 148692 - RNA, 22 nt, Human
gucacuuugcuugcgaugcucc

SEQ ID NO: 148693 - RNA, 22 nt, Human
guaugugguaccaugcaacggg

SEQ ID NO: 148694 - RNA, 22 nt, Human
guauccuccccgcuggccuuca

SEQ ID NO: 148695 - RNA, 23 nt, Human
uaagccugugccugcuaccugcu

SEQ ID NO: 148696 - RNA, 22 nt, Human
guagggguggggagguggucug

SEQ ID NO: 148697 - RNA, 22 nt, Human
guaggaguguucgggaacuggg

SEQ ID NO: 148698 - RNA, 22 nt, Human
guaggugggcuuccaagguccu

SEQ ID NO: 148699 - RNA, 22 nt, Human
uaacaacuuucugguguaacuu

SEQ ID NO: 148700 - RNA, 22 nt, Human
guagccacugaaguaaggccac

SEQ ID NO: 148701 - RNA, 22 nt, Human
uaaccaggaaaaagauaugcau

SEQ ID NO: 148702 - RNA, 22 nt, Human
guguugugauuggucagucacu

SEQ ID NO: 148703 - RNA, 22 nt, Human
guguugcaggaagauauagcug

SEQ ID NO: 148704 - RNA, 22 nt, Human
guguugaugugucuguauucua

SEQ ID NO: 148705 - RNA, 22 nt, Human
ggggacggcuggccggggcccc

SEQ ID NO: 148706 - RNA, 22 nt, Human
ggggacaagggugucaguaggc

SEQ ID NO: 148707 - RNA, 22 nt, Human
ggggaggaagcuggaacacggg

SEQ ID NO: 148708 - RNA, 22 nt, Human
ggggacuugguuuuaaugagcu

SEQ ID NO: 148709 - RNA, 22 nt, Human
ggggccaaggcaaacuugaggg

SEQ ID NO: 148710 - RNA, 22 nt, Human
ggggccaugauggacgagguga

SEQ ID NO: 148711 - RNA, 22 nt, Human
ggggccuuugaguugggucccu

SEQ ID NO: 148712 - RNA, 22 nt, Human
ggggccgggccggcagacuggg

SEQ ID NO: 148713 - RNA, 22 nt, Human
ggggcggggagcaugagcuggg

SEQ ID NO: 148714 - RNA, 17 nt, Human
ggggcguguauuugaug

SEQ ID NO: 148715 - RNA, 22 nt, Human
ggggugagaguguuuuaaagca

SEQ ID NO: 148716 - RNA, 22 nt, Human
gggucauugcgugacgcgagca

SEQ ID NO: 148717 - RNA, 22 nt, Human
guucaaggagcagcuugcuaca

SEQ ID NO: 148718 - RNA, 22 nt, Human
ggggucccucucugugucaguu

SEQ ID NO: 148719 - RNA, 22 nt, Human
gggguauuugguagacauuuug

SEQ ID NO: 148720 - RNA, 23 nt, Human
gggggagcuggacuccuagaucc

SEQ ID NO: 148721 - RNA, 22 nt, Human
gggggaggcucggcgccgcggu

SEQ ID NO: 148722 - RNA, 22 nt, Human
gggggcgccgccgcucaucuca

SEQ ID NO: 148723 - RNA, 22 nt, Human
gggggggcagguuggaugucag

SEQ ID NO: 148724 - RNA, 22 nt, Human
gggggcugugugcccgcucccc

SEQ ID NO: 148725 - RNA, 22 nt, Human
gggggcagguuccaggccagcu

SEQ ID NO: 148726 - RNA, 22 nt, Human
ggggcuggguuugcgcaggcuc

SEQ ID NO: 148727 - RNA, 22 nt, Human
ggggcguugccacggggacggg

SEQ ID NO: 148728 - RNA, 22 nt, Human
ggggcugggaggccggcgcgca

SEQ ID NO: 148729 - RNA, 21 nt, Human
ggggccucaucagaaauguua

SEQ ID NO: 148730 - RNA, 22 nt, Human
gggggagaauaugugaaggggg

SEQ ID NO: 148731 - RNA, 22 nt, Human
gggggacagugugccuggugug

SEQ ID NO: 148732 - RNA, 22 nt, Human
guucuucagauuccauuucagu

SEQ ID NO: 148733 - RNA, 22 nt, Human
gggugggguaggugacucucgc

SEQ ID NO: 148734 - RNA, 22 nt, Human
guucuguuguugaucuuuggag

SEQ ID NO: 148735 - RNA, 22 nt, Human
guucucuccugcuggugaugga

SEQ ID NO: 148736 - RNA, 22 nt, Human
ggguggggcaugcucucuucug

SEQ ID NO: 148737 - RNA, 22 nt, Human
guucaccaguagcugggcuguu

SEQ ID NO: 148738 - RNA, 22 nt, Human
gggugcucagugccaaggagug

SEQ ID NO: 148739 - RNA, 22 nt, Human
gggucucucuucuuucugugaa

SEQ ID NO: 148740 - RNA, 22 nt, Human
gggucggcacucuggcagcacc

SEQ ID NO: 148741 - RNA, 22 nt, Human
gguaccuggcccuggggcugcu

SEQ ID NO: 148742 - RNA, 22 nt, Human
guugauuuaggguuuugguuuu

SEQ ID NO: 148743 - RNA, 22 nt, Human
guugauuuaaccucaccuuuga

SEQ ID NO: 148744 - RNA, 21 nt, Human
gguagggaagguguuccucau

SEQ ID NO: 148745 - RNA, 22 nt, Human
guugcggaguguagcgaugcuu

SEQ ID NO: 148746 - RNA, 22 nt, Human
ggguucugggaggacuagggga

SEQ ID NO: 148747 - RNA, 22 nt, Human
gggugugcuaaaccuacgcaca

SEQ ID NO: 148748 - RNA, 22 nt, Human
ggguuuuggggaggaagugagc

SEQ ID NO: 148749 - RNA, 22 nt, Human
ggguuuugugauugccucugaa

SEQ ID NO: 148750 - RNA, 22 nt, Human
guucuucagcccucagguccua

SEQ ID NO: 148751 - RNA, 22 nt, Human
ggguuuguuccuacuucuacuc

SEQ ID NO: 148752 - RNA, 22 nt, Human
gggcuggcaguuuucugaguuc

SEQ ID NO: 148753 - RNA, 22 nt, Human
gggcugagagcuggaaucugag

SEQ ID NO: 148754 - RNA, 22 nt, Human
guguccuguagaaacuguucca

SEQ ID NO: 148755 - RNA, 22 nt, Human
gugucacuuucaggagcucuaa

SEQ ID NO: 148756 - RNA, 22 nt, Human
guguggcgacucagagcugccu

SEQ ID NO: 148757 - RNA, 22 nt, Human
gugugcacaaucuggcaugugc

SEQ ID NO: 148758 - RNA, 22 nt, Human
gggcuguggggccugcagaagg

SEQ ID NO: 148759 - RNA, 22 nt, Human
gggcuggggcucuggggcuagg

SEQ ID NO: 148760 - RNA, 22 nt, Human
gugugucucaguugcuccgaag

SEQ ID NO: 148761 - RNA, 22 nt, Human
gggcuuuuccaacacucuggag

SEQ ID NO: 148762 - RNA, 18 nt, Human
gggcuuuacagaguggag

SEQ ID NO: 148763 - RNA, 22 nt, Human
guguugaaaaguagcacugcuu

SEQ ID NO: 148764 - RNA, 22 nt, Human
guguucccauccacaccaagcc

SEQ ID NO: 148765 - RNA, 22 nt, Human
gggcggggcucacggugcggca

SEQ ID NO: 148766 - RNA, 22 nt, Human
gggcggggggagcuggaaugaa

SEQ ID NO: 148767 - RNA, 22 nt, Human
gggcggggcuuccguccuccac

SEQ ID NO: 148768 - RNA, 22 nt, Human
guggucaagaccgggaauagga

SEQ ID NO: 148769 - RNA, 22 nt, Human
guggugauuugggucuagcuuu

SEQ ID NO: 148770 - RNA, 22 nt, Human
gugguccugguugucugagaga

SEQ ID NO: 148771 - RNA, 22 nt, Human
gggcgcgccaggagcugcgcgg

SEQ ID NO: 148772 - RNA, 22 nt, Human
gugggugauacugccgugggag

SEQ ID NO: 148773 - RNA, 22 nt, Human
gggcgcgcggagccucgccggg

SEQ ID NO: 148774 - RNA, 22 nt, Human
gggcgcuguguuaggugcugua

SEQ ID NO: 148775 - RNA, 22 nt, Human
gggcgcuuucugggucagggcu

SEQ ID NO: 148776 - RNA, 22 nt, Human
gggcuacagaugggagggauga

SEQ ID NO: 148777 - RNA, 22 nt, Human
gggcggugccugucuccgaagc

SEQ ID NO: 148778 - RNA, 22 nt, Human
gggcggcguccucagucgggug

SEQ ID NO: 148779 - RNA, 22 nt, Human
gggcuacugagcuggaacuggg

SEQ ID NO: 148780 - RNA, 22 nt, Human
guggugggcgugguguaugccu

SEQ ID NO: 148781 - RNA, 22 nt, Human
gugguggugaggcaaggggugu

SEQ ID NO: 148782 - RNA, 22 nt, Human
gugguuugcugguguacguuua

SEQ ID NO: 148783 - RNA, 22 nt, Human
gugguuugacccuucagguaaa

SEQ ID NO: 148784 - RNA, 17 nt, Human
gugguguacauuuccau

SEQ ID NO: 148785 - RNA, 22 nt, Human
gugggugaguggggccgccuga

SEQ ID NO: 148786 - RNA, 22 nt, Human
gggccugcgcuggggggagccg

SEQ ID NO: 148787 - RNA, 22 nt, Human
gggccuguccccccaggagaac

SEQ ID NO: 148788 - RNA, 22 nt, Human
guggggguaggggguuuccugg

SEQ ID NO: 148789 - RNA, 22 nt, Human
gugggggcuaaauugaggggug

SEQ ID NO: 148790 - RNA, 22 nt, Human
gugggggugaggaauguucuau

SEQ ID NO: 148791 - RNA, 22 nt, Human
guggguccaaccugugugugug

SEQ ID NO: 148792 - RNA, 22 nt, Human
gugggggcagaagcgagugcag

SEQ ID NO: 148793 - RNA, 22 nt, Human
gugggagaaugggaggaguaau

SEQ ID NO: 148794 - RNA, 22 nt, Human
guggcagagagcaagugucuga

SEQ ID NO: 148795 - RNA, 22 nt, Human
guggcagagccuugcggcuuug

SEQ ID NO: 148796 - RNA, 22 nt, Human
guggcaaguuuucugacaagga

SEQ ID NO: 148797 - RNA, 22 nt, Human
guggcuugguauuaaggugcca

SEQ ID NO: 148798 - RNA, 22 nt, Human
guggcuggguggaacugagucu

SEQ ID NO: 148799 - RNA, 22 nt, Human
guggcuuauguccagcagauau

SEQ ID NO: 148800 - RNA, 22 nt, Human
guggcgucgaugauggugucau

SEQ ID NO: 148801 - RNA, 18 nt, Human
guggccauugaccagcuu

SEQ ID NO: 148802 - RNA, 22 nt, Human
guggagaaagcuggaaucugag

SEQ ID NO: 148803 - RNA, 22 nt, Human
gggcaugugauggacgugugcc

SEQ ID NO: 148804 - RNA, 22 nt, Human
gggccggcuggggcggggcggg

SEQ ID NO: 148805 - RNA, 19 nt, Human
gggccucacccacaccucc

SEQ ID NO: 148806 - RNA, 22 nt, Human
guggaggguuugcaaugugcag

SEQ ID NO: 148807 - RNA, 22 nt, Human
gggccaaggggagcuggaaggg

SEQ ID NO: 148808 - RNA, 20 nt, Human
gggccagguggaccaggggc

SEQ ID NO: 148809 - RNA, 22 nt, Human
gggccccgggcgcggcugcggg

SEQ ID NO: 148810 - RNA, 22 nt, Human
gggcccggguaggggaagagag

SEQ ID NO: 148811 - RNA, 22 nt, Human
guggaagggaaaccgcacuggc

SEQ ID NO: 148812 - RNA, 22 nt, Human
gggcaggggcagugguggcauu

SEQ ID NO: 148813 - RNA, 22 nt, Human
gggcaggcuggguggugguccc

SEQ ID NO: 148814 - RNA, 22 nt, Human
gggcaguuucaugugguucaac

SEQ ID NO: 148815 - RNA, 22 nt, Human
gggcagucagauucgggggccu

SEQ ID NO: 148816 - RNA, 22 nt, Human
guggaaggaauuaacagacuag

SEQ ID NO: 148817 - RNA, 22 nt, Human
guggaagauauuucugguccag

SEQ ID NO: 148818 - RNA, 22 nt, Human
ggccuugguggcuuugcugaug

SEQ ID NO: 148819 - RNA, 23 nt, Human
ggccuuuuuaaccgcgagcgaca

SEQ ID NO: 148820 - RNA, 22 nt, Human
gugcuuugcuaggaccgauugu

SEQ ID NO: 148821 - RNA, 22 nt, Human
gcccagcuuuuugaggcaggca

SEQ ID NO: 148822 - RNA, 22 nt, Human
gcuggucuggcaauccucaugg

SEQ ID NO: 148823 - RNA, 22 nt, Human
ggaagcucaauacuuuccucuu

SEQ ID NO: 148824 - RNA, 19 nt, Human
gcugggauaggauguauuu

SEQ ID NO: 148825 - RNA, 23 nt, Human
gcccagaggccccuggccugagc

SEQ ID NO: 148826 - RNA, 22 nt, Human
gcccagccucagggcaucagcu

SEQ ID NO: 148827 - RNA, 22 nt, Human
gcugggacacacagucuucuuu

SEQ ID NO: 148828 - RNA, 22 nt, Human
gcugggucucucccugguccug

SEQ ID NO: 148829 - RNA, 22 nt, Human
gcuggguuguucuccuggucca

SEQ ID NO: 148830 - RNA, 22 nt, Human
ggaaggugagugcugugugauu

SEQ ID NO: 148831 - RNA, 21 nt, Human
gccugcuguucacccugccac

SEQ ID NO: 148832 - RNA, 22 nt, Human
gccuggcagggagauuguaaga

SEQ ID NO: 148833 - RNA, 22 nt, Human
gccuggccaaucgccgucuagg

SEQ ID NO: 148834 - RNA, 22 nt, Human
gccuggaaugcaaugugacgaa

SEQ ID NO: 148835 - RNA, 22 nt, Human
gccugcuugaaagcacuuucug

SEQ ID NO: 148836 - RNA, 22 nt, Human
ggaccucagccaucccucggag

SEQ ID NO: 148837 - RNA, 22 nt, Human
ggacuccuguguuuuggcugag

SEQ ID NO: 148838 - RNA, 23 nt, Human
ggacuaggcaacagaugggacag

SEQ ID NO: 148839 - RNA, 21 nt, Human
ggacucguucgccgugccagc

SEQ ID NO: 148840 - RNA, 22 nt, Human
ggacucucaggcugucggcuuc

SEQ ID NO: 148841 - RNA, 22 nt, Human
gccuucccuccucugcucucag

SEQ ID NO: 148842 - RNA, 22 nt, Human
gccuugagcucaugucccagcu

SEQ ID NO: 148843 - RNA, 22 nt, Human
ggacagacagcauggaaccaua

SEQ ID NO: 148844 - RNA, 22 nt, Human
ggacccagggcuuauucauguu

SEQ ID NO: 148845 - RNA, 21 nt, Human
gcgcgcucgugcucgacgcgc

SEQ ID NO: 148846 - RNA, 22 nt, Human
gcgcgccugccucccgcggugc

SEQ ID NO: 148847 - RNA, 22 nt, Human
gcgcagugagguuaagaaugca

SEQ ID NO: 148848 - RNA, 20 nt, Human
gcgcaguuccgggcgcgucu

SEQ ID NO: 148849 - RNA, 22 nt, Human
ggagcaguggaggggccagggu

SEQ ID NO: 148850 - RNA, 22 nt, Human
ggagcagaggaaagaguagcau

SEQ ID NO: 148851 - RNA, 22 nt, Human
ggagaugucugugccacgucuc

SEQ ID NO: 148852 - RNA, 22 nt, Human
ggagaucugggcuguuucuggc

SEQ ID NO: 148853 - RNA, 22 nt, Human
ggagaucuuggacuggccggcc

SEQ ID NO: 148854 - RNA, 22 nt, Human
gcgggugagauucgagagaugg

SEQ ID NO: 148855 - RNA, 22 nt, Human
gcgguuggacguucgccucggg

SEQ ID NO: 148856 - RNA, 22 nt, Human
gcuacaaaaccagggcaaagga

SEQ ID NO: 148857 - RNA, 22 nt, Human
gcuaagcuuugagucuggacag

SEQ ID NO: 148858 - RNA, 22 nt, Human
gcggggcucuacuuggccugga

SEQ ID NO: 148859 - RNA, 22 nt, Human
ggcagagcugugcgcccaccca

SEQ ID NO: 148860 - RNA, 20 nt, Human
ggcagagcuaugucuguugc

SEQ ID NO: 148861 - RNA, 22 nt, Human
gcucagcuggagagggacgggu

SEQ ID NO: 148862 - RNA, 22 nt, Human
ggcagggagagcaugcugauaa

SEQ ID NO: 148863 - RNA, 22 nt, Human
gcuccacugccccugggcaccg

SEQ ID NO: 148864 - RNA, 22 nt, Human
gcucaugggcccagagcagccc

SEQ ID NO: 148865 - RNA, 22 nt, Human
gcucaacucaacgucauuugaa

SEQ ID NO: 148866 - RNA, 23 nt, Human
ggauccugacauauaccaucacc

SEQ ID NO: 148867 - RNA, 22 nt, Human
ggagcauggcuucuuggggcug

SEQ ID NO: 148868 - RNA, 22 nt, Human
ggagccaguuuagaccucaguu

SEQ ID NO: 148869 - RNA, 23 nt, Human
ggauggacauacguaugcacagg

SEQ ID NO: 148870 - RNA, 22 nt, Human
ggaugcugcuccacaucccaca

SEQ ID NO: 148871 - RNA, 22 nt, Human
ggaugauuuucaguuguguggg

SEQ ID NO: 148872 - RNA, 22 nt, Human
ggaugaguuguauauaggauuc

SEQ ID NO: 148873 - RNA, 22 nt, Human
gcggcgucccagcuccgacggc

SEQ ID NO: 148874 - RNA, 22 nt, Human
gcggcuggcuguccaaacuggg

SEQ ID NO: 148875 - RNA, 22 nt, Human
gcgggcgcuguggccccggccu

SEQ ID NO: 148876 - RNA, 19 nt, Human
gcgggcucuccaccccauc

SEQ ID NO: 148877 - RNA, 23 nt, Human
gcgggcggagccgggaggcgggg

SEQ ID NO: 148878 - RNA, 22 nt, Human
gcggcccggguccccagcagca

SEQ ID NO: 148879 - RNA, 22 nt, Human
gcggcggcggaggcgggggcag

SEQ ID NO: 148880 - RNA, 22 nt, Human
ggauuugaugagacuaucuacu

SEQ ID NO: 148881 - RNA, 22 nt, Human
ggaugggcuuggggaggucuag

SEQ ID NO: 148882 - RNA, 22 nt, Human
gcugcgcgcagccggcgccgag

SEQ ID NO: 148883 - RNA, 22 nt, Human
gcugcgccgggagccggggccg

SEQ ID NO: 148884 - RNA, 22 nt, Human
ggcgaugaggucuuagaaucua

SEQ ID NO: 148885 - RNA, 22 nt, Human
ggcgaggcgggccgcggggucu

SEQ ID NO: 148886 - RNA, 23 nt, Human
gcugccguuucccaucgugguga

SEQ ID NO: 148887 - RNA, 22 nt, Human
ggccuugggauguggcugcagc

SEQ ID NO: 148888 - RNA, 22 nt, Human
ggcgccugguauucuuccucuc

SEQ ID NO: 148889 - RNA, 22 nt, Human
ggcgccuuguggaaugagagcu

SEQ ID NO: 148890 - RNA, 22 nt, Human
ggcuagggaucuagaccaggac

SEQ ID NO: 148891 - RNA, 22 nt, Human
ggcuaaggacgggcaaguccca

SEQ ID NO: 148892 - RNA, 22 nt, Human
ggcuauuguuuuaaaaaaugag

SEQ ID NO: 148893 - RNA, 23 nt, Human
ggcgugcugggcugacccuuggc

SEQ ID NO: 148894 - RNA, 22 nt, Human
ggcgggucuagggcccuggagu

SEQ ID NO: 148895 - RNA, 22 nt, Human
ggcggugcgaggaugcagggcu

SEQ ID NO: 148896 - RNA, 22 nt, Human
ggcguccuccucgucugaggcg

SEQ ID NO: 148897 - RNA, 22 nt, Human
ggccucucuccuuggcuugcag

SEQ ID NO: 148898 - RNA, 20 nt, Human
ggccugagcauggcuggcag

SEQ ID NO: 148899 - RNA, 22 nt, Human
ggccccagggauuaggccaacc

SEQ ID NO: 148900 - RNA, 22 nt, Human
ggcccgcgcugcuggcgcgcca

SEQ ID NO: 148901 - RNA, 22 nt, Human
ggcccugcuuccccaguguaca

SEQ ID NO: 148902 - RNA, 22 nt, Human
ggccgccgcuuagcugagcccc

SEQ ID NO: 148903 - RNA, 22 nt, Human
gcugcagggagcuggaaggcuc

SEQ ID NO: 148904 - RNA, 22 nt, Human
gcugcaggaggugguagggucu

SEQ ID NO: 148905 - RNA, 22 nt, Human
gcugcccauugcucucccacuc

SEQ ID NO: 148906 - RNA, 22 nt, Human
gcugauucuucugcuuuuucuc

SEQ ID NO: 148907 - RNA, 22 nt, Human
gcucugcuccaucuguuuccuc

SEQ ID NO: 148908 - RNA, 22 nt, Human
gcugacuauaaggcugcucugu

SEQ ID NO: 148909 - RNA, 22 nt, Human
ggcuggaacuucuucuggcauu

SEQ ID NO: 148910 - RNA, 22 nt, Human
gcuggcgauggccgagucuccg

SEQ ID NO: 148911 - RNA, 21 nt, Human
gcuggcugucucuuacacggu

SEQ ID NO: 148912 - RNA, 22 nt, Human
gcugggagucgcgucuguggcc

SEQ ID NO: 148913 - RNA, 22 nt, Human
gcugggagaggcagcuuucgga

SEQ ID NO: 148914 - RNA, 22 nt, Human
ggcugcagggaacaggaugggu

SEQ ID NO: 148915 - RNA, 22 nt, Human
ggcugcagugcaacucuuucua

SEQ ID NO: 148916 - RNA, 22 nt, Human
ggcugcuggaguugggucucuc

SEQ ID NO: 148917 - RNA, 22 nt, Human
ggcugcugcccaccccugcaug

SEQ ID NO: 148918 - RNA, 22 nt, Human
ggcugcuauuggucuggcuugg

SEQ ID NO: 148919 - RNA, 22 nt, Human
ggcugcuugauagauaugagua

SEQ ID NO: 148920 - RNA, 22 nt, Human
ggcucuggcgagcuuuaguaca

SEQ ID NO: 148921 - RNA, 22 nt, Human
ggcugaugacgccugagucuga

SEQ ID NO: 148922 - RNA, 22 nt, Human
gcuggaugucugugccaggcac

SEQ ID NO: 148923 - RNA, 22 nt, Human
ggcucuccacuauggaugagaa

SEQ ID NO: 148924 - RNA, 22 nt, Human
gcuggauuuaggguucccuccu

SEQ ID NO: 148925 - RNA, 22 nt, Human
ggcucguaaaggccucacaggu

SEQ ID NO: 148926 - RNA, 22 nt, Human
ggcucccccauggcugacagac

SEQ ID NO: 148927 - RNA, 22 nt, Human
gcugcuggcuuccugcuguuuu

SEQ ID NO: 148928 - RNA, 22 nt, Human
gcuguccugggaacaggcacua

SEQ ID NO: 148929 - RNA, 22 nt, Human
gcugugacaagaggcugcuucu

SEQ ID NO: 148930 - RNA, 22 nt, Human
gcugucaggaacaugccuuggu

SEQ ID NO: 148931 - RNA, 22 nt, Human
ggcuuacgcgcuaacagugaau

SEQ ID NO: 148932 - RNA, 22 nt, Human
ggcugugggguccuguggugug

SEQ ID NO: 148933 - RNA, 22 nt, Human
ggcuucucuuggccaugguccc

SEQ ID NO: 148934 - RNA, 20 nt, Human
gcugugccaugacccucgag

SEQ ID NO: 148935 - RNA, 22 nt, Human
gcugggccucuuacuucuuacg

SEQ ID NO: 148936 - RNA, 22 nt, Human
gcuggguaguucuuguuuggga

SEQ ID NO: 148937 - RNA, 22 nt, Human
gcuggggaucgaaggcagagcc

SEQ ID NO: 148938 - RNA, 22 nt, Human
gcugguggcagagcuccgcggc

SEQ ID NO: 148939 - RNA, 22 nt, Human
ggcuggacuuucugcugggcuc

SEQ ID NO: 148940 - RNA, 22 nt, Human
gguagaggaugaggagguugga

SEQ ID NO: 148941 - RNA, 22 nt, Human
gguagggaaggucucccacauu

SEQ ID NO: 148942 - RNA, 22 nt, Human
ggguguuaugccucugagucag

SEQ ID NO: 148943 - RNA, 22 nt, Human
ggguguggaggugacacauuug

SEQ ID NO: 148944 - RNA, 22 nt, Human
ggucugcgauggcaagggucuu

SEQ ID NO: 148945 - RNA, 22 nt, Human
ggucugauaccugcagguuguc

SEQ ID NO: 148946 - RNA, 22 nt, Human
ggucuuccuugggggacuugaa

SEQ ID NO: 148947 - RNA, 22 nt, Human
ggugaaggaucccucuuggccu

SEQ ID NO: 148948 - RNA, 22 nt, Human
ggucuucauaugccacagaguc

SEQ ID NO: 148949 - RNA, 22 nt, Human
ggcaagcacugggugucuuagc

SEQ ID NO: 148950 - RNA, 22 nt, Human
ggucgaguuccuuguuuuuuau

SEQ ID NO: 148951 - RNA, 22 nt, Human
ggcaccuuucaucccaucuaga

SEQ ID NO: 148952 - RNA, 22 nt, Human
ggcaagauccagcacaaacaca

SEQ ID NO: 148953 - RNA, 22 nt, Human
ggcagcagaacuggcccuguau

SEQ ID NO: 148954 - RNA, 22 nt, Human
ggugcagucuggggcacauuau

SEQ ID NO: 148955 - RNA, 19 nt, Human
ggucugcggggugaccgug

SEQ ID NO: 148956 - RNA, 22 nt, Human
ggugacucacauuaggacuucg

SEQ ID NO: 148957 - RNA, 18 nt, Human
ggcagggcucagcugcuc

SEQ ID NO: 148958 - RNA, 22 nt, Human
ggcagggagagcgccgccaugc

SEQ ID NO: 148959 - RNA, 22 nt, Human
ggcagggacugggauauggaga

SEQ ID NO: 148960 - RNA, 22 nt, Human
ggcagggaauucagagggaagg

SEQ ID NO: 148961 - RNA, 22 nt, Human
gguggggacuuggggucagcgg

SEQ ID NO: 148962 - RNA, 22 nt, Human
gguggggugagggggcgaggcc

SEQ ID NO: 148963 - RNA, 22 nt, Human
gguggucaggagcgcccguugg

SEQ ID NO: 148964 - RNA, 22 nt, Human
gguguaaucacaagcuggaauu

SEQ ID NO: 148965 - RNA, 22 nt, Human
gguggguccuuugacagagaug

SEQ ID NO: 148966 - RNA, 22 nt, Human
ggcagguggcacugcugcuccc

SEQ ID NO: 148967 - RNA, 22 nt, Human
ggcagucaucacuuauucauca

SEQ ID NO: 148968 - RNA, 22 nt, Human
ggcagugguaggagcccaggag

SEQ ID NO: 148969 - RNA, 22 nt, Human
ggcagucuuucccuugagcucu

SEQ ID NO: 148970 - RNA, 22 nt, Human
gguggcuucuguuugcaagagg

SEQ ID NO: 148971 - RNA, 22 nt, Human
ggccugcuaccagcugugaccu

SEQ ID NO: 148972 - RNA, 22 nt, Human
ggccugcucuggcuguggucag

SEQ ID NO: 148973 - RNA, 22 nt, Human
ggccuggcacauaguaggcagu

SEQ ID NO: 148974 - RNA, 22 nt, Human
ggccuggccuccugcuuuucca

SEQ ID NO: 148975 - RNA, 22 nt, Human
ggccugagaagcaaggacacaa

SEQ ID NO: 148976 - RNA, 22 nt, Human
ggccgggugggaggcagcggag

SEQ ID NO: 148977 - RNA, 18 nt, Human
ggccucagccuggccgga

SEQ ID NO: 148978 - RNA, 22 nt, Human
ggccgccacuuuccagugcugc

SEQ ID NO: 148979 - RNA, 22 nt, Human
ggccgggcaugcgagcugagcg

SEQ ID NO: 148980 - RNA, 22 nt, Human
ggccgcuuucuggggagugagg

SEQ ID NO: 148981 - RNA, 22 nt, Human
guagguggaggcaacacagcca

SEQ ID NO: 148982 - RNA, 22 nt, Human
guacuacagguuugguaguggg

SEQ ID NO: 148983 - RNA, 22 nt, Human
ggcccuggggcaggagcagagg

SEQ ID NO: 148984 - RNA, 22 nt, Human
ggccgccacacagauucccccg

SEQ ID NO: 148985 - RNA, 22 nt, Human
gguugccuguggcucccuguua

SEQ ID NO: 148986 - RNA, 22 nt, Human
ggccagcgugggggaguagcgg

SEQ ID NO: 148987 - RNA, 22 nt, Human
ggugucaucugggcuggagaua

SEQ ID NO: 148988 - RNA, 21 nt, Human
ggccagauucucccauagcug

SEQ ID NO: 148989 - RNA, 22 nt, Human
ggugucagccacuuugucggag

SEQ ID NO: 148990 - RNA, 22 nt, Human
gcuguggguuccuccccugucc

SEQ ID NO: 148991 - RNA, 22 nt, Human
gggaggcagacgcuggagccca

SEQ ID NO: 148992 - RNA, 22 nt, Human
gggagcuggagcuggaagacuc

SEQ ID NO: 148993 - RNA, 22 nt, Human
gcuguggagaagcugccuaugg

SEQ ID NO: 148994 - RNA, 22 nt, Human
gcuguggcuccaauggugagcc

SEQ ID NO: 148995 - RNA, 22 nt, Human
gcuguggacacagcucucuuca

SEQ ID NO: 148996 - RNA, 22 nt, Human
gcuuuguucauuuaguuuuuuu

SEQ ID NO: 148997 - RNA, 22 nt, Human
ggaaaaugcugaagcaucugaa

SEQ ID NO: 148998 - RNA, 22 nt, Human
gggcagaaaggaaggcuggggg

SEQ ID NO: 148999 - RNA, 22 nt, Human
gggcaagaagcuggaagcauuc

SEQ ID NO: 149000 - RNA, 21 nt, Human
gggagugaguaaugauggggg

SEQ ID NO: 149001 - RNA, 22 nt, Human
gggaguggagagugaagcuaau

SEQ ID NO: 149002 - RNA, 22 nt, Human
gggauggggagcuggaaagggg

SEQ ID NO: 149003 - RNA, 19 nt, Human
gggauuccuggcuuuagaa

SEQ ID NO: 149004 - RNA, 22 nt, Human
gggcgagcgucucagccgggcg

SEQ ID NO: 149005 - RNA, 22 nt, Human
gggcgccgggagugagagugag

SEQ ID NO: 149006 - RNA, 22 nt, Human
gggcgcaagcaugugucugggu

SEQ ID NO: 149007 - RNA, 22 nt, Human
gggccuuggaggagaaggacuu

SEQ ID NO: 149008 - RNA, 18 nt, Human
ggaaggugcuggagugca

SEQ ID NO: 149009 - RNA, 22 nt, Human
ggaagcuguugugagugcagca

SEQ ID NO: 149010 - RNA, 17 nt, Human
ggaagaaaaggaucauc

SEQ ID NO: 149011 - RNA, 19 nt, Human
ggaacgcugggcuccccuc

SEQ ID NO: 149012 - RNA, 22 nt, Human
gggccaggaugugguucauuuu

SEQ ID NO: 149013 - RNA, 22 nt, Human
gggcaugcagcaauucuguggu

SEQ ID NO: 149014 - RNA, 21 nt, Human
gggagugucuguugcaaggug

SEQ ID NO: 149015 - RNA, 22 nt, Human
ggaaguggauucagggcugcua

SEQ ID NO: 149016 - RNA, 22 nt, Human
gggcggccugcucuguggggag

SEQ ID NO: 149017 - RNA, 22 nt, Human
ggacagacuuuacagccccggg

SEQ ID NO: 149018 - RNA, 22 nt, Human
ggacagggagcaaaaacguccc

SEQ ID NO: 149019 - RNA, 22 nt, Human
gggcucaaccauagcacaaaga

SEQ ID NO: 149020 - RNA, 22 nt, Human
gggcuagggucagggggccacu

SEQ ID NO: 149021 - RNA, 20 nt, Human
gggcucugcauccaucagcc

SEQ ID NO: 149022 - RNA, 22 nt, Human
ggguggugauacugcuucugcc

SEQ ID NO: 149023 - RNA, 20 nt, Human
gggucuggcaucucucucug

SEQ ID NO: 149024 - RNA, 22 nt, Human
gggucagggaggccccaccaug

SEQ ID NO: 149025 - RNA, 22 nt, Human
gggucuggagauccgggugaag

SEQ ID NO: 149026 - RNA, 22 nt, Human
ggagggagugcaggcaggcaga

SEQ ID NO: 149027 - RNA, 22 nt, Human
ggguacaccaauggaugccagg

SEQ ID NO: 149028 - RNA, 22 nt, Human
ggagggaggggugggagaugga

SEQ ID NO: 149029 - RNA, 22 nt, Human
gggguguuuugaagagguucag

SEQ ID NO: 149030 - RNA, 22 nt, Human
ggggugugcugggagaagggau

SEQ ID NO: 149031 - RNA, 22 nt, Human
gggugguggagguuugacagac

SEQ ID NO: 149032 - RNA, 22 nt, Human
gggugucugcugaauuucccuu

SEQ ID NO: 149033 - RNA, 22 nt, Human
ggaguguuaggaaguuguguuu

SEQ ID NO: 149034 - RNA, 22 nt, Human
ggaguucaaaucuuuuggaucu

SEQ ID NO: 149035 - RNA, 22 nt, Human
ggggcucauuugcaggggggag

SEQ ID NO: 149036 - RNA, 22 nt, Human
ggaggaagagaccagggggcuu

SEQ ID NO: 149037 - RNA, 22 nt, Human
ggggugaggcagggcagggguc

SEQ ID NO: 149038 - RNA, 22 nt, Human
gggguguuagucuuacccagag

SEQ ID NO: 149039 - RNA, 22 nt, Human
ggggugggcuggguguccaagg

SEQ ID NO: 149040 - RNA, 22 nt, Human
ggggucugaucccuucuggcuu

SEQ ID NO: 149041 - RNA, 22 nt, Human
gggguacgaugguggggggcga

SEQ ID NO: 149042 - RNA, 22 nt, Human
ggggcgaguguggaccgcagcc

SEQ ID NO: 149043 - RNA, 22 nt, Human
ggggcggcgugggcgcggugau

SEQ ID NO: 149044 - RNA, 21 nt, Human
ggggcccccacacaugccucc

SEQ ID NO: 149045 - RNA, 22 nt, Human
gggcugcuccgcccgcugcgcc

SEQ ID NO: 149046 - RNA, 22 nt, Human
ggacauggccguaguccccacg

SEQ ID NO: 149047 - RNA, 22 nt, Human
gggcugaugcuuauacauacug

SEQ ID NO: 149048 - RNA, 22 nt, Human
ggggaggugugcaggacaccuc

SEQ ID NO: 149049 - RNA, 22 nt, Human
ggggaauuaaaugagaagccuu

SEQ ID NO: 149050 - RNA, 22 nt, Human
ggagaccaauuaaugaaggaau

SEQ ID NO: 149051 - RNA, 22 nt, Human
ggagagcguggaugggcuucca

SEQ ID NO: 149052 - RNA, 22 nt, Human
ggggcaucguugauugcauggu

SEQ ID NO: 149053 - RNA, 22 nt, Human
ggagagcuagugagcuggaggu

SEQ ID NO: 149054 - RNA, 22 nt, Human
gcggcaguccuuccaguacagg

SEQ ID NO: 149055 - RNA, 22 nt, Human
gcagcgcugagaugauuuguug

SEQ ID NO: 149056 - RNA, 22 nt, Human
gcggccucuuugcugccucagg

SEQ ID NO: 149057 - RNA, 22 nt, Human
gcagccugaguuuagcucgucg

SEQ ID NO: 149058 - RNA, 22 nt, Human
gcagccauggcuggccgggcau

SEQ ID NO: 149059 - RNA, 22 nt, Human
gcagcccucuuggucacuaggc

SEQ ID NO: 149060 - RNA, 22 nt, Human
gcgauugguuuggggccagagu

SEQ ID NO: 149061 - RNA, 22 nt, Human
gcggagcuaaagauuggcuccu

SEQ ID NO: 149062 - RNA, 22 nt, Human
gccuuggacuaccacucccaca

SEQ ID NO: 149063 - RNA, 22 nt, Human
gcagccaauggcgagccccaca

SEQ ID NO: 149064 - RNA, 22 nt, Human
gcagccagggaccuuugacuau

SEQ ID NO: 149065 - RNA, 22 nt, Human
gcaggacuucuguuuaaccagu

SEQ ID NO: 149066 - RNA, 22 nt, Human
gcaggaaugguacauaccuguu

SEQ ID NO: 149067 - RNA, 22 nt, Human
gcgguuguucugugugcaugga

SEQ ID NO: 149068 - RNA, 22 nt, Human
gcggggggcucgggcagcucgg

SEQ ID NO: 149069 - RNA, 22 nt, Human
gcggguggaggagggacgggca

SEQ ID NO: 149070 - RNA, 22 nt, Human
gcgguguuuuaacacucccucg

SEQ ID NO: 149071 - RNA, 22 nt, Human
gcgguggcuacuaaaguucgaa

SEQ ID NO: 149072 - RNA, 22 nt, Human
gcggucuaggaccucagugugu

SEQ ID NO: 149073 - RNA, 22 nt, Human
gcagcguuaacauuuuuccugu

SEQ ID NO: 149074 - RNA, 22 nt, Human
gcagcucagcacgcacagguaa

SEQ ID NO: 149075 - RNA, 22 nt, Human
gcgggccggcaggggaggaguu

SEQ ID NO: 149076 - RNA, 19 nt, Human
gcggcggugccggcuggga

SEQ ID NO: 149077 - RNA, 22 nt, Human
gcgugcauguguguaugcgugu

SEQ ID NO: 149078 - RNA, 22 nt, Human
gcgucucugggcugacccaggu

SEQ ID NO: 149079 - RNA, 22 nt, Human
gcaggggguaaggggcagggcu

SEQ ID NO: 149080 - RNA, 21 nt, Human
gcaggggugugugagcugggg

SEQ ID NO: 149081 - RNA, 22 nt, Human
gcgugugugauaugccucugca

SEQ ID NO: 149082 - RNA, 22 nt, Human
gcuacaacugugucuguggggc

SEQ ID NO: 149083 - RNA, 21 nt, Human
gcucccgaagugcucggcguu

SEQ ID NO: 149084 - RNA, 19 nt, Human
gcuccugcagcuagagugc

SEQ ID NO: 149085 - RNA, 22 nt, Human
gcucaacuucuaggacuucagg

SEQ ID NO: 149086 - RNA, 22 nt, Human
gcuaguucugccuccccuagug

SEQ ID NO: 149087 - RNA, 22 nt, Human
gcaucuguuagagugugcaugc

SEQ ID NO: 149088 - RNA, 22 nt, Human
gcucgauugucaguguuaggga

SEQ ID NO: 149089 - RNA, 23 nt, Human
gcucuccaucacaugguguggca

SEQ ID NO: 149090 - RNA, 22 nt, Human
gcucaagaccaagggagcgggg

SEQ ID NO: 149091 - RNA, 22 nt, Human
gcuauuuagaaaggcuuggaga

SEQ ID NO: 149092 - RNA, 22 nt, Human
gcaguugugguuucguuuccuu

SEQ ID NO: 149093 - RNA, 22 nt, Human
gcaguuugugauguggcaguca

SEQ ID NO: 149094 - RNA, 18 nt, Human
gccagcccuccaaccucc

SEQ ID NO: 149095 - RNA, 22 nt, Human
gccagccggugaguggaagcgg

SEQ ID NO: 149096 - RNA, 22 nt, Human
gcugccuugaacuuggccuggg

SEQ ID NO: 149097 - RNA, 22 nt, Human
gcugccgcugcggggcgcgggc

SEQ ID NO: 149098 - RNA, 22 nt, Human
gcugcccucccagggcaagcuu

SEQ ID NO: 149099 - RNA, 23 nt, Human
gcugcagugaauguuguuguugu

SEQ ID NO: 149100 - RNA, 19 nt, Human
gccacguuggcuaguugcc

SEQ ID NO: 149101 - RNA, 20 nt, Human
gccaaggaggagaaacaggc

SEQ ID NO: 149102 - RNA, 22 nt, Human
gcugagcaaugcacugccgcau

SEQ ID NO: 149103 - RNA, 22 nt, Human
gcucuggcuacuguggcuaccg

SEQ ID NO: 149104 - RNA, 22 nt, Human
gcucuggcugccuuaguuuugu

SEQ ID NO: 149105 - RNA, 22 nt, Human
gcucucuggccugggaggagga

SEQ ID NO: 149106 - RNA, 22 nt, Human
gcugcacgguccuggcaccacg

SEQ ID NO: 149107 - RNA, 22 nt, Human
gcugagcagcgaaggcacaugc

SEQ ID NO: 149108 - RNA, 23 nt, Human
gcugagcaccagccauaucuuuu

SEQ ID NO: 149109 - RNA, 22 nt, Human
gcugagcagaacaauuagaaau

SEQ ID NO: 149110 - RNA, 22 nt, Human
gccagucgucuuuauuacagcu

SEQ ID NO: 149111 - RNA, 22 nt, Human
gccaggugauuucaaaguccuu

SEQ ID NO: 149112 - RNA, 22 nt, Human
gcuggaaauaacuuguguagaa

SEQ ID NO: 149113 - RNA, 22 nt, Human
gccagggcucgagcaggccagc

SEQ ID NO: 149114 - RNA, 22 nt, Human
gcugcuucgcugcacacccgag

SEQ ID NO: 149115 - RNA, 22 nt, Human
gcugcgcugggacgccaccaac

SEQ ID NO: 149116 - RNA, 22 nt, Human
gccaggcggcccaggagauggc

SEQ ID NO: 149117 - RNA, 22 nt, Human
gccaggccuggguggagcgcuc

SEQ ID NO: 149118 - RNA, 22 nt, Human
gccaggcagcagcgaggauggu

SEQ ID NO: 149119 - RNA, 22 nt, Human
gcugcuggcggagcuggcgcug

SEQ ID NO: 149120 - RNA, 22 nt, Human
gcugcuacagagcuggaggggg

SEQ ID NO: 149121 - RNA, 22 nt, Human
gcugcucaaaaaaacacuagcu

SEQ ID NO: 149122 - RNA, 22 nt, Human
gccaucugcuuagauugcuggg

SEQ ID NO: 149123 - RNA, 22 nt, Human
gccaguggucagugggagggug

SEQ ID NO: 149124 - RNA, 22 nt, Human
gcuggaagggccagcuuucagg

SEQ ID NO: 149125 - RNA, 22 nt, Human
gcuggccugcgagggcaggcug

SEQ ID NO: 149126 - RNA, 22 nt, Human
gcuggauaaggaucaguuucuu

SEQ ID NO: 149127 - RNA, 20 nt, Human
gcccacccgcacucccgccg

SEQ ID NO: 149128 - RNA, 22 nt, Human
gcccagacaucuguugggaccu

SEQ ID NO: 149129 - RNA, 22 nt, Human
gccauggugagccaccuggugg

SEQ ID NO: 149130 - RNA, 22 nt, Human
gcuggcggguuggggaggcgga

SEQ ID NO: 149131 - RNA, 22 nt, Human
gccaugguggggccucccugac

SEQ ID NO: 149132 - RNA, 22 nt, Human
gccauguucuugaaucuggguc

SEQ ID NO: 149133 - RNA, 22 nt, Human
gccggagagccaacaccacgga

SEQ ID NO: 149134 - RNA, 22 nt, Human
gccgcguggcagucuuggugac

SEQ ID NO: 149135 - RNA, 22 nt, Human
gccgggagaggcggcgcagggg

SEQ ID NO: 149136 - RNA, 20 nt, Human
gccggggcauaggggccguc

SEQ ID NO: 149137 - RNA, 22 nt, Human
gauuccuuucgccugccgagcu

SEQ ID NO: 149138 - RNA, 22 nt, Human
gccgccgccgccuuuguugcgg

SEQ ID NO: 149139 - RNA, 15 nt, Human
gccgcgcuggggagc

SEQ ID NO: 149140 - RNA, 18 nt, Human
gccgccuugcucgugaac

SEQ ID NO: 149141 - RNA, 22 nt, Human
gauguaucugagcugcuuaggu

SEQ ID NO: 149142 - RNA, 22 nt, Human
gcccuagaguugagagcaccca

SEQ ID NO: 149143 - RNA, 22 nt, Human
gcccucugccacaggacgccag

SEQ ID NO: 149144 - RNA, 22 nt, Human
gcccugaaggccuccaggacuc

SEQ ID NO: 149145 - RNA, 22 nt, Human
gccugcaaagacuuccuucucu

SEQ ID NO: 149146 - RNA, 22 nt, Human
gcacagcuaugagcugaauugu

SEQ ID NO: 149147 - RNA, 22 nt, Human
gccugggcuuccgggacccggg

SEQ ID NO: 149148 - RNA, 20 nt, Human
gccugggagaagaucaggga

SEQ ID NO: 149149 - RNA, 22 nt, Human
gccugggugcugugggguggag

SEQ ID NO: 149150 - RNA, 22 nt, Human
gcaacguauauggguaaggaua

SEQ ID NO: 149151 - RNA, 22 nt, Human
gccuccagaggggacaaaaauu

SEQ ID NO: 149152 - RNA, 22 nt, Human
gccuccgccuuccugucucccc

SEQ ID NO: 149153 - RNA, 22 nt, Human
gccuccggagucgcagugucuu

SEQ ID NO: 149154 - RNA, 21 nt, Human
gauuuuagggcagccaaacac

SEQ ID NO: 149155 - RNA, 22 nt, Human
gccuagaagaaugagcgcaggg

SEQ ID NO: 149156 - RNA, 22 nt, Human
gccuagggacuuugguuuagau

SEQ ID NO: 149157 - RNA, 22 nt, Human
gagguuggagggcugcccugca

SEQ ID NO: 149158 - RNA, 22 nt, Human
gcaggccgauuuguuagaaguc

SEQ ID NO: 149159 - RNA, 22 nt, Human
gaggugggaggcgggccugcau

SEQ ID NO: 149160 - RNA, 22 nt, Human
gauaagugauucugauucacau

SEQ ID NO: 149161 - RNA, 22 nt, Human
gcaugcuguuuggaaacgauaa

SEQ ID NO: 149162 - RNA, 22 nt, Human
gauacaugucacaaguugugca

SEQ ID NO: 149163 - RNA, 22 nt, Human
gcccgccaacuugccagcggug

SEQ ID NO: 149164 - RNA, 22 nt, Human
gauggacgguuuuaccagacag

SEQ ID NO: 149165 - RNA, 22 nt, Human
gaugaaguaguccacuggaagg

SEQ ID NO: 149166 - RNA, 18 nt, Human
gaugaagaggaagaggag

SEQ ID NO: 149167 - RNA, 22 nt, Human
gaggggcgaggacgcugaagua

SEQ ID NO: 149168 - RNA, 22 nt, Human
gcagauccaaauauaguucuug

SEQ ID NO: 149169 - RNA, 22 nt, Human
gcagcaaucuucacagugucau

SEQ ID NO: 149170 - RNA, 20 nt, Human
gcagcagacagacaggggac

SEQ ID NO: 149171 - RNA, 22 nt, Human
gagggggcggccccugugggca

SEQ ID NO: 149172 - RNA, 21 nt, Human
gcagcaugagaaagccccaaa

SEQ ID NO: 149173 - RNA, 22 nt, Human
gaggggcucuugggcaugaagg

SEQ ID NO: 149174 - RNA, 22 nt, Human
gaggguggagccuccuggaagu

SEQ ID NO: 149175 - RNA, 22 nt, Human
gaggguggggaauagacugcua

SEQ ID NO: 149176 - RNA, 22 nt, Human
gcagaaguauuguacgguggga

SEQ ID NO: 149177 - RNA, 22 nt, Human
gagggcucaacuacuacuaggc

SEQ ID NO: 149178 - RNA, 22 nt, Human
gagggauuuuagugcagcaacu

SEQ ID NO: 149179 - RNA, 22 nt, Human
gcagaggcaaagucuggaugac

SEQ ID NO: 149180 - RNA, 22 nt, Human
gcagagcacccugcagugguau

SEQ ID NO: 149181 - RNA, 22 nt, Human
gcagagcugucuaagucacuuc

SEQ ID NO: 149182 - RNA, 22 nt, Human
gcagacuaacuuuugucagccu

SEQ ID NO: 149183 - RNA, 22 nt, Human
gcagaguauaaguguggagcug

SEQ ID NO: 149184 - RNA, 22 nt, Human
gaggggacugucuggcuccgag

SEQ ID NO: 149185 - RNA, 22 nt, Human
gaggggcacaguggggccuggg

SEQ ID NO: 149186 - RNA, 22 nt, Human
gcagccauuugcaucuaauuaa

SEQ ID NO: 149187 - RNA, 22 nt, Human
gaggucaugcagcucugaguuc

SEQ ID NO: 149188 - RNA, 22 nt, Human
gaggucggaagugaggguaacu

SEQ ID NO: 149189 - RNA, 22 nt, Human
gaggaggcuggagaggccagga

SEQ ID NO: 149190 - RNA, 22 nt, Human
gagguagcgugcagggcccgaa

SEQ ID NO: 149191 - RNA, 22 nt, Human
gaggucagcaagccaugcuugu

SEQ ID NO: 149192 - RNA, 22 nt, Human
gaggguuucagugggacggguu

SEQ ID NO: 149193 - RNA, 22 nt, Human
gcaggagggggccuggagccca

SEQ ID NO: 149194 - RNA, 22 nt, Human
gcaggcagauccagaagcacua

SEQ ID NO: 149195 - RNA, 22 nt, Human
gcaggacugauggagcauaugu

SEQ ID NO: 149196 - RNA, 22 nt, Human
gcagccuccggccuggcccccu

SEQ ID NO: 149197 - RNA, 22 nt, Human
gcagcguguggcuaauggcucu

SEQ ID NO: 149198 - RNA, 22 nt, Human
gcagccucugcaguucaggagg

SEQ ID NO: 149199 - RNA, 22 nt, Human
gcacggucagggugggggagug

SEQ ID NO: 149200 - RNA, 22 nt, Human
gcacccagggcaggaagugagg

SEQ ID NO: 149201 - RNA, 22 nt, Human
gcaccgagaaggaagcaugccu

SEQ ID NO: 149202 - RNA, 22 nt, Human
gaggccauguggcccgggcugc

SEQ ID NO: 149203 - RNA, 22 nt, Human
gaggccagcacccagaugcaug

SEQ ID NO: 149204 - RNA, 22 nt, Human
gcaccacccaaaggcggggcuc

SEQ ID NO: 149205 - RNA, 22 nt, Human
gaggaucuuuagcgggacugcu

SEQ ID NO: 149206 - RNA, 22 nt, Human
gaggcagaggaaacagcucauu

SEQ ID NO: 149207 - RNA, 22 nt, Human
gaggcggugguggcgagaguca

SEQ ID NO: 149208 - RNA, 22 nt, Human
gaggcgcgcugcgagggcgcgg

SEQ ID NO: 149209 - RNA, 22 nt, Human
gcacucuguggagacaagauag

SEQ ID NO: 149210 - RNA, 22 nt, Human
gcacugagacuuuagauuggag

SEQ ID NO: 149211 - RNA, 23 nt, Human
gcacuccgagggcacgugucucu

SEQ ID NO: 149212 - RNA, 22 nt, Human
gagggagagaugcuggaccggg

SEQ ID NO: 149213 - RNA, 22 nt, Human
gaggcuugccacuguccauggc

SEQ ID NO: 149214 - RNA, 22 nt, Human
gaggcuccgccggggcgggccg

SEQ ID NO: 149215 - RNA, 23 nt, Human
gcacuguuugaggagcacugugc

SEQ ID NO: 149216 - RNA, 21 nt, Human
gcagaacuaggacuugaacau

SEQ ID NO: 149217 - RNA, 19 nt, Human
gcacacccugcaccaccau

SEQ ID NO: 149218 - RNA, 22 nt, Human
gaggagacaguggagccgcuac

SEQ ID NO: 149219 - RNA, 22 nt, Human
gcacacaaaaauauguguugaa

SEQ ID NO: 149220 - RNA, 22 nt, Human
gcacagauaaucugccuuacca

SEQ ID NO: 149221 - RNA, 22 nt, Human
gaggaggucaccuggugagcaa

SEQ ID NO: 149222 - RNA, 22 nt, Human
gcacacuguaugcugguauuug

SEQ ID NO: 149223 - RNA, 22 nt, Human
gaggagcggugcaugugggggc

SEQ ID NO: 149224 - RNA, 22 nt, Human
gaggagcugggucagggagaca

SEQ ID NO: 149225 - RNA, 22 nt, Human
gaggagcuucagaggaaucuua

SEQ ID NO: 149226 - RNA, 22 nt, Human
gaggaggagaagcggcggcgga

SEQ ID NO: 149227 - RNA, 22 nt, Human
gcaaggacagaagcccacacag

SEQ ID NO: 149228 - RNA, 22 nt, Human
gcaaggaagcagaguugcuauc

SEQ ID NO: 149229 - RNA, 22 nt, Human
gaggacugguugggaaugugaa

SEQ ID NO: 149230 - RNA, 22 nt, Human
gcaauuggaaugaauucuauuu

SEQ ID NO: 149231 - RNA, 22 nt, Human
gagcaggucucaguucugccuc

SEQ ID NO: 149232 - RNA, 19 nt, Human
gagcaugacuggccuugca

SEQ ID NO: 149233 - RNA, 22 nt, Human
gagcaugacgcaacaccaagug

SEQ ID NO: 149234 - RNA, 22 nt, Human
gauguuggugcauucacuucug

SEQ ID NO: 149235 - RNA, 22 nt, Human
gagcagcugagcuggaaugaga

SEQ ID NO: 149236 - RNA, 22 nt, Human
gagcagguuauuagaaauggaa

SEQ ID NO: 149237 - RNA, 22 nt, Human
gagcaggucuuugguaaugcuu

SEQ ID NO: 149238 - RNA, 22 nt, Human
gagccauggaggaugugcagca

SEQ ID NO: 149239 - RNA, 22 nt, Human
gagccgcagcugcguagggucc

SEQ ID NO: 149240 - RNA, 22 nt, Human
gauucugaaauuaacagacugg

SEQ ID NO: 149241 - RNA, 22 nt, Human
gagcccuguagcaagucauguc

SEQ ID NO: 149242 - RNA, 22 nt, Human
gauuccugcuauucacagggcu

SEQ ID NO: 149243 - RNA, 22 nt, Human
gauugcugccagcguguccgug

SEQ ID NO: 149244 - RNA, 22 nt, Human
gauuggucacacaauaguauau

SEQ ID NO: 149245 - RNA, 22 nt, Human
gauugggagugugacauuguau

SEQ ID NO: 149246 - RNA, 22 nt, Human
gagcgacucuuuuaguccagag

SEQ ID NO: 149247 - RNA, 22 nt, Human
gagcgcgcaaucucuccagcug

SEQ ID NO: 149248 - RNA, 19 nt, Human
gagccgcucccgcagccgg

SEQ ID NO: 149249 - RNA, 22 nt, Human
gagccuggagcuggaacgaagc

SEQ ID NO: 149250 - RNA, 22 nt, Human
gagccggggcucccugaggucc

SEQ ID NO: 149251 - RNA, 22 nt, Human
gauuuugaaccuuauuuggaaa

SEQ ID NO: 149252 - RNA, 22 nt, Human
gcaaaaacaguguagucuucug

SEQ ID NO: 149253 - RNA, 21 nt, Human
gcaaccagaccacagggcagu

SEQ ID NO: 149254 - RNA, 22 nt, Human
gagcuggacauacaggaaacca

SEQ ID NO: 149255 - RNA, 22 nt, Human
gagcucucgggcuggggcguug

SEQ ID NO: 149256 - RNA, 22 nt, Human
gagcuaagcccuggagaggucg

SEQ ID NO: 149257 - RNA, 22 nt, Human
gagcuggagaaacacauaagaa

SEQ ID NO: 149258 - RNA, 22 nt, Human
gagauccccagugugucucggc

SEQ ID NO: 149259 - RNA, 22 nt, Human
gagagugggagauuuccagcag

SEQ ID NO: 149260 - RNA, 22 nt, Human
gauggguugaguucauggagcc

SEQ ID NO: 149261 - RNA, 22 nt, Human
gauggugauggcccuaagcuga

SEQ ID NO: 149262 - RNA, 22 nt, Human
gaugguggggggcagcugggag

SEQ ID NO: 149263 - RNA, 22 nt, Human
gaugguggaggaaucgcugaag

SEQ ID NO: 149264 - RNA, 22 nt, Human
gagcagcacagaccaaacagaa

SEQ ID NO: 149265 - RNA, 22 nt, Human
gagcacugagcuggaauuggag

SEQ ID NO: 149266 - RNA, 22 nt, Human
gagcagcaggccagguugcagg

SEQ ID NO: 149267 - RNA, 22 nt, Human
gaugcauccuuucugucuucuc

SEQ ID NO: 149268 - RNA, 22 nt, Human
gaugccggggucguagccgugg

SEQ ID NO: 149269 - RNA, 22 nt, Human
gagaggguugggaggcagcaga

SEQ ID NO: 149270 - RNA, 22 nt, Human
gagaggaagugccugcucccag

SEQ ID NO: 149271 - RNA, 22 nt, Human
gagaggcagcucaggaggucag

SEQ ID NO: 149272 - RNA, 22 nt, Human
gagagcugucagcguagcaccg

SEQ ID NO: 149273 - RNA, 22 nt, Human
gaugcucuugauuggaccaggg

SEQ ID NO: 149274 - RNA, 22 nt, Human
gagaggacaggauccggagggc

SEQ ID NO: 149275 - RNA, 22 nt, Human
gauggcaaugcuagaaauuuag

SEQ ID NO: 149276 - RNA, 22 nt, Human
gagccaugagauaagagcaccu

SEQ ID NO: 149277 - RNA, 22 nt, Human
gagacagugucagccauugaaa

SEQ ID NO: 149278 - RNA, 22 nt, Human
gagaccuuaagagaugucagcu

SEQ ID NO: 149279 - RNA, 23 nt, Human
gaugauggcaacuacauccggug

SEQ ID NO: 149280 - RNA, 22 nt, Human
aaaagcucucuucuucggcuuu

SEQ ID NO: 149281 - RNA, 22 nt, Human
aaacaccaagagcuagcuauua

SEQ ID NO: 149282 - RNA, 23 nt, Human
aaacuacauuuauaguuuuucuc

SEQ ID NO: 149283 - RNA, 18 nt, Human
aaacgguuucaugcugua

SEQ ID NO: 149284 - RNA, 22 nt, Human
aaacgcauucuuacaugcuucc

SEQ ID NO: 149285 - RNA, 22 nt, Human
aaagagugugcauguaccugug

SEQ ID NO: 149286 - RNA, 23 nt, Human
aaagaggugaauccaggacaagc

SEQ ID NO: 149287 - RNA, 22 nt, Human
aaagaugaaguucagcgaagaa

SEQ ID NO: 149288 - RNA, 22 nt, Human
aaagaacguuucugggaaucag

SEQ ID NO: 149289 - RNA, 22 nt, Human
aaaccgguacccuccugccugc

SEQ ID NO: 149290 - RNA, 22 nt, Human
aaaggucagaugugucgaggag

SEQ ID NO: 149291 - RNA, 22 nt, Human
aaaggaaacuaugaaucucugg

SEQ ID NO: 149292 - RNA, 22 nt, Human
aaagccagggacagugugcaug

SEQ ID NO: 149293 - RNA, 22 nt, Human
aaagaucaguuaacgccaucaa

SEQ ID NO: 149294 - RNA, 22 nt, Human
aaagguggugguuagggaauau

SEQ ID NO: 149295 - RNA, 17 nt, Human
aaagccgaucagauguu

SEQ ID NO: 149296 - RNA, 22 nt, Human
aaagcgagccggcuuggaggga

SEQ ID NO: 149297 - RNA, 22 nt, Human
aaagggagauaaaguaauuuua

SEQ ID NO: 149298 - RNA, 22 nt, Human
aacagggcgugaauaaugaaga

SEQ ID NO: 149299 - RNA, 20 nt, Human
aacagcucucgacuuaucuu

SEQ ID NO: 149300 - RNA, 21 nt, Human
aacaaaagggaagaacagcug

SEQ ID NO: 149301 - RNA, 22 nt, Human
aacaaaacauuuuacgaauaua

SEQ ID NO: 149302 - RNA, 22 nt, Human
aauguggaguugguuuccuucc

SEQ ID NO: 149303 - RNA, 22 nt, Human
aaucgguugaacccaggaagug

SEQ ID NO: 149304 - RNA, 22 nt, Human
aauggaccuuaaauugcuucag

SEQ ID NO: 149305 - RNA, 22 nt, Human
acaaaucccuguaaacacagcu

SEQ ID NO: 149306 - RNA, 20 nt, Human
acaaccacugcucacaguuu

SEQ ID NO: 149307 - RNA, 22 nt, Human
acaacagaacuccugggauuuu

SEQ ID NO: 149308 - RNA, 22 nt, Human
acaacccacacguuccgggugg

SEQ ID NO: 149309 - RNA, 22 nt, Human
aauuucuuuagagguacugauc

SEQ ID NO: 149310 - RNA, 22 nt, Human
aauuucuuucagcugcuuuaag

SEQ ID NO: 149311 - RNA, 22 nt, Human
aauuauucaugucugggcagcc

SEQ ID NO: 149312 - RNA, 22 nt, Human
acaaggccugagggugacagca

SEQ ID NO: 149313 - RNA, 22 nt, Human
acaaggccaagcauucuagcaa

SEQ ID NO: 149314 - RNA, 22 nt, Human
acaagaaaggucugggaacaau

SEQ ID NO: 149315 - RNA, 22 nt, Human
acaagaccagcagggagggugc

SEQ ID NO: 149316 - RNA, 21 nt, Human
acaaugaguuugaggcaucag

SEQ ID NO: 149317 - RNA, 22 nt, Human
acacaagaaugugcacucagcc

SEQ ID NO: 149318 - RNA, 22 nt, Human
acacacaugccuuuccuaagua

SEQ ID NO: 149319 - RNA, 19 nt, Human
acacaccagugccugugac

SEQ ID NO: 149320 - RNA, 22 nt, Human
acacgcacaccugugcacucgu

SEQ ID NO: 149321 - RNA, 22 nt, Human
acacccuugcagacgguuccuu

SEQ ID NO: 149322 - RNA, 20 nt, Human
acacagccuagaguuuggcu

SEQ ID NO: 149323 - RNA, 21 nt, Human
acacagcuggagcaucccggu

SEQ ID NO: 149324 - RNA, 20 nt, Human
acacaccugcucagacugag

SEQ ID NO: 149325 - RNA, 22 nt, Human
acacgauguuuuaagccccuaa

SEQ ID NO: 149326 - RNA, 22 nt, Human
acacacagaaggaagccccacu

SEQ ID NO: 149327 - RNA, 22 nt, Human
acacgguggccagcaguaggug

SEQ ID NO: 149328 - RNA, 22 nt, Human
acagaugccagcuacaccaccg

SEQ ID NO: 149329 - RNA, 22 nt, Human
acagcauagaggaaauguggaa

SEQ ID NO: 149330 - RNA, 22 nt, Human
acagcagguuauuguuauggca

SEQ ID NO: 149331 - RNA, 22 nt, Human
acagccacccuggaacgguugu

SEQ ID NO: 149332 - RNA, 23 nt, Human
acagcaagaggaccagaugugag

SEQ ID NO: 149333 - RNA, 23 nt, Human
acagaggcaucagagcagcaggc

SEQ ID NO: 149334 - RNA, 22 nt, Human
acagagggagugacggccaacc

SEQ ID NO: 149335 - RNA, 22 nt, Human
acagcuggaggucugugagcac

SEQ ID NO: 149336 - RNA, 22 nt, Human
acagcugguugaaggggaccaa

SEQ ID NO: 149337 - RNA, 22 nt, Human
acagcucaggcccaucaacccc

SEQ ID NO: 149338 - RNA, 19 nt, Human
acagccuguugguggggcu

SEQ ID NO: 149339 - RNA, 20 nt, Human
acagccguaaugguccuugg

SEQ ID NO: 149340 - RNA, 22 nt, Human
acagccacuaugacagauuuag

SEQ ID NO: 149341 - RNA, 22 nt, Human
acagcugagaugcuacuugugg

SEQ ID NO: 149342 - RNA, 22 nt, Human
acaggcugcccgcuccccaccu

SEQ ID NO: 149343 - RNA, 22 nt, Human
acaggacgugugugcgcaugug

SEQ ID NO: 149344 - RNA, 22 nt, Human
acagguuggagguguggaguca

SEQ ID NO: 149345 - RNA, 22 nt, Human
acaggcgucgccugcucuugcc

SEQ ID NO: 149346 - RNA, 22 nt, Human
acagguaucccuuucuaccuga

SEQ ID NO: 149347 - RNA, 22 nt, Human
acauccagcagauuguccagag

SEQ ID NO: 149348 - RNA, 21 nt, Human
acauccaggguccucacugcc

SEQ ID NO: 149349 - RNA, 20 nt, Human
acauccacugagugggauga

SEQ ID NO: 149350 - RNA, 22 nt, Human
acagguauuaugaagccuauuu

SEQ ID NO: 149351 - RNA, 22 nt, Human
acauaaacaugcagccugccaa

SEQ ID NO: 149352 - RNA, 19 nt, Human
aaggcuuucugagugaaaa

SEQ ID NO: 149353 - RNA, 22 nt, Human
aaggucuuggcucuggccgcac

SEQ ID NO: 149354 - RNA, 22 nt, Human
aaggggaauaguaggaccuggg

SEQ ID NO: 149355 - RNA, 22 nt, Human
aagggcuucucgccugugugca

SEQ ID NO: 149356 - RNA, 23 nt, Human
aaggugaagccaccaggugagga

SEQ ID NO: 149357 - RNA, 22 nt, Human
aagucgccuaaacaaaguaucu

SEQ ID NO: 149358 - RNA, 22 nt, Human
aagucuuugagaucggacauag

SEQ ID NO: 149359 - RNA, 22 nt, Human
aagugaaaaaagucaguacuga

SEQ ID NO: 149360 - RNA, 22 nt, Human
aagucuguucuacagcaccaga

SEQ ID NO: 149361 - RNA, 21 nt, Human
aaguacccuuuugcuacucag

SEQ ID NO: 149362 - RNA, 22 nt, Human
aagugcuggccuacucaaucga

SEQ ID NO: 149363 - RNA, 23 nt, Human
aaguugucauguaaaaugggcua

SEQ ID NO: 149364 - RNA, 22 nt, Human
aaguucaccugcauuuacuaaa

SEQ ID NO: 149365 - RNA, 22 nt, Human
aauagcacauguugguugagua

SEQ ID NO: 149366 - RNA, 22 nt, Human
aaucacuggcuccucacggcaa

SEQ ID NO: 149367 - RNA, 19 nt, Human
aaucacaagcaauaggggu

SEQ ID NO: 149368 - RNA, 22 nt, Human
aagcgcggccgccgcggucgcu

SEQ ID NO: 149369 - RNA, 22 nt, Human
aagcaaguucuaaaguaauucu

SEQ ID NO: 149370 - RNA, 22 nt, Human
aagccucaugccagauccaggu

SEQ ID NO: 149371 - RNA, 22 nt, Human
aagcugccugggaggaagggcu

SEQ ID NO: 149372 - RNA, 22 nt, Human
aagcucugggacugaggcuccu

SEQ ID NO: 149373 - RNA, 22 nt, Human
aaggaacuucagggcgaaugga

SEQ ID NO: 149374 - RNA, 22 nt, Human
aagcgcaaggugucagcagguu

SEQ ID NO: 149375 - RNA, 22 nt, Human
aagcucuauaggagauacagua

SEQ ID NO: 149376 - RNA, 22 nt, Human
aagcgggcagcggccugcgcca

SEQ ID NO: 149377 - RNA, 22 nt, Human
aagcuagguccuccugaacugc

SEQ ID NO: 149378 - RNA, 22 nt, Human
aagcugcagacccccugucuca

SEQ ID NO: 149379 - RNA, 20 nt, Human
aagcuguguucaagauggga

SEQ ID NO: 149380 - RNA, 22 nt, Human
aaggaggaugaauugucugcaa

SEQ ID NO: 149381 - RNA, 22 nt, Human
aaggccacacuugcuggccagc

SEQ ID NO: 149382 - RNA, 22 nt, Human
aaggcaguuaauuuggcuagaa

SEQ ID NO: 149383 - RNA, 22 nt, Human
aagaacaugggugugggcauuc

SEQ ID NO: 149384 - RNA, 20 nt, Human
aagacacuguccccacugga

SEQ ID NO: 149385 - RNA, 23 nt, Human
aagaaugcuucugaagagcugcc

SEQ ID NO: 149386 - RNA, 22 nt, Human
aagaaggcggaccagaagggag

SEQ ID NO: 149387 - RNA, 22 nt, Human
aagaaguccuugaggcgcaccc

SEQ ID NO: 149388 - RNA, 22 nt, Human
aagaccacaggaaucaaacagg

SEQ ID NO: 149389 - RNA, 22 nt, Human
aagaaggaaggcaagagauggg

SEQ ID NO: 149390 - RNA, 22 nt, Human
aagaucugaccgugauggcggc

SEQ ID NO: 149391 - RNA, 22 nt, Human
aagcaaaagguuacacuucugg

SEQ ID NO: 149392 - RNA, 22 nt, Human
aagaggcuacagcccugugucu

SEQ ID NO: 149393 - RNA, 22 nt, Human
aguucccgcgggagggcgcagg

SEQ ID NO: 149394 - RNA, 22 nt, Human
aguuccucagaagggccuggga

SEQ ID NO: 149395 - RNA, 22 nt, Human
aguucggauuguaauagauaau

SEQ ID NO: 149396 - RNA, 22 nt, Human
aguugcugccagguccugggag

SEQ ID NO: 149397 - RNA, 22 nt, Human
aguucugggaggugcacgucca

SEQ ID NO: 149398 - RNA, 22 nt, Human
aguugguggaagcuaagcuucu

SEQ ID NO: 149399 - RNA, 22 nt, Human
aguuggcauuuuauuuaaguau

SEQ ID NO: 149400 - RNA, 22 nt, Human
aguugcagguucacguaucuug

SEQ ID NO: 149401 - RNA, 22 nt, Human
aguugguucgucucgccuugag

SEQ ID NO: 149402 - RNA, 22 nt, Human
aguugguauuuacugcaguugg

SEQ ID NO: 149403 - RNA, 22 nt, Human
aguuuccacuggagacacugug

SEQ ID NO: 149404 - RNA, 22 nt, Human
aguuucccucacaggucugcau

SEQ ID NO: 149405 - RNA, 22 nt, Human
aguugguguuagaguuuuucag

SEQ ID NO: 149406 - RNA, 22 nt, Human
aguuguucucagcagaagaacu

SEQ ID NO: 149407 - RNA, 22 nt, Human
aguguucaauuugagcucaaag

SEQ ID NO: 149408 - RNA, 22 nt, Human
aguggugaucuguuacagucac

SEQ ID NO: 149409 - RNA, 22 nt, Human
agugucuuuagucgcugagcaa

SEQ ID NO: 149410 - RNA, 22 nt, Human
aguggcugugaaauacauggga

SEQ ID NO: 149411 - RNA, 22 nt, Human
aguggcuucucuggggucaaga

SEQ ID NO: 149412 - RNA, 22 nt, Human
agugucagcagcuucauugucu

SEQ ID NO: 149413 - RNA, 22 nt, Human
aguguucaucacaggcuagaga

SEQ ID NO: 149414 - RNA, 22 nt, Human
agugugacccauggcaagggca

SEQ ID NO: 149415 - RNA, 22 nt, Human
aguguccaacucagcuugucaa

SEQ ID NO: 149416 - RNA, 22 nt, Human
aguucaugugguuuaacuuaau

SEQ ID NO: 149417 - RNA, 22 nt, Human
aguucaugcuuagaucucauuu

SEQ ID NO: 149418 - RNA, 22 nt, Human
aguucauccucauuuacaagga

SEQ ID NO: 149419 - RNA, 22 nt, Human
aguggcuggcaggggagggucc

SEQ ID NO: 149420 - RNA, 22 nt, Human
agugcuuuauguuguugugcaa

SEQ ID NO: 149421 - RNA, 21 nt, Human
aguggcacuguuucuucccua

SEQ ID NO: 149422 - RNA, 22 nt, Human
aguggagguuacagcuguacau

SEQ ID NO: 149423 - RNA, 23 nt, Human
aguggaggucgggguggggagac

SEQ ID NO: 149424 - RNA, 23 nt, Human
aguggccgaucaucucgggcuug

SEQ ID NO: 149425 - RNA, 22 nt, Human
aguggugccuaagcgcggaggc

SEQ ID NO: 149426 - RNA, 22 nt, Human
aguggggcccaagaaucugcau

SEQ ID NO: 149427 - RNA, 22 nt, Human
aguggcuguuccaggugaggac

SEQ ID NO: 149428 - RNA, 19 nt, Human
agugggcaaggaagaugac

SEQ ID NO: 149429 - RNA, 23 nt, Human
agugaugcaguaucugggucugu

SEQ ID NO: 149430 - RNA, 22 nt, Human
agugccauggcugcuagauggc

SEQ ID NO: 149431 - RNA, 22 nt, Human
agugccuggcugauggguccug

SEQ ID NO: 149432 - RNA, 22 nt, Human
agugaauuagccuauuuguaaa

SEQ ID NO: 149433 - RNA, 22 nt, Human
agugacauuauuuuguguacua

SEQ ID NO: 149434 - RNA, 22 nt, Human
agugaaauaugcccauugcugu

SEQ ID NO: 149435 - RNA, 22 nt, Human
agugagcuuuuaaaauuuacca

SEQ ID NO: 149436 - RNA, 18 nt, Human
agucugagugaaauguag

SEQ ID NO: 149437 - RNA, 22 nt, Human
agucugaguaucucugagccag

SEQ ID NO: 149438 - RNA, 22 nt, Human
agggcaguuuuacugaaaggug

SEQ ID NO: 149439 - RNA, 22 nt, Human
agggcaugugaaguaaccuagg

SEQ ID NO: 149440 - RNA, 20 nt, Human
agggccuauauaaacugcug

SEQ ID NO: 149441 - RNA, 22 nt, Human
agggcccaccuuggugcugagg

SEQ ID NO: 149442 - RNA, 22 nt, Human
agggaggcccagcagacuggcg

SEQ ID NO: 149443 - RNA, 19 nt, Human
agggaggcaagagaaaugu

SEQ ID NO: 149444 - RNA, 22 nt, Human
agggagucuggccgucggcugg

SEQ ID NO: 149445 - RNA, 22 nt, Human
agggcuguuggugcccucgagg

SEQ ID NO: 149446 - RNA, 22 nt, Human
agggcaggguuggugcuggugc

SEQ ID NO: 149447 - RNA, 22 nt, Human
agggccaagaaagaguggcuuu

SEQ ID NO: 149448 - RNA, 22 nt, Human
agggccagcagcuuggccaacc

SEQ ID NO: 149449 - RNA, 21 nt, Human
agggccagaucaccaaggagc

SEQ ID NO: 149450 - RNA, 22 nt, Human
agggcaguuaugaaugucucca

SEQ ID NO: 149451 - RNA, 22 nt, Human
agggcaguguggugggacugac

SEQ ID NO: 149452 - RNA, 22 nt, Human
aggcugucucagccugcuugca

SEQ ID NO: 149453 - RNA, 22 nt, Human
aggcugucucaccucaggaggg

SEQ ID NO: 149454 - RNA, 22 nt, Human
aggcuguagaucuagacaugua

SEQ ID NO: 149455 - RNA, 18 nt, Human
aggcuggggaucacaggg

SEQ ID NO: 149456 - RNA, 22 nt, Human
aggcuucaaggacagcagccac

SEQ ID NO: 149457 - RNA, 22 nt, Human
aggguggaggacaggccaguga

SEQ ID NO: 149458 - RNA, 22 nt, Human
aggguaccugauuuauggagca

SEQ ID NO: 149459 - RNA, 22 nt, Human
agggcacuuccucugggucccu

SEQ ID NO: 149460 - RNA, 22 nt, Human
aggggcugugucauuuguccua

SEQ ID NO: 149461 - RNA, 20 nt, Human
agggguucuguuaugaaaua

SEQ ID NO: 149462 - RNA, 22 nt, Human
agggcugcugcuccgggcccag

SEQ ID NO: 149463 - RNA, 22 nt, Human
agggcucagccuccuccucagc

SEQ ID NO: 149464 - RNA, 22 nt, Human
agggcuucugcugcagagaccu

SEQ ID NO: 149465 - RNA, 22 nt, Human
aggggcugagaguuugaugugg

SEQ ID NO: 149466 - RNA, 22 nt, Human
aggucgugggugagagagagac

SEQ ID NO: 149467 - RNA, 22 nt, Human
aggucugcccaggaugcugcuu

SEQ ID NO: 149468 - RNA, 22 nt, Human
aggucuacaugcuuaauauauc

SEQ ID NO: 149469 - RNA, 22 nt, Human
agguccaucugaaucuuauucc

SEQ ID NO: 149470 - RNA, 22 nt, Human
agguccugucuuaucucuguaa

SEQ ID NO: 149471 - RNA, 22 nt, Human
agggucgucuggguccgugggg

SEQ ID NO: 149472 - RNA, 22 nt, Human
aggguuucucuccaguguggac

SEQ ID NO: 149473 - RNA, 22 nt, Human
agggggccggggcucaggagcc

SEQ ID NO: 149474 - RNA, 22 nt, Human
aggguuaggguggcauggggaa

SEQ ID NO: 149475 - RNA, 22 nt, Human
aggugucauuauagaccagaua

SEQ ID NO: 149476 - RNA, 22 nt, Human
agguggucuuguggaugccgca

SEQ ID NO: 149477 - RNA, 22 nt, Human
agguggucccaauggcugggca

SEQ ID NO: 149478 - RNA, 22 nt, Human
aggugggucgcaggcaucagug

SEQ ID NO: 149479 - RNA, 21 nt, Human
aggugcccaggauuauuuuuu

SEQ ID NO: 149480 - RNA, 22 nt, Human
aggucccauguccucccugacc

SEQ ID NO: 149481 - RNA, 22 nt, Human
agguucaucaauaacucagaga

SEQ ID NO: 149482 - RNA, 22 nt, Human
aggucuugguaggccagagucu

SEQ ID NO: 149483 - RNA, 19 nt, Human
aggugaugugacucuagaa

SEQ ID NO: 149484 - RNA, 22 nt, Human
aggugcucaguaauugauuguu

SEQ ID NO: 149485 - RNA, 22 nt, Human
aggugcccaaaucuucuguuuu

SEQ ID NO: 149486 - RNA, 22 nt, Human
aggugcagcugguggagucugg

SEQ ID NO: 149487 - RNA, 22 nt, Human
agguuuggaaguggcgauccau

SEQ ID NO: 149488 - RNA, 20 nt, Human
agguugguuuacuagucugu

SEQ ID NO: 149489 - RNA, 22 nt, Human
agguugggagaggucacccuga

SEQ ID NO: 149490 - RNA, 22 nt, Human
agguuuaggaaaacugagaguc

SEQ ID NO: 149491 - RNA, 18 nt, Human
agguugcaucugugcaga

SEQ ID NO: 149492 - RNA, 22 nt, Human
agguggcguauguguucguguu

SEQ ID NO: 149493 - RNA, 22 nt, Human
agguggcuaugaggaugcaguc

SEQ ID NO: 149494 - RNA, 22 nt, Human
agguuuggccuuggggggaguu

SEQ ID NO: 149495 - RNA, 22 nt, Human
agguuguugagaucaucuggcu

SEQ ID NO: 149496 - RNA, 22 nt, Human
aggugcuugcauacugcuugac

SEQ ID NO: 149497 - RNA, 22 nt, Human
agguuuuugucauuuucuggua

SEQ ID NO: 149498 - RNA, 22 nt, Human
agcggcaggacgucuucuucga

SEQ ID NO: 149499 - RNA, 22 nt, Human
agcgcugugaaggcugggccac

SEQ ID NO: 149500 - RNA, 22 nt, Human
aggaauugucgucauguauaau

SEQ ID NO: 149501 - RNA, 22 nt, Human
aggaacaguuucaaagagugaa

SEQ ID NO: 149502 - RNA, 19 nt, Human
agcggagguuguauauugu

SEQ ID NO: 149503 - RNA, 22 nt, Human
aggaauguugagacauggcuaa

SEQ ID NO: 149504 - RNA, 22 nt, Human
aggagcacugggcaugucaccc

SEQ ID NO: 149505 - RNA, 22 nt, Human
aggaggcaaaugagagggcuca

SEQ ID NO: 149506 - RNA, 22 nt, Human
aggaggaggacucgccaggcca

SEQ ID NO: 149507 - RNA, 22 nt, Human
aggaggcucucagguccucccc

SEQ ID NO: 149508 - RNA, 22 nt, Human
aggagcugccggauggggcaug

SEQ ID NO: 149509 - RNA, 22 nt, Human
aggagcccggucgucaugguaa

SEQ ID NO: 149510 - RNA, 22 nt, Human
aggauugucuccugugaugugc

SEQ ID NO: 149511 - RNA, 22 nt, Human
aggagguaucuggucuccuuuu

SEQ ID NO: 149512 - RNA, 22 nt, Human
aggaugagugaagagguaaauu

SEQ ID NO: 149513 - RNA, 22 nt, Human
aggcagagaggucuuccuggaa

SEQ ID NO: 149514 - RNA, 20 nt, Human
aggcagacaaggagucuguu

SEQ ID NO: 149515 - RNA, 20 nt, Human
aggauuauguacauggaugc

SEQ ID NO: 149516 - RNA, 22 nt, Human
aggcaauuuuuaggguuguugu

SEQ ID NO: 149517 - RNA, 23 nt, Human
aggcaagaacggguuguucaccc

SEQ ID NO: 149518 - RNA, 22 nt, Human
aggcaauagagggugaggagga

SEQ ID NO: 149519 - RNA, 22 nt, Human
aggccagggacaaugaggcaga

SEQ ID NO: 149520 - RNA, 22 nt, Human
aggcaguguggagggcuguugc

SEQ ID NO: 149521 - RNA, 22 nt, Human
aggcaguguguagcuggaagag

SEQ ID NO: 149522 - RNA, 22 nt, Human
aggcagugccuggaccccagcu

SEQ ID NO: 149523 - RNA, 22 nt, Human
aggccaggcgccggcgcgagac

SEQ ID NO: 149524 - RNA, 22 nt, Human
aggcauuuucuuguuauuuuua

SEQ ID NO: 149525 - RNA, 22 nt, Human
aggccacucagggggccaagau

SEQ ID NO: 149526 - RNA, 22 nt, Human
aggcauuuaaagauguaagacu

SEQ ID NO: 149527 - RNA, 22 nt, Human
aggcauuuaucaggaaauguuc

SEQ ID NO: 149528 - RNA, 20 nt, Human
aggccgcccgcugccgcuuc

SEQ ID NO: 149529 - RNA, 22 nt, Human
aggccgcgguggcgaaggcguu

SEQ ID NO: 149530 - RNA, 22 nt, Human
aggccgagaugacagagccacu

SEQ ID NO: 149531 - RNA, 22 nt, Human
aggcucagcaucugauucauau

SEQ ID NO: 149532 - RNA, 22 nt, Human
aggcuccucugggggccccgga

SEQ ID NO: 149533 - RNA, 22 nt, Human
aggcuaagugauuagugacaua

SEQ ID NO: 149534 - RNA, 22 nt, Human
aggcugcuggcaggcguggacg

SEQ ID NO: 149535 - RNA, 22 nt, Human
aggcugggaaguguguccugag

SEQ ID NO: 149536 - RNA, 22 nt, Human
aggcugcucucgccggcggugu

SEQ ID NO: 149537 - RNA, 21 nt, Human
aggccaaguuggauuucuuca

SEQ ID NO: 149538 - RNA, 19 nt, Human
aggcugccucacccucccu

SEQ ID NO: 149539 - RNA, 21 nt, Human
aggcauuuucuuggagauucu

SEQ ID NO: 149540 - RNA, 23 nt, Human
aggcagaguccuggggcacagcc

SEQ ID NO: 149541 - RNA, 22 nt, Human
aggcaguggcuuuuguuguguu

SEQ ID NO: 149542 - RNA, 22 nt, Human
aggcaguggagcuggaauaggc

SEQ ID NO: 149543 - RNA, 22 nt, Human
aggcaucguguuuuucugcuuu

SEQ ID NO: 149544 - RNA, 22 nt, Human
aggcauguugcuucgggcuuug

SEQ ID NO: 149545 - RNA, 22 nt, Human
aggcagugguguuugcuggugg

SEQ ID NO: 149546 - RNA, 23 nt, Human
aggcagcaugcaacaggccauuu

SEQ ID NO: 149547 - RNA, 19 nt, Human
aggcagccccaacuugcau

SEQ ID NO: 149548 - RNA, 22 nt, Human
aggcaggauuugcgaugugguu

SEQ ID NO: 149549 - RNA, 22 nt, Human
aggcagcagggagggagaaaug

SEQ ID NO: 149550 - RNA, 22 nt, Human
aggcaggcucaaugcccagucu

SEQ ID NO: 149551 - RNA, 22 nt, Human
aggcaggagcugugguggugag

SEQ ID NO: 149552 - RNA, 21 nt, Human
aggcagcgauuuucauauugc

SEQ ID NO: 149553 - RNA, 22 nt, Human
aggcagagauggcugcagggcc

SEQ ID NO: 149554 - RNA, 22 nt, Human
aggcagaugggagcuggaaguu

SEQ ID NO: 149555 - RNA, 22 nt, Human
agcagcaggcugggaugagucu

SEQ ID NO: 149556 - RNA, 22 nt, Human
agcagcaggugaccucgaugcc

SEQ ID NO: 149557 - RNA, 17 nt, Human
agcagcuggguugaucu

SEQ ID NO: 149558 - RNA, 22 nt, Human
agcagggagacagugcagcauu

SEQ ID NO: 149559 - RNA, 22 nt, Human
agcagcugagccccagcuguga

SEQ ID NO: 149560 - RNA, 22 nt, Human
agcacuaccggucacggccaug

SEQ ID NO: 149561 - RNA, 22 nt, Human
agcacguucuucauuacuucac

SEQ ID NO: 149562 - RNA, 22 nt, Human
agcacgcccaccuccugcggcg

SEQ ID NO: 149563 - RNA, 22 nt, Human
agcagcaccuguccucgcugcu

SEQ ID NO: 149564 - RNA, 22 nt, Human
agcaaagguagcagcucccagg

SEQ ID NO: 149565 - RNA, 22 nt, Human
agcaauucagagcauggacuuu

SEQ ID NO: 149566 - RNA, 22 nt, Human
agcaauucugaaauuacuugac

SEQ ID NO: 149567 - RNA, 19 nt, Human
agcaccuaucuggauaagg

SEQ ID NO: 149568 - RNA, 22 nt, Human
agcacagugccugacauauaug

SEQ ID NO: 149569 - RNA, 20 nt, Human
agcacaggcagucauucagu

SEQ ID NO: 149570 - RNA, 22 nt, Human
agcacauguuucuuuugcaauu

SEQ ID NO: 149571 - RNA, 22 nt, Human
agcaaggguugguuuucugaca

SEQ ID NO: 149572 - RNA, 22 nt, Human
agcacucacuagaguuagaacc

SEQ ID NO: 149573 - RNA, 22 nt, Human
agcacggugguuaagagagugg

SEQ ID NO: 149574 - RNA, 22 nt, Human
agcgcgcggggcugcggcaggg

SEQ ID NO: 149575 - RNA, 19 nt, Human
agcgccucuacugcaugga

SEQ ID NO: 149576 - RNA, 21 nt, Human
agcgcugcauccaccauggcu

SEQ ID NO: 149577 - RNA, 22 nt, Human
agccucuagcuccccaaagcca

SEQ ID NO: 149578 - RNA, 22 nt, Human
agccgcgcuguuccugcugcug

SEQ ID NO: 149579 - RNA, 22 nt, Human
agccggccucggacagagggag

SEQ ID NO: 149580 - RNA, 22 nt, Human
agccuauucaucugaucuugaa

SEQ ID NO: 149581 - RNA, 22 nt, Human
agccuacauuugacuauagucu

SEQ ID NO: 149582 - RNA, 21 nt, Human
agccgggacaacguggacccc

SEQ ID NO: 149583 - RNA, 22 nt, Human
agcgacuguaagagggccccgg

SEQ ID NO: 149584 - RNA, 22 nt, Human
agccgcugaauuugaaacaagc

SEQ ID NO: 149585 - RNA, 22 nt, Human
agccucucugaugugacagcua

SEQ ID NO: 149586 - RNA, 22 nt, Human
agccuggacagcuacggagaac

SEQ ID NO: 149587 - RNA, 22 nt, Human
agccugaaccaauauagcagcc

SEQ ID NO: 149588 - RNA, 22 nt, Human
agccauggagaacagacuugaa

SEQ ID NO: 149589 - RNA, 22 nt, Human
agccaugcuguuuugccuggga

SEQ ID NO: 149590 - RNA, 22 nt, Human
agccauggagauguggguuggg

SEQ ID NO: 149591 - RNA, 22 nt, Human
agccagugcagcuggaaauuca

SEQ ID NO: 149592 - RNA, 22 nt, Human
agccagugucgugugacaugag

SEQ ID NO: 149593 - RNA, 22 nt, Human
agcaggguggcaagucuuucug

SEQ ID NO: 149594 - RNA, 22 nt, Human
agcauucagacaucugauggau

SEQ ID NO: 149595 - RNA, 22 nt, Human
agcccgggagggcugucuggga

SEQ ID NO: 149596 - RNA, 22 nt, Human
agccacagucuguagccagcuu

SEQ ID NO: 149597 - RNA, 22 nt, Human
agccagauuuuuugagaggcga

SEQ ID NO: 149598 - RNA, 22 nt, Human
agccagcauauauauaguugaa

SEQ ID NO: 149599 - RNA, 21 nt, Human
agccagguuuccuuugaagag

SEQ ID NO: 149600 - RNA, 22 nt, Human
agccacggcaaugauaggcugc

SEQ ID NO: 149601 - RNA, 22 nt, Human
agccaucuggugucaaugauuc

SEQ ID NO: 149602 - RNA, 23 nt, Human
agcccagcagagaaccuaggucc

SEQ ID NO: 149603 - RNA, 22 nt, Human
agcccuucccuuucacuggugc

SEQ ID NO: 149604 - RNA, 22 nt, Human
agccgauaaauuguuuucuugg

SEQ ID NO: 149605 - RNA, 22 nt, Human
agcccagguggagugugugggg

SEQ ID NO: 149606 - RNA, 22 nt, Human
agccccaauuacagcugugcug

SEQ ID NO: 149607 - RNA, 22 nt, Human
agccccggugagggaguccugu

SEQ ID NO: 149608 - RNA, 19 nt, Human
agaucaggauguauuuuug

SEQ ID NO: 149609 - RNA, 22 nt, Human
agauccuagaugugaauagcua

SEQ ID NO: 149610 - RNA, 22 nt, Human
agauaggcuuagccaagcuuuc

SEQ ID NO: 149611 - RNA, 22 nt, Human
agaugaguaaauggagucuucc

SEQ ID NO: 149612 - RNA, 22 nt, Human
agaugacuuuguccugagcuga

SEQ ID NO: 149613 - RNA, 22 nt, Human
agaugaugugugucuucagcua

SEQ ID NO: 149614 - RNA, 23 nt, Human
agaugaugaauaaagagugagga

SEQ ID NO: 149615 - RNA, 22 nt, Human
agauguugucucuuacguuuga

SEQ ID NO: 149616 - RNA, 22 nt, Human
agaucauuaaccaccuguucug

SEQ ID NO: 149617 - RNA, 21 nt, Human
agaugcaguuugcaggugggu

SEQ ID NO: 149618 - RNA, 22 nt, Human
agauucgucuuuaauucaccau

SEQ ID NO: 149619 - RNA, 22 nt, Human
agauggaguccugaagccagaa

SEQ ID NO: 149620 - RNA, 22 nt, Human
agauggggccugaggacacugu

SEQ ID NO: 149621 - RNA, 22 nt, Human
agauggcuccaguguccagagg

SEQ ID NO: 149622 - RNA, 22 nt, Human
agcaagggucucucauggcuug

SEQ ID NO: 149623 - RNA, 22 nt, Human
agcaacauggaguuugugcgca

SEQ ID NO: 149624 - RNA, 22 nt, Human
agcaaaacuaaagacacagaca

SEQ ID NO: 149625 - RNA, 22 nt, Human
agacgcgcagaaggaagcggcc

SEQ ID NO: 149626 - RNA, 22 nt, Human
agacgacucuuaaggcagaauu

SEQ ID NO: 149627 - RNA, 22 nt, Human
agacuacggggaggggagggaa

SEQ ID NO: 149628 - RNA, 22 nt, Human
agaggugcuuaugcucaugguu

SEQ ID NO: 149629 - RNA, 22 nt, Human
agagggagcuccaagaucaagg

SEQ ID NO: 149630 - RNA, 22 nt, Human
agagggcugugcuaaauuucag

SEQ ID NO: 149631 - RNA, 22 nt, Human
agaggcaggcagcagagaagau

SEQ ID NO: 149632 - RNA, 22 nt, Human
agagccuaguauggacucuuag

SEQ ID NO: 149633 - RNA, 22 nt, Human
agagggagagaccuccgugccu

SEQ ID NO: 149634 - RNA, 22 nt, Human
agagcucguggcucauugagga

SEQ ID NO: 149635 - RNA, 22 nt, Human
agagcuccaggguuuuguagug

SEQ ID NO: 149636 - RNA, 22 nt, Human
agagcugggacuuggacucaau

SEQ ID NO: 149637 - RNA, 22 nt, Human
agagcagcuuuucggaaccacu

SEQ ID NO: 149638 - RNA, 22 nt, Human
agagccggagucuucuuguuug

SEQ ID NO: 149639 - RNA, 22 nt, Human
agagcccagaucccacccugga

SEQ ID NO: 149640 - RNA, 22 nt, Human
agagccauuuaaauaguuguca

SEQ ID NO: 149641 - RNA, 22 nt, Human
agaugaccaguaagugguugaa

SEQ ID NO: 149642 - RNA, 22 nt, Human
agaguggcaccuuaccugagac

SEQ ID NO: 149643 - RNA, 22 nt, Human
agauaaacaacucuuagcuguu

SEQ ID NO: 149644 - RNA, 22 nt, Human
acgccugccuguacuugugggg

SEQ ID NO: 149645 - RNA, 22 nt, Human
acgccggguaaggucauucugc

SEQ ID NO: 149646 - RNA, 22 nt, Human
acgccuugagccuugccugaau

SEQ ID NO: 149647 - RNA, 23 nt, Human
acgcagacacauguaugggccuc

SEQ ID NO: 149648 - RNA, 20 nt, Human
acgccgcgaggugagcuggu

SEQ ID NO: 149649 - RNA, 22 nt, Human
acgcggagccagaggguguggg

SEQ ID NO: 149650 - RNA, 22 nt, Human
acguccaccccguaccagauca

SEQ ID NO: 149651 - RNA, 22 nt, Human
acgucaucguugucaucgucau

SEQ ID NO: 149652 - RNA, 22 nt, Human
acggggagcgucggccucuccc

SEQ ID NO: 149653 - RNA, 22 nt, Human
acggccgaugacuccagcaugg

SEQ ID NO: 149654 - RNA, 22 nt, Human
acgcuucacaggugcgcauugu

SEQ ID NO: 149655 - RNA, 22 nt, Human
acgcugagcucauggagaugca

SEQ ID NO: 149656 - RNA, 22 nt, Human
acgcgcuccagcaggugcuuca

SEQ ID NO: 149657 - RNA, 22 nt, Human
acgccaggagcuucuccguuca

SEQ ID NO: 149658 - RNA, 21 nt, Human
acaguacuugagaucuuuuga

SEQ ID NO: 149659 - RNA, 22 nt, Human
acagugguggagggcuguccug

SEQ ID NO: 149660 - RNA, 22 nt, Human
acagucucucaagcauauccug

SEQ ID NO: 149661 - RNA, 22 nt, Human
acaucccccuacuuguguccug

SEQ ID NO: 149662 - RNA, 20 nt, Human
acuaccaugcaauuccgcuu

SEQ ID NO: 149663 - RNA, 22 nt, Human
acgucuacaugcaauucuuaua

SEQ ID NO: 149664 - RNA, 22 nt, Human
acggugagacuggcgaaggaaa

SEQ ID NO: 149665 - RNA, 22 nt, Human
acgguuuugugagguaguacuu

SEQ ID NO: 149666 - RNA, 22 nt, Human
acguccgcugauucuuuggaag

SEQ ID NO: 149667 - RNA, 22 nt, Human
acggguuccuugagggcaggau

SEQ ID NO: 149668 - RNA, 22 nt, Human
acguugaaaugggcauuuuccg

SEQ ID NO: 149669 - RNA, 22 nt, Human
acgugugugugcacguguguau

SEQ ID NO: 149670 - RNA, 23 nt, Human
acucucuguuuggaggcacuggu

SEQ ID NO: 149671 - RNA, 22 nt, Human
acucgggggccgcugcagggag

SEQ ID NO: 149672 - RNA, 22 nt, Human
acucggaggccaaggccaacgg

SEQ ID NO: 149673 - RNA, 22 nt, Human
acucggcggccucgagugcugg

SEQ ID NO: 149674 - RNA, 22 nt, Human
acuccuuuuaugugugcuaaaa

SEQ ID NO: 149675 - RNA, 22 nt, Human
acucaucauuuuacggagcagc

SEQ ID NO: 149676 - RNA, 21 nt, Human
acuccagccacugacugucuc

SEQ ID NO: 149677 - RNA, 22 nt, Human
acucacuguuuugaaauugaac

SEQ ID NO: 149678 - RNA, 22 nt, Human
acucaaacuuuuuguggacauu

SEQ ID NO: 149679 - RNA, 22 nt, Human
acuggagcccguggaggcgcag

SEQ ID NO: 149680 - RNA, 21 nt, Human
acugccaugcaggagccucca

SEQ ID NO: 149681 - RNA, 22 nt, Human
acugccauauuaggagcuucag

SEQ ID NO: 149682 - RNA, 22 nt, Human
acugaugacaaugugaguguuc

SEQ ID NO: 149683 - RNA, 22 nt, Human
acugauuccaagcuuguggagg

SEQ ID NO: 149684 - RNA, 22 nt, Human
acugcagauccucugagaaacc

SEQ ID NO: 149685 - RNA, 22 nt, Human
acugacuacauguccugucauu

SEQ ID NO: 149686 - RNA, 22 nt, Human
acugagcaaaacugauccuguu

SEQ ID NO: 149687 - RNA, 22 nt, Human
acugaaaguugaugagucacug

SEQ ID NO: 149688 - RNA, 22 nt, Human
agaagaagacccuaaggaaagg

SEQ ID NO: 149689 - RNA, 22 nt, Human
agaagaucccugugguuacgac

SEQ ID NO: 149690 - RNA, 22 nt, Human
agaagguggaguagaacaagcu

SEQ ID NO: 149691 - RNA, 22 nt, Human
agaaggcaucugcucgcuucca

SEQ ID NO: 149692 - RNA, 22 nt, Human
agaaccauccugguuccagcuu

SEQ ID NO: 149693 - RNA, 19 nt, Human
agaacccccuuccucugcu

SEQ ID NO: 149694 - RNA, 22 nt, Human
agaagggaagcaggagaggcau

SEQ ID NO: 149695 - RNA, 22 nt, Human
agaacccaaggcccagggaugu

SEQ ID NO: 149696 - RNA, 22 nt, Human
agaaucucuagaaaugggucuc

SEQ ID NO: 149697 - RNA, 22 nt, Human
agaauccucuagggauggcagg

SEQ ID NO: 149698 - RNA, 22 nt, Human
agacacagcaauaacuacuguu

SEQ ID NO: 149699 - RNA, 22 nt, Human
agaaugucaagucaagaacaau

SEQ ID NO: 149700 - RNA, 22 nt, Human
agacaaucaacuguugaugccu

SEQ ID NO: 149701 - RNA, 22 nt, Human
acuuugccagcucccugcuggc

SEQ ID NO: 149702 - RNA, 21 nt, Human
acuuccacaucacugaguaga

SEQ ID NO: 149703 - RNA, 22 nt, Human
acuuugccuucuuacuguguug

SEQ ID NO: 149704 - RNA, 22 nt, Human
acuugagcuugaaagguaugcu

SEQ ID NO: 149705 - RNA, 22 nt, Human
acuguugcuuguuuggaauguu

SEQ ID NO: 149706 - RNA, 22 nt, Human
acuguugagggaagcagaugaa

SEQ ID NO: 149707 - RNA, 19 nt, Human
acuugcuuucauuuaagau

SEQ ID NO: 149708 - RNA, 22 nt, Human
acuugggaaaugaaaauacaga

SEQ ID NO: 149709 - RNA, 22 nt, Human
acuuggucguggugcagcaugg

SEQ ID NO: 149710 - RNA, 22 nt, Human
acugcucugugguuggaagccu

SEQ ID NO: 149711 - RNA, 22 nt, Human
acugcugauuauugaaguagag

SEQ ID NO: 149712 - RNA, 22 nt, Human
acuucaggagcagucucuggaa

SEQ ID NO: 149713 - RNA, 22 nt, Human
acuucugcccuggcgagggcgu

SEQ ID NO: 149714 - RNA, 22 nt, Human
gaaaaucaugaaaguguguugu

SEQ ID NO: 149715 - RNA, 18 nt, Human
gaagcaacaguucugagu

SEQ ID NO: 149716 - RNA, 22 nt, Human
gaagcagguucuucaggaugaa

SEQ ID NO: 149717 - RNA, 22 nt, Human
gaagcaccuggacggugccugg

SEQ ID NO: 149718 - RNA, 22 nt, Human
gagcggcucaguggccauguga

SEQ ID NO: 149719 - RNA, 22 nt, Human
gaagccaugauaaccagugugg

SEQ ID NO: 149720 - RNA, 22 nt, Human
gaagcggguucacuggauggcu

SEQ ID NO: 149721 - RNA, 22 nt, Human
gagcggcggugagaaguguggg

SEQ ID NO: 149722 - RNA, 22 nt, Human
gagcgcacagaaggaagcagcc

SEQ ID NO: 149723 - RNA, 22 nt, Human
gaagcuccaggaugccugcacu

SEQ ID NO: 149724 - RNA, 22 nt, Human
gaagcuucgaaagagugauuuc

SEQ ID NO: 149725 - RNA, 21 nt, Human
gaagcugcuaugaagggggac

SEQ ID NO: 149726 - RNA, 22 nt, Human
gagcgugaggcagcuuucuaag

SEQ ID NO: 149727 - RNA, 22 nt, Human
gagcuuuagcugagaccugcuu

SEQ ID NO: 149728 - RNA, 22 nt, Human
gaggacuucaggccuggccagg

SEQ ID NO: 149729 - RNA, 22 nt, Human
gaggacccuuaggucagacaga

SEQ ID NO: 149730 - RNA, 22 nt, Human
gaaggcagucuggggagcagcc

SEQ ID NO: 149731 - RNA, 22 nt, Human
gaggagggagcuggaagcucuu

SEQ ID NO: 149732 - RNA, 22 nt, Human
gaggaggagacggaggccuggg

SEQ ID NO: 149733 - RNA, 22 nt, Human
gaggaggacauuggaaagaacu

SEQ ID NO: 149734 - RNA, 22 nt, Human
gaaggggccuggggcaaggcua

SEQ ID NO: 149735 - RNA, 22 nt, Human
gaggagcaggcaggaucugguc

SEQ ID NO: 149736 - RNA, 22 nt, Human
gaaggcuguggcuggucucagu

SEQ ID NO: 149737 - RNA, 22 nt, Human
gaggcaggaagggaggguugug

SEQ ID NO: 149738 - RNA, 22 nt, Human
gaaugcacacgugugugcaugc

SEQ ID NO: 149739 - RNA, 20 nt, Human
gaaucuggucaaaugucuau

SEQ ID NO: 149740 - RNA, 22 nt, Human
gaggcggcgacgcgggcccggg

SEQ ID NO: 149741 - RNA, 22 nt, Human
gaggcugguucccuugaucuuu

SEQ ID NO: 149742 - RNA, 22 nt, Human
gaggcccugagauugcugcccu

SEQ ID NO: 149743 - RNA, 22 nt, Human
gaauggagaacccuggacacug

SEQ ID NO: 149744 - RNA, 22 nt, Human
gaaugccugggguucuucgauc

SEQ ID NO: 149745 - RNA, 22 nt, Human
gaggcagaggaugggacuguau

SEQ ID NO: 149746 - RNA, 22 nt, Human
gaagucugacucuuuguaagcu

SEQ ID NO: 149747 - RNA, 22 nt, Human
gaauaagaauccacuucuggca

SEQ ID NO: 149748 - RNA, 22 nt, Human
gaggaugacaaagaaggcagac

SEQ ID NO: 149749 - RNA, 22 nt, Human
gagggaaaggggccaugauugg

SEQ ID NO: 149750 - RNA, 22 nt, Human
gagggagugggcccgugggcac

SEQ ID NO: 149751 - RNA, 22 nt, Human
gagggcugccacguugggcgag

SEQ ID NO: 149752 - RNA, 22 nt, Human
gaggggaaggguguucaauggg

SEQ ID NO: 149753 - RNA, 22 nt, Human
gaggggcaagaaguuggccucu

SEQ ID NO: 149754 - RNA, 22 nt, Human
gaggggaauguuccugagcugg

SEQ ID NO: 149755 - RNA, 22 nt, Human
gagggggaaaagggcagcagag

SEQ ID NO: 149756 - RNA, 22 nt, Human
gaggggcggggcgggaggagag

SEQ ID NO: 149757 - RNA, 22 nt, Human
gaggggcugggguugacuccaa

SEQ ID NO: 149758 - RNA, 19 nt, Human
gaauugcacgagcagaggc

SEQ ID NO: 149759 - RNA, 22 nt, Human
gacagcaggaugugaggggaug

SEQ ID NO: 149760 - RNA, 22 nt, Human
gaggucuugagugacuuagcag

SEQ ID NO: 149761 - RNA, 22 nt, Human
gaggugauuccucccauguaau

SEQ ID NO: 149762 - RNA, 22 nt, Human
gacagaccucugcugacuggag

SEQ ID NO: 149763 - RNA, 22 nt, Human
gacaggcagagaggaagagaga

SEQ ID NO: 149764 - RNA, 22 nt, Human
gaggugcaggggcccgggcugg

SEQ ID NO: 149765 - RNA, 20 nt, Human
gagguugcucagaguggggu

SEQ ID NO: 149766 - RNA, 22 nt, Human
gagguuggagggcuggccugca

SEQ ID NO: 149767 - RNA, 22 nt, Human
gacaccuucuacugacuaugga

SEQ ID NO: 149768 - RNA, 22 nt, Human
gacacucuuaauccuaucccug

SEQ ID NO: 149769 - RNA, 22 nt, Human
gagguccaggguggggccugag

SEQ ID NO: 149770 - RNA, 22 nt, Human
gaggucagugugggggcaaggg

SEQ ID NO: 149771 - RNA, 22 nt, Human
gaggucacacugauagucuuga

SEQ ID NO: 149772 - RNA, 22 nt, Human
gagggugugguauggauguguu

SEQ ID NO: 149773 - RNA, 22 nt, Human
gacacaacuucccucccacauu

SEQ ID NO: 149774 - RNA, 22 nt, Human
gacacaacuauccaguauggga

SEQ ID NO: 149775 - RNA, 22 nt, Human
gagggggcaggcucggcaccgg

SEQ ID NO: 149776 - RNA, 22 nt, Human
gagggugguggcggccggcacc

SEQ ID NO: 149777 - RNA, 22 nt, Human
gaccugcucagcccuguguguu

SEQ ID NO: 149778 - RNA, 22 nt, Human
gaccugguggccauugucccag

SEQ ID NO: 149779 - RNA, 22 nt, Human
gagucaauucaccuuggugcuu

SEQ ID NO: 149780 - RNA, 23 nt, Human
gaccucuuccuccagccucugaa

SEQ ID NO: 149781 - RNA, 22 nt, Human
gacggggcagccagcugguggc

SEQ ID NO: 149782 - RNA, 22 nt, Human
gagucuacaugcaggcaauugu

SEQ ID NO: 149783 - RNA, 22 nt, Human
gaguccuggagagcccgagcgc

SEQ ID NO: 149784 - RNA, 22 nt, Human
gagguuggggugucucucccca

SEQ ID NO: 149785 - RNA, 22 nt, Human
gacuggucuuuugugauggaug

SEQ ID NO: 149786 - RNA, 22 nt, Human
gacugggacucaacccaccauu

SEQ ID NO: 149787 - RNA, 22 nt, Human
gacuggcucuaucaggauaaau

SEQ ID NO: 149788 - RNA, 22 nt, Human
gaguggucacuaauuuccuuaa

SEQ ID NO: 149789 - RNA, 22 nt, Human
gaguucaaagaucuaggaagag

SEQ ID NO: 149790 - RNA, 22 nt, Human
gaguggugagaauacaacggaa

SEQ ID NO: 149791 - RNA, 22 nt, Human
gagucaguuguugcaccacuag

SEQ ID NO: 149792 - RNA, 22 nt, Human
gauaccugccaagcugcacuca

SEQ ID NO: 149793 - RNA, 22 nt, Human
gauacuugaggagaucaccaca

SEQ ID NO: 149794 - RNA, 22 nt, Human
gagaacaaggaagagucggcag

SEQ ID NO: 149795 - RNA, 22 nt, Human
gagaaauagauucaugguagau

SEQ ID NO: 149796 - RNA, 22 nt, Human
gaucccccaucuacuaucccca

SEQ ID NO: 149797 - RNA, 22 nt, Human
gagaagguggaccugaaggagc

SEQ ID NO: 149798 - RNA, 22 nt, Human
gaucccaguccuacccucauaa

SEQ ID NO: 149799 - RNA, 22 nt, Human
gacagcguguuuugcaugaaca

SEQ ID NO: 149800 - RNA, 22 nt, Human
gacacugccaagugccccgaga

SEQ ID NO: 149801 - RNA, 22 nt, Human
gaccugaccucauuagcaaguu

SEQ ID NO: 149802 - RNA, 22 nt, Human
gaccuccauucugucaugacug

SEQ ID NO: 149803 - RNA, 22 nt, Human
gaccucauggaguaagugagug

SEQ ID NO: 149804 - RNA, 22 nt, Human
gaccgggcucugcugacggucu

SEQ ID NO: 149805 - RNA, 22 nt, Human
gacccugaggauucccugcuga

SEQ ID NO: 149806 - RNA, 22 nt, Human
gacagugucccucuggggugga

SEQ ID NO: 149807 - RNA, 22 nt, Human
gacaguggagccacguugggag

SEQ ID NO: 149808 - RNA, 22 nt, Human
cuuuuggcaucagccucaggaa

SEQ ID NO: 149809 - RNA, 22 nt, Human
cuuuuugccuugaagugaccuc

SEQ ID NO: 149810 - RNA, 22 nt, Human
gacuugcucaaaucagauuuua

SEQ ID NO: 149811 - RNA, 22 nt, Human
gagacugcguggcucugacaca

SEQ ID NO: 149812 - RNA, 22 nt, Human
cuugagcugaguuugcagcucu

SEQ ID NO: 149813 - RNA, 22 nt, Human
cuucuuuuggggaugaaaaugg

SEQ ID NO: 149814 - RNA, 22 nt, Human
gaagggccaggggcaggcugga

SEQ ID NO: 149815 - RNA, 21 nt, Human
cuucgcuguuccagcucuugg

SEQ ID NO: 149816 - RNA, 23 nt, Human
cuucggcgcucgcugggcggagg

SEQ ID NO: 149817 - RNA, 22 nt, Human
cuuccuuucagaggaaggccug

SEQ ID NO: 149818 - RNA, 22 nt, Human
gaauggcagaaugaagcagugu

SEQ ID NO: 149819 - RNA, 22 nt, Human
cuugauucauuuaagguuggag

SEQ ID NO: 149820 - RNA, 22 nt, Human
cuugccagggacucagucaggg

SEQ ID NO: 149821 - RNA, 22 nt, Human
cuugccaguguugcagaagcuc

SEQ ID NO: 149822 - RNA, 23 nt, Human
cuuggcuagccacuuccacgcuc

SEQ ID NO: 149823 - RNA, 22 nt, Human
cuuggcuccuucacagggagau

SEQ ID NO: 149824 - RNA, 22 nt, Human
gacacccgccggcgccugccuc

SEQ ID NO: 149825 - RNA, 20 nt, Human
gacaagccacagcucccaga

SEQ ID NO: 149826 - RNA, 19 nt, Human
cuuguggcuaugcagauac

SEQ ID NO: 149827 - RNA, 22 nt, Human
gacaacuucaguaaaguagauu

SEQ ID NO: 149828 - RNA, 22 nt, Human
gacaagaugacaucauggcuuc

SEQ ID NO: 149829 - RNA, 22 nt, Human
cuggcuuucauggcgcaguuga

SEQ ID NO: 149830 - RNA, 21 nt, Human
cuggcucgccaugguucuuuu

SEQ ID NO: 149831 - RNA, 22 nt, Human
cuggcuaaugugcugauagcca

SEQ ID NO: 149832 - RNA, 22 nt, Human
cugaucccuuuucauuugcagg

SEQ ID NO: 149833 - RNA, 23 nt, Human
cuucagaccucagaaggucuguu

SEQ ID NO: 149834 - RNA, 22 nt, Human
cuggagcuucaggguucucggg

SEQ ID NO: 149835 - RNA, 22 nt, Human
cuggagucagcaaggacgaggc

SEQ ID NO: 149836 - RNA, 22 nt, Human
cuggauagaggaugguaggcac

SEQ ID NO: 149837 - RNA, 22 nt, Human
cugggaugagcuguuuccuggu

SEQ ID NO: 149838 - RNA, 22 nt, Human
cugggagaugacucagagcagg

SEQ ID NO: 149839 - RNA, 22 nt, Human
cugggaggagacaggggauggg

SEQ ID NO: 149840 - RNA, 22 nt, Human
cugggaccugugugccugggcc

SEQ ID NO: 149841 - RNA, 22 nt, Human
cugggagaggaaccucgagggu

SEQ ID NO: 149842 - RNA, 22 nt, Human
cugggcaugggaacuucaaggc

SEQ ID NO: 149843 - RNA, 22 nt, Human
cugggugugugugaacagagau

SEQ ID NO: 149844 - RNA, 22 nt, Human
cuggguguggugggugcugccg

SEQ ID NO: 149845 - RNA, 22 nt, Human
cugggguggugcaggccucaug

SEQ ID NO: 149846 - RNA, 22 nt, Human
cugggguaucugccacaacucu

SEQ ID NO: 149847 - RNA, 22 nt, Human
cugggcuuucaggcccuaaggc

SEQ ID NO: 149848 - RNA, 22 nt, Human
cugggcucccucucccgccucg

SEQ ID NO: 149849 - RNA, 22 nt, Human
cuguccugauggugccacuggu

SEQ ID NO: 149850 - RNA, 22 nt, Human
gaaaugaaacacacaugcagcu

SEQ ID NO: 149851 - RNA, 22 nt, Human
gaacaaggauucccaaagaaga

SEQ ID NO: 149852 - RNA, 22 nt, Human
cugugggcucucaugggaccug

SEQ ID NO: 149853 - RNA, 21 nt, Human
cugugggaaggccugaggucu

SEQ ID NO: 149854 - RNA, 22 nt, Human
gaagaggaagaggagccagagc

SEQ ID NO: 149855 - RNA, 22 nt, Human
cuguguugggauggugcgcgca

SEQ ID NO: 149856 - RNA, 22 nt, Human
gaacagauucaucuaguggcua

SEQ ID NO: 149857 - RNA, 22 nt, Human
cuguguuguuugaguagcuuga

SEQ ID NO: 149858 - RNA, 22 nt, Human
gaacggccucguuccucggugu

SEQ ID NO: 149859 - RNA, 22 nt, Human
cuggugcuguagccugauugag

SEQ ID NO: 149860 - RNA, 22 nt, Human
cuggugggucacgugugggugg

SEQ ID NO: 149861 - RNA, 22 nt, Human
cugguuacuucagaucaguagu

SEQ ID NO: 149862 - RNA, 22 nt, Human
gaaaacccuguauguagcguuu

SEQ ID NO: 149863 - RNA, 22 nt, Human
cuggguguuccuuucauuuuaa

SEQ ID NO: 149864 - RNA, 22 nt, Human
cuggguuuggcugugcuugaau

SEQ ID NO: 149865 - RNA, 19 nt, Human
cuguccacacacucgcuuc

SEQ ID NO: 149866 - RNA, 22 nt, Human
cuguccccauugcugucccugg

SEQ ID NO: 149867 - RNA, 22 nt, Human
cugucucugauaagcucgaggg

SEQ ID NO: 149868 - RNA, 22 nt, Human
cuguccuguggccugcuccggu

SEQ ID NO: 149869 - RNA, 22 nt, Human
cuguauggaggaggugcuagcc

SEQ ID NO: 149870 - RNA, 22 nt, Human
cuggugagaccgacuuccacuu

SEQ ID NO: 149871 - RNA, 22 nt, Human
cucagcgggagucuggccgaac

SEQ ID NO: 149872 - RNA, 22 nt, Human
cucagcugauuaauuucauguu

SEQ ID NO: 149873 - RNA, 22 nt, Human
cucagcaauuaccugugucucu

SEQ ID NO: 149874 - RNA, 22 nt, Human
cucagcacauuccuaagggaug

SEQ ID NO: 149875 - RNA, 22 nt, Human
cucagaugcacacaggugaggg

SEQ ID NO: 149876 - RNA, 22 nt, Human
cucagcaacccacacacggucu

SEQ ID NO: 149877 - RNA, 22 nt, Human
cucaugcugcaaauggcuguuu

SEQ ID NO: 149878 - RNA, 22 nt, Human
cucaugagucugucagagucau

SEQ ID NO: 149879 - RNA, 22 nt, Human
cucaagacacccuggccucuac

SEQ ID NO: 149880 - RNA, 22 nt, Human
cucacccaaacuauaucuuuaa

SEQ ID NO: 149881 - RNA, 22 nt, Human
cucaccugccuccccgcccucc

SEQ ID NO: 149882 - RNA, 22 nt, Human
cucacgguuugcaucaagagug

SEQ ID NO: 149883 - RNA, 22 nt, Human
cugcuuuggaucucucucugcc

SEQ ID NO: 149884 - RNA, 22 nt, Human
cugggaguugacgaggcuugua

SEQ ID NO: 149885 - RNA, 22 nt, Human
cugggggacagagagaggcggu

SEQ ID NO: 149886 - RNA, 22 nt, Human
cuccuuuuuauaucuuucucug

SEQ ID NO: 149887 - RNA, 22 nt, Human
cugggguuggccagggcccuag

SEQ ID NO: 149888 - RNA, 22 nt, Human
cugggguaucuggugucuuggu

SEQ ID NO: 149889 - RNA, 22 nt, Human
cugggugggcacccagccuggg

SEQ ID NO: 149890 - RNA, 22 nt, Human
cugggugagcuggccagagggu

SEQ ID NO: 149891 - RNA, 22 nt, Human
cuggucaauaaucauguaguac

SEQ ID NO: 149892 - RNA, 22 nt, Human
cuggucuugguauucgcagaag

SEQ ID NO: 149893 - RNA, 22 nt, Human
cuccgccuguccugggcccacg

SEQ ID NO: 149894 - RNA, 22 nt, Human
cuccgcagcugggguuggcgcu

SEQ ID NO: 149895 - RNA, 22 nt, Human
cuccgaaaugcaucccagggca

SEQ ID NO: 149896 - RNA, 22 nt, Human
cuggcuguguguuugugcaucu

SEQ ID NO: 149897 - RNA, 22 nt, Human
cuccagagagaaaggaggccgc

SEQ ID NO: 149898 - RNA, 22 nt, Human
cuccagcagaaagggcgagugg

SEQ ID NO: 149899 - RNA, 22 nt, Human
cuggcggcccgaggcagaggag

SEQ ID NO: 149900 - RNA, 22 nt, Human
cuggcggugaucccgauggugu

SEQ ID NO: 149901 - RNA, 22 nt, Human
cuggcgauugcgagagucgccu

SEQ ID NO: 149902 - RNA, 22 nt, Human
cucuguugucaguggaagcagc

SEQ ID NO: 149903 - RNA, 22 nt, Human
cuggugaagccuucggagaccc

SEQ ID NO: 149904 - RNA, 22 nt, Human
cucuggacaucugcggugcuuc

SEQ ID NO: 149905 - RNA, 22 nt, Human
cucuggagggaggcugagcugg

SEQ ID NO: 149906 - RNA, 22 nt, Human
cugugccagucagggggcaagu

SEQ ID NO: 149907 - RNA, 22 nt, Human
cugugcuguuaagaaauuuagu

SEQ ID NO: 149908 - RNA, 22 nt, Human
cuguuccuccaccucaacaaac

SEQ ID NO: 149909 - RNA, 22 nt, Human
cuguuguucacuuugcugguga

SEQ ID NO: 149910 - RNA, 20 nt, Human
cuguucucuugccacaugag

SEQ ID NO: 149911 - RNA, 23 nt, Human
cugagggcuggucugaagucugc

SEQ ID NO: 149912 - RNA, 22 nt, Human
cugagggagcugcuggccuugg

SEQ ID NO: 149913 - RNA, 22 nt, Human
cugagggagacagugcggacua

SEQ ID NO: 149914 - RNA, 20 nt, Human
cuguuugcuaucaugagcug

SEQ ID NO: 149915 - RNA, 19 nt, Human
cugagcagggaaaaacccu

SEQ ID NO: 149916 - RNA, 22 nt, Human
cugagcaucaaaugggcaauua

SEQ ID NO: 149917 - RNA, 22 nt, Human
cugccggcugcugcagagaggu

SEQ ID NO: 149918 - RNA, 22 nt, Human
cugccgaugcgcaguggcgccu

SEQ ID NO: 149919 - RNA, 22 nt, Human
cugccuggggaaugugaggauu

SEQ ID NO: 149920 - RNA, 22 nt, Human
cuacugaugccccgcugugccu

SEQ ID NO: 149921 - RNA, 22 nt, Human
cugcggcaccaaccccuucaug

SEQ ID NO: 149922 - RNA, 22 nt, Human
cugccuuggcccuaguucaugg

SEQ ID NO: 149923 - RNA, 22 nt, Human
cugcgcagaucugcuguucucu

SEQ ID NO: 149924 - RNA, 22 nt, Human
cuagaggaacaguuucagguuu

SEQ ID NO: 149925 - RNA, 22 nt, Human
cugccccucgcucaccagcucu

SEQ ID NO: 149926 - RNA, 18 nt, Human
cuaagaggucguuucuca

SEQ ID NO: 149927 - RNA, 22 nt, Human
cugcuacgguguccgguggggc

SEQ ID NO: 149928 - RNA, 22 nt, Human
cuagcagaagcuccuugagggu

SEQ ID NO: 149929 - RNA, 22 nt, Human
cugcguugaccagacuccuggg

SEQ ID NO: 149930 - RNA, 22 nt, Human
cuaggaugcuguaauggugucu

SEQ ID NO: 149931 - RNA, 22 nt, Human
cugcugccagcuuaauacucac

SEQ ID NO: 149932 - RNA, 21 nt, Human
cugcugaaggaaccccaugga

SEQ ID NO: 149933 - RNA, 22 nt, Human
cugcuguuuuccccaccaucuc

SEQ ID NO: 149934 - RNA, 22 nt, Human
cugcuguugagguuccaggcca

SEQ ID NO: 149935 - RNA, 22 nt, Human
cugcuguuuucugggcuucuua

SEQ ID NO: 149936 - RNA, 22 nt, Human
cugcugugcagacagacucucu

SEQ ID NO: 149937 - RNA, 22 nt, Human
cgugugcguauguguuuguaug

SEQ ID NO: 149938 - RNA, 22 nt, Human
cgugcuaccugagcugacagcu

SEQ ID NO: 149939 - RNA, 22 nt, Human
cugcacagucauuuccucucaa

SEQ ID NO: 149940 - RNA, 22 nt, Human
cugauuucaaauggugcuagau

SEQ ID NO: 149941 - RNA, 22 nt, Human
cugcagagaccuaggucagguu

SEQ ID NO: 149942 - RNA, 20 nt, Human
cugauguucgugcuuccugg

SEQ ID NO: 149943 - RNA, 22 nt, Human
cugcaguguccgcuugcucagc

SEQ ID NO: 149944 - RNA, 22 nt, Human
cugcagauaaguguuuugaaaa

SEQ ID NO: 149945 - RNA, 22 nt, Human
cugcaucacagcaggaggcaca

SEQ ID NO: 149946 - RNA, 22 nt, Human
cucugcguggcugggcccaggg

SEQ ID NO: 149947 - RNA, 22 nt, Human
cggugcuuuccauaucagcagc

SEQ ID NO: 149948 - RNA, 22 nt, Human
cgguggcccauuguacgcagcu

SEQ ID NO: 149949 - RNA, 22 nt, Human
cgguugcaggaugugcgggcag

SEQ ID NO: 149950 - RNA, 22 nt, Human
cgucagccacagcugccccggg

SEQ ID NO: 149951 - RNA, 21 nt, Human
cgucccggcgugagagagcug

SEQ ID NO: 149952 - RNA, 22 nt, Human
cgucauuuguaaaugaucaaga

SEQ ID NO: 149953 - RNA, 22 nt, Human
cgucauacagaugaacaaucuc

SEQ ID NO: 149954 - RNA, 22 nt, Human
cugagcugcucccgcugcagcg

SEQ ID NO: 149955 - RNA, 22 nt, Human
cguggccacaguggagcugagc

SEQ ID NO: 149956 - RNA, 22 nt, Human
cguggcaguagagcuggaacuu

SEQ ID NO: 149957 - RNA, 22 nt, Human
cgugccugguggagagcgaggg

SEQ ID NO: 149958 - RNA, 22 nt, Human
cgugaucuguuauauagugagc

SEQ ID NO: 149959 - RNA, 22 nt, Human
cugauagagcauuagugugaga

SEQ ID NO: 149960 - RNA, 22 nt, Human
cugaugcucuggauguagucaa

SEQ ID NO: 149961 - RNA, 22 nt, Human
cugauggagagugugauuuggg

SEQ ID NO: 149962 - RNA, 22 nt, Human
cgcccccgaucggggccgccgc

SEQ ID NO: 149963 - RNA, 22 nt, Human
cgcccguacuuugccggcauga

SEQ ID NO: 149964 - RNA, 22 nt, Human
cgccaguggcagcuggaacagg

SEQ ID NO: 149965 - RNA, 22 nt, Human
cuagcaggacucagcagauauu

SEQ ID NO: 149966 - RNA, 22 nt, Human
cuagguggcagcacuccgaggu

SEQ ID NO: 149967 - RNA, 22 nt, Human
cuaggucagaggacacagcuua

SEQ ID NO: 149968 - RNA, 22 nt, Human
cgccaaccaggcuguccuccca

SEQ ID NO: 149969 - RNA, 22 nt, Human
cgcagcuucagggccaggaggg

SEQ ID NO: 149970 - RNA, 22 nt, Human
cgcuagggagcacuuggcagug

SEQ ID NO: 149971 - RNA, 22 nt, Human
cgcgcgguguuccgcauucugc

SEQ ID NO: 149972 - RNA, 22 nt, Human
cgccugucugcauggccacugg

SEQ ID NO: 149973 - RNA, 22 nt, Human
cucagcgagggaaagaggccgc

SEQ ID NO: 149974 - RNA, 22 nt, Human
cuaggggucccaagggugcucu

SEQ ID NO: 149975 - RNA, 22 nt, Human
cgccgugcagucagcccagaag

SEQ ID NO: 149976 - RNA, 22 nt, Human
cuccaggacugaggacagagcu

SEQ ID NO: 149977 - RNA, 22 nt, Human
cuccggccuucugacuccccug

SEQ ID NO: 149978 - RNA, 22 nt, Human
cuccacagccccuccaguggca

SEQ ID NO: 149979 - RNA, 22 nt, Human
cuccacccuagagggcccaugc

SEQ ID NO: 149980 - RNA, 22 nt, Human
cgcugcugucaucgucuacggu

SEQ ID NO: 149981 - RNA, 22 nt, Human
cucagugacuuccugcucaauu

SEQ ID NO: 149982 - RNA, 22 nt, Human
cucaucagagcccuccucuggc

SEQ ID NO: 149983 - RNA, 22 nt, Human
cgcuggagagcaagugcgugca

SEQ ID NO: 149984 - RNA, 22 nt, Human
cuccucccagcccaggcgccac

SEQ ID NO: 149985 - RNA, 22 nt, Human
cggagcauacugccuggagaug

SEQ ID NO: 149986 - RNA, 22 nt, Human
cggagcgagaaggggaaagccc

SEQ ID NO: 149987 - RNA, 22 nt, Human
cggaggagcugcgcggaggggg

SEQ ID NO: 149988 - RNA, 22 nt, Human
cggccgcgggauggcgggcagc

SEQ ID NO: 149989 - RNA, 22 nt, Human
cggcccggccucgcggcgcaug

SEQ ID NO: 149990 - RNA, 22 nt, Human
cuaccagcacgccuuccucuac

SEQ ID NO: 149991 - RNA, 22 nt, Human
cgaggagguccaggagcaguag

SEQ ID NO: 149992 - RNA, 22 nt, Human
cuaccccaggccccucgaugcc

SEQ ID NO: 149993 - RNA, 22 nt, Human
cgaggcuugcaaggacgaggag

SEQ ID NO: 149994 - RNA, 22 nt, Human
cgaggccgcuucauggcuggca

SEQ ID NO: 149995 - RNA, 22 nt, Human
cgugucauggcggcgcaggugg

SEQ ID NO: 149996 - RNA, 22 nt, Human
cgugugugugcgugugcgugug

SEQ ID NO: 149997 - RNA, 20 nt, Human
cguguacauuuaugccccug

SEQ ID NO: 149998 - RNA, 22 nt, Human
cuaaacacuauucuggaaauag

SEQ ID NO: 149999 - RNA, 22 nt, Human
cgagguacuuacccuggucugu

SEQ ID NO: 150000 - RNA, 22 nt, Human
cgagggcuggaggggagacaga

SEQ ID NO: 150001 - RNA, 22 nt, Human
cgagugauuauucuggcugaga

SEQ ID NO: 150002 - RNA, 22 nt, Human
cgcacuugugagcgacagggcu

SEQ ID NO: 150003 - RNA, 22 nt, Human
cgcacaggcacagacacuggga

SEQ ID NO: 150004 - RNA, 22 nt, Human
cuagaucuuuaaaaaucuggaa

SEQ ID NO: 150005 - RNA, 22 nt, Human
cuagaucuggcaggcacaaggu

SEQ ID NO: 150006 - RNA, 22 nt, Human
ccuuggaucugcauaucagcua

SEQ ID NO: 150007 - RNA, 22 nt, Human
cgucauguuauggcucauucua

SEQ ID NO: 150008 - RNA, 22 nt, Human
ccuugcgaggaugcugugagcu

SEQ ID NO: 150009 - RNA, 22 nt, Human
ccuucugcuggucaucccagug

SEQ ID NO: 150010 - RNA, 22 nt, Human
cgggagaugaggagagcuucgg

SEQ ID NO: 150011 - RNA, 22 nt, Human
cgggcacucagggucgaggugg

SEQ ID NO: 150012 - RNA, 22 nt, Human
cgggcacagguugagguagaug

SEQ ID NO: 150013 - RNA, 22 nt, Human
cgggaggcggagcuccgcgggg

SEQ ID NO: 150014 - RNA, 21 nt, Human
ccuggagacaaagacagggug

SEQ ID NO: 150015 - RNA, 22 nt, Human
ccuggcauuagaaauuccguca

SEQ ID NO: 150016 - RNA, 22 nt, Human
ccuggcccugcugcuugccagc

SEQ ID NO: 150017 - RNA, 22 nt, Human
cguggaggucgcauauuccucu

SEQ ID NO: 150018 - RNA, 22 nt, Human
cgugaagaaguaauagguggug

SEQ ID NO: 150019 - RNA, 22 nt, Human
cgaaaaagaagugcaccauguu

SEQ ID NO: 150020 - RNA, 17 nt, Human
cgugaggaccaggcagc

SEQ ID NO: 150021 - RNA, 22 nt, Human
cgucuaaggaacuccauucaca

SEQ ID NO: 150022 - RNA, 22 nt, Human
cgugaaaugcagaaaguugugg

SEQ ID NO: 150023 - RNA, 22 nt, Human
ccuuucuggucucugagagacu

SEQ ID NO: 150024 - RNA, 22 nt, Human
ccgugccuuuaguuucuucugu

SEQ ID NO: 150025 - RNA, 22 nt, Human
ccgugcaguuucucacacacau

SEQ ID NO: 150026 - RNA, 19 nt, Human
ccggucaugcauuccuuug

SEQ ID NO: 150027 - RNA, 22 nt, Human
ccggguucuuguucuaggaugu

SEQ ID NO: 150028 - RNA, 22 nt, Human
cgaacggcagagagcccguccc

SEQ ID NO: 150029 - RNA, 20 nt, Human
ccuagacacagggagggccg

SEQ ID NO: 150030 - RNA, 22 nt, Human
ccuaggcuggcugucuucaggu

SEQ ID NO: 150031 - RNA, 19 nt, Human
ccuccguguuaccuguccu

SEQ ID NO: 150032 - RNA, 22 nt, Human
ccuccugggccuugcucuguga

SEQ ID NO: 150033 - RNA, 22 nt, Human
ccuccgguucucagggcuccac

SEQ ID NO: 150034 - RNA, 21 nt, Human
ccuccagccagagggucugga

SEQ ID NO: 150035 - RNA, 22 nt, Human
ccucccaccguaucucaguggc

SEQ ID NO: 150036 - RNA, 20 nt, Human
ccucauucucgcguguguuu

SEQ ID NO: 150037 - RNA, 22 nt, Human
cgcacacaaaugcauacgccag

SEQ ID NO: 150038 - RNA, 22 nt, Human
cgcccggcugagacgcucgccc

SEQ ID NO: 150039 - RNA, 18 nt, Human
cgauguguaugugauuug

SEQ ID NO: 150040 - RNA, 22 nt, Human
ccugacucugauuucgcugcau

SEQ ID NO: 150041 - RNA, 22 nt, Human
ccucuggacuugggacagugag

SEQ ID NO: 150042 - RNA, 22 nt, Human
cgccgccgccugcccgcgcccc

SEQ ID NO: 150043 - RNA, 21 nt, Human
cgcccggccggaaaccccuuc

SEQ ID NO: 150044 - RNA, 22 nt, Human
ccugaggcccuggcugugcuga

SEQ ID NO: 150045 - RNA, 22 nt, Human
ccugagacucuccugugcagcc

SEQ ID NO: 150046 - RNA, 22 nt, Human
cgcugggugguugauguacagc

SEQ ID NO: 150047 - RNA, 22 nt, Human
cgccgugucuggucuguacguc

SEQ ID NO: 150048 - RNA, 19 nt, Human
cgcugcucccgcuguggcu

SEQ ID NO: 150049 - RNA, 22 nt, Human
cggagggcccucaggacugggu

SEQ ID NO: 150050 - RNA, 22 nt, Human
cggaggcugcuuucuguugcua

SEQ ID NO: 150051 - RNA, 22 nt, Human
cggcugcagcggagcaggcugg

SEQ ID NO: 150052 - RNA, 22 nt, Human
cggcugcgguucaccuagggca

SEQ ID NO: 150053 - RNA, 22 nt, Human
cgggacaauagcagugcugaug

SEQ ID NO: 150054 - RNA, 22 nt, Human
cggagguccagucacaaguaac

SEQ ID NO: 150055 - RNA, 22 nt, Human
cgcuuugacuuuagaaggccaa

SEQ ID NO: 150056 - RNA, 22 nt, Human
cgcuuugguaauagggcagccu

SEQ ID NO: 150057 - RNA, 22 nt, Human
cgcuuuccaggcacauccucuu

SEQ ID NO: 150058 - RNA, 22 nt, Human
cggacugaccugcucggggaga

SEQ ID NO: 150059 - RNA, 22 nt, Human
ccugccugggcucacuugccag

SEQ ID NO: 150060 - RNA, 22 nt, Human
ccugugcuucacucaacaagcc

SEQ ID NO: 150061 - RNA, 22 nt, Human
ccugugucaucagcuguggcua

SEQ ID NO: 150062 - RNA, 22 nt, Human
ccugugacucugucugaugguc

SEQ ID NO: 150063 - RNA, 19 nt, Human
ccugugaguuaagcuaugu

SEQ ID NO: 150064 - RNA, 22 nt, Human
ccuguuccaacccucccuggcu

SEQ ID NO: 150065 - RNA, 20 nt, Human
ccuguucacugcgcaguuuc

SEQ ID NO: 150066 - RNA, 22 nt, Human
ccugggcauuuguuucacaggu

SEQ ID NO: 150067 - RNA, 23 nt, Human
ccuggcugaccugaagguguagu

SEQ ID NO: 150068 - RNA, 22 nt, Human
ccuggcccagcuggaagcggga

SEQ ID NO: 150069 - RNA, 22 nt, Human
ccugggcucgcgcacuucaccc

SEQ ID NO: 150070 - RNA, 22 nt, Human
ccugggccuaaacaaacaagag

SEQ ID NO: 150071 - RNA, 22 nt, Human
ccuggggcucugcacagagcag

SEQ ID NO: 150072 - RNA, 22 nt, Human
ccuggccacagggcucugcauu

SEQ ID NO: 150073 - RNA, 22 nt, Human
ccgcggauggggagucaccacc

SEQ ID NO: 150074 - RNA, 22 nt, Human
ccgcgcccccggcugugccccc

SEQ ID NO: 150075 - RNA, 22 nt, Human
ccgagcagggcgcccugcccca

SEQ ID NO: 150076 - RNA, 22 nt, Human
ccgagaucagaguaggauuugg

SEQ ID NO: 150077 - RNA, 22 nt, Human
ccuggaccgacacaggaaggga

SEQ ID NO: 150078 - RNA, 19 nt, Human
ccuggccaacgucaacauu

SEQ ID NO: 150079 - RNA, 22 nt, Human
ccagagaugcagugggugcagu

SEQ ID NO: 150080 - RNA, 22 nt, Human
ccagacuggggcuccuugaggg

SEQ ID NO: 150081 - RNA, 22 nt, Human
ccagacucucucauuuuccugu

SEQ ID NO: 150082 - RNA, 22 nt, Human
cccagagggcugaggauaugaa

SEQ ID NO: 150083 - RNA, 22 nt, Human
ccggaggaaauugcauugguug

SEQ ID NO: 150084 - RNA, 22 nt, Human
ccgcuggccgacuuccgagagc

SEQ ID NO: 150085 - RNA, 22 nt, Human
ccgcucuuugagacucucccga

SEQ ID NO: 150086 - RNA, 22 nt, Human
ccuucgcuggcaucuccaggua

SEQ ID NO: 150087 - RNA, 21 nt, Human
ccuugcacucaucccaugccc

SEQ ID NO: 150088 - RNA, 22 nt, Human
ccuugagugcaucguggguguc

SEQ ID NO: 150089 - RNA, 22 nt, Human
ccuuggcuuaccuucugugugg

SEQ ID NO: 150090 - RNA, 22 nt, Human
ccuugggagcgcccuguccggg

SEQ ID NO: 150091 - RNA, 22 nt, Human
cauugcuguuaauugucucuag

SEQ ID NO: 150092 - RNA, 20 nt, Human
ccagaagagaagaaaaggaa

SEQ ID NO: 150093 - RNA, 22 nt, Human
ccacucucucccucuguagggg

SEQ ID NO: 150094 - RNA, 22 nt, Human
ccagaacguuugugcgaggcag

SEQ ID NO: 150095 - RNA, 19 nt, Human
ccacuucuuugugugugag

SEQ ID NO: 150096 - RNA, 22 nt, Human
ccacuguuggcccgaagggguc

SEQ ID NO: 150097 - RNA, 22 nt, Human
ccacuuucuaaauuggcgauuu

SEQ ID NO: 150098 - RNA, 22 nt, Human
ccagagcaccgaaacgagcuuu

SEQ ID NO: 150099 - RNA, 22 nt, Human
ccagaggcuuaugcagcugcug

SEQ ID NO: 150100 - RNA, 22 nt, Human
ccagacuggggauuuugccagg

SEQ ID NO: 150101 - RNA, 22 nt, Human
ccagagcacaccguuugccuuc

SEQ ID NO: 150102 - RNA, 22 nt, Human
ccagcaagacucgcagugggau

SEQ ID NO: 150103 - RNA, 22 nt, Human
ccagcucgaggcaggggcugca

SEQ ID NO: 150104 - RNA, 22 nt, Human
ccagcaugcucagucuaaauug

SEQ ID NO: 150105 - RNA, 22 nt, Human
ccagccacagcuuccagcuccu

SEQ ID NO: 150106 - RNA, 22 nt, Human
ccagccugccaagcccagcccu

SEQ ID NO: 150107 - RNA, 22 nt, Human
ccagcaucagcucuuggcuggc

SEQ ID NO: 150108 - RNA, 22 nt, Human
ccaggcccugccugugguuccu

SEQ ID NO: 150109 - RNA, 22 nt, Human
ccaggcccugcuccucacacca

SEQ ID NO: 150110 - RNA, 22 nt, Human
ccaggcagaggggucuggagca

SEQ ID NO: 150111 - RNA, 22 nt, Human
ccagcuuuucagaaucugccug

SEQ ID NO: 150112 - RNA, 22 nt, Human
ccagccuucugaugggacccuc

SEQ ID NO: 150113 - RNA, 17 nt, Human
ccagcugcucccucaga

SEQ ID NO: 150114 - RNA, 23 nt, Human
ccagcugugccuggcccaggagc

SEQ ID NO: 150115 - RNA, 22 nt, Human
cauuuugguaauguucguuugc

SEQ ID NO: 150116 - RNA, 22 nt, Human
ccaaacauuucaaauuuagaga

SEQ ID NO: 150117 - RNA, 22 nt, Human
ccaaagaagcaaugagaauagu

SEQ ID NO: 150118 - RNA, 22 nt, Human
ccagugacaaagucggaagucc

SEQ ID NO: 150119 - RNA, 22 nt, Human
ccagugcagacgcggaacuggc

SEQ ID NO: 150120 - RNA, 23 nt, Human
ccagucgagucccaaccuucgcc

SEQ ID NO: 150121 - RNA, 22 nt, Human
ccaguccugucaggggagggga

SEQ ID NO: 150122 - RNA, 23 nt, Human
ccagucgagucccaaccuucacc

SEQ ID NO: 150123 - RNA, 19 nt, Human
ccacacacuggucucuggg

SEQ ID NO: 150124 - RNA, 22 nt, Human
ccaaggugcagcccauggugaa

SEQ ID NO: 150125 - RNA, 22 nt, Human
ccaaggcuggagggcuuaugua

SEQ ID NO: 150126 - RNA, 22 nt, Human
ccaggcuccccaggaggcccuu

SEQ ID NO: 150127 - RNA, 22 nt, Human
ccagggaggucauagugcuggu

SEQ ID NO: 150128 - RNA, 22 nt, Human
ccagggcggacaaggucuuuga

SEQ ID NO: 150129 - RNA, 22 nt, Human
ccagggcuggguuugucggugu

SEQ ID NO: 150130 - RNA, 22 nt, Human
ccagggcuggaggaggucagga

SEQ ID NO: 150131 - RNA, 22 nt, Human
ccaaagaauuuggaaaaucuga

SEQ ID NO: 150132 - RNA, 22 nt, Human
ccaaccaguuaucuccuaaggu

SEQ ID NO: 150133 - RNA, 22 nt, Human
ccaagagcuucccauagcuucu

SEQ ID NO: 150134 - RNA, 23 nt, Human
ccacuccucccaggccacccugc

SEQ ID NO: 150135 - RNA, 23 nt, Human
ccaugugcaggguucagcacuua

SEQ ID NO: 150136 - RNA, 22 nt, Human
ccauggccaauugcaccuugcu

SEQ ID NO: 150137 - RNA, 22 nt, Human
ccaugggugucuggagcacccu

SEQ ID NO: 150138 - RNA, 16 nt, Human
cccaccuggacuaccu

SEQ ID NO: 150139 - RNA, 22 nt, Human
cccaagcuccacauuuuagcuu

SEQ ID NO: 150140 - RNA, 22 nt, Human
ccagaacgacgggcagaggcgc

SEQ ID NO: 150141 - RNA, 19 nt, Human
ccagaagggcaagcaaagg

SEQ ID NO: 150142 - RNA, 22 nt, Human
ccacccugguuacugugccagg

SEQ ID NO: 150143 - RNA, 22 nt, Human
ccacccacuucucugcccucca

SEQ ID NO: 150144 - RNA, 22 nt, Human
ccaugauguugccuacacugcu

SEQ ID NO: 150145 - RNA, 22 nt, Human
ccauggaaaagacgggcaggcc

SEQ ID NO: 150146 - RNA, 22 nt, Human
ccacuacauugagugcuuucuc

SEQ ID NO: 150147 - RNA, 22 nt, Human
ccaccccagaaagggaaggcca

SEQ ID NO: 150148 - RNA, 22 nt, Human
ccaguggugcauguuugagcaa

SEQ ID NO: 150149 - RNA, 21 nt, Human
ccacaucaugucaccuccuag

SEQ ID NO: 150150 - RNA, 22 nt, Human
ccaucccugagucacaggaggg

SEQ ID NO: 150151 - RNA, 22 nt, Human
caugauucccacauugcgauca

SEQ ID NO: 150152 - RNA, 22 nt, Human
cauuuugguccucauguguagc

SEQ ID NO: 150153 - RNA, 22 nt, Human
caugccugaucagcggccagca

SEQ ID NO: 150154 - RNA, 22 nt, Human
ccaaauuguuguuguuguuguu

SEQ ID NO: 150155 - RNA, 22 nt, Human
cauggcggcgcucucccugccu

SEQ ID NO: 150156 - RNA, 22 nt, Human
ccaaggcugcagccgugacgcg

SEQ ID NO: 150157 - RNA, 22 nt, Human
ccaaccaguuucuuggcuuuag

SEQ ID NO: 150158 - RNA, 22 nt, Human
ccaagcguguuuaggaaaugcu

SEQ ID NO: 150159 - RNA, 22 nt, Human
ccaaggcuguggggcugugcag

SEQ ID NO: 150160 - RNA, 22 nt, Human
ccaaucaacuguguggcuuucu

SEQ ID NO: 150161 - RNA, 23 nt, Human
ccacaugugagcccaccgugccc

SEQ ID NO: 150162 - RNA, 22 nt, Human
ccaccacauuugccuagacuuu

SEQ ID NO: 150163 - RNA, 22 nt, Human
caugugguauugugagauccac

SEQ ID NO: 150164 - RNA, 22 nt, Human
ccaccacugaggcacaggagcc

SEQ ID NO: 150165 - RNA, 22 nt, Human
ccacccuuccauucuuccucuu

SEQ ID NO: 150166 - RNA, 22 nt, Human
cauuagggucuuuagacagcuc

SEQ ID NO: 150167 - RNA, 22 nt, Human
ccaccuggcagcaggcucggca

SEQ ID NO: 150168 - RNA, 22 nt, Human
ccaccucuaccuggccggccuu

SEQ ID NO: 150169 - RNA, 16 nt, Human
ccacccagagaauauu

SEQ ID NO: 150170 - RNA, 22 nt, Human
cagguugaaaguggaggagcua

SEQ ID NO: 150171 - RNA, 22 nt, Human
caucacggagcaugagaagaca

SEQ ID NO: 150172 - RNA, 22 nt, Human
caucagucugaaagccagggag

SEQ ID NO: 150173 - RNA, 22 nt, Human
cauguggaaaugcaugcuuuuu

SEQ ID NO: 150174 - RNA, 22 nt, Human
cauaucuccagguucugcugga

SEQ ID NO: 150175 - RNA, 22 nt, Human
cauguguuucuuaagccaggcc

SEQ ID NO: 150176 - RNA, 21 nt, Human
caucaagaucaauggagggcu

SEQ ID NO: 150177 - RNA, 22 nt, Human
caucaauagguauuugagagac

SEQ ID NO: 150178 - RNA, 22 nt, Human
cauugcugugggcauuugcugc

SEQ ID NO: 150179 - RNA, 22 nt, Human
cauugcugccaaggugagcugg

SEQ ID NO: 150180 - RNA, 22 nt, Human
cauccagagcugccugaccccg

SEQ ID NO: 150181 - RNA, 22 nt, Human
caucaggcugggaacacagauc

SEQ ID NO: 150182 - RNA, 22 nt, Human
caucugcagccucugcauuccc

SEQ ID NO: 150183 - RNA, 22 nt, Human
caucucagguuuguucugagac

SEQ ID NO: 150184 - RNA, 22 nt, Human
caucgagaauuggcagcuaaag

SEQ ID NO: 150185 - RNA, 22 nt, Human
cauccagggguacccuggagcc

SEQ ID NO: 150186 - RNA, 22 nt, Human
cauuggaugagggccucaucga

SEQ ID NO: 150187 - RNA, 22 nt, Human
cauugggcggggaccucggcug

SEQ ID NO: 150188 - RNA, 22 nt, Human
caucuccaagucuguaagcagu

SEQ ID NO: 150189 - RNA, 22 nt, Human
caugaugaacugugcuguuagg

SEQ ID NO: 150190 - RNA, 22 nt, Human
cauugucaaguggccgggucuu

SEQ ID NO: 150191 - RNA, 22 nt, Human
caucuuuguuuuggauauaauc

SEQ ID NO: 150192 - RNA, 22 nt, Human
cagcacaggugugaggccugau

SEQ ID NO: 150193 - RNA, 22 nt, Human
cacuguugagcaauguacagug

SEQ ID NO: 150194 - RNA, 22 nt, Human
cagcagaggagguggcagcacc

SEQ ID NO: 150195 - RNA, 20 nt, Human
cagcagucagcucuccaaug

SEQ ID NO: 150196 - RNA, 22 nt, Human
cagaacugaauaaagccaggau

SEQ ID NO: 150197 - RNA, 22 nt, Human
cagcccugagagaaccaucuau

SEQ ID NO: 150198 - RNA, 22 nt, Human
cagccccaguuuucauaagacu

SEQ ID NO: 150199 - RNA, 22 nt, Human
cagacgguuaaacgauuuugcu

SEQ ID NO: 150200 - RNA, 22 nt, Human
cagaccuggaaaacaggcuugc

SEQ ID NO: 150201 - RNA, 22 nt, Human
cagccccucuucucuccucgga

SEQ ID NO: 150202 - RNA, 21 nt, Human
cagcccccauacccugcccag

SEQ ID NO: 150203 - RNA, 22 nt, Human
cagacuccugcuccucuggggc

SEQ ID NO: 150204 - RNA, 22 nt, Human
cagccccgcuggccucgccucc

SEQ ID NO: 150205 - RNA, 22 nt, Human
cagccagaucgccuuccgccuc

SEQ ID NO: 150206 - RNA, 22 nt, Human
cagaccucucaggcuguucuug

SEQ ID NO: 150207 - RNA, 22 nt, Human
cacugcacuccagccugggcaa

SEQ ID NO: 150208 - RNA, 22 nt, Human
cacugcguaguggcccgaagcu

SEQ ID NO: 150209 - RNA, 22 nt, Human
cagacugagaaagugccacagg

SEQ ID NO: 150210 - RNA, 23 nt, Human
cacucgcaggcccagcucucagg

SEQ ID NO: 150211 - RNA, 22 nt, Human
cagagagcguccauccggugcc

SEQ ID NO: 150212 - RNA, 23 nt, Human
cagaccccuggcucugacccccu

SEQ ID NO: 150213 - RNA, 22 nt, Human
cacgggcgacgugaucuaggac

SEQ ID NO: 150214 - RNA, 20 nt, Human
caccggguugcugguuucuu

SEQ ID NO: 150215 - RNA, 22 nt, Human
caccgagagccacuuccggaac

SEQ ID NO: 150216 - RNA, 22 nt, Human
caccugcaaauuccagauuucu

SEQ ID NO: 150217 - RNA, 22 nt, Human
caccacauguccgaaauucagc

SEQ ID NO: 150218 - RNA, 22 nt, Human
cacccgacugaggacgccgccc

SEQ ID NO: 150219 - RNA, 20 nt, Human
cacccgguccucagcgacuc

SEQ ID NO: 150220 - RNA, 22 nt, Human
caccagcgacugugaccagcaa

SEQ ID NO: 150221 - RNA, 22 nt, Human
caccaccaguaccaucacacgc

SEQ ID NO: 150222 - RNA, 22 nt, Human
caccaucugaauauucuccaag

SEQ ID NO: 150223 - RNA, 22 nt, Human
cacacagcuagugacaggagaa

SEQ ID NO: 150224 - RNA, 22 nt, Human
cacugcugaggcccguguuacu

SEQ ID NO: 150225 - RNA, 22 nt, Human
cacacguuuagcuucuggcggc

SEQ ID NO: 150226 - RNA, 22 nt, Human
cacacgagcccuggagccagca

SEQ ID NO: 150227 - RNA, 22 nt, Human
cacacguuucuacugcugccaa

SEQ ID NO: 150228 - RNA, 22 nt, Human
cacagauaaggcuuugucccca

SEQ ID NO: 150229 - RNA, 22 nt, Human
cacagcagcaucauuuaucugg

SEQ ID NO: 150230 - RNA, 19 nt, Human
cacuguccuagucgaggcc

SEQ ID NO: 150231 - RNA, 22 nt, Human
cacuguugaagauacuuccucu

SEQ ID NO: 150232 - RNA, 22 nt, Human
cacugcaaccuccaccucccgg

SEQ ID NO: 150233 - RNA, 22 nt, Human
caaagaaccuucgagacagggc

SEQ ID NO: 150234 - RNA, 22 nt, Human
caaugccaggaaccugggggaa

SEQ ID NO: 150235 - RNA, 22 nt, Human
caagccacugggagcugcacac

SEQ ID NO: 150236 - RNA, 22 nt, Human
cacagcuggggaagcugaggcc

SEQ ID NO: 150237 - RNA, 22 nt, Human
cacagccaagacuuggccccau

SEQ ID NO: 150238 - RNA, 19 nt, Human
cacagcccucacuuuuagc

SEQ ID NO: 150239 - RNA, 22 nt, Human
cagacagagucuucccaucagu

SEQ ID NO: 150240 - RNA, 22 nt, Human
cacauuucagcacucagggcau

SEQ ID NO: 150241 - RNA, 22 nt, Human
cacaugugggcacagggcugca

SEQ ID NO: 150242 - RNA, 22 nt, Human
caggugggauuuugcugcuuga

SEQ ID NO: 150243 - RNA, 22 nt, Human
cagguggccggguaggaggugg

SEQ ID NO: 150244 - RNA, 22 nt, Human
cagguguugcaguugaagacug

SEQ ID NO: 150245 - RNA, 22 nt, Human
caggaacucuucugggugcuug

SEQ ID NO: 150246 - RNA, 22 nt, Human
caggacacagacacuaaauaua

SEQ ID NO: 150247 - RNA, 22 nt, Human
caggacccaacggugcaauguc

SEQ ID NO: 150248 - RNA, 22 nt, Human
cagugcuggaggggugcuugca

SEQ ID NO: 150249 - RNA, 22 nt, Human
cagugcucauagcuguuccucc

SEQ ID NO: 150250 - RNA, 22 nt, Human
caggcacagcuaagacuggcca

SEQ ID NO: 150251 - RNA, 22 nt, Human
caguggacacuuccucuacaau

SEQ ID NO: 150252 - RNA, 22 nt, Human
cagugccggccaggaccuccug

SEQ ID NO: 150253 - RNA, 22 nt, Human
caggauuuaauaagauaguguu

SEQ ID NO: 150254 - RNA, 22 nt, Human
caggaggugugucccaccgggu

SEQ ID NO: 150255 - RNA, 22 nt, Human
caggaggaggccgggaggaagc

SEQ ID NO: 150256 - RNA, 22 nt, Human
caguggggaggccaggauagaa

SEQ ID NO: 150257 - RNA, 22 nt, Human
caguggggcuuccagacgcuga

SEQ ID NO: 150258 - RNA, 22 nt, Human
caguggagaccugccugcugga

SEQ ID NO: 150259 - RNA, 23 nt, Human
caggggacaggugaccugggcuc

SEQ ID NO: 150260 - RNA, 22 nt, Human
caggggcuccaggugagccugg

SEQ ID NO: 150261 - RNA, 22 nt, Human
caggccgccacugcagcagcug

SEQ ID NO: 150262 - RNA, 22 nt, Human
cagugguaaaugucguuccugu

SEQ ID NO: 150263 - RNA, 22 nt, Human
caggguuuuaguugcagguuau

SEQ ID NO: 150264 - RNA, 22 nt, Human
caggguugaugaauugucugua

SEQ ID NO: 150265 - RNA, 22 nt, Human
caguugcagagugauguguuug

SEQ ID NO: 150266 - RNA, 22 nt, Human
caguucaagauuguugcuuucu

SEQ ID NO: 150267 - RNA, 22 nt, Human
cauagcguuuacauguggauua

SEQ ID NO: 150268 - RNA, 22 nt, Human
caggugcucugauauggggcug

SEQ ID NO: 150269 - RNA, 22 nt, Human
cagguggauggcgagcccugca

SEQ ID NO: 150270 - RNA, 22 nt, Human
cagcccuggccucuucgcuuuc

SEQ ID NO: 150271 - RNA, 22 nt, Human
caggacuuccucuaugguggcg

SEQ ID NO: 150272 - RNA, 22 nt, Human
caggaacucggagcccaucucu

SEQ ID NO: 150273 - RNA, 22 nt, Human
caggaacagcaccaggagcuag

SEQ ID NO: 150274 - RNA, 22 nt, Human
cagcaugguggagcugcucuuu

SEQ ID NO: 150275 - RNA, 22 nt, Human
cagccgcucaugggcccggagc

SEQ ID NO: 150276 - RNA, 22 nt, Human
cagccuggccucuggauauuug

SEQ ID NO: 150277 - RNA, 22 nt, Human
cagcccuugcgacacccuggcu

SEQ ID NO: 150278 - RNA, 22 nt, Human
cagaggagcgaguuggacgcca

SEQ ID NO: 150279 - RNA, 22 nt, Human
cagagcugucauuugccaguga

SEQ ID NO: 150280 - RNA, 22 nt, Human
cagagcugagucuucaagguug

SEQ ID NO: 150281 - RNA, 22 nt, Human
cagagccagcuguccuuggcau

SEQ ID NO: 150282 - RNA, 22 nt, Human
cagagcagaaaccugggugauu

SEQ ID NO: 150283 - RNA, 22 nt, Human
cagcuucacuuaaaacaugcaa

SEQ ID NO: 150284 - RNA, 22 nt, Human
cagcuucaugacaaacaguuuu

SEQ ID NO: 150285 - RNA, 22 nt, Human
cagcgguggcaaggugacugug

SEQ ID NO: 150286 - RNA, 22 nt, Human
cagcuauggaauuggcccagau

SEQ ID NO: 150287 - RNA, 22 nt, Human
caggcgcugacgggaccgggcu

SEQ ID NO: 150288 - RNA, 22 nt, Human
caggccgcccucuccuguuagc

SEQ ID NO: 150289 - RNA, 22 nt, Human
caggaucccuggccuccgccca

SEQ ID NO: 150290 - RNA, 22 nt, Human
caggacccaaccucccugcucu

SEQ ID NO: 150291 - RNA, 22 nt, Human
caggcacaaugagcgccaucuu

SEQ ID NO: 150292 - RNA, 22 nt, Human
caggccccagggacugggcgcu

SEQ ID NO: 150293 - RNA, 22 nt, Human
caggcacaagaucggcuagaua

SEQ ID NO: 150294 - RNA, 22 nt, Human
cagcuggggagagacauggcag

SEQ ID NO: 150295 - RNA, 22 nt, Human
cagcugacaagaguccuuggag

SEQ ID NO: 150296 - RNA, 22 nt, Human
cagcucuggcuauugaggacca

SEQ ID NO: 150297 - RNA, 22 nt, Human
cagcugcugguguaucgggucc

SEQ ID NO: 150298 - RNA, 22 nt, Human
cagcuguauuucucugguuaga

SEQ ID NO: 150299 - RNA, 22 nt, Human
caggugccucugccccacgcgg

SEQ ID NO: 150300 - RNA, 22 nt, Human
cagcuucaaaggcccugauggu

SEQ ID NO: 150301 - RNA, 22 nt, Human
auccugugggguauugcugcau

SEQ ID NO: 150302 - RNA, 22 nt, Human
auccuggcuuuccugauuuacu

SEQ ID NO: 150303 - RNA, 20 nt, Human
aucugguggggaauaacuuc

SEQ ID NO: 150304 - RNA, 22 nt, Human
aucugugauuuuggcaagauuu

SEQ ID NO: 150305 - RNA, 22 nt, Human
aucugcugccuaggguuugucu

SEQ ID NO: 150306 - RNA, 22 nt, Human
aucugcauguggcagguggauu

SEQ ID NO: 150307 - RNA, 22 nt, Human
aucuguuccccuaugcucucua

SEQ ID NO: 150308 - RNA, 23 nt, Human
aucgcccggguccagucccggcu

SEQ ID NO: 150309 - RNA, 22 nt, Human
aucguggcacgucgccgcagcg

SEQ ID NO: 150310 - RNA, 22 nt, Human
aucggggaaugaccuuuucauu

SEQ ID NO: 150311 - RNA, 22 nt, Human
aucguuaugauagagaaagaga

SEQ ID NO: 150312 - RNA, 22 nt, Human
aucuacuuugggaguuucucuu

SEQ ID NO: 150313 - RNA, 22 nt, Human
aucuucaaagcacaucguuugu

SEQ ID NO: 150314 - RNA, 22 nt, Human
aucuucaaggacgccaagaucc

SEQ ID NO: 150315 - RNA, 22 nt, Human
aucuucaggggcaauggagaua

SEQ ID NO: 150316 - RNA, 23 nt, Human
aucugagccuggucccacccgcu

SEQ ID NO: 150317 - RNA, 22 nt, Human
aucuuggauccuuugccagcuu

SEQ ID NO: 150318 - RNA, 22 nt, Human
aucuuggccuucuccuggagug

SEQ ID NO: 150319 - RNA, 22 nt, Human
aucuaggguuuagggaccauuu

SEQ ID NO: 150320 - RNA, 22 nt, Human
aucucacuucugucauguggca

SEQ ID NO: 150321 - RNA, 22 nt, Human
augacagcucuagcacacagua

SEQ ID NO: 150322 - RNA, 22 nt, Human
augacagcuaaggaauguguag

SEQ ID NO: 150323 - RNA, 22 nt, Human
augaacugcaguauaaacuugg

SEQ ID NO: 150324 - RNA, 22 nt, Human
augaaugccggucucgggggaa

SEQ ID NO: 150325 - RNA, 22 nt, Human
aucugugguacaugacggcugc

SEQ ID NO: 150326 - RNA, 22 nt, Human
augaaacucuagcuuucagcac

SEQ ID NO: 150327 - RNA, 22 nt, Human
augcaguuagguaauagucuca

SEQ ID NO: 150328 - RNA, 22 nt, Human
augcugcuccuuuucaggcauu

SEQ ID NO: 150329 - RNA, 22 nt, Human
augcuuuauuggagacagucau

SEQ ID NO: 150330 - RNA, 22 nt, Human
augcccugggagugcuguacca

SEQ ID NO: 150331 - RNA, 22 nt, Human
augccaccucuucugauuccag

SEQ ID NO: 150332 - RNA, 17 nt, Human
augcccagggcucccug

SEQ ID NO: 150333 - RNA, 22 nt, Human
augccacuguuuaugucacuua

SEQ ID NO: 150334 - RNA, 22 nt, Human
augcccagaacccccuggaugg

SEQ ID NO: 150335 - RNA, 22 nt, Human
auggagcagagcugaugggccu

SEQ ID NO: 150336 - RNA, 22 nt, Human
auggagcgggaggauggaggag

SEQ ID NO: 150337 - RNA, 22 nt, Human
augcugccuccucuucagccgc

SEQ ID NO: 150338 - RNA, 22 nt, Human
auggaguguggccaggcaguaa

SEQ ID NO: 150339 - RNA, 22 nt, Human
augcugccuaaagcuacuuaca

SEQ ID NO: 150340 - RNA, 22 nt, Human
auggggucagagaauggugggu

SEQ ID NO: 150341 - RNA, 22 nt, Human
augggggccagggacccuggca

SEQ ID NO: 150342 - RNA, 22 nt, Human
augggcggugcauuugcacagu

SEQ ID NO: 150343 - RNA, 22 nt, Human
augggcuuuacccucagagcuu

SEQ ID NO: 150344 - RNA, 22 nt, Human
auggggaauugaccguggaucu

SEQ ID NO: 150345 - RNA, 22 nt, Human
augggugggagugaaggggcuc

SEQ ID NO: 150346 - RNA, 22 nt, Human
auggaggagcagaggguuucca

SEQ ID NO: 150347 - RNA, 22 nt, Human
auggaggaugugcagcaugggc

SEQ ID NO: 150348 - RNA, 22 nt, Human
auggauuggguugauggcauac

SEQ ID NO: 150349 - RNA, 22 nt, Human
auggcagcggagcuggaaauga

SEQ ID NO: 150350 - RNA, 22 nt, Human
auggccguggccagggucaggg

SEQ ID NO: 150351 - RNA, 22 nt, Human
augggcauggauggccgagucu

SEQ ID NO: 150352 - RNA, 22 nt, Human
auggaagagacaaugcuaucug

SEQ ID NO: 150353 - RNA, 22 nt, Human
auggaacccgggcgucugcucu

SEQ ID NO: 150354 - RNA, 22 nt, Human
augguuacgcccucacccuacc

SEQ ID NO: 150355 - RNA, 22 nt, Human
augggucccuggccgcccucgg

SEQ ID NO: 150356 - RNA, 22 nt, Human
auggugaaaugauuugauguca

SEQ ID NO: 150357 - RNA, 22 nt, Human
auggugaugaugaugaugauaa

SEQ ID NO: 150358 - RNA, 22 nt, Human
auggggaggcggauggagugcu

SEQ ID NO: 150359 - RNA, 22 nt, Human
auggggaucugcaguguugauc

SEQ ID NO: 150360 - RNA, 22 nt, Human
auguuguugaacucuuugcaug

SEQ ID NO: 150361 - RNA, 22 nt, Human
augugcacuggugugugcguuc

SEQ ID NO: 150362 - RNA, 22 nt, Human
augugggugaggaggccauugu

SEQ ID NO: 150363 - RNA, 21 nt, Human
auguguucugauagugcuugc

SEQ ID NO: 150364 - RNA, 22 nt, Human
augugcucaggucuauaucuca

SEQ ID NO: 150365 - RNA, 23 nt, Human
auuugcugaucguagaugacuag

SEQ ID NO: 150366 - RNA, 22 nt, Human
auuucauccauuaagaguacuc

SEQ ID NO: 150367 - RNA, 22 nt, Human
auugcaggucguguggaaguga

SEQ ID NO: 150368 - RNA, 22 nt, Human
auugauuuugugcuuuccuacg

SEQ ID NO: 150369 - RNA, 22 nt, Human
auuggcugucagcccggauggg

SEQ ID NO: 150370 - RNA, 22 nt, Human
auuggccaguggacagcgccgu

SEQ ID NO: 150371 - RNA, 22 nt, Human
auuguucuagaauuuuuuuucc

SEQ ID NO: 150372 - RNA, 22 nt, Human
caaaggagcccuuugccggguu

SEQ ID NO: 150373 - RNA, 22 nt, Human
caaaggaauuacauguuucgga

SEQ ID NO: 150374 - RNA, 22 nt, Human
auuuuuucaugugugguugaga

SEQ ID NO: 150375 - RNA, 19 nt, Human
caagagcaaagucuuauga

SEQ ID NO: 150376 - RNA, 22 nt, Human
caagagcgugugcagggcaagu

SEQ ID NO: 150377 - RNA, 22 nt, Human
auuuuaccauuaguuuguaaua

SEQ ID NO: 150378 - RNA, 19 nt, Human
auuuccuggcauauaucac

SEQ ID NO: 150379 - RNA, 22 nt, Human
auuucuguaauucugaggagug

SEQ ID NO: 150380 - RNA, 22 nt, Human
auuuuggguguuaacaaugaaa

SEQ ID NO: 150381 - RNA, 22 nt, Human
auucucugaugcagguggaaga

SEQ ID NO: 150382 - RNA, 22 nt, Human
auucuucauguugaagcuguca

SEQ ID NO: 150383 - RNA, 22 nt, Human
auuccagggaaauggggaugga

SEQ ID NO: 150384 - RNA, 22 nt, Human
auugacuuucccuucuccucau

SEQ ID NO: 150385 - RNA, 22 nt, Human
auucuccucaaaacaucugcug

SEQ ID NO: 150386 - RNA, 22 nt, Human
auucgaucacugccgaggaccu

SEQ ID NO: 150387 - RNA, 22 nt, Human
auucgcggcuugaucugcuugc

SEQ ID NO: 150388 - RNA, 22 nt, Human
auucuacgcuccgucucuauca

SEQ ID NO: 150389 - RNA, 22 nt, Human
auguuguuuauggguuaucaag

SEQ ID NO: 150390 - RNA, 22 nt, Human
auguugcugauccuguggcugu

SEQ ID NO: 150391 - RNA, 22 nt, Human
auucguguauauacacauccac

SEQ ID NO: 150392 - RNA, 22 nt, Human
auucugcaauaaucaguccuua

SEQ ID NO: 150393 - RNA, 22 nt, Human
auucauuuuuacaucaccaaua

SEQ ID NO: 150394 - RNA, 22 nt, Human
auucuguugguuuaauagucaa

SEQ ID NO: 150395 - RNA, 22 nt, Human
auucaccaucuugauccccucu

SEQ ID NO: 150396 - RNA, 22 nt, Human
uuucagguggaaguuuuagaug

SEQ ID NO: 150397 - RNA, 22 nt, Human
uuucagauuauguucauggguu

SEQ ID NO: 150398 - RNA, 21 nt, Human
uuuccagaggcagccggacuc

SEQ ID NO: 150399 - RNA, 22 nt, Human
uuucauggaggccaggacagag

SEQ ID NO: 150400 - RNA, 22 nt, Human
uuucauguuggauacuguuuca

SEQ ID NO: 150401 - RNA, 22 nt, Human
uuucgcuuguucggagugcuuu

SEQ ID NO: 150402 - RNA, 22 nt, Human
uuucgggauuucaaagagcaaa

SEQ ID NO: 150403 - RNA, 22 nt, Human
uuuccuucccuccugggccuuc

SEQ ID NO: 150404 - RNA, 22 nt, Human
uuucuguuuguaacuccagcaa

SEQ ID NO: 150405 - RNA, 22 nt, Human
uuucuuugggcccuggcagucu

SEQ ID NO: 150406 - RNA, 22 nt, Human
uuucuuugcugguuggcucucc

SEQ ID NO: 150407 - RNA, 22 nt, Human
uuucugcuuucuaguugguguu

SEQ ID NO: 150408 - RNA, 22 nt, Human
uuucuggacuaaagggagagau

SEQ ID NO: 150409 - RNA, 22 nt, Human
uuugccggaucugucuccagcu

SEQ ID NO: 150410 - RNA, 22 nt, Human
uuugcaggaaauguacugaaug

SEQ ID NO: 150411 - RNA, 22 nt, Human
uuugagaaugucaaucacaaga

SEQ ID NO: 150412 - RNA, 22 nt, Human
uuugagugcccauguuucccag

SEQ ID NO: 150413 - RNA, 22 nt, Human
uuugaugagaaaugacuuaagu

SEQ ID NO: 150414 - RNA, 22 nt, Human
uuuggaugcugucauaugcugc

SEQ ID NO: 150415 - RNA, 22 nt, Human
uuuggcaagcagaugaagguag

SEQ ID NO: 150416 - RNA, 22 nt, Human
uuuggcgucucucaggagcuca

SEQ ID NO: 150417 - RNA, 22 nt, Human
uuuggccauuuguaugcaugau

SEQ ID NO: 150418 - RNA, 22 nt, Human
uuuggcaccuccaaggacucgc

SEQ ID NO: 150419 - RNA, 22 nt, Human
uuuggugacuguaggaaaggau

SEQ ID NO: 150420 - RNA, 22 nt, Human
uuuggucuggaaucuucagggu

SEQ ID NO: 150421 - RNA, 22 nt, Human
uuuggucaucaaagacaaguaa

SEQ ID NO: 150422 - RNA, 22 nt, Human
uuguugcuguugaacccugcug

SEQ ID NO: 150423 - RNA, 20 nt, Human
uuguuagguucaguguuucc

SEQ ID NO: 150424 - RNA, 18 nt, Human
uuuacgaacucacuugag

SEQ ID NO: 150425 - RNA, 22 nt, Human
uuucacugaguaggagagcacu

SEQ ID NO: 150426 - RNA, 22 nt, Human
uuuauuuggugguguuacuguu

SEQ ID NO: 150427 - RNA, 22 nt, Human
uuuauuugggauuucucaucug

SEQ ID NO: 150428 - RNA, 22 nt, Human
uuggccauuacugagccuggag

SEQ ID NO: 150429 - RNA, 22 nt, Human
uuggauguggggauggaguggg

SEQ ID NO: 150430 - RNA, 22 nt, Human
uuggaguucuucaugcucugua

SEQ ID NO: 150431 - RNA, 22 nt, Human
uuggaggccacagucaucuuua

SEQ ID NO: 150432 - RNA, 20 nt, Human
uuggagaucacguguccagg

SEQ ID NO: 150433 - RNA, 22 nt, Human
uugauuugcagaagguguagag

SEQ ID NO: 150434 - RNA, 22 nt, Human
uuggcgcuauuauuaccacauu

SEQ ID NO: 150435 - RNA, 22 nt, Human
uuggccuaggcacaggcaggug

SEQ ID NO: 150436 - RNA, 22 nt, Human
uuggccuuacgcauggucggca

SEQ ID NO: 150437 - RNA, 22 nt, Human
uuggccaaggaccuuuuuggag

SEQ ID NO: 150438 - RNA, 22 nt, Human
uugggauuggugggguggguuu

SEQ ID NO: 150439 - RNA, 22 nt, Human
uugggagagaaaccuaaugccu

SEQ ID NO: 150440 - RNA, 22 nt, Human
uugguugcugaugagcuuugag

SEQ ID NO: 150441 - RNA, 22 nt, Human
uuggggaugccccuacgggcua

SEQ ID NO: 150442 - RNA, 20 nt, Human
uuggggacaggagugugaug

SEQ ID NO: 150443 - RNA, 22 nt, Human
uugguuaccuucagaaaugagu

SEQ ID NO: 150444 - RNA, 22 nt, Human
uugguguuucacuuccuugucg

SEQ ID NO: 150445 - RNA, 22 nt, Human
uugucaguggccugaggacaga

SEQ ID NO: 150446 - RNA, 23 nt, Human
uugugcggugcuuuggguuuaca

SEQ ID NO: 150447 - RNA, 22 nt, Human
uugugcucaguuguggucuauu

SEQ ID NO: 150448 - RNA, 22 nt, Human
uucggugagcugcgggcgagga

SEQ ID NO: 150449 - RNA, 22 nt, Human
uuuuccgaccuuaggaaggaac

SEQ ID NO: 150450 - RNA, 22 nt, Human
uuuuagccagcaucugggucga

SEQ ID NO: 150451 - RNA, 22 nt, Human
uuuucggggcgacuuagguucu

SEQ ID NO: 150452 - RNA, 22 nt, Human
uuuuccuugagucggggcacag

SEQ ID NO: 150453 - RNA, 22 nt, Human
uuuucuucucauucugaccuca

SEQ ID NO: 150454 - RNA, 22 nt, Human
uucuuccagugaaacgugcauc

SEQ ID NO: 150455 - RNA, 22 nt, Human
uucuucgacuguauaaaaguau

SEQ ID NO: 150456 - RNA, 22 nt, Human
uuuuguggacugauccgaggac

SEQ ID NO: 150457 - RNA, 20 nt, Human
uuuuguccaccugcaggaag

SEQ ID NO: 150458 - RNA, 22 nt, Human
uucuuuguccuagcauucuaca

SEQ ID NO: 150459 - RNA, 22 nt, Human
uucuuucgaacaagagaaguuc

SEQ ID NO: 150460 - RNA, 22 nt, Human
uucacguuguugaagaaaauac

SEQ ID NO: 150461 - RNA, 22 nt, Human
uucaccucuuuuuggggacauc

SEQ ID NO: 150462 - RNA, 20 nt, Human
uucacggaggccgcgccccc

SEQ ID NO: 150463 - RNA, 22 nt, Human
uucacucagagcaggacagccc

SEQ ID NO: 150464 - RNA, 22 nt, Human
uuugauuuuuugagcaguguau

SEQ ID NO: 150465 - RNA, 22 nt, Human
uucaaccuucagcuugaguugg

SEQ ID NO: 150466 - RNA, 21 nt, Human
uucaaccagcaauuggcagaa

SEQ ID NO: 150467 - RNA, 20 nt, Human
uucacagaucucuaacugag

SEQ ID NO: 150468 - RNA, 22 nt, Human
uuugcugggaagccuucacucu

SEQ ID NO: 150469 - RNA, 22 nt, Human
uuugcuguaaugcaugucagag

SEQ ID NO: 150470 - RNA, 22 nt, Human
uucaggugguuuaagaauugga

SEQ ID NO: 150471 - RNA, 22 nt, Human
uucaucauuuuccauuccucuu

SEQ ID NO: 150472 - RNA, 20 nt, Human
uucaggaccuuccaguccau

SEQ ID NO: 150473 - RNA, 22 nt, Human
uuuggcuaccugggagggaaag

SEQ ID NO: 150474 - RNA, 22 nt, Human
uuuggcuccccaggaucugaaa

SEQ ID NO: 150475 - RNA, 22 nt, Human
uucccgcugcuggaguuggggc

SEQ ID NO: 150476 - RNA, 23 nt, Human
uuuguugguuuaagaguagcaga

SEQ ID NO: 150477 - RNA, 20 nt, Human
uucaugcagugguugcugug

SEQ ID NO: 150478 - RNA, 22 nt, Human
uuccaaggagagcucgaccuca

SEQ ID NO: 150479 - RNA, 22 nt, Human
uuccugcuggucaaaguugccu

SEQ ID NO: 150480 - RNA, 22 nt, Human
uuccuguggggugucaucauag

SEQ ID NO: 150481 - RNA, 21 nt, Human
uuccuggaggcagaaacguga

SEQ ID NO: 150482 - RNA, 22 nt, Human
uguguguguguguguaauauau

SEQ ID NO: 150483 - RNA, 22 nt, Human
uuggauugugaaaguauucucu

SEQ ID NO: 150484 - RNA, 22 nt, Human
ugugugugugugugugugugug

SEQ ID NO: 150485 - RNA, 22 nt, Human
uguguguguccucauuugcaga

SEQ ID NO: 150486 - RNA, 22 nt, Human
uguguguguguguaugugcgug

SEQ ID NO: 150487 - RNA, 22 nt, Human
uguguguguauacauguauaua

SEQ ID NO: 150488 - RNA, 22 nt, Human
ugugugcacguacauacuguau

SEQ ID NO: 150489 - RNA, 22 nt, Human
ugugucuuuggcgaugucugga

SEQ ID NO: 150490 - RNA, 22 nt, Human
uuggaagagagauggggagaga

SEQ ID NO: 150491 - RNA, 21 nt, Human
uguguaccuucuuccgagcuc

SEQ ID NO: 150492 - RNA, 22 nt, Human
uuggaaguggcaaaggcuaaag

SEQ ID NO: 150493 - RNA, 23 nt, Human
uguuccugaugccucguccuguc

SEQ ID NO: 150494 - RNA, 22 nt, Human
uguuccacgcguaguuccugcu

SEQ ID NO: 150495 - RNA, 22 nt, Human
uuggcguuuccuguucugggug

SEQ ID NO: 150496 - RNA, 22 nt, Human
uguucggaaaagggcaagcuau

SEQ ID NO: 150497 - RNA, 22 nt, Human
uguuccuggggaccugccuucc

SEQ ID NO: 150498 - RNA, 22 nt, Human
uuggcaaaagauuggguacuua

SEQ ID NO: 150499 - RNA, 22 nt, Human
uguguucagaagaggcugccgg

SEQ ID NO: 150500 - RNA, 22 nt, Human
uuggccaaaaaagucauuagaa

SEQ ID NO: 150501 - RNA, 22 nt, Human
uuggcauuccagaugcuuuucu

SEQ ID NO: 150502 - RNA, 22 nt, Human
uguguuucucugaggggucccu

SEQ ID NO: 150503 - RNA, 22 nt, Human
uguguuguuggggauguuuuca

SEQ ID NO: 150504 - RNA, 22 nt, Human
uuguauuaauacacuccuuuuc

SEQ ID NO: 150505 - RNA, 22 nt, Human
uugucagcuagugaugcuguuc

SEQ ID NO: 150506 - RNA, 22 nt, Human
uguuguucuuuuucuucuuguu

SEQ ID NO: 150507 - RNA, 22 nt, Human
uguuguuguuguuguuguuguu

SEQ ID NO: 150508 - RNA, 22 nt, Human
uguuuaagugguuaaaggauuc

SEQ ID NO: 150509 - RNA, 22 nt, Human
uuggucaagacugauaucaaga

SEQ ID NO: 150510 - RNA, 22 nt, Human
uuggguguugguuccugggagg

SEQ ID NO: 150511 - RNA, 22 nt, Human
uugggugcugcacccuucaaca

SEQ ID NO: 150512 - RNA, 22 nt, Human
uugggucagcuuucagguagua

SEQ ID NO: 150513 - RNA, 22 nt, Human
uugggucaugggaucccagcau

SEQ ID NO: 150514 - RNA, 22 nt, Human
uuggggggucagacuugauaca

SEQ ID NO: 150515 - RNA, 22 nt, Human
uuggggcugcguauuuccaugu

SEQ ID NO: 150516 - RNA, 22 nt, Human
uuggggauugggugcaagggac

SEQ ID NO: 150517 - RNA, 22 nt, Human
uugucuguacuggcugcaucga

SEQ ID NO: 150518 - RNA, 22 nt, Human
uuguggcaggauggacagcaga

SEQ ID NO: 150519 - RNA, 22 nt, Human
uuguggacgcaauucaaggaua

SEQ ID NO: 150520 - RNA, 22 nt, Human
uugugcagugccuggacccagg

SEQ ID NO: 150521 - RNA, 22 nt, Human
uuagaugcugugauuuuucaaa

SEQ ID NO: 150522 - RNA, 22 nt, Human
uuguuucauggggacgacuggc

SEQ ID NO: 150523 - RNA, 22 nt, Human
uuguuccagaaacccaggggaa

SEQ ID NO: 150524 - RNA, 22 nt, Human
uugugugugcccaccuguggcc

SEQ ID NO: 150525 - RNA, 22 nt, Human
uugaauggaauuggaaucuuau

SEQ ID NO: 150526 - RNA, 22 nt, Human
uugaccagaaaaguuaguaauu

SEQ ID NO: 150527 - RNA, 22 nt, Human
uugaccauguggcccaggccaa

SEQ ID NO: 150528 - RNA, 22 nt, Human
uugacguccucgauggggaacu

SEQ ID NO: 150529 - RNA, 22 nt, Human
uugagcagccauuagcuggggu

SEQ ID NO: 150530 - RNA, 22 nt, Human
ugucagacagggcugcagucag

SEQ ID NO: 150531 - RNA, 21 nt, Human
ugucagcaacaauacuuucuc

SEQ ID NO: 150532 - RNA, 22 nt, Human
ugucagccacggugugaccggc

SEQ ID NO: 150533 - RNA, 22 nt, Human
uugauagauuuuagaggcaggc

SEQ ID NO: 150534 - RNA, 22 nt, Human
uugaggguggauugucagggga

SEQ ID NO: 150535 - RNA, 22 nt, Human
uugaggaagggaggcaaaacug

SEQ ID NO: 150536 - RNA, 22 nt, Human
uugaugacuaaagaaagcugcu

SEQ ID NO: 150537 - RNA, 22 nt, Human
ugucccuggacuccaggagcca

SEQ ID NO: 150538 - RNA, 22 nt, Human
uguccagcuauauguguaugug

SEQ ID NO: 150539 - RNA, 22 nt, Human
uguccccugcccagggauggga

SEQ ID NO: 150540 - RNA, 22 nt, Human
ugucuucagguuccucaccacu

SEQ ID NO: 150541 - RNA, 22 nt, Human
ugucugucugccauuuauucuc

SEQ ID NO: 150542 - RNA, 22 nt, Human
ugucugggauguuggcagccac

SEQ ID NO: 150543 - RNA, 20 nt, Human
ugucugguaagacgcccauc

SEQ ID NO: 150544 - RNA, 22 nt, Human
uugccaggagacaucuggagcc

SEQ ID NO: 150545 - RNA, 22 nt, Human
uugccgacuggccaaggaguaa

SEQ ID NO: 150546 - RNA, 22 nt, Human
uugcauauguccagccaugcau

SEQ ID NO: 150547 - RNA, 22 nt, Human
uugcaucaaauauguaccacag

SEQ ID NO: 150548 - RNA, 20 nt, Human
uugcaugcagccggaugcug

SEQ ID NO: 150549 - RNA, 22 nt, Human
ugguugauuaauuuugccaagc

SEQ ID NO: 150550 - RNA, 17 nt, Human
ugguucuuuuccugacc

SEQ ID NO: 150551 - RNA, 22 nt, Human
ugguucugccacuuuccccuug

SEQ ID NO: 150552 - RNA, 22 nt, Human
uggugcucucgauauauaaggc

SEQ ID NO: 150553 - RNA, 22 nt, Human
uggugcucuugauauauaaggc

SEQ ID NO: 150554 - RNA, 22 nt, Human
uggugcuuuuguggaugcuaac

SEQ ID NO: 150555 - RNA, 22 nt, Human
uggugccuuccgagagcuguga

SEQ ID NO: 150556 - RNA, 22 nt, Human
uggugcacgugggcagucggcc

SEQ ID NO: 150557 - RNA, 22 nt, Human
uggucugggaagaucacaauua

SEQ ID NO: 150558 - RNA, 22 nt, Human
uggugacaucuaccuagguaaa

SEQ ID NO: 150559 - RNA, 22 nt, Human
uucuuugcucaccugccgcucc

SEQ ID NO: 150560 - RNA, 22 nt, Human
ugguguccccugaguuucuauc

SEQ ID NO: 150561 - RNA, 22 nt, Human
ugguuacagaugaagaucggcc

SEQ ID NO: 150562 - RNA, 23 nt, Human
uggugugaggaaggaagacuuua

SEQ ID NO: 150563 - RNA, 22 nt, Human
uggugugggauccugggaagga

SEQ ID NO: 150564 - RNA, 20 nt, Human
ugguguccuaugcuugugcu

SEQ ID NO: 150565 - RNA, 22 nt, Human
uucuucuucuuccucauccuca

SEQ ID NO: 150566 - RNA, 22 nt, Human
uucuucuguuggcagagcauac

SEQ ID NO: 150567 - RNA, 22 nt, Human
uucuugcgaaagaaugagcuga

SEQ ID NO: 150568 - RNA, 22 nt, Human
uucuccucuuugucacugcuuu

SEQ ID NO: 150569 - RNA, 22 nt, Human
uucuccugcccuuggacuucca

SEQ ID NO: 150570 - RNA, 22 nt, Human
ugggguuuuagagcaggcagag

SEQ ID NO: 150571 - RNA, 22 nt, Human
uggguagcucaauagagccaca

SEQ ID NO: 150572 - RNA, 22 nt, Human
uggggcuccuccuggcaggagg

SEQ ID NO: 150573 - RNA, 22 nt, Human
uggggcuccaguagagaaggca

SEQ ID NO: 150574 - RNA, 22 nt, Human
uggggcggaaggaggagaggug

SEQ ID NO: 150575 - RNA, 22 nt, Human
uggggcgccuggcugaggcugc

SEQ ID NO: 150576 - RNA, 22 nt, Human
uucuaggagucugguuccugcc

SEQ ID NO: 150577 - RNA, 22 nt, Human
ugggugugcaccuacgaucucu

SEQ ID NO: 150578 - RNA, 22 nt, Human
uggguguuccuggggugcaagg

SEQ ID NO: 150579 - RNA, 22 nt, Human
uggguggugaaauggaugggaa

SEQ ID NO: 150580 - RNA, 22 nt, Human
ugggugccgcaucuugcuguuc

SEQ ID NO: 150581 - RNA, 22 nt, Human
uucucgaacaaccuacagggug

SEQ ID NO: 150582 - RNA, 22 nt, Human
ugggugaugagguccccagccc

SEQ ID NO: 150583 - RNA, 20 nt, Human
uggguucaguuguuucuggc

SEQ ID NO: 150584 - RNA, 22 nt, Human
uggguucugaucccaggacugc

SEQ ID NO: 150585 - RNA, 23 nt, Human
uggguuucagugccaaugcugcc

SEQ ID NO: 150586 - RNA, 22 nt, Human
uggguguguccauauuuugacu

SEQ ID NO: 150587 - RNA, 18 nt, Human
uucugcggugacagauau

SEQ ID NO: 150588 - RNA, 22 nt, Human
uucugcuagugguauauguuga

SEQ ID NO: 150589 - RNA, 22 nt, Human
ugguagacaacagcagugggac

SEQ ID NO: 150590 - RNA, 22 nt, Human
uucuggagacccagcaacaggg

SEQ ID NO: 150591 - RNA, 22 nt, Human
uucuggacuuccaaauggcuuc

SEQ ID NO: 150592 - RNA, 22 nt, Human
uggucacagauuuacaggaaug

SEQ ID NO: 150593 - RNA, 22 nt, Human
uggucacgucgggguauugcca

SEQ ID NO: 150594 - RNA, 22 nt, Human
ugguaugaaggaggccggcagc

SEQ ID NO: 150595 - RNA, 21 nt, Human
ugguccaaggacucauaccug

SEQ ID NO: 150596 - RNA, 22 nt, Human
uucuggggccgugacgaggggc

SEQ ID NO: 150597 - RNA, 22 nt, Human
uucuggaguuugaagaucaggu

SEQ ID NO: 150598 - RNA, 22 nt, Human
uucuguacuagaucuuaucagu

SEQ ID NO: 150599 - RNA, 22 nt, Human
uggagccuugugagaccacaau

SEQ ID NO: 150600 - RNA, 22 nt, Human
uggagcugaaguacucucacua

SEQ ID NO: 150601 - RNA, 22 nt, Human
uggagccagcaggacucagagg

SEQ ID NO: 150602 - RNA, 22 nt, Human
uuccaaaugacaaugggcugua

SEQ ID NO: 150603 - RNA, 22 nt, Human
uggcugaggcuuuucuuaaaga

SEQ ID NO: 150604 - RNA, 22 nt, Human
ugggaauuuaugagaaaauaua

SEQ ID NO: 150605 - RNA, 22 nt, Human
ugggaagccaguaucagacuaa

SEQ ID NO: 150606 - RNA, 22 nt, Human
ugggaagcugagccucgaugug

SEQ ID NO: 150607 - RNA, 22 nt, Human
uggcugaugucuguucuguuau

SEQ ID NO: 150608 - RNA, 22 nt, Human
uuccgcuuucaauggcuuggcu

SEQ ID NO: 150609 - RNA, 22 nt, Human
uucccggccgccccccgcucgg

SEQ ID NO: 150610 - RNA, 22 nt, Human
uucccugggggggccgcuuucc

SEQ ID NO: 150611 - RNA, 22 nt, Human
uuccucauuuggcacaucugag

SEQ ID NO: 150612 - RNA, 22 nt, Human
uucggcagaaagucauuugucu

SEQ ID NO: 150613 - RNA, 22 nt, Human
uucgcucuucacacagugcuga

SEQ ID NO: 150614 - RNA, 18 nt, Human
uucgucauggggaucgua

SEQ ID NO: 150615 - RNA, 22 nt, Human
uucgucaauaugcagccuguga

SEQ ID NO: 150616 - RNA, 22 nt, Human
uucgucauuaugcagccuguga

SEQ ID NO: 150617 - RNA, 22 nt, Human
uucgcggccaggcggggaggcc

SEQ ID NO: 150618 - RNA, 22 nt, Human
uuccuggaguggagggagguga

SEQ ID NO: 150619 - RNA, 22 nt, Human
uggggccaggcuguuggcuucc

SEQ ID NO: 150620 - RNA, 22 nt, Human
uuccuucccccuucuuugccuu

SEQ ID NO: 150621 - RNA, 22 nt, Human
uguuggauuuugugaaauauga

SEQ ID NO: 150622 - RNA, 22 nt, Human
ugcuccucugcaugucugcggc

SEQ ID NO: 150623 - RNA, 23 nt, Human
uguuggcucccagucucccccuc

SEQ ID NO: 150624 - RNA, 21 nt, Human
uguugguugugggaaggagga

SEQ ID NO: 150625 - RNA, 22 nt, Human
ugccuggugcggagugaguggc

SEQ ID NO: 150626 - RNA, 21 nt, Human
ugccuggccuuugcuuuuccu

SEQ ID NO: 150627 - RNA, 22 nt, Human
ugccugucuaucuuugucaucu

SEQ ID NO: 150628 - RNA, 22 nt, Human
uguugucaugcagucaguggua

SEQ ID NO: 150629 - RNA, 23 nt, Human
uguuguccaacugaucuccaggc

SEQ ID NO: 150630 - RNA, 22 nt, Human
ugcucugcuaggagaagaauga

SEQ ID NO: 150631 - RNA, 22 nt, Human
uguugguuucaagcaggagccu

SEQ ID NO: 150632 - RNA, 22 nt, Human
ugcuccugaacacagcccuaug

SEQ ID NO: 150633 - RNA, 22 nt, Human
ugcugccgccgccaccgccgcc

SEQ ID NO: 150634 - RNA, 19 nt, Human
ugcugcaggaauucucaag

SEQ ID NO: 150635 - RNA, 22 nt, Human
uguuuagcucugacuaugugau

SEQ ID NO: 150636 - RNA, 20 nt, Human
uguuucccaacaccccaaag

SEQ ID NO: 150637 - RNA, 22 nt, Human
ugcugcggauauacaggaucug

SEQ ID NO: 150638 - RNA, 22 nt, Human
ugcugcacccuucauuuuccca

SEQ ID NO: 150639 - RNA, 22 nt, Human
uguuuucuuuccccuucuuuuc

SEQ ID NO: 150640 - RNA, 22 nt, Human
ugcugcggcgcaggcacuccag

SEQ ID NO: 150641 - RNA, 22 nt, Human
ugcugcucaagcugcagcaaaa

SEQ ID NO: 150642 - RNA, 22 nt, Human
ugcuggaguggcacuguguggc

SEQ ID NO: 150643 - RNA, 22 nt, Human
ugcuggagccauguuuucucua

SEQ ID NO: 150644 - RNA, 22 nt, Human
ugcugguuucugaguaaccaca

SEQ ID NO: 150645 - RNA, 22 nt, Human
ugcuggugauuaaauccugaag

SEQ ID NO: 150646 - RNA, 22 nt, Human
ugcuugaggcuugucaucuaac

SEQ ID NO: 150647 - RNA, 22 nt, Human
ugcuuggagaaucagucccagc

SEQ ID NO: 150648 - RNA, 22 nt, Human
ugcuugggucuguuuugcaaag

SEQ ID NO: 150649 - RNA, 22 nt, Human
ugcuugacucagcaucggcaau

SEQ ID NO: 150650 - RNA, 22 nt, Human
ugcugugcuggcggcagaggcc

SEQ ID NO: 150651 - RNA, 20 nt, Human
ugcuguggguaagcuuuaua

SEQ ID NO: 150652 - RNA, 20 nt, Human
ugcugugugucuacuguggg

SEQ ID NO: 150653 - RNA, 22 nt, Human
uuagggacagcucuguagguga

SEQ ID NO: 150654 - RNA, 22 nt, Human
uggaagcccagaaggaagcaga

SEQ ID NO: 150655 - RNA, 22 nt, Human
uggaagcuagggguuucuguug

SEQ ID NO: 150656 - RNA, 22 nt, Human
uggaagcuggcugaucugacuu

SEQ ID NO: 150657 - RNA, 22 nt, Human
uggaagggguuacgcagcagga

SEQ ID NO: 150658 - RNA, 22 nt, Human
uggaaugccgggccaggcuccg

SEQ ID NO: 150659 - RNA, 21 nt, Human
uggaauuggaaaccauucuau

SEQ ID NO: 150660 - RNA, 22 nt, Human
uggacagugguggggaggagga

SEQ ID NO: 150661 - RNA, 22 nt, Human
uggacagguacuucacauuauu

SEQ ID NO: 150662 - RNA, 22 nt, Human
uggagcaagaagggaggcagaa

SEQ ID NO: 150663 - RNA, 22 nt, Human
uggagaugcacgagcaggugga

SEQ ID NO: 150664 - RNA, 22 nt, Human
uggacuguaauguguguggacc

SEQ ID NO: 150665 - RNA, 22 nt, Human
uggacccaccccagggccugcu

SEQ ID NO: 150666 - RNA, 22 nt, Human
uggaaaugcuuagaggugaucu

SEQ ID NO: 150667 - RNA, 22 nt, Human
ugcuuuccuucccuauguugag

SEQ ID NO: 150668 - RNA, 22 nt, Human
ugcuuguuuuguggcuucagcu

SEQ ID NO: 150669 - RNA, 22 nt, Human
uuaccugccucaaacacgaaug

SEQ ID NO: 150670 - RNA, 22 nt, Human
uuaccugcagagacguggaggc

SEQ ID NO: 150671 - RNA, 21 nt, Human
uuacuggcagcagaaaccuga

SEQ ID NO: 150672 - RNA, 22 nt, Human
uggaaaagaugucuuccugaau

SEQ ID NO: 150673 - RNA, 22 nt, Human
ugggucagauacaguguuuggu

SEQ ID NO: 150674 - RNA, 22 nt, Human
uggguccaggauucuguguuuc

SEQ ID NO: 150675 - RNA, 22 nt, Human
ugggucaguagccuugcagaac

SEQ ID NO: 150676 - RNA, 22 nt, Human
ugaccucugagcaaggcagagg

SEQ ID NO: 150677 - RNA, 22 nt, Human
ugggucacuggccaagcucgac

SEQ ID NO: 150678 - RNA, 22 nt, Human
ugaccucaagcaugcggagggc

SEQ ID NO: 150679 - RNA, 22 nt, Human
ugggugggcagagucuaagaua

SEQ ID NO: 150680 - RNA, 22 nt, Human
uggguggauucgggaacuuguu

SEQ ID NO: 150681 - RNA, 22 nt, Human
ugacugaggaaggugggguggg

SEQ ID NO: 150682 - RNA, 22 nt, Human
ugggugugggguaggguaagag

SEQ ID NO: 150683 - RNA, 22 nt, Human
uggguguggaagcagcgugggg

SEQ ID NO: 150684 - RNA, 22 nt, Human
ugagacuuggggggcugagggc

SEQ ID NO: 150685 - RNA, 22 nt, Human
ugagaggaagggaaagaugauu

SEQ ID NO: 150686 - RNA, 22 nt, Human
ugagagguagaacuuguagugu

SEQ ID NO: 150687 - RNA, 22 nt, Human
ugguccaaaccagugcuguggu

SEQ ID NO: 150688 - RNA, 22 nt, Human
ugguccaccgccucauucucug

SEQ ID NO: 150689 - RNA, 22 nt, Human
uggucccugaagagagaccuug

SEQ ID NO: 150690 - RNA, 22 nt, Human
ugguccaugcuccaggcacauu

SEQ ID NO: 150691 - RNA, 22 nt, Human
uggucaagcaaugaauuuauuu

SEQ ID NO: 150692 - RNA, 22 nt, Human
ugguaacgguuuccuugccauu

SEQ ID NO: 150693 - RNA, 20 nt, Human
ugagaaacaagggcuggucu

SEQ ID NO: 150694 - RNA, 22 nt, Human
uggguucaaauccugguuccac

SEQ ID NO: 150695 - RNA, 21 nt, Human
ugguguacauuuccauaguuu

SEQ ID NO: 150696 - RNA, 20 nt, Human
ugguguacauuuccauaguu

SEQ ID NO: 150697 - RNA, 22 nt, Human
ugguggccucaguggcuucugu

SEQ ID NO: 150698 - RNA, 22 nt, Human
ugaggaugaggaagaagaagaa

SEQ ID NO: 150699 - RNA, 22 nt, Human
ugaggaggugggcacacagagu

SEQ ID NO: 150700 - RNA, 22 nt, Human
ugaggaugagaaggaagagaag

SEQ ID NO: 150701 - RNA, 22 nt, Human
ugguucggcuguaaguauaucu

SEQ ID NO: 150702 - RNA, 22 nt, Human
ugguucacaagaauccagguag

SEQ ID NO: 150703 - RNA, 22 nt, Human
ugagggagggggagccguucua

SEQ ID NO: 150704 - RNA, 19 nt, Human
uggugcgcuguuccugagc

SEQ ID NO: 150705 - RNA, 22 nt, Human
ugguccucacccuacccagcug

SEQ ID NO: 150706 - RNA, 22 nt, Human
ugguccuuuccauuggagacac

SEQ ID NO: 150707 - RNA, 22 nt, Human
uggucggugguguggggaggca

SEQ ID NO: 150708 - RNA, 22 nt, Human
uggucugauggucccaccaccg

SEQ ID NO: 150709 - RNA, 19 nt, Human
ugagauuguaugaggagau

SEQ ID NO: 150710 - RNA, 22 nt, Human
ugagcagccagucauucaaaaa

SEQ ID NO: 150711 - RNA, 22 nt, Human
ugguccgagaacuguccugguu

SEQ ID NO: 150712 - RNA, 22 nt, Human
ugagcagagcacuugggaacga

SEQ ID NO: 150713 - RNA, 22 nt, Human
ugaguccagaugggccagcagg

SEQ ID NO: 150714 - RNA, 22 nt, Human
ugagguugggaggacugccuaa

SEQ ID NO: 150715 - RNA, 22 nt, Human
ugagugcuuuucgguguaccgu

SEQ ID NO: 150716 - RNA, 22 nt, Human
ugagugacuguugucaagaugg

SEQ ID NO: 150717 - RNA, 22 nt, Human
ugguuuccugauggacacuugg

SEQ ID NO: 150718 - RNA, 22 nt, Human
ugguucugucugugcugggggg

SEQ ID NO: 150719 - RNA, 19 nt, Human
ugaucuccaguacagacau

SEQ ID NO: 150720 - RNA, 20 nt, Human
ugauccacucucauugcucu

SEQ ID NO: 150721 - RNA, 20 nt, Human
ugauaugcgguacagagagg

SEQ ID NO: 150722 - RNA, 22 nt, Human
ugucacuuaagguuggugucuc

SEQ ID NO: 150723 - RNA, 22 nt, Human
ugcaagugccauggauucaggu

SEQ ID NO: 150724 - RNA, 22 nt, Human
ugucauuggugaucugaugccu

SEQ ID NO: 150725 - RNA, 22 nt, Human
uguccuauuugugauaggugac

SEQ ID NO: 150726 - RNA, 20 nt, Human
ugucccuggagagcugcaga

SEQ ID NO: 150727 - RNA, 22 nt, Human
ugauuuggcaucaguguauccu

SEQ ID NO: 150728 - RNA, 22 nt, Human
ugauuugguauccaggauuuaa

SEQ ID NO: 150729 - RNA, 22 nt, Human
ugauuuagguauuuucuuuugu

SEQ ID NO: 150730 - RNA, 22 nt, Human
ugcagaauauucuggugacaau

SEQ ID NO: 150731 - RNA, 22 nt, Human
ugcagaacacaguagacagaac

SEQ ID NO: 150732 - RNA, 22 nt, Human
ugcaauggauaucugaacgugg

SEQ ID NO: 150733 - RNA, 22 nt, Human
ugucugauccuucaggagcccc

SEQ ID NO: 150734 - RNA, 19 nt, Human
ugcagcacuaaaaacuuuc

SEQ ID NO: 150735 - RNA, 22 nt, Human
ugcagcagaauauggcugcagg

SEQ ID NO: 150736 - RNA, 22 nt, Human
ugcagccucacgcauccgcauu

SEQ ID NO: 150737 - RNA, 22 nt, Human
ugugagccuuuauuaaccucau

SEQ ID NO: 150738 - RNA, 22 nt, Human
ugccaaugauuccacaauggaa

SEQ ID NO: 150739 - RNA, 22 nt, Human
ugccagcuccgaggagcugcag

SEQ ID NO: 150740 - RNA, 22 nt, Human
ugcauguuauuguggcaagaau

SEQ ID NO: 150741 - RNA, 22 nt, Human
ugcauguuuuaagugaagcuga

SEQ ID NO: 150742 - RNA, 22 nt, Human
ugcauguuucuguauguuaaug

SEQ ID NO: 150743 - RNA, 22 nt, Human
ugcccagcagggagcuaccugg

SEQ ID NO: 150744 - RNA, 22 nt, Human
ugccccuggaggagagcaaugg

SEQ ID NO: 150745 - RNA, 22 nt, Human
ugcccccggcugcccaggggaa

SEQ ID NO: 150746 - RNA, 22 nt, Human
ugccaauuaccuauuucugaga

SEQ ID NO: 150747 - RNA, 23 nt, Human
ugccaggaagaaugaccucugcu

SEQ ID NO: 150748 - RNA, 22 nt, Human
ugcccugcagacccugcagugu

SEQ ID NO: 150749 - RNA, 22 nt, Human
uguggugcagcgggaacagcuu

SEQ ID NO: 150750 - RNA, 22 nt, Human
ugccgccccggggcccccagcc

SEQ ID NO: 150751 - RNA, 22 nt, Human
ugcccugucccuagguuugugg

SEQ ID NO: 150752 - RNA, 22 nt, Human
ugugucgccaacaauugugucu

SEQ ID NO: 150753 - RNA, 22 nt, Human
ugccgggcugagcaagugcugc

SEQ ID NO: 150754 - RNA, 17 nt, Human
uguguauucuccaggug

SEQ ID NO: 150755 - RNA, 23 nt, Human
ugccggaucuacuuuggguucuc

SEQ ID NO: 150756 - RNA, 22 nt, Human
uguguggccuccauaggguacu

SEQ ID NO: 150757 - RNA, 22 nt, Human
ugugauuucaaagggugucuuu

SEQ ID NO: 150758 - RNA, 20 nt, Human
ugcagcucccccgcaguuuc

SEQ ID NO: 150759 - RNA, 22 nt, Human
ugugauugcauugcagauuacu

SEQ ID NO: 150760 - RNA, 22 nt, Human
ugcagugcagcuggaauaucuu

SEQ ID NO: 150761 - RNA, 22 nt, Human
ugugcugcagcgagagcuacga

SEQ ID NO: 150762 - RNA, 22 nt, Human
ugcagugcagcuggaaguuggc

SEQ ID NO: 150763 - RNA, 22 nt, Human
ugcagugaugcuucuggcucag

SEQ ID NO: 150764 - RNA, 22 nt, Human
ugcaugacaauugccgucaagu

SEQ ID NO: 150765 - RNA, 22 nt, Human
ugcaucccugaggcauuauccu

SEQ ID NO: 150766 - RNA, 22 nt, Human
ucugcacagcucaccucccugg

SEQ ID NO: 150767 - RNA, 21 nt, Human
ucugaggagaaacucuuggug

SEQ ID NO: 150768 - RNA, 23 nt, Human
uggaagaaaaugguuuggcugug

SEQ ID NO: 150769 - RNA, 22 nt, Human
ucugauucauucugguaaaugg

SEQ ID NO: 150770 - RNA, 22 nt, Human
ucugaucagaagacaaaugagg

SEQ ID NO: 150771 - RNA, 21 nt, Human
ucuggccuauaaaguagucgc

SEQ ID NO: 150772 - RNA, 22 nt, Human
ucuggugcacucugauauuuga

SEQ ID NO: 150773 - RNA, 22 nt, Human
uggaagucuucucucccaugga

SEQ ID NO: 150774 - RNA, 22 nt, Human
uggaaguggcaggggagacgua

SEQ ID NO: 150775 - RNA, 22 nt, Human
uggaagugggcaucaccaucca

SEQ ID NO: 150776 - RNA, 19 nt, Human
ucuguugcuuuguguccuc

SEQ ID NO: 150777 - RNA, 22 nt, Human
uggauaugaaacaaaacaagag

SEQ ID NO: 150778 - RNA, 22 nt, Human
uggagucucacuuccuggaauu

SEQ ID NO: 150779 - RNA, 22 nt, Human
ucuguguguguggcuaaacaag

SEQ ID NO: 150780 - RNA, 19 nt, Human
ucuguggccuucccugaug

SEQ ID NO: 150781 - RNA, 20 nt, Human
ucuguggcagguggcgcuug

SEQ ID NO: 150782 - RNA, 17 nt, Human
ucuguguccgcucaguc

SEQ ID NO: 150783 - RNA, 22 nt, Human
uggagucagaaugcgacaggcc

SEQ ID NO: 150784 - RNA, 22 nt, Human
ucugugcuccuuccuugucauc

SEQ ID NO: 150785 - RNA, 21 nt, Human
ucugugcuuuuuuggcuccua

SEQ ID NO: 150786 - RNA, 22 nt, Human
ucugucaguguccucguguggu

SEQ ID NO: 150787 - RNA, 21 nt, Human
uggcccgagccgggguuggcu

SEQ ID NO: 150788 - RNA, 21 nt, Human
uggccaaggaauagaagcucu

SEQ ID NO: 150789 - RNA, 22 nt, Human
uggcauuugagcuggaaggaug

SEQ ID NO: 150790 - RNA, 22 nt, Human
uggcauuuuguagcuguguauc

SEQ ID NO: 150791 - RNA, 22 nt, Human
uggcaguugcaguaacuuguau

SEQ ID NO: 150792 - RNA, 22 nt, Human
ucuugcucuguucuaaaggauu

SEQ ID NO: 150793 - RNA, 22 nt, Human
uggcgcgcagccugcuggugcu

SEQ ID NO: 150794 - RNA, 22 nt, Human
uggcgcucacccugcggcccug

SEQ ID NO: 150795 - RNA, 22 nt, Human
uggcggagacauggacuucaga

SEQ ID NO: 150796 - RNA, 22 nt, Human
uggcucaggccuacgacgccuu

SEQ ID NO: 150797 - RNA, 22 nt, Human
uggcuacguacaauggaacuuu

SEQ ID NO: 150798 - RNA, 22 nt, Human
uggcuacauuuauacucucauu

SEQ ID NO: 150799 - RNA, 22 nt, Human
uggcagugagauuucucuucug

SEQ ID NO: 150800 - RNA, 22 nt, Human
ucuuccacuugaaccuucuguc

SEQ ID NO: 150801 - RNA, 22 nt, Human
ucuucaucucuaaaaugggaac

SEQ ID NO: 150802 - RNA, 22 nt, Human
uggcagugggaagcuggaaguc

SEQ ID NO: 150803 - RNA, 22 nt, Human
ucuucccgggcaucucugcuca

SEQ ID NO: 150804 - RNA, 22 nt, Human
ucuuccucuccuggggcauuug

SEQ ID NO: 150805 - RNA, 22 nt, Human
uggcaagcuguuggcagauagc

SEQ ID NO: 150806 - RNA, 22 nt, Human
uggcaaaaccugcaauuacuuu

SEQ ID NO: 150807 - RNA, 23 nt, Human
uggcaaacgggaauaaaggaauu

SEQ ID NO: 150808 - RNA, 20 nt, Human
ucuucagcuccaagucuggc

SEQ ID NO: 150809 - RNA, 22 nt, Human
ugcuugugcacacacauguuau

SEQ ID NO: 150810 - RNA, 22 nt, Human
ugcuuguuuguuuucuuccauu

SEQ ID NO: 150811 - RNA, 19 nt, Human
ucucugguggcuccaucag

SEQ ID NO: 150812 - RNA, 22 nt, Human
ucucugucucccguguguccgg

SEQ ID NO: 150813 - RNA, 22 nt, Human
ugcuucuuugggggugaagaga

SEQ ID NO: 150814 - RNA, 22 nt, Human
ugcuucuuuccuuggugacuuc

SEQ ID NO: 150815 - RNA, 22 nt, Human
ugcuucucucuaggaagacgcu

SEQ ID NO: 150816 - RNA, 22 nt, Human
ugcuucuuuaggauguaguuau

SEQ ID NO: 150817 - RNA, 17 nt, Human
ucuccuggcucuaucag

SEQ ID NO: 150818 - RNA, 22 nt, Human
ugcuuacgcaaccuguguuugg

SEQ ID NO: 150819 - RNA, 22 nt, Human
ucugaccccccuugccuccacu

SEQ ID NO: 150820 - RNA, 21 nt, Human
ugcuuuuguugucagcugcug

SEQ ID NO: 150821 - RNA, 22 nt, Human
ucugagcaggaaagagcagaga

SEQ ID NO: 150822 - RNA, 22 nt, Human
ucugagucgcucccuggaucca

SEQ ID NO: 150823 - RNA, 22 nt, Human
ucugagugacguccugacagga

SEQ ID NO: 150824 - RNA, 23 nt, Human
ugcuuugauuauuauucccaccu

SEQ ID NO: 150825 - RNA, 18 nt, Human
ucugaaggaaugauucca

SEQ ID NO: 150826 - RNA, 22 nt, Human
ugcuuucagauaucuguuucaa

SEQ ID NO: 150827 - RNA, 22 nt, Human
ucucuucggagagaccuuugga

SEQ ID NO: 150828 - RNA, 22 nt, Human
ugcugcuguuuccuacaucuca

SEQ ID NO: 150829 - RNA, 22 nt, Human
ugcugcucuucaccauggccuc

SEQ ID NO: 150830 - RNA, 22 nt, Human
ucucagggaugggaggccccag

SEQ ID NO: 150831 - RNA, 22 nt, Human
ucucauacguuuccagguguca

SEQ ID NO: 150832 - RNA, 22 nt, Human
ugcugggagcugggccucgaca

SEQ ID NO: 150833 - RNA, 20 nt, Human
ugcugggccaucuugcaugc

SEQ ID NO: 150834 - RNA, 22 nt, Human
ugcuggaaggguaguauuaacu

SEQ ID NO: 150835 - RNA, 22 nt, Human
ugcuggagucucuugacccugg

SEQ ID NO: 150836 - RNA, 22 nt, Human
ugcuguacaagacccucuguuu

SEQ ID NO: 150837 - RNA, 22 nt, Human
ucucccaaaucuuucuagcaca

SEQ ID NO: 150838 - RNA, 22 nt, Human
ucuccccucuggucugggcucu

SEQ ID NO: 150839 - RNA, 22 nt, Human
ucucccgcuuccugcuggcugc

SEQ ID NO: 150840 - RNA, 22 nt, Human
ucuccugacaccucuugugggg

SEQ ID NO: 150841 - RNA, 22 nt, Human
ugcuguugacuuuguuguucuu

SEQ ID NO: 150842 - RNA, 22 nt, Human
ucgcuucugaguuggugacccc

SEQ ID NO: 150843 - RNA, 22 nt, Human
ucuagggcaguacaaauucaag

SEQ ID NO: 150844 - RNA, 22 nt, Human
ucgcucgcuggcuccugcccgc

SEQ ID NO: 150845 - RNA, 20 nt, Human
ucgcugcaagggaaauggag

SEQ ID NO: 150846 - RNA, 22 nt, Human
ucgcgcgugccacgcgccgcgg

SEQ ID NO: 150847 - RNA, 22 nt, Human
ugcggaaggcagcgcagggugg

SEQ ID NO: 150848 - RNA, 22 nt, Human
ugcgcgccgacggcuccgugac

SEQ ID NO: 150849 - RNA, 22 nt, Human
ugcggagggagcagucggcugu

SEQ ID NO: 150850 - RNA, 22 nt, Human
ugcgccccgcgggccuucgggc

SEQ ID NO: 150851 - RNA, 22 nt, Human
ucgagaccagcuagaaggaagu

SEQ ID NO: 150852 - RNA, 23 nt, Human
ugcugcgggacccgagcgcgcgc

SEQ ID NO: 150853 - RNA, 23 nt, Human
ugcugcuggaguaucuacaaugc

SEQ ID NO: 150854 - RNA, 22 nt, Human
ugcugcuguuaucauuuuacca

SEQ ID NO: 150855 - RNA, 22 nt, Human
ucucaaacuauauaugggguuc

SEQ ID NO: 150856 - RNA, 22 nt, Human
uccucguccucauccgcgucau

SEQ ID NO: 150857 - RNA, 22 nt, Human
uccucgccgucacgcagccucu

SEQ ID NO: 150858 - RNA, 22 nt, Human
uccuccucgccacgacucugcu

SEQ ID NO: 150859 - RNA, 22 nt, Human
uccuccacuuagcgccacuggg

SEQ ID NO: 150860 - RNA, 22 nt, Human
uccucaucuuaucaucccaaga

SEQ ID NO: 150861 - RNA, 22 nt, Human
ugcccagagccucuuaccucca

SEQ ID NO: 150862 - RNA, 19 nt, Human
ugccccacccucuauccag

SEQ ID NO: 150863 - RNA, 22 nt, Human
ugcccacaggaagacaccagcg

SEQ ID NO: 150864 - RNA, 22 nt, Human
ugcaucugagcacuacggugga

SEQ ID NO: 150865 - RNA, 22 nt, Human
ugcaucccaaacaugguuuccu

SEQ ID NO: 150866 - RNA, 22 nt, Human
ugcaucauuaagguacaguugg

SEQ ID NO: 150867 - RNA, 22 nt, Human
ugccaaagauagagguuugagu

SEQ ID NO: 150868 - RNA, 17 nt, Human
ugcaugcgucugugaua

SEQ ID NO: 150869 - RNA, 22 nt, Human
ugcauugccucuauucauuaua

SEQ ID NO: 150870 - RNA, 22 nt, Human
uccugcccuguccuugccucug

SEQ ID NO: 150871 - RNA, 21 nt, Human
uccugccuggccuucugacua

SEQ ID NO: 150872 - RNA, 22 nt, Human
uccugcucucuccauuccuucc

SEQ ID NO: 150873 - RNA, 22 nt, Human
uccuggaagggaugguugagga

SEQ ID NO: 150874 - RNA, 22 nt, Human
uccuggccucugagucaagaac

SEQ ID NO: 150875 - RNA, 22 nt, Human
ugccuacuuuaguacuuuaaag

SEQ ID NO: 150876 - RNA, 22 nt, Human
ugccuguguuugggguggggaa

SEQ ID NO: 150877 - RNA, 22 nt, Human
ugccuggacgacaucacaguga

SEQ ID NO: 150878 - RNA, 22 nt, Human
ucgacguuguuuuuucucuguc

SEQ ID NO: 150879 - RNA, 22 nt, Human
ugcgccuccugcugccugcccu

SEQ ID NO: 150880 - RNA, 22 nt, Human
ugcgcgcaccugcauauauaug

SEQ ID NO: 150881 - RNA, 22 nt, Human
ugcgccucugucacucagcauc

SEQ ID NO: 150882 - RNA, 22 nt, Human
uccgacacacgugcucgcagcg

SEQ ID NO: 150883 - RNA, 20 nt, Human
uccgaaucaugacuuugcac

SEQ ID NO: 150884 - RNA, 22 nt, Human
ugcaggaagcucagcggggccg

SEQ ID NO: 150885 - RNA, 22 nt, Human
ugcagggucuccuguacuuggg

SEQ ID NO: 150886 - RNA, 22 nt, Human
ucccugagagacuucuuuggcu

SEQ ID NO: 150887 - RNA, 22 nt, Human
ucccugcgugagaaagcacuua

SEQ ID NO: 150888 - RNA, 22 nt, Human
ucccuguuuccugcgcuccuuc

SEQ ID NO: 150889 - RNA, 22 nt, Human
ucccugcugggcgaucuucucu

SEQ ID NO: 150890 - RNA, 22 nt, Human
uccgggcagcuccuggagcugu

SEQ ID NO: 150891 - RNA, 22 nt, Human
uccguccacacuuagagaguuu

SEQ ID NO: 150892 - RNA, 22 nt, Human
uccgcguugguuagagagggcu

SEQ ID NO: 150893 - RNA, 22 nt, Human
uccggcgaccuccagauguucc

SEQ ID NO: 150894 - RNA, 22 nt, Human
uccgagggugacuaccgcuucc

SEQ ID NO: 150895 - RNA, 22 nt, Human
uccgaccuuuacuucuugucuc

SEQ ID NO: 150896 - RNA, 22 nt, Human
ugcaggagcaccagcucacccu

SEQ ID NO: 150897 - RNA, 22 nt, Human
uccgugguguuggcucuccggc

SEQ ID NO: 150898 - RNA, 22 nt, Human
ugcauaugcauguaccuguguu

SEQ ID NO: 150899 - RNA, 22 nt, Human
ugcaguugcguuugcauuccau

SEQ ID NO: 150900 - RNA, 22 nt, Human
ucccaccugcuaagauguaucc

SEQ ID NO: 150901 - RNA, 22 nt, Human
ucccagguugaggccuugccug

SEQ ID NO: 150902 - RNA, 22 nt, Human
uccccaccuaagauacccaucu

SEQ ID NO: 150903 - RNA, 23 nt, Human
uccccagcugcccgugucccggg

SEQ ID NO: 150904 - RNA, 22 nt, Human
uccccugccccccauccucugg

SEQ ID NO: 150905 - RNA, 22 nt, Human
ucccggcaccgggagccccugc

SEQ ID NO: 150906 - RNA, 21 nt, Human
uccccugugccuggcauacag

SEQ ID NO: 150907 - RNA, 22 nt, Human
ucccgcccugcguucucccaug

SEQ ID NO: 150908 - RNA, 22 nt, Human
ucccaagugcuccucuggcccc

SEQ ID NO: 150909 - RNA, 22 nt, Human
ucccaaaacuugaagcaagccu

SEQ ID NO: 150910 - RNA, 23 nt, Human
ucccacauuucacagcacuuucc

SEQ ID NO: 150911 - RNA, 22 nt, Human
uccagccauaucuuguagcccu

SEQ ID NO: 150912 - RNA, 22 nt, Human
uccagcuccugaguucacugcu

SEQ ID NO: 150913 - RNA, 22 nt, Human
uccaggaggacugagggggcug

SEQ ID NO: 150914 - RNA, 22 nt, Human
uccagcuucugccugcugcugc

SEQ ID NO: 150915 - RNA, 22 nt, Human
uccaggacgccgacgugucggc

SEQ ID NO: 150916 - RNA, 22 nt, Human
ugagaaauauacaccagacaca

SEQ ID NO: 150917 - RNA, 22 nt, Human
ugagaccuaaaccgucuguccu

SEQ ID NO: 150918 - RNA, 22 nt, Human
ucaguagcauuuaauguucagu

SEQ ID NO: 150919 - RNA, 22 nt, Human
ugagcaccaggcaccacagcuc

SEQ ID NO: 150920 - RNA, 19 nt, Human
ucagugggacauuugcuuu

SEQ ID NO: 150921 - RNA, 20 nt, Human
ucagugggaaagugagagug

SEQ ID NO: 150922 - RNA, 22 nt, Human
ugaggaaugugacaaaaccaag

SEQ ID NO: 150923 - RNA, 22 nt, Human
ugaggaggugcuaccagcgucu

SEQ ID NO: 150924 - RNA, 22 nt, Human
ugaggagggcuagagucuccug

SEQ ID NO: 150925 - RNA, 22 nt, Human
ucauguauucugggcaggagau

SEQ ID NO: 150926 - RNA, 22 nt, Human
ucaugcagaguagaaagggcaa

SEQ ID NO: 150927 - RNA, 22 nt, Human
ugagugccagugcuugcucuac

SEQ ID NO: 150928 - RNA, 22 nt, Human
ucauccugucucuguucggaau

SEQ ID NO: 150929 - RNA, 22 nt, Human
ucaucgauggggagcucuacaa

SEQ ID NO: 150930 - RNA, 22 nt, Human
ugaggcuuucacuuggcaaaga

SEQ ID NO: 150931 - RNA, 22 nt, Human
ucauccucguccucuggugccc

SEQ ID NO: 150932 - RNA, 21 nt, Human
ucauccagguccugcuucuuc

SEQ ID NO: 150933 - RNA, 22 nt, Human
ugaucaacagggcuggaaagag

SEQ ID NO: 150934 - RNA, 22 nt, Human
ucauggucucccagcccccucu

SEQ ID NO: 150935 - RNA, 22 nt, Human
ugaucaguacuguaugagggau

SEQ ID NO: 150936 - RNA, 18 nt, Human
ugauggcuaagagccggg

SEQ ID NO: 150937 - RNA, 22 nt, Human
ugaugaugccaaaauuuggcau

SEQ ID NO: 150938 - RNA, 22 nt, Human
uccaaggcagacacauuuuuug

SEQ ID NO: 150939 - RNA, 19 nt, Human
uccaccgcgugcaccucua

SEQ ID NO: 150940 - RNA, 22 nt, Human
ugauucaguacuuucucuaacu

SEQ ID NO: 150941 - RNA, 22 nt, Human
ugauugauaaugaagacaguca

SEQ ID NO: 150942 - RNA, 22 nt, Human
ucucagaagaaacaucugcugg

SEQ ID NO: 150943 - RNA, 22 nt, Human
ucucaggcuuccuggugcugug

SEQ ID NO: 150944 - RNA, 22 nt, Human
ucucagcuggcugggagcccug

SEQ ID NO: 150945 - RNA, 22 nt, Human
ucucaccuagucuuggaggucu

SEQ ID NO: 150946 - RNA, 22 nt, Human
ucucaaagagcuacuggucuau

SEQ ID NO: 150947 - RNA, 22 nt, Human
ucucaaagguuuuccucuuuuu

SEQ ID NO: 150948 - RNA, 21 nt, Human
ucucaagguaacauuuaagau

SEQ ID NO: 150949 - RNA, 23 nt, Human
ucucaccaggauaugacugucac

SEQ ID NO: 150950 - RNA, 22 nt, Human
ucgagcucagcagggaggugcg

SEQ ID NO: 150951 - RNA, 19 nt, Human
uagcuguucuugaguguga

SEQ ID NO: 150952 - RNA, 21 nt, Human
uaggaacuguucugagugguc

SEQ ID NO: 150953 - RNA, 22 nt, Human
uaggagcagauggcagcaggug

SEQ ID NO: 150954 - RNA, 22 nt, Human
ucuccaccccugggaggcagaa

SEQ ID NO: 150955 - RNA, 22 nt, Human
ucucgcuguuccugcuucaggu

SEQ ID NO: 150956 - RNA, 18 nt, Human
ucuccgaccccgcggucc

SEQ ID NO: 150957 - RNA, 20 nt, Human
ucucuaacaugaaugcuauc

SEQ ID NO: 150958 - RNA, 22 nt, Human
ucucucgguacagcuggcugga

SEQ ID NO: 150959 - RNA, 22 nt, Human
ucucuccuccacaccgggugcu

SEQ ID NO: 150960 - RNA, 22 nt, Human
ucucugcguucaucccaucaca

SEQ ID NO: 150961 - RNA, 20 nt, Human
ucucugccaaccaccuccuc

SEQ ID NO: 150962 - RNA, 22 nt, Human
ucucugguagcucugugcucug

SEQ ID NO: 150963 - RNA, 22 nt, Human
ucucugguggcuccaucaguag

SEQ ID NO: 150964 - RNA, 22 nt, Human
ucugaccaggcucuuguagccu

SEQ ID NO: 150965 - RNA, 22 nt, Human
ucucuugcuauugcgaacaggu

SEQ ID NO: 150966 - RNA, 22 nt, Human
ucugagagcuguagaagccuau

SEQ ID NO: 150967 - RNA, 22 nt, Human
ucugaggacagugcugugccug

SEQ ID NO: 150968 - RNA, 22 nt, Human
ucugaggaauaagaugucuaaa

SEQ ID NO: 150969 - RNA, 22 nt, Human
uaucugcuggagguaauuacuc

SEQ ID NO: 150970 - RNA, 22 nt, Human
ucugacguugguucugcccuuu

SEQ ID NO: 150971 - RNA, 22 nt, Human
ucuggguuuccuucacaagcac

SEQ ID NO: 150972 - RNA, 17 nt, Human
ucuggguuucugauuua

SEQ ID NO: 150973 - RNA, 22 nt, Human
ucuggucugccgagauccauuu

SEQ ID NO: 150974 - RNA, 22 nt, Human
ucugggucuaucccaugccuuu

SEQ ID NO: 150975 - RNA, 22 nt, Human
ucugggguucuuaauuuggaag

SEQ ID NO: 150976 - RNA, 21 nt, Human
ucuggggacaagguccaggaa

SEQ ID NO: 150977 - RNA, 22 nt, Human
ucugguagauuauuuagaguac

SEQ ID NO: 150978 - RNA, 22 nt, Human
ucugguuccugcauucauucaa

SEQ ID NO: 150979 - RNA, 22 nt, Human
ucuguggcaaacacagugacca

SEQ ID NO: 150980 - RNA, 22 nt, Human
ucugugcuggacugauuucaua

SEQ ID NO: 150981 - RNA, 22 nt, Human
ucugucucugucaggcugcugc

SEQ ID NO: 150982 - RNA, 22 nt, Human
ucuucagacuguuguucuuuug

SEQ ID NO: 150983 - RNA, 22 nt, Human
ucuguucacaauuacacacacu

SEQ ID NO: 150984 - RNA, 22 nt, Human
uauucagugcugguucuuuuuc

SEQ ID NO: 150985 - RNA, 22 nt, Human
ucugcuggugucauuuuugcua

SEQ ID NO: 150986 - RNA, 22 nt, Human
ucugcguggcgugguucugugc

SEQ ID NO: 150987 - RNA, 20 nt, Human
ucugcuugucuucagguucc

SEQ ID NO: 150988 - RNA, 22 nt, Human
ucuggaggucucagggcgggaa

SEQ ID NO: 150989 - RNA, 22 nt, Human
ucuggcacuugccaguuucuau

SEQ ID NO: 150990 - RNA, 22 nt, Human
ucuggcucaggagcuguguuca

SEQ ID NO: 150991 - RNA, 22 nt, Human
ucuggcaguugccgcuucaguc

SEQ ID NO: 150992 - RNA, 22 nt, Human
ucugggccaacccuuccauggg

SEQ ID NO: 150993 - RNA, 22 nt, Human
ucuggcucuccagugcucuuag

SEQ ID NO: 150994 - RNA, 22 nt, Human
ucugggaccuagacccauuguu

SEQ ID NO: 150995 - RNA, 22 nt, Human
ucuggcuucaguaggguucacu

SEQ ID NO: 150996 - RNA, 22 nt, Human
uaugaccuuaggaagcaagaag

SEQ ID NO: 150997 - RNA, 22 nt, Human
ucugagugggaacucucaugac

SEQ ID NO: 150998 - RNA, 22 nt, Human
ucugauucucuuguugaccuag

SEQ ID NO: 150999 - RNA, 22 nt, Human
uaugccaccagucuggaacucu

SEQ ID NO: 151000 - RNA, 21 nt, Human
ucugccaguuucucuuacuuu

SEQ ID NO: 151001 - RNA, 22 nt, Human
ucugcagggcccuuggcuccug

SEQ ID NO: 151002 - RNA, 22 nt, Human
ucugcggccuagcgcccggcgc

SEQ ID NO: 151003 - RNA, 22 nt, Human
ucugcgggccuggcucccagcg

SEQ ID NO: 151004 - RNA, 20 nt, Human
uaugcgaagccuuucuggac

SEQ ID NO: 151005 - RNA, 22 nt, Human
ucugcggccggaauucccuuca

SEQ ID NO: 151006 - RNA, 22 nt, Human
ucugcaugccucaggaggccug

SEQ ID NO: 151007 - RNA, 22 nt, Human
ucugccuucaggagcagacucu

SEQ ID NO: 151008 - RNA, 22 nt, Human
uccaggucauucucuccgaccg

SEQ ID NO: 151009 - RNA, 22 nt, Human
uccauggucgauggcugcuggg

SEQ ID NO: 151010 - RNA, 22 nt, Human
uccaugcaguagaggcgcuggg

SEQ ID NO: 151011 - RNA, 22 nt, Human
uccaugcgcgauggccuggcuu

SEQ ID NO: 151012 - RNA, 22 nt, Human
uccaggagucagacagauggug

SEQ ID NO: 151013 - RNA, 22 nt, Human
uccagcugugcuccaggaggug

SEQ ID NO: 151014 - RNA, 21 nt, Human
uccaggagcacgggacuagga

SEQ ID NO: 151015 - RNA, 22 nt, Human
uccaaggcuggaucuuuucuuu

SEQ ID NO: 151016 - RNA, 22 nt, Human
uacagcgaaaauuuagcuugau

SEQ ID NO: 151017 - RNA, 22 nt, Human
uccaaggacucuugucagcugu

SEQ ID NO: 151018 - RNA, 22 nt, Human
uccaaugugccuuauuuugagc

SEQ ID NO: 151019 - RNA, 22 nt, Human
uccccgcuccguagagaaagag

SEQ ID NO: 151020 - RNA, 22 nt, Human
uccccgcugcgcccgcugcugc

SEQ ID NO: 151021 - RNA, 22 nt, Human
uccccaugaacuuguggcugcu

SEQ ID NO: 151022 - RNA, 22 nt, Human
uacuucccacuggggucuacca

SEQ ID NO: 151023 - RNA, 22 nt, Human
uacugacguaguagaguugcuu

SEQ ID NO: 151024 - RNA, 22 nt, Human
uacugauggagauaggcuauca

SEQ ID NO: 151025 - RNA, 22 nt, Human
ucccugccuuauuuucauaugc

SEQ ID NO: 151026 - RNA, 22 nt, Human
ucccugccuccuggcagugcca

SEQ ID NO: 151027 - RNA, 22 nt, Human
ucccucgccccggguucuuucu

SEQ ID NO: 151028 - RNA, 22 nt, Human
ucccugagcucacauggcagga

SEQ ID NO: 151029 - RNA, 21 nt, Human
uagaccagcugugcuccucgg

SEQ ID NO: 151030 - RNA, 21 nt, Human
uccguucgguuaaaaaggccc

SEQ ID NO: 151031 - RNA, 22 nt, Human
uccgugggucuugaagugucac

SEQ ID NO: 151032 - RNA, 22 nt, Human
uccgggagcccccggaggagga

SEQ ID NO: 151033 - RNA, 22 nt, Human
uccucagcaaacacuucacucu

SEQ ID NO: 151034 - RNA, 22 nt, Human
uccucagcaagacgcuggcagc

SEQ ID NO: 151035 - RNA, 22 nt, Human
ucccuguggauuaaggagaugu

SEQ ID NO: 151036 - RNA, 23 nt, Human
ucccuguuucagggccagaacug

SEQ ID NO: 151037 - RNA, 22 nt, Human
uagaacugcucucauacuugcu

SEQ ID NO: 151038 - RNA, 21 nt, Human
uccugccuuaguccagagcag

SEQ ID NO: 151039 - RNA, 22 nt, Human
uccuggcgugggcuggcugcag

SEQ ID NO: 151040 - RNA, 22 nt, Human
uccuggcuguuagagaggcaag

SEQ ID NO: 151041 - RNA, 22 nt, Human
uccugggucugugagccauacu

SEQ ID NO: 151042 - RNA, 22 nt, Human
uccuggccuuggggagagaagu

SEQ ID NO: 151043 - RNA, 22 nt, Human
uccuugaccuccugacaguaac

SEQ ID NO: 151044 - RNA, 22 nt, Human
uccuucuuuucgccggaguuga

SEQ ID NO: 151045 - RNA, 22 nt, Human
uccuucagaggacggcagccag

SEQ ID NO: 151046 - RNA, 22 nt, Human
ucaucggcugucaucuucacgu

SEQ ID NO: 151047 - RNA, 20 nt, Human
ucaguuucccuauuagguug

SEQ ID NO: 151048 - RNA, 22 nt, Human
ucaguuccccaaagccuccuag

SEQ ID NO: 151049 - RNA, 17 nt, Human
ucaguugugcgagcagc

SEQ ID NO: 151050 - RNA, 22 nt, Human
ucaguuguuggaaguagaugua

SEQ ID NO: 151051 - RNA, 22 nt, Human
ucaugggcaaacuuggggauca

SEQ ID NO: 151052 - RNA, 22 nt, Human
ucaugcagauaagaauaaguaa

SEQ ID NO: 151053 - RNA, 21 nt, Human
uccaaaggagacugagugugu

SEQ ID NO: 151054 - RNA, 22 nt, Human
uacaaucacccaaagagccaga

SEQ ID NO: 151055 - RNA, 20 nt, Human
ucauucagaaucaguaugca

SEQ ID NO: 151056 - RNA, 22 nt, Human
ucagucacugucucagacagga

SEQ ID NO: 151057 - RNA, 22 nt, Human
ucagguuuaagugacuggaauc

SEQ ID NO: 151058 - RNA, 22 nt, Human
ucagguuuaagcuacuggaauc

SEQ ID NO: 151059 - RNA, 22 nt, Human
ucagguuuuuaaggagcuagga

SEQ ID NO: 151060 - RNA, 22 nt, Human
ucaagcuggaaaugaagaaucu

SEQ ID NO: 151061 - RNA, 22 nt, Human
guugucguucccccugcuuaaa

SEQ ID NO: 151062 - RNA, 22 nt, Human
guugguggaggcgagagaagaa

SEQ ID NO: 151063 - RNA, 22 nt, Human
guuggguaauuaagcacagaaa

SEQ ID NO: 151064 - RNA, 22 nt, Human
ucaagcacugugcaaugagcuu

SEQ ID NO: 151065 - RNA, 21 nt, Human
ucaagcggcagagcaguuauu

SEQ ID NO: 151066 - RNA, 22 nt, Human
ucagggaggagaggcaggggga

SEQ ID NO: 151067 - RNA, 22 nt, Human
ucaggcuagcccagugcuuggg

SEQ ID NO: 151068 - RNA, 22 nt, Human
guuggaggaaggacaggaacag

SEQ ID NO: 151069 - RNA, 19 nt, Human
ucaggaggucgaccuggca

SEQ ID NO: 151070 - RNA, 22 nt, Human
ucaguggaacacacagaguggg

SEQ ID NO: 151071 - RNA, 23 nt, Human
ucagugccaaggagaacuuggug

SEQ ID NO: 151072 - RNA, 22 nt, Human
ucagucauguuuaccagacgua

SEQ ID NO: 151073 - RNA, 22 nt, Human
ucagucauacuuuaugauugaa

SEQ ID NO: 151074 - RNA, 18 nt, Human
uaacugguuucuucccau

SEQ ID NO: 151075 - RNA, 20 nt, Human
ucaguggcauaguugcuaag

SEQ ID NO: 151076 - RNA, 22 nt, Human
gugcucgagcugugcgcgcugc

SEQ ID NO: 151077 - RNA, 22 nt, Human
gugcugcaaggauggagaggca

SEQ ID NO: 151078 - RNA, 22 nt, Human
uagcuucacuuuuguugaugcg

SEQ ID NO: 151079 - RNA, 22 nt, Human
uagcgggucacccugcugugaa

SEQ ID NO: 151080 - RNA, 22 nt, Human
uagcguucuugcaugcuaaccu

SEQ ID NO: 151081 - RNA, 23 nt, Human
uagcggccaugacgggggucaca

SEQ ID NO: 151082 - RNA, 22 nt, Human
uagcuggaggggcaggaugcug

SEQ ID NO: 151083 - RNA, 22 nt, Human
uagcuaggugagcggcuccggc

SEQ ID NO: 151084 - RNA, 22 nt, Human
uagccaguuuauaaaguggaag

SEQ ID NO: 151085 - RNA, 22 nt, Human
gugcuggcaaagagaacaucuu

SEQ ID NO: 151086 - RNA, 22 nt, Human
gugcugucguggaacugggcug

SEQ ID NO: 151087 - RNA, 22 nt, Human
gugcuugcgcauaacuggggcc

SEQ ID NO: 151088 - RNA, 22 nt, Human
guggacagacauaauccuaauu

SEQ ID NO: 151089 - RNA, 22 nt, Human
guggacuuuggucugugccauc

SEQ ID NO: 151090 - RNA, 22 nt, Human
guggauuguaccacgaaaagug

SEQ ID NO: 151091 - RNA, 22 nt, Human
uaggcagauuccauauuuuggc

SEQ ID NO: 151092 - RNA, 22 nt, Human
guggaguggguuguacucaggg

SEQ ID NO: 151093 - RNA, 22 nt, Human
guggauaaguuguuugaccuac

SEQ ID NO: 151094 - RNA, 22 nt, Human
guggauggagcuggaagccauu

SEQ ID NO: 151095 - RNA, 22 nt, Human
guggagauauuugugauagggg

SEQ ID NO: 151096 - RNA, 22 nt, Human
gugggcuuuuuugaaaccugaa

SEQ ID NO: 151097 - RNA, 22 nt, Human
gugggggauggcgugugggucu

SEQ ID NO: 151098 - RNA, 22 nt, Human
guggggcgggucccccgccugg

SEQ ID NO: 151099 - RNA, 22 nt, Human
gugggcccaagcagcggcggcc

SEQ ID NO: 151100 - RNA, 22 nt, Human
guggggguaggggguuuucugg

SEQ ID NO: 151101 - RNA, 22 nt, Human
gugggccaguuccucacaggua

SEQ ID NO: 151102 - RNA, 22 nt, Human
gugggcagauuaauuucucaau

SEQ ID NO: 151103 - RNA, 22 nt, Human
gugggcacguccuacugucacu

SEQ ID NO: 151104 - RNA, 18 nt, Human
gugggcacacacucuguu

SEQ ID NO: 151105 - RNA, 22 nt, Human
gugggagggaguccugggagca

SEQ ID NO: 151106 - RNA, 22 nt, Human
gugggaguggagcucagcaugu

SEQ ID NO: 151107 - RNA, 22 nt, Human
uagucaauuagaaagaggccuu

SEQ ID NO: 151108 - RNA, 22 nt, Human
uaguccacagagggcaggguca

SEQ ID NO: 151109 - RNA, 22 nt, Human
guggguauauauaugugugcug

SEQ ID NO: 151110 - RNA, 22 nt, Human
uaguggccacugaagugcuaga

SEQ ID NO: 151111 - RNA, 22 nt, Human
guggccugacagaucggaacag

SEQ ID NO: 151112 - RNA, 22 nt, Human
guggcuuuguuuccaaaugaaa

SEQ ID NO: 151113 - RNA, 23 nt, Human
uaggucacacauugggugguugc

SEQ ID NO: 151114 - RNA, 22 nt, Human
uaggucugaggcugcaucuugg

SEQ ID NO: 151115 - RNA, 22 nt, Human
guggccaaggcagagaaagagc

SEQ ID NO: 151116 - RNA, 22 nt, Human
uaggggggugaaggaggucccu

SEQ ID NO: 151117 - RNA, 19 nt, Human
uaggcccugcgaauggcuu

SEQ ID NO: 151118 - RNA, 22 nt, Human
uaggggcccgugggauggacag

SEQ ID NO: 151119 - RNA, 22 nt, Human
guggcagguguacagcucagcu

SEQ ID NO: 151120 - RNA, 22 nt, Human
guggcauggggagcagcuagaa

SEQ ID NO: 151121 - RNA, 20 nt, Human
guggcagugguggcagcagu

SEQ ID NO: 151122 - RNA, 22 nt, Human
uaggucaaggccacuucuugga

SEQ ID NO: 151123 - RNA, 22 nt, Human
gugggugucaguaucuuuaacg

SEQ ID NO: 151124 - RNA, 22 nt, Human
guggguuggguuuuugaaggga

SEQ ID NO: 151125 - RNA, 22 nt, Human
gugguggggaguuggauggaag

SEQ ID NO: 151126 - RNA, 22 nt, Human
guggugaacauuugcaucugcu

SEQ ID NO: 151127 - RNA, 22 nt, Human
gugguccuaggugcucaaguca

SEQ ID NO: 151128 - RNA, 22 nt, Human
guggugguguuggugacaaguu

SEQ ID NO: 151129 - RNA, 22 nt, Human
guguagugugcuguucaguguu

SEQ ID NO: 151130 - RNA, 22 nt, Human
guguucucagcacccacuucau

SEQ ID NO: 151131 - RNA, 22 nt, Human
guguaucagaggcuguguuaua

SEQ ID NO: 151132 - RNA, 22 nt, Human
gugguaccaguaggucagccau

SEQ ID NO: 151133 - RNA, 22 nt, Human
guuagggcaagggguuccucug

SEQ ID NO: 151134 - RNA, 22 nt, Human
guuaaaugcagauucugacuca

SEQ ID NO: 151135 - RNA, 22 nt, Human
uauguggcaggugggagaucag

SEQ ID NO: 151136 - RNA, 22 nt, Human
uaugugaguaccugucaugugc

SEQ ID NO: 151137 - RNA, 20 nt, Human
uaugugcaguuugguuuauc

SEQ ID NO: 151138 - RNA, 21 nt, Human
guguugugagguugguguuag

SEQ ID NO: 151139 - RNA, 23 nt, Human
guguuguugauuuucgaaucuuu

SEQ ID NO: 151140 - RNA, 23 nt, Human
gugugccuuuaucuucuguacuc

SEQ ID NO: 151141 - RNA, 19 nt, Human
guguucuguuauacaguug

SEQ ID NO: 151142 - RNA, 22 nt, Human
guguucuuuaugguuguagugu

SEQ ID NO: 151143 - RNA, 22 nt, Human
guguuggugagcucauuuccac

SEQ ID NO: 151144 - RNA, 22 nt, Human
guguugacacagccaucuuguc

SEQ ID NO: 151145 - RNA, 22 nt, Human
guucgucuguggugugaggugc

SEQ ID NO: 151146 - RNA, 22 nt, Human
guucggcuuccuaugucaugag

SEQ ID NO: 151147 - RNA, 22 nt, Human
guuccugagcaguuccuggcca

SEQ ID NO: 151148 - RNA, 23 nt, Human
guuauugcuggugcuggccagcc

SEQ ID NO: 151149 - RNA, 22 nt, Human
guucugcccaggccuccccaac

SEQ ID NO: 151150 - RNA, 22 nt, Human
guucuggaggagagccuggugu

SEQ ID NO: 151151 - RNA, 22 nt, Human
guucuucucuuguaauggaauc

SEQ ID NO: 151152 - RNA, 22 nt, Human
guuggcgaaggaccuggaggag

SEQ ID NO: 151153 - RNA, 22 nt, Human
ucaaccucccugcucaccccuc

SEQ ID NO: 151154 - RNA, 22 nt, Human
ucaagaagauaaugucuagggu

SEQ ID NO: 151155 - RNA, 21 nt, Human
ucaaccagguguugaaggcac

SEQ ID NO: 151156 - RNA, 22 nt, Human
guugggguuucaguggcaguca

SEQ ID NO: 151157 - RNA, 22 nt, Human
guuggugagaguuagggauuua

SEQ ID NO: 151158 - RNA, 22 nt, Human
guugggugccagaggcuucacg

SEQ ID NO: 151159 - RNA, 22 nt, Human
ucaaccagcuuaucugcaggau

SEQ ID NO: 151160 - RNA, 20 nt, Human
gucaucucagggacugucug

SEQ ID NO: 151161 - RNA, 22 nt, Human
gucagugcuuuaguucaggaug

SEQ ID NO: 151162 - RNA, 22 nt, Human
gucacuccuucccagagggagc

SEQ ID NO: 151163 - RNA, 22 nt, Human
gucaggugcaccuccaccaaca

SEQ ID NO: 151164 - RNA, 22 nt, Human
guauggaguuuuguugcacuuc

SEQ ID NO: 151165 - RNA, 22 nt, Human
guacuugauucauuauugcauu

SEQ ID NO: 151166 - RNA, 22 nt, Human
guagagccaccaccaccauagc

SEQ ID NO: 151167 - RNA, 22 nt, Human
guccuucgcggcugaggccauu

SEQ ID NO: 151168 - RNA, 22 nt, Human
guccuggagcagcuggaagaug

SEQ ID NO: 151169 - RNA, 22 nt, Human
guccaauguggcaccacagggg

SEQ ID NO: 151170 - RNA, 22 nt, Human
gucaguggugcuuaaaguuuca

SEQ ID NO: 151171 - RNA, 22 nt, Human
guccacauaggaacccagcuuc

SEQ ID NO: 151172 - RNA, 22 nt, Human
gucccagaggacagggucacau

SEQ ID NO: 151173 - RNA, 22 nt, Human
guccaugugcuaacagugcuua

SEQ ID NO: 151174 - RNA, 22 nt, Human
gucccagaaugguuucccagaa

SEQ ID NO: 151175 - RNA, 22 nt, Human
gucccuggucuaccguggcuuc

SEQ ID NO: 151176 - RNA, 22 nt, Human
guccuaugggaagggauccugg

SEQ ID NO: 151177 - RNA, 22 nt, Human
guccucgggcucacucccaggg

SEQ ID NO: 151178 - RNA, 22 nt, Human
gucgucgcucccaccuuccgcu

SEQ ID NO: 151179 - RNA, 22 nt, Human
gucguucugcuauucuaugagg

SEQ ID NO: 151180 - RNA, 22 nt, Human
gucgccuaauuaggguauccua

SEQ ID NO: 151181 - RNA, 22 nt, Human
gucgcuuuccugaggggucuca

SEQ ID NO: 151182 - RNA, 22 nt, Human
gucgagcuggaggagcgaaugg

SEQ ID NO: 151183 - RNA, 22 nt, Human
gucugugguccaaaauugccuc

SEQ ID NO: 151184 - RNA, 22 nt, Human
gucuggagccacugcugcugcu

SEQ ID NO: 151185 - RNA, 22 nt, Human
gucugguggaguuguauauacu

SEQ ID NO: 151186 - RNA, 22 nt, Human
gucugcucauguuugguuugug

SEQ ID NO: 151187 - RNA, 22 nt, Human
uacauggauguuauccuuacug

SEQ ID NO: 151188 - RNA, 20 nt, Human
uacguguccgaugaucacag

SEQ ID NO: 151189 - RNA, 22 nt, Human
uacguggcucguuaauuuccug

SEQ ID NO: 151190 - RNA, 22 nt, Human
guccccuauaugaggaagccau

SEQ ID NO: 151191 - RNA, 22 nt, Human
uaccugguuucuuaaacccaaa

SEQ ID NO: 151192 - RNA, 20 nt, Human
gugaacuggagaacugaugu

SEQ ID NO: 151193 - RNA, 22 nt, Human
uacuucauucaaguucgcuaua

SEQ ID NO: 151194 - RNA, 22 nt, Human
gugacugagcuggcaaaguaug

SEQ ID NO: 151195 - RNA, 21 nt, Human
gugaccuguuaugcaaaggca

SEQ ID NO: 151196 - RNA, 22 nt, Human
gugaaggggaagcagggagagg

SEQ ID NO: 151197 - RNA, 22 nt, Human
ggugccugggcacggaaagcau

SEQ ID NO: 151198 - RNA, 19 nt, Human
ggugaucugucccuugcuc

SEQ ID NO: 151199 - RNA, 22 nt, Human
ggugcugcugcugaacccagcu

SEQ ID NO: 151200 - RNA, 22 nt, Human
ggugcuggggaaauuaggguag

SEQ ID NO: 151201 - RNA, 22 nt, Human
ggugcguggcccauccuccacc

SEQ ID NO: 151202 - RNA, 22 nt, Human
gguguacgaagaggcgggaguc

SEQ ID NO: 151203 - RNA, 22 nt, Human
ggugguucagugguuagggcca

SEQ ID NO: 151204 - RNA, 22 nt, Human
ggugggccaaauuaaacauaua

SEQ ID NO: 151205 - RNA, 22 nt, Human
ggugucuuugauguugggcuga

SEQ ID NO: 151206 - RNA, 22 nt, Human
gguguggcaguggaccugugaa

SEQ ID NO: 151207 - RNA, 22 nt, Human
ggugucguuucacaugacccag

SEQ ID NO: 151208 - RNA, 22 nt, Human
guacugggaauggagccugggc

SEQ ID NO: 151209 - RNA, 22 nt, Human
gguuuguggagcuggaaacacu

SEQ ID NO: 151210 - RNA, 22 nt, Human
gguuucuuuccucucugugccu

SEQ ID NO: 151211 - RNA, 22 nt, Human
gguuugccagugcuggaaugca

SEQ ID NO: 151212 - RNA, 22 nt, Human
guugggcugaagugugugcuua

SEQ ID NO: 151213 - RNA, 22 nt, Human
guuggggccuggagucucuugg

SEQ ID NO: 151214 - RNA, 22 nt, Human
guugggauugaaggugccucua

SEQ ID NO: 151215 - RNA, 20 nt, Human
guugggagaagugucagcug

SEQ ID NO: 151216 - RNA, 22 nt, Human
gugcuguuagcgguuuauaaca

SEQ ID NO: 151217 - RNA, 22 nt, Human
gugcugggaggcccaggaugga

SEQ ID NO: 151218 - RNA, 22 nt, Human
gugcuugaguaaaaauagucuu

SEQ ID NO: 151219 - RNA, 22 nt, Human
ggucgucuguccugucgccgcu

SEQ ID NO: 151220 - RNA, 22 nt, Human
ggucgguuggagagaucaugaa

SEQ ID NO: 151221 - RNA, 22 nt, Human
ggucggggcuggccggcguggu

SEQ ID NO: 151222 - RNA, 22 nt, Human
ggucgagcagcacccguucggc

SEQ ID NO: 151223 - RNA, 22 nt, Human
ggucgacuaauguuucauuuca

SEQ ID NO: 151224 - RNA, 22 nt, Human
ggucccacgauguaccugucug

SEQ ID NO: 151225 - RNA, 22 nt, Human
ggucaucacugagagcagaucc

SEQ ID NO: 151226 - RNA, 22 nt, Human
gguccgcgcgcagaggcccugg

SEQ ID NO: 151227 - RNA, 22 nt, Human
guugugcaaaacaggaaggucu

SEQ ID NO: 151228 - RNA, 22 nt, Human
guugucuggcucugaccauucu

SEQ ID NO: 151229 - RNA, 22 nt, Human
ggugaggagaaacucugccccu

SEQ ID NO: 151230 - RNA, 23 nt, Human
ggugagccuuucuaguagucuug

SEQ ID NO: 151231 - RNA, 22 nt, Human
ggugacauuggagagacaggug

SEQ ID NO: 151232 - RNA, 22 nt, Human
ggugaucucuggcucugcuugu

SEQ ID NO: 151233 - RNA, 22 nt, Human
ggucuucauucuaccagacuuu

SEQ ID NO: 151234 - RNA, 22 nt, Human
ggucucugggacguuggaucgc

SEQ ID NO: 151235 - RNA, 22 nt, Human
ggucuagcucggugcuggcgac

SEQ ID NO: 151236 - RNA, 22 nt, Human
ggcgccauuuuugccuucggag

SEQ ID NO: 151237 - RNA, 22 nt, Human
ggcgcccucccuguccgucuuc

SEQ ID NO: 151238 - RNA, 22 nt, Human
ggcggagggcuguguccccggc

SEQ ID NO: 151239 - RNA, 22 nt, Human
ggcgcuccccgccugcgucgcg

SEQ ID NO: 151240 - RNA, 22 nt, Human
ggcgauuggccgggaggaggca

SEQ ID NO: 151241 - RNA, 22 nt, Human
ggcgcaguguucgcccucucgc

SEQ ID NO: 151242 - RNA, 22 nt, Human
ggccagucaaggggauccugaa

SEQ ID NO: 151243 - RNA, 22 nt, Human
ggccaguauacaaacuuccggu

SEQ ID NO: 151244 - RNA, 22 nt, Human
ggccagcuuugagcugcaggaa

SEQ ID NO: 151245 - RNA, 22 nt, Human
gguuuucagaaugcaguccugu

SEQ ID NO: 151246 - RNA, 22 nt, Human
ggcgacuacugaaugcuugaaa

SEQ ID NO: 151247 - RNA, 22 nt, Human
ggccccggaggccguuagcuua

SEQ ID NO: 151248 - RNA, 22 nt, Human
ggcggcccaggugcuccaggcg

SEQ ID NO: 151249 - RNA, 22 nt, Human
ggcggcugcuccuugcccucgg

SEQ ID NO: 151250 - RNA, 22 nt, Human
ggcgggggagccaggaacccag

SEQ ID NO: 151251 - RNA, 22 nt, Human
ggcggaggucacgcacccgcca

SEQ ID NO: 151252 - RNA, 22 nt, Human
ggcggcaagggaauggagaaga

SEQ ID NO: 151253 - RNA, 22 nt, Human
gucaucugagggacgagauuuc

SEQ ID NO: 151254 - RNA, 22 nt, Human
gucaguccugugccuuuccgga

SEQ ID NO: 151255 - RNA, 22 nt, Human
gucagugaaccuucaccaaacc

SEQ ID NO: 151256 - RNA, 20 nt, Human
gucagaggacccuagagcga

SEQ ID NO: 151257 - RNA, 22 nt, Human
gucacgucgggacagacugggg

SEQ ID NO: 151258 - RNA, 22 nt, Human
gucaaaggcggugcaggaggag

SEQ ID NO: 151259 - RNA, 22 nt, Human
gucaaugcuuaguuugccugaa

SEQ ID NO: 151260 - RNA, 22 nt, Human
guauuaugaaugccgaggcggc

SEQ ID NO: 151261 - RNA, 22 nt, Human
guauuggcaguauacauagcac

SEQ ID NO: 151262 - RNA, 22 nt, Human
gucccucauaacuggcaggugu

SEQ ID NO: 151263 - RNA, 22 nt, Human
ggcugaggccucuggggaggga

SEQ ID NO: 151264 - RNA, 22 nt, Human
guccccugcuguggaucugugg

SEQ ID NO: 151265 - RNA, 22 nt, Human
guccuguccugcugagcuccug

SEQ ID NO: 151266 - RNA, 22 nt, Human
guccuguccuguccuggagaca

SEQ ID NO: 151267 - RNA, 22 nt, Human
guccuguguaaguacuugcuca

SEQ ID NO: 151268 - RNA, 22 nt, Human
guccuggugccaccugcgggau

SEQ ID NO: 151269 - RNA, 22 nt, Human
ggcuccugggcgucuucgaaca

SEQ ID NO: 151270 - RNA, 22 nt, Human
ggcucccgugggaugguggagc

SEQ ID NO: 151271 - RNA, 22 nt, Human
ggcugagguguggggaacuaua

SEQ ID NO: 151272 - RNA, 22 nt, Human
ggcugcaagacguuauuagcgu

SEQ ID NO: 151273 - RNA, 22 nt, Human
ggcgucuugcgggcgguagcgc

SEQ ID NO: 151274 - RNA, 22 nt, Human
ggcuaaucaagaaggcccagug

SEQ ID NO: 151275 - RNA, 22 nt, Human
ggcuagggagacagagggcaug

SEQ ID NO: 151276 - RNA, 22 nt, Human
ggcucacuguaccugccgccgc

SEQ ID NO: 151277 - RNA, 22 nt, Human
ggcuccagauguccccuggcaa

SEQ ID NO: 151278 - RNA, 22 nt, Human
ggcucagaggagcuggaacggu

SEQ ID NO: 151279 - RNA, 22 nt, Human
guccaucuugcaaugagaccua

SEQ ID NO: 151280 - RNA, 22 nt, Human
ggcuccccagagcuccuuacuc

SEQ ID NO: 151281 - RNA, 22 nt, Human
ggcuccaggguaccccuggaug

SEQ ID NO: 151282 - RNA, 22 nt, Human
ggcugcuugggcuguuucuuuu

SEQ ID NO: 151283 - RNA, 21 nt, Human
ggcugcucgugaugaacuuca

SEQ ID NO: 151284 - RNA, 17 nt, Human
ggcugccaggcaacaua

SEQ ID NO: 151285 - RNA, 22 nt, Human
gucgguacuaguacugguguug

SEQ ID NO: 151286 - RNA, 22 nt, Human
gucggagcggcugcacaggggg

SEQ ID NO: 151287 - RNA, 22 nt, Human
gucgagaacauucauuaugcaa

SEQ ID NO: 151288 - RNA, 22 nt, Human
ggcugggaggcggaggcugaga

SEQ ID NO: 151289 - RNA, 22 nt, Human
ggcugggagguggcgaggaggc

SEQ ID NO: 151290 - RNA, 22 nt, Human
ggcuggagcaggcugcacagug

SEQ ID NO: 151291 - RNA, 22 nt, Human
gucuggugguggguguagggca

SEQ ID NO: 151292 - RNA, 22 nt, Human
gucugcuuuuaucacaugucau

SEQ ID NO: 151293 - RNA, 22 nt, Human
gggagccucccacugggggaag

SEQ ID NO: 151294 - RNA, 22 nt, Human
gggagcugagcuggaagagaau

SEQ ID NO: 151295 - RNA, 22 nt, Human
gggagcccuggacgggcgguau

SEQ ID NO: 151296 - RNA, 22 nt, Human
gugcaucuguaauuacaauggu

SEQ ID NO: 151297 - RNA, 22 nt, Human
gggacugcgagauucucaaggg

SEQ ID NO: 151298 - RNA, 22 nt, Human
gugcaaugaguguggcaaagcc

SEQ ID NO: 151299 - RNA, 22 nt, Human
gugauggggagagcgcagcuuu

SEQ ID NO: 151300 - RNA, 22 nt, Human
gugauggucgagcgcuuguugu

SEQ ID NO: 151301 - RNA, 19 nt, Human
gugaugaugccacuccaac

SEQ ID NO: 151302 - RNA, 22 nt, Human
gugaugaaggccugcaccuggu

SEQ ID NO: 151303 - RNA, 22 nt, Human
gggacagcuggggguaaagcau

SEQ ID NO: 151304 - RNA, 22 nt, Human
gggaccaaaugcuaccauucua

SEQ ID NO: 151305 - RNA, 22 nt, Human
gggacaggacuccuggggccug

SEQ ID NO: 151306 - RNA, 20 nt, Human
gggacugagccuuguuugug

SEQ ID NO: 151307 - RNA, 22 nt, Human
gggcacggaaggcgccaggggu

SEQ ID NO: 151308 - RNA, 22 nt, Human
gugcugcaugagcaucacguag

SEQ ID NO: 151309 - RNA, 22 nt, Human
gggcaagagaggaagagauggc

SEQ ID NO: 151310 - RNA, 22 nt, Human
gugcgaaagaagcgacuccagu

SEQ ID NO: 151311 - RNA, 22 nt, Human
gugcuaugugcugaacucaggu

SEQ ID NO: 151312 - RNA, 22 nt, Human
gggaugaaugccuggcuccccc

SEQ ID NO: 151313 - RNA, 22 nt, Human
gugccaccagaugcuguugcua

SEQ ID NO: 151314 - RNA, 22 nt, Human
gugcccaguugaggccaggacu

SEQ ID NO: 151315 - RNA, 22 nt, Human
gugccgcuggagcuggaauuga

SEQ ID NO: 151316 - RNA, 22 nt, Human
gugccgaugaggccuggcauuc

SEQ ID NO: 151317 - RNA, 22 nt, Human
gugccgggcugcggcaaggugu

SEQ ID NO: 151318 - RNA, 22 nt, Human
gggagggcuuggacccagaugu

SEQ ID NO: 151319 - RNA, 22 nt, Human
gggauacuuuguuucccugcca

SEQ ID NO: 151320 - RNA, 20 nt, Human
gggaucgaguaccuccgggu

SEQ ID NO: 151321 - RNA, 22 nt, Human
gugccuggaaucuuuucuucac

SEQ ID NO: 151322 - RNA, 22 nt, Human
gggagggggauucuggcgagaa

SEQ ID NO: 151323 - RNA, 22 nt, Human
gggaggucgaggcugggccgca

SEQ ID NO: 151324 - RNA, 22 nt, Human
gggaguauguccgggcucuaga

SEQ ID NO: 151325 - RNA, 22 nt, Human
gugaccagacagagucuagccc

SEQ ID NO: 151326 - RNA, 20 nt, Human
gugaaguuuucugaagacag

SEQ ID NO: 151327 - RNA, 22 nt, Human
gugaaggcaugugugcugugcu

SEQ ID NO: 151328 - RNA, 22 nt, Human
gggaaaucugcuuccuagggcu

SEQ ID NO: 151329 - RNA, 22 nt, Human
gggaagccugggugauccuaaa

SEQ ID NO: 151330 - RNA, 22 nt, Human
gugaggugauugcugguguuug

SEQ ID NO: 151331 - RNA, 22 nt, Human
ggcuucaaaacacaugucaaga

SEQ ID NO: 151332 - RNA, 22 nt, Human
gugaaauuguacacucaguacc

SEQ ID NO: 151333 - RNA, 19 nt, Human
ggcuuugcccuucgcuccg

SEQ ID NO: 151334 - RNA, 22 nt, Human
ggcugguggcgggcagcacaga

SEQ ID NO: 151335 - RNA, 18 nt, Human
ggcugggcugugccccuu

SEQ ID NO: 151336 - RNA, 22 nt, Human
ggcuggggccuguugaagaugc

SEQ ID NO: 151337 - RNA, 22 nt, Human
ggcuuaguagggacagaugcac

SEQ ID NO: 151338 - RNA, 22 nt, Human
ggcugugguggacgcgggaaac

SEQ ID NO: 151339 - RNA, 22 nt, Human
gucuuugagccucaguuuccuc

SEQ ID NO: 151340 - RNA, 22 nt, Human
ggcuguggcagcuggaaguggu

SEQ ID NO: 151341 - RNA, 22 nt, Human
ggccacgggguuugcugaaacu

SEQ ID NO: 151342 - RNA, 22 nt, Human
gcuguguaugaugcaggcaccu

SEQ ID NO: 151343 - RNA, 20 nt, Human
ggcauuuuuuaguugagcuu

SEQ ID NO: 151344 - RNA, 22 nt, Human
ggccacauuccagagggcugaa

SEQ ID NO: 151345 - RNA, 19 nt, Human
ggccacacuauuaaaagau

SEQ ID NO: 151346 - RNA, 22 nt, Human
ggcuucuuaacauuuggacacc

SEQ ID NO: 151347 - RNA, 22 nt, Human
gcuguguucauccugcccaggu

SEQ ID NO: 151348 - RNA, 22 nt, Human
ggcuuugggaggaugaggcggu

SEQ ID NO: 151349 - RNA, 22 nt, Human
gcuguuggaggaguucagugcu

SEQ ID NO: 151350 - RNA, 22 nt, Human
ggcuuguccuucugguugucuu

SEQ ID NO: 151351 - RNA, 22 nt, Human
gcuguugcaaucaaggccaugg

SEQ ID NO: 151352 - RNA, 22 nt, Human
gcuguugagucagacaaguuuu

SEQ ID NO: 151353 - RNA, 22 nt, Human
gcuguuguugcacggaaggugg

SEQ ID NO: 151354 - RNA, 22 nt, Human
gggaaaauguuucugagacaaa

SEQ ID NO: 151355 - RNA, 22 nt, Human
gcuuacuguuccuguuggugcu

SEQ ID NO: 151356 - RNA, 22 nt, Human
gggaacccaaauaggaaaauug

SEQ ID NO: 151357 - RNA, 22 nt, Human
gggaacuguaguuuacgcugcc

SEQ ID NO: 151358 - RNA, 22 nt, Human
gcuucugugagugcagaugcug

SEQ ID NO: 151359 - RNA, 18 nt, Human
gggaagaugccacaguga

SEQ ID NO: 151360 - RNA, 22 nt, Human
gggaagaagaaaagagguggga

SEQ ID NO: 151361 - RNA, 22 nt, Human
gggaacgacuguuaguacuugg

SEQ ID NO: 151362 - RNA, 22 nt, Human
gggacgggcuagcugccguggc

SEQ ID NO: 151363 - RNA, 22 nt, Human
gcuucuguuaggauguggcuua

SEQ ID NO: 151364 - RNA, 22 nt, Human
gcuugcaucaggggcuggggcc

SEQ ID NO: 151365 - RNA, 20 nt, Human
gcuugcggacagguggcuca

SEQ ID NO: 151366 - RNA, 20 nt, Human
gggaauggauggauugcucc

SEQ ID NO: 151367 - RNA, 22 nt, Human
gggagcucaccaugcucugcau

SEQ ID NO: 151368 - RNA, 21 nt, Human
gggagccucauuuucuucauc

SEQ ID NO: 151369 - RNA, 22 nt, Human
gcuuuugcaaagcuggagaauu

SEQ ID NO: 151370 - RNA, 22 nt, Human
gggacugguuguguguggugug

SEQ ID NO: 151371 - RNA, 22 nt, Human
gcuuucccaaccuucuugguau

SEQ ID NO: 151372 - RNA, 22 nt, Human
gggagaaccagccagugcaagg

SEQ ID NO: 151373 - RNA, 22 nt, Human
gcuuuccuggcccugucccugc

SEQ ID NO: 151374 - RNA, 22 nt, Human
gggcagagggcgagcugggaga

SEQ ID NO: 151375 - RNA, 22 nt, Human
gggcagagagcuggaacuccuu

SEQ ID NO: 151376 - RNA, 22 nt, Human
ggaaaggacuggagcccagcgc

SEQ ID NO: 151377 - RNA, 22 nt, Human
gggcccaacuguuggcagccuc

SEQ ID NO: 151378 - RNA, 22 nt, Human
gggccgcagccucuccggccug

SEQ ID NO: 151379 - RNA, 22 nt, Human
ggaagccugggcgcaggcaggg

SEQ ID NO: 151380 - RNA, 22 nt, Human
ggaagacuuagaguagcaucag

SEQ ID NO: 151381 - RNA, 21 nt, Human
gggccugggccagggccgggu

SEQ ID NO: 151382 - RNA, 22 nt, Human
gggccggagaagguagcugaag

SEQ ID NO: 151383 - RNA, 22 nt, Human
ggaagcugucugcccggcgcuc

SEQ ID NO: 151384 - RNA, 18 nt, Human
ggaauagcuuguuuccca

SEQ ID NO: 151385 - RNA, 21 nt, Human
ggacccucagauggcagugag

SEQ ID NO: 151386 - RNA, 20 nt, Human
ggacccuggguucuucugag

SEQ ID NO: 151387 - RNA, 22 nt, Human
ggacggcuagcagcagaauuca

SEQ ID NO: 151388 - RNA, 22 nt, Human
ggacggggagcuggaaagggga

SEQ ID NO: 151389 - RNA, 22 nt, Human
ggacugggagaauggaggcaag

SEQ ID NO: 151390 - RNA, 22 nt, Human
ggacuggugaagccuucggaga

SEQ ID NO: 151391 - RNA, 22 nt, Human
ggacuucuggggacuguagauu

SEQ ID NO: 151392 - RNA, 19 nt, Human
gggcuuguuggcaaaugac

SEQ ID NO: 151393 - RNA, 22 nt, Human
gggcuuguuaacuuggcuucca

SEQ ID NO: 151394 - RNA, 22 nt, Human
ggcaugcaaaugugggugaccu

SEQ ID NO: 151395 - RNA, 22 nt, Human
ggcauuccucucuguucaugga

SEQ ID NO: 151396 - RNA, 22 nt, Human
gguggccuaacaaugguggcaa

SEQ ID NO: 151397 - RNA, 22 nt, Human
ggugaucucagucuagaugguu

SEQ ID NO: 151398 - RNA, 22 nt, Human
ggugaguagaaguaguuggcuu

SEQ ID NO: 151399 - RNA, 22 nt, Human
gguggcauguaccucacagacu

SEQ ID NO: 151400 - RNA, 22 nt, Human
ggugcuucgauagguguccaua

SEQ ID NO: 151401 - RNA, 22 nt, Human
ggugcuuuucacaagcauggga

SEQ ID NO: 151402 - RNA, 22 nt, Human
ggccaauuuccuagacauuagu

SEQ ID NO: 151403 - RNA, 22 nt, Human
ggccaccuaagguugugcauca

SEQ ID NO: 151404 - RNA, 22 nt, Human
ggccaaagagcacaaugaauag

SEQ ID NO: 151405 - RNA, 22 nt, Human
ggccaagagaggauggagggau

SEQ ID NO: 151406 - RNA, 19 nt, Human
gguuaccagugugucuggc

SEQ ID NO: 151407 - RNA, 22 nt, Human
gguguuccgguucugcucuggg

SEQ ID NO: 151408 - RNA, 22 nt, Human
ggugugugugugugugugugug

SEQ ID NO: 151409 - RNA, 22 nt, Human
ggugugaauagagccuggagca

SEQ ID NO: 151410 - RNA, 22 nt, Human
gguguggguguuaguuugcuua

SEQ ID NO: 151411 - RNA, 22 nt, Human
ggugugggcagaugcccuacuu

SEQ ID NO: 151412 - RNA, 22 nt, Human
ggcacaggcugguaccaguuca

SEQ ID NO: 151413 - RNA, 22 nt, Human
ggcacccugcauuggcuugagu

SEQ ID NO: 151414 - RNA, 22 nt, Human
ggugacuucugaaccuggagug

SEQ ID NO: 151415 - RNA, 19 nt, Human
ggcacccagagucccccug

SEQ ID NO: 151416 - RNA, 22 nt, Human
ggcacagcgacuaccaucgaaa

SEQ ID NO: 151417 - RNA, 22 nt, Human
ggcaaggaagaaagcagaaguu

SEQ ID NO: 151418 - RNA, 22 nt, Human
ggauccuucagcacugaggugu

SEQ ID NO: 151419 - RNA, 18 nt, Human
ggugagggagcuggaagc

SEQ ID NO: 151420 - RNA, 22 nt, Human
ggcagagguagcuggaaccagg

SEQ ID NO: 151421 - RNA, 22 nt, Human
ggcagaggaagcuggaaguggg

SEQ ID NO: 151422 - RNA, 22 nt, Human
gguauccaaauaaagcagguaa

SEQ ID NO: 151423 - RNA, 22 nt, Human
ggauggugauguacccagucau

SEQ ID NO: 151424 - RNA, 22 nt, Human
ggauggaugugaucugccuccu

SEQ ID NO: 151425 - RNA, 22 nt, Human
ggaugcagcagagaccuggagu

SEQ ID NO: 151426 - RNA, 22 nt, Human
ggagucguguuugggaucggag

SEQ ID NO: 151427 - RNA, 22 nt, Human
ggaggucagcuggaggggaggc

SEQ ID NO: 151428 - RNA, 22 nt, Human
ggagugaguauguucugaugca

SEQ ID NO: 151429 - RNA, 22 nt, Human
ggagggcuggacguacuagggc

SEQ ID NO: 151430 - RNA, 22 nt, Human
ggagguaagaggcccugggccg

SEQ ID NO: 151431 - RNA, 22 nt, Human
ggagguggagcuggaaguucca

SEQ ID NO: 151432 - RNA, 22 nt, Human
ggguggugagagaacuuugcag

SEQ ID NO: 151433 - RNA, 22 nt, Human
gggugcuucauaggugaugcug

SEQ ID NO: 151434 - RNA, 22 nt, Human
ggguggcaagucuuucugcaac

SEQ ID NO: 151435 - RNA, 22 nt, Human
ggguucauuugccggguaguuu

SEQ ID NO: 151436 - RNA, 22 nt, Human
ggguuccuuggaacacuguuug

SEQ ID NO: 151437 - RNA, 22 nt, Human
ggguuccugaagugguucagga

SEQ ID NO: 151438 - RNA, 22 nt, Human
ggaucgauuccaaauguagauc

SEQ ID NO: 151439 - RNA, 22 nt, Human
ggauccuuccuggugaagacug

SEQ ID NO: 151440 - RNA, 22 nt, Human
ggaucagcgagaagggcugaaa

SEQ ID NO: 151441 - RNA, 22 nt, Human
ggaucccaucgagcuggcuguc

SEQ ID NO: 151442 - RNA, 22 nt, Human
ggguuguuuguauuucucugaa

SEQ ID NO: 151443 - RNA, 22 nt, Human
ggaucaccagguuuguuguugg

SEQ ID NO: 151444 - RNA, 22 nt, Human
ggguuuccugcucgcggguagc

SEQ ID NO: 151445 - RNA, 20 nt, Human
ggagcgggcauuuguguucc

SEQ ID NO: 151446 - RNA, 22 nt, Human
ggagcugaacccuuaacuggcu

SEQ ID NO: 151447 - RNA, 22 nt, Human
gggguuggaugccuuggaaauu

SEQ ID NO: 151448 - RNA, 22 nt, Human
ggaggaaauccuuaguaaggca

SEQ ID NO: 151449 - RNA, 22 nt, Human
gggggcgcguggagggccgugg

SEQ ID NO: 151450 - RNA, 22 nt, Human
ggagccuggaguuucugauggg

SEQ ID NO: 151451 - RNA, 22 nt, Human
ggaggccagagaagagccaggc

SEQ ID NO: 151452 - RNA, 22 nt, Human
ggaggaggggcggggaggggag

SEQ ID NO: 151453 - RNA, 22 nt, Human
ggaggaugaggguggugguguu

SEQ ID NO: 151454 - RNA, 22 nt, Human
ggaggagggaguucaggaguau

SEQ ID NO: 151455 - RNA, 22 nt, Human
gggugcucauggauaaggcgaa

SEQ ID NO: 151456 - RNA, 21 nt, Human
gggugcacagcaaauuugaga

SEQ ID NO: 151457 - RNA, 22 nt, Human
ggaggccgugcugugcugccag

SEQ ID NO: 151458 - RNA, 22 nt, Human
ggaggcacugaaaguccuacag

SEQ ID NO: 151459 - RNA, 22 nt, Human
gggggagcuacaggucccuugg

SEQ ID NO: 151460 - RNA, 19 nt, Human
ggagcagauaaacauacuu

SEQ ID NO: 151461 - RNA, 22 nt, Human
ggggcuuccagcgcccgccggu

SEQ ID NO: 151462 - RNA, 22 nt, Human
ggagauggucacagguaaacau

SEQ ID NO: 151463 - RNA, 22 nt, Human
ggagaugacaucccagcccggc

SEQ ID NO: 151464 - RNA, 22 nt, Human
ggagcaagagugagcaagcaga

SEQ ID NO: 151465 - RNA, 20 nt, Human
gggcuuugagcucagggcuu

SEQ ID NO: 151466 - RNA, 22 nt, Human
gggcuuuuccauuccaggguuc

SEQ ID NO: 151467 - RNA, 22 nt, Human
ggaagaggaagaugaggcagca

SEQ ID NO: 151468 - RNA, 22 nt, Human
ggaagaagagggagcuguggga

SEQ ID NO: 151469 - RNA, 21 nt, Human
ggaauagcuuaaagugagggg

SEQ ID NO: 151470 - RNA, 20 nt, Human
ggaacccuagacuugcgcag

SEQ ID NO: 151471 - RNA, 22 nt, Human
gccuggggaacuugauccuguc

SEQ ID NO: 151472 - RNA, 22 nt, Human
gccugggccgggcgcggccccc

SEQ ID NO: 151473 - RNA, 22 nt, Human
ggaauguuuuccagaccuagau

SEQ ID NO: 151474 - RNA, 22 nt, Human
ggaauuaagaggcuggacaggg

SEQ ID NO: 151475 - RNA, 22 nt, Human
ggacuuggcagugucaaauuua

SEQ ID NO: 151476 - RNA, 22 nt, Human
ggaccagagcuaaugcgcgccc

SEQ ID NO: 151477 - RNA, 22 nt, Human
ggacauggaaagugugugauuu

SEQ ID NO: 151478 - RNA, 22 nt, Human
ggacagagcaacccuacgcagc

SEQ ID NO: 151479 - RNA, 18 nt, Human
ggacaguuguagaggacu

SEQ ID NO: 151480 - RNA, 22 nt, Human
ggaggccccccaugcagcucca

SEQ ID NO: 151481 - RNA, 19 nt, Human
ggaggguguccucaguguc

SEQ ID NO: 151482 - RNA, 23 nt, Human
ggaggcccagaggucggccccac

SEQ ID NO: 151483 - RNA, 22 nt, Human
ggaggggaguuugccucugggg

SEQ ID NO: 151484 - RNA, 22 nt, Human
ggaggcggaaguccaagcaggu

SEQ ID NO: 151485 - RNA, 22 nt, Human
ggaggcccagaaggaagcccag

SEQ ID NO: 151486 - RNA, 22 nt, Human
ggagaccagaaggaagcuucga

SEQ ID NO: 151487 - RNA, 22 nt, Human
gcgcgcucugcgaggacacgcu

SEQ ID NO: 151488 - RNA, 22 nt, Human
ggagcuaagagaauggacaagg

SEQ ID NO: 151489 - RNA, 22 nt, Human
gcggagaggcagagacuccgcg

SEQ ID NO: 151490 - RNA, 22 nt, Human
gcgcucuccugcagacagccuc

SEQ ID NO: 151491 - RNA, 22 nt, Human
gcggaucuccuugagugggcaa

SEQ ID NO: 151492 - RNA, 22 nt, Human
ggcacgagccaguguguguguu

SEQ ID NO: 151493 - RNA, 22 nt, Human
ggcacuggguugcagagagaga

SEQ ID NO: 151494 - RNA, 22 nt, Human
ggcagcgcuuggcugcucgaca

SEQ ID NO: 151495 - RNA, 22 nt, Human
gcuagagaagagcccacaccgg

SEQ ID NO: 151496 - RNA, 21 nt, Human
ggcagccuggcaggggcacug

SEQ ID NO: 151497 - RNA, 22 nt, Human
ggcagcccuggacccuggagaa

SEQ ID NO: 151498 - RNA, 22 nt, Human
ggcagcagaaccaacuguggcu

SEQ ID NO: 151499 - RNA, 20 nt, Human
ggcagcaaccauaugcuaca

SEQ ID NO: 151500 - RNA, 22 nt, Human
gcguagaagaaagcugcugcua

SEQ ID NO: 151501 - RNA, 22 nt, Human
gcguaccugaaauuacggcacu

SEQ ID NO: 151502 - RNA, 22 nt, Human
gcguggccugcugaaggacuuc

SEQ ID NO: 151503 - RNA, 22 nt, Human
gcguggaugauuuugagucggu

SEQ ID NO: 151504 - RNA, 22 nt, Human
gcgugcauggccguguguaugc

SEQ ID NO: 151505 - RNA, 22 nt, Human
gcuccggggguuccagaucauc

SEQ ID NO: 151506 - RNA, 22 nt, Human
gcucggcuggcucaucucaugu

SEQ ID NO: 151507 - RNA, 22 nt, Human
gcucagagaugucugcugccuu

SEQ ID NO: 151508 - RNA, 22 nt, Human
gcucagagaaaacuggggcuug

SEQ ID NO: 151509 - RNA, 22 nt, Human
gcucaaggucacacagggguga

SEQ ID NO: 151510 - RNA, 22 nt, Human
ggcagguccugaguccugaggc

SEQ ID NO: 151511 - RNA, 22 nt, Human
ggcaguagucagaggguuuuac

SEQ ID NO: 151512 - RNA, 22 nt, Human
gcuaggagccucgacucuggag

SEQ ID NO: 151513 - RNA, 22 nt, Human
gcuagcugugcuuggaaguuug

SEQ ID NO: 151514 - RNA, 22 nt, Human
ggcaguguggauccuggagaag

SEQ ID NO: 151515 - RNA, 20 nt, Human
ggcaucugacaacuaguugc

SEQ ID NO: 151516 - RNA, 22 nt, Human
ggcauugauggggucuugggga

SEQ ID NO: 151517 - RNA, 22 nt, Human
ggcauggugggggaggacuugg

SEQ ID NO: 151518 - RNA, 22 nt, Human
gcucucucuucugcaggccuua

SEQ ID NO: 151519 - RNA, 22 nt, Human
gcaugguuuccugcaacguucu

SEQ ID NO: 151520 - RNA, 20 nt, Human
gcauggcuggcugcugucug

SEQ ID NO: 151521 - RNA, 22 nt, Human
gcccccgccuugcugggccagg

SEQ ID NO: 151522 - RNA, 22 nt, Human
gcccccauuccugcggccuuca

SEQ ID NO: 151523 - RNA, 15 nt, Human
gccccaggaaucaaa

SEQ ID NO: 151524 - RNA, 22 nt, Human
gcccuggucguggagggcaaca

SEQ ID NO: 151525 - RNA, 20 nt, Human
gcccuucccccuccgcgagc

SEQ ID NO: 151526 - RNA, 22 nt, Human
gcccuguuuucuggguuccuug

SEQ ID NO: 151527 - RNA, 22 nt, Human
gcccuguguguuugcacugauu

SEQ ID NO: 151528 - RNA, 22 nt, Human
gcugucauggacaugucuguuu

SEQ ID NO: 151529 - RNA, 22 nt, Human
gcugucccccaaagaugcuccu

SEQ ID NO: 151530 - RNA, 22 nt, Human
gcuggugugagauucucgaggg

SEQ ID NO: 151531 - RNA, 22 nt, Human
gcuguacugucugccaagccag

SEQ ID NO: 151532 - RNA, 22 nt, Human
gcuguugugaggaucagcauau

SEQ ID NO: 151533 - RNA, 22 nt, Human
gcuguuucuuuggcaaacugau

SEQ ID NO: 151534 - RNA, 22 nt, Human
gcuguggaaaaugggucuccaa

SEQ ID NO: 151535 - RNA, 18 nt, Human
gcuguccgguagcuggug

SEQ ID NO: 151536 - RNA, 22 nt, Human
gccgccgcucaccugggcgccg

SEQ ID NO: 151537 - RNA, 22 nt, Human
gccgcagauucugagacgugua

SEQ ID NO: 151538 - RNA, 22 nt, Human
gccgcaacggacccugggaguc

SEQ ID NO: 151539 - RNA, 22 nt, Human
gcuuccuuagcuuaccaaguau

SEQ ID NO: 151540 - RNA, 21 nt, Human
gccgaugugacucuacguagu

SEQ ID NO: 151541 - RNA, 22 nt, Human
gcuucccacagcuggacugggg

SEQ ID NO: 151542 - RNA, 21 nt, Human
gcuucaauucauccaccucuc

SEQ ID NO: 151543 - RNA, 22 nt, Human
gccugcaggaaggugugccugu

SEQ ID NO: 151544 - RNA, 18 nt, Human
gccugccagccgagggac

SEQ ID NO: 151545 - RNA, 22 nt, Human
gccugcagccagggaguucucu

SEQ ID NO: 151546 - RNA, 22 nt, Human
gccugccucugacuggggcuga

SEQ ID NO: 151547 - RNA, 22 nt, Human
gccgggagugcagcgggcgcgc

SEQ ID NO: 151548 - RNA, 22 nt, Human
gccggcccugcgcggggcggaa

SEQ ID NO: 151549 - RNA, 22 nt, Human
gccggcugggggcggagggcag

SEQ ID NO: 151550 - RNA, 22 nt, Human
gccggguguuccugggaagaug

SEQ ID NO: 151551 - RNA, 22 nt, Human
gccguuccuacucucucugugu

SEQ ID NO: 151552 - RNA, 21 nt, Human
gccgugcgccuccaggcgcgc

SEQ ID NO: 151553 - RNA, 18 nt, Human
gccucuguugacagaguu

SEQ ID NO: 151554 - RNA, 22 nt, Human
gcuuuggcuucuccuggcagga

SEQ ID NO: 151555 - RNA, 22 nt, Human
gcuugaggaacucagacuugag

SEQ ID NO: 151556 - RNA, 22 nt, Human
gccgcgggucugggucuggcuc

SEQ ID NO: 151557 - RNA, 22 nt, Human
gcuugcuuuguaaauaucugug

SEQ ID NO: 151558 - RNA, 20 nt, Human
gcuugcgugggaggaggggg

SEQ ID NO: 151559 - RNA, 22 nt, Human
gcuugcugaacaggaaccuggc

SEQ ID NO: 151560 - RNA, 22 nt, Human
gcuugggcugaaggccuggguc

SEQ ID NO: 151561 - RNA, 18 nt, Human
gcuuggguggcuauguuu

SEQ ID NO: 151562 - RNA, 22 nt, Human
gcuuggagaacguuuucuagaa

SEQ ID NO: 151563 - RNA, 22 nt, Human
gcaggccuccccugcuggagcu

SEQ ID NO: 151564 - RNA, 22 nt, Human
gauccucagacccuccucuggu

SEQ ID NO: 151565 - RNA, 21 nt, Human
gaucgcaaugugggaaucaug

SEQ ID NO: 151566 - RNA, 22 nt, Human
gaucuguccuggcaguuaacac

SEQ ID NO: 151567 - RNA, 22 nt, Human
gcagguccgagagggucgggua

SEQ ID NO: 151568 - RNA, 22 nt, Human
gcaguauuguguguggucaugg

SEQ ID NO: 151569 - RNA, 22 nt, Human
gcagguuguuuaaauuaggauu

SEQ ID NO: 151570 - RNA, 22 nt, Human
gcagugacagacaacuguuuga

SEQ ID NO: 151571 - RNA, 23 nt, Human
gcagugacugggauggaaguaga

SEQ ID NO: 151572 - RNA, 19 nt, Human
gagugaggagcaucguuua

SEQ ID NO: 151573 - RNA, 22 nt, Human
gaguggccugccccagccaggc

SEQ ID NO: 151574 - RNA, 22 nt, Human
gagugaucuguaggcagcaugg

SEQ ID NO: 151575 - RNA, 22 nt, Human
gagugggugaaugugcucauaa

SEQ ID NO: 151576 - RNA, 22 nt, Human
gcagugccauguggaggaucuc

SEQ ID NO: 151577 - RNA, 22 nt, Human
gcaguuaccuauuuuguagaaa

SEQ ID NO: 151578 - RNA, 22 nt, Human
gcaguugguccagccucggcug

SEQ ID NO: 151579 - RNA, 19 nt, Human
gcaguuccucuuaagagaa

SEQ ID NO: 151580 - RNA, 22 nt, Human
gagucaucucuagaaugaugau

SEQ ID NO: 151581 - RNA, 19 nt, Human
gccacccaucauauggagg

SEQ ID NO: 151582 - RNA, 20 nt, Human
gccaccucugcucuuucccg

SEQ ID NO: 151583 - RNA, 21 nt, Human
gccacugcugcucauucucug

SEQ ID NO: 151584 - RNA, 22 nt, Human
gccaaucaggaggcuguacauc

SEQ ID NO: 151585 - RNA, 22 nt, Human
gccaaccagucgguccaggaag

SEQ ID NO: 151586 - RNA, 22 nt, Human
gcaucuccugagucagauuuug

SEQ ID NO: 151587 - RNA, 22 nt, Human
gccagcuuagaucccccagccc

SEQ ID NO: 151588 - RNA, 22 nt, Human
gccaggagaaaaggcgaaugau

SEQ ID NO: 151589 - RNA, 22 nt, Human
gauccagauauuugggcuggua

SEQ ID NO: 151590 - RNA, 22 nt, Human
gaucccagaggcggggauagga

SEQ ID NO: 151591 - RNA, 22 nt, Human
gaucugguuccaggacauugca

SEQ ID NO: 151592 - RNA, 22 nt, Human
gccaucuucggcagccgccugg

SEQ ID NO: 151593 - RNA, 22 nt, Human
gcccagcucucuggccugucuu

SEQ ID NO: 151594 - RNA, 22 nt, Human
gccccaaccccuccuuggucua

SEQ ID NO: 151595 - RNA, 23 nt, Human
gccaucugcugggugccccggcc

SEQ ID NO: 151596 - RNA, 22 nt, Human
gccaguuuguuuacugaugguu

SEQ ID NO: 151597 - RNA, 22 nt, Human
gauggugcaauuaucgugcaug

SEQ ID NO: 151598 - RNA, 22 nt, Human
gauggguuugagauguuugggu

SEQ ID NO: 151599 - RNA, 22 nt, Human
gaugguaucugcuggcuuucag

SEQ ID NO: 151600 - RNA, 22 nt, Human
gcccauggagaccucaggcugg

SEQ ID NO: 151601 - RNA, 22 nt, Human
gaugggaggaugaauuggaccu

SEQ ID NO: 151602 - RNA, 22 nt, Human
gcccgaccgcgccggcccgcac

SEQ ID NO: 151603 - RNA, 22 nt, Human
gaugucauguuggcagacaguu

SEQ ID NO: 151604 - RNA, 22 nt, Human
gccccgcgcgcguagcgccgcu

SEQ ID NO: 151605 - RNA, 22 nt, Human
gcccccagcuggcuugaggauu

SEQ ID NO: 151606 - RNA, 22 nt, Human
gccccaggggaggugcccugca

SEQ ID NO: 151607 - RNA, 22 nt, Human
gcccuguuauagucugaggccu

SEQ ID NO: 151608 - RNA, 22 nt, Human
gcccuggcauuucuauucaugu

SEQ ID NO: 151609 - RNA, 22 nt, Human
gcccugccauugaucggcccag

SEQ ID NO: 151610 - RNA, 22 nt, Human
gcacaggcugcacgaccccagc

SEQ ID NO: 151611 - RNA, 21 nt, Human
gcacaacucucacauucuucu

SEQ ID NO: 151612 - RNA, 22 nt, Human
gccugcacucaaacacucucuu

SEQ ID NO: 151613 - RNA, 22 nt, Human
gcagagaaugucagauuuuguu

SEQ ID NO: 151614 - RNA, 22 nt, Human
gcacucugggucaucugcugcc

SEQ ID NO: 151615 - RNA, 22 nt, Human
gccugcugggcucuuccugcug

SEQ ID NO: 151616 - RNA, 22 nt, Human
gccugggguuugcggggcugca

SEQ ID NO: 151617 - RNA, 22 nt, Human
gcagaggcugccgugggcagga

SEQ ID NO: 151618 - RNA, 22 nt, Human
gcagaugagagugugaucuggg

SEQ ID NO: 151619 - RNA, 22 nt, Human
gcgccgacccucccugccggac

SEQ ID NO: 151620 - RNA, 22 nt, Human
gcagcauuaccaagacauggca

SEQ ID NO: 151621 - RNA, 23 nt, Human
gcagccaacccacgugagagaag

SEQ ID NO: 151622 - RNA, 22 nt, Human
gcagcagugugggcugaaccua

SEQ ID NO: 151623 - RNA, 22 nt, Human
gcgcacaaccccguggcgguga

SEQ ID NO: 151624 - RNA, 22 nt, Human
gcgcggcgcggguccucggccu

SEQ ID NO: 151625 - RNA, 20 nt, Human
gcagcugacccuagugcuug

SEQ ID NO: 151626 - RNA, 20 nt, Human
gcgcuucccuacgcucugcu

SEQ ID NO: 151627 - RNA, 22 nt, Human
gcggacaauggaagaugucauu

SEQ ID NO: 151628 - RNA, 22 nt, Human
gcgcgggugagucacgggcgga

SEQ ID NO: 151629 - RNA, 22 nt, Human
gcgcugagcuuuucuuauugaa

SEQ ID NO: 151630 - RNA, 22 nt, Human
gcgggcuuggcuccagggccca

SEQ ID NO: 151631 - RNA, 22 nt, Human
gcaggaagauugcagaaggcug

SEQ ID NO: 151632 - RNA, 22 nt, Human
gcagggcucagccgcucccacc

SEQ ID NO: 151633 - RNA, 22 nt, Human
gcagucauggguagaacucaag

SEQ ID NO: 151634 - RNA, 22 nt, Human
gcaguccuguagcgacuuuuuu

SEQ ID NO: 151635 - RNA, 22 nt, Human
gcaguagauccagcagccugca

SEQ ID NO: 151636 - RNA, 22 nt, Human
gcaggucacagcugauuggcca

SEQ ID NO: 151637 - RNA, 22 nt, Human
gcagguggaagcagcagacuca

SEQ ID NO: 151638 - RNA, 22 nt, Human
gcagggcucuggagucaggcug

SEQ ID NO: 151639 - RNA, 22 nt, Human
gcagugcugcgacagucgggug

SEQ ID NO: 151640 - RNA, 23 nt, Human
gcaguggagcgagaacuuccugu

SEQ ID NO: 151641 - RNA, 22 nt, Human
gcagugcauggaagggggugug

SEQ ID NO: 151642 - RNA, 22 nt, Human
gcaucccagaagauucugauuu

SEQ ID NO: 151643 - RNA, 22 nt, Human
gcauagauauguaaugcaucau

SEQ ID NO: 151644 - RNA, 22 nt, Human
gcucagccuuuuguucuauuca

SEQ ID NO: 151645 - RNA, 23 nt, Human
gcaucgcaggucuaagauuagcu

SEQ ID NO: 151646 - RNA, 22 nt, Human
gcauccugacuauggugguggu

SEQ ID NO: 151647 - RNA, 22 nt, Human
gcucccagcuuuuguccacggc

SEQ ID NO: 151648 - RNA, 22 nt, Human
gcaugcgugcgugcgugcaugu

SEQ ID NO: 151649 - RNA, 23 nt, Human
gcucauguugcuucuguucuguc

SEQ ID NO: 151650 - RNA, 23 nt, Human
gcugaagcccacucccugggucu

SEQ ID NO: 151651 - RNA, 22 nt, Human
gcaugcaggaagggcuugggga

SEQ ID NO: 151652 - RNA, 20 nt, Human
gcucuucuccgggucugccu

SEQ ID NO: 151653 - RNA, 22 nt, Human
ccagcaggagacuagcaacaua

SEQ ID NO: 151654 - RNA, 22 nt, Human
aauguucucuaaucuuucucuu

SEQ ID NO: 151655 - RNA, 22 nt, Human
auuaaauagcagaagaaagaug

SEQ ID NO: 151656 - RNA, 22 nt, Human
agagacuguaaugagagguaca

SEQ ID NO: 151657 - RNA, 22 nt, Human
gauacugugggcacucauaaua

SEQ ID NO: 151658 - RNA, 22 nt, Human
cugcagauguagcugcuuuccu

SEQ ID NO: 151659 - RNA, 22 nt, Human
uuuuuauaagagcagcagaguu

SEQ ID NO: 151660 - RNA, 22 nt, Human
auggauggaagcagccugaacu

SEQ ID NO: 151661 - RNA, 22 nt, Human
aggggaggcugcgggcugccgu

SEQ ID NO: 151662 - RNA, 22 nt, Human
aacacuguaucagucuucaaua

SEQ ID NO: 151663 - RNA, 22 nt, Human
cugaaagacagccaggcaaagc

SEQ ID NO: 151664 - RNA, 22 nt, Human
acuuuuccuggguagcuccugg

SEQ ID NO: 151665 - RNA, 22 nt, Human
gaggguggggaauagacugcua

SEQ ID NO: 151666 - RNA, 22 nt, Human
aagccuccgugcugcuggaucu

SEQ ID NO: 151667 - RNA, 22 nt, Human
uuauuuaaguauuuauugaagu

SEQ ID NO: 151668 - RNA, 22 nt, Human
uggccaaauuggccugauguau

SEQ ID NO: 151669 - RNA, 22 nt, Human
auaccaaugaaucccugagaau

SEQ ID NO: 151670 - RNA, 20 nt, Human
uccaguuuuggagacauucu

SEQ ID NO: 151671 - RNA, 22 nt, Human
gagggcugccacguugggcgag

SEQ ID NO: 151672 - RNA, 22 nt, Human
augcuuucucuucuauuucuca

SEQ ID NO: 151673 - RNA, 22 nt, Human
augguguaagacuguauuucuu

SEQ ID NO: 151674 - RNA, 22 nt, Human
uaagcuauuccugaagaagguu

SEQ ID NO: 151675 - RNA, 22 nt, Human
aaacagcugcaguacacggccu

SEQ ID NO: 151676 - RNA, 22 nt, Human
uacugcaguuccugcugucucc

SEQ ID NO: 151677 - RNA, 22 nt, Human
ugcccacuucaaaaucuucauu

SEQ ID NO: 151678 - RNA, 22 nt, Human
ugaacauuuuugcuugcagcuu

SEQ ID NO: 151679 - RNA, 22 nt, Human
ggcagguccugaguccugaggc

SEQ ID NO: 151680 - RNA, 22 nt, Human
uggggggacagauggagaggac

SEQ ID NO: 151681 - RNA, 22 nt, Human
uguugucaugcagucaguggua

SEQ ID NO: 151682 - RNA, 22 nt, Human
caaagccuggggagaguaagga

SEQ ID NO: 151683 - RNA, 22 nt, Human
ugagggucgcaagcaccaggcc

SEQ ID NO: 151684 - RNA, 22 nt, Human
uuuucauagccagaaacugaaa

SEQ ID NO: 151685 - RNA, 22 nt, Human
cugagguccucagagggaaagg

SEQ ID NO: 151686 - RNA, 22 nt, Human
caguggagaccugccugcugga

SEQ ID NO: 151687 - RNA, 22 nt, Human
uaaaugaaaggguuuaauuuau

SEQ ID NO: 151688 - RNA, 22 nt, Human
uugaauaaggcauaaagauacu

SEQ ID NO: 151689 - RNA, 22 nt, Human
ggcugcagggaacaggaugggu

SEQ ID NO: 151690 - RNA, 21 nt, Human
ugcuuucugugcuuuuucugc

SEQ ID NO: 151691 - RNA, 20 nt, Human
ucuugucuggcagccuggag

SEQ ID NO: 151692 - RNA, 22 nt, Human
uugccaggggacaucuggagcc

SEQ ID NO: 151693 - RNA, 22 nt, Human
aggcucagcaucugauucauau

SEQ ID NO: 151694 - RNA, 22 nt, Human
auuauugcaagcagugaaggga

SEQ ID NO: 151695 - RNA, 22 nt, Human
ggcugugguggacgcgggaaac

SEQ ID NO: 151696 - RNA, 22 nt, Human
ucaaauaugggccagaggaaau

SEQ ID NO: 151697 - RNA, 23 nt, Human
aagaaugcuucugaagagcugcc

SEQ ID NO: 151698 - RNA, 22 nt, Human
ugcucacugcuuguguucaguu

SEQ ID NO: 151699 - RNA, 22 nt, Human
uuuuuuuaaguuuugauuuuag

SEQ ID NO: 151700 - RNA, 22 nt, Human
cagcuguggagauggggugcau

SEQ ID NO: 151701 - RNA, 22 nt, Human
uacaacuuacuugaauggcuuu

SEQ ID NO: 151702 - RNA, 22 nt, Human
cacugguugccucuuucuguuc

SEQ ID NO: 151703 - RNA, 22 nt, Human
guauugauuguuuuaaaagauu

SEQ ID NO: 151704 - RNA, 22 nt, Human
ucccagaacggguucuucccag

SEQ ID NO: 151705 - RNA, 22 nt, Human
ggggaggugugcaggacaccuc

SEQ ID NO: 151706 - RNA, 22 nt, Human
uggaaggggagcuggaaagggg

SEQ ID NO: 151707 - RNA, 22 nt, Human
uuggggagaagagcuggucagg

SEQ ID NO: 151708 - RNA, 22 nt, Human
uuugauuuuuugagcaguguau

SEQ ID NO: 151709 - RNA, 22 nt, Human
cauuugcuuaucacucuucuuu

SEQ ID NO: 151710 - RNA, 22 nt, Human
cagcuucuccauucuucuggcu

SEQ ID NO: 151711 - RNA, 22 nt, Human
auguaugagagauucuuuuauu

SEQ ID NO: 151712 - RNA, 22 nt, Human
ucaguuuaauuggaucuuuuuc

SEQ ID NO: 151713 - RNA, 22 nt, Human
gugugugucuacuuucaucucu

SEQ ID NO: 151714 - RNA, 22 nt, Human
gcacauaugcuguaagcacaug

SEQ ID NO: 151715 - RNA, 20 nt, Human
gacaugagggagcaaagagc

SEQ ID NO: 151716 - RNA, 22 nt, Human
uuuugauacaaguuguaaaaaa

SEQ ID NO: 151717 - RNA, 22 nt, Human
auuuccacaaauuaagauugca

SEQ ID NO: 151718 - RNA, 22 nt, Human
aggaaaaagaagaaaagaauca

SEQ ID NO: 151719 - RNA, 22 nt, Human
aggcaggggagcuggaagggua

SEQ ID NO: 151720 - RNA, 22 nt, Human
cagaucacauccauccgucacc

SEQ ID NO: 151721 - RNA, 22 nt, Human
cugguacuggaggaguucagag

SEQ ID NO: 151722 - RNA, 22 nt, Human
ccaaagaauuuggaaaaucuga

SEQ ID NO: 151723 - RNA, 18 nt, Human
aaacccacguauucaggc

SEQ ID NO: 151724 - RNA, 22 nt, Human
ugucuuuagagugaacagaaga

SEQ ID NO: 151725 - RNA, 22 nt, Human
ucugaguuaaaauuccagaggu

SEQ ID NO: 151726 - RNA, 22 nt, Human
uggcucagcgcggccuggucuu

SEQ ID NO: 151727 - RNA, 22 nt, Human
auguuuucauuuagaagcuaau

SEQ ID NO: 151728 - RNA, 22 nt, Human
cucuuucauucuguccuuguuu

SEQ ID NO: 151729 - RNA, 22 nt, Human
augcuaaucaaacuuucugcag

SEQ ID NO: 151730 - RNA, 22 nt, Human
agauucucccuccuggcgcugu

SEQ ID NO: 151731 - RNA, 22 nt, Human
uauuuuagccaacagaaugaug

SEQ ID NO: 151732 - RNA, 22 nt, Human
gaggacccuuaggucagacaga

SEQ ID NO: 151733 - RNA, 22 nt, Human
gaauucuaguucuguaucucug

SEQ ID NO: 151734 - RNA, 22 nt, Human
uucauuuccauuuuauagauaa

SEQ ID NO: 151735 - RNA, 22 nt, Human
acauaaaccccccuuccccagg

SEQ ID NO: 151736 - RNA, 22 nt, Human
cuucuuuucuacuggccuagaa

SEQ ID NO: 151737 - RNA, 22 nt, Human
caagaaaaaacaugaugagugu

SEQ ID NO: 151738 - RNA, 22 nt, Human
gauaagugauucugauucacau

SEQ ID NO: 151739 - RNA, 19 nt, Human
acugggaugggcagugcca

SEQ ID NO: 151740 - RNA, 22 nt, Human
gggagggucugagagcugcacc

SEQ ID NO: 151741 - RNA, 22 nt, Human
gcagaugagagugugaucuggg

SEQ ID NO: 151742 - RNA, 22 nt, Human
cgggaggcggagcuccgcgggg

SEQ ID NO: 151743 - RNA, 22 nt, Human
aaaguaaagccuauuuaauaau

SEQ ID NO: 151744 - RNA, 22 nt, Human
ccagcaaguaagucagugucag

SEQ ID NO: 151745 - RNA, 22 nt, Human
guacauauggcacaugcuauuu

SEQ ID NO: 151746 - RNA, 22 nt, Human
gggaaaaaggaguuagagauaa

SEQ ID NO: 151747 - RNA, 22 nt, Human
auugacagaaaauuggauggca

SEQ ID NO: 151748 - RNA, 22 nt, Human
gagggugguggcggccggcacc

SEQ ID NO: 151749 - RNA, 22 nt, Human
cucuuuucaaaccuguuuaugg

SEQ ID NO: 151750 - RNA, 22 nt, Human
auggaguguggccaggcaguaa

SEQ ID NO: 151751 - RNA, 22 nt, Human
cuguggcugcgcccugggggag

SEQ ID NO: 151752 - RNA, 22 nt, Human
uaaauuugugaauuagcuauca

SEQ ID NO: 151753 - RNA, 22 nt, Human
ggagcucacuacgaaauaagcu

SEQ ID NO: 151754 - RNA, 22 nt, Human
cucuaagcuuugguguuucacu

SEQ ID NO: 151755 - RNA, 22 nt, Human
guggcaaguuuucugacaagga

SEQ ID NO: 151756 - RNA, 22 nt, Human
uuuuucugacugcuaacaaaaa

SEQ ID NO: 151757 - RNA, 22 nt, Human
guguucuuuguagaggaucuug

SEQ ID NO: 151758 - RNA, 20 nt, Human
agcuuucaccaguacuucca

SEQ ID NO: 151759 - RNA, 22 nt, Human
uuagaaauguccuacuaauaug

SEQ ID NO: 151760 - RNA, 22 nt, Human
acagcucaggcccaucaacccc

SEQ ID NO: 151761 - RNA, 23 nt, Human
gcccagaggccccuggccugagc

SEQ ID NO: 151762 - RNA, 22 nt, Human
aaauuuuguugaaaaauauuuu

SEQ ID NO: 151763 - RNA, 22 nt, Human
gacuggcucuaucaggauaaau

SEQ ID NO: 151764 - RNA, 22 nt, Human
auuuuucuuucacauuuucuua

SEQ ID NO: 151765 - RNA, 22 nt, Human
ggagagaacguaaucuaguauu

SEQ ID NO: 151766 - RNA, 22 nt, Human
cacagcuggggaagcugaggcc

SEQ ID NO: 151767 - RNA, 20 nt, Human
ucauucagaaucaguaugca

SEQ ID NO: 151768 - RNA, 22 nt, Human
uuauaagugccucuuuauuuuc

SEQ ID NO: 151769 - RNA, 22 nt, Human
caggagagucucugucuguacu

SEQ ID NO: 151770 - RNA, 22 nt, Human
aggugagaacguggaggggcgg

SEQ ID NO: 151771 - RNA, 22 nt, Human
gugcagcugggcgcugaccuuc

SEQ ID NO: 151772 - RNA, 22 nt, Human
cucagcgagggaaagaggccgc

SEQ ID NO: 151773 - RNA, 22 nt, Human
acauccagcagauuguccagag

SEQ ID NO: 151774 - RNA, 22 nt, Human
ugagauuuagaacuggauuuca

SEQ ID NO: 151775 - RNA, 19 nt, Human
gcugggauaggauguauuu

SEQ ID NO: 151776 - RNA, 22 nt, Human
uaggauugguguauguagguuu

SEQ ID NO: 151777 - RNA, 22 nt, Human
ggcucacuguaccugccgccgc

SEQ ID NO: 151778 - RNA, 22 nt, Human
ggugugaauagagccuggagca

SEQ ID NO: 151779 - RNA, 22 nt, Human
uccuugaauugcguccacaaga

SEQ ID NO: 151780 - RNA, 22 nt, Human
agaauacaauuguucaguaaua

SEQ ID NO: 151781 - RNA, 23 nt, Human
aggcugccacucagggugaggcu

SEQ ID NO: 151782 - RNA, 22 nt, Human
ugagggaguguggauacaguag

SEQ ID NO: 151783 - RNA, 22 nt, Human
uuuguuugcuaguauuuuguuu

SEQ ID NO: 151784 - RNA, 22 nt, Human
uggccccauuuuucuggagccu

SEQ ID NO: 151785 - RNA, 23 nt, Human
uuucugaguuuuuuaaaagucca

SEQ ID NO: 151786 - RNA, 22 nt, Human
aaauauuaaugaugaagguagu

SEQ ID NO: 151787 - RNA, 22 nt, Human
guuuccaggcuuugguaugguu

SEQ ID NO: 151788 - RNA, 22 nt, Human
guggaagauauuucugguccag

SEQ ID NO: 151789 - RNA, 22 nt, Human
gaggagggagcuggaagcucuu

SEQ ID NO: 151790 - RNA, 22 nt, Human
aggaaaguugcuuguagugcug

SEQ ID NO: 151791 - RNA, 22 nt, Human
aucuugaaacauauaugcauuu

SEQ ID NO: 151792 - RNA, 19 nt, Human
ccaguuuuuuaauauucaa

SEQ ID NO: 151793 - RNA, 22 nt, Human
uugcaagcccugaagggcugga

SEQ ID NO: 151794 - RNA, 22 nt, Human
ggagguggagcuggaaguucca

SEQ ID NO: 151795 - RNA, 22 nt, Human
gcaacuccuaggcgaggccuuc

SEQ ID NO: 151796 - RNA, 22 nt, Human
gcaguuaccuauuuuguagaaa

SEQ ID NO: 151797 - RNA, 22 nt, Human
uuuaucaggccaucuuaugucu

SEQ ID NO: 151798 - RNA, 22 nt, Human
accuuuggaggacuagggucau

SEQ ID NO: 151799 - RNA, 22 nt, Human
acauggcaugaauaauguguac

SEQ ID NO: 151800 - RNA, 22 nt, Human
agagacaggguuuugucguguu

SEQ ID NO: 151801 - RNA, 22 nt, Human
uuuauugcuaugucuugauugu

SEQ ID NO: 151802 - RNA, 22 nt, Human
ucccagguugaggccuugccug

SEQ ID NO: 151803 - RNA, 22 nt, Human
cuccucccagcccaggcgccac

SEQ ID NO: 151804 - RNA, 22 nt, Human
gcagguggaagcagcagacuca

SEQ ID NO: 151805 - RNA, 22 nt, Human
cagcuccagcccaggcagcucc

SEQ ID NO: 151806 - RNA, 21 nt, Human
uggcaggcagcuggaagcuug

SEQ ID NO: 151807 - RNA, 22 nt, Human
uucagcaagugucucuacuguc

SEQ ID NO: 151808 - RNA, 22 nt, Human
uuuuaaauggcuuuuacuuuuc

SEQ ID NO: 151809 - RNA, 22 nt, Human
uguuggaaucuucuagucuucc

SEQ ID NO: 151810 - RNA, 20 nt, Human
uggcccgcgcuccuccugcu

SEQ ID NO: 151811 - RNA, 22 nt, Human
ugcuuucagauaucuguuucaa

SEQ ID NO: 151812 - RNA, 22 nt, Human
ugucuuucuuucucuugacaga

SEQ ID NO: 151813 - RNA, 22 nt, Human
ggagacagugacuuagagacug

SEQ ID NO: 151814 - RNA, 22 nt, Human
ggcucagaggagcuggaacggu

SEQ ID NO: 151815 - RNA, 22 nt, Human
acaggcugcccgcuccccaccu

SEQ ID NO: 151816 - RNA, 22 nt, Human
uuuaauuauaucugggcaguua

SEQ ID NO: 151817 - RNA, 22 nt, Human
ggccagcuuugagcugcaggaa

SEQ ID NO: 151818 - RNA, 22 nt, Human
uuuuauuuguauguugaaugua

SEQ ID NO: 151819 - RNA, 22 nt, Human
uucuucuuuccuauaauuaauu

SEQ ID NO: 151820 - RNA, 22 nt, Human
caggggcuccaggugagccugg

SEQ ID NO: 151821 - RNA, 22 nt, Human
aauuauuauguggaagacgacg

SEQ ID NO: 151822 - RNA, 22 nt, Human
gcagagcugucuaagucacuuc

SEQ ID NO: 151823 - RNA, 22 nt, Human
aauaaagcuugaaagcagggaa

SEQ ID NO: 151824 - RNA, 22 nt, Human
cacauuuuccagaagaaucaga

SEQ ID NO: 151825 - RNA, 22 nt, Human
aucuaaaacuacgaauacuacc

SEQ ID NO: 151826 - RNA, 22 nt, Human
uauauacuugaaaauugcugag

SEQ ID NO: 151827 - RNA, 22 nt, Human
uuuauuuuccaugucucuaggu

SEQ ID NO: 151828 - RNA, 22 nt, Human
aaaguuacacgacuauuuaugu

SEQ ID NO: 151829 - RNA, 22 nt, Human
aauugcuuucacaaguguuaua

SEQ ID NO: 151830 - RNA, 22 nt, Human
cuggaagcgucggaggaagggc

SEQ ID NO: 151831 - RNA, 22 nt, Human
uucuccaccugcuccucccacc

SEQ ID NO: 151832 - RNA, 22 nt, Human
uuuaauauuacacuuaccuugu

SEQ ID NO: 151833 - RNA, 22 nt, Human
gaaaauaguucaucacaaugau

SEQ ID NO: 151834 - RNA, 22 nt, Human
cuucucuuccuucucauccuca

SEQ ID NO: 151835 - RNA, 21 nt, Human
ccgaggagugcggggagcccc

SEQ ID NO: 151836 - RNA, 22 nt, Human
agucauuugucauuuuuuugag

SEQ ID NO: 151837 - RNA, 22 nt, Human
ugcugcucaagcugcagcaaaa

SEQ ID NO: 151838 - RNA, 22 nt, Human
uaauaaaaauuuaauucacauu

SEQ ID NO: 151839 - RNA, 22 nt, Human
ggagccucuaaacaguuaucaa

SEQ ID NO: 151840 - RNA, 22 nt, Human
agggcugcugcuccgggcccag

SEQ ID NO: 151841 - RNA, 22 nt, Human
cccuguccugcuaggcccuggu

SEQ ID NO: 151842 - RNA, 22 nt, Human
uauauauacauauagaauaugu

SEQ ID NO: 151843 - RNA, 22 nt, Human
gaugauaacagcauuucaacug

SEQ ID NO: 151844 - RNA, 22 nt, Human
gcucugaacugucaugaauugg

SEQ ID NO: 151845 - RNA, 17 nt, Human
agggaaguagggugggc

SEQ ID NO: 151846 - RNA, 22 nt, Human
uuauuuuuaggaauguagaggu

SEQ ID NO: 151847 - RNA, 22 nt, Human
aaagggagauaaaguaauuuua

SEQ ID NO: 151848 - RNA, 22 nt, Human
aacugaaguuuucagauuuugc

SEQ ID NO: 151849 - RNA, 22 nt, Human
aucuguuccccuaugcucucua

SEQ ID NO: 151850 - RNA, 22 nt, Human
agggaggcccagcagacuggcg

SEQ ID NO: 151851 - RNA, 22 nt, Human
uuuuagaagcauuuaugagauu

SEQ ID NO: 151852 - RNA, 22 nt, Human
gggggcagguuccaggccagcu

SEQ ID NO: 151853 - RNA, 22 nt, Human
ugguuauauaaggauuaaauac

SEQ ID NO: 151854 - RNA, 22 nt, Human
uggagccugauggauaggaacg

SEQ ID NO: 151855 - RNA, 21 nt, Human
uccccugugccuggcauacag

SEQ ID NO: 151856 - RNA, 22 nt, Human
aaggaugguaacaguuucauuu

SEQ ID NO: 151857 - RNA, 22 nt, Human
uuuaugauguagccuagagcug

SEQ ID NO: 151858 - RNA, 22 nt, Human
uacuuaauuuuaaaagcuagau

SEQ ID NO: 151859 - RNA, 22 nt, Human
uggcagccugcgugaaggagcu

SEQ ID NO: 151860 - RNA, 22 nt, Human
uuuauuuagguaaacaugaguu

SEQ ID NO: 151861 - RNA, 22 nt, Human
augaaaacgugugugugugugu

SEQ ID NO: 151862 - RNA, 22 nt, Human
auaaaagcacaauagaguuaug

SEQ ID NO: 151863 - RNA, 22 nt, Human
uuuuguuuacauuaaauuuuga

SEQ ID NO: 151864 - RNA, 22 nt, Human
cagaguaaugugauuuccaugu

SEQ ID NO: 151865 - RNA, 22 nt, Human
ugguugauuaauuuugccaagc

SEQ ID NO: 151866 - RNA, 22 nt, Human
gauguuaauauguuucaccaaa

SEQ ID NO: 151867 - RNA, 22 nt, Human
aauaucuugaguuauaaauuca

SEQ ID NO: 151868 - RNA, 22 nt, Human
guauaaauaucuauauuguuac

SEQ ID NO: 151869 - RNA, 22 nt, Human
agaguucuauccagacucaugu

SEQ ID NO: 151870 - RNA, 22 nt, Human
gcuucuguuaggauguggcuua

SEQ ID NO: 151871 - RNA, 22 nt, Human
uacucauuggagaauuacgagg

SEQ ID NO: 151872 - RNA, 21 nt, Human
auauuguugggguuuucuuuu

SEQ ID NO: 151873 - RNA, 22 nt, Human
ugggggagggagaguugauggg

SEQ ID NO: 151874 - RNA, 22 nt, Human
gagaaaaauuucuuugcugcac

SEQ ID NO: 151875 - RNA, 22 nt, Human
gacuggggcauuagaguagcuu

SEQ ID NO: 151876 - RNA, 22 nt, Human
aagagugaguagcuugguuggu

SEQ ID NO: 151877 - RNA, 22 nt, Human
uuuaaaacagcauuuaaaaggu

SEQ ID NO: 151878 - RNA, 22 nt, Human
uaagugcuagaauuccagguuu

SEQ ID NO: 151879 - RNA, 22 nt, Human
ccugcccaucccaccccagcau

SEQ ID NO: 151880 - RNA, 22 nt, Human
guuguuuuuguuaaaacaguga

SEQ ID NO: 151881 - RNA, 22 nt, Human
ggcagagguagcuggaaccagg

SEQ ID NO: 151882 - RNA, 22 nt, Human
ucuuucugaugggaagggucaa

SEQ ID NO: 151883 - RNA, 20 nt, Human
cuggaguguagcaguggcug

SEQ ID NO: 151884 - RNA, 22 nt, Human
aagaaaagcaucuuuguaguag

SEQ ID NO: 151885 - RNA, 22 nt, Human
aaugaauaaauuuuaaagacag

SEQ ID NO: 151886 - RNA, 22 nt, Human
gaauacaaauaauaccaaggug

SEQ ID NO: 151887 - RNA, 22 nt, Human
cauuagggucuuuagacagcuc

SEQ ID NO: 151888 - RNA, 22 nt, Human
caguggacacuuccucuacaau

SEQ ID NO: 151889 - RNA, 22 nt, Human
aagccugguuauuugaggaugu

SEQ ID NO: 151890 - RNA, 22 nt, Human
ggaggaagagaccagggggcuu

SEQ ID NO: 151891 - RNA, 22 nt, Human
cacugcacuccagccugggcaa

SEQ ID NO: 151892 - RNA, 22 nt, Human
uugaaaaaugcccagcagacaa

SEQ ID NO: 151893 - RNA, 22 nt, Human
aauguugaaccuuuuuggccug

SEQ ID NO: 151894 - RNA, 22 nt, Human
ucuccuaauuacauacuugauu

SEQ ID NO: 151895 - RNA, 22 nt, Human
uaguucugaauagcauugaaga

SEQ ID NO: 151896 - RNA, 22 nt, Human
aggcauauaguguuuaaaaaaa

SEQ ID NO: 151897 - RNA, 21 nt, Human
gcagcucaggauauagacuug

SEQ ID NO: 151898 - RNA, 22 nt, Human
cuauuaauggccaggagucaug

SEQ ID NO: 151899 - RNA, 22 nt, Human
gucccucauaacuggcaggugu

SEQ ID NO: 151900 - RNA, 22 nt, Human
uguuuucuuuccccuucuuuuc

SEQ ID NO: 151901 - RNA, 22 nt, Human
acauauaugugcauacaacuau

SEQ ID NO: 151902 - RNA, 22 nt, Human
auucuuuucucuaaaugaugaa

SEQ ID NO: 151903 - RNA, 22 nt, Human
uuaaaucaggcaucauuucagu

SEQ ID NO: 151904 - RNA, 21 nt, Human
aacaaaagggaagaacagcug

SEQ ID NO: 151905 - RNA, 22 nt, Human
guggcaguaaagcuggaaaagu

SEQ ID NO: 151906 - RNA, 22 nt, Human
uaugggcaagagauaggugguc

SEQ ID NO: 151907 - RNA, 20 nt, Human
ccugggcuccaggagccccg

SEQ ID NO: 151908 - RNA, 22 nt, Human
agcaagggucucucauggcuug

SEQ ID NO: 151909 - RNA, 22 nt, Human
cugauaauaaccauuuuaaaau

SEQ ID NO: 151910 - RNA, 22 nt, Human
cuuggggauuuuaaagaccucu

SEQ ID NO: 151911 - RNA, 22 nt, Human
cagaguccugcaccagcuccag

SEQ ID NO: 151912 - RNA, 22 nt, Human
caacauuucaaggucuuuagga

SEQ ID NO: 151913 - RNA, 22 nt, Human
ucgagaccagcuagaaggaagu

SEQ ID NO: 151914 - RNA, 22 nt, Human
cagguggauggcgagcccugca

SEQ ID NO: 151915 - RNA, 22 nt, Human
gccagggcucgagcaggccagc

SEQ ID NO: 151916 - RNA, 22 nt, Human
ucagucacugugaaaugaauuu

SEQ ID NO: 151917 - RNA, 22 nt, Human
ggggaggguuuggaugagaguc

SEQ ID NO: 151918 - RNA, 22 nt, Human
cucuauuuuuucaucuuucagg

SEQ ID NO: 151919 - RNA, 22 nt, Human
aggagaaagaccagccugccga

SEQ ID NO: 151920 - RNA, 22 nt, Human
ucaggagaguguucaguggagg

SEQ ID NO: 151921 - RNA, 22 nt, Human
auauuuuacagcucucguugaa

SEQ ID NO: 151922 - RNA, 22 nt, Human
uuuuacaaugcaaauucuugcu

SEQ ID NO: 151923 - RNA, 17 nt, Human
ggaagaaaaggaucauc

SEQ ID NO: 151924 - RNA, 22 nt, Human
aaaauauuuaucuagcucuuaa

SEQ ID NO: 151925 - RNA, 22 nt, Human
gccucucuggcaaagcggugau

SEQ ID NO: 151926 - RNA, 22 nt, Human
uguacuguuuucuaggcaaaaa

SEQ ID NO: 151927 - RNA, 22 nt, Human
uuggaagacagccgucuuuauu

SEQ ID NO: 151928 - RNA, 22 nt, Human
ucugaauauguuuaucaucucu

SEQ ID NO: 151929 - RNA, 22 nt, Human
uagguggaaccauaugaaauuu

SEQ ID NO: 151930 - RNA, 22 nt, Human
agcagggagaccaucucuuccu

SEQ ID NO: 151931 - RNA, 22 nt, Human
auauaguacauguauauauaua

SEQ ID NO: 151932 - RNA, 22 nt, Human
agggcaggguuggugcuggugc

SEQ ID NO: 151933 - RNA, 22 nt, Human
auguuguugaacucuuugcaug

SEQ ID NO: 151934 - RNA, 22 nt, Human
uugugugugcccaccuguggcc

SEQ ID NO: 151935 - RNA, 19 nt, Human
agcucaggcccaucguccc

SEQ ID NO: 151936 - RNA, 22 nt, Human
ggaagcuguugugagugcagca

SEQ ID NO: 151937 - RNA, 22 nt, Human
ugucuuuuaaaaauguguaaaa

SEQ ID NO: 151938 - RNA, 22 nt, Human
uccagaaagccguugacuuauu

SEQ ID NO: 151939 - RNA, 22 nt, Human
cuucuggaggcugcagaaaaga

SEQ ID NO: 151940 - RNA, 21 nt, Human
uugugaaaguccaggaacaac

SEQ ID NO: 151941 - RNA, 22 nt, Human
gagguagaggaaaagauuauca

SEQ ID NO: 151942 - RNA, 22 nt, Human
cuguccauuuucgugccuccuu

SEQ ID NO: 151943 - RNA, 22 nt, Human
ucgagcucagcagggaggugcg

SEQ ID NO: 151944 - RNA, 22 nt, Human
agagauacugcaggccauaaau

SEQ ID NO: 151945 - RNA, 22 nt, Human
aaauagauuugacuacuuggug

SEQ ID NO: 151946 - RNA, 22 nt, Human
aagggagagggagaagguggga

SEQ ID NO: 151947 - RNA, 22 nt, Human
guggagaaagcuggaaucugag

SEQ ID NO: 151948 - RNA, 22 nt, Human
gaauacaagccugccaccugga

SEQ ID NO: 151949 - RNA, 22 nt, Human
uuuuauaauacccuugacuaau

SEQ ID NO: 151950 - RNA, 22 nt, Human
gcauaacaacagacucuguguu

SEQ ID NO: 151951 - RNA, 22 nt, Human
uggcaggggaaaagggguggga

SEQ ID NO: 151952 - RNA, 22 nt, Human
ggcagagcugugcgcccaccca

SEQ ID NO: 151953 - RNA, 22 nt, Human
gggauggggagcuggaaagggg

SEQ ID NO: 151954 - RNA, 22 nt, Human
uauauauaugcaccacaugugu

SEQ ID NO: 151955 - RNA, 22 nt, Human
agguguaauuacucuugcaguu

SEQ ID NO: 151956 - RNA, 22 nt, Human
gcaucacacgcacauacacaca

SEQ ID NO: 151957 - RNA, 22 nt, Human
ugaccucaagcaugcggagggc

SEQ ID NO: 151958 - RNA, 22 nt, Human
aguaggauguuuagcccuucuu

SEQ ID NO: 151959 - RNA, 22 nt, Human
uggggcuggccaggaggagucu

SEQ ID NO: 151960 - RNA, 22 nt, Human
ucugcccaggaggucccauggg

SEQ ID NO: 151961 - RNA, 22 nt, Human
gcugcgccgggagccggggccg

SEQ ID NO: 151962 - RNA, 22 nt, Human
agaugggacauuugucccuagg

SEQ ID NO: 151963 - RNA, 22 nt, Human
uaauucuucaauccaguguuca

SEQ ID NO: 151964 - RNA, 22 nt, Human
uggaaaauuuagaaagauuuau

SEQ ID NO: 151965 - RNA, 22 nt, Human
uaccuggauaaauguacaaccg

SEQ ID NO: 151966 - RNA, 22 nt, Human
gucuuucuuuuacauauuugug

SEQ ID NO: 151967 - RNA, 22 nt, Human
gcaggggguaaggggcagggcu

SEQ ID NO: 151968 - RNA, 22 nt, Human
auauuuuugcagaauuuuucgu

SEQ ID NO: 151969 - RNA, 22 nt, Human
aggaagaagggacagaauuuug

SEQ ID NO: 151970 - RNA, 22 nt, Human
aguaggaauucaaagagacaaa

SEQ ID NO: 151971 - RNA, 22 nt, Human
uucuggccagggaagagggguc

SEQ ID NO: 151972 - RNA, 22 nt, Human
gucagacucuggggccccaggc

SEQ ID NO: 151973 - RNA, 22 nt, Human
acuauuguccgauuucuuuacu

SEQ ID NO: 151974 - RNA, 22 nt, Human
ugaggggaggggagaaaauggu

SEQ ID NO: 151975 - RNA, 22 nt, Human
ugcauuuucuaccacacccacu

SEQ ID NO: 151976 - RNA, 22 nt, Human
ccagcugggucccugcuggggc

SEQ ID NO: 151977 - RNA, 19 nt, Human
gaguaaaacuagagagaaa

SEQ ID NO: 151978 - RNA, 22 nt, Human
uuuuuggacccaucuucuuuuu

SEQ ID NO: 151979 - RNA, 22 nt, Human
auagaagugaaaagggaugacu

SEQ ID NO: 151980 - RNA, 22 nt, Human
uuucacuucgaucagaguuuuu

SEQ ID NO: 151981 - RNA, 22 nt, Human
guugauaauuaauagcuuuuga

SEQ ID NO: 151982 - RNA, 22 nt, Human
ugggcagggauuuggggaaacu

SEQ ID NO: 151983 - RNA, 22 nt, Human
agucugugguccucuguaucuc

SEQ ID NO: 151984 - RNA, 22 nt, Human
gugauggucgagcgcuuguugu

SEQ ID NO: 151985 - RNA, 22 nt, Human
uggucucuacggaggaaagcug

SEQ ID NO: 151986 - RNA, 20 nt, Human
guugggagaagugucagcug

SEQ ID NO: 151987 - RNA, 22 nt, Human
gguggcagaggaggcgggagag

SEQ ID NO: 151988 - RNA, 22 nt, Human
auuaaaaaugagaguagggauu

SEQ ID NO: 151989 - RNA, 23 nt, Human
uuugaaucauuguggggcuuuug

SEQ ID NO: 151990 - RNA, 22 nt, Human
cuugcaaugaaggcacacuuau

SEQ ID NO: 151991 - RNA, 16 nt, Human
acauggcacacaguuu

SEQ ID NO: 151992 - RNA, 22 nt, Human
ucuucacagaugcauauacuuc

SEQ ID NO: 151993 - RNA, 22 nt, Human
aggggcugugucauuuguccua

SEQ ID NO: 151994 - RNA, 22 nt, Human
uuggaagagagauggggagaga

SEQ ID NO: 151995 - RNA, 22 nt, Human
ggacauaguugcuauggagagu

SEQ ID NO: 151996 - RNA, 22 nt, Human
cugaguuuuucaaaucugaauu

SEQ ID NO: 151997 - RNA, 22 nt, Human
ucucucucucuuccagcauguu

SEQ ID NO: 151998 - RNA, 22 nt, Human
cagcagaggagguggcagcacc

SEQ ID NO: 151999 - RNA, 22 nt, Human
gggcaagaagcuggaagcauuc

SEQ ID NO: 152000 - RNA, 22 nt, Human
accaggaguuuugaccaggggc

SEQ ID NO: 152001 - RNA, 22 nt, Human
aauuauguugaaauaugagaac

SEQ ID NO: 152002 - RNA, 22 nt, Human
uuuguuuccagccuuuugucuu

SEQ ID NO: 152003 - RNA, 22 nt, Human
guucuacaugacacucaacauu

SEQ ID NO: 152004 - RNA, 22 nt, Human
aaagccaagguccauguacuuu

SEQ ID NO: 152005 - RNA, 22 nt, Human
uccucagcaaacacuucacucu

SEQ ID NO: 152006 - RNA, 22 nt, Human
gaauuacagaguuguuaaguca

SEQ ID NO: 152007 - RNA, 22 nt, Human
cugccacuaccaugcuggauga

SEQ ID NO: 152008 - RNA, 22 nt, Human
caacaagcgcucagagcaaagc

SEQ ID NO: 152009 - RNA, 22 nt, Human
agggaguuccgaucugugcacc

SEQ ID NO: 152010 - RNA, 22 nt, Human
uggucugggaagaucacaauua

SEQ ID NO: 152011 - RNA, 22 nt, Human
cacugugagugcaagcaggggu

SEQ ID NO: 152012 - RNA, 22 nt, Human
gaaacauuuguugaguacuugc

SEQ ID NO: 152013 - RNA, 22 nt, Human
guuuuucuuugauuuagaacca

SEQ ID NO: 152014 - RNA, 22 nt, Human
uggugcucuugauauauaaggc

SEQ ID NO: 152015 - RNA, 22 nt, Human
ccccauuugaagauugggggua

SEQ ID NO: 152016 - RNA, 22 nt, Human
guucaaucucucaugcauuuuc

SEQ ID NO: 152017 - RNA, 22 nt, Human
agcauucuguggucuucuaugg

SEQ ID NO: 152018 - RNA, 22 nt, Human
agaaccaauacuacagcaagua

SEQ ID NO: 152019 - RNA, 22 nt, Human
uccuuucaaauuuauuugacau

SEQ ID NO: 152020 - RNA, 22 nt, Human
agaggcaggcagcagagaagau

SEQ ID NO: 152021 - RNA, 22 nt, Human
uucuggagucuauuuugaaaag

SEQ ID NO: 152022 - RNA, 21 nt, Human
gaaaaucuaaugugacaaugc

SEQ ID NO: 152023 - RNA, 22 nt, Human
aauggcaauagugcauuaugua

SEQ ID NO: 152024 - RNA, 22 nt, Human
ucaccuuuugaauugcuguugu

SEQ ID NO: 152025 - RNA, 22 nt, Human
ucucugaccuccaccccaggag

SEQ ID NO: 152026 - RNA, 22 nt, Human
cagaccuggaaaacaggcuugc

SEQ ID NO: 152027 - RNA, 22 nt, Human
augcaugaucccgguaugugaa

SEQ ID NO: 152028 - RNA, 22 nt, Human
gaggugauuccucccauguaau

SEQ ID NO: 152029 - RNA, 18 nt, Human
ggccucagccuggccgga

SEQ ID NO: 152030 - RNA, 22 nt, Human
gcuggaaauaacuuguguagaa

SEQ ID NO: 152031 - RNA, 22 nt, Human
auuaagucugacuggauuguau

SEQ ID NO: 152032 - RNA, 22 nt, Human
acuguugagggaagcagaugaa

SEQ ID NO: 152033 - RNA, 22 nt, Human
aggccacucagggggccaagau

SEQ ID NO: 152034 - RNA, 22 nt, Human
aucuuugauuuuggcuuuuagg

SEQ ID NO: 152035 - RNA, 22 nt, Human
gcucccagcuuuuguccacggc

SEQ ID NO: 152036 - RNA, 22 nt, Human
gaggagcugggucagggagaca

SEQ ID NO: 152037 - RNA, 22 nt, Human
aauaaugguuugauucucacau

SEQ ID NO: 152038 - RNA, 22 nt, Human
aagagaggaaagggugugaggu

SEQ ID NO: 152039 - RNA, 22 nt, Human
ucaguagcauuuaauguucagu

SEQ ID NO: 152040 - RNA, 22 nt, Human
gauaaauaguguuuggggacau

SEQ ID NO: 152041 - RNA, 20 nt, Human
cucuuuaugagaccacuguc

SEQ ID NO: 152042 - RNA, 22 nt, Human
auaaaacagaucaggagaauga

SEQ ID NO: 152043 - RNA, 19 nt, Human
auuuccuggcauauaucac

SEQ ID NO: 152044 - RNA, 22 nt, Human
cuggaaaaauggauccugucuu

SEQ ID NO: 152045 - RNA, 18 nt, Human
ggugagggagcuggaagc

SEQ ID NO: 152046 - RNA, 22 nt, Human
auacaucuuaacgcgcucuugg

SEQ ID NO: 152047 - RNA, 22 nt, Human
caacuucugcuuucuuccuugc

SEQ ID NO: 152048 - RNA, 23 nt, Human
ucugccuccuaauuguugguguc

SEQ ID NO: 152049 - RNA, 23 nt, Human
uggaaguugagagucugcuuugu

SEQ ID NO: 152050 - RNA, 22 nt, Human
uggaugccuugggggaggagga

SEQ ID NO: 152051 - RNA, 17 nt, Human
augcccagggcucccug

SEQ ID NO: 152052 - RNA, 22 nt, Human
gaauagauuagaaagaguaugu

SEQ ID NO: 152053 - RNA, 22 nt, Human
uuguuauuauuauuuucguucu

SEQ ID NO: 152054 - RNA, 22 nt, Human
ugaagcuaguauuaacucagau

SEQ ID NO: 152055 - RNA, 22 nt, Human
gcuggccugcgagggcaggcug

SEQ ID NO: 152056 - RNA, 22 nt, Human
gguggggacuuggggucagcgg

SEQ ID NO: 152057 - RNA, 22 nt, Human
cuucccaucaagcuggaggaug

SEQ ID NO: 152058 - RNA, 22 nt, Human
aagucauuaucucuucuaaucu

SEQ ID NO: 152059 - RNA, 22 nt, Human
uuuauaaacacaagaugggcuc

SEQ ID NO: 152060 - RNA, 22 nt, Human
gaggaggcuggagaggccagga

SEQ ID NO: 152061 - RNA, 22 nt, Human
gggcagagagcuggaacuccuu

SEQ ID NO: 152062 - RNA, 22 nt, Human
aaauggauaaucaagauaauca

SEQ ID NO: 152063 - RNA, 22 nt, Human
ugggggaggaggagacagacug

SEQ ID NO: 152064 - RNA, 22 nt, Human
gcugcagggagcuggaaggcuc

SEQ ID NO: 152065 - RNA, 22 nt, Human
cugggggacagagagaggcggu

SEQ ID NO: 152066 - RNA, 22 nt, Human
ggugucucagauuguaaaaugu

SEQ ID NO: 152067 - RNA, 22 nt, Human
agagggcaggcugguugggguc

SEQ ID NO: 152068 - RNA, 22 nt, Human
ugucacagugcacagcuaagaa

SEQ ID NO: 152069 - RNA, 22 nt, Human
aggcaguggagcuggaauaggc

SEQ ID NO: 152070 - RNA, 22 nt, Human
uaugaauauaccacaauuuagg

SEQ ID NO: 152071 - RNA, 22 nt, Human
gaggcaggaagggaggguugug

SEQ ID NO: 152072 - RNA, 22 nt, Human
aguucauccucauuuacaagga

SEQ ID NO: 152073 - RNA, 19 nt, Human
aacucugccgaggcaagcc

SEQ ID NO: 152074 - RNA, 22 nt, Human
ugcccacuuugucuccaugcug

SEQ ID NO: 152075 - RNA, 22 nt, Human
ucauuuaauuuggaacucagag

SEQ ID NO: 152076 - RNA, 22 nt, Human
uuuuuaaaauuaggacggcacg

SEQ ID NO: 152077 - RNA, 22 nt, Human
augaaaacggaccagagcuauu

SEQ ID NO: 152078 - RNA, 22 nt, Human
ucuuuaagugugugccuccagg

SEQ ID NO: 152079 - RNA, 22 nt, Human
aaugcuuuuugcgaaaugugca

SEQ ID NO: 152080 - RNA, 22 nt, Human
cauggcaggugcagauucugug

SEQ ID NO: 152081 - RNA, 23 nt, Human
uaaauuuuauucugauaacacag

SEQ ID NO: 152082 - RNA, 22 nt, Human
cagcuucaugacaaacaguuuu

SEQ ID NO: 152083 - RNA, 22 nt, Human
ggaagcucaauacuuuccucuu

SEQ ID NO: 152084 - RNA, 22 nt, Human
gaaaagaaaggaugguaugugu

SEQ ID NO: 152085 - RNA, 22 nt, Human
ggcuccaggguaccccuggaug

SEQ ID NO: 152086 - RNA, 22 nt, Human
ccuuugcccugagaaauguucc

SEQ ID NO: 152087 - RNA, 22 nt, Human
gagaacagauaugaugacuuca

SEQ ID NO: 152088 - RNA, 22 nt, Human
guggauggagcuggaagccauu

SEQ ID NO: 152089 - RNA, 22 nt, Human
auccugugggguauugcugcau

SEQ ID NO: 152090 - RNA, 21 nt, Human
aggcuuggaucuagacaggcc

SEQ ID NO: 152091 - RNA, 22 nt, Human
guuuuuaguuuaaguuuuugca

SEQ ID NO: 152092 - RNA, 21 nt, Human
aaguuucucccuaauuguugc

SEQ ID NO: 152093 - RNA, 22 nt, Human
ccucaggaauuuauucuucugu

SEQ ID NO: 152094 - RNA, 22 nt, Human
uugaauuuagguuuaugugaaa

SEQ ID NO: 152095 - RNA, 22 nt, Human
uuguccacuaagaaagugcccu

SEQ ID NO: 152096 - RNA, 22 nt, Human
caaaucuguuaauuucaaguug

SEQ ID NO: 152097 - RNA, 22 nt, Human
accugagauuuuuacucaguaa

SEQ ID NO: 152098 - RNA, 22 nt, Human
aauauauaugggugcaugucug

SEQ ID NO: 152099 - RNA, 22 nt, Human
aaacccaggguuuugucuuccc

SEQ ID NO: 152100 - RNA, 23 nt, Human
aguggaggucgggguggggagac

SEQ ID NO: 152101 - RNA, 23 nt, Human
cauguacacacagcuguacagug

SEQ ID NO: 152102 - RNA, 22 nt, Human
ugccagcuccgaggagcugcag

SEQ ID NO: 152103 - RNA, 21 nt, Human
guucuuaguuauauucucaau

SEQ ID NO: 152104 - RNA, 22 nt, Human
uguuuuguuuagguuuguuuuu

SEQ ID NO: 152105 - RNA, 22 nt, Human
aguacuuuuuguucaauugugc

SEQ ID NO: 152106 - RNA, 22 nt, Human
gauuuugcuuuagugaaggaag

SEQ ID NO: 152107 - RNA, 22 nt, Human
uguuccucuuagucuuaugugu

SEQ ID NO: 152108 - RNA, 22 nt, Human
auuucacucuuaauugcuuccu

SEQ ID NO: 152109 - RNA, 21 nt, Human
cuauaaaaaugguucuuugcg

SEQ ID NO: 152110 - RNA, 22 nt, Human
gccugggccgggcgcggccccc

SEQ ID NO: 152111 - RNA, 22 nt, Human
auuuuuauuugccuaugauaua

SEQ ID NO: 152112 - RNA, 22 nt, Human
auguuagcaucuggcacuaugg

SEQ ID NO: 152113 - RNA, 18 nt, Human
aggcuggggaucacaggg

SEQ ID NO: 152114 - RNA, 22 nt, Human
uccuccauguugugcacuugaa

SEQ ID NO: 152115 - RNA, 22 nt, Human
ccauuuggccauucaguuguuc

SEQ ID NO: 152116 - RNA, 22 nt, Human
guagaaaauagauugucucuug

SEQ ID NO: 152117 - RNA, 22 nt, Human
caggaacagcaccaggagcuag

SEQ ID NO: 152118 - RNA, 22 nt, Human
aauguuguaaauauucuuugag

SEQ ID NO: 152119 - RNA, 20 nt, Human
accccuccccacuccucgcc

SEQ ID NO: 152120 - RNA, 22 nt, Human
gucugcagcacugugcacgguc

SEQ ID NO: 152121 - RNA, 20 nt, Human
aaagauacuuuuuguaaugg

SEQ ID NO: 152122 - RNA, 22 nt, Human
uauguacauauauguguauaua

SEQ ID NO: 152123 - RNA, 22 nt, Human
agugccaucuuuaacuguccca

SEQ ID NO: 152124 - RNA, 22 nt, Human
gugugucucaguugcuccgaag

SEQ ID NO: 152125 - RNA, 22 nt, Human
uuuugcuucuaguauauuuuuu

SEQ ID NO: 152126 - RNA, 22 nt, Human
aaagccauaucuauucuauucu

SEQ ID NO: 152127 - RNA, 22 nt, Human
cagccccagcacuuagcugagu

SEQ ID NO: 152128 - RNA, 22 nt, Human
aauuugcuccaaugucaguucu

SEQ ID NO: 152129 - RNA, 22 nt, Human
ucucuucacuuguaugcuauca

SEQ ID NO: 152130 - RNA, 22 nt, Human
gaaggcagucuggggagcagcc

SEQ ID NO: 152131 - RNA, 22 nt, Human
auaccuauagcagacugagacu

SEQ ID NO: 152132 - RNA, 22 nt, Human
ugcaaauuuuuuuauuuuuccu

SEQ ID NO: 152133 - RNA, 22 nt, Human
ugagggaugccucuccuuccgg

SEQ ID NO: 152134 - RNA, 20 nt, Human
ccuuguggaugucuuuuuug

SEQ ID NO: 152135 - RNA, 22 nt, Human
uuucuggacuaaagggagagau

SEQ ID NO: 152136 - RNA, 22 nt, Human
gcauuuuaauuggggcaguuag

SEQ ID NO: 152137 - RNA, 22 nt, Human
gcagaggcugccgugggcagga

SEQ ID NO: 152138 - RNA, 22 nt, Human
ucuaaaaauuagaaauuagguc

SEQ ID NO: 152139 - RNA, 22 nt, Human
uacagcuuccucuaugguggcc

SEQ ID NO: 152140 - RNA, 22 nt, Human
gaggggacugucuggcuccgag

SEQ ID NO: 152141 - RNA, 22 nt, Human
gcaguaaauugagagucauguu

SEQ ID NO: 152142 - RNA, 22 nt, Human
uugaauaguuuuggauagcaua

SEQ ID NO: 152143 - RNA, 22 nt, Human
uuucuaaaauuacugcagucgg

SEQ ID NO: 152144 - RNA, 22 nt, Human
auggagugggaggacaugaagg

SEQ ID NO: 152145 - RNA, 22 nt, Human
auuuuugguuauaaaauaguuu

SEQ ID NO: 152146 - RNA, 22 nt, Human
ugaaaaauauuuuuagaaauaa

SEQ ID NO: 152147 - RNA, 22 nt, Human
cuaauaauuuacugagugcuac

SEQ ID NO: 152148 - RNA, 22 nt, Human
uuuccuaggaaaugauugaagu

SEQ ID NO: 152149 - RNA, 22 nt, Human
gggagcugagcuggaagagaau

SEQ ID NO: 152150 - RNA, 22 nt, Human
aggggaggggaguaucaggauu

SEQ ID NO: 152151 - RNA, 22 nt, Human
agggagucuggccgucggcugg

SEQ ID NO: 152152 - RNA, 22 nt, Human
gauuugucuauauucaaauaug

SEQ ID NO: 152153 - RNA, 22 nt, Human
agcaaaauuccaaaaugcuaau

SEQ ID NO: 152154 - RNA, 22 nt, Human
cuguuucucugccugcacacau

SEQ ID NO: 152155 - RNA, 22 nt, Human
ggaggggaguuugccucugggg

SEQ ID NO: 152156 - RNA, 22 nt, Human
aacccugaacuuaguucuagga

SEQ ID NO: 152157 - RNA, 22 nt, Human
uggcacagcuugucauaaacuc

SEQ ID NO: 152158 - RNA, 22 nt, Human
auucuucauguugaagcuguca

SEQ ID NO: 152159 - RNA, 22 nt, Human
cagcaugguggagcugcucuuu

SEQ ID NO: 152160 - RNA, 22 nt, Human
ugcuagggcaggaggugaggag

SEQ ID NO: 152161 - RNA, 22 nt, Human
auucuuuauuuucuguacuugc

SEQ ID NO: 152162 - RNA, 22 nt, Human
cagggagguuggauuggggccu

SEQ ID NO: 152163 - RNA, 22 nt, Human
uccacagcagagcacgguaccu

SEQ ID NO: 152164 - RNA, 22 nt, Human
aggcagaugggagcuggaaguu

SEQ ID NO: 152165 - RNA, 20 nt, Human
agugauuuguuaguacauug

SEQ ID NO: 152166 - RNA, 22 nt, Human
uuucucuuucaaucugcaguac

SEQ ID NO: 152167 - RNA, 22 nt, Human
agggaccacauccccucugugg

SEQ ID NO: 152168 - RNA, 22 nt, Human
ugcaaaaguuuuauacacagau

SEQ ID NO: 152169 - RNA, 22 nt, Human
cauaggcucuucagagaacuga

SEQ ID NO: 152170 - RNA, 22 nt, Human
cacuguugagcaauguacagug

SEQ ID NO: 152171 - RNA, 20 nt, Human
uuccccauaaaaauguucca

SEQ ID NO: 152172 - RNA, 22 nt, Human
aggaggaggacucgccaggcca

SEQ ID NO: 152173 - RNA, 20 nt, Human
agucacagacccucagguag

SEQ ID NO: 152174 - RNA, 22 nt, Human
uuggugaugcccaccuuuucau

SEQ ID NO: 152175 - RNA, 22 nt, Human
cuuauuagaaagaaaagacaug

SEQ ID NO: 152176 - RNA, 22 nt, Human
aauguaaauaauuguaaaauuu

SEQ ID NO: 152177 - RNA, 22 nt, Human
agaggagaauguaaauuuguca

SEQ ID NO: 152178 - RNA, 22 nt, Human
cuggaugucugggaggcuuccc

SEQ ID NO: 152179 - RNA, 22 nt, Human
aaauguuucauucuauuuuuag

SEQ ID NO: 152180 - RNA, 21 nt, Human
caguucuaagugucaucuuuu

SEQ ID NO: 152181 - RNA, 22 nt, Human
ucacaggagucaaggaauagua

SEQ ID NO: 152182 - RNA, 22 nt, Human
cgugccugguggagagcgaggg

SEQ ID NO: 152183 - RNA, 22 nt, Human
caggcagggagcuggaaaggau

SEQ ID NO: 152184 - RNA, 22 nt, Human
uaguuauuucugcacuuaauga

SEQ ID NO: 152185 - RNA, 20 nt, Human
caggccuucaggauggcugg

SEQ ID NO: 152186 - RNA, 22 nt, Human
agauggggccugaggacacugu

SEQ ID NO: 152187 - RNA, 22 nt, Human
uucaaaaugcagaauaguuugg

SEQ ID NO: 152188 - RNA, 22 nt, Human
ugagagguagaacuuguagugu

SEQ ID NO: 152189 - RNA, 22 nt, Human
uagugcuuaaaacagaauuuuc

SEQ ID NO: 152190 - RNA, 22 nt, Human
ugucuuugaccuuaagaaguuu

SEQ ID NO: 152191 - RNA, 16 nt, Human
gaauuccauugcucug

SEQ ID NO: 152192 - RNA, 22 nt, Human
uucacugugauguuuaagagaa

SEQ ID NO: 152193 - RNA, 22 nt, Human
auggagggcagccccacuaaag

SEQ ID NO: 152194 - RNA, 18 nt, Human
guucaagcauuuugcucu

SEQ ID NO: 152195 - RNA, 22 nt, Human
uagcauaaaguuucuguguggu

SEQ ID NO: 152196 - RNA, 22 nt, Human
ucaguggaacacacagaguggg

SEQ ID NO: 152197 - RNA, 22 nt, Human
uuuuuuuagaaagaucauaguu

SEQ ID NO: 152198 - RNA, 22 nt, Human
gcugcaggaggugguagggucu

SEQ ID NO: 152199 - RNA, 22 nt, Human
gggagggaggagccccggccau

SEQ ID NO: 152200 - RNA, 22 nt, Human
uagaccugugggggcagcgggc

SEQ ID NO: 152201 - RNA, 22 nt, Human
cccagccuuugcuuccugguuc

SEQ ID NO: 152202 - RNA, 22 nt, Human
cccuguccuucccuccaucuga

SEQ ID NO: 152203 - RNA, 22 nt, Human
uuuaugucaaaaguaaaaugaa

SEQ ID NO: 152204 - RNA, 22 nt, Human
augaggaacagcaagaauauuu

SEQ ID NO: 152205 - RNA, 22 nt, Human
ccagggcuggaggaggucagga

SEQ ID NO: 152206 - RNA, 22 nt, Human
gcacuguauuuaaauauuuaaa

SEQ ID NO: 152207 - RNA, 22 nt, Human
auagauuuuaucagauuuuauc

SEQ ID NO: 152208 - RNA, 22 nt, Human
agucauuugaggcaugauuaug

SEQ ID NO: 152209 - RNA, 19 nt, Human
uccuacaugagacagagag

SEQ ID NO: 152210 - RNA, 22 nt, Human
gggggagcuacaggucccuugg

SEQ ID NO: 152211 - RNA, 22 nt, Human
uccagccugaacuuuguccaga

SEQ ID NO: 152212 - RNA, 22 nt, Human
uucugaaccauugagcacugcc

SEQ ID NO: 152213 - RNA, 22 nt, Human
gucuugugaagacggcagaaag

SEQ ID NO: 152214 - RNA, 22 nt, Human
gcaggcaggauucagagauaca

SEQ ID NO: 152215 - RNA, 22 nt, Human
gagggaggugacaaggacauag

SEQ ID NO: 152216 - RNA, 22 nt, Human
cguuuugaguagauagccauau

SEQ ID NO: 152217 - RNA, 22 nt, Human
ucuugugguggaucccucauuu

SEQ ID NO: 152218 - RNA, 22 nt, Human
uucacccuucucuggcuuucag

SEQ ID NO: 152219 - RNA, 22 nt, Human
aagagaaacauauggccagauu

SEQ ID NO: 152220 - RNA, 22 nt, Human
acuuugaauuagaauuuugcug

SEQ ID NO: 152221 - RNA, 22 nt, Human
agauggaguccugaagccagaa

SEQ ID NO: 152222 - RNA, 22 nt, Human
uuguugcaagccuggaaucugg

SEQ ID NO: 152223 - RNA, 22 nt, Human
uaugugaaauggaauauagaaa

SEQ ID NO: 152224 - RNA, 22 nt, Human
cauggcggcgcucucccugccu

SEQ ID NO: 152225 - RNA, 21 nt, Human
auuggcagaucucuggauugu

SEQ ID NO: 152226 - RNA, 22 nt, Human
acucacuguuuugaaauugaac

SEQ ID NO: 152227 - RNA, 22 nt, Human
uuccacaugaucauuguaauaa

SEQ ID NO: 152228 - RNA, 22 nt, Human
uggguauauauguugcuacaga

SEQ ID NO: 152229 - RNA, 22 nt, Human
ucagcucucucuuggugaucuc

SEQ ID NO: 152230 - RNA, 22 nt, Human
uagugcuucauucuauugguuu

SEQ ID NO: 152231 - RNA, 22 nt, Human
cucaaaauccauaaaaucaggu

SEQ ID NO: 152232 - RNA, 22 nt, Human
ucugagugacguccugacagga

SEQ ID NO: 152233 - RNA, 22 nt, Human
ggccugcuaccagcugugaccu

SEQ ID NO: 152234 - RNA, 22 nt, Human
cagcacuuccuccgugagcccc

SEQ ID NO: 152235 - RNA, 22 nt, Human
aacuuucuuugcaucuaaguuu

SEQ ID NO: 152236 - RNA, 22 nt, Human
ugaaauuuuuuggagauaauuu

SEQ ID NO: 152237 - RNA, 22 nt, Human
ugaggaggugggcacacagagu

SEQ ID NO: 152238 - RNA, 22 nt, Human
acuucauuugaaaugguugaau

SEQ ID NO: 152239 - RNA, 22 nt, Human
uuuucaauuuucauuugcaaga

SEQ ID NO: 152240 - RNA, 22 nt, Human
gagcagcucgagaaggaagcag

SEQ ID NO: 152241 - RNA, 22 nt, Human
ccauagucacuuguccucuuuu

SEQ ID NO: 152242 - RNA, 22 nt, Human
auaaauuugccagcauauguuc

SEQ ID NO: 152243 - RNA, 22 nt, Human
cucuugugucaccauggauaaa

SEQ ID NO: 152244 - RNA, 22 nt, Human
ugcauuuugaaggaaaaaaaug

SEQ ID NO: 152245 - RNA, 22 nt, Human
auggaagagacaaugcuaucug

SEQ ID NO: 152246 - RNA, 22 nt, Human
caggggcuuuccuguuuaugga

SEQ ID NO: 152247 - RNA, 22 nt, Human
acauuuuaaaaacaguaccugg

SEQ ID NO: 152248 - RNA, 22 nt, Human
gccuuuuaaggcagagggagau

SEQ ID NO: 152249 - RNA, 22 nt, Human
gcacauauuuagaucuugaugu

SEQ ID NO: 152250 - RNA, 22 nt, Human
ugagggauuucuggccuuaacu

SEQ ID NO: 152251 - RNA, 22 nt, Human
gauaauuauaggcuaagccacu

SEQ ID NO: 152252 - RNA, 22 nt, Human
ggggcaucguugauugcauggu

SEQ ID NO: 152253 - RNA, 22 nt, Human
ugauguuucugaagggguuacu

SEQ ID NO: 152254 - RNA, 22 nt, Human
cuuacaauuuucuuggacuuuu

SEQ ID NO: 152255 - RNA, 22 nt, Human
uugcuuucuuuguagguuuucc

SEQ ID NO: 152256 - RNA, 17 nt, Human
auucaugaacauguccu

SEQ ID NO: 152257 - RNA, 22 nt, Human
uuuuccuuagaaauacauugau

SEQ ID NO: 152258 - RNA, 22 nt, Human
gucucacuucauuuucuuagcc

SEQ ID NO: 152259 - RNA, 22 nt, Human
gcgccgacccucccugccggac

SEQ ID NO: 152260 - RNA, 22 nt, Human
uaaaauaccacauauggugcuc

SEQ ID NO: 152261 - RNA, 22 nt, Human
uuuauguugagcaaaauaccac

SEQ ID NO: 152262 - RNA, 22 nt, Human
gaaggaaaagacgugcuaagua

SEQ ID NO: 152263 - RNA, 21 nt, Human
gggagugaguaaugauggggg

SEQ ID NO: 152264 - RNA, 22 nt, Human
aucacuagaguuacauugccag

SEQ ID NO: 152265 - RNA, 22 nt, Human
aguggcuguuccaggugaggac

SEQ ID NO: 152266 - RNA, 22 nt, Human
uuuucucuuugcuucucuaaaa

SEQ ID NO: 152267 - RNA, 23 nt, Human
uuugcaaauuggacacaaccaca

SEQ ID NO: 152268 - RNA, 22 nt, Human
aguaauaaacaacucauuuugg

SEQ ID NO: 152269 - RNA, 22 nt, Human
ccaccccagaaagggaaggcca

SEQ ID NO: 152270 - RNA, 22 nt, Human
aggcaggcucaaugcccagucu

SEQ ID NO: 152271 - RNA, 22 nt, Human
gcagguuguuuaaauuaggauu

SEQ ID NO: 152272 - RNA, 22 nt, Human
cuuucucucaaacacacauaca

SEQ ID NO: 152273 - RNA, 22 nt, Human
acgugugugugcacguguguau

SEQ ID NO: 152274 - RNA, 22 nt, Human
auagcaguauuaugagauaacu

SEQ ID NO: 152275 - RNA, 20 nt, Human
ugcagcucccccgcaguuuc

SEQ ID NO: 152276 - RNA, 22 nt, Human
gagccucaggguuuuguugaca

SEQ ID NO: 152277 - RNA, 22 nt, Human
uucaugucuuugauucugauaa

SEQ ID NO: 152278 - RNA, 22 nt, Human
auuaucugacugaguagucugu

SEQ ID NO: 152279 - RNA, 22 nt, Human
ucacuuccuugcagcuguagaa

SEQ ID NO: 152280 - RNA, 23 nt, Human
uaagccugugccugcuaccugcu

SEQ ID NO: 152281 - RNA, 22 nt, Human
aaucauaacaaaagcaauuaua

SEQ ID NO: 152282 - RNA, 22 nt, Human
gcugcccucccagggcaagcuu

SEQ ID NO: 152283 - RNA, 22 nt, Human
uuauauuaaaaaucgcuaacag

SEQ ID NO: 152284 - RNA, 22 nt, Human
guugggugccagaggcuucacg

SEQ ID NO: 152285 - RNA, 22 nt, Human
agugagaguauuaaugugaacu

SEQ ID NO: 152286 - RNA, 22 nt, Human
cuguggcuaggaagcuguggga

SEQ ID NO: 152287 - RNA, 22 nt, Human
gauauauuucaaauucuuuugc

SEQ ID NO: 152288 - RNA, 21 nt, Human
gcagcaugagaaagccccaaa

SEQ ID NO: 152289 - RNA, 22 nt, Human
uaaaugauaguauugaagguag

SEQ ID NO: 152290 - RNA, 22 nt, Human
aggcaguguguagcuggaagag

SEQ ID NO: 152291 - RNA, 22 nt, Human
uggcagcucauuuggaaaugga

SEQ ID NO: 152292 - RNA, 22 nt, Human
aaggucuucgaaccuuauguua

SEQ ID NO: 152293 - RNA, 22 nt, Human
auauauguauauaugugugugu

SEQ ID NO: 152294 - RNA, 22 nt, Human
ccagcugcugcaccgugcaugg

SEQ ID NO: 152295 - RNA, 17 nt, Human
auuguuuuuaauuugca

SEQ ID NO: 152296 - RNA, 22 nt, Human
aauggaaaaauccacagggaac

SEQ ID NO: 152297 - RNA, 22 nt, Human
ggggaaggaaggggagggcacg

SEQ ID NO: 152298 - RNA, 22 nt, Human
cccagagggcugaggauaugaa

SEQ ID NO: 152299 - RNA, 22 nt, Human
ugauauaaaagauucuuauuga

SEQ ID NO: 152300 - RNA, 22 nt, Human
uggcucaguaaucgagucuccu

SEQ ID NO: 152301 - RNA, 22 nt, Human
uuccgcuuucaauggcuuggcu

SEQ ID NO: 152302 - RNA, 20 nt, Human
auggaaacacgcagccccaa

SEQ ID NO: 152303 - RNA, 22 nt, Human
aauucugaggccauuuauuucc

SEQ ID NO: 152304 - RNA, 22 nt, Human
uuucagagaaagcccaaagacu

SEQ ID NO: 152305 - RNA, 23 nt, Human
agagggaagagcuuagaugggga

SEQ ID NO: 152306 - RNA, 20 nt, Human
ucagugggaaagugagagug

SEQ ID NO: 152307 - RNA, 22 nt, Human
aagaggaggcuggaauccuaaa

SEQ ID NO: 152308 - RNA, 22 nt, Human
uguauuuuuucccugaaauaaa

SEQ ID NO: 152309 - RNA, 22 nt, Human
auuuucuucauuuugauuguau

SEQ ID NO: 152310 - RNA, 22 nt, Human
acagcagguuauuguuauggca

SEQ ID NO: 152311 - RNA, 22 nt, Human
cugcaucacagcaggaggcaca

SEQ ID NO: 152312 - RNA, 22 nt, Human
cuaaaccaauauauuuucuucc

SEQ ID NO: 152313 - RNA, 22 nt, Human
aauggaaaaagaacuguuuaaa

SEQ ID NO: 152314 - RNA, 22 nt, Human
caauaccucuuggugauugggc

SEQ ID NO: 152315 - RNA, 22 nt, Human
accugcagguguuuccacacuu

SEQ ID NO: 152316 - RNA, 22 nt, Human
uccagcugugcuccaggaggug

SEQ ID NO: 152317 - RNA, 22 nt, Human
ucccaaguguuuggcgaggaga

SEQ ID NO: 152318 - RNA, 22 nt, Human
agagcuccaggguuuuguagug

SEQ ID NO: 152319 - RNA, 22 nt, Human
cuuuaaaaauguauuuuugugg

SEQ ID NO: 152320 - RNA, 22 nt, Human
acagagggagugacggccaacc

SEQ ID NO: 152321 - RNA, 17 nt, Human
agcagcuggguugaucu

SEQ ID NO: 152322 - RNA, 22 nt, Human
agucccugauggacuggaugag

SEQ ID NO: 152323 - RNA, 22 nt, Human
uauguauaacuugauaggauga

SEQ ID NO: 152324 - RNA, 22 nt, Human
uuuauguuuguuuuugaaauaa

SEQ ID NO: 152325 - RNA, 22 nt, Human
ggaggcccagaaggaagcccag

SEQ ID NO: 152326 - RNA, 22 nt, Human
uauguuaaauguuugauguuua

SEQ ID NO: 152327 - RNA, 22 nt, Human
ugugaagaauuaaugugaauca

SEQ ID NO: 152328 - RNA, 22 nt, Human
uaguggaaccuucuaaaugacg

SEQ ID NO: 152329 - RNA, 20 nt, Human
uggaucaccauccuguugcu

SEQ ID NO: 152330 - RNA, 22 nt, Human
ccacuuugagaagcugaugaaa

SEQ ID NO: 152331 - RNA, 22 nt, Human
ugguggagucugggggaggcuu

SEQ ID NO: 152332 - RNA, 22 nt, Human
acuggguuguuugucucaugag

SEQ ID NO: 152333 - RNA, 22 nt, Human
aauuacuuuaggaaaacuccuc

SEQ ID NO: 152334 - RNA, 22 nt, Human
cagggcaucucugaaucuucac

SEQ ID NO: 152335 - RNA, 22 nt, Human
aaggaaaaaauggcuugugaua

SEQ ID NO: 152336 - RNA, 22 nt, Human
aggcuccucugggggccccgga

SEQ ID NO: 152337 - RNA, 22 nt, Human
aggcgaagggaccagacgguag

SEQ ID NO: 152338 - RNA, 22 nt, Human
auggcagcggagcuggaaauga

SEQ ID NO: 152339 - RNA, 22 nt, Human
auauauacuuugacacauucug

SEQ ID NO: 152340 - RNA, 22 nt, Human
auucauucugaccucaagagaa

SEQ ID NO: 152341 - RNA, 22 nt, Human
cugacacagccauuguccuugu

SEQ ID NO: 152342 - RNA, 22 nt, Human
agugcucagggaaugccacuga

SEQ ID NO: 152343 - RNA, 20 nt, Human
uuggagaucacguguccagg

SEQ ID NO: 152344 - RNA, 22 nt, Human
ugccuuuuguguuuggcuaauc

SEQ ID NO: 152345 - RNA, 22 nt, Human
cauccagggguacccuggagcc

SEQ ID NO: 152346 - RNA, 22 nt, Human
uuccagcaaagguaguguguua

SEQ ID NO: 152347 - RNA, 22 nt, Human
aaagaugaaguucagcgaagaa

SEQ ID NO: 152348 - RNA, 22 nt, Human
gugaaauuguacacucaguacc

SEQ ID NO: 152349 - RNA, 22 nt, Human
ugagggaggggaaugugugcag

SEQ ID NO: 152350 - RNA, 22 nt, Human
cagggccaggccucaggggcgc

SEQ ID NO: 152351 - RNA, 22 nt, Human
uuuaccuuauguaaauaagagu

SEQ ID NO: 152352 - RNA, 22 nt, Human
gccugagauuggacauuauuua

SEQ ID NO: 152353 - RNA, 22 nt, Human
ccccauggaaaacccaccuagg

SEQ ID NO: 152354 - RNA, 22 nt, Human
acugaacuaaagaaaugggcaa

SEQ ID NO: 152355 - RNA, 22 nt, Human
aucucccaaauuagccucuuga

SEQ ID NO: 152356 - RNA, 22 nt, Human
aaaacauuuaggguuuuuuuua

SEQ ID NO: 152357 - RNA, 22 nt, Human
gucacuuugcuugcgaugcucc

SEQ ID NO: 152358 - RNA, 22 nt, Human
uuuuuaaaagaugauuuaauga

SEQ ID NO: 152359 - RNA, 22 nt, Human
uaguuuuaagcugacauuguuc

SEQ ID NO: 152360 - RNA, 22 nt, Human
aggggcugagaguuugaugugg

SEQ ID NO: 152361 - RNA, 22 nt, Human
gggaggcagacgcuggagccca

SEQ ID NO: 152362 - RNA, 22 nt, Human
gcauucuugucaguggggucag

SEQ ID NO: 152363 - RNA, 22 nt, Human
uuugcauuaguuuagauuucaa

SEQ ID NO: 152364 - RNA, 22 nt, Human
aaaauaaccuucauuugcauug

SEQ ID NO: 152365 - RNA, 22 nt, Human
caagcagauauuuuagucaaga

SEQ ID NO: 152366 - RNA, 22 nt, Human
cgaaggaaucacuuaacacuuu

SEQ ID NO: 152367 - RNA, 22 nt, Human
uagcacauaguaggcacaggcu

SEQ ID NO: 152368 - RNA, 22 nt, Human
ccugccugggcucacuugccag

SEQ ID NO: 152369 - RNA, 22 nt, Human
caugccucuguuuuaguuguug

SEQ ID NO: 152370 - RNA, 22 nt, Human
ugaaaaaugcuuuaaugcaugu

SEQ ID NO: 152371 - RNA, 22 nt, Human
gagaggaagugccugcucccag

SEQ ID NO: 152372 - RNA, 22 nt, Human
ugcuucuuuaggauguaguuau

SEQ ID NO: 152373 - RNA, 22 nt, Human
auauuucuacaggcugauuuua

SEQ ID NO: 152374 - RNA, 22 nt, Human
gggggcugugugcccgcucccc

SEQ ID NO: 152375 - RNA, 22 nt, Human
ggagacagauggcgucucaguu

SEQ ID NO: 152376 - RNA, 20 nt, Human
ggcagagcuaugucuguugc

SEQ ID NO: 152377 - RNA, 22 nt, Human
gauuuuaaaagauguauaaggu

SEQ ID NO: 152378 - RNA, 22 nt, Human
gaauuccaggugagagaaggua

SEQ ID NO: 152379 - RNA, 22 nt, Human
aucuucuuucaucagccccuca

SEQ ID NO: 152380 - RNA, 22 nt, Human
ugggaggcugugggaauggguc

SEQ ID NO: 152381 - RNA, 22 nt, Human
uacuuuaauugcaaaaauaaau

SEQ ID NO: 152382 - RNA, 21 nt, Human
aucagaggacaucucagggcc

SEQ ID NO: 152383 - RNA, 23 nt, Human
gcuuugaaaaugcuuucuuccag

SEQ ID NO: 152384 - RNA, 22 nt, Human
uugauagauuuuagaggcaggc

SEQ ID NO: 152385 - RNA, 22 nt, Human
auucuacucuuuaaauaugaaa

SEQ ID NO: 152386 - RNA, 22 nt, Human
gcugcccauugcucucccacuc

SEQ ID NO: 152387 - RNA, 22 nt, Human
uuuaaaccuaucuaagaaauag

SEQ ID NO: 152388 - RNA, 22 nt, Human
uauaagaaaagucauuaucaaa

SEQ ID NO: 152389 - RNA, 22 nt, Human
agagagggaugguguccagaga

SEQ ID NO: 152390 - RNA, 22 nt, Human
ccagucuuggugucuguagcac

SEQ ID NO: 152391 - RNA, 22 nt, Human
uugcugccagcgcccugcaggg

SEQ ID NO: 152392 - RNA, 22 nt, Human
uuguuguuguuguuauuuaguu

SEQ ID NO: 152393 - RNA, 22 nt, Human
cuaauuguaagcuccuugaggg

SEQ ID NO: 152394 - RNA, 22 nt, Human
ggcagaggagcuggaaacaugg

SEQ ID NO: 152395 - RNA, 22 nt, Human
acugcaggucccaucaccugcg

SEQ ID NO: 152396 - RNA, 22 nt, Human
uaggaagagauuuucacauggc

SEQ ID NO: 152397 - RNA, 22 nt, Human
aaacccuagcguuguuuauuga

SEQ ID NO: 152398 - RNA, 18 nt, Human
auucauuugcguuuggcu

SEQ ID NO: 152399 - RNA, 22 nt, Human
aguuuccacuggagacacugug

SEQ ID NO: 152400 - RNA, 22 nt, Human
uuuauaauuguuauguuaccca

SEQ ID NO: 152401 - RNA, 22 nt, Human
aaggugcugaggguccuggcuu

SEQ ID NO: 152402 - RNA, 22 nt, Human
gccugcaggaaggugugccugu

SEQ ID NO: 152403 - RNA, 22 nt, Human
uguagggaggaaggguuggaaa

SEQ ID NO: 152404 - RNA, 22 nt, Human
uugggauucugucagugugugu

SEQ ID NO: 152405 - RNA, 22 nt, Human
ggagggagugcaggcaggcaga

SEQ ID NO: 152406 - RNA, 22 nt, Human
cccagccugaucucggccagcu

SEQ ID NO: 152407 - RNA, 22 nt, Human
cuguuacggaggcuuucuaguu

SEQ ID NO: 152408 - RNA, 20 nt, Human
gaacauaaauaacucuuuac

SEQ ID NO: 152409 - RNA, 22 nt, Human
uuauuuuauaaagagaagacuu

SEQ ID NO: 152410 - RNA, 22 nt, Human
uccagaaaucucuguugauugu

SEQ ID NO: 152411 - RNA, 22 nt, Human
aacauuuauguuuugaccaagu

SEQ ID NO: 152412 - RNA, 22 nt, Human
aguuucuugaagacugauguuu

SEQ ID NO: 152413 - RNA, 22 nt, Human
uuuguuaugguuggaagcagga

SEQ ID NO: 152414 - RNA, 21 nt, Human
uuuuucuccagaguuuccacu

SEQ ID NO: 152415 - RNA, 22 nt, Human
gugguggugaggcaaggggugu

SEQ ID NO: 152416 - RNA, 22 nt, Human
ccaugauguugccuacacugcu

SEQ ID NO: 152417 - RNA, 21 nt, Human
uccaggagcacgggacuagga

SEQ ID NO: 152418 - RNA, 22 nt, Human
agaggcagagcugggguuugac

SEQ ID NO: 152419 - RNA, 20 nt, Human
uggagggaggaggggcccaa

SEQ ID NO: 152420 - RNA, 22 nt, Human
auuuuuuuaggcugucagccgc

SEQ ID NO: 152421 - RNA, 22 nt, Human
auugcaggucguguggaaguga

SEQ ID NO: 152422 - RNA, 22 nt, Human
uauuguauuagcucuuggagau

SEQ ID NO: 152423 - RNA, 21 nt, Human
gccugcuguucacccugccac

SEQ ID NO: 152424 - RNA, 21 nt, Human
ggcugcucgugaugaacuuca

SEQ ID NO: 152425 - RNA, 22 nt, Human
cugugucucccaaggaggguca

SEQ ID NO: 152426 - RNA, 19 nt, Human
ugguggaggugcaccugac

SEQ ID NO: 152427 - RNA, 22 nt, Human
aucucacuucugucauguggca

SEQ ID NO: 152428 - RNA, 22 nt, Human
auaaaaauguuuuuguguggua

SEQ ID NO: 152429 - RNA, 22 nt, Human
agcagggagacagugcagcauu

SEQ ID NO: 152430 - RNA, 22 nt, Human
agacacugacaggguccaugga

SEQ ID NO: 152431 - RNA, 22 nt, Human
acuuuuaauaguagauuuuuaa

SEQ ID NO: 152432 - RNA, 22 nt, Human
uucuuuucuucccuguuuauua

SEQ ID NO: 152433 - RNA, 22 nt, Human
uuucuaaaaccagaguuuauaa

SEQ ID NO: 152434 - RNA, 22 nt, Human
auguaaauauuuauauaugcau

SEQ ID NO: 152435 - RNA, 22 nt, Human
uacagaccaguaguucucagcg

SEQ ID NO: 152436 - RNA, 21 nt, Human
gggagaguagcgguagggagg

SEQ ID NO: 152437 - RNA, 22 nt, Human
cucagaauugucaccucaaaaa

SEQ ID NO: 152438 - RNA, 22 nt, Human
uggcucaggccuacgacgccuu

SEQ ID NO: 152439 - RNA, 22 nt, Human
gguagacugagcuccuugagga

SEQ ID NO: 152440 - RNA, 22 nt, Human
aagacagugacagucacaauug

SEQ ID NO: 152441 - RNA, 22 nt, Human
auucauauagcgcuuacagccu

SEQ ID NO: 152442 - RNA, 22 nt, Human
ucccagaaauccaggcuuaaau

SEQ ID NO: 152443 - RNA, 22 nt, Human
auagggaggcggagggagcugg

SEQ ID NO: 152444 - RNA, 22 nt, Human
uccucagcaagacgcuggcagc

SEQ ID NO: 152445 - RNA, 21 nt, Human
acugggcuagccugacuucug

SEQ ID NO: 152446 - RNA, 17 nt, Human
ucuguguccgcucaguc

SEQ ID NO: 152447 - RNA, 22 nt, Human
uaaaggcaaacucuccaaggau

SEQ ID NO: 152448 - RNA, 22 nt, Human
cccuuuuuuauggaguuggcca

SEQ ID NO: 152449 - RNA, 22 nt, Human
cuacuucucccuagaucagaaa

SEQ ID NO: 152450 - RNA, 22 nt, Human
ugaauuagagugaaggaaagcu

SEQ ID NO: 152451 - RNA, 22 nt, Human
gggggacagugugccuggugug

SEQ ID NO: 152452 - RNA, 22 nt, Human
uacaggaggaugugcagccagg

SEQ ID NO: 152453 - RNA, 22 nt, Human
aaaaggucacuguaaaaugacg

SEQ ID NO: 152454 - RNA, 22 nt, Human
aguuuuugccucgaauucugcg

SEQ ID NO: 152455 - RNA, 22 nt, Human
cagcuucacuuaaaacaugcaa

SEQ ID NO: 152456 - RNA, 22 nt, Human
gaggucagugugggggcaaggg

SEQ ID NO: 152457 - RNA, 22 nt, Human
cugucucugauaagcucgaggg

SEQ ID NO: 152458 - RNA, 22 nt, Human
gaaucucuuugucccugaguuu

SEQ ID NO: 152459 - RNA, 22 nt, Human
guuuuguagucuggagacuguc

SEQ ID NO: 152460 - RNA, 22 nt, Human
aauauuuugggacugaggaauu

SEQ ID NO: 152461 - RNA, 20 nt, Human
cuccuccccucggccccacc

SEQ ID NO: 152462 - RNA, 22 nt, Human
ugaguacauuugauuaucagag

SEQ ID NO: 152463 - RNA, 22 nt, Human
ucaacagaagugauagcuauua

SEQ ID NO: 152464 - RNA, 22 nt, Human
gcaggaaugguacauaccuguu

SEQ ID NO: 152465 - RNA, 22 nt, Human
auuuacugagguaaauaaacug

SEQ ID NO: 152466 - RNA, 22 nt, Human
auaaaucaagggcaguauuucc

SEQ ID NO: 152467 - RNA, 22 nt, Human
aaggggaggccugcgcuuucgg

SEQ ID NO: 152468 - RNA, 22 nt, Human
acuucccacugcagugacugag

SEQ ID NO: 152469 - RNA, 21 nt, Human
agaugaggauacugaggccua

SEQ ID NO: 152470 - RNA, 22 nt, Human
caacaaguugauuucacgcugc

SEQ ID NO: 152471 - RNA, 22 nt, Human
auguaaugucaaucuucagugg

SEQ ID NO: 152472 - RNA, 22 nt, Human
uggaagaaaugguugagccaug

SEQ ID NO: 152473 - RNA, 22 nt, Human
caaaacccaagugcuauugcaa

SEQ ID NO: 152474 - RNA, 22 nt, Human
auacaugacucacacauucugc

SEQ ID NO: 152475 - RNA, 22 nt, Human
gccugcugggcucuuccugcug

SEQ ID NO: 152476 - RNA, 21 nt, Human
ucucauuuuaacacagaguug

SEQ ID NO: 152477 - RNA, 20 nt, Human
aaaaacaguaaugcugaaga

SEQ ID NO: 152478 - RNA, 22 nt, Human
auguugagaaucucucuucuaa

SEQ ID NO: 152479 - RNA, 19 nt, Human
ccagaagggcaagcaaagg

SEQ ID NO: 152480 - RNA, 22 nt, Human
gguuuucacgauccucccuuuu

SEQ ID NO: 152481 - RNA, 22 nt, Human
aguucauaucuacuuuuccauc

SEQ ID NO: 152482 - RNA, 22 nt, Human
ccucaucagaaagcagaaagca

SEQ ID NO: 152483 - RNA, 22 nt, Human
agucacuguucugucaugucaa

SEQ ID NO: 152484 - RNA, 22 nt, Human
cugccucucaugccugcuugcu

SEQ ID NO: 152485 - RNA, 22 nt, Human
aauuaaauguuugguuugagcu

SEQ ID NO: 152486 - RNA, 22 nt, Human
cuucucuuggguguggugucuu

SEQ ID NO: 152487 - RNA, 22 nt, Human
aauuuauccuuuugcuaaagca

SEQ ID NO: 152488 - RNA, 22 nt, Human
uuacuuucugggauaucaaaug

SEQ ID NO: 152489 - RNA, 19 nt, Human
ugcagcuguaugagcuuaa

SEQ ID NO: 152490 - RNA, 22 nt, Human
uuaaugcagguacuguuacaau

SEQ ID NO: 152491 - RNA, 22 nt, Human
uucccugugcaguauguuccaa

SEQ ID NO: 152492 - RNA, 22 nt, Human
aaaguuacccaaucucuaugaa

SEQ ID NO: 152493 - RNA, 22 nt, Human
agugugaguuacaaagugugaa

SEQ ID NO: 152494 - RNA, 22 nt, Human
uggggagacauggaguaaaaga

SEQ ID NO: 152495 - RNA, 22 nt, Human
agggagcagcuagagggggucc

SEQ ID NO: 152496 - RNA, 22 nt, Human
guaaauacuaugagauaaugaa

SEQ ID NO: 152497 - RNA, 22 nt, Human
ucucuggacggacauuuaaggu

SEQ ID NO: 152498 - RNA, 22 nt, Human
ccauuucacaucccugacaugu

SEQ ID NO: 152499 - RNA, 22 nt, Human
ucagucugcuauagguauuugu

SEQ ID NO: 152500 - RNA, 22 nt, Human
cuccagggcuaccagguuuuag

SEQ ID NO: 152501 - RNA, 22 nt, Human
gauggcaaugcuagaaauuuag

SEQ ID NO: 152502 - RNA, 22 nt, Human
caauggagccaagaggaggaaa

SEQ ID NO: 152503 - RNA, 22 nt, Human
uuugaagaaacagucuuaagag

SEQ ID NO: 152504 - RNA, 22 nt, Human
gcuguggagaagcugccuaugg

SEQ ID NO: 152505 - RNA, 22 nt, Human
acaaucuuauuaguaguauaga

SEQ ID NO: 152506 - RNA, 22 nt, Human
ggcagaggaagcuggaaguggg

SEQ ID NO: 152507 - RNA, 22 nt, Human
caaauacaaauacgggcagcuu

SEQ ID NO: 152508 - RNA, 22 nt, Human
uggagagauagucauucuagag

SEQ ID NO: 152509 - RNA, 22 nt, Human
cugggaggagacaggggauggg

SEQ ID NO: 152510 - RNA, 22 nt, Human
gugucccaaagauuagaaauca

SEQ ID NO: 152511 - RNA, 22 nt, Human
aagugagaugggagucagagga

SEQ ID NO: 152512 - RNA, 22 nt, Human
uggagccuugugagaccacaau

SEQ ID NO: 152513 - RNA, 22 nt, Human
gaaaaagagaaggaguucagua

SEQ ID NO: 152514 - RNA, 22 nt, Human
auguuuaauuugaaauuuuauu

SEQ ID NO: 152515 - RNA, 22 nt, Human
gaggcaggcggggcccaggugg

SEQ ID NO: 152516 - RNA, 22 nt, Human
uauuucaugagugaauaucuag

SEQ ID NO: 152517 - RNA, 22 nt, Human
aaggaaaaccugacugaagaac

SEQ ID NO: 152518 - RNA, 22 nt, Human
augaacugcaguauaaacuugg

SEQ ID NO: 152519 - RNA, 22 nt, Human
cuuggcuccuucacagggagau

SEQ ID NO: 152520 - RNA, 22 nt, Human
auuaaaaaaagauaaugaguua

SEQ ID NO: 152521 - RNA, 22 nt, Human
gagggagagaugcuggaccggg

SEQ ID NO: 152522 - RNA, 22 nt, Human
ccacccugguuacugugccagg

SEQ ID NO: 152523 - RNA, 22 nt, Human
uaggcaaguggaccagagguuu

SEQ ID NO: 152524 - RNA, 22 nt, Human
cagagguagaaguagauguuug

SEQ ID NO: 152525 - RNA, 22 nt, Human
auuuaagacuguggugcaguuu

SEQ ID NO: 152526 - RNA, 22 nt, Human
aaauggaaguuuguucucagcc

SEQ ID NO: 152527 - RNA, 22 nt, Human
gcccugucagcucucauggaca

SEQ ID NO: 152528 - RNA, 22 nt, Human
gcuguguaugaugcaggcaccu

SEQ ID NO: 152529 - RNA, 22 nt, Human
aacaaaacauuuuacgaauaua

SEQ ID NO: 152530 - RNA, 17 nt, Human
cccugcacccuacucuc

SEQ ID NO: 152531 - RNA, 22 nt, Human
agcucugcuucuugggaagaug

SEQ ID NO: 152532 - RNA, 22 nt, Human
aauuagaagcuguuagcaaaau

SEQ ID NO: 152533 - RNA, 22 nt, Human
aaucccaguugacagaacuguu

SEQ ID NO: 152534 - RNA, 22 nt, Human
ucugacuucuuuuauuaucauu

SEQ ID NO: 152535 - RNA, 22 nt, Human
cacaauuuccauugagcagcag

SEQ ID NO: 152536 - RNA, 22 nt, Human
cauuuagagaagauuacaagga

SEQ ID NO: 152537 - RNA, 22 nt, Human
uauuuccugcguuucugugagc

SEQ ID NO: 152538 - RNA, 22 nt, Human
gauacuuuguggaauccuggau

SEQ ID NO: 152539 - RNA, 22 nt, Human
ccugcuggagucuaguuggucu

SEQ ID NO: 152540 - RNA, 22 nt, Human
gugggugaguggggccgccuga

SEQ ID NO: 152541 - RNA, 20 nt, Human
uucacagaucucuaacugag

SEQ ID NO: 152542 - RNA, 22 nt, Human
auuuuuuuggucauaugagaua

SEQ ID NO: 152543 - RNA, 22 nt, Human
cuuuacauuaauuucuacugau

SEQ ID NO: 152544 - RNA, 22 nt, Human
augcggcugugggggaauggga

SEQ ID NO: 152545 - RNA, 21 nt, Human
ugagcccaaagcuguauuggu

SEQ ID NO: 152546 - RNA, 22 nt, Human
agagggagccugcacagcuuuc

SEQ ID NO: 152547 - RNA, 22 nt, Human
ugcuuggagaaucagucccagc

SEQ ID NO: 152548 - RNA, 22 nt, Human
cuccuuugagcaaaucuuugau

SEQ ID NO: 152549 - RNA, 23 nt, Human
ucucccagaaguucucggggacu

SEQ ID NO: 152550 - RNA, 22 nt, Human
aauguguauguguauauauaug

SEQ ID NO: 152551 - RNA, 22 nt, Human
uggcaagcuguuggcagauagc

SEQ ID NO: 152552 - RNA, 22 nt, Human
gauuuucauuauagcuaguuuc

SEQ ID NO: 152553 - RNA, 22 nt, Human
ugaaucaaugaauugcacuuca

SEQ ID NO: 152554 - RNA, 22 nt, Human
uuuauucuuugcuagguuccau

SEQ ID NO: 152555 - RNA, 22 nt, Human
cuaaauucuauauccuugcuuc

SEQ ID NO: 152556 - RNA, 22 nt, Human
augggagggagcagugaguguu

SEQ ID NO: 152557 - RNA, 22 nt, Human
auuauacauuaggagauugauu

SEQ ID NO: 152558 - RNA, 22 nt, Human
uucuaauauuaugauuucuaag

SEQ ID NO: 152559 - RNA, 22 nt, Human
cagcucuggcuauugaggacca

SEQ ID NO: 152560 - RNA, 22 nt, Human
auugugaaugccugucagucuu

SEQ ID NO: 152561 - RNA, 22 nt, Human
ggugucuuugauguugggcuga

SEQ ID NO: 152562 - RNA, 22 nt, Human
aagaaggaaggcaagagauggg

SEQ ID NO: 152563 - RNA, 22 nt, Human
ucuucaugaaauugauugcuua

SEQ ID NO: 152564 - RNA, 22 nt, Human
uaaaaauuagauauguauuuag

SEQ ID NO: 152565 - RNA, 22 nt, Human
accuccauggcccacaucuagu

SEQ ID NO: 152566 - RNA, 22 nt, Human
gacggaggacaucagcaguguc

SEQ ID NO: 152567 - RNA, 22 nt, Human
uaaaaucaugacagauugacau

SEQ ID NO: 152568 - RNA, 22 nt, Human
aagccucaugccagauccaggu

SEQ ID NO: 152569 - RNA, 22 nt, Human
cuugcuuuaucugguuucucau

SEQ ID NO: 152570 - RNA, 22 nt, Human
gcugggacacacagucuucuuu

SEQ ID NO: 152571 - RNA, 23 nt, Human
ggccuuuuuaaccgcgagcgaca

SEQ ID NO: 152572 - RNA, 23 nt, Human
uugcuuuugccccaaaagaguua

SEQ ID NO: 152573 - RNA, 22 nt, Human
uguaauuugguuagauuucuuu

SEQ ID NO: 152574 - RNA, 22 nt, Human
aauagcaauuacccuucaacuc

SEQ ID NO: 152575 - RNA, 22 nt, Human
uugaccagaaaaguuaguaauu

SEQ ID NO: 152576 - RNA, 22 nt, Human
agggcaguuaugaaugucucca

SEQ ID NO: 152577 - RNA, 22 nt, Human
gaguucuagauguauuauuaau

SEQ ID NO: 152578 - RNA, 22 nt, Human
auucauuuuuacaucaccaaua

SEQ ID NO: 152579 - RNA, 22 nt, Human
cagguugucuaauuccaagggg

SEQ ID NO: 152580 - RNA, 22 nt, Human
cauuuugguaauguucguuugc

SEQ ID NO: 152581 - RNA, 22 nt, Human
aaaugcacaauaaaguaaaggc

SEQ ID NO: 152582 - RNA, 22 nt, Human
uguugaaacagcuauugacuuu

SEQ ID NO: 152583 - RNA, 22 nt, Human
gggagguaaugggggugcaggg

SEQ ID NO: 152584 - RNA, 22 nt, Human
ucauaagucucauauaugucca

SEQ ID NO: 152585 - RNA, 22 nt, Human
augagugugugguucuaaauga

SEQ ID NO: 152586 - RNA, 22 nt, Human
cucacugucagcugcagggcuu

SEQ ID NO: 152587 - RNA, 22 nt, Human
aggcugggaaguguguccugag

SEQ ID NO: 152588 - RNA, 22 nt, Human
aucuggaacuucucugcauuga

SEQ ID NO: 152589 - RNA, 22 nt, Human
ugggccaaaugucugcauaagu

SEQ ID NO: 152590 - RNA, 22 nt, Human
auuuaaaaacugguacaacagg

SEQ ID NO: 152591 - RNA, 22 nt, Human
cuuccauucugauggcuaauua

SEQ ID NO: 152592 - RNA, 20 nt, Human
cuuauuuuggagaacuuuuc

SEQ ID NO: 152593 - RNA, 23 nt, Human
aaauaauaauuucucuguuggga

SEQ ID NO: 152594 - RNA, 22 nt, Human
acccccaggacacugccucuga

SEQ ID NO: 152595 - RNA, 22 nt, Human
auuuauuugaagagccauugca

SEQ ID NO: 152596 - RNA, 22 nt, Human
cugggagaugacucagagcagg

SEQ ID NO: 152597 - RNA, 23 nt, Human
ugccaggaagaaugaccucugcu

SEQ ID NO: 152598 - RNA, 23 nt, Human
caggggacaggugaccugggcuc

SEQ ID NO: 152599 - RNA, 22 nt, Human
ucaguuacucugauguccugug

SEQ ID NO: 152600 - RNA, 22 nt, Human
aauucuuuguuccucugccaag

SEQ ID NO: 152601 - RNA, 22 nt, Human
uguucugauggauuacaugucu

SEQ ID NO: 152602 - RNA, 23 nt, Human
ucucacucauucuccucugucca

SEQ ID NO: 152603 - RNA, 22 nt, Human
auuuaaagaguaauacaaucca

SEQ ID NO: 152604 - RNA, 22 nt, Human
aaugaaugaaugaaugauuaug

SEQ ID NO: 152605 - RNA, 22 nt, Human
uaggauauuuuagaaugguaca

SEQ ID NO: 152606 - RNA, 22 nt, Human
cggggaggagccagcggaggau

SEQ ID NO: 152607 - RNA, 22 nt, Human
uugguuaccuucagaaaugagu

SEQ ID NO: 152608 - RNA, 22 nt, Human
aaauauagugacacuuauaguc

SEQ ID NO: 152609 - RNA, 22 nt, Human
guuuucuuguuaauuuugaacg

SEQ ID NO: 152610 - RNA, 22 nt, Human
ucccuucccaccccugccuuuu

SEQ ID NO: 152611 - RNA, 22 nt, Human
acaauaauguuuuuagguuauu

SEQ ID NO: 152612 - RNA, 22 nt, Human
aagaaauagauagaggaauacu

SEQ ID NO: 152613 - RNA, 22 nt, Human
uuaauauuuauugguaaucacu

SEQ ID NO: 152614 - RNA, 22 nt, Human
aggccagggacaaugaggcaga

SEQ ID NO: 152615 - RNA, 22 nt, Human
uguuaaaaagucccuguuuugu

SEQ ID NO: 152616 - RNA, 22 nt, Human
aaaauauaaaggauguggguuu

SEQ ID NO: 152617 - RNA, 22 nt, Human
auuauucaaggugaggguaaaa

SEQ ID NO: 152618 - RNA, 22 nt, Human
auuuuugguuucaccugcacgc

SEQ ID NO: 152619 - RNA, 22 nt, Human
ucucccaaaucuuucuagcaca

SEQ ID NO: 152620 - RNA, 22 nt, Human
gaagaaggaagaucaugcuuga

SEQ ID NO: 152621 - RNA, 22 nt, Human
uugccaggagacaucuggagcc

SEQ ID NO: 152622 - RNA, 22 nt, Human
cugcagagaccuaggucagguu

SEQ ID NO: 152623 - RNA, 22 nt, Human
guggaaggaauuaacagacuag

SEQ ID NO: 152624 - RNA, 22 nt, Human
uuauuucauguaaaauuuaugu

SEQ ID NO: 152625 - RNA, 22 nt, Human
ucaccauguacaugaagggcgg

SEQ ID NO: 152626 - RNA, 22 nt, Human
cagggcagaguuaagaugcugg

SEQ ID NO: 152627 - RNA, 22 nt, Human
ugcagagagccagcucucucgg

SEQ ID NO: 152628 - RNA, 21 nt, Human
uccugcagggcagcagagugg

SEQ ID NO: 152629 - RNA, 22 nt, Human
aagaggcuacagcccugugucu

SEQ ID NO: 152630 - RNA, 21 nt, Human
auacaguucagcuuuuacuau

SEQ ID NO: 152631 - RNA, 22 nt, Human
agcagagggucaguuuuuuagu

SEQ ID NO: 152632 - RNA, 22 nt, Human
gggccaaggggagcuggaaggg

SEQ ID NO: 152633 - RNA, 22 nt, Human
gaggcucagagggacuuucaag

SEQ ID NO: 152634 - RNA, 22 nt, Human
cuccacagccccuccaguggca

SEQ ID NO: 152635 - RNA, 22 nt, Human
aaggaaaguuaagguaaacucu

SEQ ID NO: 152636 - RNA, 20 nt, Human
ugggauggaaucaccugcac

SEQ ID NO: 152637 - RNA, 22 nt, Human
gccacucaguuuaggggcaagc

SEQ ID NO: 152638 - RNA, 22 nt, Human
uuuaaauuucugaaucuugagg

SEQ ID NO: 152639 - RNA, 22 nt, Human
cucugcuagaaggucaaucucu

SEQ ID NO: 152640 - RNA, 22 nt, Human
auuuucauauggguuauuugua

SEQ ID NO: 152641 - RNA, 22 nt, Human
caugccugaucagcggccagca

SEQ ID NO: 152642 - RNA, 22 nt, Human
uguacauuuacaaaagcuuuau

SEQ ID NO: 152643 - RNA, 22 nt, Human
cugugaaugguggccacgcguu

SEQ ID NO: 152644 - RNA, 22 nt, Human
cauauuaugcauguuguucuuu

SEQ ID NO: 152645 - RNA, 22 nt, Human
ugguggaggugggggguauuuu

SEQ ID NO: 152646 - RNA, 22 nt, Human
uugaaaaaaucugaggaggacc

SEQ ID NO: 152647 - RNA, 22 nt, Human
aagaaaagguaaccgcuuaucu

SEQ ID NO: 152648 - RNA, 22 nt, Human
aaaacauuuuacugccaucuca

SEQ ID NO: 152649 - RNA, 22 nt, Human
uugaaagaacaauucugugaug

SEQ ID NO: 152650 - RNA, 22 nt, Human
cuucuuaaaguugucacagcug

SEQ ID NO: 152651 - RNA, 22 nt, Human
acuuugugaauagaacuggaug

SEQ ID NO: 152652 - RNA, 22 nt, Human
cuggccagccucccagguaccc

SEQ ID NO: 152653 - RNA, 22 nt, Human
cuucuuucuuuucuucuucucu

SEQ ID NO: 152654 - RNA, 22 nt, Human
caggaggaggccgggaggaagc

SEQ ID NO: 152655 - RNA, 22 nt, Human
gaguaaaagaugaggcaguaga

SEQ ID NO: 152656 - RNA, 22 nt, Human
uaaaguguacaagucauaagua

SEQ ID NO: 152657 - RNA, 22 nt, Human
ggcucccgugggaugguggagc

SEQ ID NO: 152658 - RNA, 23 nt, Human
aggcugcagaagaauagggucau

SEQ ID NO: 152659 - RNA, 21 nt, Human
uuucauuaguacaucaauuug

SEQ ID NO: 152660 - RNA, 22 nt, Human
ggcagggagagcgccgccaugc

SEQ ID NO: 152661 - RNA, 22 nt, Human
uccugggcuugcucuuuccauu

SEQ ID NO: 152662 - RNA, 22 nt, Human
aacacuaaaggucaguuagaag

SEQ ID NO: 152663 - RNA, 22 nt, Human
guagucauugggucugugguca

SEQ ID NO: 152664 - RNA, 22 nt, Human
gaaguaaaacaguaacuuuguu

SEQ ID NO: 152665 - RNA, 22 nt, Human
aaauauugaauuugaggaugua

SEQ ID NO: 152666 - RNA, 22 nt, Human
cuuuuuuucuccauauuucugg

SEQ ID NO: 152667 - RNA, 22 nt, Human
agauuaagcauuauaauuauaa

SEQ ID NO: 152668 - RNA, 20 nt, Human
uacaauauucccacuuugcu

SEQ ID NO: 152669 - RNA, 22 nt, Human
agucaccuacagcucaugcuuc

SEQ ID NO: 152670 - RNA, 22 nt, Human
agugaggggagaaugaggugga

SEQ ID NO: 152671 - RNA, 22 nt, Human
uaguuucuucaacugucccagc

SEQ ID NO: 152672 - RNA, 22 nt, Human
uaagaaacauuuuuaugacagu

SEQ ID NO: 152673 - RNA, 22 nt, Human
agccacagucuguagccagcuu

SEQ ID NO: 152674 - RNA, 22 nt, Human
gaaagagaugucguuugucuuc

SEQ ID NO: 152675 - RNA, 22 nt, Human
uuuucaaucaaguuuauuuaua

SEQ ID NO: 152676 - RNA, 22 nt, Human
cccagaggcugaguugggagca

SEQ ID NO: 152677 - RNA, 22 nt, Human
auugaaauuaauuucugcuuuc

SEQ ID NO: 152678 - RNA, 22 nt, Human
guaggaaaugaauaagguaccu

SEQ ID NO: 152679 - RNA, 22 nt, Human
aucauguauauuuuugcuauua

SEQ ID NO: 152680 - RNA, 22 nt, Human
uggcuucagacuucugcuacgu

SEQ ID NO: 152681 - RNA, 22 nt, Human
ggaaagagaaacaugaacuaga

SEQ ID NO: 152682 - RNA, 22 nt, Human
augugcauguauguaucauauu

SEQ ID NO: 152683 - RNA, 22 nt, Human
agcccagguggagugugugggg

SEQ ID NO: 152684 - RNA, 22 nt, Human
ugcauucugaacguaaauguga

SEQ ID NO: 152685 - RNA, 22 nt, Human
uuccuguggggugucaucauag

SEQ ID NO: 152686 - RNA, 22 nt, Human
ccaaggcuguggggcugugcag

SEQ ID NO: 152687 - RNA, 22 nt, Human
ucuucagacuguuguucuuuug

SEQ ID NO: 152688 - RNA, 22 nt, Human
cagcuccaucuugcuuauacca

SEQ ID NO: 152689 - RNA, 22 nt, Human
ccuucugcuggucaucccagug

SEQ ID NO: 152690 - RNA, 22 nt, Human
gcuggucuggcaauccucaugg

SEQ ID NO: 152691 - RNA, 22 nt, Human
caaaacauucagagagcucacu

SEQ ID NO: 152692 - RNA, 22 nt, Human
auuagugguguauuuggcacua

SEQ ID NO: 152693 - RNA, 22 nt, Human
acacaggacacaaaagucacca

SEQ ID NO: 152694 - RNA, 22 nt, Human
caaauguuugguggcauuuugu

SEQ ID NO: 152695 - RNA, 22 nt, Human
auuugaaaaucuaugaugugca

SEQ ID NO: 152696 - RNA, 22 nt, Human
cuuuuucuugugguuaauaucu

SEQ ID NO: 152697 - RNA, 22 nt, Human
caagcacaauuucuacauguua

SEQ ID NO: 152698 - RNA, 17 nt, Human
uagccagcuugugauuu

SEQ ID NO: 152699 - RNA, 22 nt, Human
ugaauaaauaaacuuuuacuac

SEQ ID NO: 152700 - RNA, 22 nt, Human
uuccucauuuggcacaucugag

SEQ ID NO: 152701 - RNA, 22 nt, Human
uguuuuuuagagugauacuuuu

SEQ ID NO: 152702 - RNA, 22 nt, Human
aucauguauaugcagcguuugu

SEQ ID NO: 152703 - RNA, 22 nt, Human
gcuuucagggucacugucaaca

SEQ ID NO: 152704 - RNA, 22 nt, Human
cgaggagguccaggagcaguag

SEQ ID NO: 152705 - RNA, 22 nt, Human
uaauaauuaacagugauggguc

SEQ ID NO: 152706 - RNA, 22 nt, Human
ucacuguaggaaucucuaaauu

SEQ ID NO: 152707 - RNA, 22 nt, Human
ggagaggaggugagaggaagua

SEQ ID NO: 152708 - RNA, 22 nt, Human
uaguauuuguaauuaucaaagc

SEQ ID NO: 152709 - RNA, 22 nt, Human
auauguuaugccauuuucaagg

SEQ ID NO: 152710 - RNA, 22 nt, Human
uuguuuuaguagaaguuacaug

SEQ ID NO: 152711 - RNA, 22 nt, Human
uucucugcgcuccggcccaguu

SEQ ID NO: 152712 - RNA, 22 nt, Human
ccuaggcuggcugucuucaggu

SEQ ID NO: 152713 - RNA, 22 nt, Human
cagguuguucugggcauggagg

SEQ ID NO: 152714 - RNA, 22 nt, Human
uauuuugaggugaaagaguuug

SEQ ID NO: 152715 - RNA, 21 nt, Human
ugaagcccugugaggugcuua

SEQ ID NO: 152716 - RNA, 22 nt, Human
cagcucugcugggaggaugcag

SEQ ID NO: 152717 - RNA, 22 nt, Human
ccugaguucuuauuuccaguca

SEQ ID NO: 152718 - RNA, 22 nt, Human
guuuauucuuuuauuugugaga

SEQ ID NO: 152719 - RNA, 22 nt, Human
cccauuuuuuggauguguggau

SEQ ID NO: 152720 - RNA, 22 nt, Human
gcccuagaguugagagcaccca

SEQ ID NO: 152721 - RNA, 22 nt, Human
cuggagaacucugugcuucacu

SEQ ID NO: 152722 - RNA, 22 nt, Human
agagggagagaccuccgugccu

SEQ ID NO: 152723 - RNA, 17 nt, Human
aguuacugcacuugcca

SEQ ID NO: 152724 - RNA, 22 nt, Human
gccugggcuuccgggacccggg

SEQ ID NO: 152725 - RNA, 22 nt, Human
uaggucugaggcugcaucuugg

SEQ ID NO: 152726 - RNA, 20 nt, Human
aagacacuguccccacugga

SEQ ID NO: 152727 - RNA, 22 nt, Human
cccaggaaugagcaggcagggg

SEQ ID NO: 152728 - RNA, 17 nt, Human
ccagcugcucccucaga

SEQ ID NO: 152729 - RNA, 22 nt, Human
uuuuuaauuuuaagcuauuugu

SEQ ID NO: 152730 - RNA, 22 nt, Human
auaaaguaaugcauauaaugug

SEQ ID NO: 152731 - RNA, 22 nt, Human
guuaaaaugauuugugauuuau

SEQ ID NO: 152732 - RNA, 22 nt, Human
uuaugccuguuaggcagcaucu

SEQ ID NO: 152733 - RNA, 22 nt, Human
agguggucccaauggcugggca

SEQ ID NO: 152734 - RNA, 22 nt, Human
gaggagcuucagaggaaucuua

SEQ ID NO: 152735 - RNA, 22 nt, Human
uuucagaaauggcacugaaauc

SEQ ID NO: 152736 - RNA, 22 nt, Human
uuaggggcuuaggcagaguuug

SEQ ID NO: 152737 - RNA, 22 nt, Human
agaguguagugaaaagagauua

SEQ ID NO: 152738 - RNA, 22 nt, Human
uucuguacuagaucuuaucagu

SEQ ID NO: 152739 - RNA, 22 nt, Human
ggaggccgugcugugcugccag

SEQ ID NO: 152740 - RNA, 22 nt, Human
ucagucucuggggcuucuguuu

SEQ ID NO: 152741 - RNA, 22 nt, Human
ccaggcagaggggucuggagca

SEQ ID NO: 152742 - RNA, 22 nt, Human
ucugcaugccucaggaggccug

SEQ ID NO: 152743 - RNA, 22 nt, Human
ugcuugaacccaggaaguggag

SEQ ID NO: 152744 - RNA, 22 nt, Human
ugaguuuuggaagauguuacag

SEQ ID NO: 152745 - RNA, 22 nt, Human
uuauuuuuguaacacuguauag

SEQ ID NO: 152746 - RNA, 22 nt, Human
ucccaagugcuccucuggcccc

SEQ ID NO: 152747 - RNA, 22 nt, Human
caagaaguugacagccagguga

SEQ ID NO: 152748 - RNA, 22 nt, Human
cuggguguggugggugcugccg

SEQ ID NO: 152749 - RNA, 22 nt, Human
gcugucccccaaagaugcuccu

SEQ ID NO: 152750 - RNA, 22 nt, Human
ggcagggaauucagagggaagg

SEQ ID NO: 152751 - RNA, 22 nt, Human
gcucagccuuuuguucuauuca

SEQ ID NO: 152752 - RNA, 22 nt, Human
cuauguuucagauauauauaua

SEQ ID NO: 152753 - RNA, 22 nt, Human
uacccauuuugguucuugaugc

SEQ ID NO: 152754 - RNA, 22 nt, Human
uucuguguauggaagaaugucc

SEQ ID NO: 152755 - RNA, 23 nt, Human
uggcaaacgggaauaaaggaauu

SEQ ID NO: 152756 - RNA, 22 nt, Human
augaggguggggaaugggccau

SEQ ID NO: 152757 - RNA, 22 nt, Human
uggucacgucgggguauugcca

SEQ ID NO: 152758 - RNA, 22 nt, Human
aaaaguuguaauauuuccuuua

SEQ ID NO: 152759 - RNA, 22 nt, Human
uucugaaacauugcuauuuucc

SEQ ID NO: 152760 - RNA, 22 nt, Human
ucacuguuucaccgucugaagg

SEQ ID NO: 152761 - RNA, 19 nt, Human
agggagagucccaagagaa

SEQ ID NO: 152762 - RNA, 22 nt, Human
gcuuuucaaguuacaauuagcu

SEQ ID NO: 152763 - RNA, 22 nt, Human
guauauuuaugagcauuagccu

SEQ ID NO: 152764 - RNA, 22 nt, Human
cuucuuuuggggaugaaaaugg

SEQ ID NO: 152765 - RNA, 22 nt, Human
uggcgcgcagccugcuggugcu

SEQ ID NO: 152766 - RNA, 22 nt, Human
uuauuuaagaucuuaauauaua

SEQ ID NO: 152767 - RNA, 22 nt, Human
cuuuuuaaaguaaauggcuaga

SEQ ID NO: 152768 - RNA, 22 nt, Human
augcugugccuggaaagcggcu

SEQ ID NO: 152769 - RNA, 22 nt, Human
ugagaaaacaguuuguaauaau

SEQ ID NO: 152770 - RNA, 22 nt, Human
uuacuguguguaaaauaucuuu

SEQ ID NO: 152771 - RNA, 20 nt, Human
cauuccaugcaucuuggucc

SEQ ID NO: 152772 - RNA, 22 nt, Human
uggcaaggccacaggugcaguu

SEQ ID NO: 152773 - RNA, 22 nt, Human
auggagggguuguugcuugagu

SEQ ID NO: 152774 - RNA, 22 nt, Human
aaacauaugccuucuuuuguaa

SEQ ID NO: 152775 - RNA, 22 nt, Human
uucagguuuuuaaguucugccu

SEQ ID NO: 152776 - RNA, 22 nt, Human
aauauuuaccuaccugucaucu

SEQ ID NO: 152777 - RNA, 22 nt, Human
ggcuagggaucuagaccaggac

SEQ ID NO: 152778 - RNA, 22 nt, Human
uuaaaagaauccuguuauccuc

SEQ ID NO: 152779 - RNA, 22 nt, Human
acauuuuaccaucuguggauga

SEQ ID NO: 152780 - RNA, 22 nt, Human
cucugcuuguaucacauuugcu

SEQ ID NO: 152781 - RNA, 22 nt, Human
aauaauacaauuggugucaugu

SEQ ID NO: 152782 - RNA, 22 nt, Human
agaauuuguaucuacggugugc

SEQ ID NO: 152783 - RNA, 22 nt, Human
gccaguggucagugggagggug

SEQ ID NO: 152784 - RNA, 22 nt, Human
aaucacuuagaacccaggaagu

SEQ ID NO: 152785 - RNA, 22 nt, Human
aaauuaaaguuuuauuuagagc

SEQ ID NO: 152786 - RNA, 22 nt, Human
uacuuaaaacacauuuagcauu

SEQ ID NO: 152787 - RNA, 22 nt, Human
uagcauuucacugaucuucacu

SEQ ID NO: 152788 - RNA, 22 nt, Human
uucuauaagagaugaauacagu

SEQ ID NO: 152789 - RNA, 22 nt, Human
acuuuaaaucuguugcuuagcu

SEQ ID NO: 152790 - RNA, 22 nt, Human
ggaggaugaggguggugguguu

SEQ ID NO: 152791 - RNA, 22 nt, Human
uuuuuguaaaugaaguuuuauu

SEQ ID NO: 152792 - RNA, 22 nt, Human
auuucaacagaguuugaaggca

SEQ ID NO: 152793 - RNA, 22 nt, Human
uggggcuccuccuggcaggagg

SEQ ID NO: 152794 - RNA, 22 nt, Human
aggaaaauggaccagaguuguu

SEQ ID NO: 152795 - RNA, 22 nt, Human
auggugaugaugaugaugauaa

SEQ ID NO: 152796 - RNA, 22 nt, Human
cagaaaaaaaugcagacuagca

SEQ ID NO: 152797 - RNA, 18 nt, Human
uucaggcucuugcaugaa

SEQ ID NO: 152798 - RNA, 23 nt, Human
acgggaggcggggcagggcugag

SEQ ID NO: 152799 - RNA, 22 nt, Human
aggggauggagcuggaaggcag

SEQ ID NO: 152800 - RNA, 22 nt, Human
uccaugcaguagaggcgcuggg

SEQ ID NO: 152801 - RNA, 22 nt, Human
guaagaauauacccaggaguca

SEQ ID NO: 152802 - RNA, 22 nt, Human
ugcauguuuuaagugaagcuga

SEQ ID NO: 152803 - RNA, 23 nt, Human
ucagaccaaccucuugcuggaac

SEQ ID NO: 152804 - RNA, 22 nt, Human
caaagcuucaucuguuguuuug

SEQ ID NO: 152805 - RNA, 22 nt, Human
uuugcaggaaauguacugaaug

SEQ ID NO: 152806 - RNA, 22 nt, Human
ucugcagggcccuuggcuccug

SEQ ID NO: 152807 - RNA, 22 nt, Human
ugaauguggucaggaaauuguu

SEQ ID NO: 152808 - RNA, 22 nt, Human
aggaggcaaaugagagggcuca

SEQ ID NO: 152809 - RNA, 22 nt, Human
uggacacugguggauauggaau

SEQ ID NO: 152810 - RNA, 22 nt, Human
aggugcuugcauacugcuugac

SEQ ID NO: 152811 - RNA, 22 nt, Human
uuggaaaagaaauacucauaua

SEQ ID NO: 152812 - RNA, 22 nt, Human
auuaauaucaauauauuauaug

SEQ ID NO: 152813 - RNA, 22 nt, Human
gaugucccuggaggggacagga

SEQ ID NO: 152814 - RNA, 20 nt, Human
ggagagggaaaggcuguacu

SEQ ID NO: 152815 - RNA, 22 nt, Human
guugagaaucucuagcuuagga

SEQ ID NO: 152816 - RNA, 22 nt, Human
gccaggagaaaaggcgaaugau

SEQ ID NO: 152817 - RNA, 22 nt, Human
caaauuuuuauuuaccaucugc

SEQ ID NO: 152818 - RNA, 22 nt, Human
guuauuuugucuuguucaugaa

SEQ ID NO: 152819 - RNA, 22 nt, Human
gcucagagaaaacuggggcuug

SEQ ID NO: 152820 - RNA, 22 nt, Human
aggcaacagacaggcuugguuc

SEQ ID NO: 152821 - RNA, 18 nt, Human
uuccauuuuucagucuuc

SEQ ID NO: 152822 - RNA, 22 nt, Human
ucagcaggugcuuuguuuacuc

SEQ ID NO: 152823 - RNA, 22 nt, Human
guguugaugugucuguauucua

SEQ ID NO: 152824 - RNA, 22 nt, Human
gggucagggaggccccaccaug

SEQ ID NO: 152825 - RNA, 22 nt, Human
gaauuagguaauagaacuagua

SEQ ID NO: 152826 - RNA, 22 nt, Human
aaugauuuucugcaaacaguga

SEQ ID NO: 152827 - RNA, 22 nt, Human
aacgagcugggggggccggggg

SEQ ID NO: 152828 - RNA, 22 nt, Human
ucagggaggagaggcaggggga

SEQ ID NO: 152829 - RNA, 22 nt, Human
cauuuaucacuugcuaaacaua

SEQ ID NO: 152830 - RNA, 22 nt, Human
cggggcuggcguuagggaggca

SEQ ID NO: 152831 - RNA, 22 nt, Human
agagcuauuucuuaaaagcugu

SEQ ID NO: 152832 - RNA, 22 nt, Human
uuuuaauccucuugguaucuua

SEQ ID NO: 152833 - RNA, 22 nt, Human
uucuguuuauaauuugcaguug

SEQ ID NO: 152834 - RNA, 22 nt, Human
ugaggaagugguuguaugguuu

SEQ ID NO: 152835 - RNA, 22 nt, Human
aggccccacaaacucgccuuug

SEQ ID NO: 152836 - RNA, 22 nt, Human
ucgcccagguuggagugcagug

SEQ ID NO: 152837 - RNA, 22 nt, Human
cugggacacguugugcuuuaac

SEQ ID NO: 152838 - RNA, 22 nt, Human
cuccugcuuuuucuucuuccga

SEQ ID NO: 152839 - RNA, 22 nt, Human
gccugcagccagggaguucucu

SEQ ID NO: 152840 - RNA, 22 nt, Human
gcucucuggccugggaggagga

SEQ ID NO: 152841 - RNA, 22 nt, Human
ugaauucaaacuuuuuaacaag

SEQ ID NO: 152842 - RNA, 22 nt, Human
aaucccaguccuccugggggau

SEQ ID NO: 152843 - RNA, 20 nt, Human
ugcugugugucuacuguggg

SEQ ID NO: 152844 - RNA, 22 nt, Human
ugaggcaguucuuacuuguauu

SEQ ID NO: 152845 - RNA, 19 nt, Human
uccaaaauacuuguuacug

SEQ ID NO: 152846 - RNA, 22 nt, Human
gaggaaaauggaguguaauuaa

SEQ ID NO: 152847 - RNA, 22 nt, Human
uucuucuucuuccucauccuca

SEQ ID NO: 152848 - RNA, 22 nt, Human
guuuuguucaugaacauugggu

SEQ ID NO: 152849 - RNA, 22 nt, Human
caguacugucuuccugauggca

SEQ ID NO: 152850 - RNA, 22 nt, Human
ugcuuggauuuccaaaugguuu

SEQ ID NO: 152851 - RNA, 22 nt, Human
ugcagacuguuucuugacugaa

SEQ ID NO: 152852 - RNA, 22 nt, Human
gaagcccuggaggggcuggagg

SEQ ID NO: 152853 - RNA, 22 nt, Human
cuucauuucaggcugaagaaua

SEQ ID NO: 152854 - RNA, 22 nt, Human
cuuaggaaauccuguacucccc

SEQ ID NO: 152855 - RNA, 20 nt, Human
gagaaugucauuccuuuuuu

SEQ ID NO: 152856 - RNA, 22 nt, Human
uaaagugaaguucagaauggcu

SEQ ID NO: 152857 - RNA, 22 nt, Human
uaaaaugcucagauaaauauau

SEQ ID NO: 152858 - RNA, 22 nt, Human
cugcugugcagacagacucucu

SEQ ID NO: 152859 - RNA, 22 nt, Human
gaaaacccuguauguagcguuu

SEQ ID NO: 152860 - RNA, 22 nt, Human
aaauauauauaauauauauauu

SEQ ID NO: 152861 - RNA, 22 nt, Human
ugcauaagguuaaauuagcaga

SEQ ID NO: 152862 - RNA, 22 nt, Human
aauguacucgaaugauguuaag

SEQ ID NO: 152863 - RNA, 22 nt, Human
cuguuuuugccugugacaaaaa

SEQ ID NO: 152864 - RNA, 22 nt, Human
ucuguuucaggggucuggaaug

SEQ ID NO: 152865 - RNA, 22 nt, Human
guccccugcguguucauccugg

SEQ ID NO: 152866 - RNA, 22 nt, Human
caagggcagaggcagggccccg

SEQ ID NO: 152867 - RNA, 22 nt, Human
uaauuuugucacagugacaugc

SEQ ID NO: 152868 - RNA, 22 nt, Human
ccuuuuuagaugugcgaauguu

SEQ ID NO: 152869 - RNA, 22 nt, Human
ugagguuacauuaggaauaacc

SEQ ID NO: 152870 - RNA, 22 nt, Human
uucacuguucuuagagaagacc

SEQ ID NO: 152871 - RNA, 22 nt, Human
gcuguggacacagcucucuuca

SEQ ID NO: 152872 - RNA, 23 nt, Human
agggcacugaagcuggaauuggg

SEQ ID NO: 152873 - RNA, 21 nt, Human
uugauuuagcagaucuagcug

SEQ ID NO: 152874 - RNA, 20 nt, Human
aaccuauuguaauauucuaa

SEQ ID NO: 152875 - RNA, 22 nt, Human
gagacugugucugucaagcuag

SEQ ID NO: 152876 - RNA, 20 nt, Human
caugaugcaaacaguaacgu

SEQ ID NO: 152877 - RNA, 22 nt, Human
aaacgcaauuucuugcauguca

SEQ ID NO: 152878 - RNA, 22 nt, Human
gcagggcucuggagucaggcug

SEQ ID NO: 152879 - RNA, 20 nt, Human
gcauggcuggcugcugucug

SEQ ID NO: 152880 - RNA, 22 nt, Human
ggaggagggaguucaggaguau

SEQ ID NO: 152881 - RNA, 22 nt, Human
cuaaaaauguucuaguaguuca

SEQ ID NO: 152882 - RNA, 22 nt, Human
agauauuauuuucuauuuauca

SEQ ID NO: 152883 - RNA, 22 nt, Human
guuuaaaagcaaccaacaggcu

SEQ ID NO: 152884 - RNA, 22 nt, Human
cuggguuuggcugugcuugaau

SEQ ID NO: 152885 - RNA, 22 nt, Human
ggggagggcugagcacgguuga

SEQ ID NO: 152886 - RNA, 22 nt, Human
ugguucuagaugagaugaugag

SEQ ID NO: 152887 - RNA, 22 nt, Human
uuuuuaagguuuguuuauauau

SEQ ID NO: 152888 - RNA, 22 nt, Human
uggaagugggcaucaccaucca

SEQ ID NO: 152889 - RNA, 23 nt, Human
aaguggugacugugcuacugaga

SEQ ID NO: 152890 - RNA, 22 nt, Human
aggauggauagcaaggaagccg

SEQ ID NO: 152891 - RNA, 22 nt, Human
uuugauuaccuggggcccucug

SEQ ID NO: 152892 - RNA, 22 nt, Human
cucccaucacaauucagggccu

SEQ ID NO: 152893 - RNA, 22 nt, Human
ucccuugacauuacuugggagg

SEQ ID NO: 152894 - RNA, 20 nt, Human
caacacugcccauuguuugc

SEQ ID NO: 152895 - RNA, 22 nt, Human
uucaauuacaucagaaucuaaa

SEQ ID NO: 152896 - RNA, 22 nt, Human
uuuuaaaagguugcuguuauaa

SEQ ID NO: 152897 - RNA, 22 nt, Human
guccuguguaaguacuugcuca

SEQ ID NO: 152898 - RNA, 22 nt, Human
gcauccaaggagcagaagugau

SEQ ID NO: 152899 - RNA, 22 nt, Human
aaggcuguuugagcacuggagc

SEQ ID NO: 152900 - RNA, 22 nt, Human
cagaaaacauuguguguauaag

SEQ ID NO: 152901 - RNA, 22 nt, Human
gugucacuuucaggagcucuaa

SEQ ID NO: 152902 - RNA, 22 nt, Human
aaauguuugguggauaaaagga

SEQ ID NO: 152903 - RNA, 22 nt, Human
uuuuccuucuuccugccuugcc

SEQ ID NO: 152904 - RNA, 22 nt, Human
uuaaaauuguuaacuuugguga

SEQ ID NO: 152905 - RNA, 22 nt, Human
acugcauuaucaccaagaugua

SEQ ID NO: 152906 - RNA, 22 nt, Human
auaaauucuaugauggauuggg

SEQ ID NO: 152907 - RNA, 22 nt, Human
cagcacugcccuaccccuccac

SEQ ID NO: 152908 - RNA, 22 nt, Human
uggggcauacgugaaauaauuu

SEQ ID NO: 152909 - RNA, 22 nt, Human
uccaggagucagacagauggug

SEQ ID NO: 152910 - RNA, 22 nt, Human
gaggggaacaggcauucuuaag

SEQ ID NO: 152911 - RNA, 23 nt, Human
guuauugcuggugcuggccagcc

SEQ ID NO: 152912 - RNA, 18 nt, Human
uucucucuggauaguagu

SEQ ID NO: 152913 - RNA, 22 nt, Human
gcugcgcugggacgccaccaac

SEQ ID NO: 152914 - RNA, 22 nt, Human
guuuacaacaucuuguccuuca

SEQ ID NO: 152915 - RNA, 22 nt, Human
gcacugagacuuuagauuggag

SEQ ID NO: 152916 - RNA, 22 nt, Human
agguuaggaggggagugccaca

SEQ ID NO: 152917 - RNA, 22 nt, Human
aacucugcaaugaaaucauguu

SEQ ID NO: 152918 - RNA, 22 nt, Human
uucacauucauuucuuauguuu

SEQ ID NO: 152919 - RNA, 21 nt, Human
ucagccuguccaguguuaacc

SEQ ID NO: 152920 - RNA, 22 nt, Human
aacugcauaagcuucgggaccu

SEQ ID NO: 152921 - RNA, 22 nt, Human
ugugucuuuggcgaugucugga

SEQ ID NO: 152922 - RNA, 22 nt, Human
uuuaaugucuuggaaaaagacu

SEQ ID NO: 152923 - RNA, 22 nt, Human
uuuagguuguguucuggcaugu

SEQ ID NO: 152924 - RNA, 22 nt, Human
gggagggggauucuggcgagaa

SEQ ID NO: 152925 - RNA, 22 nt, Human
uuuuuuuuacuccggacagcuc

SEQ ID NO: 152926 - RNA, 22 nt, Human
gagcagcugagcuggaaugaga

SEQ ID NO: 152927 - RNA, 22 nt, Human
aucauuugaacagaauuuguuu

SEQ ID NO: 152928 - RNA, 20 nt, Human
aggggcuguaguuagaugac

SEQ ID NO: 152929 - RNA, 22 nt, Human
aagagaggcccaaguggcuggc

SEQ ID NO: 152930 - RNA, 22 nt, Human
uauuuuuuuaacauuuauugua

SEQ ID NO: 152931 - RNA, 22 nt, Human
ggagggaggggugggagaugga

SEQ ID NO: 152932 - RNA, 22 nt, Human
gcucagcuggagagggacgggu

SEQ ID NO: 152933 - RNA, 22 nt, Human
uuuuugggccaaauauauuuac

SEQ ID NO: 152934 - RNA, 22 nt, Human
uuuuuucuucucuaucuuaaua

SEQ ID NO: 152935 - RNA, 22 nt, Human
aauagaguccuguacugaauga

SEQ ID NO: 152936 - RNA, 22 nt, Human
cagagcagaaaccugggugauu

SEQ ID NO: 152937 - RNA, 22 nt, Human
auuuuuucaugugugguugaga

SEQ ID NO: 152938 - RNA, 22 nt, Human
agugaagauagagccaggucug

SEQ ID NO: 152939 - RNA, 22 nt, Human
ggcuucuuaacauuuggacacc

SEQ ID NO: 152940 - RNA, 22 nt, Human
agcaggaggguuuuguagaguc

SEQ ID NO: 152941 - RNA, 22 nt, Human
uguauauguguguagcauguua

SEQ ID NO: 152942 - RNA, 22 nt, Human
aguauuuuaaaauacauuaucc

SEQ ID NO: 152943 - RNA, 22 nt, Human
agccagcauauauauaguugaa

SEQ ID NO: 152944 - RNA, 22 nt, Human
aggauagacuucagaaggcaua

SEQ ID NO: 152945 - RNA, 22 nt, Human
auuuuauuuugggaucuuuuua

SEQ ID NO: 152946 - RNA, 22 nt, Human
ggcuagggagacagagggcaug

SEQ ID NO: 152947 - RNA, 22 nt, Human
cuccaugagccaggagggcuac

SEQ ID NO: 152948 - RNA, 22 nt, Human
uugaguuuacauuguauuagcc

SEQ ID NO: 152949 - RNA, 22 nt, Human
cuagcacagugcuuggcacaca

SEQ ID NO: 152950 - RNA, 20 nt, Human
aauaaauauaacccauaauu

SEQ ID NO: 152951 - RNA, 22 nt, Human
ccucccuucccggcauggcucu

SEQ ID NO: 152952 - RNA, 22 nt, Human
agagggagagauuggcaaucag

SEQ ID NO: 152953 - RNA, 22 nt, Human
uuauaucagaaggugagauuga

SEQ ID NO: 152954 - RNA, 22 nt, Human
ugggcagggagcuggaaccaca

SEQ ID NO: 152955 - RNA, 22 nt, Human
cagagagcguccauccggugcc

SEQ ID NO: 152956 - RNA, 22 nt, Human
caaaaauacuugccuguaucug

SEQ ID NO: 152957 - RNA, 22 nt, Human
aucuucaaggacgccaagaucc

SEQ ID NO: 152958 - RNA, 22 nt, Human
ggcugggaggcggaggcugaga

SEQ ID NO: 152959 - RNA, 22 nt, Human
uauuaauugugguuauuguauu

SEQ ID NO: 152960 - RNA, 18 nt, Human
uuuaauaagccuguuaug

SEQ ID NO: 152961 - RNA, 22 nt, Human
cagacagaguuguuucuucucc

SEQ ID NO: 152962 - RNA, 22 nt, Human
cuuauucuucuggacuuggagu

SEQ ID NO: 152963 - RNA, 22 nt, Human
agcuuucuauauaugaguugcu

SEQ ID NO: 152964 - RNA, 22 nt, Human
uuuaacauaugaaagaauauuu

SEQ ID NO: 152965 - RNA, 22 nt, Human
uucuugucuuuguuauguagga

SEQ ID NO: 152966 - RNA, 18 nt, Human
ggcugggcugugccccuu

SEQ ID NO: 152967 - RNA, 22 nt, Human
uauuuuuacuguuugaugauuc

SEQ ID NO: 152968 - RNA, 22 nt, Human
ugaguuucuuacucaggagcug

SEQ ID NO: 152969 - RNA, 19 nt, Human
ggaacgcugggcuccccuc

SEQ ID NO: 152970 - RNA, 21 nt, Human
uaauaauugggggcagggugg

SEQ ID NO: 152971 - RNA, 19 nt, Human
agagucuccacuccacuug

SEQ ID NO: 152972 - RNA, 22 nt, Human
aagaggaggacgguucccagaa

SEQ ID NO: 152973 - RNA, 22 nt, Human
uauuuuaaaagcauuaauucuu

SEQ ID NO: 152974 - RNA, 22 nt, Human
uauauaauacacaaauauguac

SEQ ID NO: 152975 - RNA, 22 nt, Human
uggcagcauuuuuuccagaaca

SEQ ID NO: 152976 - RNA, 22 nt, Human
gagaacuguguauucuuuuuca

SEQ ID NO: 152977 - RNA, 22 nt, Human
uagggaggguuugggguggagg

SEQ ID NO: 152978 - RNA, 22 nt, Human
ugaagacaguuuuacucaugag

SEQ ID NO: 152979 - RNA, 22 nt, Human
ucccauauuauggggaaaaacu

SEQ ID NO: 152980 - RNA, 22 nt, Human
agggggaauccugcuuauggau

SEQ ID NO: 152981 - RNA, 22 nt, Human
aaauauauccuucuguccugcc

SEQ ID NO: 152982 - RNA, 22 nt, Human
auuuucuugucucuguuguagg

SEQ ID NO: 152983 - RNA, 22 nt, Human
ggcagucuuucccuugagcucu

SEQ ID NO: 152984 - RNA, 22 nt, Human
uaacaguauacuacaucauauu

SEQ ID NO: 152985 - RNA, 22 nt, Human
uguaucuguguguauguguuua

SEQ ID NO: 152986 - RNA, 22 nt, Human
uugcaucagcaggcauaauugg

SEQ ID NO: 152987 - RNA, 22 nt, Human
ugcaugaucucacuuacaggug

SEQ ID NO: 152988 - RNA, 22 nt, Human
uauuucuagggcaugaaaauaa

SEQ ID NO: 152989 - RNA, 22 nt, Human
ucccuguggauuaaggagaugu

SEQ ID NO: 152990 - RNA, 22 nt, Human
uggaaggugauucucugguuaa

SEQ ID NO: 152991 - RNA, 22 nt, Human
ccagggagggccacagggccau

SEQ ID NO: 152992 - RNA, 22 nt, Human
cagcuggggagagacauggcag

SEQ ID NO: 152993 - RNA, 22 nt, Human
gugccugcucauucucaauauu

SEQ ID NO: 152994 - RNA, 22 nt, Human
uuuguuuuggugucaugcguga

SEQ ID NO: 152995 - RNA, 22 nt, Human
auuuuguugaaacccuuguugu

SEQ ID NO: 152996 - RNA, 22 nt, Human
acauauggcagguugaucaaug

SEQ ID NO: 152997 - RNA, 22 nt, Human
ucaccauguuuucauaggaaca

SEQ ID NO: 152998 - RNA, 22 nt, Human
uucuagcucauggugacagauc

SEQ ID NO: 152999 - RNA, 22 nt, Human
uuauuaauacaugcaccugcau

SEQ ID NO: 153000 - RNA, 22 nt, Human
agcgcucauuuuccuccugcuc

SEQ ID NO: 153001 - RNA, 22 nt, Human
gugcucaagacauuaggaauau

SEQ ID NO: 153002 - RNA, 22 nt, Human
agcagcugagccccagcuguga

SEQ ID NO: 153003 - RNA, 22 nt, Human
gaaugcacacgugugugcaugc

SEQ ID NO: 153004 - RNA, 22 nt, Human
cauauacauauacaugcauaca

SEQ ID NO: 153005 - RNA, 22 nt, Human
ugcuuaaccagccccuucccuu

SEQ ID NO: 153006 - RNA, 22 nt, Human
aaauucuuccaggaggaaauac

SEQ ID NO: 153007 - RNA, 22 nt, Human
gugaaaaauggccaucaggaca

SEQ ID NO: 153008 - RNA, 22 nt, Human
gaggaggagaagcggcggcgga

SEQ ID NO: 153009 - RNA, 18 nt, Human
ucagaggagauaccuaaa

SEQ ID NO: 153010 - RNA, 22 nt, Human
ggcagggagagcaugcugauaa

SEQ ID NO: 153011 - RNA, 22 nt, Human
aggggaggcugggcuggggggc

SEQ ID NO: 153012 - RNA, 22 nt, Human
agggcucacuacaacccuggga

SEQ ID NO: 153013 - RNA, 22 nt, Human
gugcugggaggcccaggaugga

SEQ ID NO: 153014 - RNA, 22 nt, Human
uugaagccaccacuguaaguca

SEQ ID NO: 153015 - RNA, 22 nt, Human
ucccugcugggcgaucuucucu

SEQ ID NO: 153016 - RNA, 22 nt, Human
cuguuaauugugaauuuuacau

SEQ ID NO: 153017 - RNA, 22 nt, Human
augugugugcgagcgugugugu

SEQ ID NO: 153018 - RNA, 23 nt, Human
gccaaacugcccguucucucugc

SEQ ID NO: 153019 - RNA, 22 nt, Human
uuucaugauuaacuuagugaau

SEQ ID NO: 153020 - RNA, 22 nt, Human
aggcagagaggucuuccuggaa

SEQ ID NO: 153021 - RNA, 23 nt, Human
uguaaaacaccguuauugcaccu

SEQ ID NO: 153022 - RNA, 19 nt, Human
ucaggaggucgaccuggca

SEQ ID NO: 153023 - RNA, 22 nt, Human
uugcacgucacccuucccaccu

SEQ ID NO: 153024 - RNA, 20 nt, Human
uggcccagcacgacgaggac

SEQ ID NO: 153025 - RNA, 22 nt, Human
ucuauuguuauccuuuccauuu

SEQ ID NO: 153026 - RNA, 22 nt, Human
aaucaaauuucuugugguuguu

SEQ ID NO: 153027 - RNA, 22 nt, Human
gaaaaagucuuaaaguaaggca

SEQ ID NO: 153028 - RNA, 18 nt, Human
uguugguguucacucacu

SEQ ID NO: 153029 - RNA, 17 nt, Human
uuagagcuacauguuga

SEQ ID NO: 153030 - RNA, 22 nt, Human
guuuugaugugauuucucaugu

SEQ ID NO: 153031 - RNA, 22 nt, Human
gccugggguuugcggggcugca

SEQ ID NO: 153032 - RNA, 22 nt, Human
aagaggaauaauaaaaauugca

SEQ ID NO: 153033 - RNA, 22 nt, Human
gagaggugaagcuaauuaauuu

SEQ ID NO: 153034 - RNA, 22 nt, Human
ucagucacugucucagacagga

SEQ ID NO: 153035 - RNA, 22 nt, Human
uacauuugauuuuugcuucuuu

SEQ ID NO: 153036 - RNA, 22 nt, Human
uuucuauuuacagugcuaggua

SEQ ID NO: 153037 - RNA, 22 nt, Human
acuuagaacagccuaugggaag

SEQ ID NO: 153038 - RNA, 22 nt, Human
aauacagcacucacaccucccu

SEQ ID NO: 153039 - RNA, 22 nt, Human
augccugcugucaggaacucuu

SEQ ID NO: 153040 - RNA, 22 nt, Human
uuucugagccacauauaauuug

SEQ ID NO: 153041 - RNA, 22 nt, Human
aagacagaaaagcagagagagg

SEQ ID NO: 153042 - RNA, 22 nt, Human
aaacccauauaccagcugugcu

SEQ ID NO: 153043 - RNA, 21 nt, Human
ucauccagguccugcuucuuc

SEQ ID NO: 153044 - RNA, 22 nt, Human
auuauaauucauuaggcuuagu

SEQ ID NO: 153045 - RNA, 19 nt, Human
ugccccacccucuauccag

SEQ ID NO: 153046 - RNA, 22 nt, Human
acauuccugaagguaaugagaa

SEQ ID NO: 153047 - RNA, 22 nt, Human
ggaaauauaagcaguuugugug

SEQ ID NO: 153048 - RNA, 22 nt, Human
ugcuuguuuuguggcuucagcu

SEQ ID NO: 153049 - RNA, 22 nt, Human
ugagauguaauguaguacuuug

SEQ ID NO: 153050 - RNA, 22 nt, Human
uggguucaaauccugguuccac

SEQ ID NO: 153051 - RNA, 22 nt, Human
auauauguauauacacauauau

SEQ ID NO: 153052 - RNA, 22 nt, Human
auuuccagcagcauauuugucu

SEQ ID NO: 153053 - RNA, 22 nt, Human
gagagaggggaagagaagcucu

SEQ ID NO: 153054 - RNA, 22 nt, Human
guaaauaucucacgaaugauuc

SEQ ID NO: 153055 - RNA, 22 nt, Human
agauggaggaaagcaguuagaa

SEQ ID NO: 153056 - RNA, 22 nt, Human
uaauauaacugccaguuaaggu

SEQ ID NO: 153057 - RNA, 23 nt, Human
gugagaccagagccuauucucag

SEQ ID NO: 153058 - RNA, 22 nt, Human
aaucaauuauccauuuguuagu

SEQ ID NO: 153059 - RNA, 22 nt, Human
cacuauguacauaauagcugcu

SEQ ID NO: 153060 - RNA, 22 nt, Human
ugcaaggcacccacucugcuuu

SEQ ID NO: 153061 - RNA, 22 nt, Human
aagacacuuucuaaauagaagu

SEQ ID NO: 153062 - RNA, 22 nt, Human
uggaguuuuaaucuguacagaa

SEQ ID NO: 153063 - RNA, 22 nt, Human
agaggggaaggaugugauguga

SEQ ID NO: 153064 - RNA, 22 nt, Human
acuaaguagaggagugaugauu

SEQ ID NO: 153065 - RNA, 22 nt, Human
gcuguugugaggaucagcauau

SEQ ID NO: 153066 - RNA, 22 nt, Human
uuauauuuuauuuaauuaaaua

SEQ ID NO: 153067 - RNA, 22 nt, Human
gggaaaaaggaaccuuauuacu

SEQ ID NO: 153068 - RNA, 22 nt, Human
auguuugugauugcugaaaaga

SEQ ID NO: 153069 - RNA, 22 nt, Human
ggaaggggagcuggaaagggua

SEQ ID NO: 153070 - RNA, 22 nt, Human
uccugagaagcacuuaauacac

SEQ ID NO: 153071 - RNA, 22 nt, Human
ugguccaccgccucauucucug

SEQ ID NO: 153072 - RNA, 22 nt, Human
gaauggcagaaugaagcagugu

SEQ ID NO: 153073 - RNA, 18 nt, Human
gacaaaaguacagacaga

SEQ ID NO: 153074 - RNA, 22 nt, Human
uuuuaaaacaugucaaaaugug

SEQ ID NO: 153075 - RNA, 22 nt, Human
augcccagaacccccuggaugg

SEQ ID NO: 153076 - RNA, 22 nt, Human
ggcaaggaagaaagcagaaguu

SEQ ID NO: 153077 - RNA, 22 nt, Human
acuuuauacuagugauaguuug

SEQ ID NO: 153078 - RNA, 22 nt, Human
agaguacagaagcauuucagau

SEQ ID NO: 153079 - RNA, 22 nt, Human
agauaacauguugcagauucug

SEQ ID NO: 153080 - RNA, 22 nt, Human
aagcucugggacugaggcuccu

SEQ ID NO: 153081 - RNA, 22 nt, Human
uccuuuauuuaugggcagugua

SEQ ID NO: 153082 - RNA, 22 nt, Human
uuuggcugucauuugaaaaugu

SEQ ID NO: 153083 - RNA, 19 nt, Human
agggaggcaagagaaaugu

SEQ ID NO: 153084 - RNA, 23 nt, Human
uccuccccaccuuuguccccucc

SEQ ID NO: 153085 - RNA, 22 nt, Human
uaauauauuuuuuaagggaugu

SEQ ID NO: 153086 - RNA, 22 nt, Human
auagaaauagacaaugcaaaga

SEQ ID NO: 153087 - RNA, 23 nt, Human
uccugcagauaagcugguugaca

SEQ ID NO: 153088 - RNA, 22 nt, Human
cucucugcugucuuucgggaaa

SEQ ID NO: 153089 - RNA, 22 nt, Human
auacauauaugcacauuaauau

SEQ ID NO: 153090 - RNA, 22 nt, Human
auaguaaauguuaacagcaaca

SEQ ID NO: 153091 - RNA, 22 nt, Human
aggacacuuccugaguggacaa

SEQ ID NO: 153092 - RNA, 21 nt, Human
uuccauggacccugucagugu

SEQ ID NO: 153093 - RNA, 22 nt, Human
ucauacuuuuuugacccuugug

SEQ ID NO: 153094 - RNA, 22 nt, Human
cggcugcagcggagcaggcugg

SEQ ID NO: 153095 - RNA, 22 nt, Human
cuccccuuauuccucaacauga

SEQ ID NO: 153096 - RNA, 22 nt, Human
acucugcaguaaggaauuguuu

SEQ ID NO: 153097 - RNA, 22 nt, Human
auuaugaauuguguuacgaaga

SEQ ID NO: 153098 - RNA, 22 nt, Human
ggcaagcacugggugucuuagc

SEQ ID NO: 153099 - RNA, 22 nt, Human
cucaucagagcccuccucuggc

SEQ ID NO: 153100 - RNA, 22 nt, Human
uggaagcccagaaggaagcaga

SEQ ID NO: 153101 - RNA, 22 nt, Human
guucuucagcccucagguccua

SEQ ID NO: 153102 - RNA, 22 nt, Human
uuauuucaggcauuuguaaaug

SEQ ID NO: 153103 - RNA, 22 nt, Human
aggggagggcuggccuuuggau

SEQ ID NO: 153104 - RNA, 22 nt, Human
ccagaugggggcugugggaggg

SEQ ID NO: 153105 - RNA, 22 nt, Human
guacugguuuucuuacucuggc

SEQ ID NO: 153106 - RNA, 22 nt, Human
auauucaaugaggucauauaag

SEQ ID NO: 153107 - RNA, 22 nt, Human
ugcauguuucuguauguuaaug

SEQ ID NO: 153108 - RNA, 22 nt, Human
auuuuuuuuccugucucuuuca

SEQ ID NO: 153109 - RNA, 22 nt, Human
cauuuuccucugcugguguuca

SEQ ID NO: 153110 - RNA, 22 nt, Human
auguuuucuugucuggagaagu

SEQ ID NO: 153111 - RNA, 22 nt, Human
ugagagggagacagcucuagca

SEQ ID NO: 153112 - RNA, 22 nt, Human
agcaaggguugguuuucugaca

SEQ ID NO: 153113 - RNA, 22 nt, Human
ggaggaggggcggggaggggag

SEQ ID NO: 153114 - RNA, 22 nt, Human
ugaguucugacugagcaugggg

SEQ ID NO: 153115 - RNA, 22 nt, Human
ucucucugcuguccagcguuau

SEQ ID NO: 153116 - RNA, 22 nt, Human
uguguuguuuggggauguccau

SEQ ID NO: 153117 - RNA, 22 nt, Human
aucaaaauuuucagauacuaca

SEQ ID NO: 153118 - RNA, 22 nt, Human
ugcuuuuguaucagaguauuca

SEQ ID NO: 153119 - RNA, 22 nt, Human
uaaaugcucuuuaaaagugcuu

SEQ ID NO: 153120 - RNA, 22 nt, Human
aaaucauagccaugaacauuug

SEQ ID NO: 153121 - RNA, 22 nt, Human
gaaggagaggauugugaggcug

SEQ ID NO: 153122 - RNA, 19 nt, Human
auucuucucuuccugcugu

SEQ ID NO: 153123 - RNA, 22 nt, Human
ugccuaguuuaaaucauuuucu

SEQ ID NO: 153124 - RNA, 22 nt, Human
ugcugccucccaucccucccga

SEQ ID NO: 153125 - RNA, 22 nt, Human
ggaggucagcuggaggggaggc

SEQ ID NO: 153126 - RNA, 22 nt, Human
cuucauaagauuguugugagga

SEQ ID NO: 153127 - RNA, 22 nt, Human
uuuuuuaaucaaguaggaaaca

SEQ ID NO: 153128 - RNA, 22 nt, Human
uaauugaacguucauuuuuaau

SEQ ID NO: 153129 - RNA, 22 nt, Human
augugaaauuugggcucuggga

SEQ ID NO: 153130 - RNA, 22 nt, Human
uucugaguguugucaccaugug

SEQ ID NO: 153131 - RNA, 22 nt, Human
ucaccaugcccuucucugcucu

SEQ ID NO: 153132 - RNA, 19 nt, Human
gauauugagcugagaauuc

SEQ ID NO: 153133 - RNA, 22 nt, Human
gggagccucccacugggggaag

SEQ ID NO: 153134 - RNA, 20 nt, Human
uucucugcagcaggcggccc

SEQ ID NO: 153135 - RNA, 19 nt, Human
caggucuucuuggaggacu

SEQ ID NO: 153136 - RNA, 22 nt, Human
aaauauuugaaugguguaagau

SEQ ID NO: 153137 - RNA, 22 nt, Human
gcacucugggucaucugcugcc

SEQ ID NO: 153138 - RNA, 22 nt, Human
aagugugugugcgcaugugcau

SEQ ID NO: 153139 - RNA, 22 nt, Human
uuuucugauccuucuaacuuga

SEQ ID NO: 153140 - RNA, 19 nt, Human
uccaccgcgugcaccucua

SEQ ID NO: 153141 - RNA, 22 nt, Human
gauuaaaggucuugauuauaag

SEQ ID NO: 153142 - RNA, 22 nt, Human
uuuuagagacagcauggagaaa

SEQ ID NO: 153143 - RNA, 22 nt, Human
uugguuuacucuggggauaucu

SEQ ID NO: 153144 - RNA, 22 nt, Human
uucacaauuuuaaaaaguggaa

SEQ ID NO: 153145 - RNA, 22 nt, Human
gaggaggagacggaggccuggg

SEQ ID NO: 153146 - RNA, 23 nt, Human
cuuauauaaucauuagaaaccau

SEQ ID NO: 153147 - RNA, 22 nt, Human
auuugcauguuuauuucuuaga

SEQ ID NO: 153148 - RNA, 22 nt, Human
guugguggaggcgagagaagaa

SEQ ID NO: 153149 - RNA, 22 nt, Human
ggagagcuagugagcuggaggu

SEQ ID NO: 153150 - RNA, 22 nt, Human
agaugaugugugucuucagcua

SEQ ID NO: 153151 - RNA, 22 nt, Human
ggaugaguuguauauaggauuc

SEQ ID NO: 153152 - RNA, 22 nt, Human
caaaaaauccauagaaagaggu

SEQ ID NO: 153153 - RNA, 22 nt, Human
aagcucuuuccacuaaaccacu

SEQ ID NO: 153154 - RNA, 22 nt, Human
ugcauugccucuauucauuaua

SEQ ID NO: 153155 - RNA, 22 nt, Human
aaauguauuagccuaugugaga

SEQ ID NO: 153156 - RNA, 22 nt, Human
aguggagguuacagcuguacau

SEQ ID NO: 153157 - RNA, 22 nt, Human
auggucugcucagucucuugac

SEQ ID NO: 153158 - RNA, 22 nt, Human
ggcugugaaguacguugaaggu

SEQ ID NO: 153159 - RNA, 22 nt, Human
uauuuuuaccuaauuuaugaga

SEQ ID NO: 153160 - RNA, 22 nt, Human
caguagcuuuuugcagacaaga

SEQ ID NO: 153161 - RNA, 22 nt, Human
uccuucagaggacggcagccag

SEQ ID NO: 153162 - RNA, 22 nt, Human
auauuugucuguuuuaguggca

SEQ ID NO: 153163 - RNA, 20 nt, Human
uaguggaccuugaaggccuc

SEQ ID NO: 153164 - RNA, 22 nt, Human
ugagaccuaaaccgucuguccu

SEQ ID NO: 153165 - RNA, 22 nt, Human
gugguggggaguuggauggaag

SEQ ID NO: 153166 - RNA, 22 nt, Human
aaaauauucuauaucaaagaua

SEQ ID NO: 153167 - RNA, 19 nt, Human
uagaggagaauggcaaaga

SEQ ID NO: 153168 - RNA, 22 nt, Human
ggcucccccauggcugacagac

SEQ ID NO: 153169 - RNA, 22 nt, Human
gugcccaguugaggccaggacu

SEQ ID NO: 153170 - RNA, 22 nt, Human
ucacuucuaugaucugucucuu

SEQ ID NO: 153171 - RNA, 22 nt, Human
uagacugugagcuccuugaggg

SEQ ID NO: 153172 - RNA, 22 nt, Human
acucauucgccuugcccaaggc

SEQ ID NO: 153173 - RNA, 22 nt, Human
gaggagagaaauguuuucugug

SEQ ID NO: 153174 - RNA, 23 nt, Human
cagagaaaauagaauaugcugug

SEQ ID NO: 153175 - RNA, 22 nt, Human
aaauuuauaacuuaaagugaau

SEQ ID NO: 153176 - RNA, 22 nt, Human
cuucauccguaccacggccaca

SEQ ID NO: 153177 - RNA, 22 nt, Human
uggaggcccagcugggggccgg

SEQ ID NO: 153178 - RNA, 22 nt, Human
uuugauuuuguuuauagugccg

SEQ ID NO: 153179 - RNA, 22 nt, Human
uggagucuugcuuugggagugc

SEQ ID NO: 153180 - RNA, 22 nt, Human
uguugaagcaccucugucuuuc

SEQ ID NO: 153181 - RNA, 23 nt, Human
aaugugaaauugaguuuuuguua

SEQ ID NO: 153182 - RNA, 22 nt, Human
ugucccaucacagaggagacua

SEQ ID NO: 153183 - RNA, 22 nt, Human
cagaaacacuguauuuagggaa

SEQ ID NO: 153184 - RNA, 22 nt, Human
auauuauuaaaauagauggaua

SEQ ID NO: 153185 - RNA, 22 nt, Human
auucuccucaaaacaucugcug

SEQ ID NO: 153186 - RNA, 19 nt, Human
auacacguguauacauaca

SEQ ID NO: 153187 - RNA, 22 nt, Human
cuucuucaucuuuuggaggaac

SEQ ID NO: 153188 - RNA, 19 nt, Human
agauggcaaaaugcaaaga

SEQ ID NO: 153189 - RNA, 22 nt, Human
aggaaauaggaccagacaaagc

SEQ ID NO: 153190 - RNA, 22 nt, Human
ugcaggaacucgaaaacuauag

SEQ ID NO: 153191 - RNA, 22 nt, Human
auccuagacuccuaugccccaa

SEQ ID NO: 153192 - RNA, 22 nt, Human
aaaucuuucacauauuuuuuau

SEQ ID NO: 153193 - RNA, 22 nt, Human
ggcagggacugggauauggaga

SEQ ID NO: 153194 - RNA, 22 nt, Human
uuuguauuguuuauuucauuuu

SEQ ID NO: 153195 - RNA, 22 nt, Human
cugggaguugacgaggcuugua

SEQ ID NO: 153196 - RNA, 22 nt, Human
agggcaguuuuacugaaaggug

SEQ ID NO: 153197 - RNA, 22 nt, Human
uaacauuagcuuugcucaugca

SEQ ID NO: 153198 - RNA, 22 nt, Human
guuuugugugugugcccacacg

SEQ ID NO: 153199 - RNA, 22 nt, Human
aguugugagaaugaacacugaa

SEQ ID NO: 153200 - RNA, 22 nt, Human
uuaucaaaaaauaguacuuuga

SEQ ID NO: 153201 - RNA, 22 nt, Human
aaaaaaacuaauuuuaaaugug

SEQ ID NO: 153202 - RNA, 22 nt, Human
aagaacaacugcuuuaaaagca

SEQ ID NO: 153203 - RNA, 22 nt, Human
auuuauuuucccucaaguaccu

SEQ ID NO: 153204 - RNA, 22 nt, Human
guggugguguuggugacaaguu

SEQ ID NO: 153205 - RNA, 22 nt, Human
uccucccugcacucagugaagu

SEQ ID NO: 153206 - RNA, 22 nt, Human
gaaccauuuaauggagaugcuc

SEQ ID NO: 153207 - RNA, 22 nt, Human
cauuuuaucagcacacgucacu

SEQ ID NO: 153208 - RNA, 22 nt, Human
acugucuuguuguaugugagcu

SEQ ID NO: 153209 - RNA, 22 nt, Human
agugucugcgggcagaggagcg

SEQ ID NO: 153210 - RNA, 22 nt, Human
caaggaaaacagaugaucaaca

SEQ ID NO: 153211 - RNA, 22 nt, Human
agauuucaauggauauugcaag

SEQ ID NO: 153212 - RNA, 22 nt, Human
uuaacauuguccuuagcagauu

SEQ ID NO: 153213 - RNA, 22 nt, Human
aagugauuuucccaccaucuac

SEQ ID NO: 153214 - RNA, 22 nt, Human
ucuucaucucuaaaaugggaac

SEQ ID NO: 153215 - RNA, 22 nt, Human
aagcugccugggaggaagggcu

SEQ ID NO: 153216 - RNA, 22 nt, Human
aaggugggacugagaggggaca

SEQ ID NO: 153217 - RNA, 22 nt, Human
gcuggggaucgaaggcagagcc

SEQ ID NO: 153218 - RNA, 22 nt, Human
gagggggaaaagggcagcagag

SEQ ID NO: 153219 - RNA, 17 nt, Human
ucuccuggcucuaucag

SEQ ID NO: 153220 - RNA, 22 nt, Human
accugcucucccucucgcaguc

SEQ ID NO: 153221 - RNA, 22 nt, Human
uuuaaaauguuuuauuuauuua

SEQ ID NO: 153222 - RNA, 22 nt, Human
aaaaaguaccacuuggacacuu

SEQ ID NO: 153223 - RNA, 22 nt, Human
gacaacuucaguaaaguagauu

SEQ ID NO: 153224 - RNA, 22 nt, Human
ggcuggggccuguugaagaugc

SEQ ID NO: 153225 - RNA, 22 nt, Human
uuuuuauguaaaauauuaaaag

SEQ ID NO: 153226 - RNA, 22 nt, Human
agauuuucuuuuccaucuuugu

SEQ ID NO: 153227 - RNA, 22 nt, Human
agaagaaugguuugaaagauuu

SEQ ID NO: 153228 - RNA, 22 nt, Human
gaauuagacggcaucacauggg

SEQ ID NO: 153229 - RNA, 22 nt, Human
cccccucuggcuccagucugac

SEQ ID NO: 153230 - RNA, 22 nt, Human
cagugcucauagcuguuccucc

SEQ ID NO: 153231 - RNA, 22 nt, Human
gcuguggaaaaugggucuccaa

SEQ ID NO: 153232 - RNA, 22 nt, Human
aguucaauuguuuuguaaaagu

SEQ ID NO: 153233 - RNA, 20 nt, Human
agguugguuuacuagucugu

SEQ ID NO: 153234 - RNA, 22 nt, Human
caauccccaggucccagaacag

SEQ ID NO: 153235 - RNA, 22 nt, Human
uaauagauagggagaguugcug

SEQ ID NO: 153236 - RNA, 22 nt, Human
uacaagcucuuguagggggaaa

SEQ ID NO: 153237 - RNA, 22 nt, Human
uggucucaaagcaaggaaggaa

SEQ ID NO: 153238 - RNA, 22 nt, Human
uccaugaguuuuuuaguuucac

SEQ ID NO: 153239 - RNA, 20 nt, Human
uauuucaaugugccaaguuu

SEQ ID NO: 153240 - RNA, 22 nt, Human
uggacagguacuucacauuauu

SEQ ID NO: 153241 - RNA, 22 nt, Human
uauuaaaagagaaaaagccacc

SEQ ID NO: 153242 - RNA, 22 nt, Human
ugaggagggcuagagucuccug

SEQ ID NO: 153243 - RNA, 22 nt, Human
cagagcugucauuugccaguga

SEQ ID NO: 153244 - RNA, 22 nt, Human
cuauacuuagaacuccauuuuc

SEQ ID NO: 153245 - RNA, 22 nt, Human
aauauuuaaauagaauuacauc

SEQ ID NO: 153246 - RNA, 22 nt, Human
auguacugacuguacuuuuaaa

SEQ ID NO: 153247 - RNA, 22 nt, Human
uuaaucagacauucucaaguuu

SEQ ID NO: 153248 - RNA, 22 nt, Human
ucagccuugguuuugguguugg

SEQ ID NO: 153249 - RNA, 22 nt, Human
agcggccucgcugccugcucag

SEQ ID NO: 153250 - RNA, 22 nt, Human
cagagacuuuugcuccgauucu

SEQ ID NO: 153251 - RNA, 22 nt, Human
augauuaagguacgucauuucu

SEQ ID NO: 153252 - RNA, 22 nt, Human
gggcuguggggccugcagaagg

SEQ ID NO: 153253 - RNA, 22 nt, Human
ugucacagagcgugcaacagaa

SEQ ID NO: 153254 - RNA, 22 nt, Human
ccagggaggucauagugcuggu

SEQ ID NO: 153255 - RNA, 22 nt, Human
ggaaggugagugcugugugauu

SEQ ID NO: 153256 - RNA, 20 nt, Human
agaaggagagaugaggcaaa

SEQ ID NO: 153257 - RNA, 22 nt, Human
guuuggguggcuagagaaagaa

SEQ ID NO: 153258 - RNA, 22 nt, Human
cauccagcuccugggggccacc

SEQ ID NO: 153259 - RNA, 22 nt, Human
ggcuggagcaggcugcacagug

SEQ ID NO: 153260 - RNA, 22 nt, Human
uuguuuaaagaacuucugacuu

SEQ ID NO: 153261 - RNA, 22 nt, Human
aguaagaaagaaugauaggccu

SEQ ID NO: 153262 - RNA, 18 nt, Human
ccuucaucucugcuucuu

SEQ ID NO: 153263 - RNA, 22 nt, Human
ccugccagaaaagagggaguuc

SEQ ID NO: 153264 - RNA, 22 nt, Human
uacaaagugauuuuggaauuga

SEQ ID NO: 153265 - RNA, 22 nt, Human
aagaguggagcuggaaaguggg

SEQ ID NO: 153266 - RNA, 22 nt, Human
uuuugaauaauucagaaacagc

SEQ ID NO: 153267 - RNA, 22 nt, Human
accuugggcccagaccggcacg

SEQ ID NO: 153268 - RNA, 22 nt, Human
uaagggagcagaagcugugaaa

SEQ ID NO: 153269 - RNA, 22 nt, Human
gagaaggagcagaaaaucuccu

SEQ ID NO: 153270 - RNA, 21 nt, Human
aaguuuuggcuguacaguugu

SEQ ID NO: 153271 - RNA, 22 nt, Human
guacuugauucauuauugcauu

SEQ ID NO: 153272 - RNA, 22 nt, Human
aggauggaaguaacuggauaau

SEQ ID NO: 153273 - RNA, 22 nt, Human
aggguggaggacaggccaguga

SEQ ID NO: 153274 - RNA, 22 nt, Human
auuucauaaaaacuuuaccuga

SEQ ID NO: 153275 - RNA, 22 nt, Human
ucccagccugacagugcaucaa

SEQ ID NO: 153276 - RNA, 22 nt, Human
uuuaaauaguugguuuuuuugc

SEQ ID NO: 153277 - RNA, 19 nt, Human
acuggggcaggcugggcuu

SEQ ID NO: 153278 - RNA, 22 nt, Human
gugguuuagccuucauuaaccu

SEQ ID NO: 153279 - RNA, 22 nt, Human
uauauuaaagugcuuugcagug

SEQ ID NO: 153280 - RNA, 22 nt, Human
aauaauuuuuuugugauuaugu

SEQ ID NO: 153281 - RNA, 22 nt, Human
uuaaguccuugguaauuuucuu

SEQ ID NO: 153282 - RNA, 22 nt, Human
auuugcuuguucaccaguacuu

SEQ ID NO: 153283 - RNA, 22 nt, Human
aaugcagaugugucuuuaauuu

SEQ ID NO: 153284 - RNA, 22 nt, Human
guucuucagauuccauuucagu

SEQ ID NO: 153285 - RNA, 22 nt, Human
aggcaguguggagggcuguugc

SEQ ID NO: 153286 - RNA, 22 nt, Human
guaugucuuaggguucaguaac

SEQ ID NO: 153287 - RNA, 22 nt, Human
uugucaggaacuaugauuaugc

SEQ ID NO: 153288 - RNA, 22 nt, Human
uggcaaacacaauauggguaca

SEQ ID NO: 153289 - RNA, 22 nt, Human
aaaugcuuuaauugaguucaug

SEQ ID NO: 153290 - RNA, 22 nt, Human
uacuuacacugaagcaaagaua

SEQ ID NO: 153291 - RNA, 23 nt, Human
uggguuucagugccaaugcugcc

SEQ ID NO: 153292 - RNA, 22 nt, Human
auaaauuugacagcucuucaug

SEQ ID NO: 153293 - RNA, 22 nt, Human
acuggagcccguggaggcgcag

SEQ ID NO: 153294 - RNA, 22 nt, Human
ugaaguuuagaaaaagugccuu

SEQ ID NO: 153295 - RNA, 22 nt, Human
ucccacgugccaucugcucugu

SEQ ID NO: 153296 - RNA, 22 nt, Human
agguuuggaaguggcgauccau

SEQ ID NO: 153297 - RNA, 22 nt, Human
uuccucauucuggggcauguug

SEQ ID NO: 153298 - RNA, 22 nt, Human
aauuuuauuuuuuccccuagau

SEQ ID NO: 153299 - RNA, 22 nt, Human
ccugacucugauuucgcugcau

SEQ ID NO: 153300 - RNA, 19 nt, Human
gagcaugacuggccuugca

SEQ ID NO: 153301 - RNA, 22 nt, Human
uggggcugguaccguaauauau

SEQ ID NO: 153302 - RNA, 22 nt, Human
acauuuugggagaaaguuguua

SEQ ID NO: 153303 - RNA, 22 nt, Human
cgaaaaagaagugcaccauguu

SEQ ID NO: 153304 - RNA, 22 nt, Human
caggaacucggagcccaucucu

SEQ ID NO: 153305 - RNA, 22 nt, Human
uucaaacaguguagaauauaug

SEQ ID NO: 153306 - RNA, 22 nt, Human
guugggcugaagugugugcuua

SEQ ID NO: 153307 - RNA, 22 nt, Human
aaacugcuuucucugccuuucc

SEQ ID NO: 153308 - RNA, 22 nt, Human
uucagaauguacugauagaaca

SEQ ID NO: 153309 - RNA, 22 nt, Human
gauucuaucauucuguauauua

SEQ ID NO: 153310 - RNA, 22 nt, Human
uugcaugauuuaagaauaucug

SEQ ID NO: 153311 - RNA, 22 nt, Human
uucauggauuugugaaauuuag

SEQ ID NO: 153312 - RNA, 22 nt, Human
ugagggagggggagccguucua

SEQ ID NO: 153313 - RNA, 22 nt, Human
ugcgccccgcgggccuucgggc

SEQ ID NO: 153314 - RNA, 22 nt, Human
aauuucuuucagcugcuuuaag

SEQ ID NO: 153315 - RNA, 22 nt, Human
ugcagaggagcuggaaggcugg

SEQ ID NO: 153316 - RNA, 20 nt, Human
cagagacaagagggaaggga

SEQ ID NO: 153317 - RNA, 17 nt, Human
ccacuagauagguugug

SEQ ID NO: 153318 - RNA, 22 nt, Human
aaaggaaacuaugaaucucugg

SEQ ID NO: 153319 - RNA, 22 nt, Human
auagagcuggggaagaagcugg

SEQ ID NO: 153320 - RNA, 22 nt, Human
uaucauuuuacugugacauuuu

SEQ ID NO: 153321 - RNA, 22 nt, Human
acucugaaaggcuacaaaugcu

SEQ ID NO: 153322 - RNA, 22 nt, Human
uucacugugauugggguggauu

SEQ ID NO: 153323 - RNA, 22 nt, Human
augaguuaaguagcccuucaug

SEQ ID NO: 153324 - RNA, 22 nt, Human
uauaaugucuuuguugaaaucu

SEQ ID NO: 153325 - RNA, 22 nt, Human
acucagcaccuagaaagugugc

SEQ ID NO: 153326 - RNA, 22 nt, Human
cauuauucaggcuuuggaauuu

SEQ ID NO: 153327 - RNA, 22 nt, Human
ggugaguagaaguaguuggcuu

SEQ ID NO: 153328 - RNA, 22 nt, Human
ggaaaaauggguggugauauga

SEQ ID NO: 153329 - RNA, 21 nt, Human
aggugaaggcgagggggacag

SEQ ID NO: 153330 - RNA, 22 nt, Human
gaggccagcacccagaugcaug

SEQ ID NO: 153331 - RNA, 19 nt, Human
uggaggcacuaacaaacuc

SEQ ID NO: 153332 - RNA, 22 nt, Human
auucccucaagagacccacagc

SEQ ID NO: 153333 - RNA, 23 nt, Human
aaggugaagccaccaggugagga

SEQ ID NO: 153334 - RNA, 22 nt, Human
uuucuauauucaguuucauaaa

SEQ ID NO: 153335 - RNA, 21 nt, Human
uuccuggaggcagaaacguga

SEQ ID NO: 153336 - RNA, 22 nt, Human
caugaugagaguaauaacacag

SEQ ID NO: 153337 - RNA, 22 nt, Human
aguucaugugguuuaacuuaau

SEQ ID NO: 153338 - RNA, 22 nt, Human
uuagucauucccucuugauauu

SEQ ID NO: 153339 - RNA, 22 nt, Human
ugauucacagacuucacaaggc

SEQ ID NO: 153340 - RNA, 22 nt, Human
gggcugagagcuggaaucugag

SEQ ID NO: 153341 - RNA, 22 nt, Human
agccugugacucugugaaacca

SEQ ID NO: 153342 - RNA, 22 nt, Human
ugucacagggauaccauggggc

SEQ ID NO: 153343 - RNA, 22 nt, Human
uuuuaucagagcuugcagugug

SEQ ID NO: 153344 - RNA, 21 nt, Human
uccauucuuggugguucugca

SEQ ID NO: 153345 - RNA, 22 nt, Human
uaauuccacacucccgcaagcg

SEQ ID NO: 153346 - RNA, 22 nt, Human
augggagggugaggaggcagcu

SEQ ID NO: 153347 - RNA, 21 nt, Human
agucaagcugccugcuuggca

SEQ ID NO: 153348 - RNA, 22 nt, Human
gcucccaauuccuuuuacaauu

SEQ ID NO: 153349 - RNA, 22 nt, Human
uuugaagaccuuaucucuaaau

SEQ ID NO: 153350 - RNA, 22 nt, Human
aacugguaauuuaguauuacug

SEQ ID NO: 153351 - RNA, 21 nt, Human
agcaucugaggcaguuuccua

SEQ ID NO: 153352 - RNA, 23 nt, Human
uauuuuccccuguaauauguauu

SEQ ID NO: 153353 - RNA, 22 nt, Human
agacuucucuuggcuauauuau

SEQ ID NO: 153354 - RNA, 22 nt, Human
uuuacaaggcaguuauuuuccu

SEQ ID NO: 153355 - RNA, 22 nt, Human
cuccagcagaaagggcgagugg

SEQ ID NO: 153356 - RNA, 22 nt, Human
ucaguauuagugcauuaucagg

SEQ ID NO: 153357 - RNA, 22 nt, Human
ucucaaagagcuacuggucuau

SEQ ID NO: 153358 - RNA, 22 nt, Human
guauuauauaaccauugguucu

SEQ ID NO: 153359 - RNA, 22 nt, Human
cagaggagcgaguuggacgcca

SEQ ID NO: 153360 - RNA, 22 nt, Human
ugaauuuguaggaauucuccau

SEQ ID NO: 153361 - RNA, 22 nt, Human
ucugaggacagugcugugccug

SEQ ID NO: 153362 - RNA, 22 nt, Human
uuuuuauaagauuuaaaaugua

SEQ ID NO: 153363 - RNA, 22 nt, Human
aagcucagcugguggugauugc

SEQ ID NO: 153364 - RNA, 22 nt, Human
uuuuauaaaaccuguuugaccu

SEQ ID NO: 153365 - RNA, 22 nt, Human
ccaggcucaccuggagccccug

SEQ ID NO: 153366 - RNA, 22 nt, Human
ucccagaaccuuuuagcuucac

SEQ ID NO: 153367 - RNA, 22 nt, Human
aaauagucagaaaucaacgugc

SEQ ID NO: 153368 - RNA, 20 nt, Human
gggcucugcauccaucagcc

SEQ ID NO: 153369 - RNA, 22 nt, Human
ggcuguggcagcuggaaguggu

SEQ ID NO: 153370 - RNA, 22 nt, Human
auacuaagcucauuacauuuug

SEQ ID NO: 153371 - RNA, 22 nt, Human
auguauauauacauguauugua

SEQ ID NO: 153372 - RNA, 22 nt, Human
guggaggguuugcaaugugcag

SEQ ID NO: 153373 - RNA, 22 nt, Human
uguaaauucuauacacuuaaaa

SEQ ID NO: 153374 - RNA, 22 nt, Human
aguuuaaauuguucuaucagaa

SEQ ID NO: 153375 - RNA, 22 nt, Human
ccugggccuaaacaaacaagag

SEQ ID NO: 153376 - RNA, 22 nt, Human
gcccagccucagggcaucagcu

SEQ ID NO: 153377 - RNA, 22 nt, Human
guggagaaauauguucagcuuc

SEQ ID NO: 153378 - RNA, 22 nt, Human
ccagaggcuuaugcagcugcug

SEQ ID NO: 153379 - RNA, 22 nt, Human
ugugucucucuuagguugucug

SEQ ID NO: 153380 - RNA, 22 nt, Human
auuagaagagcuuuuuacucuu

SEQ ID NO: 153381 - RNA, 22 nt, Human
aagauauauaaggaaguucagu

SEQ ID NO: 153382 - RNA, 22 nt, Human
aaugaguuuguucuauuauuug

SEQ ID NO: 153383 - RNA, 22 nt, Human
agucacuguuuaaucuagcuaa

SEQ ID NO: 153384 - RNA, 20 nt, Human
ugccagagagcucauacccu

SEQ ID NO: 153385 - RNA, 22 nt, Human
cuccuugguuccggcguuggag

SEQ ID NO: 153386 - RNA, 22 nt, Human
uugggaacaggcuucccacugg

SEQ ID NO: 153387 - RNA, 22 nt, Human
gcaggagggggccuggagccca

SEQ ID NO: 153388 - RNA, 22 nt, Human
cugaaagacgaggggaagucgg

SEQ ID NO: 153389 - RNA, 22 nt, Human
uaauuauuaauuuuagguugcu

SEQ ID NO: 153390 - RNA, 23 nt, Human
aggcagcaugcaacaggccauuu

SEQ ID NO: 153391 - RNA, 22 nt, Human
ucuccucucugaucuugcuccg

SEQ ID NO: 153392 - RNA, 22 nt, Human
uugaaaaaauguguuuaaggag

SEQ ID NO: 153393 - RNA, 22 nt, Human
acagagcucccagccaucuccu

SEQ ID NO: 153394 - RNA, 22 nt, Human
ugaacuguccuuguugucuaga

SEQ ID NO: 153395 - RNA, 22 nt, Human
cuguguguauaauguuugauaa

SEQ ID NO: 153396 - RNA, 17 nt, Human
guucucaaacugacuga

SEQ ID NO: 153397 - RNA, 22 nt, Human
guggguauauauaugugugcug

SEQ ID NO: 153398 - RNA, 22 nt, Human
gggacaggacuccuggggccug

SEQ ID NO: 153399 - RNA, 22 nt, Human
uucuuauuuuucguaaauccug

SEQ ID NO: 153400 - RNA, 22 nt, Human
gaggaggucaccuggugagcaa

SEQ ID NO: 153401 - RNA, 22 nt, Human
aaaagguuauagcuuugccuug

SEQ ID NO: 153402 - RNA, 22 nt, Human
ucacaucugugugauugucauu

SEQ ID NO: 153403 - RNA, 22 nt, Human
aguggcugugaaauacauggga

SEQ ID NO: 153404 - RNA, 22 nt, Human
uguuuaaauagaacauacugca

SEQ ID NO: 153405 - RNA, 22 nt, Human
gaaauagagacaguaagugucu

SEQ ID NO: 153406 - RNA, 22 nt, Human
uaucuguagucucaugguuccu

SEQ ID NO: 153407 - RNA, 17 nt, Human
ucauuucaguaaaucca

SEQ ID NO: 153408 - RNA, 22 nt, Human
uauuuuauuuagguuuaguugu

SEQ ID NO: 153409 - RNA, 19 nt, Human
ggaggguguccucaguguc

SEQ ID NO: 153410 - RNA, 22 nt, Human
uucucaauggcaacuuguugcu

SEQ ID NO: 153411 - RNA, 23 nt, Human
ccagcugugccuggcccaggagc

SEQ ID NO: 153412 - RNA, 22 nt, Human
aauuuaauugguuuuuacuugu

SEQ ID NO: 153413 - RNA, 22 nt, Human
gucccagaggacagggucacau

SEQ ID NO: 153414 - RNA, 22 nt, Human
agggcugggcuuggcaggcugg

SEQ ID NO: 153415 - RNA, 20 nt, Human
acccagaguccuccccgcgc

SEQ ID NO: 153416 - RNA, 22 nt, Human
gggagcuggagcuggaagacuc

SEQ ID NO: 153417 - RNA, 22 nt, Human
caggaaaauaauggugauggga

SEQ ID NO: 153418 - RNA, 22 nt, Human
cccuccagugucccagugggga

SEQ ID NO: 153419 - RNA, 22 nt, Human
aagggaggguaggaagagggag

SEQ ID NO: 153420 - RNA, 22 nt, Human
cauuuaaccccuugguacugaa

SEQ ID NO: 153421 - RNA, 19 nt, Human
ugccuggcaccagcuccac

SEQ ID NO: 153422 - RNA, 22 nt, Human
aggcugccuaugaaggcagaag

SEQ ID NO: 153423 - RNA, 22 nt, Human
uuaauauuaagauauugagugg

SEQ ID NO: 153424 - RNA, 20 nt, Human
auaaauaggauuuucugaca

SEQ ID NO: 153425 - RNA, 22 nt, Human
cagacagagcucacaagucuuu

SEQ ID NO: 153426 - RNA, 22 nt, Human
uauauauaauguguacagguga

SEQ ID NO: 153427 - RNA, 22 nt, Human
aggguggcuggaguggucuggu

SEQ ID NO: 153428 - RNA, 22 nt, Human
cugguuuauuucauaguuuguu

SEQ ID NO: 153429 - RNA, 22 nt, Human
uuuguacuuucuaauguauuua

SEQ ID NO: 153430 - RNA, 22 nt, Human
agaacccaaggcccagggaugu

SEQ ID NO: 153431 - RNA, 22 nt, Human
aggcuuagaugaguucccacau

SEQ ID NO: 153432 - RNA, 22 nt, Human
gaauaagaauccacuucuggca

SEQ ID NO: 153433 - RNA, 22 nt, Human
auucaucuguacuucaauaucu

SEQ ID NO: 153434 - RNA, 22 nt, Human
aaaauaauauuauaccacugcu

SEQ ID NO: 153435 - RNA, 22 nt, Human
cuaaaacuuuuccaaauuaugu

SEQ ID NO: 153436 - RNA, 22 nt, Human
gugaucagaagaaccugccgaa

SEQ ID NO: 153437 - RNA, 22 nt, Human
agcugaggccccgcagcagggu

SEQ ID NO: 153438 - RNA, 22 nt, Human
agaaacaagcccuagaaguccu

SEQ ID NO: 153439 - RNA, 22 nt, Human
auguucucagguuguauuuauu

SEQ ID NO: 153440 - RNA, 22 nt, Human
uuucuugugauuuugaugaacu

SEQ ID NO: 153441 - RNA, 19 nt, Human
cugggacaaugaaagcauc

SEQ ID NO: 153442 - RNA, 22 nt, Human
ugaggaggugcuaccagcgucu

SEQ ID NO: 153443 - RNA, 20 nt, Human
uuuuuuaaauagagcuguug

SEQ ID NO: 153444 - RNA, 23 nt, Human
aaaguacuuaaucugcaaaccac

SEQ ID NO: 153445 - RNA, 23 nt, Human
uuuuccaaaucgacucucuaguu

SEQ ID NO: 153446 - RNA, 22 nt, Human
auguuccaugacuaugcaugaa

SEQ ID NO: 153447 - RNA, 22 nt, Human
ugaauaaucuuggguauuaaua

SEQ ID NO: 153448 - RNA, 22 nt, Human
gagcaggucucaguucugccuc

SEQ ID NO: 153449 - RNA, 22 nt, Human
uauguauguauguauguauaug

SEQ ID NO: 153450 - RNA, 22 nt, Human
uacagucauaagguuucucucc

SEQ ID NO: 153451 - RNA, 22 nt, Human
ccuccuuuccuguuuuccugag

SEQ ID NO: 153452 - RNA, 22 nt, Human
cucugugucugauucugggaag

SEQ ID NO: 153453 - RNA, 22 nt, Human
cuuuucauuucauggaauacaa

SEQ ID NO: 153454 - RNA, 22 nt, Human
uuucucuuguauuugaaucacu

SEQ ID NO: 153455 - RNA, 22 nt, Human
guacauauccuuuacguuuugu

SEQ ID NO: 153456 - RNA, 22 nt, Human
agcucugauccuuuaaaggaga

SEQ ID NO: 153457 - RNA, 22 nt, Human
uauucuucaacuuuucuccucu

SEQ ID NO: 153458 - RNA, 22 nt, Human
aauggcaaaaguuucggaaauu

SEQ ID NO: 153459 - RNA, 22 nt, Human
ggaggccagagaagagccaggc

SEQ ID NO: 153460 - RNA, 22 nt, Human
uguguuguuggggauguuuuca

SEQ ID NO: 153461 - RNA, 22 nt, Human
gaggcuugccacuguccauggc

SEQ ID NO: 153462 - RNA, 22 nt, Human
uugcagagaacuaaagggagua

SEQ ID NO: 153463 - RNA, 22 nt, Human
ggggcucauuugcaggggggag

SEQ ID NO: 153464 - RNA, 22 nt, Human
ucagcucacaauguugagaaag

SEQ ID NO: 153465 - RNA, 22 nt, Human
augugaaagagguguucagugg

SEQ ID NO: 153466 - RNA, 22 nt, Human
guaagguuggaugcaaucaacu

SEQ ID NO: 153467 - RNA, 20 nt, Human
gauuuaacgcugcgucuguc

SEQ ID NO: 153468 - RNA, 22 nt, Human
ucauaaguuguugacuagcaaa

SEQ ID NO: 153469 - RNA, 22 nt, Human
acaacuuuaauggguuucagcu

SEQ ID NO: 153470 - RNA, 22 nt, Human
cuuuuucuuaucuuuuucuaug

SEQ ID NO: 153471 - RNA, 22 nt, Human
uguuuagcucugacuaugugau

SEQ ID NO: 153472 - RNA, 22 nt, Human
cagaccagaaggaagccgacaa

SEQ ID NO: 153473 - RNA, 22 nt, Human
gaggagagcuggccagguuucu

SEQ ID NO: 153474 - RNA, 22 nt, Human
ccucccaccguaucucaguggc

SEQ ID NO: 153475 - RNA, 22 nt, Human
aagaaauacagaaauggcagua

SEQ ID NO: 153476 - RNA, 22 nt, Human
agggaggagggacagaaagagg

SEQ ID NO: 153477 - RNA, 22 nt, Human
cuucagagugacucagcaucuu

SEQ ID NO: 153478 - RNA, 22 nt, Human
aaguuccacuagugacccagaa

SEQ ID NO: 153479 - RNA, 22 nt, Human
gaaagugaauguaacauguuau

SEQ ID NO: 153480 - RNA, 22 nt, Human
ugggauggacuuuagagaaucg

SEQ ID NO: 153481 - RNA, 22 nt, Human
uggagggaagcaaacacuagau

SEQ ID NO: 153482 - RNA, 22 nt, Human
uuuugaugaccauucuucuuuu

SEQ ID NO: 153483 - RNA, 22 nt, Human
agucuagagcuuuuaucaggcc

SEQ ID NO: 153484 - RNA, 22 nt, Human
ucauuuuaucaggaauggaauc

SEQ ID NO: 153485 - RNA, 22 nt, Human
cagcuuguucugaccugugauu

SEQ ID NO: 153486 - RNA, 22 nt, Human
cguggaggucgcauauuccucu

SEQ ID NO: 153487 - RNA, 22 nt, Human
ucuuuaaggggccuuuguguca

SEQ ID NO: 153488 - RNA, 22 nt, Human
cauaucuccagguucugcugga

SEQ ID NO: 153489 - RNA, 22 nt, Human
ggacggggagcuggaaagggga

SEQ ID NO: 153490 - RNA, 22 nt, Human
ugaugaugaagaaauauuauca

SEQ ID NO: 153491 - RNA, 20 nt, Human
ucacuguaauugccuacauu

SEQ ID NO: 153492 - RNA, 22 nt, Human
uuuuccuucugauacuccauuu

SEQ ID NO: 153493 - RNA, 22 nt, Human
aguauuuaguauucuauauuag

SEQ ID NO: 153494 - RNA, 22 nt, Human
uuuuuuuccaguuauucauuuu

SEQ ID NO: 153495 - RNA, 22 nt, Human
gcauaauauugagaaauuauua

SEQ ID NO: 153496 - RNA, 22 nt, Human
uggugcucucgauauauaaggc

SEQ ID NO: 153497 - RNA, 22 nt, Human
agaucugucaccauccuggagc

SEQ ID NO: 153498 - RNA, 22 nt, Human
uccagggaggggcggcaggggu

SEQ ID NO: 153499 - RNA, 22 nt, Human
gagggagugggcccgugggcac

SEQ ID NO: 153500 - RNA, 22 nt, Human
cauaaauuuuaccuuguaagug

SEQ ID NO: 153501 - RNA, 22 nt, Human
uacaaaauucaaauaauguuug

SEQ ID NO: 153502 - RNA, 22 nt, Human
uuacuuaucugaugugauuuuu

SEQ ID NO: 153503 - RNA, 22 nt, Human
aucacacaccuguuaaauugug

SEQ ID NO: 153504 - RNA, 20 nt, Human
uucacagaggacucagguca

SEQ ID NO: 153505 - RNA, 22 nt, Human
acagcugagaugcuacuugugg

SEQ ID NO: 153506 - RNA, 22 nt, Human
aauuuuauuagacaggcauaau

SEQ ID NO: 153507 - RNA, 22 nt, Human
cagacagaaggcuccuugaggu

SEQ ID NO: 153508 - RNA, 22 nt, Human
ugcucuuuguagcugcuuugcu

SEQ ID NO: 153509 - RNA, 22 nt, Human
ggagguguguucuguuuuagug

SEQ ID NO: 153510 - RNA, 22 nt, Human
ugugugcuaguuuugucaguau

SEQ ID NO: 153511 - RNA, 22 nt, Human
auuguuuugugaaacauaguga

SEQ ID NO: 153512 - RNA, 22 nt, Human
gggggaggcucggcgccgcggu

SEQ ID NO: 153513 - RNA, 22 nt, Human
cagagaggagcacaaagugaag

SEQ ID NO: 153514 - RNA, 22 nt, Human
agccccaauuacagcugugcug

SEQ ID NO: 153515 - RNA, 22 nt, Human
cuuacauuuguuuaguguuucc

SEQ ID NO: 153516 - RNA, 22 nt, Human
gaauauuuaucucagcugcaga

SEQ ID NO: 153517 - RNA, 22 nt, Human
uucugcuuuaaagcucauguuu

SEQ ID NO: 153518 - RNA, 18 nt, Human
acaaaaauagugcuuugg

SEQ ID NO: 153519 - RNA, 22 nt, Human
ggagugaguauguucugaugca

SEQ ID NO: 153520 - RNA, 22 nt, Human
cacccccaggcuccccuucugg

SEQ ID NO: 153521 - RNA, 21 nt, Human
ccugcacuucccuccucaagu

SEQ ID NO: 153522 - RNA, 21 nt, Human
uucuauauugagaauuggcua

SEQ ID NO: 153523 - RNA, 22 nt, Human
aagagaaagggaaaaugguaaa

SEQ ID NO: 153524 - RNA, 22 nt, Human
gagcacugagcuggaauuggag

SEQ ID NO: 153525 - RNA, 22 nt, Human
uaaagcacucaaaauuguagcu

SEQ ID NO: 153526 - RNA, 22 nt, Human
aaauguaaacuguauuuauaaa

SEQ ID NO: 153527 - RNA, 22 nt, Human
uuuaaucaguugguaauauuga

SEQ ID NO: 153528 - RNA, 22 nt, Human
uucauagaagggaguuuuuccu

SEQ ID NO: 153529 - RNA, 19 nt, Human
uuccucaggugugaguuag

SEQ ID NO: 153530 - RNA, 22 nt, Human
cacugcaaccuccaccucccgg

SEQ ID NO: 153531 - RNA, 22 nt, Human
ccaggcuccccaggaggcccuu

SEQ ID NO: 153532 - RNA, 22 nt, Human
agugaaaacugaaucaccuucc

SEQ ID NO: 153533 - RNA, 20 nt, Human
gugaacuggagaacugaugu

SEQ ID NO: 153534 - RNA, 22 nt, Human
uggaagggguuacgcagcagga

SEQ ID NO: 153535 - RNA, 20 nt, Human
acagagauccucucuuuauc

SEQ ID NO: 153536 - RNA, 22 nt, Human
uuggugauguagcagcaauugu

SEQ ID NO: 153537 - RNA, 22 nt, Human
gggagaguagcuggaagguucu

SEQ ID NO: 153538 - RNA, 22 nt, Human
guuuucuaaaacacauauaagu

SEQ ID NO: 153539 - RNA, 22 nt, Human
caauguuuuuccuuccuuaaua

SEQ ID NO: 153540 - RNA, 22 nt, Human
auacacuucauguuuucaucug

SEQ ID NO: 153541 - RNA, 22 nt, Human
uugucucuacagagaguaguag

SEQ ID NO: 153542 - RNA, 22 nt, Human
uuaggcuuuauugaaaacaaua

SEQ ID NO: 153543 - RNA, 23 nt, Human
cugaaauucagaugcuaaagaua

SEQ ID NO: 153544 - RNA, 22 nt, Human
agcggaggaggcggagcaggga

SEQ ID NO: 153545 - RNA, 22 nt, Human
ccagccuucugaugggacccuc

SEQ ID NO: 153546 - RNA, 22 nt, Human
uuuauaauuacguaaaauauuu

SEQ ID NO: 153547 - RNA, 22 nt, Human
uaacauuuaguuuuaagauggu

SEQ ID NO: 153548 - RNA, 22 nt, Human
cugccaggagaggccagggccc

SEQ ID NO: 153549 - RNA, 22 nt, Human
caggccccagggacugggcgcu

SEQ ID NO: 153550 - RNA, 23 nt, Human
cauuugauccucacaauaaaugg

SEQ ID NO: 153551 - RNA, 18 nt, Human
acucugaagcuaagucac

SEQ ID NO: 153552 - RNA, 19 nt, Human
agcaucuccacagaaaaag

SEQ ID NO: 153553 - RNA, 22 nt, Human
agacuccuucuaagaccucauu

SEQ ID NO: 153554 - RNA, 22 nt, Human
ggcugggagguggcgaggaggc

SEQ ID NO: 153555 - RNA, 21 nt, Human
uucugcuguucaccaccaccc

SEQ ID NO: 153556 - RNA, 22 nt, Human
uucuugugugaauauaauuaca

SEQ ID NO: 153557 - RNA, 20 nt, Human
uggguucaguuguuucuggc

SEQ ID NO: 153558 - RNA, 22 nt, Human
cauuuacauaacaguaacgcug

SEQ ID NO: 153559 - RNA, 22 nt, Human
aauggcaagccacaugcuuuuc

SEQ ID NO: 153560 - RNA, 20 nt, Human
ucugugugccaucaccuaac

SEQ ID NO: 153561 - RNA, 22 nt, Human
ggagaggaaguuuaaagaauug

SEQ ID NO: 153562 - RNA, 21 nt, Human
acuccagccacugacugucuc

SEQ ID NO: 153563 - RNA, 22 nt, Human
ucagacacacaacuucugcuua

SEQ ID NO: 153564 - RNA, 22 nt, Human
auguguguaugacugaaucuau

SEQ ID NO: 153565 - RNA, 22 nt, Human
aaggagaggagucauugggaua

SEQ ID NO: 153566 - RNA, 20 nt, Human
uuguacuuaugugagaagga

SEQ ID NO: 153567 - RNA, 22 nt, Human
uccaggaggacugagggggcug

SEQ ID NO: 153568 - RNA, 22 nt, Human
auuucauuuuagaaauaagugu

SEQ ID NO: 153569 - RNA, 22 nt, Human
ucagagaaguaggcuaauggug

SEQ ID NO: 153570 - RNA, 22 nt, Human
agaaaaggaagcuuagacugua

SEQ ID NO: 153571 - RNA, 22 nt, Human
agagggagcuccaagaucaagg

SEQ ID NO: 153572 - RNA, 22 nt, Human
gcagggcucagccgcucccacc

SEQ ID NO: 153573 - RNA, 22 nt, Human
aaaauacuaggaaaauaaauca

SEQ ID NO: 153574 - RNA, 22 nt, Human
cucuguguguuugugugugugu

SEQ ID NO: 153575 - RNA, 18 nt, Human
cccagaggaaugccugga

SEQ ID NO: 153576 - RNA, 22 nt, Human
cagggggacuuguuagguuuua

SEQ ID NO: 153577 - RNA, 22 nt, Human
aucuuuguaaguaaucaaagcu

SEQ ID NO: 153578 - RNA, 22 nt, Human
uugugcauuuuguuuuacuuau

SEQ ID NO: 153579 - RNA, 22 nt, Human
ggcugguggcgggcagcacaga

SEQ ID NO: 153580 - RNA, 22 nt, Human
guuuauuucuuaucaucacuau

SEQ ID NO: 153581 - RNA, 22 nt, Mycobacterium tuberculosis H37Rv
gguguccuccgaucgggggaag

SEQ ID NO: 153582 - RNA, 22 nt, Mycobacterium tuberculosis H37Rv
ccgcugcugcucgugguugggg

SEQ ID NO: 153583 - RNA, 22 nt, Mycobacterium tuberculosis H37Rv
ugugacgccaaccucgcgguca

SEQ ID NO: 153584 - RNA, 22 nt, Mycobacterium tuberculosis H37Rv
agguguucuucaacgaugucuu

SEQ ID NO: 153585 - RNA, 22 nt, Mycobacterium tuberculosis H37Rv
gagaccuucgaccgauguucga

SEQ ID NO: 153586 - RNA, 22 nt, Mycobacterium tuberculosis H37Rv
ugagacccccgucgaagucuag

SEQ ID NO: 153587 - RNA, 22 nt, Mycobacterium tuberculosis H37Rv
gcuacgucggaucugucggccg

SEQ ID NO: 153588 - RNA, 20 nt, Mycobacterium tuberculosis H37Rv
acggccuggccugucggcgc

SEQ ID NO: 153589 - RNA, 22 nt, Mycobacterium tuberculosis H37Rv
cuccgaugguggcacggggcug

SEQ ID NO: 153590 - RNA, 22 nt, Mycobacterium tuberculosis H37Rv
gcagagccgaucguccuguugc

SEQ ID NO: 153591 - RNA, 22 nt, Mycobacterium tuberculosis H37Rv
ugggcgauuuugcgucugcucg

SEQ ID NO: 153592 - RNA, 20 nt, Mycobacterium tuberculosis H37Rv
ucgggugcuacgacuuugcc

SEQ ID NO: 153593 - RNA, 22 nt, Mycobacterium tuberculosis H37Rv
gguggucccagcuucuguugug

SEQ ID NO: 153594 - RNA, 19 nt, Mycobacterium tuberculosis H37Rv
ucacgcgguuguucuacga

SEQ ID NO: 153595 - RNA, 22 nt, Mycobacterium tuberculosis H37Rv
ucgcaguggcgucacgcuggcg

SEQ ID NO: 153596 - RNA, 22 nt, Mycobacterium tuberculosis H37Rv
ugcucgacgugauggccgccca

SEQ ID NO: 153597 - RNA, 22 nt, Mycobacterium tuberculosis H37Rv
uugggaccaugccgcuggggug

SEQ ID NO: 153598 - RNA, 22 nt, Mycobacterium tuberculosis H37Rv
cugaaugccuauaucgcggcca

SEQ ID NO: 153599 - RNA, 22 nt, Mycobacterium tuberculosis H37Rv
gcuggucgaugggcggcuacgg

SEQ ID NO: 153600 - RNA, 22 nt, Mycobacterium tuberculosis H37Rv
cgguggauucccggccugcaca

SEQ ID NO: 153601 - RNA, 23 nt, Mycobacterium tuberculosis H37Rv
gccauugcgucagcggugcuguc

SEQ ID NO: 153602 - RNA, 22 nt, Mycobacterium tuberculosis H37Rv
gagaucgaccgggaaggugauc

SEQ ID NO: 153603 - RNA, 22 nt, Mycobacterium tuberculosis H37Rv
gagcagacgucaaagcccccga

SEQ ID NO: 153604 - RNA, 22 nt, Mycobacterium tuberculosis H37Rv
uugcugauugccggauugugcg

SEQ ID NO: 153605 - RNA, 22 nt, Mycobacterium tuberculosis H37Rv
gagcaugggcguggacguuguc

SEQ ID NO: 153606 - RNA, 22 nt, Mycobacterium tuberculosis H37Rv
gcaugccgacaugaacgcggca

SEQ ID NO: 153607 - RNA, 23 nt, Mycobacterium tuberculosis H37Rv
ucuguacgcggagccggacgugc

SEQ ID NO: 153608 - RNA, 22 nt, Mycobacterium tuberculosis H37Rv
cugcacgacagcgucgaagucg

SEQ ID NO: 153609 - RNA, 22 nt, Mycobacterium tuberculosis H37Rv
uucgggcgauuuugcgucuguc

SEQ ID NO: 153610 - RNA, 22 nt, Mycobacterium tuberculosis H37Rv
gaccagcaccgcggcgaccgca

SEQ ID NO: 153611 - RNA, 22 nt, Mycobacterium tuberculosis H37Rv
ucgaacgugaacggcuggaguc

SEQ ID NO: 153612 - RNA, 22 nt, Mycobacterium tuberculosis H37Rv
ugcccagcgauuucgaccgugc

SEQ ID NO: 153613 - RNA, 22 nt, Mycobacterium tuberculosis H37Rv
ucgucaccgcgggcaccggggu

SEQ ID NO: 153614 - RNA, 22 nt, Mycobacterium tuberculosis H37Rv
ucaugcggcccgagccagacga

SEQ ID NO: 153615 - RNA, 22 nt, Mycobacterium tuberculosis H37Rv
cgagcguaacgccaccgcgaaa

SEQ ID NO: 153616 - RNA, 22 nt, Mycobacterium tuberculosis H37Rv
augaucacggugugcggggucg

SEQ ID NO: 153617 - RNA, 21 nt, Mycobacterium tuberculosis H37Rv
agucccgagccgcuguugccg

SEQ ID NO: 153618 - RNA, 22 nt, Mycobacterium tuberculosis H37Rv
gccagccagcgagcaugccggg

SEQ ID NO: 153619 - RNA, 22 nt, Mycobacterium tuberculosis H37Rv
cgguuccgucguaggcguccac

SEQ ID NO: 153620 - RNA, 22 nt, Mycobacterium tuberculosis H37Rv
cggucgcugaugcuggauguga

SEQ ID NO: 153621 - RNA, 22 nt, Mycobacterium tuberculosis H37Rv
gaucgcugauggcgucggccag

SEQ ID NO: 153622 - RNA, 18 nt, Mycobacterium tuberculosis H37Rv
ugcuggagaucccgacga

SEQ ID NO: 153623 - RNA, 22 nt, Mycobacterium tuberculosis H37Rv
cgaagaacugguugccgucgac

SEQ ID NO: 153624 - RNA, 22 nt, Mycobacterium tuberculosis H37Rv
agcagacgcaaaagcccccuaa

SEQ ID NO: 153625 - RNA, 17 nt, Mycobacterium tuberculosis H37Rv
agccgccuuggaccggc

SEQ ID NO: 153626 - RNA, 22 nt, Mycobacterium tuberculosis H37Rv
ucgaacaucggucgaaggucuc

SEQ ID NO: 153627 - RNA, 22 nt, Mycobacterium tuberculosis H37Rv
auuggccaugcgcgggcgccgu

SEQ ID NO: 153628 - RNA, 22 nt, Mycobacterium tuberculosis H37Rv
ucccgcugaccugcuguguuag

SEQ ID NO: 153629 - RNA, 22 nt, Mycobacterium tuberculosis H37Rv
acacgccuugguagccgcugac

SEQ ID NO: 153630 - RNA, 21 nt, Mycobacterium tuberculosis H37Rv
augucguccaccggcuuaugg

SEQ ID NO: 153631 - RNA, 22 nt, Mycobacterium tuberculosis H37Rv
uccggacgcggucaugggcguu

SEQ ID NO: 153632 - RNA, 22 nt, Mycobacterium tuberculosis H37Rv
ugcgugcgguugcggagcuuca

SEQ ID NO: 153633 - RNA, 22 nt, Mycobacterium tuberculosis H37Rv
cggugaccgcgacccgcgcggu

SEQ ID NO: 153634 - RNA, 22 nt, Mycobacterium tuberculosis H37Rv
cgucuggugcagggauucuucg

SEQ ID NO: 153635 - RNA, 22 nt, Mycobacterium tuberculosis H37Rv
augacgccgagguguugcucga

SEQ ID NO: 153636 - RNA, 22 nt, Mycobacterium tuberculosis H37Rv
cggcaaugugggcguugccggc

SEQ ID NO: 153637 - RNA, 22 nt, Mycobacterium tuberculosis H37Rv
gacaccgaacgaaacgucggga

SEQ ID NO: 153638 - RNA, 22 nt, Mycobacterium tuberculosis H37Rv
uaaugcgauucugcgucugcuu

SEQ ID NO: 153639 - RNA, 22 nt, Mycobacterium tuberculosis H37Rv
ugaccucguugaaacgagucga

SEQ ID NO: 153640 - RNA, 22 nt, Mycobacterium tuberculosis H37Rv
agccgcagcuugucgauguccu

SEQ ID NO: 153641 - RNA, 22 nt, Mycobacterium tuberculosis H37Rv
ucgaucccgaccgcgagguguu

SEQ ID NO: 153642 - RNA, 22 nt, Mycobacterium tuberculosis H37Rv
uggugcagcuugagcugcgggc

SEQ ID NO: 153643 - RNA, 22 nt, Mycobacterium tuberculosis H37Rv
caccuggccguaccccgaaauc

SEQ ID NO: 153644 - RNA, 22 nt, Mycobacterium tuberculosis H37Rv
uugagcucggugagguugcgca

SEQ ID NO: 153645 - RNA, 22 nt, Mycobacterium tuberculosis H37Rv
aacucgucgaaccgcagcgcgu

SEQ ID NO: 153646 - RNA, 22 nt, Mycobacterium tuberculosis H37Rv
accgauggaucacgguaccgcc

SEQ ID NO: 153647 - RNA, 22 nt, Mycobacterium tuberculosis H37Rv
cggugcacaccaucgcccagua

SEQ ID NO: 153648 - RNA, 22 nt, Mycobacterium tuberculosis H37Rv
gccgaacgugcaaccauggcgg

SEQ ID NO: 153649 - RNA, 20 nt, Mycobacterium tuberculosis H37Rv
aacggcaacacgucgucgcg

SEQ ID NO: 153650 - RNA, 22 nt, Mycobacterium tuberculosis H37Rv
cgagcgugcacugagggcgaga

SEQ ID NO: 153651 - RNA, 22 nt, Mycobacterium tuberculosis H37Rv
ucggcuccguacuugccgugcu

SEQ ID NO: 153652 - RNA, 22 nt, Mycobacterium tuberculosis H37Rv
gccguacgucuucgaugcugac

SEQ ID NO: 153653 - RNA, 22 nt, Mycobacterium tuberculosis H37Rv
aucccgagggacacaucugugc

SEQ ID NO: 153654 - RNA, 22 nt, Mycobacterium tuberculosis H37Rv
aagcagacgcagaaucgcacaa

SEQ ID NO: 153655 - RNA, 23 nt, Mycobacterium tuberculosis H37Rv
ccacucuggagauucucgcugag

SEQ ID NO: 153656 - RNA, 22 nt, Mycobacterium tuberculosis H37Rv
ugaccgaugagcaggcgaucac

SEQ ID NO: 153657 - RNA, 22 nt, Mycobacterium tuberculosis H37Rv
ucgucguuguguacgaggucau

SEQ ID NO: 153658 - RNA, 22 nt, Mycobacterium tuberculosis H37Rv
acggguaguugcgagcgccgcg

SEQ ID NO: 153659 - RNA, 22 nt, Mycobacterium tuberculosis H37Rv
ugccagccgccgacgagcagca

SEQ ID NO: 153660 - RNA, 20 nt, Mycobacterium tuberculosis H37Rv
acgugaccagaucaccgacc

SEQ ID NO: 153661 - RNA, 22 nt, Mycobacterium tuberculosis H37Rv
ucuuuauggcgugccgucguga

SEQ ID NO: 153662 - RNA, 22 nt, Mycobacterium tuberculosis H37Rv
accgcgcuguuucggcugcucg

SEQ ID NO: 153663 - RNA, 22 nt, Mycobacterium tuberculosis H37Rv
ccgaucaaugggcgcccgguca

SEQ ID NO: 153664 - RNA, 22 nt, Mycobacterium tuberculosis H37Rv
aggucgaugacucguuggccgc

SEQ ID NO: 153665 - RNA, 22 nt, Mycobacterium tuberculosis H37Rv
uguaaccgaccgacgugccccg

SEQ ID NO: 153666 - RNA, 22 nt, Mycobacterium tuberculosis H37Rv
gacgucaagacgccggcgggca

SEQ ID NO: 153667 - RNA, 21 nt, Mycobacterium tuberculosis H37Rv
ugacggugacgaugugcacgc

SEQ ID NO: 153668 - RNA, 22 nt, Mycobacterium tuberculosis H37Rv
ccgacugugaaucucacgacgc

SEQ ID NO: 153669 - RNA, 22 nt, Mycobacterium tuberculosis H37Rv
guugacucugcguccaccaggc

SEQ ID NO: 153670 - RNA, 22 nt, Mycobacterium tuberculosis H37Rv
caggguggugagaaugacgccc

SEQ ID NO: 153671 - RNA, 22 nt, Mycobacterium tuberculosis H37Rv
guucgaaaaccacacugccguu

SEQ ID NO: 153672 - RNA, 22 nt, Mycobacterium tuberculosis H37Rv
cgccugcucccagcgcggcuau

SEQ ID NO: 153673 - RNA, 22 nt, Mycobacterium tuberculosis H37Rv
gucggucuucaaggcgaccacg

SEQ ID NO: 153674 - RNA, 22 nt, Mycobacterium tuberculosis H37Rv
ugagcgcggaucauggcgccau

SEQ ID NO: 153675 - RNA, 22 nt, Mycobacterium tuberculosis H37Rv
uuugccgaccgcggcaucagcu

SEQ ID NO: 153676 - RNA, 22 nt, Mycobacterium tuberculosis H37Rv
ggcaucuacugaacugcgccgu

SEQ ID NO: 153677 - RNA, 21 nt, Mycobacterium tuberculosis H37Rv
ggcaccuaccgacaggacgua

SEQ ID NO: 153678 - RNA, 22 nt, Mycobacterium tuberculosis H37Rv
aacggccuggcggccgcgucga

SEQ ID NO: 153679 - RNA, 22 nt, Mycobacterium tuberculosis H37Rv
cccguuaccgaucagcggacgg

SEQ ID NO: 153680 - RNA, 22 nt, Mycobacterium tuberculosis H37Rv
ucugggcaguagccagcaugcc

SEQ ID NO: 153681 - RNA, 22 nt, Mycobacterium tuberculosis H37Rv
ggucaaccaggacggccgaucc

SEQ ID NO: 153682 - RNA, 22 nt, Mycobacterium tuberculosis H37Rv
agcugcgacgggccgggcugga

SEQ ID NO: 153683 - RNA, 22 nt, Mycobacterium tuberculosis H37Rv
gcccguucgaucgucggcaucg

SEQ ID NO: 153684 - RNA, 22 nt, Mycobacterium tuberculosis H37Rv
auccgcgcgacgaacuugucga

SEQ ID NO: 153685 - RNA, 22 nt, Mycobacterium tuberculosis H37Rv
guugaagcuggaaaucuggccg

SEQ ID NO: 153686 - RNA, 22 nt, Mycobacterium tuberculosis H37Rv
ccugggugccgaucgagccggu

SEQ ID NO: 153687 - RNA, 23 nt, Mycobacterium tuberculosis H37Rv
gcacaucgaccacccguccgagg

SEQ ID NO: 153688 - RNA, 22 nt, Mycobacterium tuberculosis H37Rv
ccguaacgcgugcacuucggcg

SEQ ID NO: 153689 - RNA, 22 nt, Mycobacterium tuberculosis H37Rv
gccgauggaccgccuggaugac

SEQ ID NO: 153690 - RNA, 21 nt, Mycobacterium tuberculosis H37Rv
caucuugaucaccccggcgac

SEQ ID NO: 153691 - RNA, 22 nt, Mycobacterium tuberculosis H37Rv
ugaucgcuaggugcucgccggc

SEQ ID NO: 153692 - RNA, 22 nt, Mycobacterium tuberculosis H37Rv
ugacagcgcugauccugguguu

SEQ ID NO: 153693 - RNA, 22 nt, Mycobacterium tuberculosis H37Rv
ucgcagugccguuacguucgug

SEQ ID NO: 153694 - RNA, 22 nt, Mycobacterium tuberculosis H37Rv
ugcaccgucgccgaccaucacu

SEQ ID NO: 153695 - RNA, 22 nt, Mycobacterium tuberculosis H37Rv
ccgccgauagugaauucggcgc

SEQ ID NO: 153696 - RNA, 22 nt, Mycobacterium tuberculosis H37Rv
ugggcugcugcgccgcaucggc

SEQ ID NO: 153697 - RNA, 22 nt, Mycobacterium tuberculosis H37Rv
caacgcaucagugccggcgccg

SEQ ID NO: 153698 - RNA, 21 nt, Mycobacterium tuberculosis H37Rv
ucgucgagguaacgcaugcgc

SEQ ID NO: 153699 - RNA, 22 nt, Mycobacterium tuberculosis H37Rv
cggucaccaucucgcagacaua

SEQ ID NO: 153700 - RNA, 22 nt, Mycobacterium tuberculosis H37Rv
cuccggugccggcaguagucgg

SEQ ID NO: 153701 - RNA, 22 nt, Mycobacterium tuberculosis H37Rv
uguccgauguggcggcggcggg

SEQ ID NO: 153702 - RNA, 22 nt, Mycobacterium tuberculosis H37Rv
uaucugcuggccagucccgacg

SEQ ID NO: 153703 - RNA, 16 nt, Mycobacterium tuberculosis H37Rv
ccucaccggccaggcg

SEQ ID NO: 153704 - RNA, 22 nt, Mycobacterium tuberculosis H37Rv
guggucgagguggcgugugccg

SEQ ID NO: 153705 - RNA, 22 nt, Mycobacterium tuberculosis H37Rv
gcucuaccacguccugcacgcg

SEQ ID NO: 153706 - RNA, 22 nt, Mycobacterium tuberculosis H37Rv
uugaugauggucggcgccgaca

SEQ ID NO: 153707 - RNA, 22 nt, Mycobacterium tuberculosis H37Rv
ucaaccgguauugguggcggcu

SEQ ID NO: 153708 - RNA, 22 nt, Mycobacterium tuberculosis H37Rv
cgagcagacgcaaaagccaccg

SEQ ID NO: 153709 - RNA, 22 nt, Mycobacterium tuberculosis H37Rv
ccgaggagcuggucgcgcugcu

SEQ ID NO: 153710 - RNA, 22 nt, Mycobacterium tuberculosis H37Rv
acuugccggcgccguuagcccc

SEQ ID NO: 153711 - RNA, 22 nt, Mycobacterium tuberculosis H37Rv
uaccgcgugcguggccgccaac

SEQ ID NO: 153712 - RNA, 22 nt, Mycobacterium tuberculosis H37Rv
ggcggucaccgauugggagagg

SEQ ID NO: 153713 - RNA, 22 nt, Mycobacterium tuberculosis H37Rv
uucgggcgauuuugcgucugcu

SEQ ID NO: 153714 - RNA, 22 nt, Mycobacterium tuberculosis H37Rv
cugcuggccagcguugcgcugu

SEQ ID NO: 153715 - RNA, 22 nt, Mycobacterium tuberculosis H37Rv
ccgccgauagugaauucggcga

SEQ ID NO: 153716 - RNA, 22 nt, Mycobacterium tuberculosis H37Rv
gagcagacgcaaaagcacccca

SEQ ID NO: 153717 - RNA, 20 nt, Mycobacterium tuberculosis H37Rv
ugguggacgcagagucagcg

SEQ ID NO: 153718 - RNA, 22 nt, Mycobacterium tuberculosis H37Rv
uccgucaaacguugaaucgacu

SEQ ID NO: 153719 - RNA, 22 nt, Mycobacterium tuberculosis H37Rv
auugggcgauucugcgucugcu

SEQ ID NO: 153720 - RNA, 22 nt, Mycobacterium tuberculosis H37Rv
ugcucgaccaaugcgacgcggc

SEQ ID NO: 153721 - RNA, 22 nt, Mycobacterium tuberculosis H37Rv
auggguuagguuuggcggccgc

SEQ ID NO: 153722 - RNA, 20 nt, Mycobacterium tuberculosis H37Rv
agguacucgcagacgcgguc

SEQ ID NO: 153723 - RNA, 22 nt, Mycobacterium tuberculosis H37Rv
agcagacgcaaaaucgcccaaa

SEQ ID NO: 153724 - RNA, 22 nt, Mycobacterium tuberculosis H37Rv
aucgcguccugcgcggaaucgg

SEQ ID NO: 153725 - RNA, 22 nt, Mycobacterium tuberculosis H37Rv
gaguaggcgcaaaagaacauga

SEQ ID NO: 153726 - RNA, 22 nt, Mycobacterium tuberculosis H37Rv
ugcugugcaccgaugucgguuc

SEQ ID NO: 153727 - RNA, 22 nt, Mycobacterium tuberculosis H37Rv
gaccagguuggacagcaucgcc

SEQ ID NO: 153728 - RNA, 22 nt, Mycobacterium tuberculosis H37Rv
ggguccguuucccguggccgcc

SEQ ID NO: 153729 - RNA, 22 nt, Mycobacterium tuberculosis H37Rv
gucgccagauucacggucgcgc

SEQ ID NO: 153730 - RNA, 22 nt, Mycobacterium tuberculosis H37Rv
ugaaggugacccacccggcggc

SEQ ID NO: 153731 - RNA, 22 nt, Mycobacterium tuberculosis H37Rv
uuccgggaagguggugguggcg

SEQ ID NO: 153732 - RNA, 22 nt, Mycobacterium tuberculosis H37Rv
cgauccucgcaccgcucgccgc

SEQ ID NO: 153733 - RNA, 22 nt, Mycobacterium tuberculosis H37Rv
ccaugagcacccggauggccug

SEQ ID NO: 153734 - RNA, 22 nt, Mycobacterium tuberculosis H37Rv
gcgauucugcgucugcucgcgc

SEQ ID NO: 153735 - RNA, 23 nt, Mycobacterium tuberculosis H37Rv
cgccuagcccaccggcgccgauc

SEQ ID NO: 153736 - RNA, 22 nt, Mycobacterium tuberculosis H37Rv
ccgcaucggugucuuccgggcg

SEQ ID NO: 153737 - RNA, 22 nt, Mycobacterium tuberculosis H37Rv
cuggccgacggugucgccggug

SEQ ID NO: 153738 - RNA, 22 nt, Mycobacterium tuberculosis H37Rv
agccauggucgaccgcgccguc

SEQ ID NO: 153739 - RNA, 22 nt, Mycobacterium tuberculosis H37Rv
gcgauucugcgucugcucgccg

SEQ ID NO: 153740 - RNA, 19 nt, Mycobacterium tuberculosis H37Rv
aacaggcgggauucgccga

SEQ ID NO: 153741 - RNA, 22 nt, Mycobacterium tuberculosis H37Rv
ucggcgacuucugcgucugcuc

SEQ ID NO: 153742 - RNA, 22 nt, Mycobacterium tuberculosis H37Rv
aagaucguugauccccagugcu

SEQ ID NO: 153743 - RNA, 22 nt, Mycobacterium tuberculosis H37Rv
ucgcgagcagacgcagaaucgc

SEQ ID NO: 153744 - RNA, 22 nt, Mycobacterium tuberculosis H37Rv
gccgaauccagccaggagugug

SEQ ID NO: 153745 - RNA, 22 nt, Mycobacterium tuberculosis H37Rv
caucugcagcuggaccgccugg

SEQ ID NO: 153746 - RNA, 22 nt, Mycobacterium tuberculosis H37Rv
acggucgggcgccaucgacgcc

SEQ ID NO: 153747 - RNA, 22 nt, Mycobacterium tuberculosis H37Rv
uugugcgauucugcgucugcuu

SEQ ID NO: 153748 - RNA, 22 nt, Mycobacterium tuberculosis H37Rv
ccgcagguguucggcgaccaga

SEQ ID NO: 153749 - RNA, 22 nt, Mycobacterium tuberculosis H37Rv
cgccacgugccggugcucgacg

SEQ ID NO: 153750 - RNA, 22 nt, Mycobacterium tuberculosis H37Rv
uggcgaucgcggugguguccac

SEQ ID NO: 153751 - RNA, 21 nt, Mycobacterium tuberculosis H37Rv
augucacgcgguccugaucgc

SEQ ID NO: 153752 - RNA, 22 nt, Mycobacterium tuberculosis H37Rv
cgguggaugcggugcucgccgg

SEQ ID NO: 153753 - RNA, 22 nt, Mycobacterium tuberculosis H37Rv
aagcucgauggauccagcggcc

SEQ ID NO: 153754 - RNA, 22 nt, Mycobacterium tuberculosis H37Rv
gcgucgauugccuccgccucgg

SEQ ID NO: 153755 - RNA, 22 nt, Mycobacterium tuberculosis H37Rv
gcggcaguucgccaguggcgag

SEQ ID NO: 153756 - RNA, 18 nt, Mycobacterium tuberculosis H37Rv
uugcgggccaucgcgucc

SEQ ID NO: 153757 - RNA, 22 nt, Mycobacterium tuberculosis H37Rv
aucaaggcgcuacuguucgggg

SEQ ID NO: 153758 - RNA, 23 nt, Mycobacterium tuberculosis H37Rv
aguccgggccgacguugccgcgc

SEQ ID NO: 153759 - RNA, 22 nt, Mycobacterium tuberculosis H37Rv
uuggcgaauccgugcgaguuga

SEQ ID NO: 153760 - RNA, 22 nt, Mycobacterium tuberculosis H37Rv
gacgaggccgucgccgcguugc

SEQ ID NO: 153761 - RNA, 22 nt, Mycobacterium tuberculosis H37Rv
ggaugcaccggccagcaugaag

SEQ ID NO: 153762 - RNA, 22 nt, Mycobacterium tuberculosis H37Rv
cggugaucacggucggcgggua

SEQ ID NO: 153763 - RNA, 22 nt, Mycobacterium tuberculosis H37Rv
gaaggaucuggcgucggcgggc

SEQ ID NO: 153764 - RNA, 19 nt, Mycobacterium tuberculosis H37Rv
ggugagcagggucucgcgc

SEQ ID NO: 153765 - RNA, 22 nt, Mycobacterium tuberculosis H37Rv
aucagcagcgugguugccgcgu

SEQ ID NO: 153766 - RNA, 22 nt, Mycobacterium tuberculosis H37Rv
gucaucgccgccgagcuuggcc

SEQ ID NO: 153767 - RNA, 22 nt, Mycobacterium tuberculosis H37Rv
gagcagacgcaaaagcccccaa

SEQ ID NO: 153768 - RNA, 19 nt, Mycobacterium tuberculosis H37Rv
aucgcggcucggccuaccg

SEQ ID NO: 153769 - RNA, 22 nt, Mycobacterium tuberculosis H37Rv
ggcaggugcgcuaggucccggu

SEQ ID NO: 153770 - RNA, 22 nt, Mycobacterium tuberculosis H37Rv
gacagacgcaaaaucgcccgaa

SEQ ID NO: 153771 - RNA, 22 nt, Mycobacterium tuberculosis H37Rv
aauucgccguggcguuacgcuc

SEQ ID NO: 153772 - RNA, 22 nt, Mycobacterium tuberculosis H37Rv
ucgcgucgccagauucacaauc

SEQ ID NO: 153773 - RNA, 22 nt, Mycobacterium tuberculosis H37Rv
gccgagaaagucgaccugcgag

SEQ ID NO: 153774 - RNA, 22 nt, Mycobacterium tuberculosis H37Rv
cugggcgaugaagcgcuggguc

SEQ ID NO: 153775 - RNA, 23 nt, Mycobacterium tuberculosis H37Rv
ggcuggucguuggucugaugcuc

SEQ ID NO: 153776 - RNA, 22 nt, Mycobacterium tuberculosis H37Rv
caaccgcgacgcucaggccagc

SEQ ID NO: 153777 - RNA, 22 nt, Mycobacterium tuberculosis H37Rv
ccaguucgguauguuuggcggc

SEQ ID NO: 153778 - RNA, 22 nt, Mycobacterium tuberculosis H37Rv
gccgccuaugugccguaugugg

SEQ ID NO: 153779 - RNA, 22 nt, Mycobacterium tuberculosis H37Rv
gcgaguugguguuuccgcugca

SEQ ID NO: 153780 - RNA, 22 nt, Mycobacterium tuberculosis H37Rv
auucagguguugagaaaaugua

SEQ ID NO: 153781 - RNA, 22 nt, Mycobacterium tuberculosis H37Rv
uugcgcaggggcaugucagcgu

SEQ ID NO: 153782 - RNA, 22 nt, Mycobacterium tuberculosis H37Rv
gaggucgaugcgcgucggguag

SEQ ID NO: 153783 - RNA, 22 nt, Mycobacterium tuberculosis H37Rv
gccacugugaauggcacgacgc

SEQ ID NO: 153784 - RNA, 22 nt, Mycobacterium tuberculosis H37Rv
ucgcaccgcggucauuuucacc

SEQ ID NO: 153785 - RNA, 22 nt, Mycobacterium tuberculosis H37Rv
ugcgagcgugcgggugcucguc

SEQ ID NO: 153786 - RNA, 22 nt, Mycobacterium tuberculosis H37Rv
guacgcggagaucccggcgggg

SEQ ID NO: 153787 - RNA, 22 nt, Mycobacterium tuberculosis H37Rv
uaaccgcauacgaugucgcugc

SEQ ID NO: 153788 - RNA, 22 nt, Mycobacterium tuberculosis H37Rv
acccgucgauguucgagccggu

SEQ ID NO: 153789 - RNA, 22 nt, Mycobacterium tuberculosis H37Rv
gaagucggucaccacagugccg

SEQ ID NO: 153790 - RNA, 22 nt, Mycobacterium tuberculosis H37Rv
gaaggcaccagagagaucaccu

SEQ ID NO: 153791 - RNA, 22 nt, Mycobacterium tuberculosis H37Rv
aaucucgcccccagugcacgcu

SEQ ID NO: 153792 - RNA, 22 nt, Mycobacterium tuberculosis H37Rv
auucggcuucggcucgcugguu

SEQ ID NO: 153793 - RNA, 22 nt, Mycobacterium tuberculosis H37Rv
cgagcguaacgccacugcgauu

SEQ ID NO: 153794 - RNA, 22 nt, Mycobacterium tuberculosis H37Rv
acaggucgccccagacgcgcuc

SEQ ID NO: 153795 - RNA, 22 nt, Mycobacterium tuberculosis H37Rv
ugaccagcagugcggccacggc

SEQ ID NO: 153796 - RNA, 22 nt, Mycobacterium tuberculosis H37Rv
gugucggcggcaacgccgugcu

SEQ ID NO: 153797 - RNA, 22 nt, Mycobacterium tuberculosis H37Rv
cacgucggugaccagaugaucg

SEQ ID NO: 153798 - RNA, 21 nt, Mycobacterium tuberculosis H37Rv
ugggcgauuuugcgucugcuc

SEQ ID NO: 153799 - RNA, 21 nt, Mycobacterium tuberculosis H37Rv
agcaaugcgcguucggucggc

SEQ ID NO: 153800 - RNA, 22 nt, Mycobacterium tuberculosis H37Rv
aacgcgcgccccgcuuugucaa

SEQ ID NO: 153801 - RNA, 22 nt, Mycobacterium tuberculosis H37Rv
aagaccucacggcgcucggcca

SEQ ID NO: 153802 - RNA, 22 nt, Mycobacterium tuberculosis H37Rv
cucgaguggucugggcucgacc

SEQ ID NO: 153803 - RNA, 20 nt, Mycobacterium tuberculosis H37Rv
ucuggcccgagcccaugaug

SEQ ID NO: 153804 - RNA, 22 nt, Mycobacterium tuberculosis H37Rv
aucgaguugaugcgccaucgcg

SEQ ID NO: 153805 - RNA, 22 nt, Mycobacterium tuberculosis H37Rv
gguccgugcgucgaucgccgcg

SEQ ID NO: 153806 - RNA, 22 nt, Mycobacterium tuberculosis H37Rv
ccaucagcaccgucgugccggu

SEQ ID NO: 153807 - RNA, 22 nt, Mycobacterium tuberculosis H37Rv
guaccgcuggcaugcgcaacag

SEQ ID NO: 153808 - RNA, 22 nt, Mycobacterium tuberculosis H37Rv
accggccacaggcugugcuggu

SEQ ID NO: 153809 - RNA, 23 nt, Mycobacterium tuberculosis H37Rv
cgucucgguaugggagcugcucc

SEQ ID NO: 153810 - RNA, 22 nt, Mycobacterium tuberculosis H37Rv
ccgacgacguugaccaagaauu

SEQ ID NO: 153811 - RNA, 22 nt, Mycobacterium tuberculosis H37Rv
gaccucaucggccaucgcugcg

SEQ ID NO: 153812 - RNA, 22 nt, Mycobacterium tuberculosis H37Rv
aggcacacgccagacggcgccc

SEQ ID NO: 153813 - RNA, 22 nt, Mycobacterium tuberculosis H37Rv
ccaccgauugugucgaugcgca

SEQ ID NO: 153814 - RNA, 22 nt, Mycobacterium tuberculosis H37Rv
uucgccgccgagaucggugcgg

SEQ ID NO: 153815 - RNA, 22 nt, Mycobacterium tuberculosis H37Rv
aacgcgguugcgacugcugguc

SEQ ID NO: 153816 - RNA, 22 nt, Mycobacterium tuberculosis H37Rv
gguccucugauccgcaccgcau

SEQ ID NO: 153817 - RNA, 22 nt, Mycobacterium tuberculosis H37Rv
gcggacgucgaugucgagcugu

SEQ ID NO: 153818 - RNA, 22 nt, Mycobacterium tuberculosis H37Rv
uaccugggguucuugcugaucg

SEQ ID NO: 153819 - RNA, 23 nt, Mycobacterium tuberculosis H37Rv
caaucgguuugucggcgaggugg

SEQ ID NO: 153820 - RNA, 22 nt, Mycobacterium tuberculosis H37Rv
cgaguucggcaucacccgcaug

SEQ ID NO: 153821 - RNA, 22 nt, Mycobacterium tuberculosis H37Rv
ugugaucggguugcggaucgcc

SEQ ID NO: 153822 - RNA, 22 nt, Mycobacterium tuberculosis H37Rv
ugcagcgugucggguccgagcc

SEQ ID NO: 153823 - RNA, 22 nt, Mycobacterium tuberculosis H37Rv
cgagcaucugaacgccugggug

SEQ ID NO: 153824 - RNA, 22 nt, Mycobacterium tuberculosis H37Rv
uuucgcgugacugagcggucug

SEQ ID NO: 153825 - RNA, 22 nt, Mycobacterium tuberculosis H37Rv
aggccgaguucgucaugcagcu

SEQ ID NO: 153826 - RNA, 22 nt, Mycobacterium tuberculosis H37Rv
cacacguggccgaucgguuacu

SEQ ID NO: 153827 - RNA, 22 nt, Mycobacterium tuberculosis H37Rv
aucagcggggacuugguuucgg

SEQ ID NO: 153828 - RNA, 18 nt, Mycobacterium tuberculosis H37Rv
ccggcguucuggugcucg

SEQ ID NO: 153829 - RNA, 22 nt, Mycobacterium tuberculosis H37Rv
gagagcuucucgccgucgauau

SEQ ID NO: 153830 - RNA, 22 nt, Mycobacterium tuberculosis H37Rv
cgguacgguccgcaguugggug

SEQ ID NO: 153831 - RNA, 23 nt, Mycobacterium tuberculosis H37Rv
ucugguccagcggucaccguccc

SEQ ID NO: 153832 - RNA, 22 nt, Mycobacterium tuberculosis H37Rv
ccggugucacggugaucacguu

SEQ ID NO: 153833 - RNA, 22 nt, Mycobacterium tuberculosis H37Rv
ugcagcgcaaggauuuugguga

SEQ ID NO: 153834 - RNA, 19 nt, Mycobacterium tuberculosis H37Rv
uggacgguaccggucuucg

SEQ ID NO: 153835 - RNA, 22 nt, Mycobacterium tuberculosis H37Rv
aaggcuuuagggucgcugucau

SEQ ID NO: 153836 - RNA, 23 nt, Mycobacterium tuberculosis H37Rv
cgcacgcuuucuggacaccgggg

SEQ ID NO: 153837 - RNA, 22 nt, Mycobacterium tuberculosis H37Rv
gccgucuggaucugcgaacgga

SEQ ID NO: 153838 - RNA, 22 nt, Mycobacterium tuberculosis H37Rv
gcugaugcggugacgguggccg

SEQ ID NO: 153839 - RNA, 19 nt, Mycobacterium tuberculosis H37Rv
ucagcuguacucgaugaau

SEQ ID NO: 153840 - RNA, 22 nt, Mycobacterium tuberculosis H37Rv
uggaaccccaugacgcaggcgu

SEQ ID NO: 153841 - RNA, 22 nt, Mycobacterium tuberculosis H37Rv
gagcagacgcaaaagcccccau

SEQ ID NO: 153842 - RNA, 22 nt, Mycobacterium tuberculosis H37Rv
gccaacuguguaaugguugccc

SEQ ID NO: 153843 - RNA, 22 nt, Mycobacterium tuberculosis H37Rv
gcugacaucgucgaacaccagg

SEQ ID NO: 153844 - RNA, 22 nt, Mycobacterium tuberculosis H37Rv
uggccgaugugaugcgcaucgc

SEQ ID NO: 153845 - RNA, 22 nt, Mycobacterium tuberculosis H37Rv
gaugcgauuccgcgucugcucg

SEQ ID NO: 153846 - RNA, 22 nt, Mycobacterium tuberculosis H37Rv
acuguuggccgcggagguauuc

SEQ ID NO: 153847 - RNA, 21 nt, Mycobacterium tuberculosis H37Rv
ucgucggcuucccgguccaau

SEQ ID NO: 153848 - RNA, 22 nt, Mycobacterium tuberculosis H37Rv
cagacgcaaaaucgcccaauuc

SEQ ID NO: 153849 - RNA, 22 nt, Mycobacterium tuberculosis H37Rv
ucagcuaccaaggcaacgacau

SEQ ID NO: 153850 - RNA, 22 nt, Mycobacterium tuberculosis H37Rv
ucgggcaucucgcguucggcuc

SEQ ID NO: 153851 - RNA, 22 nt, Mycobacterium tuberculosis H37Rv
uggcgcugcaguacuuucacgc

SEQ ID NO: 153852 - RNA, 22 nt, Mycobacterium tuberculosis H37Rv
ucgucgacgugcugcgggaguc

SEQ ID NO: 153853 - RNA, 22 nt, Mycobacterium tuberculosis H37Rv
augucguuaugagaacaucgcc

SEQ ID NO: 153854 - RNA, 23 nt, Mycobacterium tuberculosis H37Rv
gaggcgcuggcagcggcccgguu

SEQ ID NO: 153855 - RNA, 22 nt, Mycobacterium tuberculosis H37Rv
gaucggcgccagguccgaucgc

SEQ ID NO: 153856 - RNA, 22 nt, Mycobacterium tuberculosis H37Rv
aucgacggcgucguuggcgaac

SEQ ID NO: 153857 - RNA, 22 nt, Mycobacterium tuberculosis H37Rv
uuaggccuggccugcgccccga

SEQ ID NO: 153858 - RNA, 22 nt, Mycobacterium tuberculosis H37Rv
ugccgcauucuucagcucgucg

SEQ ID NO: 153859 - RNA, 22 nt, Mycobacterium tuberculosis H37Rv
caugcccgguagcucguugcgc

SEQ ID NO: 153860 - RNA, 22 nt, Mycobacterium tuberculosis H37Rv
cgaugacccgcaggcccagccc

SEQ ID NO: 153861 - RNA, 22 nt, Mycobacterium tuberculosis H37Rv
cgucguccuuuccgugggggua

SEQ ID NO: 153862 - RNA, 22 nt, Mycobacterium tuberculosis H37Rv
ugccgucacuggugucggccgg

SEQ ID NO: 153863 - RNA, 22 nt, Mycobacterium tuberculosis H37Rv
cgggcgaucaaagccagcaccu

SEQ ID NO: 153864 - RNA, 22 nt, Mycobacterium tuberculosis H37Rv
aacggucugcgguugccagucg

SEQ ID NO: 153865 - RNA, 22 nt, Mycobacterium tuberculosis H37Rv
gucguggacggcacgagcgcug

SEQ ID NO: 153866 - RNA, 18 nt, Mycobacterium tuberculosis H37Rv
acggguucuccggcggca

SEQ ID NO: 153867 - RNA, 22 nt, Mycobacterium tuberculosis H37Rv
cgagcagacgcaaaacccccuu

SEQ ID NO: 153868 - RNA, 22 nt, Mycobacterium tuberculosis H37Rv
ccacgacgagcucgugcugccg

SEQ ID NO: 153869 - RNA, 20 nt, Mycobacterium tuberculosis H37Rv
ugucuccggcgguguccauc

SEQ ID NO: 153870 - RNA, 22 nt, Mycobacterium tuberculosis H37Rv
ccugauggcgucgaucaccggc

SEQ ID NO: 153871 - RNA, 22 nt, Mycobacterium tuberculosis H37Rv
auguugaccgagaugccgccga

SEQ ID NO: 153872 - RNA, 22 nt, Mycobacterium tuberculosis H37Rv
agaugcgggcggcccuggcagc

SEQ ID NO: 153873 - RNA, 22 nt, Mycobacterium tuberculosis H37Rv
uucaaccgguccuggaugcuug

SEQ ID NO: 153874 - RNA, 22 nt, Mycobacterium tuberculosis H37Rv
gccuugcugggaucggucagcu

SEQ ID NO: 153875 - RNA, 22 nt, Mycobacterium tuberculosis H37Rv
uaggaacuggcuugugcccaau

SEQ ID NO: 153876 - RNA, 22 nt, Mycobacterium tuberculosis H37Rv
gcuucacaucauuuucuggaag

SEQ ID NO: 153877 - RNA, 22 nt, Mycobacterium tuberculosis H37Rv
ucagcgucgaugaccaugucga

SEQ ID NO: 153878 - RNA, 22 nt, Mycobacterium tuberculosis H37Rv
guucgccgagauccuccggcug

SEQ ID NO: 153879 - RNA, 22 nt, Mycobacterium tuberculosis H37Rv
ggucacagcagagcggccgucg

SEQ ID NO: 153880 - RNA, 22 nt, Mycobacterium tuberculosis H37Rv
ccagauacugcagggaaucggg

SEQ ID NO: 153881 - RNA, 21 nt, Mycobacterium tuberculosis H37Rv
gcgauucugcgucugcucgcc

SEQ ID NO: 153882 - RNA, 22 nt, Mycobacterium tuberculosis H37Rv
ucggccugucgcgcgaggugau

SEQ ID NO: 153883 - RNA, 22 nt, Mycobacterium tuberculosis H37Rv
aucgguguucgccgcgaccguu

SEQ ID NO: 153884 - RNA, 22 nt, Mycobacterium tuberculosis H37Rv
acacggcaaagaucaggaaugc

SEQ ID NO: 153885 - RNA, 22 nt, Mycobacterium tuberculosis H37Rv
ggcguuccacgaccggcgcggc

SEQ ID NO: 153886 - RNA, 22 nt, Mycobacterium tuberculosis H37Rv
cucgcgaucuggauggccggug

SEQ ID NO: 153887 - RNA, 22 nt, Mycobacterium tuberculosis H37Rv
cauccgcacggugcugauccca

SEQ ID NO: 153888 - RNA, 22 nt, Mycobacterium tuberculosis H37Rv
cggacguggaaaauguggucgu

SEQ ID NO: 153889 - RNA, 22 nt, Mycobacterium tuberculosis H37Rv
acccgguguuugcgggccugau

SEQ ID NO: 153890 - RNA, 22 nt, Mycobacterium tuberculosis H37Rv
ccagcucaucgccguagcugag

SEQ ID NO: 153891 - RNA, 20 nt, Mycobacterium tuberculosis H37Rv
aacggucgcuacagcauugc

SEQ ID NO: 153892 - RNA, 22 nt, Mycobacterium tuberculosis H37Rv
acgcucguggaaccgggucggc

SEQ ID NO: 153893 - RNA, 22 nt, Mycobacterium tuberculosis H37Rv
acccugaugaaaugcaugccgc

SEQ ID NO: 153894 - RNA, 22 nt, Mycobacterium tuberculosis H37Rv
accaucuuggccgaaccgcugc

SEQ ID NO: 153895 - RNA, 22 nt, Mycobacterium tuberculosis H37Rv
accgaacgauccacgcgauggc

SEQ ID NO: 153896 - RNA, 22 nt, Mycobacterium tuberculosis H37Rv
aucaaugccgauccccggacgg

SEQ ID NO: 153897 - RNA, 22 nt, Mycobacterium tuberculosis H37Rv
uugggcagcgcgccgccguuga

SEQ ID NO: 153898 - RNA, 22 nt, Mycobacterium tuberculosis H37Rv
ggucagcacgcaugugcggugg

SEQ ID NO: 153899 - RNA, 22 nt, Mycobacterium tuberculosis H37Rv
gacgcucuggccacuaaguugu

SEQ ID NO: 153900 - RNA, 22 nt, Mycobacterium tuberculosis H37Rv
agcgcggugcgcuccaagguaa

SEQ ID NO: 153901 - RNA, 22 nt, Mycobacterium tuberculosis H37Rv
uuucgccgugacguuacgcugg

SEQ ID NO: 153902 - RNA, 22 nt, Mycobacterium tuberculosis H37Rv
ccguucgccgacauggguuuug

SEQ ID NO: 153903 - RNA, 22 nt, Mycobacterium tuberculosis H37Rv
gcugucaacggggguagcgcug

SEQ ID NO: 153904 - RNA, 22 nt, Mycobacterium tuberculosis H37Rv
uccaacuccaagaugccgcccc

SEQ ID NO: 153905 - RNA, 22 nt, Mycobacterium tuberculosis H37Rv
uagccgacaucgccggcgccuu

SEQ ID NO: 153906 - RNA, 22 nt, Mycobacterium tuberculosis H37Rv
accgcggacgucuacgccgucc

SEQ ID NO: 153907 - RNA, 22 nt, Mycobacterium tuberculosis H37Rv
aggcuucagcggggggcuuauc

SEQ ID NO: 153908 - RNA, 22 nt, Mycobacterium tuberculosis H37Rv
guuccgguguccgguuggucga

SEQ ID NO: 153909 - RNA, 22 nt, Mycobacterium tuberculosis H37Rv
ucggugacagcugcguggugcu

SEQ ID NO: 153910 - RNA, 22 nt, Mycobacterium tuberculosis H37Rv
ucgaccgguacgacgcugcuga

SEQ ID NO: 153911 - RNA, 22 nt, Mycobacterium tuberculosis H37Rv
ugaacgggugcguugaucgcau

SEQ ID NO: 153912 - RNA, 22 nt, Mycobacterium tuberculosis H37Rv
guacgugcugggcaccgagcgc

SEQ ID NO: 153913 - RNA, 22 nt, Mycobacterium tuberculosis H37Rv
gcacggguucguugcugugcau

SEQ ID NO: 153914 - RNA, 22 nt, Mycobacterium tuberculosis H37Rv
ggucggauucgaggcagccggc

SEQ ID NO: 153915 - RNA, 22 nt, Mycobacterium tuberculosis H37Rv
gguggacgcagagucaacagau

SEQ ID NO: 153916 - RNA, 22 nt, Mycobacterium tuberculosis H37Rv
ucccgacguuucguucgguguc

SEQ ID NO: 153917 - RNA, 22 nt, Mycobacterium tuberculosis H37Rv
ucggcgaaccccgcggccggca

SEQ ID NO: 153918 - RNA, 22 nt, Mycobacterium tuberculosis H37Rv
ggugaacaccgacagcaccaac

SEQ ID NO: 153919 - RNA, 22 nt, Mycobacterium tuberculosis H37Rv
ucgacaaaacgcgguauccgcc

SEQ ID NO: 153920 - RNA, 22 nt, Mycobacterium tuberculosis H37Rv
gagcggauuuuucgcaccggga

SEQ ID NO: 153921 - RNA, 22 nt, Mycobacterium tuberculosis H37Rv
accgguccccgaucaccguguc

SEQ ID NO: 153922 - RNA, 22 nt, Mycobacterium tuberculosis H37Rv
ugcagucaauggugucucgucg

SEQ ID NO: 153923 - RNA, 20 nt, Mycobacterium tuberculosis H37Rv
gucgcugcugcggcggucgc

SEQ ID NO: 153924 - RNA, 22 nt, Mycobacterium tuberculosis H37Rv
ucgucgcuggcgcgagucauag

SEQ ID NO: 153925 - RNA, 22 nt, Mycobacterium tuberculosis H37Rv
aucaucgaggccgucgggccgg

SEQ ID NO: 153926 - RNA, 22 nt, Mycobacterium tuberculosis H37Rv
gucuggacuucgacgucgcccc

SEQ ID NO: 153927 - RNA, 22 nt, Mycobacterium tuberculosis H37Rv
uggacgagcaucgcgagcacgc

SEQ ID NO: 153928 - RNA, 22 nt, Mycobacterium tuberculosis H37Rv
ccgcgaucuccuccucgcugag

SEQ ID NO: 153929 - RNA, 22 nt, Mycobacterium tuberculosis H37Rv
cgaucccgcggucgaacggcac

SEQ ID NO: 153930 - RNA, 22 nt, Mycobacterium tuberculosis H37Rv
ccgcgacugggaauccugcgac

SEQ ID NO: 153931 - RNA, 22 nt, Mycobacterium tuberculosis H37Rv
accaucgucaugcgcgccggag

SEQ ID NO: 153932 - RNA, 22 nt, Mycobacterium tuberculosis H37Rv
cuggcggucggugccgucgaug

SEQ ID NO: 153933 - RNA, 22 nt, Mycobacterium tuberculosis H37Rv
uugucgccgucucgguccagcu

SEQ ID NO: 153934 - RNA, 22 nt, Mycobacterium tuberculosis H37Rv
acgagauugccgucauggcugu

SEQ ID NO: 153935 - RNA, 22 nt, Mycobacterium tuberculosis H37Rv
agguccaggaauucggcgaccc

SEQ ID NO: 153936 - RNA, 22 nt, Mycobacterium tuberculosis H37Rv
cguagagcgugggguugccggc

SEQ ID NO: 153937 - RNA, 22 nt, Mycobacterium tuberculosis H37Rv
acggcaucuccaugggucauga

SEQ ID NO: 153938 - RNA, 22 nt, Mycobacterium tuberculosis H37Rv
gcguugaacugauaggugcggc

SEQ ID NO: 153939 - RNA, 23 nt, Mycobacterium tuberculosis H37Rv
acaacgagcguugcagaaucugc

SEQ ID NO: 153940 - RNA, 22 nt, Mycobacterium tuberculosis H37Rv
caagucgccaagaccggugacu

SEQ ID NO: 153941 - RNA, 22 nt, Mycobacterium tuberculosis H37Rv
caccgcguucggugugcggcgu

SEQ ID NO: 153942 - RNA, 22 nt, Mycobacterium tuberculosis H37Rv
uccgcgcaccacgaccgaaccg

SEQ ID NO: 153943 - RNA, 18 nt, Mycobacterium tuberculosis H37Rv
auugugcguggcuguccg

SEQ ID NO: 153944 - RNA, 22 nt, Mycobacterium tuberculosis H37Rv
cgguccuacgcgugcucgucga

SEQ ID NO: 153945 - RNA, 22 nt, Mycobacterium tuberculosis H37Rv
cuucgguaucgccuccgccuuu

SEQ ID NO: 153946 - RNA, 22 nt, Mycobacterium tuberculosis H37Rv
uugccugggccuggaucucguc

SEQ ID NO: 153947 - RNA, 22 nt, Mycobacterium tuberculosis H37Rv
aucgggucggcaauggccgccg

SEQ ID NO: 153948 - RNA, 22 nt, Mycobacterium tuberculosis H37Rv
gcggcguaccacccagcgcguc

SEQ ID NO: 153949 - RNA, 22 nt, Mycobacterium tuberculosis H37Rv
gcgucgugagauucacagucgg

SEQ ID NO: 153950 - RNA, 22 nt, Mycobacterium tuberculosis H37Rv
acgacgugaccggagcguccga

SEQ ID NO: 153951 - RNA, 22 nt, Mycobacterium tuberculosis H37Rv
aggaccguuucgauuuugacag

SEQ ID NO: 153952 - RNA, 22 nt, Mycobacterium tuberculosis H37Rv
gaugcgggugcagcacaccaac

SEQ ID NO: 153953 - RNA, 22 nt, Mycobacterium tuberculosis H37Rv
uacguugcaacccgagcgcuuc

SEQ ID NO: 153954 - RNA, 22 nt, Mycobacterium tuberculosis H37Rv
cgucgauguugaacggagcggu

SEQ ID NO: 153955 - RNA, 22 nt, Mycobacterium tuberculosis H37Rv
gacgcguccgcugucggcgacc

SEQ ID NO: 153956 - RNA, 22 nt, Mycobacterium tuberculosis H37Rv
uaccggcggcaacggcgcugac

SEQ ID NO: 153957 - RNA, 22 nt, Mycobacterium tuberculosis H37Rv
ggcugauggccaacgaguuuua

SEQ ID NO: 153958 - RNA, 21 nt, Mycobacterium tuberculosis H37Rv
ucgaugugccggaaugcgccc

SEQ ID NO: 153959 - RNA, 22 nt, Mycobacterium tuberculosis H37Rv
cgaggaguagcgcaucccacga

SEQ ID NO: 153960 - RNA, 22 nt, Mycobacterium tuberculosis H37Rv
cuugcugguaugccgggccacc

SEQ ID NO: 153961 - RNA, 22 nt, Mycobacterium tuberculosis H37Rv
augcugcucggacccagcggcu

SEQ ID NO: 153962 - RNA, 22 nt, Mycobacterium tuberculosis H37Rv
gugcugcagcgcggugagggcc

SEQ ID NO: 153963 - RNA, 20 nt, Mycobacterium tuberculosis H37Rv
ucgcuguguggucaucgaca

SEQ ID NO: 153964 - RNA, 22 nt, Mycobacterium tuberculosis H37Rv
ucaucaccggaucgccgccgac

SEQ ID NO: 153965 - RNA, 22 nt, Mycobacterium tuberculosis H37Rv
uucaccggugcucuccgcgauc

SEQ ID NO: 153966 - RNA, 22 nt, Mycobacterium tuberculosis H37Rv
accgccagcaucaucgugcagc

SEQ ID NO: 153967 - RNA, 22 nt, Mycobacterium tuberculosis H37Rv
aaugggcgauuuugcgucugcu

SEQ ID NO: 153968 - RNA, 22 nt, Mycobacterium tuberculosis H37Rv
auggguucgaacguccaggugg

SEQ ID NO: 153969 - RNA, 22 nt, Mycobacterium tuberculosis H37Rv
ucgccagccguuggcguggaaa

SEQ ID NO: 153970 - RNA, 22 nt, Mycobacterium tuberculosis H37Rv
ggcggcaucgacuaucugguga

SEQ ID NO: 153971 - RNA, 22 nt, Mycobacterium tuberculosis H37Rv
gccgauuaucgagauggcgucg

SEQ ID NO: 153972 - RNA, 22 nt, Mycobacterium tuberculosis H37Rv
gagugugaaucccgcgacgccg

SEQ ID NO: 153973 - RNA, 22 nt, Mycobacterium tuberculosis H37Rv
gcgccgaacgugcccugguggc

SEQ ID NO: 153974 - RNA, 22 nt, Mycobacterium tuberculosis H37Rv
cguucgaucaccggcccgcugc

SEQ ID NO: 153975 - RNA, 22 nt, Mycobacterium tuberculosis H37Rv
gauggacaagccggacgucgac

SEQ ID NO: 153976 - RNA, 22 nt, Mycobacterium tuberculosis H37Rv
gcacuugcuuuguuaggagcgu

SEQ ID NO: 153977 - RNA, 22 nt, Mycobacterium tuberculosis H37Rv
uagcgcgcauugagacuuucaa

SEQ ID NO: 153978 - RNA, 22 nt, Mycobacterium tuberculosis H37Rv
ucgguuccaggaugugguggau

SEQ ID NO: 153979 - RNA, 22 nt, Mycobacterium tuberculosis H37Rv
gugauccgcagcaagguguaga

SEQ ID NO: 153980 - RNA, 22 nt, Mycobacterium tuberculosis H37Rv
gagcagacgcaaaagcccccga

SEQ ID NO: 153981 - RNA, 22 nt, Mycobacterium tuberculosis H37Rv
ugguggcaucacaguaggccuc

SEQ ID NO: 153982 - RNA, 22 nt, Mycobacterium tuberculosis H37Rv
gcgggaucgagaugcuccagca

SEQ ID NO: 153983 - RNA, 22 nt, Mycobacterium tuberculosis H37Rv
cgaugguuaccuguucgccuuc

SEQ ID NO: 153984 - RNA, 22 nt, Mycobacterium tuberculosis H37Rv
ugagcgauccggaaaccgacua

SEQ ID NO: 153985 - RNA, 22 nt, Mycobacterium tuberculosis H37Rv
acccguucgaccagggugucgg

SEQ ID NO: 153986 - RNA, 22 nt, Mycobacterium tuberculosis H37Rv
uaaccggacgugaccagaucac

SEQ ID NO: 153987 - RNA, 22 nt, Mycobacterium tuberculosis H37Rv
aucugcugggcuuugucgaugg

SEQ ID NO: 153988 - RNA, 22 nt, Mycobacterium tuberculosis H37Rv
gccgaacgugaacugacggcgg

SEQ ID NO: 153989 - RNA, 22 nt, Mycobacterium tuberculosis H37Rv
gauccgcugggacccaucauca

SEQ ID NO: 153990 - RNA, 22 nt, Mycobacterium tuberculosis H37Rv
cauugaaaccgaugaucaccgc

SEQ ID NO: 153991 - RNA, 20 nt, Mycobacterium tuberculosis H37Rv
gccugcagaacguugaucuc

SEQ ID NO: 153992 - RNA, 22 nt, Mycobacterium tuberculosis H37Rv
cuggcuugccuccugccgcgac

SEQ ID NO: 153993 - RNA, 22 nt, Mycobacterium tuberculosis H37Rv
gcggugcucaacgccucgguga

SEQ ID NO: 153994 - RNA, 22 nt, Mycobacterium tuberculosis H37Rv
gcgucgaggucuuccugauggg

SEQ ID NO: 153995 - RNA, 22 nt, Mycobacterium tuberculosis H37Rv
cgugaugguggccgugcagucg

SEQ ID NO: 153996 - RNA, 21 nt, Mycobacterium tuberculosis H37Rv
ugcggguaccacggcggcggc

SEQ ID NO: 153997 - RNA, 22 nt, Mycobacterium tuberculosis H37Rv
auucggcgcgcacccggucgag

SEQ ID NO: 153998 - RNA, 22 nt, Mycobacterium tuberculosis H37Rv
uuuccgacaucggugucaccgu

SEQ ID NO: 153999 - RNA, 22 nt, Mycobacterium tuberculosis H37Rv
cggaccaugguguuggccgguu

SEQ ID NO: 154000 - RNA, 22 nt, Mycobacterium tuberculosis H37Rv
uucgccgagcagacgcaaaagc

SEQ ID NO: 154001 - RNA, 22 nt, Mycobacterium tuberculosis H37Rv
aucccuugguaugucacgguuc

SEQ ID NO: 154002 - RNA, 22 nt, Mycobacterium tuberculosis H37Rv
ccaggugcuugccauggcaguu

SEQ ID NO: 154003 - RNA, 22 nt, Mycobacterium tuberculosis H37Rv
guccgggucagcuuguggcugu

SEQ ID NO: 154004 - RNA, 22 nt, Mycobacterium tuberculosis H37Rv
gucggucugaaaaugugcggcg

SEQ ID NO: 154005 - RNA, 22 nt, Mycobacterium tuberculosis H37Rv
uugccggacggcagcaccagca

SEQ ID NO: 154006 - RNA, 22 nt, Mycobacterium tuberculosis H37Rv
uggcugacgacgaccgucggcg

SEQ ID NO: 154007 - RNA, 22 nt, Mycobacterium tuberculosis H37Rv
gucauugcgucauuuccuucga

SEQ ID NO: 154008 - RNA, 23 nt, Mycobacterium tuberculosis H37Rv
ucgaaggaaaugacgcaaugacc

SEQ ID NO: 154009 - RNA, 22 nt, Mycobacterium tuberculosis H37Rv
gugcagcgagcgcacuggccgu

SEQ ID NO: 154010 - RNA, 22 nt, Mycobacterium tuberculosis H37Rv
gucggugaccgugcccggaggg

SEQ ID NO: 154011 - RNA, 22 nt, Mycobacterium tuberculosis H37Rv
cgccgaucccgaaccggcgcuc

SEQ ID NO: 154012 - RNA, 22 nt, Mycobacterium tuberculosis H37Rv
ugaccuugaucggugcgggucc

SEQ ID NO: 154013 - RNA, 22 nt, Mycobacterium tuberculosis H37Rv
ucgugcugucuugcuguuguaa

SEQ ID NO: 154014 - RNA, 22 nt, Mycobacterium tuberculosis H37Rv
aggccgugacgaucagguccgg

SEQ ID NO: 154015 - RNA, 22 nt, Mycobacterium tuberculosis H37Rv
cgaaaucgacauuagcgcggug

SEQ ID NO: 154016 - RNA, 20 nt, Mycobacterium tuberculosis H37Rv
ugcgauugugugucugcucg

SEQ ID NO: 154017 - RNA, 22 nt, Mycobacterium tuberculosis H37Rv
accgugauuguuccgcaccgac

SEQ ID NO: 154018 - RNA, 23 nt, Mycobacterium tuberculosis H37Rv
agggaugugguagccccggcgag

SEQ ID NO: 154019 - RNA, 22 nt, Mycobacterium tuberculosis H37Rv
cgauccacugaccgaguagcgc

SEQ ID NO: 154020 - RNA, 22 nt, Mycobacterium tuberculosis H37Rv
ugaucgaucaggaacuggccgc

SEQ ID NO: 154021 - RNA, 22 nt, Mycobacterium tuberculosis H37Rv
ugcgccgagaucgacguuagcg

SEQ ID NO: 154022 - RNA, 22 nt, Mycobacterium tuberculosis H37Rv
gcgugaacugagggcggaaaau

SEQ ID NO: 154023 - RNA, 22 nt, Mycobacterium tuberculosis H37Rv
gugugcgcgcggacagcuggau

SEQ ID NO: 154024 - RNA, 22 nt, Mycobacterium tuberculosis H37Rv
gcuccgguaaaccgauggccgc

SEQ ID NO: 154025 - RNA, 22 nt, Mycobacterium tuberculosis H37Rv
uuuccagcggcacgcauucggc

SEQ ID NO: 154026 - RNA, 22 nt, Mycobacterium tuberculosis H37Rv
ucgucgaggcugugccguccgg

SEQ ID NO: 154027 - RNA, 22 nt, Mycobacterium tuberculosis H37Rv
ccgacugugaaccgcgcgacgu

SEQ ID NO: 154028 - RNA, 22 nt, Mycobacterium tuberculosis H37Rv
acgugcugcgcggggcacccgg

SEQ ID NO: 154029 - RNA, 22 nt, Mycobacterium tuberculosis H37Rv
acgagcguaacggcacugcgaa

SEQ ID NO: 154030 - RNA, 22 nt, Mycobacterium tuberculosis H37Rv
guagugcauuucacagucggau

SEQ ID NO: 154031 - RNA, 22 nt, Mycobacterium tuberculosis H37Rv
agccggugaaucaacgcugaua

SEQ ID NO: 154032 - RNA, 22 nt, Mycobacterium tuberculosis H37Rv
auggcgaacgaugccggcgguc

SEQ ID NO: 154033 - RNA, 22 nt, Mycobacterium tuberculosis H37Rv
uugccggccaucugauagccgg

SEQ ID NO: 154034 - RNA, 22 nt, Mycobacterium tuberculosis H37Rv
cggcacuucgguuugaccgacc

SEQ ID NO: 154035 - RNA, 22 nt, Mycobacterium tuberculosis H37Rv
caagggcaucgaguugggcacc

SEQ ID NO: 154036 - RNA, 22 nt, Mycobacterium tuberculosis H37Rv
gccgaacgugaagccagggcga

SEQ ID NO: 154037 - RNA, 22 nt, Mycobacterium tuberculosis H37Rv
uggaagacgagcucgacgagau

SEQ ID NO: 154038 - RNA, 23 nt, Mycobacterium tuberculosis H37Rv
gcgaguugccgacgcaggcgacc

SEQ ID NO: 154039 - RNA, 22 nt, Mycobacterium tuberculosis H37Rv
ugaucucacccgaaguuguguc

SEQ ID NO: 154040 - RNA, 22 nt, Mycobacterium tuberculosis H37Rv
ccgaacgugcaaccacggcggc

SEQ ID NO: 154041 - RNA, 22 nt, Mycobacterium tuberculosis H37Rv
agguucagcgucgagucgagga

SEQ ID NO: 154042 - RNA, 22 nt, Mycobacterium tuberculosis H37Rv
gagaccacagcaccgaccgacu

SEQ ID NO: 154043 - RNA, 22 nt, Mycobacterium tuberculosis H37Rv
ccgguuguccagauacgacgug

SEQ ID NO: 154044 - RNA, 22 nt, Mycobacterium tuberculosis H37Rv
uagcgcccggccacuggccaau

SEQ ID NO: 154045 - RNA, 22 nt, Mycobacterium tuberculosis H37Rv
uggagauuggagacgucggccg

SEQ ID NO: 154046 - RNA, 22 nt, Mycobacterium tuberculosis H37Rv
ucggccucccaugcggcgaucu

SEQ ID NO: 154047 - RNA, 22 nt, Mycobacterium tuberculosis H37Rv
gacgcgaaagaacaugaugggc

SEQ ID NO: 154048 - RNA, 22 nt, Mycobacterium tuberculosis H37Rv
agcgcggugauggccacccgcu

SEQ ID NO: 154049 - RNA, 22 nt, Mycobacterium tuberculosis H37Rv
aguccgagugccgcgaucgcgu

SEQ ID NO: 154050 - RNA, 22 nt, Mycobacterium tuberculosis H37Rv
ucgacaacgcgucgaaaggucg

SEQ ID NO: 154051 - RNA, 22 nt, Mycobacterium tuberculosis H37Rv
guucgcaggcgaugaccgcuac

SEQ ID NO: 154052 - RNA, 22 nt, Mycobacterium tuberculosis H37Rv
aauccgcuugcaccagugugca

SEQ ID NO: 154053 - RNA, 22 nt, Mycobacterium tuberculosis H37Rv
gucgcguugcaguucgaagagc

SEQ ID NO: 154054 - RNA, 22 nt, Mycobacterium tuberculosis H37Rv
acgcggucagcuucaggcauug

SEQ ID NO: 154055 - RNA, 22 nt, Mycobacterium tuberculosis H37Rv
acguguucggguugggcacccg

SEQ ID NO: 154056 - RNA, 22 nt, Mycobacterium tuberculosis H37Rv
gcgaauccgggucaccgugcac

SEQ ID NO: 154057 - RNA, 22 nt, Mycobacterium tuberculosis H37Rv
cugcugcuggccggccagcccg

SEQ ID NO: 154058 - RNA, 22 nt, Mycobacterium tuberculosis H37Rv
uccgugauggaacgucuggaga

SEQ ID NO: 154059 - RNA, 22 nt, Mycobacterium tuberculosis H37Rv
uguugacucugcguccaccgga

SEQ ID NO: 154060 - RNA, 21 nt, Mycobacterium tuberculosis H37Rv
cguggugcacgccaugcuggc

SEQ ID NO: 154061 - RNA, 18 nt, Mycobacterium tuberculosis H37Rv
gcgcugcugucgauuucg

SEQ ID NO: 154062 - RNA, 22 nt, Mycobacterium tuberculosis H37Rv
uagcggcgaagcgggccacgcu

SEQ ID NO: 154063 - RNA, 22 nt, Mycobacterium tuberculosis H37Rv
aucggcguagcagauaccgggu

SEQ ID NO: 154064 - RNA, 22 nt, Mycobacterium tuberculosis H37Rv
acgggugaacugcacgcggugu

SEQ ID NO: 154065 - RNA, 22 nt, Mycobacterium tuberculosis H37Rv
cgucggcacgcccaacgaggug

SEQ ID NO: 154066 - RNA, 22 nt, Mycobacterium tuberculosis H37Rv
cgaucucgccggagccgauucg

SEQ ID NO: 154067 - RNA, 22 nt, Mycobacterium tuberculosis H37Rv
ugcagcuagcaccggcggauuu

SEQ ID NO: 154068 - RNA, 22 nt, Mycobacterium tuberculosis H37Rv
cgcgaauguaacgccacugcga

SEQ ID NO: 154069 - RNA, 22 nt, Mycobacterium tuberculosis H37Rv
ucggcugacacguuccgcccgg

SEQ ID NO: 154070 - RNA, 19 nt, Mycobacterium tuberculosis H37Rv
cgaggucguaugccguccg

SEQ ID NO: 154071 - RNA, 18 nt, Mycobacterium tuberculosis H37Rv
ucgugggcgcgccgccaa

SEQ ID NO: 154072 - RNA, 22 nt, Mycobacterium tuberculosis H37Rv
ggugaccagucgagcaccguug

SEQ ID NO: 154073 - RNA, 22 nt, Mycobacterium tuberculosis H37Rv
ggauucgggucuuggugagccg

SEQ ID NO: 154074 - RNA, 22 nt, Mycobacterium tuberculosis H37Rv
gcgauccggauuccggggaaga

SEQ ID NO: 154075 - RNA, 20 nt, Mycobacterium tuberculosis H37Rv
cacucucggcucgauuuggc

SEQ ID NO: 154076 - RNA, 22 nt, Mycobacterium tuberculosis H37Rv
ugucgaucugcugauggugguc

SEQ ID NO: 154077 - RNA, 22 nt, Mycobacterium tuberculosis H37Rv
gaacgcgucggugggaucggug

SEQ ID NO: 154078 - RNA, 22 nt, Mycobacterium tuberculosis H37Rv
cggcauuggccagaccgguguu

SEQ ID NO: 154079 - RNA, 22 nt, Mycobacterium tuberculosis H37Rv
cgaggcauccaccgccgcaucg

SEQ ID NO: 154080 - RNA, 20 nt, Mycobacterium tuberculosis H37Rv
caucgguucucgggccagca

SEQ ID NO: 154081 - RNA, 22 nt, Mycobacterium tuberculosis H37Rv
agguagacgugucccgcauggg

SEQ ID NO: 154082 - RNA, 22 nt, Mycobacterium tuberculosis H37Rv
agucggcucccuucaucaauuc

SEQ ID NO: 154083 - RNA, 22 nt, Mycobacterium tuberculosis H37Rv
augaugggucugggcggagugc

SEQ ID NO: 154084 - RNA, 22 nt, Mycobacterium tuberculosis H37Rv
gcucgguuaucaguugauaaca

SEQ ID NO: 154085 - RNA, 22 nt, Mycobacterium tuberculosis H37Rv
gcguggacaagugcuugugcua

SEQ ID NO: 154086 - RNA, 22 nt, Mycobacterium tuberculosis H37Rv
caagggcauggccguuuugcuc

SEQ ID NO: 154087 - RNA, 20 nt, Mycobacterium tuberculosis H37Rv
ugugcaccuccaccggccag

SEQ ID NO: 154088 - RNA, 22 nt, Mycobacterium tuberculosis H37Rv
agcauggcgcauaccuuguccg

SEQ ID NO: 154089 - RNA, 22 nt, Mycobacterium tuberculosis H37Rv
ugcuggcccgagaaccgaugac

SEQ ID NO: 154090 - RNA, 22 nt, Mycobacterium tuberculosis H37Rv
ugcgacucugugucugcucgcc

SEQ ID NO: 154091 - RNA, 22 nt, Mycobacterium tuberculosis H37Rv
guaucggugacgcgcgaccgga

SEQ ID NO: 154092 - RNA, 22 nt, Mycobacterium tuberculosis H37Rv
acggucacucgcacauguucgu

SEQ ID NO: 154093 - RNA, 22 nt, Mycobacterium tuberculosis H37Rv
gaucguugauccagccggccag

SEQ ID NO: 154094 - RNA, 20 nt, Mycobacterium tuberculosis H37Rv
gugcgcaaccucaccgagcu

SEQ ID NO: 154095 - RNA, 22 nt, Mycobacterium tuberculosis H37Rv
ccgaucauuucggugauuccgg

SEQ ID NO: 154096 - RNA, 22 nt, Mycobacterium tuberculosis H37Rv
gcgguaguagaggucccgguag

SEQ ID NO: 154097 - RNA, 22 nt, Mycobacterium tuberculosis H37Rv
augaggcgauuuugcgucugcu

SEQ ID NO: 154098 - RNA, 22 nt, Mycobacterium tuberculosis H37Rv
ucuggucggggucgaucuccag

SEQ ID NO: 154099 - RNA, 22 nt, Mycobacterium tuberculosis H37Rv
ggcugaggccgccgaguuggcg

SEQ ID NO: 154100 - RNA, 23 nt, Mycobacterium tuberculosis H37Rv
uccagcccgacucauacccgcug

SEQ ID NO: 154101 - RNA, 21 nt, Mycobacterium tuberculosis H37Rv
ccggcucaccguuggccgggu

SEQ ID NO: 154102 - RNA, 22 nt, Mycobacterium tuberculosis H37Rv
ugcguuaucccacggcagauag

SEQ ID NO: 154103 - RNA, 21 nt, Mycobacterium tuberculosis H37Rv
aucgggauucagcagcagggu

SEQ ID NO: 154104 - RNA, 22 nt, Mycobacterium tuberculosis H37Rv
cagaccggcaggaacacgucag

SEQ ID NO: 154105 - RNA, 22 nt, Mycobacterium tuberculosis H37Rv
acgcgacgaauccacugcgcuu

SEQ ID NO: 154106 - RNA, 22 nt, Mycobacterium tuberculosis H37Rv
ucucccggugcaccgccaccaa

SEQ ID NO: 154107 - RNA, 22 nt, Mycobacterium tuberculosis H37Rv
ucaccugcccggucacaaucuc

SEQ ID NO: 154108 - RNA, 22 nt, Mycobacterium tuberculosis H37Rv
acggcccauuguggcggccguc

SEQ ID NO: 154109 - RNA, 22 nt, Mycobacterium tuberculosis H37Rv
ccgaacgugaacucacggcgga

SEQ ID NO: 154110 - RNA, 22 nt, Mycobacterium tuberculosis H37Rv
cgagcagacgcggaaucgcacc

SEQ ID NO: 154111 - RNA, 22 nt, Mycobacterium tuberculosis H37Rv
acgauguuccgccacgccgagc

SEQ ID NO: 154112 - RNA, 22 nt, Mycobacterium tuberculosis H37Rv
agucgcaaaagcccccgacacg

SEQ ID NO: 154113 - RNA, 22 nt, Mycobacterium tuberculosis H37Rv
uuggcgccggacacgucggcga

SEQ ID NO: 154114 - RNA, 22 nt, Mycobacterium tuberculosis H37Rv
cgccgagauccacgccagagcg

SEQ ID NO: 154115 - RNA, 22 nt, Mycobacterium tuberculosis H37Rv
gcaguucaacgagcccgucgac

SEQ ID NO: 154116 - RNA, 22 nt, Mycobacterium tuberculosis H37Rv
gucggucaccgacggcgccguc

SEQ ID NO: 154117 - RNA, 22 nt, Mycobacterium tuberculosis H37Rv
ugaugcauuccuuucacguuca

SEQ ID NO: 154118 - RNA, 22 nt, Mycobacterium tuberculosis H37Rv
gauggccugaugcuccgccuca

SEQ ID NO: 154119 - RNA, 22 nt, Mycobacterium tuberculosis H37Rv
cuacuucgacgucgaaccccgu

SEQ ID NO: 154120 - RNA, 22 nt, Mycobacterium tuberculosis H37Rv
aucgccugcuggggcgccaucu

SEQ ID NO: 154121 - RNA, 22 nt, Mycobacterium tuberculosis H37Rv
gacgccgaguaccgcgcgaugu

SEQ ID NO: 154122 - RNA, 22 nt, Mycobacterium tuberculosis H37Rv
uucucgcgcucgagugagcaga

SEQ ID NO: 154123 - RNA, 22 nt, Mycobacterium tuberculosis H37Rv
ucgaucucgccgucgcccgcca

SEQ ID NO: 154124 - RNA, 22 nt, Mycobacterium tuberculosis H37Rv
ugcucgaagggggaaagguguu

SEQ ID NO: 154125 - RNA, 22 nt, Mycobacterium tuberculosis H37Rv
uugcgaggugcgggccucggcc

SEQ ID NO: 154126 - RNA, 22 nt, Mycobacterium tuberculosis H37Rv
cgcaugcucguccggccugacg

SEQ ID NO: 154127 - RNA, 22 nt, Mycobacterium tuberculosis H37Rv
aaccgcuacaaaugaaguuggu

SEQ ID NO: 154128 - RNA, 22 nt, Mycobacterium tuberculosis H37Rv
cagcgugaacugagggcggaga

SEQ ID NO: 154129 - RNA, 22 nt, Mycobacterium tuberculosis H37Rv
ucgacgccgaacgucaacccga

SEQ ID NO: 154130 - RNA, 22 nt, Mycobacterium tuberculosis H37Rv
ucgaccgugacggcaggggcgu

SEQ ID NO: 154131 - RNA, 23 nt, Mycobacterium tuberculosis H37Rv
augggcgauuuugcgucugcucg

SEQ ID NO: 154132 - RNA, 22 nt, Mycobacterium tuberculosis H37Rv
aucgccuagccgcggcgggugg

SEQ ID NO: 154133 - RNA, 20 nt, Mycobacterium tuberculosis H37Rv
gcguggucggaugcaggcca

SEQ ID NO: 154134 - RNA, 22 nt, Mycobacterium tuberculosis H37Rv
uccguugcaacaccuucggaug

SEQ ID NO: 154135 - RNA, 22 nt, Mycobacterium tuberculosis H37Rv
gcuguccuguggcgcccgcagc

SEQ ID NO: 154136 - RNA, 23 nt, Mycobacterium tuberculosis H37Rv
ucauaccgaccaccuguccuagg

SEQ ID NO: 154137 - RNA, 22 nt, Mycobacterium tuberculosis H37Rv
uacgcggugaccguagccggau

SEQ ID NO: 154138 - RNA, 20 nt, Mycobacterium tuberculosis H37Rv
gcuaccggcauuauucagcc

SEQ ID NO: 154139 - RNA, 22 nt, Mycobacterium tuberculosis H37Rv
cgacgucccucucuauuggcaa

SEQ ID NO: 154140 - RNA, 22 nt, Mycobacterium tuberculosis H37Rv
cuggcgcuguugggacgcccgu

SEQ ID NO: 154141 - RNA, 22 nt, Mycobacterium tuberculosis H37Rv
gagcguaacgccacggcgagcu

SEQ ID NO: 154142 - RNA, 22 nt, Mycobacterium tuberculosis H37Rv
cuggcgauaucagacguucgac

SEQ ID NO: 154143 - RNA, 22 nt, Mycobacterium tuberculosis H37Rv
agcagacgcauaagcccccgca

SEQ ID NO: 154144 - RNA, 22 nt, Mycobacterium tuberculosis H37Rv
uacugcugcagcgucugccgca

SEQ ID NO: 154145 - RNA, 22 nt, Mycobacterium tuberculosis H37Rv
ugccagaacgugaugcuggggc

SEQ ID NO: 154146 - RNA, 22 nt, Mycobacterium tuberculosis H37Rv
acuucagcaccaccgacgcgaa

SEQ ID NO: 154147 - RNA, 22 nt, Mycobacterium tuberculosis H37Rv
ugcgccgaaugugcacuggugg

SEQ ID NO: 154148 - RNA, 22 nt, Mycobacterium tuberculosis H37Rv
gugcgucaccggaucaaagaca

SEQ ID NO: 154149 - RNA, 22 nt, Mycobacterium tuberculosis H37Rv
cggcgcuacuggcggugagagc

SEQ ID NO: 154150 - RNA, 22 nt, Mycobacterium tuberculosis H37Rv
uuaguuaccaucguugcugaug

SEQ ID NO: 154151 - RNA, 22 nt, Mycobacterium tuberculosis H37Rv
uuucgcagugccgucacgcucg

SEQ ID NO: 154152 - RNA, 22 nt, Mycobacterium tuberculosis H37Rv
gcgaccaccguuugagcggcca

SEQ ID NO: 154153 - RNA, 22 nt, Mycobacterium tuberculosis H37Rv
ugaccggcgcgaccggcgcuac

SEQ ID NO: 154154 - RNA, 22 nt, Mycobacterium tuberculosis H37Rv
gccuucgacucggcgccgagcg

SEQ ID NO: 154155 - RNA, 22 nt, Mycobacterium tuberculosis H37Rv
cuguccgcgcgcacaccaacgg

SEQ ID NO: 154156 - RNA, 22 nt, Mycobacterium tuberculosis H37Rv
ucaugcgacucugcgucugcuc

SEQ ID NO: 154157 - RNA, 21 nt, Mycobacterium tuberculosis H37Rv
ugcgucagcagcggugcugcc

SEQ ID NO: 154158 - RNA, 22 nt, Mycobacterium tuberculosis H37Rv
aaucggccggcgacacuguugu

SEQ ID NO: 154159 - RNA, 22 nt, Mycobacterium tuberculosis H37Rv
caucgagucgacgauguggugg

SEQ ID NO: 154160 - RNA, 22 nt, Mycobacterium tuberculosis H37Rv
auuugggcgauuuugcgucugc

SEQ ID NO: 154161 - RNA, 22 nt, Mycobacterium tuberculosis H37Rv
uucgugaucgcgagcgcaaugc

SEQ ID NO: 154162 - RNA, 22 nt, Mycobacterium tuberculosis H37Rv
accgugggcucuucggccguca

SEQ ID NO: 154163 - RNA, 20 nt, Mycobacterium tuberculosis H37Rv
gcuugccgacccggcgccgu

SEQ ID NO: 154164 - RNA, 19 nt, Mycobacterium tuberculosis H37Rv
uucccgcguccacgucggc

SEQ ID NO: 154165 - RNA, 22 nt, Mycobacterium tuberculosis H37Rv
guggcgaccgacguugucgcgg

SEQ ID NO: 154166 - RNA, 22 nt, Mycobacterium tuberculosis H37Rv
gugucugccgcucgggucagcg

SEQ ID NO: 154167 - RNA, 22 nt, Mycobacterium tuberculosis H37Rv
uccgcugaccgagggcugggcu

SEQ ID NO: 154168 - RNA, 22 nt, Mycobacterium tuberculosis H37Rv
gucgggaauacgacgaguucgu

SEQ ID NO: 154169 - RNA, 22 nt, Mycobacterium tuberculosis H37Rv
uccggcuacggucaccgcguau

SEQ ID NO: 154170 - RNA, 22 nt, Mycobacterium tuberculosis H37Rv
cgagcagacgcaaaagccccca

SEQ ID NO: 154171 - RNA, 23 nt, Mycobacterium tuberculosis H37Rv
gucgccgaauucacuaucggcgg

SEQ ID NO: 154172 - RNA, 22 nt, Mycobacterium tuberculosis H37Rv
ucccggcuggcugcgaccgagc

SEQ ID NO: 154173 - RNA, 22 nt, Mycobacterium tuberculosis H37Rv
gggaaugcuccuucgccggcga

SEQ ID NO: 154174 - RNA, 22 nt, Mycobacterium tuberculosis H37Rv
uccucagucguugacagcgcuc

SEQ ID NO: 154175 - RNA, 19 nt, Mycobacterium tuberculosis H37Rv
cggaaucgaagcacgcucc

SEQ ID NO: 154176 - RNA, 22 nt, Mycobacterium tuberculosis H37Rv
ucgugucgcgaguuucacucuc

SEQ ID NO: 154177 - RNA, 22 nt, Mycobacterium tuberculosis H37Rv
ucggugacggacugcacagcga

SEQ ID NO: 154178 - RNA, 22 nt, Mycobacterium tuberculosis H37Rv
accgguugcccgccguggaucg

SEQ ID NO: 154179 - RNA, 22 nt, Mycobacterium tuberculosis H37Rv
gaguaugccggauccuucagcu

SEQ ID NO: 154180 - RNA, 22 nt, Mycobacterium tuberculosis H37Rv
cuggccguggugugucgcgcau

SEQ ID NO: 154181 - RNA, 22 nt, Mycobacterium tuberculosis H37Rv
gugaccgccccggagcgagcac

SEQ ID NO: 154182 - RNA, 22 nt, Mycobacterium tuberculosis H37Rv
cgucgugaccugccggccggac

SEQ ID NO: 154183 - RNA, 22 nt, Mycobacterium tuberculosis H37Rv
gcgaucgacgacagcccgauca

SEQ ID NO: 154184 - RNA, 22 nt, Mycobacterium tuberculosis H37Rv
aguucgugauggaggaugccgu

SEQ ID NO: 154185 - RNA, 22 nt, Mycobacterium tuberculosis H37Rv
auaucaccguuaucggagcgau

SEQ ID NO: 154186 - RNA, 22 nt, Mycobacterium tuberculosis H37Rv
gugauccaucucuaugagcgug

SEQ ID NO: 154187 - RNA, 22 nt, Mycobacterium tuberculosis H37Rv
ucgcgguugacugcggccaugc

SEQ ID NO: 154188 - RNA, 22 nt, Mycobacterium tuberculosis H37Rv
ggcgggaucuccuucggugcgu

SEQ ID NO: 154189 - RNA, 22 nt, Mycobacterium tuberculosis H37Rv
cgagcagacguaaagcccccaa

SEQ ID NO: 154190 - RNA, 22 nt, Mycobacterium tuberculosis H37Rv
ucgcccuggcuucacguucggc

SEQ ID NO: 154191 - RNA, 22 nt, Mycobacterium tuberculosis H37Rv
ggugcgcaaccguugggcgacc

SEQ ID NO: 154192 - RNA, 22 nt, Mycobacterium tuberculosis H37Rv
gugccgcagcuuucgaguugug

SEQ ID NO: 154193 - RNA, 22 nt, Mycobacterium tuberculosis H37Rv
gguguucacggcgcacguagcc

SEQ ID NO: 154194 - RNA, 22 nt, Mycobacterium tuberculosis H37Rv
cugcgacugugaaucucacgac

SEQ ID NO: 154195 - RNA, 22 nt, Mycobacterium tuberculosis H37Rv
ggcuggaucgugccgcgcuggc

SEQ ID NO: 154196 - RNA, 22 nt, Mycobacterium tuberculosis H37Rv
aaaugggcgcuuaugcgucugc

SEQ ID NO: 154197 - RNA, 18 nt, Mycobacterium tuberculosis H37Rv
cucggcgaccacguccuu

SEQ ID NO: 154198 - RNA, 22 nt, Mycobacterium tuberculosis H37Rv
acuggcgguagaggccgccggc

SEQ ID NO: 154199 - RNA, 22 nt, Mycobacterium tuberculosis H37Rv
ucggugcggaaucguugugagu

SEQ ID NO: 154200 - RNA, 22 nt, Mycobacterium tuberculosis H37Rv
cccggucaaagaugucgcuggg

SEQ ID NO: 154201 - RNA, 22 nt, Mycobacterium tuberculosis H37Rv
aacccgcuugccgaccucaucc

SEQ ID NO: 154202 - RNA, 21 nt, Mycobacterium tuberculosis H37Rv
caucaggugcauaacguugcc

SEQ ID NO: 154203 - RNA, 23 nt, Mycobacterium tuberculosis H37Rv
ucgagcugggacuggguggaccg

SEQ ID NO: 154204 - RNA, 22 nt, Mycobacterium tuberculosis H37Rv
gcccagcaggaaaggccuuugu

SEQ ID NO: 154205 - RNA, 22 nt, Mycobacterium tuberculosis H37Rv
cgaacuaucgugacggcgccuu

SEQ ID NO: 154206 - RNA, 22 nt, Mycobacterium tuberculosis H37Rv
caggccgacacuuccagcucgg

SEQ ID NO: 154207 - RNA, 22 nt, Mycobacterium tuberculosis H37Rv
cacgauguugcgaaacgccuga

SEQ ID NO: 154208 - RNA, 22 nt, Mycobacterium tuberculosis H37Rv
cgccgcauuggcgaugucggcg

SEQ ID NO: 154209 - RNA, 22 nt, Mycobacterium tuberculosis H37Rv
ugauuccgcucggcucgugcac

SEQ ID NO: 154210 - RNA, 22 nt, Mycobacterium tuberculosis H37Rv
ucaucgagauccauaugaugua

SEQ ID NO: 154211 - RNA, 21 nt, Mycobacterium tuberculosis H37Rv
ccgcuauucggggcgcggcaa

SEQ ID NO: 154212 - RNA, 22 nt, Mycobacterium tuberculosis H37Rv
gucgcggacagucccauguuag

SEQ ID NO: 154213 - RNA, 22 nt, Mycobacterium tuberculosis H37Rv
acggucgccaaccuggcgagca

SEQ ID NO: 154214 - RNA, 22 nt, Mycobacterium tuberculosis H37Rv
aucggcacggcgagacggccga

SEQ ID NO: 154215 - RNA, 22 nt, Mycobacterium tuberculosis H37Rv
ucgaccaagccaagcguguugu

SEQ ID NO: 154216 - RNA, 22 nt, Mycobacterium tuberculosis H37Rv
ccgauggucugccguacaccca

SEQ ID NO: 154217 - RNA, 22 nt, Mycobacterium tuberculosis H37Rv
uucgcgucgguggugcugaagu

SEQ ID NO: 154218 - RNA, 23 nt, Mycobacterium tuberculosis H37Rv
guuccgucaccgaagacgucgcc

SEQ ID NO: 154219 - RNA, 21 nt, Mycobacterium tuberculosis H37Rv
caugccggggcgguucaucga

SEQ ID NO: 154220 - RNA, 22 nt, Mycobacterium tuberculosis H37Rv
gcucaugucgccguagaccggg

SEQ ID NO: 154221 - RNA, 22 nt, Mycobacterium tuberculosis H37Rv
gcggucgauguuccguugguga

SEQ ID NO: 154222 - RNA, 21 nt, Mycobacterium tuberculosis H37Rv
ucgaaugugugggaucggccg

SEQ ID NO: 154223 - RNA, 22 nt, Mycobacterium tuberculosis H37Rv
guugcccgagggugcgaccuug

SEQ ID NO: 154224 - RNA, 22 nt, Mycobacterium tuberculosis H37Rv
aucgagauugagccggccccga

SEQ ID NO: 154225 - RNA, 22 nt, Mycobacterium tuberculosis H37Rv
guucaggagagucguugcggua

SEQ ID NO: 154226 - RNA, 22 nt, Mycobacterium tuberculosis H37Rv
gcagugcgauucugcgucugcu

SEQ ID NO: 154227 - RNA, 22 nt, Mycobacterium tuberculosis H37Rv
agcagacguaaaagcccccauu

SEQ ID NO: 154228 - RNA, 19 nt, Mycobacterium tuberculosis H37Rv
ggcugcguacucggcgguc

SEQ ID NO: 154229 - RNA, 22 nt, Mycobacterium tuberculosis H37Rv
acgccugcgucaugggguucca

SEQ ID NO: 154230 - RNA, 22 nt, Mycobacterium tuberculosis H37Rv
ugcagcaugguuucgucgugcu

SEQ ID NO: 154231 - RNA, 22 nt, Mycobacterium tuberculosis H37Rv
guggcgacaagagccguaaacu

SEQ ID NO: 154232 - RNA, 23 nt, Mycobacterium tuberculosis H37Rv
gcuacuggcggcgagagcgucgg

SEQ ID NO: 154233 - RNA, 22 nt, Mycobacterium tuberculosis H37Rv
cgacgaggcgcaacggauuccg

SEQ ID NO: 154234 - RNA, 22 nt, Mycobacterium tuberculosis H37Rv
accgcagcggguugcgggcaug

SEQ ID NO: 154235 - RNA, 22 nt, Mycobacterium tuberculosis H37Rv
cccugguugcacguucggcgug

SEQ ID NO: 154236 - RNA, 22 nt, Mycobacterium tuberculosis H37Rv
gagcgugaacugagggcggaga

SEQ ID NO: 154237 - RNA, 22 nt, Mycobacterium tuberculosis H37Rv
ggugcgauuccgcgucugcucg

SEQ ID NO: 154238 - RNA, 22 nt, Mycobacterium tuberculosis H37Rv
uuuggcgccgaauacgccaacg

SEQ ID NO: 154239 - RNA, 22 nt, Mycobacterium tuberculosis H37Rv
ucgugggaucaccccuaccgcg

SEQ ID NO: 154240 - RNA, 22 nt, Mycobacterium tuberculosis H37Rv
cgagcguaacgccacugcgcua

SEQ ID NO: 154241 - RNA, 22 nt, Mycobacterium tuberculosis H37Rv
gcggaucgacaaccaguugcgu

SEQ ID NO: 154242 - RNA, 22 nt, Mycobacterium tuberculosis H37Rv
augcugcuggccgacaugcucg

SEQ ID NO: 154243 - RNA, 22 nt, Mycobacterium tuberculosis H37Rv
augucacggucgugacccgcug

SEQ ID NO: 154244 - RNA, 20 nt, Mycobacterium tuberculosis H37Rv
ucgacgugccccggaucacc

SEQ ID NO: 154245 - RNA, 22 nt, Mycobacterium tuberculosis H37Rv
ggucggucaaggucgcgugcac

SEQ ID NO: 154246 - RNA, 22 nt, Mycobacterium tuberculosis H37Rv
agcaccuacaugugguggaggu

SEQ ID NO: 154247 - RNA, 20 nt, Mycobacterium tuberculosis H37Rv
ucgcaguggcguuacgcucg

SEQ ID NO: 154248 - RNA, 22 nt, Mycobacterium tuberculosis H37Rv
cccggugagcugaucuucguga

SEQ ID NO: 154249 - RNA, 19 nt, Mycobacterium tuberculosis H37Rv
acccaggccgucacuucga

SEQ ID NO: 154250 - RNA, 22 nt, Mycobacterium tuberculosis H37Rv
gucgccaguagccacuguuccg

SEQ ID NO: 154251 - RNA, 21 nt, Mycobacterium tuberculosis H37Rv
guucucguaguagccgcuagg

SEQ ID NO: 154252 - RNA, 22 nt, Mycobacterium tuberculosis H37Rv
uuccggcgcgaccggucugauc

SEQ ID NO: 154253 - RNA, 22 nt, Mycobacterium tuberculosis H37Rv
ccguggucacagacgaucacga

SEQ ID NO: 154254 - RNA, 22 nt, Mycobacterium tuberculosis H37Rv
gcgacgcugaagagcccgacga

SEQ ID NO: 154255 - RNA, 22 nt, Mycobacterium tuberculosis H37Rv
uuacgccgguugugguuggccg

SEQ ID NO: 154256 - RNA, 22 nt, Mycobacterium tuberculosis H37Rv
uggcaaugugaucgccggcaac

SEQ ID NO: 154257 - RNA, 22 nt, Mycobacterium tuberculosis H37Rv
uugaggaucagguucagcuggc

SEQ ID NO: 154258 - RNA, 22 nt, Mycobacterium tuberculosis H37Rv
uggcgagcagacgcaaaagccc

SEQ ID NO: 154259 - RNA, 22 nt, Mycobacterium tuberculosis H37Rv
ggcuugucggaacucggcccca

SEQ ID NO: 154260 - RNA, 22 nt, Mycobacterium tuberculosis H37Rv
gcugaccgggacgccggccugg

SEQ ID NO: 154261 - RNA, 21 nt, Mycobacterium tuberculosis H37Rv
gcggcguucagguugagcagg

SEQ ID NO: 154262 - RNA, 22 nt, Mycobacterium tuberculosis H37Rv
uccgggugaauaccgccauguc

SEQ ID NO: 154263 - RNA, 20 nt, Mycobacterium tuberculosis H37Rv
aauguggucgaugcccuggc

SEQ ID NO: 154264 - RNA, 23 nt, Mycobacterium tuberculosis H37Rv
ggcugcugcggaguccacaccga

SEQ ID NO: 154265 - RNA, 22 nt, Mycobacterium tuberculosis H37Rv
uugcggauccagaucgacgagc

SEQ ID NO: 154266 - RNA, 22 nt, Mycobacterium tuberculosis H37Rv
ugguucucggcgauaccucgac

SEQ ID NO: 154267 - RNA, 20 nt, Mycobacterium tuberculosis H37Rv
ugcgcagcuggacgcggugc

SEQ ID NO: 154268 - RNA, 22 nt, Mycobacterium tuberculosis H37Rv
uugcagauccggcccaccuugg

SEQ ID NO: 154269 - RNA, 22 nt, Mycobacterium tuberculosis H37Rv
ccaggaacgggacgccgugugc

SEQ ID NO: 154270 - RNA, 22 nt, Mycobacterium tuberculosis H37Rv
ggagacguuguauggcgagauc

SEQ ID NO: 154271 - RNA, 22 nt, Mycobacterium tuberculosis H37Rv
uccguugacucugcguccacca

SEQ ID NO: 154272 - RNA, 22 nt, Mycobacterium tuberculosis H37Rv
gugagccauagguugucggugg

SEQ ID NO: 154273 - RNA, 22 nt, Mycobacterium tuberculosis H37Rv
ugccggcauuggcgaccguguc

SEQ ID NO: 154274 - RNA, 22 nt, Mycobacterium tuberculosis H37Rv
ugcggcacucgucaggcccgcg

SEQ ID NO: 154275 - RNA, 22 nt, Mycobacterium tuberculosis H37Rv
cgggcagacgcguaagcgccca

SEQ ID NO: 154276 - RNA, 22 nt, Mycobacterium tuberculosis H37Rv
cgcgagcagacgcaaaaucgcc

SEQ ID NO: 154277 - RNA, 22 nt, Mycobacterium tuberculosis H37Rv
cggacgaaguccucggcguucu

SEQ ID NO: 154278 - RNA, 22 nt, Mycobacterium tuberculosis H37Rv
gcacugacaccaccggcccugg

SEQ ID NO: 154279 - RNA, 22 nt, Mycobacterium tuberculosis H37Rv
gugcaagucgaucugccggcgc

SEQ ID NO: 154280 - RNA, 23 nt, Mycobacterium tuberculosis H37Rv
ugguggccgggaucggcauggcc

SEQ ID NO: 154281 - RNA, 22 nt, Mycobacterium tuberculosis H37Rv
ucggagcuggggcacgguugga

SEQ ID NO: 154282 - RNA, 22 nt, Mycobacterium tuberculosis H37Rv
uagccaccgcagcggucgcggu

SEQ ID NO: 154283 - RNA, 22 nt, Mycobacterium tuberculosis H37Rv
ggcgauuuugcgucugcucgcc

SEQ ID NO: 154284 - RNA, 22 nt, Mycobacterium tuberculosis H37Rv
cgagcagacgcggaaucgcauc

SEQ ID NO: 154285 - RNA, 22 nt, Mycobacterium tuberculosis H37Rv
ugucgcgucgccagguucacgc

SEQ ID NO: 154286 - RNA, 21 nt, Mycobacterium tuberculosis H37Rv
gucguucuccaggaucagguc

SEQ ID NO: 154287 - RNA, 22 nt, Mycobacterium tuberculosis H37Rv
gcgugcgauucugugucuguuc

SEQ ID NO: 154288 - RNA, 22 nt, Mycobacterium tuberculosis H37Rv
cggugcaauggucgcaugcucu

SEQ ID NO: 154289 - RNA, 22 nt, Mycobacterium tuberculosis H37Rv
uuggccggguggucgagcccgc

SEQ ID NO: 154290 - RNA, 22 nt, Mycobacterium tuberculosis H37Rv
auuucgugaccuuguagccgca

SEQ ID NO: 154291 - RNA, 22 nt, Mycobacterium tuberculosis H37Rv
gccaugguugcacguucggcgu

SEQ ID NO: 154292 - RNA, 22 nt, Mycobacterium tuberculosis H37Rv
ggacugccaacuucggguuguu

SEQ ID NO: 154293 - RNA, 22 nt, Mycobacterium tuberculosis H37Rv
aucgccggugaccgcugacccc

SEQ ID NO: 154294 - RNA, 22 nt, Mycobacterium tuberculosis H37Rv
ccaucgccagcgucgacgugcc

SEQ ID NO: 154295 - RNA, 22 nt, Mycobacterium tuberculosis H37Rv
ucgcguggugcacaucggcgau

SEQ ID NO: 154296 - RNA, 22 nt, Mycobacterium tuberculosis H37Rv
cguggauuuugaggcgcaccgg

SEQ ID NO: 154297 - RNA, 22 nt, Mycobacterium tuberculosis H37Rv
gcuggcgaugcuccugaauuca

SEQ ID NO: 154298 - RNA, 22 nt, Mycobacterium tuberculosis H37Rv
ucgccgagccuguaauuuugca

SEQ ID NO: 154299 - RNA, 22 nt, Mycobacterium tuberculosis H37Rv
gguggagcuggcugccgcgcua

SEQ ID NO: 154300 - RNA, 22 nt, Mycobacterium tuberculosis H37Rv
ugggcgacggcgaacauggucg

SEQ ID NO: 154301 - RNA, 20 nt, Mycobacterium tuberculosis H37Rv
acugcgacacgcucccgaau

SEQ ID NO: 154302 - RNA, 22 nt, Mycobacterium tuberculosis H37Rv
cgugagcagacgcaaagucgcc

SEQ ID NO: 154303 - RNA, 22 nt, Mycobacterium tuberculosis H37Rv
ggagccguguucgcgauucugc

SEQ ID NO: 154304 - RNA, 22 nt, Mycobacterium tuberculosis H37Rv
ucgguccaccccgcaggcgcug

SEQ ID NO: 154305 - RNA, 22 nt, Mycobacterium tuberculosis H37Rv
cugcggaugggucagcagauug

SEQ ID NO: 154306 - RNA, 22 nt, Mycobacterium tuberculosis H37Rv
gcggacacgaucgcgucggcua

SEQ ID NO: 154307 - RNA, 21 nt, Mycobacterium tuberculosis H37Rv
ggcgaugaacgaaggaucggc

SEQ ID NO: 154308 - RNA, 22 nt, Mycobacterium tuberculosis H37Rv
uguugcgacgcgaccugggguu

SEQ ID NO: 154309 - RNA, 22 nt, Mycobacterium tuberculosis H37Rv
ggcgaugccgaguugggucagc

SEQ ID NO: 154310 - RNA, 22 nt, Mycobacterium tuberculosis H37Rv
aacgggcgcugcgugagcacgu

SEQ ID NO: 154311 - RNA, 22 nt, Mycobacterium tuberculosis H37Rv
uucacccagcgcgacgccgucg

SEQ ID NO: 154312 - RNA, 22 nt, Mycobacterium tuberculosis H37Rv
gcgacgucaugaucgcgcuggg

SEQ ID NO: 154313 - RNA, 22 nt, Mycobacterium tuberculosis H37Rv
aguucaaccucuugucggccga

SEQ ID NO: 154314 - RNA, 22 nt, Mycobacterium tuberculosis H37Rv
ucguccaaugaaccacaacccc

SEQ ID NO: 154315 - RNA, 22 nt, Mycobacterium tuberculosis H37Rv
accuagcgguccaagaugcggu

SEQ ID NO: 154316 - RNA, 22 nt, Mycobacterium tuberculosis H37Rv
gagcagacacacaaucgcaucc

SEQ ID NO: 154317 - RNA, 20 nt, Mycobacterium tuberculosis H37Rv
caccgcagucgacgcucgcg

SEQ ID NO: 154318 - RNA, 20 nt, Mycobacterium tuberculosis H37Rv
aucaggccggcugcccccgc

SEQ ID NO: 154319 - RNA, 22 nt, Mycobacterium tuberculosis H37Rv
cgcugucgauacagcgucagca

SEQ ID NO: 154320 - RNA, 22 nt, Mycobacterium tuberculosis H37Rv
cgauguggcacugugcaccgcc

SEQ ID NO: 154321 - RNA, 22 nt, Mycobacterium tuberculosis H37Rv
ccagugcggauagcgcggcggc

SEQ ID NO: 154322 - RNA, 21 nt, Mycobacterium tuberculosis H37Rv
ugacccacugggccgagucgg

SEQ ID NO: 154323 - RNA, 17 nt, Mycobacterium tuberculosis H37Rv
guugccggugggacgga

SEQ ID NO: 154324 - RNA, 22 nt, Mycobacterium tuberculosis H37Rv
ugaucgaacaucugcccagagg

SEQ ID NO: 154325 - RNA, 22 nt, Mycobacterium tuberculosis H37Rv
aaucuggugaaugcaccccaua

SEQ ID NO: 154326 - RNA, 22 nt, Mycobacterium tuberculosis H37Rv
gucaccgaaguugcggcgcggc

SEQ ID NO: 154327 - RNA, 22 nt, Mycobacterium tuberculosis H37Rv
cguugacucugcguccaccgug

SEQ ID NO: 154328 - RNA, 22 nt, Mycobacterium tuberculosis H37Rv
ugcgagucugugucugcucgcc

SEQ ID NO: 154329 - RNA, 22 nt, Mycobacterium tuberculosis H37Rv
ugcgacucugugucugcucgcg

SEQ ID NO: 154330 - RNA, 22 nt, Mycobacterium tuberculosis H37Rv
acaggucggcaccaccaucggg

SEQ ID NO: 154331 - RNA, 22 nt, Mycobacterium tuberculosis H37Rv
ugcggcagcgaaaggagcucca

SEQ ID NO: 154332 - RNA, 20 nt, Mycobacterium tuberculosis H37Rv
ucaucgugucuucgggcgcc

SEQ ID NO: 154333 - RNA, 22 nt, Mycobacterium tuberculosis H37Rv
ugaugaugggucccagcggauc

SEQ ID NO: 154334 - RNA, 22 nt, Mycobacterium tuberculosis H37Rv
ucaucgagaccgucgacgaauu

SEQ ID NO: 154335 - RNA, 22 nt, Mycobacterium tuberculosis H37Rv
gccagggucgcuucgggcagag

SEQ ID NO: 154336 - RNA, 22 nt, Mycobacterium tuberculosis H37Rv
gcucggaucaucaucuuguccg

SEQ ID NO: 154337 - RNA, 22 nt, Mycobacterium tuberculosis H37Rv
guguggcagucgcugcggcaug

SEQ ID NO: 154338 - RNA, 20 nt, Mycobacterium tuberculosis H37Rv
gaugaugaucguguaugcga

SEQ ID NO: 154339 - RNA, 22 nt, Mycobacterium tuberculosis H37Rv
gaucguggugcggugcuugcca

SEQ ID NO: 154340 - RNA, 22 nt, Mycobacterium tuberculosis H37Rv
cgaaugugcacugguggcggcg

SEQ ID NO: 154341 - RNA, 20 nt, Mycobacterium tuberculosis H37Rv
auucugcgucugcucggcgg

SEQ ID NO: 154342 - RNA, 22 nt, Mycobacterium tuberculosis H37Rv
agugcggcuauccgccgccgac

SEQ ID NO: 154343 - RNA, 22 nt, Mycobacterium tuberculosis H37Rv
cugacgguggcgacgccaugcc

SEQ ID NO: 154344 - RNA, 22 nt, Mycobacterium tuberculosis H37Rv
gcguugcuggcgaucggauuca

SEQ ID NO: 154345 - RNA, 22 nt, Mycobacterium tuberculosis H37Rv
ucgcugauagucgcuccauccg

SEQ ID NO: 154346 - RNA, 22 nt, Mycobacterium tuberculosis H37Rv
caccgucaauacgauguugcug

SEQ ID NO: 154347 - RNA, 22 nt, Mycobacterium tuberculosis H37Rv
ccgauuccgauugccgccccau

SEQ ID NO: 154348 - RNA, 22 nt, Mycobacterium tuberculosis H37Rv
cccugcuggagaucugcgcggu

SEQ ID NO: 154349 - RNA, 22 nt, Mycobacterium tuberculosis H37Rv
ucaacccgaauguguugccagc

SEQ ID NO: 154350 - RNA, 22 nt, Mycobacterium tuberculosis H37Rv
ggucgcaaugggcaggacuuug

SEQ ID NO: 154351 - RNA, 22 nt, Mycobacterium tuberculosis H37Rv
guuggcuaucgaccgcgucaaa

SEQ ID NO: 154352 - RNA, 19 nt, Mycobacterium tuberculosis H37Rv
ugcugcugcagcgcagaau

SEQ ID NO: 154353 - RNA, 22 nt, Mycobacterium tuberculosis H37Rv
uccacgguuuaucgugcccagc

SEQ ID NO: 154354 - RNA, 22 nt, Mycobacterium tuberculosis H37Rv
acggcgaaaucgacagcagcgc

SEQ ID NO: 154355 - RNA, 22 nt, Mycobacterium tuberculosis H37Rv
accgcggagccggaguuugugc

SEQ ID NO: 154356 - RNA, 22 nt, Mycobacterium tuberculosis H37Rv
ccggugguggaaggccugcuga

SEQ ID NO: 154357 - RNA, 22 nt, Mycobacterium tuberculosis H37Rv
acugcgcccggcgcuggccucc

SEQ ID NO: 154358 - RNA, 22 nt, Mycobacterium tuberculosis H37Rv
ucgacgaugaccagucgccggc

SEQ ID NO: 154359 - RNA, 22 nt, Mycobacterium tuberculosis H37Rv
ucgaugaaccaccugacaugac

SEQ ID NO: 154360 - RNA, 22 nt, Mycobacterium tuberculosis H37Rv
gguggcagcggguccggcgacu

SEQ ID NO: 154361 - RNA, 22 nt, Mycobacterium tuberculosis H37Rv
auucgucgagcaauugcuggua

SEQ ID NO: 154362 - RNA, 22 nt, Mycobacterium tuberculosis H37Rv
ucgcucgcaucgcgaucuuuua

SEQ ID NO: 154363 - RNA, 22 nt, Mycobacterium tuberculosis H37Rv
gcugacucgguuuggugcgacg

SEQ ID NO: 154364 - RNA, 22 nt, Mycobacterium tuberculosis H37Rv
uggccgcuuuucgauggugucg

SEQ ID NO: 154365 - RNA, 22 nt, Mycobacterium tuberculosis H37Rv
cagacgcaaaagaacaugaugg

SEQ ID NO: 154366 - RNA, 22 nt, Mycobacterium tuberculosis H37Rv
auugcucagcaucgggcuggcu

SEQ ID NO: 154367 - RNA, 22 nt, Mycobacterium tuberculosis H37Rv
aucggaucacauugcgcccgga

SEQ ID NO: 154368 - RNA, 22 nt, Mycobacterium tuberculosis H37Rv
aguucgcccacggcuguguguc

SEQ ID NO: 154369 - RNA, 20 nt, Mycobacterium tuberculosis H37Rv
ucggcaaagccuggacgauc

SEQ ID NO: 154370 - RNA, 22 nt, Mycobacterium tuberculosis H37Rv
ggcgacguuggcaccucggugc

SEQ ID NO: 154371 - RNA, 22 nt, Mycobacterium tuberculosis H37Rv
gcgcagcagcgacaggguggcg

SEQ ID NO: 154372 - RNA, 22 nt, Mycobacterium tuberculosis H37Rv
ccgaacgugaacugagggcgga

SEQ ID NO: 154373 - RNA, 22 nt, Mycobacterium tuberculosis H37Rv
acgucgacauccgugcaccagg

SEQ ID NO: 154374 - RNA, 22 nt, Mycobacterium tuberculosis H37Rv
caagaugacccuaccggugcua

SEQ ID NO: 154375 - RNA, 23 nt, Mycobacterium tuberculosis H37Rv
ucguuucgaugccggacaccguu

SEQ ID NO: 154376 - RNA, 22 nt, Mycobacterium tuberculosis H37Rv
gcaccucgucaaacgccgucga

SEQ ID NO: 154377 - RNA, 22 nt, Mycobacterium tuberculosis H37Rv
cgacggcucgcgugacgccguc

SEQ ID NO: 154378 - RNA, 22 nt, Mycobacterium tuberculosis H37Rv
cagacgcauaagcgcccaauuu

SEQ ID NO: 154379 - RNA, 22 nt, Mycobacterium tuberculosis H37Rv
cgcugcuaucgguggggcgccg

SEQ ID NO: 154380 - RNA, 21 nt, Mycobacterium tuberculosis H37Rv
uggacgcagagucaacgugua

SEQ ID NO: 154381 - RNA, 22 nt, Mycobacterium tuberculosis H37Rv
caggaggugcugcgggaggcga

SEQ ID NO: 154382 - RNA, 22 nt, Mycobacterium tuberculosis H37Rv
ucgucgggccgagguuuucggc

SEQ ID NO: 154383 - RNA, 22 nt, Mycobacterium tuberculosis H37Rv
cgcggucuugcaguacaugucc

SEQ ID NO: 154384 - RNA, 22 nt, Mycobacterium tuberculosis H37Rv
ucguuaccacagcauccgaucc

SEQ ID NO: 154385 - RNA, 22 nt, Mycobacterium tuberculosis H37Rv
agcugcuucuccccuuggucga

SEQ ID NO: 154386 - RNA, 17 nt, Mycobacterium tuberculosis H37Rv
cgucugccggcagcgca

SEQ ID NO: 154387 - RNA, 22 nt, Mycobacterium tuberculosis H37Rv
gagcagacgcagaaucgcaucg

SEQ ID NO: 154388 - RNA, 22 nt, Mycobacterium tuberculosis H37Rv
acggcucaacgguuauuuccgc

SEQ ID NO: 154389 - RNA, 22 nt, Mycobacterium tuberculosis H37Rv
ggcggcuaccugaaggacauca

SEQ ID NO: 154390 - RNA, 22 nt, Mycobacterium tuberculosis H37Rv
aaggcugcggguaugaaacgca

SEQ ID NO: 154391 - RNA, 22 nt, Mycobacterium tuberculosis H37Rv
auuggccaguggccgggcgcua

SEQ ID NO: 154392 - RNA, 22 nt, Mycobacterium tuberculosis H37Rv
cugcaacagaauugggcuacuc

SEQ ID NO: 154393 - RNA, 22 nt, Mycobacterium tuberculosis H37Rv
ggcgaugcgguggaucucgucg

SEQ ID NO: 154394 - RNA, 22 nt, Mycobacterium tuberculosis H37Rv
caggugcucgcugaucuugucg

SEQ ID NO: 154395 - RNA, 22 nt, Mycobacterium tuberculosis H37Rv
guuggcagagcgcgacgucucg

SEQ ID NO: 154396 - RNA, 22 nt, Mycobacterium tuberculosis H37Rv
gacugguacgccgaccugccgg

SEQ ID NO: 154397 - RNA, 21 nt, Mycobacterium tuberculosis H37Rv
cauccguucggaggaccggca

SEQ ID NO: 154398 - RNA, 22 nt, Mycobacterium tuberculosis H37Rv
gugaccacgguggugcgccacg

SEQ ID NO: 154399 - RNA, 21 nt, Mycobacterium tuberculosis H37Rv
gaccgggaugaacggguacga

SEQ ID NO: 154400 - RNA, 23 nt, Mycobacterium tuberculosis H37Rv
uggucgaugcggucaaagcacgc

SEQ ID NO: 154401 - RNA, 22 nt, Mycobacterium tuberculosis H37Rv
cgucgaccagugagguggcaac

SEQ ID NO: 154402 - RNA, 22 nt, Mycobacterium tuberculosis H37Rv
cugcuccggcacguuggucgag

SEQ ID NO: 154403 - RNA, 22 nt, Mycobacterium tuberculosis H37Rv
ggugucgagcacgcugggccga

SEQ ID NO: 154404 - RNA, 22 nt, Mycobacterium tuberculosis H37Rv
gaaucgcgaacacggcucccgc

SEQ ID NO: 154405 - RNA, 22 nt, Mycobacterium tuberculosis H37Rv
acagcccugaacgcaaucuggg

SEQ ID NO: 154406 - RNA, 22 nt, Mycobacterium tuberculosis H37Rv
cucagcugcagugcggugggcg

SEQ ID NO: 154407 - RNA, 22 nt, Mycobacterium tuberculosis H37Rv
ucgaugagcgauuggaacaacg

SEQ ID NO: 154408 - RNA, 22 nt, Mycobacterium tuberculosis H37Rv
gaccggaaaccuaccagcaggc

SEQ ID NO: 154409 - RNA, 22 nt, Mycobacterium tuberculosis H37Rv
gcgaucagguucgacgcgcauc

SEQ ID NO: 154410 - RNA, 22 nt, Mycobacterium tuberculosis H37Rv
gagcugacgccgagcugguuga

SEQ ID NO: 154411 - RNA, 22 nt, Mycobacterium tuberculosis H37Rv
cgcucgucguaucugauggggu

SEQ ID NO: 154412 - RNA, 22 nt, Mycobacterium tuberculosis H37Rv
ugaucggugccgucgcaugcgg

SEQ ID NO: 154413 - RNA, 22 nt, Mycobacterium tuberculosis H37Rv
uuccgcaauccuucgucggcgu

SEQ ID NO: 154414 - RNA, 20 nt, Mycobacterium tuberculosis H37Rv
uuggcggaucggcgaucacc

SEQ ID NO: 154415 - RNA, 22 nt, Mycobacterium tuberculosis H37Rv
acguugcuggacauggugcggg

SEQ ID NO: 154416 - RNA, 23 nt, Mycobacterium tuberculosis H37Rv
ugaccgagcgggugcgcuuccac

SEQ ID NO: 154417 - RNA, 22 nt, Mycobacterium tuberculosis H37Rv
uccgccgugaguucacguucgg

SEQ ID NO: 154418 - RNA, 22 nt, Mycobacterium tuberculosis H37Rv
ggcuccguagcagcguuggcua

SEQ ID NO: 154419 - RNA, 22 nt, Mycobacterium tuberculosis H37Rv
ugggaugaguccaccuggcggc

SEQ ID NO: 154420 - RNA, 22 nt, Mycobacterium tuberculosis H37Rv
gaaauugggcgauuuugcgucu

SEQ ID NO: 154421 - RNA, 22 nt, Mycobacterium tuberculosis H37Rv
gcugaaccugauccucaagggc

SEQ ID NO: 154422 - RNA, 22 nt, Mycobacterium tuberculosis H37Rv
uacccggucgguguucgaccau

SEQ ID NO: 154423 - RNA, 22 nt, Mycobacterium tuberculosis H37Rv
cgagcguaacgccacugcgaaa

SEQ ID NO: 154424 - RNA, 22 nt, Mycobacterium tuberculosis H37Rv
gggcuuccguaccgccgacauu

SEQ ID NO: 154425 - RNA, 22 nt, Mycobacterium tuberculosis H37Rv
cgcgagcagacacagagucgca

SEQ ID NO: 154426 - RNA, 22 nt, Mycobacterium tuberculosis H37Rv
ggcgagcagacacagacucgca

SEQ ID NO: 154427 - RNA, 22 nt, Mycobacterium tuberculosis H37Rv
uggucacgcugauugccgggcc

SEQ ID NO: 154428 - RNA, 22 nt, Mycobacterium tuberculosis H37Rv
gccacucgccgcugguguugug

SEQ ID NO: 154429 - RNA, 22 nt, Mycobacterium tuberculosis H37Rv
aucgcuuggcugggucaaucgu

SEQ ID NO: 154430 - RNA, 22 nt, Mycobacterium tuberculosis H37Rv
acgcgcacggggagcuggccga

SEQ ID NO: 154431 - RNA, 22 nt, Mycobacterium tuberculosis H37Rv
cgagcagacgcuaaagcccccg

SEQ ID NO: 154432 - RNA, 22 nt, Mycobacterium tuberculosis H37Rv
aucucuguagguggugggugcg

SEQ ID NO: 154433 - RNA, 22 nt, Mycobacterium tuberculosis H37Rv
gagcugcuugggugggcgguca

SEQ ID NO: 154434 - RNA, 22 nt, Mycobacterium tuberculosis H37Rv
acgucgaagacgaucaggcguu

SEQ ID NO: 154435 - RNA, 22 nt, Mycobacterium tuberculosis H37Rv
uuggccggcgacguuuccacga

SEQ ID NO: 154436 - RNA, 22 nt, Mycobacterium tuberculosis H37Rv
cgagcagacgcgaaaucccccg

SEQ ID NO: 154437 - RNA, 22 nt, Mycobacterium tuberculosis H37Rv
ucgagcccggcgacuucgugau

SEQ ID NO: 154438 - RNA, 22 nt, Mycobacterium tuberculosis H37Rv
ucagcagacgcaaaagcccccg

SEQ ID NO: 154439 - RNA, 22 nt, Mycobacterium tuberculosis H37Rv
uaccgcucgggcgcgaggacgc

SEQ ID NO: 154440 - RNA, 22 nt, Mycobacterium tuberculosis H37Rv
gcgauagccgaaccacccgccg

SEQ ID NO: 154441 - RNA, 22 nt, Mycobacterium tuberculosis H37Rv
agcgugcacugggggcgagauu

SEQ ID NO: 154442 - RNA, 22 nt, Mycobacterium tuberculosis H37Rv
uagaccggcaaacgugacggca

SEQ ID NO: 154443 - RNA, 22 nt, Mycobacterium tuberculosis H37Rv
ggucgagucguggucgcaugag

SEQ ID NO: 154444 - RNA, 22 nt, Mycobacterium tuberculosis H37Rv
gcgucgacgguguggguucgga

SEQ ID NO: 154445 - RNA, 22 nt, Mycobacterium tuberculosis H37Rv
gcagccguccgugccggccgua

SEQ ID NO: 154446 - RNA, 22 nt, Mycobacterium tuberculosis H37Rv
gccugcaaaauguugaucucac

SEQ ID NO: 154447 - RNA, 22 nt, Mycobacterium tuberculosis H37Rv
gaccaugucgcggcguagccgu

SEQ ID NO: 154448 - RNA, 22 nt, Mycobacterium tuberculosis H37Rv
gcggcacugugucgggcgcgag

SEQ ID NO: 154449 - RNA, 22 nt, Mycobacterium tuberculosis H37Rv
gcagacguaaaagcccccgaca

SEQ ID NO: 154450 - RNA, 22 nt, Mycobacterium tuberculosis H37Rv
cccgaagacgaccccggugaca

SEQ ID NO: 154451 - RNA, 22 nt, Mycobacterium tuberculosis H37Rv
gcacuccgcccagacccaucau

SEQ ID NO: 154452 - RNA, 22 nt, Mycobacterium tuberculosis H37Rv
aucugcacaccgagagaguucc

SEQ ID NO: 154453 - RNA, 22 nt, Mycobacterium tuberculosis H37Rv
ccggaacgcccugguggugcug

SEQ ID NO: 154454 - RNA, 22 nt, Mycobacterium tuberculosis H37Rv
ggcgguacaggcauugcgcgau

SEQ ID NO: 154455 - RNA, 21 nt, Mycobacterium tuberculosis H37Rv
ucgaaggaucacgcgaugacc

SEQ ID NO: 154456 - RNA, 22 nt, Mycobacterium tuberculosis H37Rv
ggugaucacgagggccuguuca

SEQ ID NO: 154457 - RNA, 22 nt, Mycobacterium tuberculosis H37Rv
aagcagacgcagaaucgcauua

SEQ ID NO: 154458 - RNA, 22 nt, Mycobacterium tuberculosis H37Rv
auugggcgauuuugcgucugcu

SEQ ID NO: 154459 - RNA, 22 nt, Mycobacterium tuberculosis H37Rv
gccauugccgaugccgguguug

SEQ ID NO: 154460 - RNA, 19 nt, Mycobacterium tuberculosis H37Rv
aagaggucaccgagaucaa

SEQ ID NO: 154461 - RNA, 22 nt, Mycobacterium tuberculosis H37Rv
agucguggauuugccagggggc

SEQ ID NO: 154462 - RNA, 19 nt, Mycobacterium tuberculosis H37Rv
ggagugcccggugccggcg

SEQ ID NO: 154463 - RNA, 22 nt, Mycobacterium tuberculosis H37Rv
gcggacagaauacgcugccgau

SEQ ID NO: 154464 - RNA, 22 nt, Mycobacterium tuberculosis H37Rv
cagcggcuguggcggagucugc

SEQ ID NO: 154465 - RNA, 22 nt, Mycobacterium tuberculosis H37Rv
uagaccggcuguucgguggccg

SEQ ID NO: 154466 - RNA, 23 nt, Mycobacterium tuberculosis H37Rv
aucagcuggauaggcaaggagac

SEQ ID NO: 154467 - RNA, 22 nt, Mycobacterium tuberculosis H37Rv
cgagcagacgcagagucgcacu

SEQ ID NO: 154468 - RNA, 22 nt, Mycobacterium tuberculosis H37Rv
cgcgagcagacgcagaaucgca

SEQ ID NO: 154469 - RNA, 22 nt, Mycobacterium tuberculosis H37Rv
ugccgacuguggauccugcgac

SEQ ID NO: 154470 - RNA, 22 nt, Mycobacterium tuberculosis H37Rv
gguucaccucacuguucaguca

SEQ ID NO: 154471 - RNA, 22 nt, Mycobacterium tuberculosis H37Rv
cguccgaaggcaucggcgaguc

SEQ ID NO: 154472 - RNA, 22 nt, Mycobacterium tuberculosis H37Rv
gcaaccguugcucgaguccaga

SEQ ID NO: 154473 - RNA, 22 nt, Mycobacterium tuberculosis H37Rv
ugcucgucggugacgccgugcu

SEQ ID NO: 154474 - RNA, 22 nt, Mycobacterium tuberculosis H37Rv
aggcaaucagucaggucgcuau

SEQ ID NO: 154475 - RNA, 22 nt, Mycobacterium tuberculosis H37Rv
gaaggccgagcggaucugacau

SEQ ID NO: 154476 - RNA, 22 nt, Mycobacterium tuberculosis H37Rv
caacuucgacgcugacggcuag

SEQ ID NO: 154477 - RNA, 22 nt, Mycobacterium tuberculosis H37Rv
ccggagaaugcggaaucacgcu

SEQ ID NO: 154478 - RNA, 22 nt, Mycobacterium tuberculosis H37Rv
cggcuucccagacuucggauuc

SEQ ID NO: 154479 - RNA, 22 nt, Mycobacterium tuberculosis H37Rv
accucggugaacccgguggcgg

SEQ ID NO: 154480 - RNA, 22 nt, Mycobacterium tuberculosis H37Rv
cccggucuacgacgucgcugua

SEQ ID NO: 154481 - RNA, 22 nt, Mycobacterium tuberculosis H37Rv
uugaacagcuccagcgccauca

SEQ ID NO: 154482 - RNA, 22 nt, Mycobacterium tuberculosis H37Rv
gacaaccguucugaugccgcgu

SEQ ID NO: 154483 - RNA, 22 nt, Mycobacterium tuberculosis H37Rv
cggcuagcagcccaacaggacu

SEQ ID NO: 154484 - RNA, 22 nt, Mycobacterium tuberculosis H37Rv
ccgucgcuuccgcuggugccag

SEQ ID NO: 154485 - RNA, 22 nt, Mycobacterium tuberculosis H37Rv
gcgggaguugcgggauugauga

SEQ ID NO: 154486 - RNA, 20 nt, Mycobacterium tuberculosis H37Rv
cugguugcaugacaaucacg

SEQ ID NO: 154487 - RNA, 22 nt, Mycobacterium tuberculosis H37Rv
ccgagugaaggugggguacaug

SEQ ID NO: 154488 - RNA, 20 nt, Mycobacterium tuberculosis H37Rv
ggugcucgucgaguuggguu

SEQ ID NO: 154489 - RNA, 22 nt, Mycobacterium tuberculosis H37Rv
agucgauguugucgccacggcu

SEQ ID NO: 154490 - RNA, 22 nt, Mycobacterium tuberculosis H37Rv
guucguagagcgccucggcgcg

SEQ ID NO: 154491 - RNA, 22 nt, Mycobacterium tuberculosis H37Rv
ucaccggucuuggcgacuuggu

SEQ ID NO: 154492 - RNA, 22 nt, Mycobacterium tuberculosis H37Rv
cagcgguuuucgcggccaucgg

SEQ ID NO: 154493 - RNA, 22 nt, Mycobacterium tuberculosis H37Rv
gaguucuucgcgguggccaaga

SEQ ID NO: 154494 - RNA, 22 nt, Mycobacterium tuberculosis H37Rv
auucgaagugacggccuggguc

SEQ ID NO: 154495 - RNA, 22 nt, Mycobacterium tuberculosis H37Rv
uugcccgcgguuccgccggugu

SEQ ID NO: 154496 - RNA, 22 nt, Mycobacterium tuberculosis H37Rv
uggcggucgauccgucgggugc

SEQ ID NO: 154497 - RNA, 22 nt, Mycobacterium tuberculosis H37Rv
gugagcagacgcaaaagccccc

SEQ ID NO: 154498 - RNA, 22 nt, Mycobacterium tuberculosis H37Rv
ccaugucgacgugaucgcugug

SEQ ID NO: 154499 - RNA, 22 nt, Mycobacterium tuberculosis H37Rv
gguggccaggaucaccgacgga

SEQ ID NO: 154500 - RNA, 22 nt, Mycobacterium tuberculosis H37Rv
gugcucaugaccggccaaugcg

SEQ ID NO: 154501 - RNA, 22 nt, Mycobacterium tuberculosis H37Rv
ggcacgauggaaugucgcaacc

SEQ ID NO: 154502 - RNA, 22 nt, Mycobacterium tuberculosis H37Rv
gccuggucaccgugccgaaggu

SEQ ID NO: 154503 - RNA, 22 nt, Mycobacterium tuberculosis H37Rv
auugcgagccacgcagguugaa

SEQ ID NO: 154504 - RNA, 22 nt, Mycobacterium tuberculosis H37Rv
ggcggucuggcugcugggcguc

SEQ ID NO: 154505 - RNA, 22 nt, Mycobacterium tuberculosis H37Rv
gagcagacgcaaaaucgcccaa

SEQ ID NO: 154506 - RNA, 22 nt, Mycobacterium tuberculosis H37Rv
uuucgccaucggguccgcgacu

SEQ ID NO: 154507 - RNA, 22 nt, Mycobacterium tuberculosis H37Rv
acgcggucgccgcgcuggguau

SEQ ID NO: 154508 - RNA, 21 nt, Mycobacterium tuberculosis H37Rv
auggucugacguucuggagca

SEQ ID NO: 154509 - RNA, 22 nt, Mycobacterium tuberculosis H37Rv
ggcucggugaacaagaucgucg

SEQ ID NO: 154510 - RNA, 22 nt, Mycobacterium tuberculosis H37Rv
ugccgguccuccgaacggaugu

SEQ ID NO: 154511 - RNA, 22 nt, Mycobacterium tuberculosis H37Rv
aucuggacgugcacgccaacgg

SEQ ID NO: 154512 - RNA, 22 nt, Mycobacterium tuberculosis H37Rv
gcuggugagugcggcgaccgcu

SEQ ID NO: 154513 - RNA, 22 nt, Mycobacterium tuberculosis H37Rv
ugggcuucugggacaucgcggu

SEQ ID NO: 154514 - RNA, 22 nt, Mycobacterium tuberculosis H37Rv
ggucucgagcuugccggccgca

SEQ ID NO: 154515 - RNA, 22 nt, Mycobacterium tuberculosis H37Rv
augccgguucuuccgaugcaug

SEQ ID NO: 154516 - RNA, 22 nt, Mycobacterium tuberculosis H37Rv
cgcaccgaaggagaucccgccg

SEQ ID NO: 154517 - RNA, 22 nt, Mycobacterium tuberculosis H37Rv
uugaugucggcgacuacaucuu

SEQ ID NO: 154518 - RNA, 22 nt, Mycobacterium tuberculosis H37Rv
gcgaccgugaaucuggcgacgc

SEQ ID NO: 154519 - RNA, 22 nt, Mycobacterium tuberculosis H37Rv
acagcugcugguuugagucugc

SEQ ID NO: 154520 - RNA, 22 nt, Mycobacterium tuberculosis H37Rv
cagcguaugggcgggcaggcga

SEQ ID NO: 154521 - RNA, 22 nt, Mycobacterium tuberculosis H37Rv
aaccggcuguccagggccaucu

SEQ ID NO: 154522 - RNA, 22 nt, Mycobacterium tuberculosis H37Rv
gggcaucgugcugggcggaucg

SEQ ID NO: 154523 - RNA, 22 nt, Mycobacterium tuberculosis H37Rv
acgcgugugacgcugcggcgaa

SEQ ID NO: 154524 - RNA, 22 nt, Mycobacterium tuberculosis H37Rv
cggcgagacggaugccgugacg

SEQ ID NO: 154525 - RNA, 18 nt, Mycobacterium tuberculosis H37Rv
ucagcgaucggggugcgg

SEQ ID NO: 154526 - RNA, 22 nt, Mycobacterium tuberculosis H37Rv
gucggucucauacguccagauc

SEQ ID NO: 154527 - RNA, 22 nt, Mycobacterium tuberculosis H37Rv
ugcccgucgcgaaguacgacug

SEQ ID NO: 154528 - RNA, 22 nt, Mycobacterium tuberculosis H37Rv
ggcguucaagaucaccaccaaa

SEQ ID NO: 154529 - RNA, 21 nt, Mycobacterium tuberculosis H37Rv
accgcgcacgggcaugcgauc

SEQ ID NO: 154530 - RNA, 23 nt, Mycobacterium tuberculosis H37Rv
cgcugcgaucgaagacguccugc

SEQ ID NO: 154531 - RNA, 22 nt, Mycobacterium tuberculosis H37Rv
acgucgcggugcuguucgugga

SEQ ID NO: 154532 - RNA, 22 nt, Mycobacterium tuberculosis H37Rv
gagcagacgcagaagucgccga

SEQ ID NO: 154533 - RNA, 18 nt, Mycobacterium tuberculosis H37Rv
ugcagguugguggcaucc

SEQ ID NO: 154534 - RNA, 22 nt, Mycobacterium tuberculosis H37Rv
auucacuggauagccacacuau

SEQ ID NO: 154535 - RNA, 22 nt, Mycobacterium tuberculosis H37Rv
ucauguucuuucgcgucuacuc

SEQ ID NO: 154536 - RNA, 22 nt, Mycobacterium tuberculosis H37Rv
gguccagugucagcgcggccau

SEQ ID NO: 154537 - RNA, 20 nt, Mycobacterium tuberculosis H37Rv
gagccgcagcgggacccggu

SEQ ID NO: 154538 - RNA, 22 nt, Mycobacterium tuberculosis H37Rv
gugagcuacugagcagguaucu

SEQ ID NO: 154539 - RNA, 22 nt, Mycobacterium tuberculosis H37Rv
ccguuuggucccgaggugucgg

SEQ ID NO: 154540 - RNA, 20 nt, Mycobacterium tuberculosis H37Rv
gccgaauucacuaucggcgg

SEQ ID NO: 154541 - RNA, 22 nt, Mycobacterium tuberculosis H37Rv
ucggccaucaacuguagcuuug

SEQ ID NO: 154542 - RNA, 22 nt, Mycobacterium tuberculosis H37Rv
augggcgauuuugcgucugcuc

SEQ ID NO: 154543 - RNA, 22 nt, Mycobacterium tuberculosis H37Rv
uccgugucaugcggcggaucug

SEQ ID NO: 154544 - RNA, 22 nt, Mycobacterium tuberculosis H37Rv
cugugcaucgucgccggcgcga

SEQ ID NO: 154545 - RNA, 22 nt, Mycobacterium tuberculosis H37Rv
aaccgagcguugggccugccgu

SEQ ID NO: 154546 - RNA, 22 nt, Mycobacterium tuberculosis H37Rv
gcccgcaacuccaugcgcguac

SEQ ID NO: 154547 - RNA, 22 nt, Mycobacterium tuberculosis H37Rv
gaggaauucgcacccgcugccg

SEQ ID NO: 154548 - RNA, 22 nt, Mycobacterium tuberculosis H37Rv
ccgcuuggggugacacgggguu

SEQ ID NO: 154549 - RNA, 18 nt, Mycobacterium tuberculosis H37Rv
gcaagucccggagaaccu

SEQ ID NO: 154550 - RNA, 22 nt, Mycobacterium tuberculosis H37Rv
gguccgaaggcuucggcaagcc

SEQ ID NO: 154551 - RNA, 22 nt, Mycobacterium tuberculosis H37Rv
accgggcuggucgacggccagc

SEQ ID NO: 154552 - RNA, 19 nt, Mycobacterium tuberculosis H37Rv
agaguuacagccucagcga

SEQ ID NO: 154553 - RNA, 22 nt, Mycobacterium tuberculosis H37Rv
cggagcgacgucgcgaugguca

SEQ ID NO: 154554 - RNA, 22 nt, Mycobacterium tuberculosis H37Rv
accgaagccucgugcgcggcca

SEQ ID NO: 154555 - RNA, 22 nt, Mycobacterium tuberculosis H37Rv
ucuucgagcuccuuggcgaugc

SEQ ID NO: 154556 - RNA, 22 nt, Mycobacterium tuberculosis H37Rv
gacgaccgaugucugggugauc

SEQ ID NO: 154557 - RNA, 22 nt, Mycobacterium tuberculosis H37Rv
guauccgucgaucgaccucgau

SEQ ID NO: 154558 - RNA, 22 nt, Mycobacterium tuberculosis H37Rv
guucagggcaucgguccgugcc

SEQ ID NO: 154559 - RNA, 22 nt, Mycobacterium tuberculosis H37Rv
guuucgcugucgcuggccgugu

SEQ ID NO: 154560 - RNA, 22 nt, Mycobacterium tuberculosis H37Rv
cucgggucggguucgccgucga

SEQ ID NO: 154561 - RNA, 22 nt, Mycobacterium tuberculosis H37Rv
aucggucugcuggccagcgucg

SEQ ID NO: 154562 - RNA, 22 nt, Mycobacterium tuberculosis H37Rv
acggugucauagagcgagaacc

SEQ ID NO: 154563 - RNA, 22 nt, Mycobacterium tuberculosis H37Rv
aacuggccgugcucggcccgcu

SEQ ID NO: 154564 - RNA, 22 nt, Mycobacterium tuberculosis H37Rv
agucggcucgagcaacaccgug

SEQ ID NO: 154565 - RNA, 22 nt, Mycobacterium tuberculosis H37Rv
uagcguggcggcgccggacaac

SEQ ID NO: 154566 - RNA, 22 nt, Mycobacterium tuberculosis H37Rv
ugcucggcgcacccguuggcga

SEQ ID NO: 154567 - RNA, 22 nt, Mycobacterium tuberculosis H37Rv
agcagacgcaaaaucgcccauu

SEQ ID NO: 154568 - RNA, 22 nt, Mycobacterium tuberculosis H37Rv
acgguguucgguguggccgucg

SEQ ID NO: 154569 - RNA, 22 nt, Mycobacterium tuberculosis H37Rv
cacggugaucggggaccggucg

SEQ ID NO: 154570 - RNA, 22 nt, Mycobacterium tuberculosis H37Rv
agcgaccggacugguggucgga

SEQ ID NO: 154571 - RNA, 22 nt, Mycobacterium tuberculosis H37Rv
agugccgcguucaugucggcau

SEQ ID NO: 154572 - RNA, 22 nt, Mycobacterium tuberculosis H37Rv
gacgaaugcgaaugcauccgcu

SEQ ID NO: 154573 - RNA, 22 nt, Mycobacterium tuberculosis H37Rv
acacggucacgguggcgacguc

SEQ ID NO: 154574 - RNA, 22 nt, Mycobacterium tuberculosis H37Rv
gucgacggucuccggugguuga

SEQ ID NO: 154575 - RNA, 22 nt, Mycobacterium tuberculosis H37Rv
ugugcggcugguaugccgcucg

SEQ ID NO: 154576 - RNA, 22 nt, Mycobacterium tuberculosis H37Rv
ucgcggcaugggaucacugggu

SEQ ID NO: 154577 - RNA, 22 nt, Mycobacterium tuberculosis H37Rv
ugcgaucuggacggcggcgguc

SEQ ID NO: 154578 - RNA, 22 nt, Mycobacterium tuberculosis H37Rv
ggaguucaaugccacggcgucg

SEQ ID NO: 154579 - RNA, 22 nt, Mycobacterium tuberculosis H37Rv
acagcgucaaugcaccugcgau

SEQ ID NO: 154580 - RNA, 22 nt, Mycobacterium tuberculosis H37Rv
ugcagaauccguucgacgaguu

SEQ ID NO: 154581 - RNA, 22 nt, Mycobacterium tuberculosis H37Rv
gugcagguucguacuggcaugc

SEQ ID NO: 154582 - RNA, 20 nt, Mycobacterium tuberculosis H37Rv
guccuuggugccgaagugac

SEQ ID NO: 154583 - RNA, 21 nt, Mycobacterium tuberculosis H37Rv
acgccucucauguugugcgcc

SEQ ID NO: 154584 - RNA, 22 nt, Mycobacterium tuberculosis H37Rv
cuggccgagcuggucaacggcg

SEQ ID NO: 154585 - RNA, 23 nt, Mycobacterium tuberculosis H37Rv
acgacgccggccacagccuugac

SEQ ID NO: 154586 - RNA, 23 nt, Mycobacterium tuberculosis H37Rv
cuucgcgacugggagaaccacug

SEQ ID NO: 154587 - RNA, 22 nt, Mycobacterium tuberculosis H37Rv
cuggucuguaaucggugcccgg

SEQ ID NO: 154588 - RNA, 22 nt, Mycobacterium tuberculosis H37Rv
aacgccgacgguuggggugucg

SEQ ID NO: 154589 - RNA, 22 nt, Mycobacterium tuberculosis H37Rv
ucgcccugacgucacguucggc

SEQ ID NO: 154590 - RNA, 22 nt, Mycobacterium tuberculosis H37Rv
gaugaacaucgugaccgucuac

SEQ ID NO: 154591 - RNA, 22 nt, Mycobacterium tuberculosis H37Rv
aggucggcguaugggaaguacc

SEQ ID NO: 154592 - RNA, 22 nt, Mycobacterium tuberculosis H37Rv
ugaccgagagcaugcuggaguu

SEQ ID NO: 154593 - RNA, 22 nt, Mycobacterium tuberculosis H37Rv
cagacgcaaaagcccccgcacg

SEQ ID NO: 154594 - RNA, 22 nt, Mycobacterium tuberculosis H37Rv
gugccgacgacgugguguucag

SEQ ID NO: 154595 - RNA, 22 nt, Mycobacterium tuberculosis H37Rv
ggccgaaacaccgcgcgaaggg

SEQ ID NO: 154596 - RNA, 22 nt, Mycobacterium tuberculosis H37Rv
auuucggucggcucgucgacua

SEQ ID NO: 154597 - RNA, 22 nt, Mycobacterium tuberculosis H37Rv
gcugcaacaucaaaccgacucc

SEQ ID NO: 154598 - RNA, 22 nt, Mycobacterium tuberculosis H37Rv
cauccuggccuauuccggcggu

SEQ ID NO: 154599 - RNA, 22 nt, Mycobacterium tuberculosis H37Rv
aacucgacgugcaucccgguga

SEQ ID NO: 154600 - RNA, 22 nt, Mycobacterium tuberculosis H37Rv
auaccgcgaucgcuuuggccgc

SEQ ID NO: 154601 - RNA, 22 nt, Mycobacterium tuberculosis H37Rv
ugcgccgaaggcccagcgcgga

SEQ ID NO: 154602 - RNA, 22 nt, Mycobacterium tuberculosis H37Rv
uccgucggugauccuggccacc

SEQ ID NO: 154603 - RNA, 22 nt, Mycobacterium tuberculosis H37Rv
ucagcgaucccaaugccugggu

SEQ ID NO: 154604 - RNA, 22 nt, Mycobacterium tuberculosis H37Rv
cggucgacguuccuagcuuucg

SEQ ID NO: 154605 - RNA, 22 nt, Mycobacterium tuberculosis H37Rv
agucgcauaagcccccgacacg

SEQ ID NO: 154606 - RNA, 22 nt, Mycobacterium tuberculosis H37Rv
agcagacgcaaaaucgcccaau

SEQ ID NO: 154607 - RNA, 22 nt, Mycobacterium tuberculosis H37Rv
accgcgaucagcgcagcgaucg

SEQ ID NO: 154608 - RNA, 22 nt, Mycobacterium tuberculosis H37Rv
gccuggaggaccuggacucggc

SEQ ID NO: 154609 - RNA, 22 nt, Mycobacterium tuberculosis H37Rv
uccgcgucacaagauccgcucg

SEQ ID NO: 154610 - RNA, 22 nt, Mycobacterium tuberculosis H37Rv
cgacguucggguccggcgcugg

SEQ ID NO: 154611 - RNA, 22 nt, Mycobacterium tuberculosis H37Rv
ucgucgggcucuucagcgucgc

SEQ ID NO: 154612 - RNA, 22 nt, Mycobacterium tuberculosis H37Rv
gagcagacgcauaagcgcccau

SEQ ID NO: 154613 - RNA, 22 nt, Mycobacterium tuberculosis H37Rv
aacaccuuggguuccuggcugc

SEQ ID NO: 154614 - RNA, 22 nt, Mycobacterium tuberculosis H37Rv
cgcgagcagacgcagagucgca

SEQ ID NO: 154615 - RNA, 20 nt, Mycobacterium tuberculosis H37Rv
gcgauucugacuugcccagc

SEQ ID NO: 154616 - RNA, 22 nt, Mycobacterium tuberculosis H37Rv
cgagcagacgcauaagcccccg

SEQ ID NO: 154617 - RNA, 22 nt, Mycobacterium tuberculosis H37Rv
cugcgcaucgaggccggcgacg

SEQ ID NO: 154618 - RNA, 22 nt, Mycobacterium tuberculosis H37Rv
ccaagguggccgaucugcgccg

SEQ ID NO: 154619 - RNA, 22 nt, Mycobacterium tuberculosis H37Rv
augggcgauucugcgucugcuc

SEQ ID NO: 154620 - RNA, 22 nt, Mycobacterium tuberculosis H37Rv
cggguucgcgaucgcgccggag

SEQ ID NO: 154621 - RNA, 22 nt, Mycobacterium tuberculosis H37Rv
gaacgucucgugcuuggguggg

SEQ ID NO: 154622 - RNA, 22 nt, Mycobacterium tuberculosis H37Rv
cagguugaccgccacgauuccg

SEQ ID NO: 154623 - RNA, 19 nt, Mycobacterium tuberculosis H37Rv
caacggcgacgggcucguc

SEQ ID NO: 154624 - RNA, 22 nt, Mycobacterium tuberculosis H37Rv
gcgucgagacgaagcucaacaa

SEQ ID NO: 154625 - RNA, 22 nt, Mycobacterium tuberculosis H37Rv
ucggugcgccacggugucacca

SEQ ID NO: 154626 - RNA, 22 nt, Mycobacterium tuberculosis H37Rv
ugcgacucugcgucugcucgcg

SEQ ID NO: 154627 - RNA, 22 nt, Mycobacterium tuberculosis H37Rv
uugucaaaguuggaggcgggau

SEQ ID NO: 154628 - RNA, 22 nt, Mycobacterium tuberculosis H37Rv
uguuaucgacugauaaccgauu

SEQ ID NO: 154629 - RNA, 22 nt, Mycobacterium tuberculosis H37Rv
cugcaauucgacagcugugcgu

SEQ ID NO: 154630 - RNA, 22 nt, Mycobacterium tuberculosis H37Rv
gccgaguugcgucgcugggauc

SEQ ID NO: 154631 - RNA, 22 nt, Mycobacterium tuberculosis H37Rv
ugcgcccuugccugucgucgac

SEQ ID NO: 154632 - RNA, 20 nt, Mycobacterium tuberculosis H37Rv
caacggcgagcuucccgcac

SEQ ID NO: 154633 - RNA, 19 nt, Mycobacterium tuberculosis H37Rv
ugcgaaucgaagccugggc

SEQ ID NO: 154634 - RNA, 22 nt, Mycobacterium tuberculosis H37Rv
aucgcuucauccaugagcugcu

SEQ ID NO: 154635 - RNA, 22 nt, Mycobacterium tuberculosis H37Rv
aguuugucgggaucuugaccaa

SEQ ID NO: 154636 - RNA, 22 nt, Mycobacterium tuberculosis H37Rv
gcaccgcaucgccgaacuuccg

SEQ ID NO: 154637 - RNA, 22 nt, Mycobacterium tuberculosis H37Rv
gcggaguccuugcucaccauga

SEQ ID NO: 154638 - RNA, 22 nt, Mycobacterium tuberculosis H37Rv
ugggcgcuuaugcgucugcucg

SEQ ID NO: 154639 - RNA, 22 nt, Mycobacterium tuberculosis H37Rv
accgagaagucguaugcggugc

SEQ ID NO: 154640 - RNA, 22 nt, Mycobacterium tuberculosis H37Rv
cggugaucgaucugccggccuc

SEQ ID NO: 154641 - RNA, 22 nt, Mycobacterium tuberculosis H37Rv
gucgcaggauucccagucgcgg

SEQ ID NO: 154642 - RNA, 23 nt, Mycobacterium tuberculosis H37Rv
auuggcugccgauucguccccau

SEQ ID NO: 154643 - RNA, 22 nt, Mycobacterium tuberculosis H37Rv
cgcaucgagaucgacgucagcg

SEQ ID NO: 154644 - RNA, 22 nt, Mycobacterium tuberculosis H37Rv
gcccaucauguucuuuugcgcc

SEQ ID NO: 154645 - RNA, 22 nt, Mycobacterium tuberculosis H37Rv
ugcugcucgucggcggcuggca

SEQ ID NO: 154646 - RNA, 22 nt, Mycobacterium tuberculosis H37Rv
ucgaugcgccggacggugccgu

SEQ ID NO: 154647 - RNA, 22 nt, Mycobacterium tuberculosis H37Rv
ucgcguaugcgaagaucacgag

SEQ ID NO: 154648 - RNA, 22 nt, Mycobacterium tuberculosis H37Rv
ccaggacaggaugcugucggcc

SEQ ID NO: 154649 - RNA, 22 nt, Mycobacterium tuberculosis H37Rv
ucagcuguguccgcacaaccgg

SEQ ID NO: 154650 - RNA, 22 nt, Mycobacterium tuberculosis H37Rv
ucgaugccucacccagguacac

SEQ ID NO: 154651 - RNA, 22 nt, Mycobacterium tuberculosis H37Rv
accgaugcugacgaugcggucg

SEQ ID NO: 154652 - RNA, 22 nt, Mycobacterium tuberculosis H37Rv
gacggguguucccggaucggug

SEQ ID NO: 154653 - RNA, 22 nt, Mycobacterium tuberculosis H37Rv
agucggccagguacggcaucag

SEQ ID NO: 154654 - RNA, 22 nt, Mycobacterium tuberculosis H37Rv
gccaaaucgagccgagaguggg

SEQ ID NO: 154655 - RNA, 22 nt, Mycobacterium tuberculosis H37Rv
ucguaaugaaugucgaaccuga

SEQ ID NO: 154656 - RNA, 22 nt, Mycobacterium tuberculosis H37Rv
cgucccgaucacccaaccaggc

SEQ ID NO: 154657 - RNA, 22 nt, Mycobacterium tuberculosis H37Rv
gauccgcccagauuugccggaa

SEQ ID NO: 154658 - RNA, 22 nt, Mycobacterium tuberculosis H37Rv
ggcuggcagcucacgacgccuc

SEQ ID NO: 154659 - RNA, 22 nt, Mycobacterium tuberculosis H37Rv
cugggcacugaauaccggccag

SEQ ID NO: 154660 - RNA, 22 nt, Mycobacterium tuberculosis H37Rv
uggcucagcgggucaacgaggc

SEQ ID NO: 154661 - RNA, 22 nt, Mycobacterium tuberculosis H37Rv
gggccgaugcggaacucgauca

SEQ ID NO: 154662 - RNA, 20 nt, Mycobacterium tuberculosis H37Rv
cggauacacaacguggcugc

SEQ ID NO: 154663 - RNA, 22 nt, Mycobacterium tuberculosis H37Rv
gauuguucuggaugaucguggu

SEQ ID NO: 154664 - RNA, 22 nt, Mycobacterium tuberculosis H37Rv
ccgggcaaccauuacacaguug

SEQ ID NO: 154665 - RNA, 22 nt, Mycobacterium tuberculosis H37Rv
gagggacuuaugcgucugcuag

SEQ ID NO: 154666 - RNA, 22 nt, Mycobacterium tuberculosis H37Rv
ucucgcagugacguuacgcucg

SEQ ID NO: 154667 - RNA, 22 nt, Mycobacterium tuberculosis H37Rv
cgugauugugcccggcaccagc

SEQ ID NO: 154668 - RNA, 22 nt, Mycobacterium tuberculosis H37Rv
accucgacgagcaccauccggu

SEQ ID NO: 154669 - RNA, 22 nt, Mycobacterium tuberculosis H37Rv
cgucgccaucagaaggucaucg

SEQ ID NO: 154670 - RNA, 22 nt, Mycobacterium tuberculosis H37Rv
cgauggugugucggcgaucacg

SEQ ID NO: 154671 - RNA, 22 nt, Mycobacterium tuberculosis H37Rv
ccggugauaugggucgucucgu

SEQ ID NO: 154672 - RNA, 22 nt, Mycobacterium tuberculosis H37Rv
cgcaggucgcgaccacgcugac

SEQ ID NO: 154673 - RNA, 22 nt, Mycobacterium tuberculosis H37Rv
gucgugcgcgaaugccucgucg

SEQ ID NO: 154674 - RNA, 22 nt, Mycobacterium tuberculosis H37Rv
gcagaugauccucggcggugau

SEQ ID NO: 154675 - RNA, 22 nt, Mycobacterium tuberculosis H37Rv
acguacggauauacugaacgca

SEQ ID NO: 154676 - RNA, 22 nt, Mycobacterium tuberculosis H37Rv
gauguugacucugguggcgacg

SEQ ID NO: 154677 - RNA, 22 nt, Mycobacterium tuberculosis H37Rv
guggcacaccacccgacgucgc

SEQ ID NO: 154678 - RNA, 22 nt, Mycobacterium tuberculosis H37Rv
ccacgcugagccguggcgaauu

SEQ ID NO: 154679 - RNA, 22 nt, Mycobacterium tuberculosis H37Rv
gcgacagugaugcccagucugc

SEQ ID NO: 154680 - RNA, 22 nt, Mycobacterium tuberculosis H37Rv
caucgccucgaccggcggaaac

SEQ ID NO: 154681 - RNA, 22 nt, Mycobacterium tuberculosis H37Rv
guguccgucgugggccaguugg

SEQ ID NO: 154682 - RNA, 19 nt, Mycobacterium tuberculosis H37Rv
gccgggaaucgugcuuggc

SEQ ID NO: 154683 - RNA, 22 nt, Mycobacterium tuberculosis H37Rv
ucgaacauccacagcgccgcgg

SEQ ID NO: 154684 - RNA, 22 nt, Mycobacterium tuberculosis H37Rv
auggcugaacgggcgccacgcg

SEQ ID NO: 154685 - RNA, 22 nt, Mycobacterium tuberculosis H37Rv
aacagucgaccgacgcguucgu

SEQ ID NO: 154686 - RNA, 22 nt, Mycobacterium tuberculosis H37Rv
augucgagucgaacucggcgcu

SEQ ID NO: 154687 - RNA, 20 nt, Mycobacterium tuberculosis H37Rv
cgaucagcgucacgccuagu

SEQ ID NO: 154688 - RNA, 22 nt, Mycobacterium tuberculosis H37Rv
gcgagcuggaaugcggugugcu

SEQ ID NO: 154689 - RNA, 22 nt, Mycobacterium tuberculosis H37Rv
ugcaccucgaacgagguggcgu

SEQ ID NO: 154690 - RNA, 22 nt, Mycobacterium tuberculosis H37Rv
ucaccgggaugcacgucgaguu

SEQ ID NO: 154691 - RNA, 22 nt, Mycobacterium tuberculosis H37Rv
cgcaacguggcucuuacuggca

SEQ ID NO: 154692 - RNA, 22 nt, Mycobacterium tuberculosis H37Rv
gagcagacgcaaaaucgcccau

SEQ ID NO: 154693 - RNA, 22 nt, Mycobacterium tuberculosis H37Rv
uugucgccgugcaccaccugga

SEQ ID NO: 154694 - RNA, 22 nt, Mycobacterium tuberculosis H37Rv
caggacgguuagugcugauggg

SEQ ID NO: 154695 - RNA, 22 nt, Mycobacterium tuberculosis H37Rv
uuuggccuggcaugcguggaac

SEQ ID NO: 154696 - RNA, 22 nt, Mycobacterium tuberculosis H37Rv
uuugcgucgagaucgacggcag

SEQ ID NO: 154697 - RNA, 22 nt, Mycobacterium tuberculosis H37Rv
ccgguggacaagaucuuuaccc

SEQ ID NO: 154698 - RNA, 22 nt, Mycobacterium tuberculosis H37Rv
cgcgcguaucgcacgcauuggg

SEQ ID NO: 154699 - RNA, 22 nt, Mycobacterium tuberculosis H37Rv
cccaggcugaacauccgggccg

SEQ ID NO: 154700 - RNA, 22 nt, Mycobacterium tuberculosis H37Rv
cucuggccaaggugucgagcac

SEQ ID NO: 154701 - RNA, 22 nt, Mycobacterium tuberculosis H37Rv
gcccugaguucacgcucggcgc

SEQ ID NO: 154702 - RNA, 22 nt, Mycobacterium tuberculosis H37Rv
ugcguuucauacccgcagccuu

SEQ ID NO: 154703 - RNA, 22 nt, Mycobacterium tuberculosis H37Rv
ggcaacuccgggguggccagca

SEQ ID NO: 154704 - RNA, 22 nt, Mycobacterium tuberculosis H37Rv
cgcgagcagacacagaaucgca

SEQ ID NO: 154705 - RNA, 22 nt, Mycobacterium tuberculosis H37Rv
uguucgaagcuguggagcaaca

SEQ ID NO: 154706 - RNA, 22 nt, Mycobacterium tuberculosis H37Rv
uucaagaucgcgggcucgcagg

SEQ ID NO: 154707 - RNA, 22 nt, Mycobacterium tuberculosis H37Rv
ggugcgcucuggugccggagcu

SEQ ID NO: 154708 - RNA, 21 nt, Mycobacterium tuberculosis H37Rv
gcgcagcaucucagccagugc

SEQ ID NO: 154709 - RNA, 22 nt, Mycobacterium tuberculosis H37Rv
aagccggucacgcguggccaac

SEQ ID NO: 154710 - RNA, 22 nt, Mycobacterium tuberculosis H37Rv
acuugccgaacugggcgguguu

SEQ ID NO: 154711 - RNA, 22 nt, Mycobacterium tuberculosis H37Rv
caacgccguuucggcgaucgcu

SEQ ID NO: 154712 - RNA, 22 nt, Mycobacterium tuberculosis H37Rv
cggaugcgaguggugaguucuu

SEQ ID NO: 154713 - RNA, 22 nt, Mycobacterium tuberculosis H37Rv
gauaagaucccccgcuggcccu

SEQ ID NO: 154714 - RNA, 22 nt, Mycobacterium tuberculosis H37Rv
cugaugacagccuguguuuccg

SEQ ID NO: 154715 - RNA, 22 nt, Mycobacterium tuberculosis H37Rv
ccggucaaggugacgugcgugc

SEQ ID NO: 154716 - RNA, 22 nt, Mycobacterium tuberculosis H37Rv
acgugggcgccucggcggguuc

SEQ ID NO: 154717 - RNA, 22 nt, Mycobacterium tuberculosis H37Rv
gccgcgaugucgaucucggucu

SEQ ID NO: 154718 - RNA, 21 nt, Mycobacterium tuberculosis H37Rv
gcgagcucgucauggucuuuc

SEQ ID NO: 154719 - RNA, 18 nt, Mycobacterium tuberculosis H37Rv
ucguugauacagcgacca

SEQ ID NO: 154720 - RNA, 22 nt, Mycobacterium tuberculosis H37Rv
cguaccgccugcacgccgggcc

SEQ ID NO: 154721 - RNA, 22 nt, Mycobacterium tuberculosis H37Rv
ugcacggcgaugcggucuggca

SEQ ID NO: 154722 - RNA, 22 nt, Mycobacterium tuberculosis H37Rv
guaccgggucgagauugcggcc

SEQ ID NO: 154723 - RNA, 22 nt, Mycobacterium tuberculosis H37Rv
cguccgguugggauugucgagg

SEQ ID NO: 154724 - RNA, 22 nt, Mycobacterium tuberculosis H37Rv
cgucgagcagguagcgcacggc

SEQ ID NO: 154725 - RNA, 22 nt, Mycobacterium tuberculosis H37Rv
cgucgugguggucggcggcucg

SEQ ID NO: 154726 - RNA, 22 nt, Mycobacterium tuberculosis H37Rv
ggcugacgucgugguggcguau

SEQ ID NO: 154727 - RNA, 22 nt, Mycobacterium tuberculosis H37Rv
agacgcuguugucgcgcccguu

SEQ ID NO: 154728 - RNA, 22 nt, Mycobacterium tuberculosis H37Rv
uuugacuccacgcgaaacacag

SEQ ID NO: 154729 - RNA, 22 nt, Mycobacterium tuberculosis H37Rv
gaucgcugcgcugaucgcgguc

SEQ ID NO: 154730 - RNA, 22 nt, Mycobacterium tuberculosis H37Rv
uguagaucuccugaugcgccuu

SEQ ID NO: 154731 - RNA, 22 nt, Mycobacterium tuberculosis H37Rv
ugguuucccgugaggugaucgc

SEQ ID NO: 154732 - RNA, 22 nt, Mycobacterium tuberculosis H37Rv
gagcagacgcagaaguccccga

SEQ ID NO: 154733 - RNA, 22 nt, Mycobacterium tuberculosis H37Rv
gcccgauuuccucggugaaugg

SEQ ID NO: 154734 - RNA, 22 nt, Mycobacterium tuberculosis H37Rv
cccgguguugaagaagcccgac

SEQ ID NO: 154735 - RNA, 22 nt, Mycobacterium tuberculosis H37Rv
cgagcguaacgucacugcgaga

SEQ ID NO: 154736 - RNA, 22 nt, Mycobacterium tuberculosis H37Rv
gcugcagcggcucguggguggu

SEQ ID NO: 154737 - RNA, 22 nt, Mycobacterium tuberculosis H37Rv
gcagcuucgaugacuacgacca

SEQ ID NO: 154738 - RNA, 22 nt, Mycobacterium tuberculosis H37Rv
ccgucucaccgaggauuucgac

SEQ ID NO: 154739 - RNA, 22 nt, Mycobacterium tuberculosis H37Rv
gucgugagauucacagucgcag

SEQ ID NO: 154740 - RNA, 22 nt, Mycobacterium tuberculosis H37Rv
cgcucuggcguggaucucggcg

SEQ ID NO: 154741 - RNA, 19 nt, Mycobacterium tuberculosis H37Rv
cugcgcgacaacgaacccg

SEQ ID NO: 154742 - RNA, 22 nt, Mycobacterium tuberculosis H37Rv
cgagcagucgcauaagcccccg

SEQ ID NO: 154743 - RNA, 22 nt, Mycobacterium tuberculosis H37Rv
gucggacuaucugguggccgau

SEQ ID NO: 154744 - RNA, 22 nt, Mycobacterium tuberculosis H37Rv
uugucggaguaggcaccgccga

SEQ ID NO: 154745 - RNA, 22 nt, Mycobacterium tuberculosis H37Rv
aacgauguugggccggaaaugc

SEQ ID NO: 154746 - RNA, 22 nt, Mycobacterium tuberculosis H37Rv
ggucugcgcccuccgggcgauc

SEQ ID NO: 154747 - RNA, 22 nt, Mycobacterium tuberculosis H37Rv
ccagcgugacgccacugcgaga

SEQ ID NO: 154748 - RNA, 22 nt, Mycobacterium tuberculosis H37Rv
ucgcgauggugguggcggccug

SEQ ID NO: 154749 - RNA, 20 nt, Mycobacterium tuberculosis H37Rv
agccuuuguuccggaagcag

SEQ ID NO: 154750 - RNA, 22 nt, Mycobacterium tuberculosis H37Rv
cgcagugacguuuguuggcugu

SEQ ID NO: 154751 - RNA, 22 nt, Mycobacterium tuberculosis H37Rv
ucaccgccgcgguuggugcgca

SEQ ID NO: 154752 - RNA, 22 nt, Mycobacterium tuberculosis H37Rv
auccgcuagccaacguuaauaa

SEQ ID NO: 154753 - RNA, 22 nt, Mycobacterium tuberculosis H37Rv
ggcggcuugaacuccggugccg

SEQ ID NO: 154754 - RNA, 22 nt, Mycobacterium tuberculosis H37Rv
ucgguggcgccgacaugccggu

SEQ ID NO: 154755 - RNA, 22 nt, Mycobacterium tuberculosis H37Rv
ggcgagcagacacagagucgca

SEQ ID NO: 154756 - RNA, 22 nt, Mycobacterium tuberculosis H37Rv
ggcgaucgguugucccgcgaca

SEQ ID NO: 154757 - RNA, 22 nt, Mycobacterium tuberculosis H37Rv
ugcgcuugcccuugccgaguuu

SEQ ID NO: 154758 - RNA, 22 nt, Mycobacterium tuberculosis H37Rv
aguugucgcgcugaggcgggca

SEQ ID NO: 154759 - RNA, 22 nt, Mycobacterium tuberculosis H37Rv
ggcacugucagccuguccucac

SEQ ID NO: 154760 - RNA, 22 nt, Mycobacterium tuberculosis H37Rv
uguacagcuggaucgugcugca

SEQ ID NO: 154761 - RNA, 22 nt, Mycobacterium tuberculosis H37Rv
gaugagaucaacgacgucgucc

SEQ ID NO: 154762 - RNA, 22 nt, Mycobacterium tuberculosis H37Rv
ucaucgggcacaucgucgcggu

SEQ ID NO: 154763 - RNA, 22 nt, Mycobacterium tuberculosis H37Rv
accuuggcguauugggcuucuu

SEQ ID NO: 154764 - RNA, 22 nt, Mycobacterium tuberculosis H37Rv
cgagguguggucauggagcacc

SEQ ID NO: 154765 - RNA, 22 nt, Mycobacterium tuberculosis H37Rv
aagcccgcguugugggcaucuu

SEQ ID NO: 154766 - RNA, 22 nt, Mycobacterium tuberculosis H37Rv
caucgcgguggugcgcgcuucg

SEQ ID NO: 154767 - RNA, 22 nt, Mycobacterium tuberculosis H37Rv
cuacgccgcgguguucaucgac

SEQ ID NO: 154768 - RNA, 22 nt, Mycobacterium tuberculosis H37Rv
cgugcaccugcggaccaugcau

SEQ ID NO: 154769 - RNA, 22 nt, Mycobacterium tuberculosis H37Rv
cgucugccccaccuucugcuug

SEQ ID NO: 154770 - RNA, 22 nt, Mycobacterium tuberculosis H37Rv
agcgugaucaggcucggcucgc

SEQ ID NO: 154771 - RNA, 21 nt, Mycobacterium tuberculosis H37Rv
gcgagcagggcaucaccgccg

SEQ ID NO: 154772 - RNA, 22 nt, Mycobacterium tuberculosis H37Rv
ucgcagccacguuacgcucgcg

SEQ ID NO: 154773 - RNA, 22 nt, Mycobacterium tuberculosis H37Rv
cgcagcgucaagguuuccgaag

SEQ ID NO: 154774 - RNA, 22 nt, Mycobacterium tuberculosis H37Rv
gucgagcaggaccuuggcuuca

SEQ ID NO: 154775 - RNA, 22 nt, Mycobacterium tuberculosis H37Rv
acccguuguugagugccacgau

SEQ ID NO: 154776 - RNA, 22 nt, Mycobacterium tuberculosis H37Rv
gcgcacgucguugucggcuccu

SEQ ID NO: 154777 - RNA, 22 nt, Mycobacterium tuberculosis H37Rv
gcggagucgcgccaauggcuug

SEQ ID NO: 154778 - RNA, 22 nt, Mycobacterium tuberculosis H37Rv
agcagacgcaaaaucgcccgaa

SEQ ID NO: 154779 - RNA, 22 nt, Mycobacterium tuberculosis H37Rv
caccugccgaucgcacagguug

SEQ ID NO: 154780 - RNA, 22 nt, Mycobacterium tuberculosis H37Rv
cucgucguucuacugcccgcga

SEQ ID NO: 154781 - RNA, 22 nt, Mycobacterium tuberculosis H37Rv
guccggaugcacuucgcgcagc

SEQ ID NO: 154782 - RNA, 22 nt, Mycobacterium tuberculosis H37Rv
gccggaacgguguagucgauga

SEQ ID NO: 154783 - RNA, 22 nt, Mycobacterium tuberculosis H37Rv
uagcccaguucacgugccaaau

SEQ ID NO: 154784 - RNA, 22 nt, Mycobacterium tuberculosis H37Rv
ucggcggugaucuugccuacuu

SEQ ID NO: 154785 - RNA, 22 nt, Mycobacterium tuberculosis H37Rv
ugucgccgcaaccgucguuauc

SEQ ID NO: 154786 - RNA, 22 nt, Mycobacterium tuberculosis H37Rv
ucgcaguccgguuacgcucgcg

SEQ ID NO: 154787 - RNA, 22 nt, Mycobacterium tuberculosis H37Rv
aacuccagcaugcucucgguca

SEQ ID NO: 154788 - RNA, 18 nt, Mycobacterium tuberculosis H37Rv
uggugcaccuuguuuggg

SEQ ID NO: 154789 - RNA, 22 nt, Mycobacterium tuberculosis H37Rv
aacuccucgacguccugcaugc

SEQ ID NO: 154790 - RNA, 22 nt, Mycobacterium tuberculosis H37Rv
gcagacgcaaaaucgcccaaau

SEQ ID NO: 154791 - RNA, 20 nt, Mycobacterium tuberculosis H37Rv
cggugucgccgugcuugccg

SEQ ID NO: 154792 - RNA, 22 nt, Mycobacterium tuberculosis H37Rv
ccgaacgcaucggugugacguu

SEQ ID NO: 154793 - RNA, 22 nt, Mycobacterium tuberculosis H37Rv
augcagccggucucggcgccgc

SEQ ID NO: 154794 - RNA, 21 nt, Mycobacterium tuberculosis H37Rv
cgaugcggcccagauugacgc

SEQ ID NO: 154795 - RNA, 21 nt, Mycobacterium tuberculosis H37Rv
gcacacuggaagccagcacgc

SEQ ID NO: 154796 - RNA, 22 nt, Mycobacterium tuberculosis H37Rv
ucaggugguauccgaugucuuu

SEQ ID NO: 154797 - RNA, 22 nt, Mycobacterium tuberculosis H37Rv
cgagcagacgcaaaaucgccca

SEQ ID NO: 154798 - RNA, 22 nt, Mycobacterium tuberculosis H37Rv
gacaccguugccgacggccgcc

SEQ ID NO: 154799 - RNA, 22 nt, Mycobacterium tuberculosis H37Rv
acugcuuuccugucugggcggc

SEQ ID NO: 154800 - RNA, 22 nt, Mycobacterium tuberculosis H37Rv
gcgguguccgcguucgggauga

SEQ ID NO: 154801 - RNA, 22 nt, Mycobacterium tuberculosis H37Rv
cggcugauccccaucgagggca

SEQ ID NO: 154802 - RNA, 19 nt, Mycobacterium tuberculosis H37Rv
cucgcgguguuuuccgacc

SEQ ID NO: 154803 - RNA, 22 nt, Mycobacterium tuberculosis H37Rv
gaugccgacguggucggacugg

SEQ ID NO: 154804 - RNA, 22 nt, Mycobacterium tuberculosis H37Rv
ugacgaccgcggugagcgcagc

SEQ ID NO: 154805 - RNA, 22 nt, Mycobacterium tuberculosis H37Rv
cgcuugaugcccggucggcaag

SEQ ID NO: 154806 - RNA, 22 nt, Mycobacterium tuberculosis H37Rv
uugccgauggaucguucguacg

SEQ ID NO: 154807 - RNA, 22 nt, Mycobacterium tuberculosis H37Rv
caucucugugucgauccgauga

SEQ ID NO: 154808 - RNA, 21 nt, Mycobacterium tuberculosis H37Rv
ucaccgcgacggcuugccggg

SEQ ID NO: 154809 - RNA, 22 nt, Mycobacterium tuberculosis H37Rv
cgaacagacacagaaucgcacg

SEQ ID NO: 154810 - RNA, 22 nt, Mycobacterium tuberculosis H37Rv
ggucaucgcgugauccuucgaa

SEQ ID NO: 154811 - RNA, 22 nt, Mycobacterium tuberculosis H37Rv
agacgcauaagcccccgacacg

SEQ ID NO: 154812 - RNA, 22 nt, Mycobacterium tuberculosis H37Rv
agugcgacucugcgucugcuca

SEQ ID NO: 154813 - RNA, 22 nt, Mycobacterium tuberculosis H37Rv
gucgguucggucggccugcgaa

SEQ ID NO: 154814 - RNA, 22 nt, Mycobacterium tuberculosis H37Rv
accagugucgcgagguccugcu

SEQ ID NO: 154815 - RNA, 22 nt, Mycobacterium tuberculosis H37Rv
ugcccgucgccaaguacgacug

SEQ ID NO: 154816 - RNA, 22 nt, Mycobacterium tuberculosis H37Rv
ugccgauugugaaucuggcgac

SEQ ID NO: 154817 - RNA, 22 nt, Mycobacterium tuberculosis H37Rv
gucggcgugcgggugaugccgg

SEQ ID NO: 154818 - RNA, 22 nt, Mycobacterium tuberculosis H37Rv
ucccgacgugcgcgccgggguc

SEQ ID NO: 154819 - RNA, 22 nt, Mycobacterium tuberculosis H37Rv
caccacuucagguugcgugacg

SEQ ID NO: 154820 - RNA, 23 nt, Mycobacterium tuberculosis H37Rv
ugcgauucugugucugcucgcgc

SEQ ID NO: 154821 - RNA, 22 nt, Mycobacterium tuberculosis H37Rv
uuucgggcgauuuugcgucugc

SEQ ID NO: 154822 - RNA, 22 nt, Mycobacterium tuberculosis H37Rv
cgaguaucgcuugcgcaccgau

SEQ ID NO: 154823 - RNA, 22 nt, Mycobacterium tuberculosis H37Rv
cugaucgcgucaucgaucgugc

SEQ ID NO: 154824 - RNA, 22 nt, Mycobacterium tuberculosis H37Rv
gcaugcgauucugcgucugcuc

SEQ ID NO: 154825 - RNA, 22 nt, Mycobacterium tuberculosis H37Rv
cgguugacgggcguccgcgccg

SEQ ID NO: 154826 - RNA, 22 nt, Mycobacterium tuberculosis H37Rv
accaggucgccgccauaggggu

SEQ ID NO: 154827 - RNA, 22 nt, Mycobacterium tuberculosis H37Rv
ucgacgguguaacccgccgcga

SEQ ID NO: 154828 - RNA, 22 nt, Mycobacterium tuberculosis H37Rv
uucaggccgaucggaggacgcc

SEQ ID NO: 154829 - RNA, 23 nt, Mycobacterium tuberculosis H37Rv
cgagggcuuuagugucugcucgc

SEQ ID NO: 154830 - RNA, 22 nt, Mycobacterium tuberculosis H37Rv
ccggguaucggcugcaccccgu

SEQ ID NO: 154831 - RNA, 22 nt, Mycobacterium tuberculosis H37Rv
gcgucgacucagucgccgccga

SEQ ID NO: 154832 - RNA, 22 nt, Mycobacterium tuberculosis H37Rv
cacggcguguuugagugcgagu

SEQ ID NO: 154833 - RNA, 22 nt, Mycobacterium tuberculosis H37Rv
gagcagacgcagaaucgcccau

SEQ ID NO: 154834 - RNA, 22 nt, Mycobacterium tuberculosis H37Rv
cggcuucugcaccagcggguca

SEQ ID NO: 154835 - RNA, 22 nt, Mycobacterium tuberculosis H37Rv
gcaggcagugucaugccgccga

SEQ ID NO: 154836 - RNA, 23 nt, Mycobacterium tuberculosis H37Rv
ggguccguuucccguggccgccc

SEQ ID NO: 154837 - RNA, 21 nt, Mycobacterium tuberculosis H37Rv
ucgccguggcguuacgcucgc

SEQ ID NO: 154838 - RNA, 22 nt, Mycobacterium tuberculosis H37Rv
cccgauccacggugaccagggg

SEQ ID NO: 154839 - RNA, 22 nt, Mycobacterium tuberculosis H37Rv
uuccggcgcugacggugagcag

SEQ ID NO: 154840 - RNA, 22 nt, Mycobacterium tuberculosis H37Rv
accggugugcuggcgaagguuc

SEQ ID NO: 154841 - RNA, 22 nt, Mycobacterium tuberculosis H37Rv
cgcugccaguucaccagccgca

SEQ ID NO: 154842 - RNA, 22 nt, Mycobacterium tuberculosis H37Rv
cauggcagguuuucgacgaugg

SEQ ID NO: 154843 - RNA, 22 nt, Mycobacterium tuberculosis H37Rv
gaucugguguguuggcgcgccg

SEQ ID NO: 154844 - RNA, 22 nt, Mycobacterium tuberculosis H37Rv
ucggugagcgccugcuucaggg

SEQ ID NO: 154845 - RNA, 22 nt, Mycobacterium tuberculosis H37Rv
caucgaggagaugcaggcgugg

SEQ ID NO: 154846 - RNA, 22 nt, Mycobacterium tuberculosis H37Rv
agaccgucgcggccaggcagca

SEQ ID NO: 154847 - RNA, 22 nt, Mycobacterium tuberculosis H37Rv
uccacgcaacuggccgcgacac

SEQ ID NO: 154848 - RNA, 22 nt, Mycobacterium tuberculosis H37Rv
uugcccgcugaacuguugcccg

SEQ ID NO: 154849 - RNA, 22 nt, Mycobacterium tuberculosis H37Rv
gucgaucggcgcguucgagcac

SEQ ID NO: 154850 - RNA, 22 nt, Mycobacterium tuberculosis H37Rv
aaggccggcaacggcggugccg

SEQ ID NO: 154851 - RNA, 22 nt, Mycobacterium tuberculosis H37Rv
gcgguggaucucggcgccgauu

SEQ ID NO: 154852 - RNA, 22 nt, Mycobacterium tuberculosis H37Rv
ucgagacgauuugucggcagau

SEQ ID NO: 154853 - RNA, 22 nt, Mycobacterium tuberculosis H37Rv
gauuggucuagagcauucccgg

SEQ ID NO: 154854 - RNA, 22 nt, Mycobacterium tuberculosis H37Rv
ucgaugucggccuugguggccg

SEQ ID NO: 154855 - RNA, 22 nt, Mycobacterium tuberculosis H37Rv
ucgacgcgggaacaccguuggg

SEQ ID NO: 154856 - RNA, 22 nt, Mycobacterium tuberculosis H37Rv
gguucuccgggacuugcucgcg

SEQ ID NO: 154857 - RNA, 22 nt, Mycobacterium tuberculosis H37Rv
aucgugguggaggagaaccgcu

SEQ ID NO: 154858 - RNA, 23 nt, Mycobacterium tuberculosis H37Rv
uacggcgucacgauguugaaggc

SEQ ID NO: 154859 - RNA, 22 nt, Mycobacterium tuberculosis H37Rv
cuggcgguuuggcugcuguuga

SEQ ID NO: 154860 - RNA, 22 nt, Mycobacterium tuberculosis H37Rv
ggugcagcggucagcaguccga

SEQ ID NO: 154861 - RNA, 22 nt, Mycobacterium tuberculosis H37Rv
gcccauuugcccgacgucgcau

SEQ ID NO: 154862 - RNA, 22 nt, Mycobacterium tuberculosis H37Rv
gaugcccacgacgacgauaucg

SEQ ID NO: 154863 - RNA, 22 nt, Mycobacterium tuberculosis H37Rv
cucggugucaaggcgauuagcg

SEQ ID NO: 154864 - RNA, 23 nt, Mycobacterium tuberculosis H37Rv
cauccugcuggugcggaccggca

SEQ ID NO: 154865 - RNA, 22 nt, Mycobacterium tuberculosis H37Rv
gugccgugggucggcaauagca

SEQ ID NO: 154866 - RNA, 22 nt, Mycobacterium tuberculosis H37Rv
ugguggacgcagagucaacacg

SEQ ID NO: 154867 - RNA, 22 nt, Mycobacterium tuberculosis H37Rv
ugcuggcuaccuacucggaguu

SEQ ID NO: 154868 - RNA, 21 nt, Mycobacterium tuberculosis H37Rv
cggugcuguucgagcuuuaug

SEQ ID NO: 154869 - RNA, 22 nt, Mycobacterium tuberculosis H37Rv
ccggaagcagcuccggauucaa

SEQ ID NO: 154870 - RNA, 21 nt, Mycobacterium tuberculosis H37Rv
gcuaccgcgcccgugagcgcc

SEQ ID NO: 154871 - RNA, 22 nt, Mycobacterium tuberculosis H37Rv
ugaauccgagggcguuacggca

SEQ ID NO: 154872 - RNA, 22 nt, Mycobacterium tuberculosis H37Rv
uggucgaugaucaaggggcgcg

SEQ ID NO: 154873 - RNA, 23 nt, Mycobacterium tuberculosis H37Rv
augacgggauucugcuucgcaaa

SEQ ID NO: 154874 - RNA, 22 nt, Mycobacterium tuberculosis H37Rv
cgcuaugcugacugauuccgcg

SEQ ID NO: 154875 - RNA, 22 nt, Mycobacterium tuberculosis H37Rv
ugcgauucugcgucugcucgcc

SEQ ID NO: 154876 - RNA, 22 nt, Mycobacterium tuberculosis H37Rv
ucgcccugaguucacgcucggc

SEQ ID NO: 154877 - RNA, 22 nt, Mycobacterium tuberculosis H37Rv
ggugccuggucggcauuuucgc

SEQ ID NO: 154878 - RNA, 21 nt, Mycobacterium tuberculosis H37Rv
gguucucgagguagcugggcu

SEQ ID NO: 154879 - RNA, 23 nt, Mycobacterium tuberculosis H37Rv
acgucaugaaugugguguugcgg

SEQ ID NO: 154880 - RNA, 22 nt, Mycobacterium tuberculosis H37Rv
ccgcuguugccguugguccagc

SEQ ID NO: 154881 - RNA, 22 nt, Mycobacterium tuberculosis H37Rv
acccggaugucuuucgcgccga

SEQ ID NO: 154882 - RNA, 22 nt, Mycobacterium tuberculosis H37Rv
ucgggaaggcucgguucucguc

SEQ ID NO: 154883 - RNA, 21 nt, Mycobacterium tuberculosis H37Rv
ggaugccguaaccgauugccc

SEQ ID NO: 154884 - RNA, 22 nt, Mycobacterium tuberculosis H37Rv
cgaugagaucuguuccggucgc

SEQ ID NO: 154885 - RNA, 22 nt, Mycobacterium tuberculosis H37Rv
ucgcgcuggcagacccgccgcc

SEQ ID NO: 154886 - RNA, 22 nt, Mycobacterium tuberculosis H37Rv
uggugccgggcacaaucacggc

SEQ ID NO: 154887 - RNA, 22 nt, Mycobacterium tuberculosis H37Rv
cccggguuugaccacgaugcug

SEQ ID NO: 154888 - RNA, 22 nt, Mycobacterium tuberculosis H37Rv
guugucgacgaagugcacggcu

SEQ ID NO: 154889 - RNA, 22 nt, Mycobacterium tuberculosis H37Rv
gugugagccugacagcccgaca

SEQ ID NO: 154890 - RNA, 22 nt, Mycobacterium tuberculosis H37Rv
uccgugugucacgacgucgccu

SEQ ID NO: 154891 - RNA, 22 nt, Mycobacterium tuberculosis H37Rv
aagaacgcgucguagcgcucgu

SEQ ID NO: 154892 - RNA, 22 nt, Mycobacterium tuberculosis H37Rv
uggugcgcagaccacgaucggc

SEQ ID NO: 154893 - RNA, 23 nt, Mycobacterium tuberculosis H37Rv
auccgccgccuugaacucccacg

SEQ ID NO: 154894 - RNA, 22 nt, Mycobacterium tuberculosis H37Rv
gucggcgugggcuuuggaaacg

SEQ ID NO: 154895 - RNA, 22 nt, Mycobacterium tuberculosis H37Rv
ccgacgaggaaauggcuccgau

SEQ ID NO: 154896 - RNA, 22 nt, Mycobacterium tuberculosis H37Rv
cccgucguacggcuggaucugg

SEQ ID NO: 154897 - RNA, 22 nt, Mycobacterium tuberculosis H37Rv
gcggugaccgggucguggauau

SEQ ID NO: 154898 - RNA, 22 nt, Mycobacterium tuberculosis H37Rv
cgccugguggggucgaacugug

SEQ ID NO: 154899 - RNA, 22 nt, Mycobacterium tuberculosis H37Rv
cgcgaucacaccggcguaggcg

SEQ ID NO: 154900 - RNA, 22 nt, Mycobacterium tuberculosis H37Rv
gcgucgugccauucacaguggc

SEQ ID NO: 154901 - RNA, 22 nt, Mycobacterium tuberculosis H37Rv
ugccaguaccucucgaugccaa

SEQ ID NO: 154902 - RNA, 21 nt, Mycobacterium tuberculosis H37Rv
cgauccggccgggauuuucgg

SEQ ID NO: 154903 - RNA, 22 nt, Mycobacterium tuberculosis H37Rv
auugugaaaugugcgacgccag

SEQ ID NO: 154904 - RNA, 22 nt, Mycobacterium tuberculosis H37Rv
ugggacagcuggaaguuaucgg

SEQ ID NO: 154905 - RNA, 22 nt, Mycobacterium tuberculosis H37Rv
gucagggcgacuuuuugauccg

SEQ ID NO: 154906 - RNA, 22 nt, Mycobacterium tuberculosis H37Rv
cgugcucgauccgacgcggcuc

SEQ ID NO: 154907 - RNA, 22 nt, Mycobacterium tuberculosis H37Rv
cugcggagaucuaccagcucga

SEQ ID NO: 154908 - RNA, 22 nt, Mycobacterium tuberculosis H37Rv
gcggcgaucaagcccgacuagu

SEQ ID NO: 154909 - RNA, 22 nt, Mycobacterium tuberculosis H37Rv
caaaggccuuuccugcugggcu

SEQ ID NO: 154910 - RNA, 22 nt, Mycobacterium tuberculosis H37Rv
uugguagccgaugcgugcaguu

SEQ ID NO: 154911 - RNA, 22 nt, Mycobacterium tuberculosis H37Rv
ugucgcagccugcacgagggug

SEQ ID NO: 154912 - RNA, 22 nt, Mycobacterium tuberculosis H37Rv
ugaucgacuucgaagacgaugg

SEQ ID NO: 154913 - RNA, 22 nt, Mycobacterium tuberculosis H37Rv
caccgggauggaaaccacccgc

SEQ ID NO: 154914 - RNA, 22 nt, Mycobacterium tuberculosis H37Rv
agaucgugauugccgugccggc

SEQ ID NO: 154915 - RNA, 22 nt, Mycobacterium tuberculosis H37Rv
guccggcuacgaucaugcccgc

SEQ ID NO: 154916 - RNA, 22 nt, Mycobacterium tuberculosis H37Rv
ucgauggugaugacgcuggcgc

SEQ ID NO: 154917 - RNA, 22 nt, Mycobacterium tuberculosis H37Rv
acuugcucgccgaccugcugcc

SEQ ID NO: 154918 - RNA, 22 nt, Mycobacterium tuberculosis H37Rv
agcagacgcaaaaugcccccga

SEQ ID NO: 154919 - RNA, 22 nt, Mycobacterium tuberculosis H37Rv
gagaucaacauuuugcaggcaa

SEQ ID NO: 154920 - RNA, 22 nt, Mycobacterium tuberculosis H37Rv
auggccaaccucccgacuggua

SEQ ID NO: 154921 - RNA, 22 nt, Mycobacterium tuberculosis H37Rv
ucugcuggucgaugcgggacug

SEQ ID NO: 154922 - RNA, 21 nt, Mycobacterium tuberculosis H37Rv
cgauucugugucugcucggcg

SEQ ID NO: 154923 - RNA, 22 nt, Mycobacterium tuberculosis H37Rv
cgagacgagccacggcuucgcc

SEQ ID NO: 154924 - RNA, 22 nt, Mycobacterium tuberculosis H37Rv
cauggugggcgcgggccagcac

SEQ ID NO: 154925 - RNA, 22 nt, Mycobacterium tuberculosis H37Rv
gcgugagguccgcggccuguag

SEQ ID NO: 154926 - RNA, 22 nt, Mycobacterium tuberculosis H37Rv
gcuggaauucuuuggauucgcc

SEQ ID NO: 154927 - RNA, 22 nt, Mycobacterium tuberculosis H37Rv
ucgacgguuccucguucggcac

SEQ ID NO: 154928 - RNA, 22 nt, Mycobacterium tuberculosis H37Rv
aaaggccuuacccuggcugggu

SEQ ID NO: 154929 - RNA, 22 nt, Mycobacterium tuberculosis H37Rv
aucggcuuucccgccgcccgag

SEQ ID NO: 154930 - RNA, 22 nt, Mycobacterium tuberculosis H37Rv
agaccgguuacccggugaucuc

SEQ ID NO: 154931 - RNA, 22 nt, Mycobacterium tuberculosis H37Rv
ggugagcagacgcagagucgca

SEQ ID NO: 154932 - RNA, 22 nt, Mycobacterium tuberculosis H37Rv
guugggcagcgucacggucguc

SEQ ID NO: 154933 - RNA, 21 nt, Mycobacterium tuberculosis H37Rv
acgagcccaucgcgaacucgu

SEQ ID NO: 154934 - RNA, 22 nt, Mycobacterium tuberculosis H37Rv
gagguguccgacgaaccugguu

SEQ ID NO: 154935 - RNA, 22 nt, Mycobacterium tuberculosis H37Rv
gguucgagcuggacgcgggucu

SEQ ID NO: 154936 - RNA, 18 nt, Mycobacterium tuberculosis H37Rv
ucaucgagcacggguuga

SEQ ID NO: 154937 - RNA, 22 nt, Mycobacterium tuberculosis H37Rv
acgcuugacguggugaguauaa

SEQ ID NO: 154938 - RNA, 19 nt, Mycobacterium tuberculosis H37Rv
agcucgcgcagccgggugg

SEQ ID NO: 154939 - RNA, 22 nt, Mycobacterium tuberculosis H37Rv
aaugaugccgucgguggccagg

SEQ ID NO: 154940 - RNA, 22 nt, Mycobacterium tuberculosis H37Rv
ggcugaguuuagucaagcgcgu

SEQ ID NO: 154941 - RNA, 22 nt, Mycobacterium tuberculosis H37Rv
agcguguugauguuguccagua

SEQ ID NO: 154942 - RNA, 22 nt, Mycobacterium tuberculosis H37Rv
uaucgugggaugcgcuacuccu

SEQ ID NO: 154943 - RNA, 20 nt, Mycobacterium tuberculosis H37Rv
cacuggguacacgcucggcg

SEQ ID NO: 154944 - RNA, 22 nt, Mycobacterium tuberculosis H37Rv
cagauccuucuggccgcuggca

SEQ ID NO: 154945 - RNA, 22 nt, Mycobacterium tuberculosis H37Rv
ucgacuugcccgaaccgcuggg

SEQ ID NO: 154946 - RNA, 22 nt, Mycobacterium tuberculosis H37Rv
cgcuaacgucgaucucggcgca

SEQ ID NO: 154947 - RNA, 22 nt, Mycobacterium tuberculosis H37Rv
gugacggcgagccgccaguuga

SEQ ID NO: 154948 - RNA, 21 nt, Mycobacterium tuberculosis H37Rv
gcucugcaucgucgccggcgg

SEQ ID NO: 154949 - RNA, 22 nt, Mycobacterium tuberculosis H37Rv
guggccgucgaccaccgugacg

SEQ ID NO: 154950 - RNA, 22 nt, Mycobacterium tuberculosis H37Rv
ugucggagccgacuuucgccgc

SEQ ID NO: 154951 - RNA, 18 nt, Mycobacterium tuberculosis H37Rv
cgcugacaccaucagcau

SEQ ID NO: 154952 - RNA, 22 nt, Mycobacterium tuberculosis H37Rv
acgccagaacucaauaccgucu

SEQ ID NO: 154953 - RNA, 22 nt, Mycobacterium tuberculosis H37Rv
ggucccuuaaacccgaaugccg

SEQ ID NO: 154954 - RNA, 22 nt, Mycobacterium tuberculosis H37Rv
ugcgauucugcgucugcucgcg

SEQ ID NO: 154955 - RNA, 22 nt, Mycobacterium tuberculosis H37Rv
aaccggugcaacaacgcacgcu

SEQ ID NO: 154956 - RNA, 22 nt, Mycobacterium tuberculosis H37Rv
guugucaugugcauggugaccg

SEQ ID NO: 154957 - RNA, 22 nt, Mycobacterium tuberculosis H37Rv
cggacaccagcggccaccgauu

SEQ ID NO: 154958 - RNA, 22 nt, Mycobacterium tuberculosis H37Rv
cucgaugaugucguugacgucg

SEQ ID NO: 154959 - RNA, 22 nt, Mycobacterium tuberculosis H37Rv
gcggcgaaggugagcuggggau

SEQ ID NO: 154960 - RNA, 22 nt, Mycobacterium tuberculosis H37Rv
cgcggugauccaucucgccccg

SEQ ID NO: 154961 - RNA, 22 nt, Mycobacterium tuberculosis H37Rv
ccgguucaucguaaucgggguc

SEQ ID NO: 154962 - RNA, 22 nt, Mycobacterium tuberculosis H37Rv
auucgggaguagcgcuccuuga

SEQ ID NO: 154963 - RNA, 22 nt, Mycobacterium tuberculosis H37Rv
gcagaucggaaucgucgucgac

SEQ ID NO: 154964 - RNA, 22 nt, Mycobacterium tuberculosis H37Rv
accugcuccuugcugaucccgg

SEQ ID NO: 154965 - RNA, 22 nt, Mycobacterium tuberculosis H37Rv
ccgagaucaacguucugcaggc

SEQ ID NO: 154966 - RNA, 22 nt, Mycobacterium tuberculosis H37Rv
gcugccucgcugggcgcccagg

SEQ ID NO: 154967 - RNA, 22 nt, Mycobacterium tuberculosis H37Rv
gaucaccgaauugguagaugac

SEQ ID NO: 154968 - RNA, 22 nt, Mycobacterium tuberculosis H37Rv
ugggccgacccgcgcauggucg

SEQ ID NO: 154969 - RNA, 22 nt, Mycobacterium tuberculosis H37Rv
gccugcuggcaccgaaucuguu

SEQ ID NO: 154970 - RNA, 22 nt, Mycobacterium tuberculosis H37Rv
ucauggugucuagcgaggucgc

SEQ ID NO: 154971 - RNA, 22 nt, Mycobacterium tuberculosis H37Rv
ucgccgaucggcguggugcccu

SEQ ID NO: 154972 - RNA, 22 nt, Mycobacterium tuberculosis H37Rv
agcggacgcgaguguucuucug

SEQ ID NO: 154973 - RNA, 22 nt, Mycobacterium tuberculosis H37Rv
cccgcgaagccgccugcugcac

SEQ ID NO: 154974 - RNA, 22 nt, Mycobacterium tuberculosis H37Rv
gcagcaaaccugagguggcuga

SEQ ID NO: 154975 - RNA, 22 nt, Mycobacterium tuberculosis H37Rv
cgggauggugaccgcggcgaug

SEQ ID NO: 154976 - RNA, 22 nt, Mycobacterium tuberculosis H37Rv
gccaggcuggugucggcggugg

SEQ ID NO: 154977 - RNA, 22 nt, Mycobacterium tuberculosis H37Rv
acccgggucggcacgacccggg

SEQ ID NO: 154978 - RNA, 22 nt, Mycobacterium tuberculosis H37Rv
gcgaaccgggugaaccugcccu

SEQ ID NO: 154979 - RNA, 20 nt, Mycobacterium tuberculosis H37Rv
gucgggauccccggcggcgc

SEQ ID NO: 154980 - RNA, 22 nt, Mycobacterium tuberculosis H37Rv
ugugcgcgaucaguucaugguc

SEQ ID NO: 154981 - RNA, 22 nt, Mycobacterium tuberculosis H37Rv
gguggcagcccaggguccgcgg

SEQ ID NO: 154982 - RNA, 22 nt, Mycobacterium tuberculosis H37Rv
cccgacagcaccaccgauaccg

SEQ ID NO: 154983 - RNA, 22 nt, Mycobacterium tuberculosis H37Rv
cucugggaccuggaccggcgga

SEQ ID NO: 154984 - RNA, 22 nt, Mycobacterium tuberculosis H37Rv
cgucuccgacguacuggauggu

SEQ ID NO: 154985 - RNA, 22 nt, Mycobacterium tuberculosis H37Rv
acgcuggcgacauggcgggcag

SEQ ID NO: 154986 - RNA, 22 nt, Mycobacterium tuberculosis H37Rv
gcgagcguaacgccacggcgaa

SEQ ID NO: 154987 - RNA, 20 nt, Mycobacterium tuberculosis H37Rv
agucgaagucggucagcuug

SEQ ID NO: 154988 - RNA, 22 nt, Mycobacterium tuberculosis H37Rv
gccaugccgaccgcggcgaucg

SEQ ID NO: 154989 - RNA, 22 nt, Mycobacterium tuberculosis H37Rv
ugaucgcaugcccgugcgcggu

SEQ ID NO: 154990 - RNA, 22 nt, Mycobacterium tuberculosis H37Rv
ucgucgacgugaucaccgauac

SEQ ID NO: 154991 - RNA, 22 nt, Mycobacterium tuberculosis H37Rv
cgaacguaacggcacugcgaau

SEQ ID NO: 154992 - RNA, 22 nt, Mycobacterium tuberculosis H37Rv
gacuccagccguucacguucga

SEQ ID NO: 154993 - RNA, 22 nt, Mycobacterium tuberculosis H37Rv
gcgacagcggagucgaugccga

SEQ ID NO: 154994 - RNA, 22 nt, Mycobacterium tuberculosis H37Rv
ugaccugagccuugucugcgga

SEQ ID NO: 154995 - RNA, 22 nt, Mycobacterium tuberculosis H37Rv
gagucagccgcgguauggcgca

SEQ ID NO: 154996 - RNA, 22 nt, Mycobacterium tuberculosis H37Rv
ggugcgagccaggccggcucgg

SEQ ID NO: 154997 - RNA, 22 nt, Mycobacterium tuberculosis H37Rv
ggcgagcagacgcagaaucgca

SEQ ID NO: 154998 - RNA, 22 nt, Mycobacterium tuberculosis H37Rv
gaaccuggcacggcgggcugca

SEQ ID NO: 154999 - RNA, 22 nt, Mycobacterium tuberculosis H37Rv
acguugaccgcgguggcgugcu

SEQ ID NO: 155000 - RNA, 22 nt, Mycobacterium tuberculosis H37Rv
ucggcgaaggugaucucgcugg

SEQ ID NO: 155001 - RNA, 22 nt, Mycobacterium tuberculosis H37Rv
cccagucgugcucgcucucggc

SEQ ID NO: 155002 - RNA, 19 nt, Mycobacterium tuberculosis H37Rv
ugcucgagugccgcaccca

SEQ ID NO: 155003 - RNA, 20 nt, Mycobacterium tuberculosis H37Rv
ugucgcugcuggccacccac

SEQ ID NO: 155004 - RNA, 22 nt, Mycobacterium tuberculosis H37Rv
cgguggcuuuugcgucugcucg

SEQ ID NO: 155005 - RNA, 22 nt, Mycobacterium tuberculosis H37Rv
gauggcgaugcgcaccccgucg

SEQ ID NO: 155006 - RNA, 22 nt, Mycobacterium tuberculosis H37Rv
aagcuggaagaugccggugcgg

SEQ ID NO: 155007 - RNA, 21 nt, Mycobacterium tuberculosis H37Rv
agcgguccuugaucagggacc

SEQ ID NO: 155008 - RNA, 22 nt, Mycobacterium tuberculosis H37Rv
augugccgcucaucgcccggug

SEQ ID NO: 155009 - RNA, 22 nt, Mycobacterium tuberculosis H37Rv
aucgaggcguucagcacccgga

SEQ ID NO: 155010 - RNA, 22 nt, Mycobacterium tuberculosis H37Rv
gucagcuucgugcccaggugau

SEQ ID NO: 155011 - RNA, 22 nt, Mycobacterium tuberculosis H37Rv
ucgagcggcauaccagccgcac

SEQ ID NO: 155012 - RNA, 21 nt, Mycobacterium tuberculosis H37Rv
gcgguugauuggucuucgguc

SEQ ID NO: 155013 - RNA, 22 nt, Mycobacterium tuberculosis H37Rv
aacccggugcuggccgugcccg

SEQ ID NO: 155014 - RNA, 22 nt, Mycobacterium tuberculosis H37Rv
ggcgccauuuugauauaaguca

SEQ ID NO: 155015 - RNA, 22 nt, Mycobacterium tuberculosis H37Rv
caccgcugagcgugguugcggu

SEQ ID NO: 155016 - RNA, 22 nt, Mycobacterium tuberculosis H37Rv
ggacaugaccgaacacgguugg

SEQ ID NO: 155017 - RNA, 22 nt, Mycobacterium tuberculosis H37Rv
cgacggcaacccgcugugugaa

SEQ ID NO: 155018 - RNA, 22 nt, Mycobacterium tuberculosis H37Rv
ucggucccugaaacguccacga

SEQ ID NO: 155019 - RNA, 22 nt, Mycobacterium tuberculosis H37Rv
aggacgucgucgauuucgucga

SEQ ID NO: 155020 - RNA, 22 nt, Mycobacterium tuberculosis H37Rv
cgaccaagcgucggcccaacca

SEQ ID NO: 155021 - RNA, 22 nt, Mycobacterium tuberculosis H37Rv
aucggcgugcaagcgguguccg

SEQ ID NO: 155022 - RNA, 22 nt, Mycobacterium tuberculosis H37Rv
ugcagccaguugaucaugaacg

SEQ ID NO: 155023 - RNA, 22 nt, Mycobacterium tuberculosis H37Rv
agccaagccguaguccucgacg

SEQ ID NO: 155024 - RNA, 22 nt, Mycobacterium tuberculosis H37Rv
gaucgccgauaucgacggccug

SEQ ID NO: 155025 - RNA, 22 nt, Mycobacterium tuberculosis H37Rv
uaacagucugccaggaaucgcc

SEQ ID NO: 155026 - RNA, 22 nt, Mycobacterium tuberculosis H37Rv
uugacucugcgcucaccacgcg

SEQ ID NO: 155027 - RNA, 22 nt, Mycobacterium tuberculosis H37Rv
gucggguaucgcggcacccacg

SEQ ID NO: 155028 - RNA, 22 nt, Mycobacterium tuberculosis H37Rv
gucaggcgccggccgcgcagug

SEQ ID NO: 155029 - RNA, 22 nt, Mycobacterium tuberculosis H37Rv
ucggcgacguaggugccggugu

SEQ ID NO: 155030 - RNA, 22 nt, Mycobacterium tuberculosis H37Rv
cgcaggguuuggagucgguggc

SEQ ID NO: 155031 - RNA, 22 nt, Mycobacterium tuberculosis H37Rv
guggccaccaacgccgagggcg

SEQ ID NO: 155032 - RNA, 21 nt, Mycobacterium tuberculosis H37Rv
ugacgccaucaaguccgccgg

SEQ ID NO: 155033 - RNA, 22 nt, Mycobacterium tuberculosis H37Rv
cucagcgaggaguacuacaggg

SEQ ID NO: 155034 - RNA, 22 nt, Mycobacterium tuberculosis H37Rv
uacccagguugaaguugccgau

SEQ ID NO: 155035 - RNA, 22 nt, Mycobacterium tuberculosis H37Rv
agcuguccgacaaaguauccga

SEQ ID NO: 155036 - RNA, 22 nt, Mycobacterium tuberculosis H37Rv
gacgcgaguuggccguccuccu

SEQ ID NO: 155037 - RNA, 22 nt, Mycobacterium tuberculosis H37Rv
cccgguugaccgaagccggacu

SEQ ID NO: 155038 - RNA, 22 nt, Mycobacterium tuberculosis H37Rv
ugucgcgcccgugcaacaguga

SEQ ID NO: 155039 - RNA, 22 nt, Mycobacterium tuberculosis H37Rv
aaggcuguggccggcgucgucg

SEQ ID NO: 155040 - RNA, 22 nt, Mycobacterium tuberculosis H37Rv
gcagcaccgcugcugacgcacu

SEQ ID NO: 155041 - RNA, 22 nt, Mycobacterium tuberculosis H37Rv
gcgggucugaugcaggaucgcg

SEQ ID NO: 155042 - RNA, 20 nt, Mycobacterium tuberculosis H37Rv
cacuccuggcuggauucggc

SEQ ID NO: 155043 - RNA, 22 nt, Mycobacterium tuberculosis H37Rv
aaagacgcaaaagcucccaaau

SEQ ID NO: 155044 - RNA, 22 nt, Mycobacterium tuberculosis H37Rv
uaccgaaaugcaucggcgcauc

SEQ ID NO: 155045 - RNA, 22 nt, Mycobacterium tuberculosis H37Rv
guugcgcaucgucaccgguacc

SEQ ID NO: 155046 - RNA, 22 nt, Mycobacterium tuberculosis H37Rv
ucggugaucucgugggugucga

SEQ ID NO: 155047 - RNA, 22 nt, Mycobacterium tuberculosis H37Rv
ccguaucaccggucgcugacaa

SEQ ID NO: 155048 - RNA, 22 nt, Mycobacterium tuberculosis H37Rv
ggcgucgaucagggcugugucg

SEQ ID NO: 155049 - RNA, 22 nt, Mycobacterium tuberculosis H37Rv
gacgucgucgcagccggccauc

SEQ ID NO: 155050 - RNA, 20 nt, Mycobacterium tuberculosis H37Rv
cgauggucagcgcuugcgga

SEQ ID NO: 155051 - RNA, 22 nt, Mycobacterium tuberculosis H37Rv
ucggcguaggccaaguggacgc

SEQ ID NO: 155052 - RNA, 22 nt, Mycobacterium tuberculosis H37Rv
caucggugcgcacgcgucgaca

SEQ ID NO: 155053 - RNA, 22 nt, Mycobacterium tuberculosis H37Rv
aauuccucuauuacgacgacgg

SEQ ID NO: 155054 - RNA, 22 nt, Mycobacterium tuberculosis H37Rv
cuucgacgauaagggccggccg

SEQ ID NO: 155055 - RNA, 22 nt, Mycobacterium tuberculosis H37Rv
aagcggcccgauauggugcugc

SEQ ID NO: 155056 - RNA, 22 nt, Mycobacterium tuberculosis H37Rv
acuucgaucugacgcccgauga

SEQ ID NO: 155057 - RNA, 22 nt, Mycobacterium tuberculosis H37Rv
cucagucgguccugaaggcguu

SEQ ID NO: 155058 - RNA, 22 nt, Mycobacterium tuberculosis H37Rv
ggccuggacgccgcagaccugg

SEQ ID NO: 155059 - RNA, 22 nt, Mycobacterium tuberculosis H37Rv
gcaagcugcgggcgcuuggugu

SEQ ID NO: 155060 - RNA, 22 nt, Mycobacterium tuberculosis H37Rv
gaagcgcucggguugcaacgua

SEQ ID NO: 155061 - RNA, 22 nt, Mycobacterium tuberculosis H37Rv
accgagucgcgaggcguuccgg

SEQ ID NO: 155062 - RNA, 22 nt, Mycobacterium tuberculosis H37Rv
cggugucgaagaucgugggaca

SEQ ID NO: 155063 - RNA, 22 nt, Mycobacterium tuberculosis H37Rv
gccagguugacguugguuucgg

SEQ ID NO: 155064 - RNA, 22 nt, Mycobacterium tuberculosis H37Rv
gaccugguugacaccggcgacc

SEQ ID NO: 155065 - RNA, 22 nt, Mycobacterium tuberculosis H37Rv
ucaccggacugcgcgaauugau

SEQ ID NO: 155066 - RNA, 22 nt, Mycobacterium tuberculosis H37Rv
agcaugcgaccauugcaccgug

SEQ ID NO: 155067 - RNA, 23 nt, Mycobacterium tuberculosis H37Rv
cgagcgguauggccggcgcugac

SEQ ID NO: 155068 - RNA, 22 nt, Mycobacterium tuberculosis H37Rv
ugcgauaucggcaccggcuugc

SEQ ID NO: 155069 - RNA, 23 nt, Mycobacterium tuberculosis H37Rv
acacuggugcuguugccggagac

SEQ ID NO: 155070 - RNA, 22 nt, Mycobacterium tuberculosis H37Rv
ggcgagaucgccgccgccaucg

SEQ ID NO: 155071 - RNA, 22 nt, Mycobacterium tuberculosis H37Rv
agcagacguaaaagcccccgca

SEQ ID NO: 155072 - RNA, 23 nt, Mycobacterium tuberculosis H37Rv
agaccgcucgacgcgggcgaucg

SEQ ID NO: 155073 - RNA, 22 nt, Mycobacterium tuberculosis H37Rv
cgccgauucgggauugucaccg

SEQ ID NO: 155074 - RNA, 22 nt, Mycobacterium tuberculosis H37Rv
accgucagggcaucaccgaggc

SEQ ID NO: 155075 - RNA, 22 nt, Mycobacterium tuberculosis H37Rv
aucggcugccaccgcucgcggu

SEQ ID NO: 155076 - RNA, 22 nt, Mycobacterium tuberculosis H37Rv
cgagcgugaacugagggcgaga

SEQ ID NO: 155077 - RNA, 22 nt, Mycobacterium tuberculosis H37Rv
cuccguuggccccggugccggg

SEQ ID NO: 155078 - RNA, 22 nt, Mycobacterium tuberculosis H37Rv
ugccgcuggauccggaagccgu

SEQ ID NO: 155079 - RNA, 22 nt, Mycobacterium tuberculosis H37Rv
gacccgauggaaguacccggca

SEQ ID NO: 155080 - RNA, 22 nt, Mycobacterium tuberculosis H37Rv
gcgcuguggcucacgacgacga

SEQ ID NO: 155081 - RNA, 22 nt, Mycobacterium tuberculosis H37Rv
acggugagggcgucgucgaguu

SEQ ID NO: 155082 - RNA, 22 nt, Mycobacterium tuberculosis H37Rv
ucgucgguggacaaggcggccc

SEQ ID NO: 155083 - RNA, 20 nt, Mycobacterium tuberculosis H37Rv
cgcuggucguugaugcgcag

SEQ ID NO: 155084 - RNA, 22 nt, Mycobacterium tuberculosis H37Rv
cgaccguuccgucgugcagucg

SEQ ID NO: 155085 - RNA, 21 nt, Mycobacterium tuberculosis H37Rv
ucugcccagcgcguggaucac

SEQ ID NO: 155086 - RNA, 21 nt, Mycobacterium tuberculosis H37Rv
cauggguccgcucuuuacguu

SEQ ID NO: 155087 - RNA, 22 nt, Mycobacterium tuberculosis H37Rv
gcgcuggucggaauuccucgaa

SEQ ID NO: 155088 - RNA, 22 nt, Mycobacterium tuberculosis H37Rv
auggccgcgugugcaaguagcg

SEQ ID NO: 155089 - RNA, 21 nt, Mycobacterium tuberculosis H37Rv
ucgugcgauucacugucggcg

SEQ ID NO: 155090 - RNA, 22 nt, Mycobacterium tuberculosis H37Rv
aacgcggugucggcggccugcc

SEQ ID NO: 155091 - RNA, 22 nt, Mycobacterium tuberculosis H37Rv
auuugggagcuuuugcgucugc

SEQ ID NO: 155092 - RNA, 22 nt, Mycobacterium tuberculosis H37Rv
agucuuggugaccguccgguac

SEQ ID NO: 155093 - RNA, 22 nt, Mycobacterium tuberculosis H37Rv
gcuacggauuucgcccgucgaa

SEQ ID NO: 155094 - RNA, 22 nt, Mycobacterium tuberculosis H37Rv
agcugcaugacgaacucggccu

SEQ ID NO: 155095 - RNA, 22 nt, Mycobacterium tuberculosis H37Rv
agccgagcaggugcgcuuccuc

SEQ ID NO: 155096 - RNA, 22 nt, Mycobacterium tuberculosis H37Rv
acaccgaguucauggcgcccgc

SEQ ID NO: 155097 - RNA, 22 nt, Mycobacterium tuberculosis H37Rv
cgguggcauagguaguugcucg

SEQ ID NO: 155098 - RNA, 22 nt, Mycobacterium tuberculosis H37Rv
gcugugccgagggcuucgcugg

SEQ ID NO: 155099 - RNA, 22 nt, Mycobacterium tuberculosis H37Rv
ccacccguaugaucgcugcggc

SEQ ID NO: 155100 - RNA, 22 nt, Mycobacterium tuberculosis H37Rv
agcccaguguggcauagcggca

SEQ ID NO: 155101 - RNA, 22 nt, Mycobacterium tuberculosis H37Rv
auacgcgccgacgauccggggu

SEQ ID NO: 155102 - RNA, 22 nt, Mycobacterium tuberculosis H37Rv
aggacgaugaacuuuuacuccg

SEQ ID NO: 155103 - RNA, 22 nt, Mycobacterium tuberculosis H37Rv
ucaguugugcggccugaccggg

SEQ ID NO: 155104 - RNA, 22 nt, Mycobacterium tuberculosis H37Rv
uacggaccgaucaugacgaugc

SEQ ID NO: 155105 - RNA, 19 nt, Mycobacterium tuberculosis H37Rv
agcgugcguuguugcaccg

SEQ ID NO: 155106 - RNA, 22 nt, Mycobacterium tuberculosis H37Rv
uccaucaucggaaggcgucgac

SEQ ID NO: 155107 - RNA, 22 nt, Mycobacterium tuberculosis H37Rv
gccgguuauuggaugugcacgc

SEQ ID NO: 155108 - RNA, 22 nt, Mycobacterium tuberculosis H37Rv
ucggccuguuggucgccgccgg

SEQ ID NO: 155109 - RNA, 22 nt, Mycobacterium tuberculosis H37Rv
ugggcuaccgaggucagggcgc

SEQ ID NO: 155110 - RNA, 22 nt, Mycobacterium tuberculosis H37Rv
uccggcgucugguggcgguggc

SEQ ID NO: 155111 - RNA, 22 nt, Mycobacterium tuberculosis H37Rv
guggccgaacguggucauggcc

SEQ ID NO: 155112 - RNA, 22 nt, Mycobacterium tuberculosis H37Rv
ucgcugaggcuguaacucugca

SEQ ID NO: 155113 - RNA, 22 nt, Mycobacterium tuberculosis H37Rv
caugucgcugcuguacaucggc

SEQ ID NO: 155114 - RNA, 22 nt, Mycobacterium tuberculosis H37Rv
ugccugguauccgcagagucaa

SEQ ID NO: 155115 - RNA, 22 nt, Mycobacterium tuberculosis H37Rv
cugaugauccagcgcggcugcg

SEQ ID NO: 155116 - RNA, 22 nt, Mycobacterium tuberculosis H37Rv
acagcgcgguucgcggaccgaa

SEQ ID NO: 155117 - RNA, 22 nt, Mycobacterium tuberculosis H37Rv
acggguugcgggugggaccgua

SEQ ID NO: 155118 - RNA, 22 nt, Mycobacterium tuberculosis H37Rv
gugacguugcgaucguguccga

SEQ ID NO: 155119 - RNA, 22 nt, Mycobacterium tuberculosis H37Rv
aacaguggcgagccgguccgua

SEQ ID NO: 155120 - RNA, 22 nt, Mycobacterium tuberculosis H37Rv
gcggccaacgaggcagcggcgg

SEQ ID NO: 155121 - RNA, 22 nt, Mycobacterium tuberculosis H37Rv
uugaugccgaacugguugauca

SEQ ID NO: 155122 - RNA, 22 nt, Mycobacterium tuberculosis H37Rv
aacgcgggcaaggagacgguca

SEQ ID NO: 155123 - RNA, 22 nt, Mycobacterium tuberculosis H37Rv
ggcgaguagacgcaaaagcccc

SEQ ID NO: 155124 - RNA, 22 nt, Mycobacterium tuberculosis H37Rv
ugcgagccgauuucgauuuggc

SEQ ID NO: 155125 - RNA, 22 nt, Mycobacterium tuberculosis H37Rv
ggaccaccgugaagaucgucca

SEQ ID NO: 155126 - RNA, 22 nt, Mycobacterium tuberculosis H37Rv
ugcgcugacucugcguccacca

SEQ ID NO: 155127 - RNA, 22 nt, Mycobacterium tuberculosis H37Rv
uucgcaguggcguuacauucgc

SEQ ID NO: 155128 - RNA, 22 nt, Mycobacterium tuberculosis H37Rv
ggcuccugucugugcgggcaga

SEQ ID NO: 155129 - RNA, 21 nt, Mycobacterium tuberculosis H37Rv
caagggcaagguuuggaccgg

SEQ ID NO: 155130 - RNA, 20 nt, Mycobacterium tuberculosis H37Rv
ugguggacgcagagucaacg

SEQ ID NO: 155131 - RNA, 22 nt, Mycobacterium tuberculosis H37Rv
ugaucgagacggcgaagcggcu

SEQ ID NO: 155132 - RNA, 22 nt, Mycobacterium tuberculosis H37Rv
acgcuggugaagcuuugcgcaa

SEQ ID NO: 155133 - RNA, 22 nt, Mycobacterium tuberculosis H37Rv
gcagacgcaaaaucgcccgaaa

SEQ ID NO: 155134 - RNA, 22 nt, Mycobacterium tuberculosis H37Rv
uccaucgguuccugcucgaagc

SEQ ID NO: 155135 - RNA, 22 nt, Mycobacterium tuberculosis H37Rv
aagggucgcagugggcagcgau

SEQ ID NO: 155136 - RNA, 22 nt, Mycobacterium tuberculosis H37Rv
aggucgugcagauagcgcgggu

SEQ ID NO: 155137 - RNA, 22 nt, Mycobacterium tuberculosis H37Rv
cccguacggcucgucacgcacc

SEQ ID NO: 155138 - RNA, 22 nt, Mycobacterium tuberculosis H37Rv
acgucgaguugaccgucgccuu

SEQ ID NO: 155139 - RNA, 22 nt, Mycobacterium tuberculosis H37Rv
gcugacucagacuccggcugcg

SEQ ID NO: 155140 - RNA, 22 nt, Mycobacterium tuberculosis H37Rv
uugagguccagcuuguccaggu

SEQ ID NO: 155141 - RNA, 22 nt, Mycobacterium tuberculosis H37Rv
gccggacugggugcggcggugg

SEQ ID NO: 155142 - RNA, 22 nt, Mycobacterium tuberculosis H37Rv
ucgucgguguagggcgaacugc

SEQ ID NO: 155143 - RNA, 22 nt, Mycobacterium tuberculosis H37Rv
ugcuugccacuucuuguucgga

SEQ ID NO: 155144 - RNA, 22 nt, Mycobacterium tuberculosis H37Rv
uguugcaggcccucaccgguca

SEQ ID NO: 155145 - RNA, 23 nt, Mycobacterium tuberculosis H37Rv
gcacgcgacaagcucguuugugg

SEQ ID NO: 155146 - RNA, 22 nt, Mycobacterium tuberculosis H37Rv
caucgggaaauuccauggcgug

SEQ ID NO: 155147 - RNA, 22 nt, Mycobacterium tuberculosis H37Rv
uggccgucgauugcgguggcgu

SEQ ID NO: 155148 - RNA, 20 nt, Mycobacterium tuberculosis H37Rv
agcagugagccgaucgcguc

SEQ ID NO: 155149 - RNA, 22 nt, Mycobacterium tuberculosis H37Rv
gcgaaacacgggaucgggcgag

SEQ ID NO: 155150 - RNA, 21 nt, Mycobacterium tuberculosis H37Rv
ggccaucgcugcuugcugcgc

SEQ ID NO: 155151 - RNA, 21 nt, Mycobacterium tuberculosis H37Rv
ccguucgcguuugugugggcc

SEQ ID NO: 155152 - RNA, 22 nt, Mycobacterium tuberculosis H37Rv
uugcccggauugcggugcggca

SEQ ID NO: 155153 - RNA, 19 nt, Mycobacterium tuberculosis H37Rv
cgccaucgcgcugugccuc

SEQ ID NO: 155154 - RNA, 22 nt, Mycobacterium tuberculosis H37Rv
agguaaccacacaugccgcagg

SEQ ID NO: 155155 - RNA, 22 nt, Mycobacterium tuberculosis H37Rv
caccgagccggucaccaacgcg

SEQ ID NO: 155156 - RNA, 22 nt, Mycobacterium tuberculosis H37Rv
uucaugccucgcucgcgcacgc

SEQ ID NO: 155157 - RNA, 22 nt, Mycobacterium tuberculosis H37Rv
agcagucgcaaaagcccccgca

SEQ ID NO: 155158 - RNA, 22 nt, Mycobacterium tuberculosis H37Rv
cgagcagucgcuaaagcccccg

SEQ ID NO: 155159 - RNA, 22 nt, Mycobacterium tuberculosis H37Rv
acccagguguagucaggaucgg

SEQ ID NO: 155160 - RNA, 22 nt, Mycobacterium tuberculosis H37Rv
aacgcgccgaccacauacggcg

SEQ ID NO: 155161 - RNA, 22 nt, Mycobacterium tuberculosis H37Rv
cagcguugucucggcgaacacc

SEQ ID NO: 155162 - RNA, 22 nt, Mycobacterium tuberculosis H37Rv
caacuucauuuguagcgguuac

SEQ ID NO: 155163 - RNA, 22 nt, Mycobacterium tuberculosis H37Rv
gcggauuggaucaaggugaugg

SEQ ID NO: 155164 - RNA, 22 nt, Mycobacterium tuberculosis H37Rv
aucggcauuggguuaaccggca

SEQ ID NO: 155165 - RNA, 22 nt, Mycobacterium tuberculosis H37Rv
cuccgcaguccuuuaggggaca

SEQ ID NO: 155166 - RNA, 22 nt, Mycobacterium tuberculosis H37Rv
ugcggugcaccgugcgauuagc

SEQ ID NO: 155167 - RNA, 22 nt, Mycobacterium tuberculosis H37Rv
gcgcuacaaccagcugaucgcc

SEQ ID NO: 155168 - RNA, 22 nt, Mycobacterium tuberculosis H37Rv
ucgagcggaucuugugacgcgg

SEQ ID NO: 155169 - RNA, 22 nt, Mycobacterium tuberculosis H37Rv
gcggcuucuuacgagcaguugu

SEQ ID NO: 155170 - RNA, 22 nt, Mycobacterium tuberculosis H37Rv
ggucguucguggucgcgaugau

SEQ ID NO: 155171 - RNA, 22 nt, Mycobacterium tuberculosis H37Rv
gccgggaugcacgcacgucacc

SEQ ID NO: 155172 - RNA, 22 nt, Mycobacterium tuberculosis H37Rv
agcagacgcagaaucgcccaau

SEQ ID NO: 155173 - RNA, 22 nt, Mycobacterium tuberculosis H37Rv
ccgcgacugugagucuggcgac

SEQ ID NO: 155174 - RNA, 22 nt, Mycobacterium tuberculosis H37Rv
ucgcccagcgagugcgccuggu

SEQ ID NO: 155175 - RNA, 22 nt, Mycobacterium tuberculosis H37Rv
ugugcgacgacgauccggucau

SEQ ID NO: 155176 - RNA, 22 nt, Mycobacterium tuberculosis H37Rv
caccgguauugaaauuaccggc

SEQ ID NO: 155177 - RNA, 22 nt, Mycobacterium tuberculosis H37Rv
cgguuugacgucgcgaugcguu

SEQ ID NO: 155178 - RNA, 22 nt, Mycobacterium tuberculosis H37Rv
gucuaccauuugggcgaucguc

SEQ ID NO: 155179 - RNA, 23 nt, Mycobacterium tuberculosis H37Rv
auggacggcgcgcagguugcggc

SEQ ID NO: 155180 - RNA, 22 nt, Mycobacterium tuberculosis H37Rv
augcgggugaugccgaacucgg

SEQ ID NO: 155181 - RNA, 22 nt, Mycobacterium tuberculosis H37Rv
gguugccagcgaaccggaaugg

SEQ ID NO: 155182 - RNA, 22 nt, Mycobacterium tuberculosis H37Rv
caugggugcgguaagcgcgucu

SEQ ID NO: 155183 - RNA, 22 nt, Mycobacterium tuberculosis H37Rv
gcggugucgccgagcguuggga

SEQ ID NO: 155184 - RNA, 22 nt, Mycobacterium tuberculosis H37Rv
aacgcugcgucuuuggucagcg

SEQ ID NO: 155185 - RNA, 19 nt, Mycobacterium tuberculosis H37Rv
gcccgaacccacggccggc

SEQ ID NO: 155186 - RNA, 22 nt, Mycobacterium tuberculosis H37Rv
gaucuugucccggcgguggcgc

SEQ ID NO: 155187 - RNA, 23 nt, Mycobacterium tuberculosis H37Rv
ucgacggacguggucgcgcuaug

SEQ ID NO: 155188 - RNA, 20 nt, Mycobacterium tuberculosis H37Rv
uggucgacgacgagcuuggc

SEQ ID NO: 155189 - RNA, 22 nt, Mycobacterium tuberculosis H37Rv
aucgcacguucugcugcagcgc

SEQ ID NO: 155190 - RNA, 22 nt, Mycobacterium tuberculosis H37Rv
agugcucgucguccugcucgac

SEQ ID NO: 155191 - RNA, 22 nt, Mycobacterium tuberculosis H37Rv
uaguugucgucgucggugccaa

SEQ ID NO: 155192 - RNA, 22 nt, Mycobacterium tuberculosis H37Rv
uacggcauggucuuucugcugc

SEQ ID NO: 155193 - RNA, 22 nt, Mycobacterium tuberculosis H37Rv
guccggcaaccgugcucgacuc

SEQ ID NO: 155194 - RNA, 22 nt, Mycobacterium tuberculosis H37Rv
ggucaccgucacgcucgagccg

SEQ ID NO: 155195 - RNA, 22 nt, Mycobacterium tuberculosis H37Rv
aagcugauucugauggcgauug

SEQ ID NO: 155196 - RNA, 18 nt, Mycobacterium tuberculosis H37Rv
gcgucaccccggggugua

SEQ ID NO: 155197 - RNA, 22 nt, Mycobacterium tuberculosis H37Rv
aucggugcgcaagcgauacucg

SEQ ID NO: 155198 - RNA, 22 nt, Mycobacterium tuberculosis H37Rv
acccgguuggacaugucgaucc

SEQ ID NO: 155199 - RNA, 22 nt, Mycobacterium tuberculosis H37Rv
ugucaucuaccaauucggugau

SEQ ID NO: 155200 - RNA, 22 nt, Mycobacterium tuberculosis H37Rv
aaucggcacuguugcagcgggu

SEQ ID NO: 155201 - RNA, 22 nt, Mycobacterium tuberculosis H37Rv
cugcgaagaaguccauccugac

SEQ ID NO: 155202 - RNA, 22 nt, Mycobacterium tuberculosis H37Rv
gcgauucugcgcgguguguggg

SEQ ID NO: 155203 - RNA, 22 nt, Mycobacterium tuberculosis H37Rv
aucggcaagcacggcgacaccg

SEQ ID NO: 155204 - RNA, 22 nt, Mycobacterium tuberculosis H37Rv
cagccggaggaucucggcgaac

SEQ ID NO: 155205 - RNA, 22 nt, Mycobacterium tuberculosis H37Rv
acccguccgguugggcggcggu

SEQ ID NO: 155206 - RNA, 22 nt, Mycobacterium tuberculosis H37Rv
gaugcugugcuacuggccguua

SEQ ID NO: 155207 - RNA, 22 nt, Mycobacterium tuberculosis H37Rv
ucaucgacgccaccuccggugc

SEQ ID NO: 155208 - RNA, 22 nt, Mycobacterium tuberculosis H37Rv
ggucuugcucgacguucgcgca

SEQ ID NO: 155209 - RNA, 22 nt, Mycobacterium tuberculosis H37Rv
gacaugaucgacccugccaucc

SEQ ID NO: 155210 - RNA, 20 nt, Mycobacterium tuberculosis H37Rv
ucaucgccgguuacgaagcc

SEQ ID NO: 155211 - RNA, 22 nt, Mycobacterium tuberculosis H37Rv
agcgucucggcggcguugcaga

SEQ ID NO: 155212 - RNA, 22 nt, Mycobacterium tuberculosis H37Rv
gaucgucgccgacggcuaccga

SEQ ID NO: 155213 - RNA, 22 nt, Mycobacterium tuberculosis H37Rv
uggaaugccggcgacgcggcgu

SEQ ID NO: 155214 - RNA, 22 nt, Mycobacterium tuberculosis H37Rv
acccggucgagcaccccgauga

SEQ ID NO: 155215 - RNA, 22 nt, Mycobacterium tuberculosis H37Rv
cggacucuggugaugguguggu

SEQ ID NO: 155216 - RNA, 22 nt, Mycobacterium tuberculosis H37Rv
augcugccggcauugaccacau

SEQ ID NO: 155217 - RNA, 21 nt, Mycobacterium tuberculosis H37Rv
gauccgaguccgagcucggcc

SEQ ID NO: 155218 - RNA, 22 nt, Mycobacterium tuberculosis H37Rv
ugacgacggacuugcggaucga

SEQ ID NO: 155219 - RNA, 22 nt, Mycobacterium tuberculosis H37Rv
ggcaacggcggcaacgccggca

SEQ ID NO: 155220 - RNA, 22 nt, Mycobacterium tuberculosis H37Rv
ucagcgucggcccccgaaccag

SEQ ID NO: 155221 - RNA, 22 nt, Mycobacterium tuberculosis H37Rv
gugccgcuggcaggugcggugc

SEQ ID NO: 155222 - RNA, 22 nt, Mycobacterium tuberculosis H37Rv
cuggguucgacccaguccaagc

SEQ ID NO: 155223 - RNA, 22 nt, Mycobacterium tuberculosis H37Rv
gagcagacgcagaaucgcaugc

SEQ ID NO: 155224 - RNA, 22 nt, Mycobacterium tuberculosis H37Rv
gaugccgcgguuuguccgggag

SEQ ID NO: 155225 - RNA, 22 nt, Mycobacterium tuberculosis H37Rv
ggcuugucgguacucggaccga

SEQ ID NO: 155226 - RNA, 22 nt, Mycobacterium tuberculosis H37Rv
gucgaccaugggugcggugccc

SEQ ID NO: 155227 - RNA, 22 nt, Mycobacterium tuberculosis H37Rv
aaggugcggucaaugcgcucga

SEQ ID NO: 155228 - RNA, 22 nt, Mycobacterium tuberculosis H37Rv
gaucuagcgaacgugggaucga

SEQ ID NO: 155229 - RNA, 22 nt, Mycobacterium tuberculosis H37Rv
ucaaccgaucggucguccggau

SEQ ID NO: 155230 - RNA, 22 nt, Mycobacterium tuberculosis H37Rv
ccgaccguguuaaccgcgcggg

SEQ ID NO: 155231 - RNA, 23 nt, Mycobacterium tuberculosis H37Rv
gucgucagauucacggucgccgg

SEQ ID NO: 155232 - RNA, 22 nt, Mycobacterium tuberculosis H37Rv
cuggccaucgagggcaucgggc

SEQ ID NO: 155233 - RNA, 21 nt, Mycobacterium tuberculosis H37Rv
cccuggugcuggccaccggcu

SEQ ID NO: 155234 - RNA, 22 nt, Mycobacterium tuberculosis H37Rv
ggcugacggcguggcggugcug

SEQ ID NO: 155235 - RNA, 22 nt, Mycobacterium tuberculosis H37Rv
uccguccggucugaccacuaau

SEQ ID NO: 155236 - RNA, 22 nt, Mycobacterium tuberculosis H37Rv
cguuggccggcgcugcgggugu

SEQ ID NO: 155237 - RNA, 22 nt, Mycobacterium tuberculosis H37Rv
agcagacgcagaaucgcacugc

SEQ ID NO: 155238 - RNA, 22 nt, Mycobacterium tuberculosis H37Rv
cugacgucgaucucgaugcguc

SEQ ID NO: 155239 - RNA, 22 nt, Mycobacterium tuberculosis H37Rv
acccggacgcgaucuuggccac

SEQ ID NO: 155240 - RNA, 22 nt, Mycobacterium tuberculosis H37Rv
ucgacucgaucggcgagccccg

SEQ ID NO: 155241 - RNA, 23 nt, Mycobacterium tuberculosis H37Rv
ucgcagugccguuacgcucgugg

SEQ ID NO: 155242 - RNA, 22 nt, Mycobacterium tuberculosis H37Rv
cgcugguggaauucgagcgcuc

SEQ ID NO: 155243 - RNA, 22 nt, Mycobacterium tuberculosis H37Rv
gugacggucggggaaaucugcc

SEQ ID NO: 155244 - RNA, 22 nt, Mycobacterium tuberculosis H37Rv
uugcuccgagacggaggucugc

SEQ ID NO: 155245 - RNA, 22 nt, Mycobacterium tuberculosis H37Rv
gcgugguacggugguguaccgu

SEQ ID NO: 155246 - RNA, 22 nt, Mycobacterium tuberculosis H37Rv
gaucaguccggcccgggcgaua

SEQ ID NO: 155247 - RNA, 22 nt, Mycobacterium tuberculosis H37Rv
ccaggugcugcugaccgcgcac

SEQ ID NO: 155248 - RNA, 22 nt, Mycobacterium tuberculosis H37Rv
cgucgugauugucaugcaacca

SEQ ID NO: 155249 - RNA, 22 nt, Mycobacterium tuberculosis H37Rv
ucaggaucgacucggacuugua

SEQ ID NO: 155250 - RNA, 22 nt, Mycobacterium tuberculosis H37Rv
uugacguggagcuuggucugaa

SEQ ID NO: 155251 - RNA, 21 nt, Mycobacterium tuberculosis H37Rv
agcucggccaaaagcgccggc

SEQ ID NO: 155252 - RNA, 22 nt, Mycobacterium tuberculosis H37Rv
uucgcccgccuugucccagauc

SEQ ID NO: 155253 - RNA, 22 nt, Mycobacterium tuberculosis H37Rv
auagcggcgcugaucuccgaca

SEQ ID NO: 155254 - RNA, 23 nt, Mycobacterium tuberculosis H37Rv
ggcuggacuggucgacaccgcag

SEQ ID NO: 155255 - RNA, 22 nt, Mycobacterium tuberculosis H37Rv
ggucaaccgggcauugcuggcg

SEQ ID NO: 155256 - RNA, 22 nt, Mycobacterium tuberculosis H37Rv
ccgaccguucgaagauguggaa

SEQ ID NO: 155257 - RNA, 22 nt, Mycobacterium tuberculosis H37Rv
gccggcaugccgcgacauucac

SEQ ID NO: 155258 - RNA, 22 nt, Mycobacterium tuberculosis H37Rv
cgaguagucacgugccaguuug

SEQ ID NO: 155259 - RNA, 19 nt, Mycobacterium tuberculosis H37Rv
aagcugacggccuuggugu

SEQ ID NO: 155260 - RNA, 22 nt, Mycobacterium tuberculosis H37Rv
agcggugaucguggugcagagg

SEQ ID NO: 155261 - RNA, 22 nt, Mycobacterium tuberculosis H37Rv
cgugaucgugugccucggcugg

SEQ ID NO: 155262 - RNA, 19 nt, Mycobacterium tuberculosis H37Rv
guggcucgccugaucaccu

SEQ ID NO: 155263 - RNA, 22 nt, Mycobacterium tuberculosis H37Rv
cggccguaucgucgugcagauc

SEQ ID NO: 155264 - RNA, 22 nt, Mycobacterium tuberculosis H37Rv
cgccgagauugacguuuugcag

SEQ ID NO: 155265 - RNA, 21 nt, Mycobacterium tuberculosis H37Rv
uuccacugccggcgccgguga

SEQ ID NO: 155266 - RNA, 22 nt, Mycobacterium tuberculosis H37Rv
acggcguuggagaugucggucu

SEQ ID NO: 155267 - RNA, 22 nt, Mycobacterium tuberculosis H37Rv
cgcugcagcggcagccuccgcc

SEQ ID NO: 155268 - RNA, 22 nt, Mycobacterium tuberculosis H37Rv
auugggcgcuuaugcgucugcu

SEQ ID NO: 155269 - RNA, 22 nt, Mycobacterium tuberculosis H37Rv
ucuggucaccgacgugcaauuc

SEQ ID NO: 155270 - RNA, 18 nt, Mycobacterium tuberculosis H37Rv
acgcaccugcgcuaccag

SEQ ID NO: 155271 - RNA, 22 nt, Mycobacterium tuberculosis H37Rv
ucugugcgcgguuugugcacag

SEQ ID NO: 155272 - RNA, 22 nt, Mycobacterium tuberculosis H37Rv
cuggcgaucaccgugcgccgca

SEQ ID NO: 155273 - RNA, 22 nt, Mycobacterium tuberculosis H37Rv
ggugaccgucgccgcgucguug

SEQ ID NO: 155274 - RNA, 22 nt, Mycobacterium tuberculosis H37Rv
gcuggacguucgucggcggccc

SEQ ID NO: 155275 - RNA, 22 nt, Mycobacterium tuberculosis H37Rv
gucggccaguagcgcaccgucg

SEQ ID NO: 155276 - RNA, 19 nt, Mycobacterium tuberculosis H37Rv
ugguggacgcagagucaac

SEQ ID NO: 155277 - RNA, 22 nt, Mycobacterium tuberculosis H37Rv
agugcgguucauguauucggug

SEQ ID NO: 155278 - RNA, 21 nt, Mycobacterium tuberculosis H37Rv
gcucccgaucucccggggaga

SEQ ID NO: 155279 - RNA, 22 nt, Mycobacterium tuberculosis H37Rv
gauguagguucgggcucaugga

SEQ ID NO: 155280 - RNA, 22 nt, Mycobacterium tuberculosis H37Rv
agcggcucaaacaggaugugcc

SEQ ID NO: 155281 - RNA, 22 nt, Mycobacterium tuberculosis H37Rv
uugcgcagccggugauccugga

SEQ ID NO: 155282 - RNA, 22 nt, Mycobacterium tuberculosis H37Rv
ugcggcagacgcugcagcagua

SEQ ID NO: 155283 - RNA, 20 nt, Mycobacterium tuberculosis H37Rv
aucgacacaaucgguggauc

SEQ ID NO: 155284 - RNA, 22 nt, Mycobacterium tuberculosis H37Rv
gucagcgcgucguuggccagcg

SEQ ID NO: 155285 - RNA, 22 nt, Mycobacterium tuberculosis H37Rv
cggccauccucgagcaccugca

SEQ ID NO: 155286 - RNA, 22 nt, Mycobacterium tuberculosis H37Rv
ucgccgagcagacacagaaucg

SEQ ID NO: 155287 - RNA, 22 nt, Mycobacterium tuberculosis H37Rv
uaccagcuggccuuccggacac

SEQ ID NO: 155288 - RNA, 22 nt, Mycobacterium tuberculosis H37Rv
guacagaucugguugugcccgu

SEQ ID NO: 155289 - RNA, 22 nt, Mycobacterium tuberculosis H37Rv
gcgcgaugugcugcucgggucu

SEQ ID NO: 155290 - RNA, 17 nt, Mycobacterium tuberculosis H37Rv
gucaccgucgccacagc

SEQ ID NO: 155291 - RNA, 22 nt, Mycobacterium tuberculosis H37Rv
uggcagcaaucggguauccgau

SEQ ID NO: 155292 - RNA, 22 nt, Mycobacterium tuberculosis H37Rv
aguugccgaggauguugggcuu

SEQ ID NO: 155293 - RNA, 22 nt, Mycobacterium tuberculosis H37Rv
auggauggcgaggcguuguggu

SEQ ID NO: 155294 - RNA, 22 nt, Mycobacterium tuberculosis H37Rv
cgaacgccuggccaccgacggc

SEQ ID NO: 155295 - RNA, 22 nt, Mycobacterium tuberculosis H37Rv
ucggcgguucguuugaccguga

SEQ ID NO: 155296 - RNA, 22 nt, Mycobacterium tuberculosis H37Rv
cccuggugguccgaucguucau

SEQ ID NO: 155297 - RNA, 22 nt, Mycobacterium tuberculosis H37Rv
cgucgggaucuccagcacgucc

SEQ ID NO: 155298 - RNA, 22 nt, Mycobacterium tuberculosis H37Rv
gcguucguuucaagcggaucga

SEQ ID NO: 155299 - RNA, 22 nt, Mycobacterium tuberculosis H37Rv
cgagcagacgcaaaaucgcccu

SEQ ID NO: 155300 - RNA, 22 nt, Mycobacterium tuberculosis H37Rv
gcgaugcgcgauuacgucgaac

SEQ ID NO: 155301 - RNA, 22 nt, Mycobacterium tuberculosis H37Rv
cgaggauuucgucgcgcggcug

SEQ ID NO: 155302 - RNA, 22 nt, Mycobacterium tuberculosis H37Rv
cggucgcuugcguucaccgcga

SEQ ID NO: 155303 - RNA, 22 nt, Mycobacterium tuberculosis H37Rv
ccgagcuggaagugucggccug

SEQ ID NO: 155304 - RNA, 22 nt, Mycobacterium tuberculosis H37Rv
uucgaccaguucauguugcggc

SEQ ID NO: 155305 - RNA, 22 nt, Mycobacterium tuberculosis H37Rv
acggccaugaugcaguucuacg

SEQ ID NO: 155306 - RNA, 22 nt, Mycobacterium tuberculosis H37Rv
cuggugaugaucgguuccgcgg

SEQ ID NO: 155307 - RNA, 22 nt, Mycobacterium tuberculosis H37Rv
cgguugcggugccagccaaccg

SEQ ID NO: 155308 - RNA, 19 nt, Mycobacterium tuberculosis H37Rv
ucgucgucgacgauccgac

SEQ ID NO: 155309 - RNA, 22 nt, Mycobacterium tuberculosis H37Rv
gcaggcgaugacugcugugguc

SEQ ID NO: 155310 - RNA, 22 nt, Mycobacterium tuberculosis H37Rv
gcgcacgauuucaaaucuaagg

SEQ ID NO: 155311 - RNA, 22 nt, Mycobacterium tuberculosis H37Rv
gcuggugccggacgacgucgca

SEQ ID NO: 155312 - RNA, 22 nt, Mycobacterium tuberculosis H37Rv
aagucaccgacgaucgcuugag

SEQ ID NO: 155313 - RNA, 22 nt, Mycobacterium tuberculosis H37Rv
gaucgggugcuugcggugaucu

SEQ ID NO: 155314 - RNA, 22 nt, Mycobacterium tuberculosis H37Rv
uguccgaagacacgaaccuggc

SEQ ID NO: 155315 - RNA, 22 nt, Mycobacterium tuberculosis H37Rv
uugcgggcauaguugcggcuga

SEQ ID NO: 155316 - RNA, 22 nt, Mycobacterium tuberculosis H37Rv
gcucaucgcaguguucugcugg

SEQ ID NO: 155317 - RNA, 22 nt, Mycobacterium tuberculosis H37Rv
uccgcaagcgcugaccaucgcu

SEQ ID NO: 155318 - RNA, 21 nt, Mycobacterium tuberculosis H37Rv
cgcgccauggcaacccggccc

SEQ ID NO: 155319 - RNA, 22 nt, Mycobacterium tuberculosis H37Rv
ccgugagccggugcagagccgg

SEQ ID NO: 155320 - RNA, 22 nt, Mycobacterium tuberculosis H37Rv
agggcgauuuugcgucugcucg

SEQ ID NO: 155321 - RNA, 22 nt, Mycobacterium tuberculosis H37Rv
acggugaugccguugcggucga

SEQ ID NO: 155322 - RNA, 22 nt, Mycobacterium tuberculosis H37Rv
gcgucauugggcccaacggggu

SEQ ID NO: 155323 - RNA, 22 nt, Mycobacterium tuberculosis H37Rv
caugcaucggaagaaccggcau

SEQ ID NO: 155324 - RNA, 22 nt, Mycobacterium tuberculosis H37Rv
uccaggguggugcggaucaggu

SEQ ID NO: 155325 - RNA, 22 nt, Mycobacterium tuberculosis H37Rv
gaugcaccggugucggugaccg

SEQ ID NO: 155326 - RNA, 22 nt, Mycobacterium tuberculosis H37Rv
agguggcggucaucggcuugcc

SEQ ID NO: 155327 - RNA, 21 nt, Mycobacterium tuberculosis H37Rv
cagucgucuggcagcggccug

SEQ ID NO: 155328 - RNA, 22 nt, Mycobacterium tuberculosis H37Rv
cgcggucugcaugacgaugggc

SEQ ID NO: 155329 - RNA, 22 nt, Mycobacterium tuberculosis H37Rv
uagacguccauaucgccaugcc

SEQ ID NO: 155330 - RNA, 22 nt, Mycobacterium tuberculosis H37Rv
agugaucggcaccgcuuuggcg

SEQ ID NO: 155331 - RNA, 22 nt, Mycobacterium tuberculosis H37Rv
ucggcguccggccaggcgaaca

SEQ ID NO: 155332 - RNA, 22 nt, Mycobacterium tuberculosis H37Rv
acgucgugagauucaccgucgg

SEQ ID NO: 155333 - RNA, 22 nt, Mycobacterium tuberculosis H37Rv
accugggucgccaccgacgacg

SEQ ID NO: 155334 - RNA, 22 nt, Mycobacterium tuberculosis H37Rv
aucgaggaaugcgccgcguacg

SEQ ID NO: 155335 - RNA, 22 nt, Mycobacterium tuberculosis H37Rv
accaucgucgggcucgagacac

SEQ ID NO: 155336 - RNA, 22 nt, Mycobacterium tuberculosis H37Rv
ugucagggugcacaccgucgcc

SEQ ID NO: 155337 - RNA, 22 nt, Mycobacterium tuberculosis H37Rv
ucgccacguacaccguugcuuc

SEQ ID NO: 155338 - RNA, 22 nt, Mycobacterium tuberculosis H37Rv
uugcacguagaucgacucggcg

SEQ ID NO: 155339 - RNA, 22 nt, Mycobacterium tuberculosis H37Rv
acguacucccauugcggaucgu

SEQ ID NO: 155340 - RNA, 22 nt, Mycobacterium tuberculosis H37Rv
cggucggucaaggucgcgugca

SEQ ID NO: 155341 - RNA, 22 nt, Mycobacterium tuberculosis H37Rv
ucaccgcggcuuuguccaucgc

SEQ ID NO: 155342 - RNA, 22 nt, Mycobacterium tuberculosis H37Rv
gcuccuuggacuacggcugugu

SEQ ID NO: 155343 - RNA, 22 nt, Mycobacterium tuberculosis H37Rv
augaucggcggcgcgguguggu

SEQ ID NO: 155344 - RNA, 22 nt, Mycobacterium tuberculosis H37Rv
gugccgagcgugcaucuggggc

SEQ ID NO: 155345 - RNA, 22 nt, Mycobacterium tuberculosis H37Rv
ugcggcucgucuacggcgggca

SEQ ID NO: 155346 - RNA, 22 nt, Mycobacterium tuberculosis H37Rv
cgccaacugcucaaccauaccg

SEQ ID NO: 155347 - RNA, 22 nt, Mycobacterium tuberculosis H37Rv
ccgagacugacguuuugcagug

SEQ ID NO: 155348 - RNA, 22 nt, Mycobacterium tuberculosis H37Rv
gaauaccauugcccccgcggug

SEQ ID NO: 155349 - RNA, 22 nt, Mycobacterium tuberculosis H37Rv
aaggccggcaacggcggugccg

SEQ ID NO: 155350 - RNA, 22 nt, Mycobacterium tuberculosis H37Rv
aacacuaugcagcauuugggau

SEQ ID NO: 155351 - RNA, 22 nt, Mycobacterium tuberculosis H37Rv
acugcuuuccugucugggcggc

SEQ ID NO: 155352 - RNA, 22 nt, Mycobacterium tuberculosis H37Rv
acugucccgagcgcaccaggaa

SEQ ID NO: 155353 - RNA, 22 nt, Mycobacterium tuberculosis H37Rv
acagcugcugguuugagucugc

SEQ ID NO: 155354 - RNA, 22 nt, Mycobacterium tuberculosis H37Rv
acaagcauccaggaccgguuga

SEQ ID NO: 155355 - RNA, 22 nt, Mycobacterium tuberculosis H37Rv
acacgccuugguagccgcugac

SEQ ID NO: 155356 - RNA, 22 nt, Mycobacterium tuberculosis H37Rv
agguagacgugucccgcauggg

SEQ ID NO: 155357 - RNA, 22 nt, Mycobacterium tuberculosis H37Rv
aggcuucagcggggggcuuauc

SEQ ID NO: 155358 - RNA, 22 nt, Mycobacterium tuberculosis H37Rv
aucucuguagguggugggugcg

SEQ ID NO: 155359 - RNA, 23 nt, Mycobacterium tuberculosis H37Rv
augacgggauucugcuucgcaaa

SEQ ID NO: 155360 - RNA, 22 nt, Mycobacterium tuberculosis H37Rv
augaggcgauuuugcgucugcu

SEQ ID NO: 155361 - RNA, 22 nt, Mycobacterium tuberculosis H37Rv
auggccaaccucccgacuggua

SEQ ID NO: 155362 - RNA, 22 nt, Mycobacterium tuberculosis H37Rv
auugcgagccacgcagguugaa

SEQ ID NO: 155363 - RNA, 22 nt, Mycobacterium tuberculosis H37Rv
auugugaaaugugcgacgccag

SEQ ID NO: 155364 - RNA, 21 nt, Mycobacterium tuberculosis H37Rv
auggucugacguucuggagca

SEQ ID NO: 155365 - RNA, 22 nt, Mycobacterium tuberculosis H37Rv
cagauccuucuggccgcuggca

SEQ ID NO: 155366 - RNA, 22 nt, Mycobacterium tuberculosis H37Rv
cagcguugucucggcgaacacc

SEQ ID NO: 155367 - RNA, 22 nt, Mycobacterium tuberculosis H37Rv
caggacgguuagugcugauggg

SEQ ID NO: 155368 - RNA, 22 nt, Mycobacterium tuberculosis H37Rv
caggaggugcugcgggaggcga

SEQ ID NO: 155369 - RNA, 20 nt, Mycobacterium tuberculosis H37Rv
cacuccuggcuggauucggc

SEQ ID NO: 155370 - RNA, 22 nt, Mycobacterium tuberculosis H37Rv
caccugccgaucgcacagguug

SEQ ID NO: 155371 - RNA, 22 nt, Mycobacterium tuberculosis H37Rv
caauguuucgacgggcaccaaa

SEQ ID NO: 155372 - RNA, 22 nt, Mycobacterium tuberculosis H37Rv
uggcucagcgggucaacgaggc

SEQ ID NO: 155373 - RNA, 22 nt, Mycobacterium tuberculosis H37Rv
uggcgagcagacgcaaaagccc

SEQ ID NO: 155374 - RNA, 22 nt, Mycobacterium tuberculosis H37Rv
ugguuucccgugaggugaucgc

SEQ ID NO: 155375 - RNA, 22 nt, Mycobacterium tuberculosis H37Rv
ugagacccccgucgaagucuag

SEQ ID NO: 155376 - RNA, 22 nt, Mycobacterium tuberculosis H37Rv
ugaucucacccgaaguuguguc

SEQ ID NO: 155377 - RNA, 22 nt, Mycobacterium tuberculosis H37Rv
uggcagcaaucggguauccgau

SEQ ID NO: 155378 - RNA, 22 nt, Mycobacterium tuberculosis H37Rv
ucugugcgcgguuugugcacag

SEQ ID NO: 155379 - RNA, 21 nt, Mycobacterium tuberculosis H37Rv
ucugcccagcgcguggaucac

SEQ ID NO: 155380 - RNA, 22 nt, Mycobacterium tuberculosis H37Rv
uaacagucugccaggaaucgcc

SEQ ID NO: 155381 - RNA, 22 nt, Mycobacterium tuberculosis H37Rv
ucagcuguguccgcacaaccgg

SEQ ID NO: 155382 - RNA, 19 nt, Mycobacterium tuberculosis H37Rv
ucagcuguacucgaugaau

SEQ ID NO: 155383 - RNA, 22 nt, Mycobacterium tuberculosis H37Rv
uauguucaauaaaucauuaugu

SEQ ID NO: 155384 - RNA, 22 nt, Mycobacterium tuberculosis H37Rv
ggucacagcagagcggccgucg

SEQ ID NO: 155385 - RNA, 22 nt, Mycobacterium tuberculosis H37Rv
gugcagguucguacuggcaugc

SEQ ID NO: 155386 - RNA, 22 nt, Mycobacterium tuberculosis H37Rv
gccaggcuggugucggcggugg

SEQ ID NO: 155387 - RNA, 22 nt, Mycobacterium tuberculosis H37Rv
gccagguugacguugguuucgg

SEQ ID NO: 155388 - RNA, 22 nt, Mycobacterium tuberculosis H37Rv
gccgaacgugaagccagggcga

SEQ ID NO: 155389 - RNA, 22 nt, Mycobacterium tuberculosis H37Rv
gcccauuugcccgacgucgcau

SEQ ID NO: 155390 - RNA, 22 nt, Mycobacterium tuberculosis H37Rv
gaccaugucgcggcguagccgu

SEQ ID NO: 155391 - RNA, 22 nt, Mycobacterium tuberculosis H37Rv
gaccagguuggacagcaucgcc

SEQ ID NO: 155392 - RNA, 22 nt, Mycobacterium tuberculosis H37Rv
gcaggcagugucaugccgccga

SEQ ID NO: 155393 - RNA, 22 nt, Mycobacterium tuberculosis H37Rv
gcaggcgaugacugcugugguc

SEQ ID NO: 155394 - RNA, 22 nt, Mycobacterium tuberculosis H37Rv
gacgccgaguaccgcgcgaugu

SEQ ID NO: 155395 - RNA, 22 nt, Mycobacterium tuberculosis H37Rv
gacuccagccguucacguucga

SEQ ID NO: 155396 - RNA, 22 nt, Mycobacterium tuberculosis H37Rv
ggcgagcagacacagagucgca

SEQ ID NO: 155397 - RNA, 22 nt, Mycobacterium tuberculosis H37Rv
ggccgaaacaccgcgcgaaggg

SEQ ID NO: 155398 - RNA, 22 nt, Mycobacterium tuberculosis H37Rv
ggcaugagucgaagccucaacg

SEQ ID NO: 155399 - RNA, 22 nt, Mycobacterium tuberculosis H37Rv
ggcaggugcgcuaggucccggu

SEQ ID NO: 155400 - RNA, 22 nt, Mycobacterium tuberculosis H37Rv
ggcaacuccgggguggccagca

SEQ ID NO: 155401 - RNA, 22 nt, Mycobacterium tuberculosis H37Rv
gcugcagcggcucguggguggu

SEQ ID NO: 155402 - RNA, 22 nt, Mycobacterium tuberculosis H37Rv
gcugaaccugauccucaagggc

SEQ ID NO: 155403 - RNA, 21 nt, Mycobacterium tuberculosis H37Rv
gcucugcaucgucgccggcgg

SEQ ID NO: 155404 - RNA, 22 nt, Mycobacterium tuberculosis H37Rv
gcuguccuguggcgcccgcagc

SEQ ID NO: 155405 - RNA, 22 nt, Mycobacterium tuberculosis H37Rv
cuugcugguaugccgggccacc

SEQ ID NO: 155406 - RNA, 22 nt, Mycobacterium tuberculosis H37Rv
cucuggccaaggugucgagcac

SEQ ID NO: 155407 - RNA, 22 nt, Mycobacterium tuberculosis H37Rv
cggucaccaucucgcagacaua

SEQ ID NO: 155408 - RNA, 22 nt, Mycobacterium tuberculosis H37Rv
cgauccucgcaccgcucgccgc

SEQ ID NO: 155409 - RNA, 23 nt, Mycobacterium tuberculosis H37Rv
cgagggcuuuagugucugcucgc

SEQ ID NO: 155410 - RNA, 22 nt, Mycobacterium tuberculosis H37Rv
caggccgacacuuccagcucgg

SEQ ID NO: 155411 - RNA, 22 nt, Mycobacterium tuberculosis H37Rv
cgaccaagcgucggcccaacca

SEQ ID NO: 155412 - RNA, 23 nt, Mycobacterium tuberculosis H37Rv
cauccugcuggugcggaccggca

SEQ ID NO: 155413 - RNA, 22 nt, Mycobacterium tuberculosis H37Rv
cgagcagacgcagagucgcacu

SEQ ID NO: 155414 - RNA, 22 nt, Mycobacterium tuberculosis H37Rv
aagaacgcgucguagcgcucgu

SEQ ID NO: 155415 - RNA, 22 nt, Mycobacterium tuberculosis H37Rv
aaccgcuacaaaugaaguuggu

SEQ ID NO: 155416 - RNA, 19 nt, Mycobacterium tuberculosis H37Rv
acccaggccgucacuucga

SEQ ID NO: 155417 - RNA, 22 nt, Mycobacterium tuberculosis H37Rv
acgagcguaacggcacugcgaa

SEQ ID NO: 155418 - RNA, 21 nt, Mycobacterium tuberculosis H37Rv
acgagcccaucgcgaacucgu

SEQ ID NO: 155419 - RNA, 22 nt, Mycobacterium tuberculosis H37Rv
aaugccagcgcgaagaccgcca

SEQ ID NO: 155420 - RNA, 22 nt, Mycobacterium tuberculosis H37Rv
agcuguccgacaaaguauccga

SEQ ID NO: 155421 - RNA, 22 nt, Mycobacterium tuberculosis H37Rv
agcugcaugacgaacucggccu

SEQ ID NO: 155422 - RNA, 17 nt, Mycobacterium tuberculosis H37Rv
agccgccuuggaccggc

SEQ ID NO: 155423 - RNA, 22 nt, Mycobacterium tuberculosis H37Rv
agccaagccguaguccucgacg

SEQ ID NO: 155424 - RNA, 22 nt, Mycobacterium tuberculosis H37Rv
uugaggaucagguucagcuggc

SEQ ID NO: 155425 - RNA, 22 nt, Mycobacterium tuberculosis H37Rv
uugaugauggucggcgccgaca

SEQ ID NO: 155426 - RNA, 22 nt, Mycobacterium tuberculosis H37Rv
uugcgcaggggcaugucagcgu

SEQ ID NO: 155427 - RNA, 22 nt, Mycobacterium tuberculosis H37Rv
uugucgccgucucgguccagcu

SEQ ID NO: 155428 - RNA, 22 nt, Mycobacterium tuberculosis H37Rv
uugucgccgugcaccaccugga

SEQ ID NO: 155429 - RNA, 22 nt, Mycobacterium tuberculosis H37Rv
ugggcugcugcgccgcaucggc

SEQ ID NO: 155430 - RNA, 22 nt, Mycobacterium tuberculosis H37Rv
ugggacagcuggaaguuaucgg

SEQ ID NO: 155431 - RNA, 18 nt, Mycobacterium tuberculosis H37Rv
uggugcaccuuguuuggg

SEQ ID NO: 155432 - RNA, 18 nt, Mycobacterium tuberculosis H37Rv
ucagcgaucggggugcgg

SEQ ID NO: 155433 - RNA, 22 nt, Mycobacterium tuberculosis H37Rv
ucagcgucgaugaccaugucga

SEQ ID NO: 155434 - RNA, 22 nt, Mycobacterium tuberculosis H37Rv
ucaccgccgcgguuggugcgca

SEQ ID NO: 155435 - RNA, 22 nt, Mycobacterium tuberculosis H37Rv
ucagcagacgcaaaagcccccg

SEQ ID NO: 155436 - RNA, 22 nt, Mycobacterium tuberculosis H37Rv
ucgcccagcgagugcgccuggu

SEQ ID NO: 155437 - RNA, 22 nt, Mycobacterium tuberculosis H37Rv
ucggccucccaugcggcgaucu

SEQ ID NO: 155438 - RNA, 22 nt, Mycobacterium tuberculosis H37Rv
ucgguggcgccgacaugccggu

SEQ ID NO: 155439 - RNA, 18 nt, Mycobacterium tuberculosis H37Rv
ucgugggcgcgccgccaa

SEQ ID NO: 155440 - RNA, 22 nt, Mycobacterium tuberculosis H37Rv
ucggugacggacugcacagcga

SEQ ID NO: 155441 - RNA, 20 nt, Mycobacterium tuberculosis H37Rv
ugcgcagcuggacgcggugc

SEQ ID NO: 155442 - RNA, 21 nt, Mycobacterium tuberculosis H37Rv
ugacccacugggccgagucgg

SEQ ID NO: 155443 - RNA, 22 nt, Mycobacterium tuberculosis H37Rv
ugacauauaucaaagagauguu

SEQ ID NO: 155444 - RNA, 22 nt, Mycobacterium tuberculosis H37Rv
ugcagcaugguuucgucgugcu

SEQ ID NO: 155445 - RNA, 22 nt, Mycobacterium tuberculosis H37Rv
guuggcagagcgcgacgucucg

SEQ ID NO: 155446 - RNA, 22 nt, Mycobacterium tuberculosis H37Rv
guugugaacggaaccgccggga

SEQ ID NO: 155447 - RNA, 20 nt, Mycobacterium tuberculosis H37Rv
guccuuggugccgaagugac

SEQ ID NO: 155448 - RNA, 22 nt, Mycobacterium tuberculosis H37Rv
gucauugcgucauuuccuucga

SEQ ID NO: 155449 - RNA, 22 nt, Mycobacterium tuberculosis H37Rv
guugaucagcuuguugagcugc

SEQ ID NO: 155450 - RNA, 22 nt, Mycobacterium tuberculosis H37Rv
gguccgaaggcuucggcaagcc

SEQ ID NO: 155451 - RNA, 22 nt, Mycobacterium tuberculosis H37Rv
ggucagcacgcaugugcggugg

SEQ ID NO: 155452 - RNA, 22 nt, Mycobacterium tuberculosis H37Rv
ggaguucaaugccacggcgucg

SEQ ID NO: 155453 - RNA, 22 nt, Mycobacterium tuberculosis H37Rv
gguggcagcggguccggcgacu

SEQ ID NO: 155454 - RNA, 22 nt, Mycobacterium tuberculosis H37Rv
gguggagcuggcugccgcgcua

SEQ ID NO: 155455 - RNA, 22 nt, Mycobacterium tuberculosis H37Rv
gcgugagguccgcggccuguag

SEQ ID NO: 155456 - RNA, 22 nt, Mycobacterium tuberculosis H37Rv
gcucaugucgccguagaccggg

SEQ ID NO: 155457 - RNA, 22 nt, Mycobacterium tuberculosis H37Rv
gcuccuuggacuacggcugugu

SEQ ID NO: 155458 - RNA, 19 nt, Mycobacterium tuberculosis H37Rv
ggagugcccggugccggcg

SEQ ID NO: 155459 - RNA, 22 nt, Mycobacterium tuberculosis H37Rv
ccucuagguccgaugguggcga

SEQ ID NO: 155460 - RNA, 22 nt, Mycobacterium tuberculosis H37Rv
ccgaggagcuggucgcgcugcu

SEQ ID NO: 155461 - RNA, 21 nt, Mycobacterium tuberculosis H37Rv
cccuggugcuggccaccggcu

SEQ ID NO: 155462 - RNA, 22 nt, Mycobacterium tuberculosis H37Rv
cccuggugguccgaucguucau

SEQ ID NO: 155463 - RNA, 22 nt, Mycobacterium tuberculosis H37Rv
cgggauggugaccgcggcgaug

SEQ ID NO: 155464 - RNA, 22 nt, Mycobacterium tuberculosis H37Rv
cccaggcugaacauccgggccg

SEQ ID NO: 155465 - RNA, 22 nt, Mycobacterium tuberculosis H37Rv
ccaugagcacccggauggccug

SEQ ID NO: 155466 - RNA, 23 nt, Mycobacterium tuberculosis H37Rv
ccacucuggagauucucgcugag

SEQ ID NO: 155467 - RNA, 22 nt, Mycobacterium tuberculosis H37Rv
ccagcucaucgccguagcugag

SEQ ID NO: 155468 - RNA, 22 nt, Mycobacterium tuberculosis H37Rv
cauggaaaugcuuugcacggcg

SEQ ID NO: 155469 - RNA, 22 nt, Mycobacterium tuberculosis H37Rv
aggccgaguucgucaugcagcu

SEQ ID NO: 155470 - RNA, 22 nt, Mycobacterium tuberculosis H37Rv
caugcaucggaagaaccggcau

SEQ ID NO: 155471 - RNA, 22 nt, Mycobacterium tuberculosis H37Rv
gagggacuuaugcgucugcuag

SEQ ID NO: 155472 - RNA, 22 nt, Mycobacterium tuberculosis H37Rv
gagguguccgacgaaccugguu

SEQ ID NO: 155473 - RNA, 23 nt, Mycobacterium tuberculosis H37Rv
gaggcgcuggcagcggcccgguu

SEQ ID NO: 155474 - RNA, 22 nt, Mycobacterium tuberculosis H37Rv
gagcaugggcguggacguuguc

SEQ ID NO: 155475 - RNA, 20 nt, Mycobacterium tuberculosis H37Rv
gagccgcagcgggacccggu

SEQ ID NO: 155476 - RNA, 22 nt, Mycobacterium tuberculosis H37Rv
gagcggauuuuucgcaccggga

SEQ ID NO: 155477 - RNA, 22 nt, Mycobacterium tuberculosis H37Rv
cuggguucgacccaguccaagc

SEQ ID NO: 155478 - RNA, 22 nt, Mycobacterium tuberculosis H37Rv
cuggugaugaucgguuccgcgg

SEQ ID NO: 155479 - RNA, 22 nt, Mycobacterium tuberculosis H37Rv
cuggcuugccuccugccgcgac

SEQ ID NO: 155480 - RNA, 22 nt, Mycobacterium tuberculosis H37Rv
cugggcacugaauaccggccag

SEQ ID NO: 155481 - RNA, 22 nt, Mycobacterium tuberculosis H37Rv
cuggccgacggugucgccggug

SEQ ID NO: 155482 - RNA, 21 nt, Mycobacterium tuberculosis H37Rv
gcgagcucgucauggucuuuc

SEQ ID NO: 155483 - RNA, 22 nt, Mycobacterium tuberculosis H37Rv
gcgaaacacgggaucgggcgag

SEQ ID NO: 155484 - RNA, 20 nt, Mycobacterium tuberculosis H37Rv
gccugcagaacguugaucuc

SEQ ID NO: 155485 - RNA, 22 nt, Mycobacterium tuberculosis H37Rv
gcgcagcagcgacaggguggcg

SEQ ID NO: 155486 - RNA, 22 nt, Mycobacterium tuberculosis H37Rv
gcgauagccgaaccacccgccg

SEQ ID NO: 155487 - RNA, 21 nt, Mycobacterium tuberculosis H37Rv
gcgcagcaucucagccagugc

SEQ ID NO: 155488 - RNA, 22 nt, Mycobacterium tuberculosis H37Rv
gcggccaacgaggcagcggcgg

SEQ ID NO: 155489 - RNA, 22 nt, Mycobacterium tuberculosis H37Rv
gcgcucaacgggauauugauac

SEQ ID NO: 155490 - RNA, 22 nt, Mycobacterium tuberculosis H37Rv
gauguagguucgggcucaugga

SEQ ID NO: 155491 - RNA, 20 nt, Mycobacterium tuberculosis H37Rv
gaugaugaucguguaugcga

SEQ ID NO: 155492 - RNA, 22 nt, Mycobacterium tuberculosis H37Rv
gauggcgaugcgcaccccgucg

SEQ ID NO: 155493 - RNA, 22 nt, Mycobacterium tuberculosis H37Rv
gcacggguucguugcugugcau

SEQ ID NO: 155494 - RNA, 21 nt, Mycobacterium tuberculosis H37Rv
gcacacuggaagccagcacgc

SEQ ID NO: 155495 - RNA, 22 nt, Mycobacterium tuberculosis H37Rv
gcagacucuuggucaugggcug

SEQ ID NO: 155496 - RNA, 22 nt, Mycobacterium tuberculosis H37Rv
gcagagccgaucguccuguugc

SEQ ID NO: 155497 - RNA, 22 nt, Mycobacterium tuberculosis H37Rv
gcagaugauccucggcggugau

SEQ ID NO: 155498 - RNA, 22 nt, Human
aaauggaaguuuguucucagcc

SEQ ID NO: 155499 - RNA, 22 nt, Human
aaagaccuucacuuucuggcug

SEQ ID NO: 155500 - RNA, 22 nt, Human
aacgugcuuuacaaaugaccuu

SEQ ID NO: 155501 - RNA, 22 nt, Human
aaccuagaggaagaugggucag

SEQ ID NO: 155502 - RNA, 22 nt, Human
aaccaauaagaggaugccauuu

SEQ ID NO: 155503 - RNA, 22 nt, Human
aaccucuuuaaaagggauauug

SEQ ID NO: 155504 - RNA, 22 nt, Human
aacugggugauucaggcuguuu

SEQ ID NO: 155505 - RNA, 22 nt, Human
aacgggguugauuauuggaaga

SEQ ID NO: 155506 - RNA, 21 nt, Human
aauucccagaaacagcacaag

SEQ ID NO: 155507 - RNA, 22 nt, Human
acauaaacaugcagccugccaa

SEQ ID NO: 155508 - RNA, 22 nt, Human
acgugcauuacucaaaucucaa

SEQ ID NO: 155509 - RNA, 22 nt, Human
accccuauugcuugugauuaug

SEQ ID NO: 155510 - RNA, 22 nt, Human
aggaacaguuucaaagagugaa

SEQ ID NO: 155511 - RNA, 22 nt, Human
agucugaaccagauggcaaggu

SEQ ID NO: 155512 - RNA, 22 nt, Human
auccagaaguauuuuggguacu

SEQ ID NO: 155513 - RNA, 22 nt, Human
aucaaaauguguagucuugauc

SEQ ID NO: 155514 - RNA, 22 nt, Human
aucaaaauuuucagauacuaca

SEQ ID NO: 155515 - RNA, 21 nt, Human
augcgcgguggagugagcgaa

SEQ ID NO: 155516 - RNA, 22 nt, Human
cacaaagugucaggggagagaa

SEQ ID NO: 155517 - RNA, 22 nt, Human
caaagaaccuucgagacagggc

SEQ ID NO: 155518 - RNA, 22 nt, Human
auuuuugugucacaucuaggaa

SEQ ID NO: 155519 - RNA, 22 nt, Human
auuucagaguagaucguuauuu

SEQ ID NO: 155520 - RNA, 22 nt, Human
auuucagaaugaaaggaaaaau

SEQ ID NO: 155521 - RNA, 22 nt, Human
auuuccacaaauuaagauugca

SEQ ID NO: 155522 - RNA, 22 nt, Human
caggguugaugaauugucugua

SEQ ID NO: 155523 - RNA, 22 nt, Human
cuggauuaaacaguuugauacu

SEQ ID NO: 155524 - RNA, 22 nt, Human
cugggaaucuagagggcucauu

SEQ ID NO: 155525 - RNA, 21 nt, Human
cucauuccccgucccggcccc

SEQ ID NO: 155526 - RNA, 22 nt, Human
cuggaaaaauggauccugucuu

SEQ ID NO: 155527 - RNA, 22 nt, Human
cuugccucucccucuagggggu

SEQ ID NO: 155528 - RNA, 22 nt, Human
gacggagugcgcuugcuguuca

SEQ ID NO: 155529 - RNA, 22 nt, Human
gacggggcagccagcugguggc

SEQ ID NO: 155530 - RNA, 22 nt, Human
gaacugggguagggguagcuuu

SEQ ID NO: 155531 - RNA, 22 nt, Human
cugaaggcuuugaauggaauga

SEQ ID NO: 155532 - RNA, 19 nt, Human
cggggcuugguggguucuc

SEQ ID NO: 155533 - RNA, 22 nt, Human
cucgccugacucggaugggcug

SEQ ID NO: 155534 - RNA, 22 nt, Human
cgcacaggcacagacacuggga

SEQ ID NO: 155535 - RNA, 22 nt, Human
uuuuguuacugauuauuaaaau

SEQ ID NO: 155536 - RNA, 22 nt, Human
gauggauuuuuuauuaaaucag

SEQ ID NO: 155537 - RNA, 22 nt, Human
gaugccuccaggaaagaggacg

SEQ ID NO: 155538 - RNA, 23 nt, Human
gcauuugcaggaaacuggaaaag

SEQ ID NO: 155539 - RNA, 22 nt, Human
gcugcgcgcagccggcgccgag

SEQ ID NO: 155540 - RNA, 22 nt, Human
ggaaaaugcugaagcaucugaa

SEQ ID NO: 155541 - RNA, 22 nt, Human
ggugggaauccaggccuucauc

SEQ ID NO: 155542 - RNA, 23 nt, Human
gcugaagcccacucccugggucu

SEQ ID NO: 155543 - RNA, 23 nt, Human
ggaauuucagaugugaaauaaaa

SEQ ID NO: 155544 - RNA, 22 nt, Human
ggacugggagaauggaggcaag

SEQ ID NO: 155545 - RNA, 22 nt, Human
ggaauacggguuuauuuagucu

SEQ ID NO: 155546 - RNA, 22 nt, Human
guggaaauuuuaggaucaucuu

SEQ ID NO: 155547 - RNA, 22 nt, Human
guggagaaagcuggaaucugag

SEQ ID NO: 155548 - RNA, 22 nt, Human
gguugccuguggcucccuguua

SEQ ID NO: 155549 - RNA, 22 nt, Human
gguugccuuugcaguuggauca

SEQ ID NO: 155550 - RNA, 22 nt, Human
uacagugaggcgagauucacca

SEQ ID NO: 155551 - RNA, 22 nt, Human
gugaagcacaugggcguugggu

SEQ ID NO: 155552 - RNA, 22 nt, Human
uacugaagaugccaucacaagc

SEQ ID NO: 155553 - RNA, 22 nt, Human
ucaccgucucaguacggaggga

SEQ ID NO: 155554 - RNA, 22 nt, Human
guuguugucauuagcuguuuaa

SEQ ID NO: 155555 - RNA, 22 nt, Human
uauucccacuccucagcaauuu

SEQ ID NO: 155556 - RNA, 22 nt, Human
ugaacuggauuugugagcuccu

SEQ ID NO: 155557 - RNA, 22 nt, Human
uagugggauuuugaacaaaacc

SEQ ID NO: 155558 - RNA, 22 nt, Human
ugccgccgugggucccgacgcg

SEQ ID NO: 155559 - RNA, 22 nt, Human
uggaaaugcuuagaggugaucu

SEQ ID NO: 155560 - RNA, 22 nt, Human
ugaagcuagguucaugaggucg

SEQ ID NO: 155561 - RNA, 22 nt, Human
ugggaacuggaaaaaaugaagu

SEQ ID NO: 155562 - RNA, 22 nt, Human
ugaaccgacaggggaagauugu

SEQ ID NO: 155563 - RNA, 22 nt, Human
ugaggaaugugacaaaaccaag

SEQ ID NO: 155564 - RNA, 22 nt, Human
ugcauuuucuaccacacccacu

SEQ ID NO: 155565 - RNA, 20 nt, Human
uucuccacaggguggaggag

SEQ ID NO: 155566 - RNA, 22 nt, Human
ugggauucucagaaacacagag

SEQ ID NO: 155567 - RNA, 22 nt, Human
uuaucugugcuuuacugacaga

SEQ ID NO: 155568 - RNA, 22 nt, Human
uuucagacugcccauguuugcc

SEQ ID NO: 155569 - RNA, 22 nt, Human
uuucuguuuguaacuccagcaa

SEQ ID NO: 155570 - RNA, 22 nt, Human
uuggaaauguagaaaagcagau

SEQ ID NO: 155571 - RNA, 22 nt, Human
uuuaaguuaguauggguuaggu

SEQ ID NO: 155572 - RNA, 18 nt, Human
uuuuuuguucuguuuugu

SEQ ID NO: 155573 - RNA, 22 nt, Human
uuuuuuguuccuugguuuuugu

SEQ ID NO: 155574 - RNA, 22 nt, Human
uuuugggugcaaauuguuuguu

SEQ ID NO: 155575 - RNA, 22 nt, Human
aaaucgcuugaacccaggaagu

SEQ ID NO: 155576 - RNA, 22 nt, Human
aauaugccaaauccugucacau

SEQ ID NO: 155577 - RNA, 22 nt, Human
aaguuccuaaagucagggguca

SEQ ID NO: 155578 - RNA, 22 nt, Human
acaaagugaaaagcaucgaauu

SEQ ID NO: 155579 - RNA, 22 nt, Human
acugauuuuauauauuaccccg

SEQ ID NO: 155580 - RNA, 22 nt, Human
acgccugccuguacuugugggg

SEQ ID NO: 155581 - RNA, 22 nt, Human
aggcauuuaucaggaaauguuc

SEQ ID NO: 155582 - RNA, 22 nt, Human
aggcauuuaaagauguaagacu

SEQ ID NO: 155583 - RNA, 21 nt, Human
aggcauuuucuuggagauucu

SEQ ID NO: 155584 - RNA, 22 nt, Human
aggauuuauuccagaaaugcaa

SEQ ID NO: 155585 - RNA, 22 nt, Human
aggauuuagcaugaaaugugaa

SEQ ID NO: 155586 - RNA, 18 nt, Human
agggggaagccaggagga

SEQ ID NO: 155587 - RNA, 22 nt, Human
aguaggaauucaaagagacaaa

SEQ ID NO: 155588 - RNA, 22 nt, Human
agugggaaagcugccuuguaga

SEQ ID NO: 155589 - RNA, 22 nt, Human
auaaaaucugaagcaagaauaa

SEQ ID NO: 155590 - RNA, 20 nt, Human
auucucaccaugugacaugg

SEQ ID NO: 155591 - RNA, 22 nt, Human
auuuuugugcuuuauuggggua

SEQ ID NO: 155592 - RNA, 22 nt, Human
auuuuuaucuaaaauccacuuu

SEQ ID NO: 155593 - RNA, 22 nt, Human
augggcauggauggccgagucu

SEQ ID NO: 155594 - RNA, 22 nt, Human
augggaauggauugagugggug

SEQ ID NO: 155595 - RNA, 22 nt, Human
caggauuuaauaagauaguguu

SEQ ID NO: 155596 - RNA, 22 nt, Human
caaaagcaaagaucuuugauug

SEQ ID NO: 155597 - RNA, 22 nt, Human
cagaaauuggcagagaagaccu

SEQ ID NO: 155598 - RNA, 22 nt, Human
cauuccccaacucaacagggcu

SEQ ID NO: 155599 - RNA, 22 nt, Human
cgagguuuaugaguuuguguuc

SEQ ID NO: 155600 - RNA, 22 nt, Human
cgccgugcagucagcccagaag

SEQ ID NO: 155601 - RNA, 22 nt, Human
cgucauuuguaaaugaucaaga

SEQ ID NO: 155602 - RNA, 22 nt, Human
cugcuguuuuccccaccaucuc

SEQ ID NO: 155603 - RNA, 22 nt, Human
cugcgcgagcacugccggcggg

SEQ ID NO: 155604 - RNA, 22 nt, Human
cuguccuguggccugcuccggu

SEQ ID NO: 155605 - RNA, 22 nt, Human
gaacugaauguguaauguuggc

SEQ ID NO: 155606 - RNA, 22 nt, Human
gaaaaaccacaauugguauuuu

SEQ ID NO: 155607 - RNA, 23 nt, Human
cuucagaccucagaaggucuguu

SEQ ID NO: 155608 - RNA, 22 nt, Human
gaaguggggaggagaagacuga

SEQ ID NO: 155609 - RNA, 22 nt, Human
gaaugguuauaugauguuuaaa

SEQ ID NO: 155610 - RNA, 22 nt, Human
gcgcgggugagucacgggcgga

SEQ ID NO: 155611 - RNA, 22 nt, Human
gauuccugcuauucacagggcu

SEQ ID NO: 155612 - RNA, 22 nt, Human
gaugucccuggaggggacagga

SEQ ID NO: 155613 - RNA, 22 nt, Human
ggguuguuuguauuucucugaa

SEQ ID NO: 155614 - RNA, 22 nt, Human
gggaacuguaguuuacgcugcc

SEQ ID NO: 155615 - RNA, 22 nt, Human
gggaaaugugucuuggcauucu

SEQ ID NO: 155616 - RNA, 22 nt, Human
gugaaaauaguaaccuggcuag

SEQ ID NO: 155617 - RNA, 22 nt, Human
gugaagcaagggucaccugugg

SEQ ID NO: 155618 - RNA, 22 nt, Human
gggaaaucugcuuccuagggcu

SEQ ID NO: 155619 - RNA, 22 nt, Human
gggaauguuaaccuuucuauuu

SEQ ID NO: 155620 - RNA, 22 nt, Human
gucuccuucauuuacuguuucc

SEQ ID NO: 155621 - RNA, 22 nt, Human
guuguuaagugcugguuguuag

SEQ ID NO: 155622 - RNA, 22 nt, Human
uaaaaugcucagauaaauauau

SEQ ID NO: 155623 - RNA, 22 nt, Human
guaacugguuuucuucccucuc

SEQ ID NO: 155624 - RNA, 22 nt, Human
gucacuccuucccagagggagc

SEQ ID NO: 155625 - RNA, 22 nt, Human
gugggauaaccugagauaacau

SEQ ID NO: 155626 - RNA, 22 nt, Human
guggaaauaugggcaacaaaga

SEQ ID NO: 155627 - RNA, 22 nt, Human
ucauaaaggugccacucaguuu

SEQ ID NO: 155628 - RNA, 22 nt, Human
uauaaagaccuuauccuucaua

SEQ ID NO: 155629 - RNA, 22 nt, Human
ugugaagcgugugcaggggaca

SEQ ID NO: 155630 - RNA, 22 nt, Human
ugucugaauuguaauguugcgu

SEQ ID NO: 155631 - RNA, 23 nt, Human
uggguuucagugccaaugcugcc

SEQ ID NO: 155632 - RNA, 19 nt, Human
uuacaugacauaugaagga

SEQ ID NO: 155633 - RNA, 22 nt, Human
uggaacugguuugcuucagacu

SEQ ID NO: 155634 - RNA, 22 nt, Human
uggaaugaaagaaaaauuguag

SEQ ID NO: 155635 - RNA, 22 nt, Human
uuccugaucuuuucccagaguu

SEQ ID NO: 155636 - RNA, 22 nt, Human
uugaagccaccacuguaaguca

SEQ ID NO: 155637 - RNA, 22 nt, Human
uuguuuuaaaaagaauaacuac

SEQ ID NO: 155638 - RNA, 22 nt, Human
uguuuuuucccccccuucuaaa

SEQ ID NO: 155639 - RNA, 22 nt, Human
uguuuaucaguagacucaaguu

SEQ ID NO: 155640 - RNA, 22 nt, Human
uuuuuuguggcuggaagaaaaa

SEQ ID NO: 155641 - RNA, 22 nt, Human
uuuuuugucuugaagaaauggu

SEQ ID NO: 155642 - RNA, 22 nt, Human
uuuauaauuacguaaaauauuu

SEQ ID NO: 155643 - RNA, 22 nt, Human
uuguuguuguuguuauuuaguu

SEQ ID NO: 155644 - RNA, 22 nt, Human
uuuggguuuuuccuuagggacu

SEQ ID NO: 155645 - RNA, 22 nt, Human
uuucuugugauuuugaugaacu

SEQ ID NO: 155646 - RNA, 22 nt, Human
aagcaaaaucgcaucuggggcc

SEQ ID NO: 155647 - RNA, 22 nt, Human
gagcgcgcaaucucuccagcug

SEQ ID NO: 155648 - RNA, 18 nt, Human
uugugccugagaaggugg

SEQ ID NO: 155649 - RNA, 22 nt, Human
ugagugacuguugucaagaugg

SEQ ID NO: 155650 - RNA, 22 nt, Human
uuaucaaaaaauaguacuuuga

SEQ ID NO: 155651 - RNA, 22 nt, Human
acaguuagguccuaaaauucug

SEQ ID NO: 155652 - RNA, 22 nt, Human
ucagcucucucuuggugaucuc

SEQ ID NO: 155653 - RNA, 22 nt, Human
aaugauuuucugcaaacaguga

SEQ ID NO: 155654 - RNA, 22 nt, Human
ccagaggcuuaugcagcugcug

SEQ ID NO: 155655 - RNA, 18 nt, Human
cauuguacaaugcuuuau

SEQ ID NO: 155656 - RNA, 22 nt, Human
agacagcggugcaauaaauggu

SEQ ID NO: 155657 - RNA, 22 nt, Human
ggagacagauggcgucucaguu

SEQ ID NO: 155658 - RNA, 22 nt, Human
ggagagcguggaugggcuucca

SEQ ID NO: 155659 - RNA, 22 nt, Human
auuuuuauuugccuaugauaua

SEQ ID NO: 155660 - RNA, 22 nt, Human
aaaauaaccuucauuugcauug

SEQ ID NO: 155661 - RNA, 22 nt, Human
ugugccuagauuccaugcacuc

SEQ ID NO: 155662 - RNA, 22 nt, Human
cucaugagucugucagagucau

SEQ ID NO: 155663 - RNA, 20 nt, Human
cguguacauuuaugccccug

SEQ ID NO: 155664 - RNA, 22 nt, Human
agagacaggguuuugucguguu

SEQ ID NO: 155665 - RNA, 22 nt, Human
cuggccuuaucacaaagcuaga

SEQ ID NO: 155666 - RNA, 20 nt, Human
gcugugccaugacccucgag

SEQ ID NO: 155667 - RNA, 22 nt, Human
ucuguuguauggcugucuaauu

SEQ ID NO: 155668 - RNA, 22 nt, Human
ugcccagagccucuuaccucca

SEQ ID NO: 155669 - RNA, 22 nt, Human
gagagagacugggaaaucauca

SEQ ID NO: 155670 - RNA, 22 nt, Human
cuucagagugacucagcaucuu

SEQ ID NO: 155671 - RNA, 22 nt, Human
uacaaaauucaaauaauguuug

SEQ ID NO: 155672 - RNA, 22 nt, Human
acucagaguuugcguuccauac

SEQ ID NO: 155673 - RNA, 16 nt, Human
ccccucaggaaguaca

SEQ ID NO: 155674 - RNA, 22 nt, Human
aauguuuaguuuuauuuuagua

SEQ ID NO: 155675 - RNA, 22 nt, Human
ggcucccccauggcugacagac

SEQ ID NO: 155676 - RNA, 22 nt, Human
caaaaauacuugccuguaucug

SEQ ID NO: 155677 - RNA, 22 nt, Human
aacauuguuuaaguuaaauugu

SEQ ID NO: 155678 - RNA, 22 nt, Human
uagagaaauauuuguagugcug

SEQ ID NO: 155679 - RNA, 22 nt, Human
uuuagcaaggagaaauaauccu

SEQ ID NO: 155680 - RNA, 22 nt, Human
auuucagaguagaucguuauuu

SEQ ID NO: 155681 - RNA, 22 nt, Human
aucccacaccccuacaacauau

SEQ ID NO: 155682 - RNA, 22 nt, Human
acuguugugaauaaugaaaugc

SEQ ID NO: 155683 - RNA, 20 nt, Human
aggccgcccgcugccgcuuc

SEQ ID NO: 155684 - RNA, 22 nt, Human
cgaccccugaaaauggcagcca

SEQ ID NO: 155685 - RNA, 22 nt, Human
cacccccaggcuccccuucugg

SEQ ID NO: 155686 - RNA, 22 nt, Human
aagcaaaagguuacacuucugg

SEQ ID NO: 155687 - RNA, 22 nt, Human
aaauauuugaaugguguaagau

SEQ ID NO: 155688 - RNA, 22 nt, Human
cagacagagucuucccaucagu

SEQ ID NO: 155689 - RNA, 22 nt, Human
uuagagagguuggagugguaga

SEQ ID NO: 155690 - RNA, 22 nt, Human
ucagagagagagaggcggaaga

SEQ ID NO: 155691 - RNA, 22 nt, Human
ccaccccagaaagggaaggcca

SEQ ID NO: 155692 - RNA, 22 nt, Human
ugccagcuccgaggagcugcag

SEQ ID NO: 155693 - RNA, 22 nt, Human
acuuuaaaucuguugcuuagcu

SEQ ID NO: 155694 - RNA, 22 nt, Human
uauauuaaagugcuuugcagug

SEQ ID NO: 155695 - RNA, 22 nt, Human
gccugcaggaaggugugccugu

SEQ ID NO: 155696 - RNA, 22 nt, Human
uaugugugugcguguguuuugc

SEQ ID NO: 155697 - RNA, 22 nt, Human
ugagagaggugaaaugacuuuc

SEQ ID NO: 155698 - RNA, 22 nt, Human
ccacccacuucucugcccucca

SEQ ID NO: 155699 - RNA, 22 nt, Human
accaguuaaagaauaugaggcc

SEQ ID NO: 155700 - RNA, 22 nt, Human
ccaccacugaggcacaggagcc

SEQ ID NO: 155701 - RNA, 22 nt, Human
accucccugaaaaagacagugc

SEQ ID NO: 155702 - RNA, 22 nt, Human
ccacucagaagaaacaagagag

SEQ ID NO: 155703 - RNA, 22 nt, Human
ccaucccugagucacaggaggg

SEQ ID NO: 155704 - RNA, 22 nt, Human
ucacuggauucauguuucuuua

SEQ ID NO: 155705 - RNA, 23 nt, Human
ugcaaaauuugcagaguucgaug

SEQ ID NO: 155706 - RNA, 22 nt, Human
cagagagcguccauccggugcc

SEQ ID NO: 155707 - RNA, 22 nt, Human
uucccugugcaguauguuccaa

SEQ ID NO: 155708 - RNA, 22 nt, Human
acccccacuccgcaguagaacu

SEQ ID NO: 155709 - RNA, 22 nt, Human
acugcuguugugauggguauuu

SEQ ID NO: 155710 - RNA, 22 nt, Human
cccccucugcugaugcccccau

SEQ ID NO: 155711 - RNA, 22 nt, Human
accucagauuguggcuccgcug

SEQ ID NO: 155712 - RNA, 22 nt, Human
uacauuguguuaaaacagaaga

SEQ ID NO: 155713 - RNA, 22 nt, Human
cugcggcaccaaccccuucaug

SEQ ID NO: 155714 - RNA, 22 nt, Human
ucacauugcauuuucucauuug

SEQ ID NO: 155715 - RNA, 22 nt, Human
acacaggacacaaaagucacca

SEQ ID NO: 155716 - RNA, 22 nt, Human
cagacacgucccuguugaccug

SEQ ID NO: 155717 - RNA, 20 nt, Human
gcccacccgcacucccgccg

SEQ ID NO: 155718 - RNA, 22 nt, Human
uccccaccuaagauacccaucu

SEQ ID NO: 155719 - RNA, 22 nt, Human
gaaaugaaacacacaugcagcu

SEQ ID NO: 155720 - RNA, 22 nt, Human
uugccucuaauuagcucuguga

SEQ ID NO: 155721 - RNA, 22 nt, Human
ggagagagggaucuuuguggag

SEQ ID NO: 155722 - RNA, 22 nt, Human
aggagcacugggcaugucaccc

SEQ ID NO: 155723 - RNA, 22 nt, Human
agagcagcuuuucggaaccacu

SEQ ID NO: 155724 - RNA, 22 nt, Human
aauauuuaaauagaauuacauc

SEQ ID NO: 155725 - RNA, 22 nt, Human
ccccucuguagcccgagcugcu

SEQ ID NO: 155726 - RNA, 22 nt, Human
guucccuugccuuuaguuugau

SEQ ID NO: 155727 - RNA, 22 nt, Human
guucucuccugcuggugaugga

SEQ ID NO: 155728 - RNA, 22 nt, Human
uugugacaauacagcauggaga

SEQ ID NO: 155729 - RNA, 22 nt, Human
cacauuguuuggucagagcaua

SEQ ID NO: 155730 - RNA, 22 nt, Human
ucucuacugcuucugugaguga

SEQ ID NO: 155731 - RNA, 22 nt, Human
aauguuuaacuguggucagcag

SEQ ID NO: 155732 - RNA, 22 nt, Human
ugucacagagcgugcaacagaa

SEQ ID NO: 155733 - RNA, 22 nt, Human
cccuccagugucccagugggga

SEQ ID NO: 155734 - RNA, 22 nt, Human
uuuagcaaaaaagcucugcgua

SEQ ID NO: 155735 - RNA, 19 nt, Human
gcacacccugcaccaccau

SEQ ID NO: 155736 - RNA, 23 nt, Human
cacaggcagaaaucaagacggua

SEQ ID NO: 155737 - RNA, 22 nt, Human
agaggcuuuccuaagauugguu

SEQ ID NO: 155738 - RNA, 22 nt, Human
cucagcgagggaaagaggccgc

SEQ ID NO: 155739 - RNA, 22 nt, Human
aagagaaaaaucuuaaucuagu

SEQ ID NO: 155740 - RNA, 22 nt, Human
uuuaaaccuuggaagccacaua

SEQ ID NO: 155741 - RNA, 22 nt, Human
ccucccaccguaucucaguggc

SEQ ID NO: 155742 - RNA, 22 nt, Human
gagaaagggagaaaaagaucuu

SEQ ID NO: 155743 - RNA, 22 nt, Human
cuguuguguuauuugcagugca

SEQ ID NO: 155744 - RNA, 22 nt, Human
uccccugccccccauccucugg

SEQ ID NO: 155745 - RNA, 22 nt, Human
ggcauuccgggguccccuucuc

SEQ ID NO: 155746 - RNA, 22 nt, Human
cccgcucaccccacuccaccag

SEQ ID NO: 155747 - RNA, 22 nt, Human
gcucagagaugucugcugccuu

SEQ ID NO: 155748 - RNA, 22 nt, Human
uguauauguguguagcauguua

SEQ ID NO: 155749 - RNA, 22 nt, Human
cugugugcagggcacaauggaa

SEQ ID NO: 155750 - RNA, 22 nt, Human
agcaaaauuccaaaaugcuaau

SEQ ID NO: 155751 - RNA, 22 nt, Human
ugagacagaccuuggaccaugu

SEQ ID NO: 155752 - RNA, 22 nt, Human
ugucagccacggugugaccggc

SEQ ID NO: 155753 - RNA, 19 nt, Human
ggcacccagagucccccug

SEQ ID NO: 155754 - RNA, 22 nt, Human
cccccauccccugaaggagcug

SEQ ID NO: 155755 - RNA, 22 nt, Human
ggagacagugacuuagagacug

SEQ ID NO: 155756 - RNA, 22 nt, Human
aagaggcuacagcccugugucu

SEQ ID NO: 155757 - RNA, 22 nt, Human
agcuggaaucucggcaaagcgu

SEQ ID NO: 155758 - RNA, 22 nt, Human
ucaggagaguguucaguggagg

SEQ ID NO: 155759 - RNA, 22 nt, Human
ccagccacagcuuccagcuccu

SEQ ID NO: 155760 - RNA, 22 nt, Human
cagcagaggagguggcagcacc

SEQ ID NO: 155761 - RNA, 21 nt, Human
cagcccccauacccugcccag

SEQ ID NO: 155762 - RNA, 22 nt, Human
ggcagcccuggacccuggagaa

SEQ ID NO: 155763 - RNA, 23 nt, Human
cagagaaaauagaauaugcugug

SEQ ID NO: 155764 - RNA, 22 nt, Human
uaaaugcucuuuaaaagugcuu

SEQ ID NO: 155765 - RNA, 22 nt, Human
cagccccaguuuucauaagacu

SEQ ID NO: 155766 - RNA, 20 nt, Human
cagagacaagagggaaggga

SEQ ID NO: 155767 - RNA, 22 nt, Human
uaaaugauaguauugaagguag

SEQ ID NO: 155768 - RNA, 21 nt, Human
ucuguuguguguugaggacuu

SEQ ID NO: 155769 - RNA, 20 nt, Human
agagaacaguuuggucacag

SEQ ID NO: 155770 - RNA, 22 nt, Human
ccaccucuaccuggccggccuu

SEQ ID NO: 155771 - RNA, 22 nt, Human
uccucagagacaaguugagagg

SEQ ID NO: 155772 - RNA, 22 nt, Human
aaaauauuuaucuagcucuuaa

SEQ ID NO: 155773 - RNA, 22 nt, Human
gcucagagaaaacuggggcuug

SEQ ID NO: 155774 - RNA, 23 nt, Human
acagaggcaucagagcagcaggc

SEQ ID NO: 155775 - RNA, 22 nt, Human
agagggagagauuggcaaucag

SEQ ID NO: 155776 - RNA, 18 nt, Human
gccagcccuccaaccucc

SEQ ID NO: 155777 - RNA, 22 nt, Human
ggagaaacuaguuagauccaau

SEQ ID NO: 155778 - RNA, 22 nt, Human
cugagcugcucccgcugcagcg

SEQ ID NO: 155779 - RNA, 22 nt, Human
accaccacugacaccagcucgg

SEQ ID NO: 155780 - RNA, 22 nt, Human
ucagagacaucagguuguagca

SEQ ID NO: 155781 - RNA, 22 nt, Human
uuuaaaccuaucuaagaaauag

SEQ ID NO: 155782 - RNA, 22 nt, Human
cuccccacucaacucccagacc

SEQ ID NO: 155783 - RNA, 22 nt, Human
uagagagaaaccaggguuuggg

SEQ ID NO: 155784 - RNA, 22 nt, Human
aacauuguggacaagggcaggu

SEQ ID NO: 155785 - RNA, 22 nt, Neisseria meningitidis MC58
uuucagacgguauuuugauugu

SEQ ID NO: 155786 - RNA, 22 nt, Neisseria meningitidis MC58
ggucugaaacccuaacuaugca

SEQ ID NO: 155787 - RNA, 22 nt, Neisseria meningitidis MC58
uugccgucuugauaaguuuccc

SEQ ID NO: 155788 - RNA, 22 nt, Neisseria meningitidis MC58
agacggcauuuucuguuuauuu

SEQ ID NO: 155789 - RNA, 22 nt, Neisseria meningitidis MC58
ucugcgcgauacgcucaaacgg

SEQ ID NO: 155790 - RNA, 23 nt, Neisseria meningitidis MC58
cgggaaugacggauuucgagauu

SEQ ID NO: 155791 - RNA, 22 nt, Neisseria meningitidis MC58
cugaaaggucuggauucccgcc

SEQ ID NO: 155792 - RNA, 22 nt, Neisseria meningitidis MC58
aaugacgggauuaaaguuucaa

SEQ ID NO: 155793 - RNA, 22 nt, Neisseria meningitidis MC58
augccguccgaacgcuguccga

SEQ ID NO: 155794 - RNA, 18 nt, Neisseria meningitidis MC58
ccggaaacauagauauac

SEQ ID NO: 155795 - RNA, 22 nt, Neisseria meningitidis MC58
gccuucgccgagcacgguguuu

SEQ ID NO: 155796 - RNA, 22 nt, Neisseria meningitidis MC58
uugcgcgguguuugguuuucca

SEQ ID NO: 155797 - RNA, 22 nt, Neisseria meningitidis MC58
cugauuuaaaguuaauccacua

SEQ ID NO: 155798 - RNA, 22 nt, Neisseria meningitidis MC58
ccugccugcgcaucuggcggac

SEQ ID NO: 155799 - RNA, 22 nt, Neisseria meningitidis MC58
cugaaauguccucugaaagcgc

SEQ ID NO: 155800 - RNA, 22 nt, Neisseria meningitidis MC58
gcgggauauuuuugacggacgg

SEQ ID NO: 155801 - RNA, 22 nt, Neisseria meningitidis MC58
uuucagacggcauuguuuuuga

SEQ ID NO: 155802 - RNA, 22 nt, Neisseria meningitidis MC58
gaaaccgaacaagccggauucc

SEQ ID NO: 155803 - RNA, 22 nt, Neisseria meningitidis MC58
augccgucugaaagggugugga

SEQ ID NO: 155804 - RNA, 22 nt, Neisseria meningitidis MC58
auucccgccugcgcgggaauga

SEQ ID NO: 155805 - RNA, 22 nt, Neisseria meningitidis MC58
gcgggaaugacgaauuucaggu

SEQ ID NO: 155806 - RNA, 22 nt, Neisseria meningitidis MC58
ggaaugacggguuucgagauug

SEQ ID NO: 155807 - RNA, 22 nt, Neisseria meningitidis MC58
ucagacggcauuuucccguuuu

SEQ ID NO: 155808 - RNA, 22 nt, Neisseria meningitidis MC58
gggaauccagguucguugaguu

SEQ ID NO: 155809 - RNA, 22 nt, Neisseria meningitidis MC58
gucgcccugcugcauuugcgcc

SEQ ID NO: 155810 - RNA, 22 nt, Neisseria meningitidis MC58
cagacggcauuuugauguucgg

SEQ ID NO: 155811 - RNA, 22 nt, Neisseria meningitidis MC58
augccgucugaaaugccugcga

SEQ ID NO: 155812 - RNA, 22 nt, Neisseria meningitidis MC58
aaugacggcagagcgguuucug

SEQ ID NO: 155813 - RNA, 22 nt, Neisseria meningitidis MC58
ggccgucugaaaauaaaaucuu

SEQ ID NO: 155814 - RNA, 22 nt, Neisseria meningitidis MC58
gugggaaugacggcguaaaggu

SEQ ID NO: 155815 - RNA, 20 nt, Neisseria meningitidis MC58
cagacggcauuuuuugcuug

SEQ ID NO: 155816 - RNA, 22 nt, Neisseria meningitidis MC58
ucugauacaguaucuguccggu

SEQ ID NO: 155817 - RNA, 22 nt, Neisseria meningitidis MC58
cgggaaugacggauuuuaguuu

SEQ ID NO: 155818 - RNA, 22 nt, Neisseria meningitidis MC58
gccgucugaagggaccgggcag

SEQ ID NO: 155819 - RNA, 22 nt, Neisseria meningitidis MC58
agacggcauaccgcuauguuaa

SEQ ID NO: 155820 - RNA, 20 nt, Neisseria meningitidis MC58
aaugacgggauuagaguuuc

SEQ ID NO: 155821 - RNA, 22 nt, Neisseria meningitidis MC58
aauacagcacacugccgggcag

SEQ ID NO: 155822 - RNA, 22 nt, Neisseria meningitidis MC58
uugccuuggaagauuuaguugc

SEQ ID NO: 155823 - RNA, 22 nt, Neisseria meningitidis MC58
ggaaugacggauuuuagguugg

SEQ ID NO: 155824 - RNA, 22 nt, Neisseria meningitidis MC58
aaugccguuuuucaggauauug

SEQ ID NO: 155825 - RNA, 22 nt, Neisseria meningitidis MC58
ggaaugacgggauuucagguua

SEQ ID NO: 155826 - RNA, 22 nt, Neisseria meningitidis MC58
aagcgguugucggcuuccugcc

SEQ ID NO: 155827 - RNA, 22 nt, Neisseria meningitidis MC58
aaugacggcagaacgguuucug

SEQ ID NO: 155828 - RNA, 22 nt, Neisseria meningitidis MC58
augccgucugcaggaagcaggu

SEQ ID NO: 155829 - RNA, 22 nt, Neisseria meningitidis MC58
guuucagacgaccuuaagaugu

SEQ ID NO: 155830 - RNA, 22 nt, Neisseria meningitidis MC58
augacgggauuagaguuucaaa

SEQ ID NO: 155831 - RNA, 22 nt, Neisseria meningitidis MC58
agcugcugaaucacacuguaaa

SEQ ID NO: 155832 - RNA, 22 nt, Neisseria meningitidis MC58
gaugccgccggcguggcauccu

SEQ ID NO: 155833 - RNA, 22 nt, Neisseria meningitidis MC58
ggaggcuucaaacaaggcuuuc

SEQ ID NO: 155834 - RNA, 20 nt, Human
aaaaacaguaaugcugaaga

SEQ ID NO: 155835 - RNA, 22 nt, Human
aaaaacuuaccccagggcaagg

SEQ ID NO: 155836 - RNA, 22 nt, Human
aaaaaguaccacuuggacacuu

SEQ ID NO: 155837 - RNA, 22 nt, Human
aaaaaauugcuggcagagcugu

SEQ ID NO: 155838 - RNA, 22 nt, Human
aaaaaaacuaauuuuaaaugug

SEQ ID NO: 155839 - RNA, 22 nt, Human
aaaacuuucagggauacagaaa

SEQ ID NO: 155840 - RNA, 22 nt, Human
aaaaccugcaagaugaaaucag

SEQ ID NO: 155841 - RNA, 22 nt, Human
aaaagacaaggaucuggaguga

SEQ ID NO: 155842 - RNA, 22 nt, Human
aaaagaaugaugggagcugggu

SEQ ID NO: 155843 - RNA, 22 nt, Human
aaaagauguaaacauauauuaa

SEQ ID NO: 155844 - RNA, 20 nt, Human
aaaaauguguuuauggagau

SEQ ID NO: 155845 - RNA, 22 nt, Human
aaaacauuuaggguuuuuuuua

SEQ ID NO: 155846 - RNA, 22 nt, Human
aaagacuaaccaguugucaaaa

SEQ ID NO: 155847 - RNA, 21 nt, Human
aaagaagagcucagagguaga

SEQ ID NO: 155848 - RNA, 22 nt, Human
aaacuuuaucaaguacucuuca

SEQ ID NO: 155849 - RNA, 22 nt, Human
aaagagccaacuaccgcaaauu

SEQ ID NO: 155850 - RNA, 21 nt, Human
aaagaaguuaguucagugguu

SEQ ID NO: 155851 - RNA, 22 nt, Human
aaagaauuucaagauucccaca

SEQ ID NO: 155852 - RNA, 20 nt, Human
aaacucucugaucuuacagu

SEQ ID NO: 155853 - RNA, 22 nt, Human
aaacuagaacagagagagaagc

SEQ ID NO: 155854 - RNA, 22 nt, Human
aaacucaucaguuuagaaaccu

SEQ ID NO: 155855 - RNA, 22 nt, Human
aaacugcuuucucugccuuucc

SEQ ID NO: 155856 - RNA, 22 nt, Human
aaacuuuaggcacauggaucua

SEQ ID NO: 155857 - RNA, 23 nt, Human
aaacuacauuuauaguuuuucuc

SEQ ID NO: 155858 - RNA, 22 nt, Human
aaacucaugccagagaacuuaa

SEQ ID NO: 155859 - RNA, 22 nt, Human
aaacucuaagacuaaaauugaa

SEQ ID NO: 155860 - RNA, 22 nt, Human
aaacaauaauaauuaggaagga

SEQ ID NO: 155861 - RNA, 22 nt, Human
aaaauaauauuauaccacugcu

SEQ ID NO: 155862 - RNA, 22 nt, Human
aaaauaaccuucauuugcauug

SEQ ID NO: 155863 - RNA, 22 nt, Human
aaaaggaagaguuuucagagac

SEQ ID NO: 155864 - RNA, 22 nt, Human
aaaaggaacaauaugguauuuu

SEQ ID NO: 155865 - RNA, 22 nt, Human
aaacauguagugcaugaggauc

SEQ ID NO: 155866 - RNA, 22 nt, Human
aaaauauguugagauacugaaa

SEQ ID NO: 155867 - RNA, 18 nt, Human
aaacauggcuuaaaggcu

SEQ ID NO: 155868 - RNA, 22 nt, Human
aaaauacuaggaaaauaaauca

SEQ ID NO: 155869 - RNA, 22 nt, Human
aaacauaugccuucuuuuguaa

SEQ ID NO: 155870 - RNA, 21 nt, Human
aaacaugcagccugccaauuc

SEQ ID NO: 155871 - RNA, 22 nt, Human
aaaccagaguucauaguauuca

SEQ ID NO: 155872 - RNA, 21 nt, Human
aauucccagaaacagcacaag

SEQ ID NO: 155873 - RNA, 21 nt, Human
aauuauuugcauuuuucuugu

SEQ ID NO: 155874 - RNA, 22 nt, Human
aauucaacagucaguuaucuca

SEQ ID NO: 155875 - RNA, 22 nt, Human
aauuauuaagcuuucuccagug

SEQ ID NO: 155876 - RNA, 22 nt, Human
aauuagaagcuguuagcaaaau

SEQ ID NO: 155877 - RNA, 22 nt, Human
aauuauucuugccuagguuuaa

SEQ ID NO: 155878 - RNA, 22 nt, Human
aauguuuaagcuuuuauuuaca

SEQ ID NO: 155879 - RNA, 22 nt, Human
aauguuugaacuuugcauauuu

SEQ ID NO: 155880 - RNA, 22 nt, Human
aauguugaaccuuuuuggccug

SEQ ID NO: 155881 - RNA, 22 nt, Human
aauguauuuuuaggcagaauau

SEQ ID NO: 155882 - RNA, 22 nt, Human
aauguucucuaaucuuucucuu

SEQ ID NO: 155883 - RNA, 22 nt, Human
aauguacucuguguuucucaug

SEQ ID NO: 155884 - RNA, 22 nt, Human
aaugguuacuacccugggucuu

SEQ ID NO: 155885 - RNA, 22 nt, Human
aauguaaauaauuguaaaauuu

SEQ ID NO: 155886 - RNA, 22 nt, Human
aauggacuucucugagccuguu

SEQ ID NO: 155887 - RNA, 22 nt, Human
aauggaugauuaaauggaugaa

SEQ ID NO: 155888 - RNA, 22 nt, Human
aauggagaaaagacaauguuga

SEQ ID NO: 155889 - RNA, 22 nt, Human
aauggcaauagugcauuaugua

SEQ ID NO: 155890 - RNA, 22 nt, Human
aaugccuucauuggcgaagugc

SEQ ID NO: 155891 - RNA, 22 nt, Human
aauggaaaaauccacagggaac

SEQ ID NO: 155892 - RNA, 22 nt, Human
aaugacaguggcacagucacuu

SEQ ID NO: 155893 - RNA, 22 nt, Human
aaugaacuuugaagauggugaa

SEQ ID NO: 155894 - RNA, 22 nt, Human
aaugagauggaggacucuuaau

SEQ ID NO: 155895 - RNA, 22 nt, Human
aaugaaacuaguagaaucuuug

SEQ ID NO: 155896 - RNA, 22 nt, Human
aaugaaaaucugucaguucaag

SEQ ID NO: 155897 - RNA, 22 nt, Human
aaugaaugaaugaaugauuaug

SEQ ID NO: 155898 - RNA, 22 nt, Human
aaugauuuucugcaaacaguga

SEQ ID NO: 155899 - RNA, 22 nt, Human
aaugaguuuguucuauuauuug

SEQ ID NO: 155900 - RNA, 22 nt, Human
aaucuagagaacuguggggcag

SEQ ID NO: 155901 - RNA, 22 nt, Human
aauccaaacaggauuaccuauc

SEQ ID NO: 155902 - RNA, 22 nt, Human
aauauuuugggacugaggaauu

SEQ ID NO: 155903 - RNA, 22 nt, Human
aaucaaauuucuugugguuguu

SEQ ID NO: 155904 - RNA, 22 nt, Human
aaucuuuuugaaggaggagaga

SEQ ID NO: 155905 - RNA, 22 nt, Human
aaucuguugucaggaauccaca

SEQ ID NO: 155906 - RNA, 22 nt, Human
aaugaauaaauuuuaaagacag

SEQ ID NO: 155907 - RNA, 22 nt, Human
aaucucguuaugaagaugguug

SEQ ID NO: 155908 - RNA, 19 nt, Human
aaguauagucagccuucua

SEQ ID NO: 155909 - RNA, 22 nt, Human
aaguagaaaaccgcacuggacu

SEQ ID NO: 155910 - RNA, 22 nt, Human
aagucauuaucucuucuaaucu

SEQ ID NO: 155911 - RNA, 17 nt, Human
aagugggcaaagugaga

SEQ ID NO: 155912 - RNA, 22 nt, Human
aaguggugagacccugcugaaa

SEQ ID NO: 155913 - RNA, 23 nt, Human
aaguggugacugugcuacugaga

SEQ ID NO: 155914 - RNA, 22 nt, Human
aagugucucugggaggcccgga

SEQ ID NO: 155915 - RNA, 22 nt, Human
aagugugugugcgcaugugcau

SEQ ID NO: 155916 - RNA, 22 nt, Human
aaguuaauugcuucuaguuaau

SEQ ID NO: 155917 - RNA, 22 nt, Human
aaguugaaugucuugcugaaug

SEQ ID NO: 155918 - RNA, 22 nt, Human
aauaagaguuaagaaguauauu

SEQ ID NO: 155919 - RNA, 22 nt, Human
aauacagcacucacaccucccu

SEQ ID NO: 155920 - RNA, 22 nt, Human
aauaauuuuuuugugauuaugu

SEQ ID NO: 155921 - RNA, 22 nt, Human
aauacaaucagauuaugguagu

SEQ ID NO: 155922 - RNA, 21 nt, Human
aaguuucucccuaauuguugc

SEQ ID NO: 155923 - RNA, 22 nt, Human
aaguuuaagguagugaugauga

SEQ ID NO: 155924 - RNA, 22 nt, Human
aauaguggcuuggacuaaauau

SEQ ID NO: 155925 - RNA, 22 nt, Human
aauaucuagccuuuagcagcuu

SEQ ID NO: 155926 - RNA, 22 nt, Human
aauauauaugggugcaugucug

SEQ ID NO: 155927 - RNA, 22 nt, Human
aaggucuucgaaccuuauguua

SEQ ID NO: 155928 - RNA, 22 nt, Human
aaggugcugaggguccuggcuu

SEQ ID NO: 155929 - RNA, 22 nt, Human
aagguuuuguuuucgguuuuuu

SEQ ID NO: 155930 - RNA, 22 nt, Human
aaguaauuugugaaggcauguu

SEQ ID NO: 155931 - RNA, 22 nt, Human
aagguauaaauaacucgggagg

SEQ ID NO: 155932 - RNA, 22 nt, Human
aagggaaacagccaggcccugu

SEQ ID NO: 155933 - RNA, 22 nt, Human
aagggcuucucgccugugugca

SEQ ID NO: 155934 - RNA, 22 nt, Human
aagggaaaagcugaaugagaug

SEQ ID NO: 155935 - RNA, 22 nt, Human
aaggcgaggggcacagcugaga

SEQ ID NO: 155936 - RNA, 22 nt, Human
aaggcaggagaguaggaggugg

SEQ ID NO: 155937 - RNA, 22 nt, Human
aaggccacacuugcuggccagc

SEQ ID NO: 155938 - RNA, 22 nt, Human
aaggcaguuaauuuggcuagaa

SEQ ID NO: 155939 - RNA, 22 nt, Human
aaggcggcggcggcggcugcgg

SEQ ID NO: 155940 - RNA, 22 nt, Human
aaggcgccacagugauugcaaa

SEQ ID NO: 155941 - RNA, 22 nt, Human
aaggcuuugugcugaguugucg

SEQ ID NO: 155942 - RNA, 22 nt, Human
aaggaggaugaauugucugcaa

SEQ ID NO: 155943 - RNA, 22 nt, Human
aagccuuagauuggcgaugucg

SEQ ID NO: 155944 - RNA, 22 nt, Human
aaggaucuuucuuuuuaccauu

SEQ ID NO: 155945 - RNA, 22 nt, Human
aagcauaucaaguuuuaugugc

SEQ ID NO: 155946 - RNA, 22 nt, Human
aagccucaugccagauccaggu

SEQ ID NO: 155947 - RNA, 22 nt, Human
aacgggguugauuauuggaaga

SEQ ID NO: 155948 - RNA, 21 nt, Human
aacuaaugacugcagcaggaa

SEQ ID NO: 155949 - RNA, 22 nt, Human
aacgccgggacucgcagggagc

SEQ ID NO: 155950 - RNA, 22 nt, Human
aacuuaaacaagcucccaaguu

SEQ ID NO: 155951 - RNA, 22 nt, Human
aacucgaugcaauucacuuugu

SEQ ID NO: 155952 - RNA, 22 nt, Human
aacucugagaaacuugcaguug

SEQ ID NO: 155953 - RNA, 23 nt, Human
aacucuggcuagcauagaauaga

SEQ ID NO: 155954 - RNA, 22 nt, Human
aacuuucagaauccuaugcauu

SEQ ID NO: 155955 - RNA, 22 nt, Human
aagaaauagauagaggaauacu

SEQ ID NO: 155956 - RNA, 22 nt, Human
aagaacaacugcuuuaaaagca

SEQ ID NO: 155957 - RNA, 22 nt, Human
aagaaauacagaaauggcagua

SEQ ID NO: 155958 - RNA, 22 nt, Human
aagaaaagguaaccgcuuaucu

SEQ ID NO: 155959 - RNA, 22 nt, Human
aagaaaagaaacauggguaugc

SEQ ID NO: 155960 - RNA, 23 nt, Human
aacugcaagguugcugggaagua

SEQ ID NO: 155961 - RNA, 22 nt, Human
aacuuuuucuuaggggaaagca

SEQ ID NO: 155962 - RNA, 22 nt, Human
aacuuuuaugaaggaaaucaua

SEQ ID NO: 155963 - RNA, 20 nt, Human
aacuuugagugcaugacuuu

SEQ ID NO: 155964 - RNA, 21 nt, Human
aacuuucccaauccagauuug

SEQ ID NO: 155965 - RNA, 22 nt, Human
aagcagaaaaacugagcuccaa

SEQ ID NO: 155966 - RNA, 22 nt, Human
aagcaaaagguuacacuucugg

SEQ ID NO: 155967 - RNA, 22 nt, Human
aagcagcauaugacagcaucca

SEQ ID NO: 155968 - RNA, 22 nt, Human
aagcagaacuguuuuguuuucu

SEQ ID NO: 155969 - RNA, 22 nt, Human
aagccagccaguuccagcagcu

SEQ ID NO: 155970 - RNA, 22 nt, Human
aagcauuuuagauaaagcauca

SEQ ID NO: 155971 - RNA, 22 nt, Human
aagcaacccagugcuuguauag

SEQ ID NO: 155972 - RNA, 22 nt, Human
aagaugcuucaugagaguuggg

SEQ ID NO: 155973 - RNA, 22 nt, Human
aagauuuaccacuuuauucaag

SEQ ID NO: 155974 - RNA, 22 nt, Human
aagagaaagggaaaaugguaaa

SEQ ID NO: 155975 - RNA, 22 nt, Human
aagagaaaaaucuuaaucuagu

SEQ ID NO: 155976 - RNA, 22 nt, Human
aagaguggagcuggaaaguggg

SEQ ID NO: 155977 - RNA, 22 nt, Human
aagaggcagcuugguaggcauc

SEQ ID NO: 155978 - RNA, 22 nt, Human
aagaccacaggaaucaaacagg

SEQ ID NO: 155979 - RNA, 21 nt, Human
aagagcgccgggcagggcuga

SEQ ID NO: 155980 - RNA, 23 nt, Human
aagaaugcuucugaagagcugcc

SEQ ID NO: 155981 - RNA, 22 nt, Human
aagaacaugggugugggcauuc

SEQ ID NO: 155982 - RNA, 22 nt, Human
aagaaggcggaccagaagggag

SEQ ID NO: 155983 - RNA, 22 nt, Human
aagaaguccuugaggcgcaccc

SEQ ID NO: 155984 - RNA, 22 nt, Human
aagaaugaaaugaaagaacuaa

SEQ ID NO: 155985 - RNA, 22 nt, Human
aaccuagaggaagaugggucag

SEQ ID NO: 155986 - RNA, 22 nt, Human
aaccuggguguacauuaugguc

SEQ ID NO: 155987 - RNA, 22 nt, Human
aaccuuauuguguaucaccaua

SEQ ID NO: 155988 - RNA, 22 nt, Human
aaccaauaagaggaugccauuu

SEQ ID NO: 155989 - RNA, 22 nt, Human
aacauuuauguuuugaccaagu

SEQ ID NO: 155990 - RNA, 22 nt, Human
aacauuuccggccuuuuguucu

SEQ ID NO: 155991 - RNA, 22 nt, Human
aacauuguuuaaguuaaauugu

SEQ ID NO: 155992 - RNA, 22 nt, Human
aaccucgggcugcacuuggcac

SEQ ID NO: 155993 - RNA, 22 nt, Human
aacagguucaagccuugcagca

SEQ ID NO: 155994 - RNA, 21 nt, Human
aacagguuuccuaccacuugc

SEQ ID NO: 155995 - RNA, 22 nt, Human
aacaucaaaggaagaaugauau

SEQ ID NO: 155996 - RNA, 22 nt, Human
aaccaggcgagagagcggucag

SEQ ID NO: 155997 - RNA, 22 nt, Human
aacccugaacuuaguucuagga

SEQ ID NO: 155998 - RNA, 22 nt, Human
aaccucuuuaaaagggauauug

SEQ ID NO: 155999 - RNA, 20 nt, Human
aaccuauuguaauauucuaa

SEQ ID NO: 156000 - RNA, 22 nt, Human
aacccuguuguguacaugcaua

SEQ ID NO: 156001 - RNA, 22 nt, Human
aacgcugugcacuggguccagg

SEQ ID NO: 156002 - RNA, 22 nt, Human
aaccaguacuucucuauucagu

SEQ ID NO: 156003 - RNA, 22 nt, Human
aacccguagaucaguucuaggu

SEQ ID NO: 156004 - RNA, 22 nt, Human
aaccuuucucccugcacacugg

SEQ ID NO: 156005 - RNA, 22 nt, Human
aacgucugagaccccuccucuc

SEQ ID NO: 156006 - RNA, 22 nt, Human
aaccucuuugugaaugucauga

SEQ ID NO: 156007 - RNA, 21 nt, Human
aacuauuaauaccauuagcaa

SEQ ID NO: 156008 - RNA, 22 nt, Human
aaagaccuucacuuucuggcug

SEQ ID NO: 156009 - RNA, 20 nt, Human
aaagauacuuuuuguaaugg

SEQ ID NO: 156010 - RNA, 22 nt, Human
aaaugguguucuuuagaugaaa

SEQ ID NO: 156011 - RNA, 22 nt, Human
aaauggauaaucaagauaauca

SEQ ID NO: 156012 - RNA, 22 nt, Human
aaauguuucauucuauuuuuag

SEQ ID NO: 156013 - RNA, 22 nt, Human
aaauguuugguggauaaaagga

SEQ ID NO: 156014 - RNA, 22 nt, Human
aaauucagauggcuuucuuuuc

SEQ ID NO: 156015 - RNA, 22 nt, Human
aaauucagcagguuucaaaagc

SEQ ID NO: 156016 - RNA, 22 nt, Human
aacagaaaucauuuagggcucu

SEQ ID NO: 156017 - RNA, 22 nt, Human
aacaucugagagcccuugugca

SEQ ID NO: 156018 - RNA, 20 nt, Human
aacagcucucgacuuaucuu

SEQ ID NO: 156019 - RNA, 22 nt, Human
aaauugucuuuaaucaggucau

SEQ ID NO: 156020 - RNA, 20 nt, Human
aaauugaacaagccaggcug

SEQ ID NO: 156021 - RNA, 22 nt, Human
aacaaaacauuuuacgaauaua

SEQ ID NO: 156022 - RNA, 21 nt, Human
aacaaaagggaagaacagcug

SEQ ID NO: 156023 - RNA, 22 nt, Human
aacacugaaaugucuuaagauu

SEQ ID NO: 156024 - RNA, 22 nt, Human
aacacguuuauccuaagaacuc

SEQ ID NO: 156025 - RNA, 21 nt, Human
aaauuucauauggccaaccua

SEQ ID NO: 156026 - RNA, 22 nt, Human
aaauucuuccaggaggaaauac

SEQ ID NO: 156027 - RNA, 22 nt, Human
aaauuuuguugaaaaauauuuu

SEQ ID NO: 156028 - RNA, 22 nt, Human
agucuauguuuuuguucuuauu

SEQ ID NO: 156029 - RNA, 22 nt, Human
agucuagagcuuuuaucaggcc

SEQ ID NO: 156030 - RNA, 22 nt, Human
agucugaaccagauggcaaggu

SEQ ID NO: 156031 - RNA, 19 nt, Human
agugaacuccauaucaggu

SEQ ID NO: 156032 - RNA, 22 nt, Human
agucaggacagauuuucugggg

SEQ ID NO: 156033 - RNA, 22 nt, Human
agucauuugucauuuuuuugag

SEQ ID NO: 156034 - RNA, 22 nt, Human
agucggggagcgugaccagaga

SEQ ID NO: 156035 - RNA, 22 nt, Human
agucauuugaggcaugauuaug

SEQ ID NO: 156036 - RNA, 22 nt, Human
agucaacauuugagaugcaaug

SEQ ID NO: 156037 - RNA, 22 nt, Human
agucagaaggugucagaucuug

SEQ ID NO: 156038 - RNA, 21 nt, Human
agucaagcugccugcuuggca

SEQ ID NO: 156039 - RNA, 22 nt, Human
agucaaaaaaccuagaaacacc

SEQ ID NO: 156040 - RNA, 22 nt, Human
aguauuuaguauucuauauuag

SEQ ID NO: 156041 - RNA, 19 nt, Human
aguauuggcagguccugua

SEQ ID NO: 156042 - RNA, 22 nt, Human
aguauuuuaaaauacauuaucc

SEQ ID NO: 156043 - RNA, 22 nt, Human
aguauugguaaguguagcaaau

SEQ ID NO: 156044 - RNA, 22 nt, Human
aguauuuucuuuaguuuguuag

SEQ ID NO: 156045 - RNA, 22 nt, Human
aguauuggauauaaucuaggaa

SEQ ID NO: 156046 - RNA, 22 nt, Human
aguagaauuacagguuuucucu

SEQ ID NO: 156047 - RNA, 22 nt, Human
agguuuuacuuuuuuuggaggu

SEQ ID NO: 156048 - RNA, 22 nt, Human
agguuuuagaagcugaagccaa

SEQ ID NO: 156049 - RNA, 18 nt, Human
aguaaauguuaaauauug

SEQ ID NO: 156050 - RNA, 22 nt, Human
aggugcuugcauacugcuugac

SEQ ID NO: 156051 - RNA, 23 nt, Human
aggucucggaugaagguaaggag

SEQ ID NO: 156052 - RNA, 22 nt, Human
aggugcuuaaagaauguguggu

SEQ ID NO: 156053 - RNA, 22 nt, Human
agguggcguauguguucguguu

SEQ ID NO: 156054 - RNA, 22 nt, Human
aggccagugcagcuggaacaga

SEQ ID NO: 156055 - RNA, 22 nt, Human
aggauggaaguaacuggauaau

SEQ ID NO: 156056 - RNA, 22 nt, Human
aggauggauagcaaggaagccg

SEQ ID NO: 156057 - RNA, 22 nt, Human
aggcugccuaugaaggcagaag

SEQ ID NO: 156058 - RNA, 22 nt, Human
aggcgaagggaccagacgguag

SEQ ID NO: 156059 - RNA, 22 nt, Human
agggaaauaggagaagaaagga

SEQ ID NO: 156060 - RNA, 22 nt, Human
aggcuucauuacagugguucaa

SEQ ID NO: 156061 - RNA, 22 nt, Human
aggcuuaacuacaauuuuugcc

SEQ ID NO: 156062 - RNA, 22 nt, Human
aggcugucucagccugcuugca

SEQ ID NO: 156063 - RNA, 22 nt, Human
aggcugcucucgccggcggugu

SEQ ID NO: 156064 - RNA, 22 nt, Human
aggcgguuggcuuugucugggu

SEQ ID NO: 156065 - RNA, 22 nt, Human
aggcgagcgcggccggugcccc

SEQ ID NO: 156066 - RNA, 22 nt, Human
agggaaauuaaugugagcaaug

SEQ ID NO: 156067 - RNA, 22 nt, Human
aggccugcccuuggggagccuu

SEQ ID NO: 156068 - RNA, 22 nt, Human
aggccugaggaccagauaaaug

SEQ ID NO: 156069 - RNA, 23 nt, Human
aggcugccacucagggugaggcu

SEQ ID NO: 156070 - RNA, 22 nt, Human
aggcugaagcacacucaugcag

SEQ ID NO: 156071 - RNA, 22 nt, Human
aggcugcuggcaggcguggacg

SEQ ID NO: 156072 - RNA, 22 nt, Human
agggcggucccugagacucucc

SEQ ID NO: 156073 - RNA, 22 nt, Human
agggcgugguggugcuggagca

SEQ ID NO: 156074 - RNA, 20 nt, Human
agggauuugguugguauugu

SEQ ID NO: 156075 - RNA, 19 nt, Human
agggagagucccaagagaa

SEQ ID NO: 156076 - RNA, 22 nt, Human
agggcucuuucauuguuaagaa

SEQ ID NO: 156077 - RNA, 22 nt, Human
agggcugcugcuccgggcccag

SEQ ID NO: 156078 - RNA, 22 nt, Human
aggggagaguuaaugugaaugu

SEQ ID NO: 156079 - RNA, 22 nt, Human
agggcuugggggccuugaaggc

SEQ ID NO: 156080 - RNA, 22 nt, Human
aggguuuucauauauuauuagu

SEQ ID NO: 156081 - RNA, 22 nt, Human
aggggauggagcuggaaggcag

SEQ ID NO: 156082 - RNA, 22 nt, Human
aggguuugugaagacuuggcca

SEQ ID NO: 156083 - RNA, 22 nt, Human
aggguuugaauccucuuucuua

SEQ ID NO: 156084 - RNA, 22 nt, Human
aggugcagcugguggagucugg

SEQ ID NO: 156085 - RNA, 22 nt, Human
agguauaguuauuucugcuccc

SEQ ID NO: 156086 - RNA, 22 nt, Human
aggaaauaguuuagucccaaaa

SEQ ID NO: 156087 - RNA, 22 nt, Human
agcuggaaucucggcaaagcgu

SEQ ID NO: 156088 - RNA, 22 nt, Human
agcuggauuaaucacagugacu

SEQ ID NO: 156089 - RNA, 22 nt, Human
aggaaauaggaccagacaaagc

SEQ ID NO: 156090 - RNA, 22 nt, Human
aggaaaggcucugugguuccua

SEQ ID NO: 156091 - RNA, 22 nt, Human
agcuugcccuuguaccagccag

SEQ ID NO: 156092 - RNA, 20 nt, Human
agcuuucaccaguacuucca

SEQ ID NO: 156093 - RNA, 22 nt, Human
agcuuucaagaaauugucacaa

SEQ ID NO: 156094 - RNA, 22 nt, Human
aggaagaagggacagaauuuug

SEQ ID NO: 156095 - RNA, 19 nt, Human
aggaaggggauaaguaaca

SEQ ID NO: 156096 - RNA, 20 nt, Human
aggaaggagaaucugagcaa

SEQ ID NO: 156097 - RNA, 22 nt, Human
aggaaaauggaccagaguuguu

SEQ ID NO: 156098 - RNA, 22 nt, Human
aggaaaguugagcugucuguag

SEQ ID NO: 156099 - RNA, 22 nt, Human
aggacagagggaccagagccca

SEQ ID NO: 156100 - RNA, 22 nt, Human
aggacucagcgucugucucccg

SEQ ID NO: 156101 - RNA, 22 nt, Human
aggaagccuggaguccugccca

SEQ ID NO: 156102 - RNA, 22 nt, Human
aggauaaaugggucauuaggca

SEQ ID NO: 156103 - RNA, 22 nt, Human
aggagaaagaccagccugccga

SEQ ID NO: 156104 - RNA, 22 nt, Human
agcuuugucccaagugcucugg

SEQ ID NO: 156105 - RNA, 22 nt, Human
agcuuugcugcuggagaagggu

SEQ ID NO: 156106 - RNA, 22 nt, Human
aggaaaaagaagaaaagaauca

SEQ ID NO: 156107 - RNA, 22 nt, Human
agcuuugcccaaugaguuaugu

SEQ ID NO: 156108 - RNA, 22 nt, Human
agcugauugucuuuuuaaaagu

SEQ ID NO: 156109 - RNA, 22 nt, Human
aggaaagacgcauuucuguagg

SEQ ID NO: 156110 - RNA, 22 nt, Human
agcugcuggcggauguuggacu

SEQ ID NO: 156111 - RNA, 22 nt, Human
agcugcuuuacuggucggcugg

SEQ ID NO: 156112 - RNA, 22 nt, Human
agcuguaacagguuaauaugga

SEQ ID NO: 156113 - RNA, 22 nt, Human
agcuucccaggagaucuccgcc

SEQ ID NO: 156114 - RNA, 22 nt, Human
agcugaggccccgcagcagggu

SEQ ID NO: 156115 - RNA, 22 nt, Human
agcucuuccuccauucuggcca

SEQ ID NO: 156116 - RNA, 22 nt, Human
agcucuuuggacuuuguuuuau

SEQ ID NO: 156117 - RNA, 22 nt, Human
agcugaccugauugcuuuucag

SEQ ID NO: 156118 - RNA, 19 nt, Human
agcugcugauugguggagg

SEQ ID NO: 156119 - RNA, 22 nt, Human
agcugcugcaaguggugcuaac

SEQ ID NO: 156120 - RNA, 20 nt, Human
agcugaauaguuuugugaaa

SEQ ID NO: 156121 - RNA, 22 nt, Human
agcggugacauccuucugugcu

SEQ ID NO: 156122 - RNA, 22 nt, Human
agcggcgcgucuccgagcugga

SEQ ID NO: 156123 - RNA, 22 nt, Human
agcgcgcggggcugcggcaggg

SEQ ID NO: 156124 - RNA, 19 nt, Human
agcgccucuacugcaugga

SEQ ID NO: 156125 - RNA, 22 nt, Human
agcgagccugugcacuucuaac

SEQ ID NO: 156126 - RNA, 22 nt, Human
agcggcucaggccccgugggcu

SEQ ID NO: 156127 - RNA, 22 nt, Human
agccuuucugcgcacucuuccg

SEQ ID NO: 156128 - RNA, 22 nt, Human
agccuugcaugauuucauucau

SEQ ID NO: 156129 - RNA, 22 nt, Human
agccuguuacuguccugugcca

SEQ ID NO: 156130 - RNA, 18 nt, Human
agcccucuguuacuggaa

SEQ ID NO: 156131 - RNA, 22 nt, Human
agcauuagguguguuucagagg

SEQ ID NO: 156132 - RNA, 22 nt, Human
agcauucccuuugcagugucau

SEQ ID NO: 156133 - RNA, 22 nt, Human
agcauugguggcauuugcagcu

SEQ ID NO: 156134 - RNA, 22 nt, Human
agcccugaccuguccuguucug

SEQ ID NO: 156135 - RNA, 22 nt, Human
agcauuuuaaaacuaguuacca

SEQ ID NO: 156136 - RNA, 19 nt, Human
agcaucuccacagaaaaag

SEQ ID NO: 156137 - RNA, 22 nt, Human
agcauucagacaucugauggau

SEQ ID NO: 156138 - RNA, 22 nt, Human
agcauuugcuguucuagaaagu

SEQ ID NO: 156139 - RNA, 22 nt, Human
agcauuucuacugugucagaaa

SEQ ID NO: 156140 - RNA, 22 nt, Human
agcaugaauugccauuuauuaa

SEQ ID NO: 156141 - RNA, 21 nt, Human
agcaucugaggcaguuuccua

SEQ ID NO: 156142 - RNA, 22 nt, Human
agcagcaggcugggaugagucu

SEQ ID NO: 156143 - RNA, 22 nt, Human
agcaggaaggcuagaagcagga

SEQ ID NO: 156144 - RNA, 22 nt, Human
agcagguucaagggcaaagcug

SEQ ID NO: 156145 - RNA, 22 nt, Human
agcagggagacagugcagcauu

SEQ ID NO: 156146 - RNA, 19 nt, Human
agcaguggagccaugccug

SEQ ID NO: 156147 - RNA, 22 nt, Human
agcaguugcuuuguauauuaaa

SEQ ID NO: 156148 - RNA, 22 nt, Human
accgucagguuagaaugagcac

SEQ ID NO: 156149 - RNA, 22 nt, Human
accgugcccauucauuuacaaa

SEQ ID NO: 156150 - RNA, 22 nt, Human
accuauuuauacaacugcacca

SEQ ID NO: 156151 - RNA, 22 nt, Human
accgauguggaaaauuucauuu

SEQ ID NO: 156152 - RNA, 22 nt, Human
accgagcaggguguuugcgcac

SEQ ID NO: 156153 - RNA, 22 nt, Human
accgaauucuauucccaauacc

SEQ ID NO: 156154 - RNA, 22 nt, Human
acccuuucgagauuucugccuu

SEQ ID NO: 156155 - RNA, 22 nt, Human
accgcuggcacuggggacgggg

SEQ ID NO: 156156 - RNA, 22 nt, Human
accuauuguccagagccaggcc

SEQ ID NO: 156157 - RNA, 22 nt, Human
accugaccagguggcuucccaa

SEQ ID NO: 156158 - RNA, 22 nt, Human
accuccauggcucagguuccaa

SEQ ID NO: 156159 - RNA, 21 nt, Human
accgucaguacuaguauugac

SEQ ID NO: 156160 - RNA, 23 nt, Human
accgccgcugccgccgcccccgc

SEQ ID NO: 156161 - RNA, 22 nt, Human
accugauuuuauggauuuugag

SEQ ID NO: 156162 - RNA, 22 nt, Human
accgauuucaaauggugcuaga

SEQ ID NO: 156163 - RNA, 22 nt, Human
acguuuuagccauguaguuucu

SEQ ID NO: 156164 - RNA, 22 nt, Human
acgguguuucucguucaggguu

SEQ ID NO: 156165 - RNA, 22 nt, Human
acgguuuggggaggaggauccc

SEQ ID NO: 156166 - RNA, 22 nt, Human
accuuguuguagguacaaaaga

SEQ ID NO: 156167 - RNA, 22 nt, Human
accuuuuauuuucaugcuugcu

SEQ ID NO: 156168 - RNA, 22 nt, Human
acgaagggggcauggugagagu

SEQ ID NO: 156169 - RNA, 22 nt, Human
acgauuugguucagugaagaca

SEQ ID NO: 156170 - RNA, 22 nt, Human
acggagggagagagggaggaga

SEQ ID NO: 156171 - RNA, 22 nt, Human
acgcuucacaggugcgcauugu

SEQ ID NO: 156172 - RNA, 22 nt, Human
acggcuugaacgcgccuguggg

SEQ ID NO: 156173 - RNA, 22 nt, Human
accuuaaacagauggcggcugg

SEQ ID NO: 156174 - RNA, 22 nt, Human
accuuagcuguuaaaacuaagu

SEQ ID NO: 156175 - RNA, 22 nt, Human
accuucguuuaguacucauuuu

SEQ ID NO: 156176 - RNA, 20 nt, Human
accuucuuugguagacggaa

SEQ ID NO: 156177 - RNA, 22 nt, Human
acgauacaaucauauaguaccu

SEQ ID NO: 156178 - RNA, 22 nt, Human
accuugggcccagaccggcacg

SEQ ID NO: 156179 - RNA, 22 nt, Human
acauaaacaugcagccugccaa

SEQ ID NO: 156180 - RNA, 22 nt, Human
acauaaauagcacugugaauuu

SEQ ID NO: 156181 - RNA, 22 nt, Human
acauggggaaaaaggccugcuc

SEQ ID NO: 156182 - RNA, 22 nt, Human
acauauaugugcauacaacuau

SEQ ID NO: 156183 - RNA, 22 nt, Human
acaugggggugggacggcagag

SEQ ID NO: 156184 - RNA, 22 nt, Human
aauugccaagaauuagugauac

SEQ ID NO: 156185 - RNA, 22 nt, Human
acaguuagguccuaaaauucug

SEQ ID NO: 156186 - RNA, 22 nt, Human
aauucuaaugaguucuuaucua

SEQ ID NO: 156187 - RNA, 22 nt, Human
aauucugcagucguacuauaau

SEQ ID NO: 156188 - RNA, 22 nt, Human
aauucugaggccauuuauuucc

SEQ ID NO: 156189 - RNA, 22 nt, Human
acauggaauuucagaagagcau

SEQ ID NO: 156190 - RNA, 22 nt, Human
acauuucuccuacuuguuauuu

SEQ ID NO: 156191 - RNA, 22 nt, Human
acauuguuauuccucaggaguu

SEQ ID NO: 156192 - RNA, 22 nt, Human
acauggcaugaauaauguguac

SEQ ID NO: 156193 - RNA, 22 nt, Human
acauuugauauggaguugugua

SEQ ID NO: 156194 - RNA, 22 nt, Human
acauuuuaaaaacaguaccugg

SEQ ID NO: 156195 - RNA, 22 nt, Human
acauugguauuaguguggcuga

SEQ ID NO: 156196 - RNA, 22 nt, Human
acauucucuuuuagaaagcugu

SEQ ID NO: 156197 - RNA, 22 nt, Human
acauuccugaagguaaugagaa

SEQ ID NO: 156198 - RNA, 22 nt, Human
acauccaguaucagaagcauca

SEQ ID NO: 156199 - RNA, 21 nt, Human
acauccaggguccucacugcc

SEQ ID NO: 156200 - RNA, 22 nt, Human
acauuuugggagaaaguuguua

SEQ ID NO: 156201 - RNA, 22 nt, Human
acauuuuaccaucuguggauga

SEQ ID NO: 156202 - RNA, 22 nt, Human
acauuuguuucucuagaguagg

SEQ ID NO: 156203 - RNA, 22 nt, Human
accagccacccugccgcguccg

SEQ ID NO: 156204 - RNA, 22 nt, Human
acauuuccaaagaugccaguca

SEQ ID NO: 156205 - RNA, 22 nt, Human
accaccacugacaccagcucgg

SEQ ID NO: 156206 - RNA, 22 nt, Human
acaugguguggcacuaggggcu

SEQ ID NO: 156207 - RNA, 22 nt, Human
accaauaaaagcaauucacagu

SEQ ID NO: 156208 - RNA, 19 nt, Human
accaaacaguggacggagc

SEQ ID NO: 156209 - RNA, 22 nt, Human
acauuuuguuuauggaaaagau

SEQ ID NO: 156210 - RNA, 22 nt, Human
acauuuuuggguugaugucuga

SEQ ID NO: 156211 - RNA, 22 nt, Human
accaaucugguauauuccagaa

SEQ ID NO: 156212 - RNA, 22 nt, Human
accagguugagacuucggcuuu

SEQ ID NO: 156213 - RNA, 22 nt, Human
acccgguuuucccagcaccucc

SEQ ID NO: 156214 - RNA, 22 nt, Human
agagauugagcucagaagaccu

SEQ ID NO: 156215 - RNA, 22 nt, Human
agagcagauggagcuggaagag

SEQ ID NO: 156216 - RNA, 22 nt, Human
agagcuauuucuuaaaagcugu

SEQ ID NO: 156217 - RNA, 22 nt, Human
agaggcuuuccuaagauugguu

SEQ ID NO: 156218 - RNA, 22 nt, Human
agaggcaggcagcagagaagau

SEQ ID NO: 156219 - RNA, 22 nt, Human
agauaaucacaaucuagacuuu

SEQ ID NO: 156220 - RNA, 19 nt, Human
agagucuccacuccacuug

SEQ ID NO: 156221 - RNA, 22 nt, Human
agagaguagaagggacaguauu

SEQ ID NO: 156222 - RNA, 21 nt, Human
agacugaugggaagacucugu

SEQ ID NO: 156223 - RNA, 22 nt, Human
agagaaccauggcauccaggua

SEQ ID NO: 156224 - RNA, 22 nt, Human
agagagggaugguguccagaga

SEQ ID NO: 156225 - RNA, 22 nt, Human
agagaagaauccccugguggag

SEQ ID NO: 156226 - RNA, 22 nt, Human
agagaauuugggaauauaaauc

SEQ ID NO: 156227 - RNA, 22 nt, Human
agacuguuccgucagacucagu

SEQ ID NO: 156228 - RNA, 22 nt, Human
agagaaauguacuagucuaacu

SEQ ID NO: 156229 - RNA, 22 nt, Human
agagaaacauuaauugaugagg

SEQ ID NO: 156230 - RNA, 22 nt, Human
agacccugauucugcuggcggu

SEQ ID NO: 156231 - RNA, 22 nt, Human
agaccccuggggaggauuauag

SEQ ID NO: 156232 - RNA, 22 nt, Human
agacagaacauaauuaguacug

SEQ ID NO: 156233 - RNA, 22 nt, Human
agaauguaagaaugcaaagauu

SEQ ID NO: 156234 - RNA, 22 nt, Human
agaaugcaagguauuuggaggg

SEQ ID NO: 156235 - RNA, 22 nt, Human
agaccagugaguaggccuuaga

SEQ ID NO: 156236 - RNA, 22 nt, Human
agaaucaggaagacagccuggc

SEQ ID NO: 156237 - RNA, 22 nt, Human
agaaucagagcagaaucuucau

SEQ ID NO: 156238 - RNA, 22 nt, Human
agaaggcagaaaagcuuuacaa

SEQ ID NO: 156239 - RNA, 22 nt, Human
agaaccaauacuacagcaagua

SEQ ID NO: 156240 - RNA, 22 nt, Human
agaacaagaaacccgaaaagug

SEQ ID NO: 156241 - RNA, 22 nt, Human
acuuuuuugccaucccuccagc

SEQ ID NO: 156242 - RNA, 22 nt, Human
acuuuggugcgaagucacuuua

SEQ ID NO: 156243 - RNA, 22 nt, Human
acuuuuaaggggccuugauuua

SEQ ID NO: 156244 - RNA, 21 nt, Human
agaagcggucgaaucgcagac

SEQ ID NO: 156245 - RNA, 22 nt, Human
agaagcauaagggcuuugccag

SEQ ID NO: 156246 - RNA, 22 nt, Human
agaagcaauuggaaaguacagg

SEQ ID NO: 156247 - RNA, 22 nt, Human
agaagcaaagcaaacacauucu

SEQ ID NO: 156248 - RNA, 22 nt, Human
agaaauggccagacuugccccu

SEQ ID NO: 156249 - RNA, 19 nt, Human
agaaacaacauucuggaga

SEQ ID NO: 156250 - RNA, 22 nt, Human
agaagaagacccuaaggaaagg

SEQ ID NO: 156251 - RNA, 22 nt, Human
acuugggaaaugaaaauacaga

SEQ ID NO: 156252 - RNA, 22 nt, Human
acuuugugaauagaacuggaug

SEQ ID NO: 156253 - RNA, 22 nt, Human
acuuuuagccuucccacaacag

SEQ ID NO: 156254 - RNA, 22 nt, Human
acuuuuccuggguagcuccugg

SEQ ID NO: 156255 - RNA, 22 nt, Human
acuguccucgaaguaccugugc

SEQ ID NO: 156256 - RNA, 18 nt, Human
acuguggcucagaguugc

SEQ ID NO: 156257 - RNA, 22 nt, Human
acuggugcucuggccaccgcug

SEQ ID NO: 156258 - RNA, 22 nt, Human
acugguuucaaguuggacugaa

SEQ ID NO: 156259 - RNA, 22 nt, Human
acuggcuuauuguuguggagcu

SEQ ID NO: 156260 - RNA, 22 nt, Human
acuggcauuccuaggggagggg

SEQ ID NO: 156261 - RNA, 22 nt, Human
acuggcuuggaaauggguauuu

SEQ ID NO: 156262 - RNA, 22 nt, Human
acuggggaggucuggauggauc

SEQ ID NO: 156263 - RNA, 22 nt, Human
acuguucacccagcacuagcag

SEQ ID NO: 156264 - RNA, 22 nt, Human
acugcagauccucugagaaacc

SEQ ID NO: 156265 - RNA, 22 nt, Human
acugcauuucauaaauuacaau

SEQ ID NO: 156266 - RNA, 22 nt, Human
acuggauuuugugguguaucuu

SEQ ID NO: 156267 - RNA, 22 nt, Human
acugccuugcaccauggcuuuu

SEQ ID NO: 156268 - RNA, 22 nt, Human
cgcacuggagcuggaacgaguc

SEQ ID NO: 156269 - RNA, 22 nt, Human
cgcagcuucagggccaggaggg

SEQ ID NO: 156270 - RNA, 22 nt, Human
cgccaaccaggcuguccuccca

SEQ ID NO: 156271 - RNA, 22 nt, Human
ccugccuuccagcucuggggag

SEQ ID NO: 156272 - RNA, 22 nt, Human
ccugcugcugaugcuguuucac

SEQ ID NO: 156273 - RNA, 22 nt, Human
ccgcagucugcaaucucccugg

SEQ ID NO: 156274 - RNA, 22 nt, Human
ccgauuuauucugacaguuuau

SEQ ID NO: 156275 - RNA, 22 nt, Human
cgacaagagaaaugcuuuguuu

SEQ ID NO: 156276 - RNA, 19 nt, Human
ccugcugaagugaugcagc

SEQ ID NO: 156277 - RNA, 22 nt, Human
ccugcugagccuggugggcagc

SEQ ID NO: 156278 - RNA, 22 nt, Human
ccugcuggagucuaguuggucu

SEQ ID NO: 156279 - RNA, 22 nt, Human
cggccuuuggcuucuccugugu

SEQ ID NO: 156280 - RNA, 22 nt, Human
cggcggcgaaccgaccugggug

SEQ ID NO: 156281 - RNA, 21 nt, Human
ccugcacuucccuccucaagu

SEQ ID NO: 156282 - RNA, 22 nt, Human
ccugcucccccugcaagccuug

SEQ ID NO: 156283 - RNA, 22 nt, Human
cggcccggccucgcggcgcaug

SEQ ID NO: 156284 - RNA, 22 nt, Human
ccugaagaugguugauccccuu

SEQ ID NO: 156285 - RNA, 20 nt, Human
ccucuuuaguugauggguuu

SEQ ID NO: 156286 - RNA, 22 nt, Human
ccugaaaugaguucugcucacu

SEQ ID NO: 156287 - RNA, 22 nt, Human
cgccugucugcauggccacugg

SEQ ID NO: 156288 - RNA, 22 nt, Human
cgcucggcuuucccuccgccgg

SEQ ID NO: 156289 - RNA, 22 nt, Human
ccugcacuaccuggggcugcug

SEQ ID NO: 156290 - RNA, 22 nt, Human
ccugaguucuuauuuccaguca

SEQ ID NO: 156291 - RNA, 22 nt, Human
cgcucugccugcccuaacuucc

SEQ ID NO: 156292 - RNA, 22 nt, Human
cuaagaaggaggaaaagugcca

SEQ ID NO: 156293 - RNA, 19 nt, Human
cgacauggguaaugggaga

SEQ ID NO: 156294 - RNA, 22 nt, Human
cgaacggcagagagcccguccc

SEQ ID NO: 156295 - RNA, 22 nt, Human
cguuugagggaguuggaacugc

SEQ ID NO: 156296 - RNA, 22 nt, Human
cgugccugguggagagcgaggg

SEQ ID NO: 156297 - RNA, 22 nt, Human
cgguuuuuaaaagucucuucua

SEQ ID NO: 156298 - RNA, 22 nt, Human
cgucagccacagcugccccggg

SEQ ID NO: 156299 - RNA, 22 nt, Human
cggucggagagaaugaccugga

SEQ ID NO: 156300 - RNA, 22 nt, Human
cgguugcaggaugugcgggcag

SEQ ID NO: 156301 - RNA, 19 nt, Human
cgguaugaauguacuaugg

SEQ ID NO: 156302 - RNA, 22 nt, Human
cggggcgggcgugggaggugga

SEQ ID NO: 156303 - RNA, 22 nt, Human
ccuguuuguucauguacuguga

SEQ ID NO: 156304 - RNA, 22 nt, Human
cggggcaaggggggcuggugga

SEQ ID NO: 156305 - RNA, 21 nt, Human
ccugucagcccaacuuuugga

SEQ ID NO: 156306 - RNA, 22 nt, Human
cucgccugacucggaugggcug

SEQ ID NO: 156307 - RNA, 22 nt, Human
cucuauucuaauggauucuggg

SEQ ID NO: 156308 - RNA, 22 nt, Human
cucuauuuuuucaucuuucagg

SEQ ID NO: 156309 - RNA, 22 nt, Human
cgcuuugacuuuagaaggccaa

SEQ ID NO: 156310 - RNA, 22 nt, Human
cggacugaccugcucggggaga

SEQ ID NO: 156311 - RNA, 22 nt, Human
cgcuuuccaggcacauccucuu

SEQ ID NO: 156312 - RNA, 21 nt, Human
cucauuccccgucccggcccc

SEQ ID NO: 156313 - RNA, 22 nt, Human
cuccaucccccugugugucaau

SEQ ID NO: 156314 - RNA, 22 nt, Human
cuauugguaucacacugauuuc

SEQ ID NO: 156315 - RNA, 22 nt, Human
cucaauuuuuauugcuuuuuug

SEQ ID NO: 156316 - RNA, 22 nt, Human
cucagaagaacaaaggcucuac

SEQ ID NO: 156317 - RNA, 22 nt, Human
cgccuggccccgcagcgcuugu

SEQ ID NO: 156318 - RNA, 22 nt, Human
cuauguuuugcuagugaugggu

SEQ ID NO: 156319 - RNA, 22 nt, Human
cuaugaaucaauuucugcaguu

SEQ ID NO: 156320 - RNA, 21 nt, Human
cuauaaaaaugguucuuugcg

SEQ ID NO: 156321 - RNA, 22 nt, Human
cggggcuggcguuagggaggca

SEQ ID NO: 156322 - RNA, 22 nt, Human
cugaaggacacgugaggagcca

SEQ ID NO: 156323 - RNA, 22 nt, Human
cugaaucaaaugacuuagccau

SEQ ID NO: 156324 - RNA, 22 nt, Human
cugaaucugccuccgaggguuu

SEQ ID NO: 156325 - RNA, 23 nt, Human
cugaaauucagaugcuaaagaua

SEQ ID NO: 156326 - RNA, 20 nt, Human
cugaaaggaaagaaauuuuu

SEQ ID NO: 156327 - RNA, 22 nt, Human
cugaaagacgaggggaagucgg

SEQ ID NO: 156328 - RNA, 22 nt, Human
cggggcggcgagcgggccgggc

SEQ ID NO: 156329 - RNA, 22 nt, Human
cgggacaauagcagugcugaug

SEQ ID NO: 156330 - RNA, 22 nt, Human
cgggagcagcucuggggcuggg

SEQ ID NO: 156331 - RNA, 22 nt, Human
cucuuucauucuuagguugccg

SEQ ID NO: 156332 - RNA, 22 nt, Human
cugaaacucaagauaggaggaa

SEQ ID NO: 156333 - RNA, 22 nt, Human
cggcgcugguacaguggaagag

SEQ ID NO: 156334 - RNA, 22 nt, Human
cggcugcagcggagcaggcugg

SEQ ID NO: 156335 - RNA, 22 nt, Human
cugaaacuauggggaggggagc

SEQ ID NO: 156336 - RNA, 22 nt, Human
cucucuaacuagagacaggagu

SEQ ID NO: 156337 - RNA, 22 nt, Human
ccgaaaaacagaaucuuggaac

SEQ ID NO: 156338 - RNA, 22 nt, Human
ccugcaguuuuuccaugauaca

SEQ ID NO: 156339 - RNA, 22 nt, Human
ccugccagaaaagagggaguuc

SEQ ID NO: 156340 - RNA, 22 nt, Human
ccugccugggcucacuugccag

SEQ ID NO: 156341 - RNA, 21 nt, Human
ccugagccuguuuauccagaa

SEQ ID NO: 156342 - RNA, 22 nt, Human
cccuucauguagcugugugucc

SEQ ID NO: 156343 - RNA, 22 nt, Human
ccugauauggugucauuuaaac

SEQ ID NO: 156344 - RNA, 22 nt, Human
ccucuggacuugggacagugag

SEQ ID NO: 156345 - RNA, 22 nt, Human
ccugaccauuugccacaugggu

SEQ ID NO: 156346 - RNA, 22 nt, Human
cccucucaaucuuuaaaauaca

SEQ ID NO: 156347 - RNA, 19 nt, Human
cccucggcuucugguuacu

SEQ ID NO: 156348 - RNA, 22 nt, Human
ccuccacgaggggucuucucuu

SEQ ID NO: 156349 - RNA, 22 nt, Human
cccgccggccacaccggccgcc

SEQ ID NO: 156350 - RNA, 22 nt, Human
ccucuagaauuaucacuuuuaa

SEQ ID NO: 156351 - RNA, 22 nt, Human
cccgcuaaaucaguucugaguc

SEQ ID NO: 156352 - RNA, 22 nt, Human
cccggcgccucguuuccuaguc

SEQ ID NO: 156353 - RNA, 22 nt, Human
ccggguucuuguucuaggaugu

SEQ ID NO: 156354 - RNA, 22 nt, Human
ccggcggguggagcaugcgcgg

SEQ ID NO: 156355 - RNA, 22 nt, Human
cccagccgaaugcucccuuccc

SEQ ID NO: 156356 - RNA, 22 nt, Human
ccggcggaaacauggcggcgcc

SEQ ID NO: 156357 - RNA, 22 nt, Human
cccagagacuuuguccgacgac

SEQ ID NO: 156358 - RNA, 22 nt, Human
ccuacccucaagggccuggggg

SEQ ID NO: 156359 - RNA, 22 nt, Human
ccuauauaaaugacauauagga

SEQ ID NO: 156360 - RNA, 22 nt, Human
ccuauuuucaaaauuguuuauc

SEQ ID NO: 156361 - RNA, 22 nt, Human
ccucaucagaaagcagaaagca

SEQ ID NO: 156362 - RNA, 20 nt, Human
ccucaaccuccuuucucucc

SEQ ID NO: 156363 - RNA, 22 nt, Human
cccaugacucucauucacaguc

SEQ ID NO: 156364 - RNA, 22 nt, Human
cccauauacuuuuucuggucca

SEQ ID NO: 156365 - RNA, 22 nt, Human
ccguccgcuccuccagccgcug

SEQ ID NO: 156366 - RNA, 22 nt, Human
ccaguuuuuccagugcuuucug

SEQ ID NO: 156367 - RNA, 22 nt, Human
ccagucuuggugucuguagcac

SEQ ID NO: 156368 - RNA, 22 nt, Human
cccuggcucaggcagcuuuguu

SEQ ID NO: 156369 - RNA, 22 nt, Human
cccugauaaaucagcaccucag

SEQ ID NO: 156370 - RNA, 21 nt, Human
cccuugccugcacuccucggc

SEQ ID NO: 156371 - RNA, 22 nt, Human
ccauaaaagagaaucuaaauga

SEQ ID NO: 156372 - RNA, 22 nt, Human
ccaucuuugcucuuuuauugca

SEQ ID NO: 156373 - RNA, 22 nt, Human
ccauggaaaagacgggcaggcc

SEQ ID NO: 156374 - RNA, 22 nt, Human
ccgcaccgucugccauacacgc

SEQ ID NO: 156375 - RNA, 22 nt, Human
ccgauuuaugucucugacuuga

SEQ ID NO: 156376 - RNA, 19 nt, Human
ccgagcagauugauguuuc

SEQ ID NO: 156377 - RNA, 22 nt, Human
ccgagcagggcgcccugcccca

SEQ ID NO: 156378 - RNA, 22 nt, Human
ccauuuggccauucaguuguuc

SEQ ID NO: 156379 - RNA, 22 nt, Human
ccagccugccaagcccagcccu

SEQ ID NO: 156380 - RNA, 22 nt, Human
ccaggcagaggggucuggagca

SEQ ID NO: 156381 - RNA, 22 nt, Human
cccgaaaauuguuguacugcag

SEQ ID NO: 156382 - RNA, 22 nt, Human
ccccuuucucccgcgucuggcc

SEQ ID NO: 156383 - RNA, 22 nt, Human
ccagggcggacaaggucuuuga

SEQ ID NO: 156384 - RNA, 22 nt, Human
ccaggcuaggaccgauuucccu

SEQ ID NO: 156385 - RNA, 20 nt, Human
caucaacaccuugucagccu

SEQ ID NO: 156386 - RNA, 22 nt, Human
caugucaagacugaagauccag

SEQ ID NO: 156387 - RNA, 22 nt, Human
cccagcccaucauuccugcaaa

SEQ ID NO: 156388 - RNA, 22 nt, Human
cccagcaccauaacucaggccu

SEQ ID NO: 156389 - RNA, 22 nt, Human
ccagcaagacucgcagugggau

SEQ ID NO: 156390 - RNA, 22 nt, Human
ccccaaauuugugcuuucauag

SEQ ID NO: 156391 - RNA, 22 nt, Human
ccagcaggagacuagcaacaua

SEQ ID NO: 156392 - RNA, 22 nt, Human
ccagcaucagcucuuggcuggc

SEQ ID NO: 156393 - RNA, 22 nt, Human
ccagccacagcuuccagcuccu

SEQ ID NO: 156394 - RNA, 22 nt, Human
cccagcuuugcggacccgggag

SEQ ID NO: 156395 - RNA, 22 nt, Human
cuguuuggaugccauggucaag

SEQ ID NO: 156396 - RNA, 22 nt, Human
cuguuucucugccugcacacau

SEQ ID NO: 156397 - RNA, 22 nt, Human
cuguuucuuugcugucagagag

SEQ ID NO: 156398 - RNA, 20 nt, Human
cuguuugcuaucaugagcug

SEQ ID NO: 156399 - RNA, 22 nt, Human
cuguucagugcauauguauuga

SEQ ID NO: 156400 - RNA, 22 nt, Human
gaacaaaagauagcccaaacau

SEQ ID NO: 156401 - RNA, 22 nt, Human
cuguucuccacuccugacuucu

SEQ ID NO: 156402 - RNA, 22 nt, Human
gaagccaacacgugggagggag

SEQ ID NO: 156403 - RNA, 22 nt, Human
cuucagcgucgucaguguugcu

SEQ ID NO: 156404 - RNA, 20 nt, Human
cuuauuuuggagaacuuuuc

SEQ ID NO: 156405 - RNA, 22 nt, Human
cuguguguauaauguuugauaa

SEQ ID NO: 156406 - RNA, 22 nt, Human
cugugcuguuagcgauuuuuaa

SEQ ID NO: 156407 - RNA, 22 nt, Human
cugugcuguuaagaaauuuagu

SEQ ID NO: 156408 - RNA, 22 nt, Human
cuggauuaaacaguuugauacu

SEQ ID NO: 156409 - RNA, 21 nt, Human
cuuugccuccagcagccgcag

SEQ ID NO: 156410 - RNA, 21 nt, Human
cuuuggcaagggagaagucac

SEQ ID NO: 156411 - RNA, 22 nt, Human
cuuuggauuuuuugcuuuugua

SEQ ID NO: 156412 - RNA, 22 nt, Human
cuuugugcagcagaaaugugug

SEQ ID NO: 156413 - RNA, 20 nt, Human
gaauucugaagauaauuugg

SEQ ID NO: 156414 - RNA, 22 nt, Human
cuuggguacaguaaagggaggu

SEQ ID NO: 156415 - RNA, 22 nt, Human
gaauggaugcuggucaguuugg

SEQ ID NO: 156416 - RNA, 22 nt, Human
gaaugcacacgugugugcaugc

SEQ ID NO: 156417 - RNA, 22 nt, Human
cuugcuuuaucugguuucucau

SEQ ID NO: 156418 - RNA, 22 nt, Human
cuugcuguccgaugggucugua

SEQ ID NO: 156419 - RNA, 22 nt, Human
cuucuucuagaagauggggaag

SEQ ID NO: 156420 - RNA, 22 nt, Human
gaaguaaugugauugcucaggg

SEQ ID NO: 156421 - RNA, 22 nt, Human
gaauacaaauaauaccaaggug

SEQ ID NO: 156422 - RNA, 22 nt, Human
gaaucucuuugucccugaguuu

SEQ ID NO: 156423 - RNA, 22 nt, Human
gaagcggguucacuggauggcu

SEQ ID NO: 156424 - RNA, 22 nt, Human
gaagcucaguugcuuagaucuc

SEQ ID NO: 156425 - RNA, 22 nt, Human
cuucauccguaccacggccaca

SEQ ID NO: 156426 - RNA, 22 nt, Human
cuucauaagauuguugugagga

SEQ ID NO: 156427 - RNA, 22 nt, Human
gaaggcaguaaauggcuguuuu

SEQ ID NO: 156428 - RNA, 22 nt, Human
cuuccauucugauggcuaauua

SEQ ID NO: 156429 - RNA, 22 nt, Human
cuuccguuacugacaaaauguu

SEQ ID NO: 156430 - RNA, 22 nt, Human
cuucuguggcugagaaggcagc

SEQ ID NO: 156431 - RNA, 22 nt, Human
cuucccugucuacaacccugcc

SEQ ID NO: 156432 - RNA, 22 nt, Human
gacuacauuugguauugacgag

SEQ ID NO: 156433 - RNA, 22 nt, Human
cuuuuaccuuaauuucgacaca

SEQ ID NO: 156434 - RNA, 22 nt, Human
cuuuucaaacaggacagguccu

SEQ ID NO: 156435 - RNA, 22 nt, Human
gacauugaauugaauccagauu

SEQ ID NO: 156436 - RNA, 22 nt, Human
cuuuaaaaauguauuuuugugg

SEQ ID NO: 156437 - RNA, 22 nt, Human
cuuguuuggccauaggugcugg

SEQ ID NO: 156438 - RNA, 18 nt, Human
gacaaaaguacagacaga

SEQ ID NO: 156439 - RNA, 22 nt, Human
cuuguuaacaauugguaucuuu

SEQ ID NO: 156440 - RNA, 22 nt, Human
gaaagcauucuggaggggcaga

SEQ ID NO: 156441 - RNA, 22 nt, Human
gaaagcuuggaaacgacuuuau

SEQ ID NO: 156442 - RNA, 22 nt, Human
gaaaccauggcaaccagguccu

SEQ ID NO: 156443 - RNA, 22 nt, Human
gagaauuauacaugagcuauuu

SEQ ID NO: 156444 - RNA, 22 nt, Human
gaaacguuguggaaaauccucu

SEQ ID NO: 156445 - RNA, 22 nt, Human
gaaagagaugucguuugucuuc

SEQ ID NO: 156446 - RNA, 22 nt, Human
gacuucaucagagcguacuguu

SEQ ID NO: 156447 - RNA, 22 nt, Human
gaaaagcucuuuagaagagguu

SEQ ID NO: 156448 - RNA, 22 nt, Human
gaaaaaccacaauugguauuuu

SEQ ID NO: 156449 - RNA, 22 nt, Human
gaaaaagagaaggaguucagua

SEQ ID NO: 156450 - RNA, 22 nt, Human
gacuggucuuuugugauggaug

SEQ ID NO: 156451 - RNA, 22 nt, Human
gaagaggaagaggagccagagc

SEQ ID NO: 156452 - RNA, 22 nt, Human
gagcagucuuugaaaggcacca

SEQ ID NO: 156453 - RNA, 22 nt, Human
gagcagcacagaccaaacagaa

SEQ ID NO: 156454 - RNA, 22 nt, Human
gaacauuucugcagaugucuga

SEQ ID NO: 156455 - RNA, 22 nt, Human
gagcagcucgagaaggaagcag

SEQ ID NO: 156456 - RNA, 22 nt, Human
gagcagccugaggauucugcuc

SEQ ID NO: 156457 - RNA, 22 nt, Human
gagcagcaggccagguugcagg

SEQ ID NO: 156458 - RNA, 22 nt, Human
gaaccauuuaauggagaugcuc

SEQ ID NO: 156459 - RNA, 22 nt, Human
gagauuuccauauuuuguaaca

SEQ ID NO: 156460 - RNA, 22 nt, Human
gagauuaauuaaaaccuuuaug

SEQ ID NO: 156461 - RNA, 20 nt, Human
gaacauaaauaacucuuuac

SEQ ID NO: 156462 - RNA, 22 nt, Human
gaaauagagacaguaagugucu

SEQ ID NO: 156463 - RNA, 22 nt, Human
gagagugggagauuuccagcag

SEQ ID NO: 156464 - RNA, 22 nt, Human
gaaaugggggcaugcguuacau

SEQ ID NO: 156465 - RNA, 22 nt, Human
gaaaugaaacacacaugcagcu

SEQ ID NO: 156466 - RNA, 22 nt, Human
gaaauuucuuuguuaucuuggu

SEQ ID NO: 156467 - RNA, 22 nt, Human
gaaaugucaagauauguuugga

SEQ ID NO: 156468 - RNA, 22 nt, Human
gaaagugaauguaacauguuau

SEQ ID NO: 156469 - RNA, 22 nt, Human
gagagcugucagcguagcaccg

SEQ ID NO: 156470 - RNA, 22 nt, Human
gagaggguugggaggcagcaga

SEQ ID NO: 156471 - RNA, 20 nt, Human
gagaggguuaggauauuugc

SEQ ID NO: 156472 - RNA, 22 nt, Human
cuugccucucccucuagggggu

SEQ ID NO: 156473 - RNA, 22 nt, Human
cuugccuuugaaagcauuucuc

SEQ ID NO: 156474 - RNA, 22 nt, Human
cuugcaaugaaggcacacuuau

SEQ ID NO: 156475 - RNA, 22 nt, Human
cuugcagagcccauggauguca

SEQ ID NO: 156476 - RNA, 22 nt, Human
cugcccgcaugcaggaaugcug

SEQ ID NO: 156477 - RNA, 22 nt, Human
cugcccauggcuccuggcugug

SEQ ID NO: 156478 - RNA, 22 nt, Human
cuugagcugaguuugcagcucu

SEQ ID NO: 156479 - RNA, 22 nt, Human
cugccucucaugccugcuugcu

SEQ ID NO: 156480 - RNA, 22 nt, Human
cuucuguggaauagguuugaca

SEQ ID NO: 156481 - RNA, 22 nt, Human
cuuccugcaacaccuguguugc

SEQ ID NO: 156482 - RNA, 22 nt, Human
cuuccuuucagaggaaggccug

SEQ ID NO: 156483 - RNA, 21 nt, Human
cugcacugugauuuaaaaugu

SEQ ID NO: 156484 - RNA, 22 nt, Human
cuucauuucaggcugaagaaua

SEQ ID NO: 156485 - RNA, 22 nt, Human
cugauuucaaauggugcuagau

SEQ ID NO: 156486 - RNA, 22 nt, Human
cuggaaauggcagaguugcauu

SEQ ID NO: 156487 - RNA, 22 nt, Human
cuuguuaaaagugacccuaaug

SEQ ID NO: 156488 - RNA, 22 nt, Human
cuggagaacucugugcuucacu

SEQ ID NO: 156489 - RNA, 20 nt, Human
cuuguuaaauaugcagguag

SEQ ID NO: 156490 - RNA, 22 nt, Human
cuuguuuuaaacuguuguggcu

SEQ ID NO: 156491 - RNA, 22 nt, Human
cuuuacauuaauuucuacugau

SEQ ID NO: 156492 - RNA, 22 nt, Human
cuuuaagugaaaggggauuaaa

SEQ ID NO: 156493 - RNA, 22 nt, Human
cuuugauuucucugguccaauc

SEQ ID NO: 156494 - RNA, 22 nt, Human
cuuuccugaaaucucuucugca

SEQ ID NO: 156495 - RNA, 22 nt, Human
cuuggcaaaguggcaaaauuag

SEQ ID NO: 156496 - RNA, 22 nt, Human
cuuggcauguucaucugcuugg

SEQ ID NO: 156497 - RNA, 20 nt, Human
cugcuccauggcaucuuuag

SEQ ID NO: 156498 - RNA, 22 nt, Human
cugcggcaccaaccccuucaug

SEQ ID NO: 156499 - RNA, 22 nt, Human
cugcuguuuucugggcuucuua

SEQ ID NO: 156500 - RNA, 22 nt, Human
cugcuguuuuccccaccaucuc

SEQ ID NO: 156501 - RNA, 22 nt, Human
cuugguuugaaacauacucuac

SEQ ID NO: 156502 - RNA, 22 nt, Human
cuuggggcuugcuguuguagcc

SEQ ID NO: 156503 - RNA, 22 nt, Human
cugcuguugagguuccaggcca

SEQ ID NO: 156504 - RNA, 22 nt, Human
cuccagucccuccuugcccagc

SEQ ID NO: 156505 - RNA, 22 nt, Human
cugggaaucuagagggcucauu

SEQ ID NO: 156506 - RNA, 19 nt, Human
cugggacaaugaaagcauc

SEQ ID NO: 156507 - RNA, 22 nt, Human
cuccugauuucuaggccuuauc

SEQ ID NO: 156508 - RNA, 22 nt, Human
cuccuuuacaauugugggaaaa

SEQ ID NO: 156509 - RNA, 22 nt, Human
cuccuuugagcaaaucuuugau

SEQ ID NO: 156510 - RNA, 22 nt, Human
cuccugcuuuuucuucuuccga

SEQ ID NO: 156511 - RNA, 22 nt, Human
cucagaauugucaccucaaaaa

SEQ ID NO: 156512 - RNA, 22 nt, Human
cuggaauugcuugagcuaggaa

SEQ ID NO: 156513 - RNA, 22 nt, Human
cucaaugagcuauuuguuucau

SEQ ID NO: 156514 - RNA, 22 nt, Human
cuggaaaaauggauccugucuu

SEQ ID NO: 156515 - RNA, 22 nt, Human
cugagaggcacaaggcauuucg

SEQ ID NO: 156516 - RNA, 22 nt, Human
cugauaauaaccauuuuaaaau

SEQ ID NO: 156517 - RNA, 22 nt, Human
cugagcggugagggcauacagc

SEQ ID NO: 156518 - RNA, 20 nt, Human
cuuaugcaaaauguuaggga

SEQ ID NO: 156519 - RNA, 22 nt, Human
cugagcuauauauuaugcauag

SEQ ID NO: 156520 - RNA, 22 nt, Human
cugagaaauacccaagucuggu

SEQ ID NO: 156521 - RNA, 22 nt, Human
cuuauaucaacuggaaaaauua

SEQ ID NO: 156522 - RNA, 22 nt, Human
cugacacagccauuguccuugu

SEQ ID NO: 156523 - RNA, 22 nt, Human
cugaauucuuguugucggagca

SEQ ID NO: 156524 - RNA, 22 nt, Human
cugaccugugagcuaugccggc

SEQ ID NO: 156525 - RNA, 22 nt, Human
cugaccgugccgcgguacugcu

SEQ ID NO: 156526 - RNA, 22 nt, Human
cuguguugggauggugcgcgca

SEQ ID NO: 156527 - RNA, 22 nt, Human
cugaaggcuuugaauggaauga

SEQ ID NO: 156528 - RNA, 22 nt, Human
cugugugugcacacguguaugg

SEQ ID NO: 156529 - RNA, 22 nt, Human
cuguguggccuaaguggagaca

SEQ ID NO: 156530 - RNA, 22 nt, Human
cugugaaugguggccacgcguu

SEQ ID NO: 156531 - RNA, 22 nt, Human
cuguggaaugcaguugcgagca

SEQ ID NO: 156532 - RNA, 20 nt, Human
cuggugccuucugcgauuua

SEQ ID NO: 156533 - RNA, 22 nt, Human
cucugcuuguaucacauuugcu

SEQ ID NO: 156534 - RNA, 22 nt, Human
cagcuuuugcagacuucuugcc

SEQ ID NO: 156535 - RNA, 22 nt, Human
caggaaaauaauggugauggga

SEQ ID NO: 156536 - RNA, 22 nt, Human
cagggggacuuguuagguuuua

SEQ ID NO: 156537 - RNA, 22 nt, Human
caggggacacuccugcuugggc

SEQ ID NO: 156538 - RNA, 22 nt, Human
cagggcaucucugaaucuucac
